United States Patent 9,283,287 (MODIFIED POLYNUCLEOTIDES FOR THE PRODUCTION OF NUCLEAR PROTEINS) - sequence listing, part 12

SEQ ID NO: 21381 - DNA, 2016 bp, Artificial Sequence
  Description of Artificial Sequence: Synthetic coding sequence
atggccgccaccttccagctgcccggccaccaggagatgcccctgacctttcaggatgttgccgtgtattttagccaagcggagggccgccagttgggtccacagcaaagggccctatatcgggacgtaatgttggaaaactacggaaacgtggccagtcttggcttccctgtgcctaagcccgaactgatttcccagctcgaacagggcaaggaactttgggtgctcaacctccttggggcagaagagcctgatatcctgaagtcatgccagaaggattccgaggtgggcacaaagaaagaactctcaattctgaatcaaaaattttcagaggaagtgaaaacccccgaattcgtttcgaggcggcttctgcgcgacaatgcacaggccgctgaatttagggaggcctgggggcgcgagggcaagctgaaagagcgcgtgggaaatagcgcagggcagtcgctgaacaagccaaatatacataaacgggtgttgacagaggccaccgtggggcgagaaagatctctgggggagagaacacaagaatgctccgcctttgatagaaacctcaaccttgaccagaatgtggtacgccttcagaggaacaagacaggagagcgcgtcttcaaatgcgacatatgcagcaaaactttcaaatataattctgatctttctagacaccaaagatctcacactggcgaaaagccatacgaatgcgggagatgcggacgggcgttcacccactcctcaaatctggtgctccatcatcatattcacacaggcaacaagcctttcaaatgtgatgaatgcggaaagacattcggtttaaacagccacctgcgcttgcacaggagaatccacactggggagaagccttttggatgcggcgaatgtgggaaagctttttctaggagctcgacactgatccagcaccgcatcatccatacgggcgaaaagccttacaagtgtaatgaatgcggcagggggttttcccagagtccgcagctaacacagcatcaacgcatacatacaggagaaaaaccccatgaatgcagccattgcggcaaggccttctccagatcttcttcactgattcagcacgaacgcatccacactggtgagaagccacataagtgtaatcagtgcggcaaagctttcagccagagtagctccctcttccttcatcaccgcgtccataccggggagaaaccctatgtgtgcaacgagtgcggtcgggcatttgggtttaattcacatctgactgagcacgtcagaatccacacaggggaaaaaccttatgtatgcaatgaatgcgggaaagccttcaggcgttcttccactctggtgcagcatagacgagtgcatactggcgagaaaccgtatcagtgcgtagagtgtggaaaggcattcagccaatcctcccagttgacacttcaccagagagtgcacacgggcgagaagccatacgactgcggggattgcgggaaggcgttctccagacggtccactcttattcagcatcagaaggtgcactccggggaaacaaggaagtgcaggaagcatgggcccgcctttgtgcacggttccagcctaacagccgacgggcagattcccacaggagagaagcatggtcgcgccttcaaccacggagcaaacctcatcctccgttggacagttcataccggggaaaaatccttcgggtgcaacgaatatggcaaggccttttcgccgacgtctaggcccacagaggatcagattatgcacgcaggcgagaaaccgtacaaatgtcaggagtgtggtaatgcattttccggtaaatcaactttgatccagcaccaagtaacccacactggtcagaagccatgtcactgctccgtctatggcaaggcttttagccagagttctcaattgacaccaccccaacaaactcgcgtgggcgagaagcccgcactaaacgatggatcaaagagatactttattcacattaagaaaatttttcaggagcgccacttttag

SEQ ID NO: 21382 - DNA, 1602 bp, Artificial Sequence
  Description of Artificial Sequence: Synthetic coding sequence
atggccaccagcttccggaccgccagctgctggggcctgctgagcttcaaggacatatcgatggagtttacctgggacgaatggcagctcttggactctacacagaagtacctgtatcgcgacgtgatcctagaaaattatcataatctgatctccgttggctaccacgggacaaaaccagacctgatcttcaagctagagcagggcgaagatccttggataattaatgctaagattagtcgtcagagctgtcccgacggatgggaggagtggtaccagaacaatcaggatgaactcgagtctattgagcgatcctacgcgtgctcagtactggggaggctaaacttgtctaagacccacgatagttccagacagagactttacaatacccgagggaaatccttgactcagaatagtgcccccagccgctcgtacctgcggaagaatcccgacaaatttcacggctacgaagagccttatttcctaaaacaccagagggcacattcaatcgagaaaaattgcgtatgttctgaatgcggaaaggcctttcgctgcaagtcccagttgatagttcacttgaggatacataccggtgagcgaccatatgaatgttccaagtgtgagcgggccttcagcgcaaaatccaacctgaacgcgcatcagcgtgtccacactggcgagaagccatatagctgctctgagtgtgaaaaggtcttctcctttagatctcaactcatcgtgcatcaggagatccataccggcgggaaaccatacgggtgttcagagtgtgggaaagcttatagctggaaaagccagcttttgctacaccagagatctcatactggggtgaaaccatacgagtgcagcgagtgcggaaaggcattctccctgaaatcgcccttcgttgtacatcagcgcacccatacaggagtgaaacctcacaaatgtagtgaatgcgggaaggccttcaggagtaagtcatatctgttggtccacatcaggatgcatacaggcgagaagccttaccagtgctccgactgcggaaaggcgtttaacatgaaaacccagctcattgtgcaccagggagtgcacactggtaacaacccctatcagtgcggggagtgtggaaaggctttcggtcggaaggagcaactgaccgcacacctgcgggctcacgctggagagaagccttacggctgcagcgagtgtggtaaagcctttagctctaagagttatctggtcatccataggcgcacacacacaggagagagaccatacgagtgctctctatgcgaacgggccttctgcggcaagagtcagctgatcatccaccagaggacacatagcaccgagaagccttacgagtgtaacgaatgtgaaaaagcgtatcccaggaaggcctcactgcagattcatcaaaaaactcatagcggggagaaaccattcaagtgttcagaatgcgggaaggcattcactcaaaagtcctctctgtccgagcaccaacgtgtgcacaccggggagaaaccttggaaatgctccgagtgcggaaaatctttctgttggaatagcggtctgcggatacaccgcaaaactcataaatag

SEQ ID NO: 21383 - DNA, 939 bp, Artificial Sequence
  Description of Artificial Sequence: Synthetic coding sequence
atgtgcagcccccaggagagcggcatgaccgccctgagcgcccggatgctcaccaggtccagatcactcggaccaggagctgggcctcgagggtgtagagaagagcctggccccctccgccggagggaggctgcagcggaggcacgcaagagccattcaccggtcaagagaccgcgcaaggcccagcgcttaagagtggcctacgagggatctgattcggaaaagggcgagggcgcagagccgcttaaagttcctgtatgggagccgcaggactggcagcagcagctcgtaaatattagagctatgaggaacaagaaagacgcacccgtagatcacctcgggacagagcactgttacgatagcagcgccccacctaaggtgaggcgctatcaggtcctgctgagtttgatgctatccagccagacaaaagaccaggtgacagcaggagcaatgcagagacttcgtgctcgcgggctgactgtggatagcatcctgcagaccgacgatgccaccctggggaaattaatataccccgtgggcttctggcgctcgaaagtgaagtacataaagcaaactagcgccatcctgcagcagcattacgggggtgacatcccagcttccgtggccgagctggttgccttaccaggtgtgggaccgaagatggcccacctcgcaatggcagtcgcctggggtaccgtctccggcattgccgttgatacccatgttcaccggattgcaaacagattgaggtggacgaagaaggcaacaaagagtcccgaagagacaagagcagctctggaagagtggctcccaagagagctctggcacgaaataaatggtcttttagtgggcttcggtcagcagacctgcttacctgtccacccacggtgccatgcatgcctgaatcaagcgctgtgtcccgctgcacaggggctctag

SEQ ID NO: 21384 - DNA, 996 bp, Artificial Sequence
  Description of Artificial Sequence: Synthetic coding sequence
atggagcaggccctggccggcgccagcagcggccgggagctgggccgtccaaaggagctccagcccaagaagctgcacctttgtccgttgtgcggcaaaaacttcagcaataatagcaatctcatccgccaccagagaatccacgccgctgagcgcctgtgcatgggagtggactgcactgagatcttcgggggaaatccaagattcctttccctccaccgcgctcacctaggcgaagaagcacataagtgcctggagtgtggaaagtgcttttcgcagaacactcacctgacacggcatcaaagaacccatacaggagagaagccttatcagtgcaacatttgcggcaagtgtttctcctgtaacagcaacttgcacagacatcagagaactcatactggggagaaaccctacaaatgtccggagtgtggtgagatctttgcccatagtagtaatctgctgcggcaccaacggatccataccggagagaggccgtataaatgccctgaatgcggcaagagctttagccgttccagccatctcgtgatccatgagcggactcacgagagggaaagactgtacccgttcagtgagtgcggtgaagcggtgagcgatagcacaccctttctaaccaatcatggcgcgcataaagccgagaagaaactgttcgagtgtttgacctgcggcaagagtttccgtcaaggtatgcacctgactaggcatcagagaacccacaccggcgaaaaaccttacaagtgtacactgtgcggcgaaaatttctcccaccgtagcaacctgattagacaccaacggatccacacaggagagaaaccctacacctgccatgagtgtggagattccttttcgcatagcagcaaccggataaggcacctgcggacacatacaggggaaagaccttacaagtgtagcgaatgcggtgagtcattcagccggtcctctcgacttatgagtcaccagcgcacacacacagggtag

SEQ ID NO: 21385 - DNA, 1515 bp, Artificial Sequence
  Description of Artificial Sequence: Synthetic coding sequence
atgctggacaactaccggaacctggtgttcctgggcatcgccgtgagcaaacctgacctcatcacatgcctggagcaggggaaagaaccctgcaatatgaaacgacacgctatggtcgccaaaccacccgtagtctgctcacactttgcgcaagatctgtggccgaaacaaggcttgaaggattccttccagaaagtgatactgcggaggtatggtaagtacggacacgagaacctgcagttgcgaaaggggtgcaagtccgctgatgagcataaagtgcacaagcggggatacaacggactgaatcagtgcctcacaacaacacagagcaagatctttcagtgtgataaatacgtgaaagtgctccacaagtttagcaatagtaatattcataaaaaacgccaaacaggaaagaagcctttcaaatgcaaggaatgcgggaaatcttgttgcattttgagccagctaactcaacacaagaagactgcaactcgtgttaatttttacaagtgcaaaacttgtggaaaagcttttaaccagtttagcaacctcaccaaacacaaaatcatccacccagaagttaatccatacaagtgtgaagaatgcgggaaggccttcaatcagagcttaactctcactaagcataagaaaatccataccgaggaaaagccctataaatgcgaagattgtggaaaagtcttctccgtcttttcagttctgactaagcacaagattatccacactggcactaagccctacaactgcgaagagtgcggaaagggttttagcatcttctctacccttacaaaacataagatcattcacaccggcgagaaaccgtacaaatgtaatgagtgtgggaaggcgtttaattggtcgagtaccttgacaaaacacaagagaatacatacaggcgagaagccctataagtgtgaagagtgcggcaaagcctttaatcagagcagtaccctgacgaggcataagatagtccacactggggaaaagccatataaatgtgaggaatgtggaaaggcatttaaacgctctaccactcttaccaagcacaagcgaatttataccaaagagaagccctataagtgtgaagagtgcggtaaggccttttccgtgttctcaacactgacaaagcacaaaatcatccacacaggagctaagccctacaagtgcgaagagtgtgggtcagccttcagggcgttctccaccctgacagagcataaacgggtacatacgggcgagaagccttataagtgtaatgaatgtggtaaggcgtttaattggtccagtacactgacaaaacataagcgcattcataccggggagaagccctataaatgtgaagaatgtggcaaagcatttaatagatcatccaatttgactcgacacaaaaaaattcataccggagagaaaccctataagcctaaacgctgcgatagtgcgtttgacaatacacccaacttctcccgtcacaaaaggaatcatatgggagagaagtcttag

SEQ ID NO: 21386 - DNA, 1710 bp, Artificial Sequence
  Description of Artificial Sequence: Synthetic coding sequence
atgagcagcgccccccggggcccccccagcgtggcccccctgcccgcaggaatagggaggtctacggcgaaaaccccgggcctgcctgggtcattggagatggggcctttaacttttcgagacgtggccatagaattcagcctggaagagtggcaatgcctggatacttcccagcaaaatctgtaccggaacgtgatgctagacaactatagaaatctagtattcctgggaatagctgtctcgaagccagacctcattacttgcttggaacagggcaaagaaccatgtaacatgaagcggcacgcaatggtggctaagccacccgtagtttgctcacacttcgcccaggatttgtggccaaagcaggggctgaaagattcctttcagaaggtgatcctacgccgctacgggaaatatggtcatgagaatttgcagctgcgaaagggatgcaagtctgctgacgaacataaagtccacaagagggggtataatgggttaaatcagtgcctaaccacaactcagagtaagatcttccaatgtgataagtacgtgaaagtgcttcataagttctctaacagcaatatccacaagaaacgacagacgggtaagaagccctttaagtgcaaggagtgcggaaagagttgctgtatcctgagccaactgacacaacataagaaaactgcaactagggtgaacttctataagtgtaaaacctgtggcaaagcattcaatcaattctcaaacttgaccaagcataaaataatccatccggaggtgaatccctacaaatgcgaagagtgtgggaaggcctttaatcagtccctcaccctgacaaaacacaaaaaaattcatacagaggagaagccttacaagtgcgaggactgcggcaaggtgtttagcgtcttcagtgtgttgacaaaacacaaaatcatccacactggaactaaaccatataattgcgaagagtgtggaaagggtttctcaatcttctcaacattaaccaaacataaaataattcacacaggtgaaaaaccgtacaaatgcaatgagtgcggcaaggctttcaattggagctcaacactgacaaaacacaagcggatccacactggggagaagccttataaatgtgaggagtgcgggaaagcatttaaccagtctagcactttgacccggcacaagattgttcacactggcgagaagccttataagtgcgaagagtgcggtaaagcctttaagcgaagtacaactcttaccaagcacaaaaggatttacaccaaggaaaagccttataagtgcgaggaatgtgggaaggccttctccgtcttcagtactttgacaaagcataaaattatccacaccggtgcaaaaccctacaaatgcgaggagtgcggaagtgctttccgtgccttctctactctgacagaacacaagcgcgtacataccggggagaaaccgtacaagtgcaacgaatgcggaaaagcatttaactggagttccaccctaacaaagcacaaaagaatccatacgggcgaaaagccgtataagtgcgaggagtgcggtaaggcatttaatcggtcttcgaaccttacgaggcacaaaaaaatccataccggagagaaaccatacaagccaaaacggtgcgattcagcgtttgataacacgcccaatttctcccggcacaaacgtaaccatatgggggaaaagtcatag

SEQ ID NO: 21387 - DNA, 246 bp, Artificial Sequence
  Description of Artificial Sequence: Synthetic coding sequence
atgggccccctgaccttccgggacgtggccatcgagttcagcctggaggagtggcagtgtctcgacacatcacagcagaatctgtatcggaatgtcatgctggataactatagaaatctggttttcttgggcatagccgtgtccaaacctgacctgatcacatgtctggagcagggcaaagagccctgcaacatgaaaagacatgccatggttgccaagcctcctggctggtcggctgttgcctag

SEQ ID NO: 21388 - DNA, 1131 bp, Artificial Sequence
  Description of Artificial Sequence: Synthetic coding sequence
atgaagggcgaggacgcccagccccaggagatggccagcaccagctttcccagggcttccggcccctcccctgaattcagacaacacggcgatagtgacgggaaacggggtagtccacaaaatctccctattgagcaccatttcgcctgcaaggaatgcggagacaccttcaggctgaaagtgctgctcgtccaacatcagcgggtgcattcagaggaaaaaggttgggaatgtggagactgcggaaaggtatttcgaggggtggcagagttcaacgagcatcgaaagtcacacgtcgcagctgagccccagccagggccatcccgtgcgctggaaaacgccgccgagaagagggaacagatggagagggaagcaaaaccgttcgaatgcgaagagtgcggcaagagatttaagaaaaatgctggactttctcagcatctaagagttcactcaagggaaaagcccttcgactgtgaggagtgcgggcgatctttcaaggtgaacacccatctgttcaggcaccagaagctgcatacctccgaaaaaccctttgcgtgtaaagcctgcagcagggattttcttgacaggcaggaactcttgaagcatcagcgtatgcacactggccaccttccttttgattgcgatgattgcgggaagagcttcagaggggtgaacggactggccgagcaccagaggattcacagtggggctaaaccctacggatgcccccattgtgggaaactgtttcgccgctcatctgagctaaccaagcatcggaggattcatactggagagaagccttacgcctgtgggcaatgcggcaaggcctttcgtcagtcatcctctctgctagagcatgcccggatccattctggcgaaaggccttatgcctgcggtgagtgtgggaaggcgtttagggggcctagcgatcttataaagcacaggcgcatacattcgggcctcaagccctacgagtgcgataaatgcgggaaggcatttcggcgcagcagtggtctttcccgacacaggcgtattcattccggagcgaggcgttgtgagtgtagccagtgcggacgggtattcaagcgacgctcggcccttcagaagcatcagcccacccatcacgagtag

SEQ ID NO: 21389 - DNA, 990 bp, Artificial Sequence
  Description of Artificial Sequence: Synthetic coding sequence
atgatgagccacccctgcgtgagcctgctgggcgtgcccgtgctgaatcctgccctggtcccccacctggctcaaggacaggttcttctggtgtctgacccgtctcctaacacagaccccgccaagtattcagagtctacgagcgctaccagacatcagatgaagggcgaggatgcccaacctcaggagatggcttctaccagtttccctcgtgcctcggggccctcacctgaattccggcagcatggcgattctgacggtaaacggggctccccccagaatctgccaattgagcaccactttgcttgtaaagagtgcggcgacactttccgcctaaaggtactgcttgtacaacaccagagggtgcattctgaggagaagggctgggaatgtggcgactgtggcaaggttttcagaggggtggcagaattcaacgagcatagaaagagccatgtagctgctgagccgcagcctggcccttcaagagcacttgagaacgcggcggaaaagcgcgagcagatggagcgcgaggctaagccatttgagtgcgaggaatgtggtaaaaggtttaagaaaaacgccggtctgtcccaacacttaagagtacactcacgcgagaaaccattcgattgcgaagaatgtggtaggagtttcaaggtcaatactcacctgttcaggcaccagaaattacacacaagcgagaaaccattcgcttgtaaagcatgcagcagggatttccttgacagacaggagctgctgaagcaccagcgcatgcatacaggacacctcccttttgattgcgatgattgtggcaagtcctttcgtggcgttaatgggctggctgaacatcagcgaatccactccggcgccaagccttatggatgcccccactgcggaaagcttttccgacgctcctccgagctgacaaagcaccggcgaatccatacaggcgagaagccatacgcgtgcgggctcccctgggcactttag

SEQ ID NO: 21390 - DNA, 1290 bp, Artificial Sequence
  Description of Artificial Sequence: Synthetic coding sequence
atgatgagccacccctgcgtgagcctgctgggcgtgcccgtgctgaaccccgctctcgtaccgcatctcgcacagggtcaggtcttgctggtgtccgacccttcccccaataccgatcccgcgaaatattctgaaagcacctccgccactcgccaccaaatgaaaggcgaagacgcacagccacaggaaatggcttctacatcatttccccgggccagcgggcccagcccagagttccgccaacatggagacagtgatggcaagagaggaagcccccagaacctgcctattgagcaccactttgcatgcaaggagtgtggtgacacgtttagactcaaggtgttgctggtgcagcatcaaagagttcactcagaggaaaaagggtgggagtgcggagactgcgggaaggtgttccggggagtggcagagttcaatgaacacaggaaatcccacgtggccgctgagccacagcctggtccctcccgcgctctggaaaacgccgcagagaaacgtgagcagatggagagagaggccaagccttttgaatgcgaggagtgcggaaagcggttcaagaagaacgccgggttgtcacagcaccttcgggttcactctagagagaaacctttcgactgtgaggagtgtggtaggagcttcaaggtgaacacacacctgttccgacaccagaaactgcacacatccgagaaaccgttcgcgtgtaaagcatgctctcgcgatttccttgacagacaggagctcttgaagcaccagaggatgcacaccggccatctccccttcgactgcgatgactgcggaaagagctttagaggcgtcaatggactcgctgagcaccagcgcatccactcaggcgccaagccatacggttgcccacactgcggaaaattgttcagaagatcgagtgagctaacaaagcatagacggatccatacaggcgagaagccctacgcttgcggccagtgcgggaaggccttcagacagtcaagttcgctgttggaacatgctagaattcatagtggtgaacgaccgtacgcatgcggggagtgtggcaaagcatttagaggcccgagtgacctcatcaaacaccgacggatccactccggactgaaaccttatgagtgtgataagtgcggaaaagcctttagacgatcttctggcctgagccggcatcggcgcatccattcaggagcccgacgctgcgaatgctcacaatgcgggcgggtgttcaagaggagaagtgcactgcaaaaacaccagccaacccatcacgagtag

SEQ ID NO: 21391 - DNA, 1380 bp, Artificial Sequence
  Description of Artificial Sequence: Synthetic coding sequence
atgcccgaggacctggtgaccttcgacgacgtggcctggtacctgaccacccgggagtggttcaagttagatccagaacaacgggctcttgagtactatggcaatgtgacaagtgtggctggagtacccgtgctaaacccggcactagttccccatcttgcgcagggccaggtgctgcttgtgtctgacccgagcccaaatactgacccagcaaagtatagtgagtctacctctgccacgcggcatcaaatgaaaggcgaagatgcccagccccaggaaatggccagcacttcgtttcccagggcatcaggcccaagtcccgaatttcgtcagcatggcgactctgatgggaagagaggctctccacaaaatctgcctatcgagcatcacttcgcgtgcaaagagtgcggggataccttccggctgaaagtcctgctcgtacaacaccaaagagttcactcagaggagaaaggctgggaatgtggcgactgcgggaaggtgtttcgaggagtagccgagttcaatgagcatagaaaatcacacgtagctgccgagcctcagccgggcccctcccgcgcccttgagaatgccgctgagaagagagagcagatggagcgggaggccaagccattcgagtgtgaggagtgcgggaagaggtttaaaaagaatgcaggcctttcccaacaccttagagtgcactccagggagaagccgtttgactgtgaagagtgtggaaggtcttttaaagtcaacacccatctttttcgccatcaaaagctgcatacctcagaaaagccgtttgcatgtaaggcttgtagcagagacttcctcgacagacaagaactgcttaagcatcagaggatgcatactggacatctccccttcgattgtgatgactgcggaaagtcttttcgcggtgtcaacggtctcgcagaacaccagagaatccacagtggggcaaaaccctatggctgcccgcactgcggaaaactgtttagaaggtcctcagaactgaccaagcatcgaaggatccatactggcgagaagccttacgcatgtggtcagtgtgggaaagcatttcgccagtcgtcttccctgcttgagcatgccaggatccattccggtgagcgtccttatgcctgtggcgagtgtggtaaggccttcagggggccctcagacctgattaaacatcgccgcattcactctggtctgaaaccctacgagtgcgacaaatgcgggaaagcatttcggcgctcctccggactgagcaggcacagaagaattcactccggtgctagacgctgcgaatgttctcaatgcggtcgagtgtttaaaagaagatccgccttgcagaagcatcagcctactcatcacgagtag

SEQ ID NO: 21392 - DNA, 1620 bp, Artificial Sequence
  Description of Artificial Sequence: Synthetic coding sequence
atgggccactgccggctgtgccacggcaagttcagcagccggagcctgcggagcataagtgagcgcgcacccggtgcatctatggagaggccatccgccgaagagagagtgctagtgcgggactttcaaagactgcttggggtggctgtcagacaggatcctactctgagtccctttgtgtgcaaaagttgtcatgctcagttctaccagtgtcactcactgctgaaatcatttctgcaacgggttaatgctagtccagctggcaggaggaaaccttgcgccaaagtgggagcccaaccacctactggtgccgaagagggagcttgcctggttgacttgattacgtccagcccacaatgcctccacggacttgtgggttgggttcatgggcacgctgcctcctgtggggccctgccacacctccagagaacactctctagtgagtactgcggggtgatccaggtcgtctggggttgcgaccagggccatgactatacgatggatacttcaagctcgtgcaaagccttcctcttggattctgctcttgcagtgaagtggccttgggacaaggaaaccgccccgagattaccgcagcatcgcggatggaatccgggcgatgctccccagacctcccaggggaggggcaccggaacccccgtcggagccgaaacgaagaccctgccatctacagatgtcgctcagccaccatccgacagtgacgcggtaggcccaagaagcgggttcccacctcaaccctcgttgcctctgtgtagggcccctgggcagttaggcgaaaaacaactacctagcagcacttctgacgatagagtgaaggatgagttctcagacctgtcagaaggcgatgttcttagtgaggacgaaaacgacaaaaaacaaaatgctcagagtagcgatgagtcattcgagccttatcccgagcgaaaagtgagcgggaagaagtccgagtctaaagaagcgaagaaatctgaagagcctcgtatccgaaagaagcctggccctaaaccaggctggaagaagaaactgcggtgtgagagagaagaacttccgaccatttacaaatgcccctatcagggttgtaccgccgtatacagaggcgcggacggcatgaaaaagcacatcaaagagcaccatgaggaagtgagggaaaggccctgcccacaccccgggtgcaacaaggtgtttatgatcgatagatacctccagcgccacgttaaactgatccatacagaagtgaggaattacatctgtgacgaatgcgggcagacattcaagcagcgaaaacacctgcttgtccaccagatgaggcacagcggggctaagcctttgcagtgtgaggtttgcggctttcagtgcaggcagcgcgcatccctgaagtatcatatgacaaaacacaaggcagagacggagctcgatttcgcatgcgaccagtgcggaagaaggttcgagaaggcacataatcttaacgtgcatatgtcaatggtgcacccgctgacacagacccaggataaggcactccctctggaggctgaacctccaccaggcccgccctccccaagcgtgaccaccgaagggcaagccgtaaagcccgagcccacctag

SEQ ID NO: 21393 - DNA, 1845 bp, Artificial Sequence
  Description of Artificial Sequence: Synthetic coding sequence
atgaagcgggaccggctgggccggttcctgagccccggcagcagccgacagtgtggtgcttcggacggcggcggaggagtgtcccgaactaggggcaggccctctttgtccggcggtcctcgcgtagatggggccacagcacgtagggcgtggggcccagtcggaagctgcggcgatgccggcgaagatggggctgatgaagctggagccggaagggctttagctatgggtcactgtcggctttgccatgggaaatttagctctcgttctttgagaagcatctcagaaagggccccaggtgccagcatggaaaggccatctgcggaggagagggttctggttagggacttccagcgccttttgggtgtcgctgtgcggcaagatccaaccctgtccccattcgtttgtaaatcgtgccatgctcaattttaccaatgtcacagcttgctcaagtcctttttgcagagagtgaatgcttcccccgccggccgccgaaagccatgtgctaaggtgggggctcagcctccaactggcgccgaggagggcgcctgtctagtggacctaatcacaagctcgccccagtgtttgcatggacttgtgggttgggttcacggtcatgccgcctcatgtggcgcattgcctcacctgcagaggacgctgagttcagaatattgcggggtgatccaggtggtgtggggatgcgaccagggccatgattatactatggacacctcatcatcttgcaaagcatttttgctggattccgcactcgcagttaaatggccctgggacaaagagactgctccgaggctgccgcagcacagaggctggaaccccggcgatgctccccaaacgagtcaggggcgagggactggtacccctgtgggggcagaaacgaaaaccctgcccagcaccgatgtcgcccaacctccctcagactccgacgccgtgggacctcgtagcgggttcccgcctcaaccctccctgccattgtgccgcgctcctggacaactgggagagaaacagttgccaagctccacctctgatgacagagttaaagacgaatttagcgacttgtctgaaggtgacgtgctgagcgaggatgagaatgataagaaacagaacgctcagtcgagcgatgagagctttgaaccatacccagagcgcaaagtgtccggcaagaaaagcgagtcaaaggaagctaagaagagcgaggagccccgaattcggaagaaaccggggcctaagccagggtggaagaagaagcttcggtgtgagagagaagaattgccgaccatttacaaatgcccctaccagggctgtacagcagtctacagaggggcagatgggatgaaaaaacatattaaagagcatcacgaggaggttcgggagcgaccctgccctcacccaggctgtaacaaggtctttatgatcgacaggtacctgcagaggcacgtaaaactcatccatacggaggtgagaaattatatctgtgatgaatgtggacaaacatttaagcaacgtaagcatctgctcgttcaccaaatgagacattcaggagcgaagccgttgcagtgcgaggtttgtggtttccagtgtaggcagcgggccagtttgaagtatcacatgactaagcacaaggccgagacagaactggatttcgcctgcgaccagtgcggaagacggttcgaaaaggctcataaccttaacgtgcacatgagcatggttcacccactgacccagacccaggataaagccttgccactagaggccgagccccctcctggcccgccctctccatcagtgacgaccgaggggcaggctgtgaagccagagcccacttag

SEQ ID NO: 21394 - DNA, 1203 bp, Artificial Sequence
  Description of Artificial Sequence: Synthetic coding sequence
atggacatgcggcccgccgccggcccctgccccaccttccggggccactgtccgccttccaccgccgcatcctcacgcagctgcggagccgcgacgagggctaccacaaccccttggatacctgctccggcggccaggcctagctgttggacggtcaggtggcaatccagcggccacggcactaaaagacgcaggcatggatgcccctctacagagggtgggacccttggcatgcccctgcggccccccagagttgaaggtcaaggtccccagttggggcttcggccgcgcccttgtcccgcgcggatgtggccatcactgctgcgcactgcaactagatgggggccaggacgtgctagtcatctgagccaggcatgtccgtttgcggggccacaaggaagctgggtgcgctcttctttccacctgcagccccgcatgattggggatgtgctttcagaagatgagaacgataaaaaacaaaatgcgcagtcctcagatgagtcgtttgagccctatccagaacggaaggtgtctggcaagaaatcggagtctaaagaggctaaaaaatcagaagaacctcggattcgaaaaaagcctggacccaagcctggatggaagaagaaacttcgatgtgagcgagaggaactgccaaccatctataaatgcccataccagggatgcactgctgtttatagaggcgcagatgggatgaagaaacatattaaagaacaccatgaggaagtgagggaacgcccctgcccacacccagggtgcaataaggtttttatgatcgaccgctatctacaacgacacgtcaaacttattcatacagaggtccgcaattatatctgcgatgaatgtggtcaaacctttaagcagcgtaagcatctcttagtgcaccagatgagacattctggagccaaacccctgcagtgcgaggtttgcggcttccagtgcagacaacgcgcatctcttaagtaccacatgaccaaacacaaagccgaaacggagctggactttgcttgcgaccagtgtgggcgacggttcgagaaggcccataacctcaacgttcatatgagcatggtccacccgctgactcagacacaggacaaagctctgcccttagaagcagaacctccacccgggccaccttctccttctgtcacaactgaaggccaagccgtcaagcccgaacctacttag

SEQ ID NO: 21395 - DNA, 1998 bp, Artificial Sequence
  Description of Artificial Sequence: Synthetic coding sequence
atgatgaagaccttcttcagcaccggccagggcaacaccgaggccttccatacaggtacgttgcagaggcaggcaagtcatcatataggggacttttgcttccagaagatcgaaaaggatatacacggcttccagttccagtggaaggaggacgagaccaacgatcacgctgcgccaatgactgaaatcaaggaactaaccggaagcaccgggcagcatgatcagaggcatgccggaaataagcacatcaaggatcagctggggttgtcctttcatagccacctgccagagttgcacatatttcagcctgagggcaagattggcaatcaggtcgaaaaatccataaataatgcgtcctctgtcagcacttcccaacgtatttgctgcaggccaaagacccacatttcaaacaaatacggcaacaactcactgcattcgtcactgcttactcagaaacggaacgtgcatatgcgggaaaagagtttccagtgtatcgagtctggcaaaagtttcaactgtagttcccttctcaaaaaacatcagatcacgcatctcgaagagaaacaatgcaaatgcgatgtgtacggaaaggtgtttaatcaaaaaagatatttggcatgtcacagaaggtcacatatagacgagaaaccttataaatgcaatgagtgcggaaagatcttcggccataacacaagtctgttcctgcacaaagcactgcatactgctgacaaaccctacgagtgcgaggagtgtgataaagtcttttcccgaaagagccaccttgagactcacaagatcatctacaccggcgggaagccgtataagtgtaaagtgtgtgataaggcctttacctgcaactcctacctcgccaaacacacaatcatccataccggggaaaaaccctacaaatgtaatgaatgtgggaaggtcttcaacagattgtctaccctggctcgtcaccggagactccacacaggggaaaagccatacgaatgcgaggaatgtgagaaggtattcagcagaaagtcccatttggagagacacaagaggatccataccggggagaagccatacaaatgcaaggtgtgtgacaaagctttcgcttacaactcctacctcgcaaaacatagcataattcacacgggagagaagccgtataaatgtaatgagtgtgggaaggtttttaatcagcagagtaccttggcaagacaccatcggttgcataccgccgagaaaccatataaatgcgaagagtgtgataaagtttttcggtgcaaaagccacctcgagcggcatcggagaatccataccggcgagaaaccatataaatgtaaagtgtgcgataaggcttttaggtccgattcttgtttgacggaacatcagcgagttcataccggggaaaaaccctacatgtgcaatgagtgtggcaaggtcttcagcacaaaggcaaacctggcgtgtcatcacaaacttcatacagctgagaaaccttacaaatgcgaggaatgcgaaaaagtatttagccgcaaaagtcacatggagagacatcgacggattcacactggagaaaaaccatacaaatgcaaggtgtgtgacaaagcttttcgccgcgattcccatttggcacagcatcagagagtccacacaggtgagaaaccatacaaatgcaacgagtgcggcaaaacgttcagacagacctcatcccttataatccatcggaggctccacaccggtgaaaagccgtacaagtgtaatgagtgtggcaagaccttttcacaaatgtcaagtctggtctatcatcaccgcctccattctggagagaagccatataagtgtaatgaatgcggaaaggtattcaatcagcaggcacatctcgcacagcaccagcgggtacataccggtgaaaaaccttacaaatgcaatgagtgtggtaagactttctctcagatgagtaacctggtgtatcatcataggttgcacagtggagagaagccctag

SEQ ID NO: 21396 - DNA, 1998 bp, Artificial Sequence
  Description of Artificial Sequence: Synthetic coding sequence
atgatgaagaccttcttcagcaccggccagggcaacaccgaggccttccacaccggcactcttcagcggcaggcgagtcaccacatcggagatttttgctttcagaagatcgagaaggacatacacgggttccagtttcagtggaaagaagatgaaacaaatgaccacgctgcacccatgactgagatcaaggaacttaccggcagcacaggacaacacgaccaacggcatgccggcaacaagcatatcaaggatcagttaggcctgagctttcacagccatttgccagagctgcatatatttcagcccgaaggaaaaatcggaaatcaggtggagaagagtataaataacgcgagttctgtgtccaccagccaacggatttgctgccgccccaagactcatatctcaaataagtatggcaacaattcattgcattcaagcctcctgactcagaagagaaatgtccatatgcgggaaaaaagtttccagtgtattgaaagcggcaagagtttcaattgtagctcccttcttaagaaacaccagatcacccacttagaggagaaacagtgcaaatgcgatgtgtacgggaaagtattcaatcagaaaaggtatctggcatgtcataggaggtctcacattgatgaaaagccatataagtgtaatgagtgcggaaagatatttggacataacacaagtctcttcctgcacaaagccctgcacacagctgataaaccctacgagtgtgaggaatgtgacaaagttttttctcggaaatcacatctagagacacacaaaattatttacaccggtggaaaaccctataagtgcaaagtgtgtgataaggctttcacgtgtaattcgtacctggctaagcatactatcattcacaccggggaaaagccatataaatgtaacgagtgcggaaaggtgtttaatagactctctaccctagcaaggcaccggaggctgcacacaggtgaaaagccatatgagtgcgaagagtgcgagaaggttttctctcgcaagagccatttggaacgccacaaaagaatccatacgggggagaagccatataaatgtaaagtgtgtgacaaggccttcgcttacaattcctacctggcgaaacattcaatcattcacactggcgaaaagccctacaaatgcaatgagtgcggcaaagtcttcaaccagcagtctacacttgcacggcatcaccggctgcacacagccgaaaagccctacaaatgcgaagaatgtgataaagtttttagatgcaagtcacacctcgagaggcataggagaatccacacgggggagaaaccttataagtgcaaggtatgcgataaggcgttccggtccgacagttgtctaaccgagcatcagagggtgcatactggcgagaaaccgtacatgtgcaatgaatgtggaaaggtctttagcaccaaggcaaatctcgcctgccatcacaaactgcacaccgcagagaagccatacaagtgtgaggagtgtgagaaagtcttttctcgaaaaagtcatatggagcgccaccgtagaatacacacaggggaaaagccctacaaatgcaaggtttgcgacaaggcttttcgtagagacagccacctcgctcagcatcagagggttcacacaggggagaagccctacaaatgcaacgaatgcggaaaaacttttcggcagacatcttctttgatcatccaccggagattacacaccggagagaaaccttacaaatgtaatgagtgtggcaaaaccttttcccagatgagttctctggtgtaccaccacagactgcactccggtgagaaaccttacaagtgcaacgagtgcgggaaggttttcaaccagcaggctcatcttgctcaacaccagcgcgtccatacaggcgagaaaccttataagtgtaacgaatgcgggaagactttctcacaaatgtcaaacctggtctatcaccataggctgcactcaggcgaaaaaccctag

SEQ ID NO: 21397 - DNA, 2157 bp, Artificial Sequence
  Description of Artificial Sequence: Synthetic coding sequence
atggccctgccccagggcctgctgaccttccgggacgtggccatcgagttctctcaggaggaatggaagtgtctggaccccgcacagagaacactgtatcgggacgtaatgttggaaaattacaggaacctagtctccctggatatctctagtaagtgcatgatgaagacattttttagtactggccaaggaaacactgaagcatttcacacggggacgctccagcggcaggctagtcatcatatcggggacttttgcttccagaaaatcgagaaggacatccatggctttcagtttcagtggaaggaggacgagaccaacgaccatgcagccccaatgaccgagatcaaggagctaacgggctcgacaggtcagcacgaccagagacatgccggtaataaacatatcaaagatcaactcggcttatcctttcacagccacctccctgaactccatattttccagcccgaggggaagatcggtaatcaggtcgagaaaagtataaacaatgccagcagcgtgagcacctctcagcggatctgttgtcggccaaaaacgcacattagtaataagtatggcaacaacagccttcattcgtccctgctcacgcagaaacgaaatgttcatatgcgggagaaaagttttcagtgcattgagtcaggaaagagctttaactgtagcagtcttctgaagaaacaccaaattactcacctggaggagaagcagtgtaagtgtgacgtgtacggcaaagtgtttaaccagaaaaggtacctggcgtgccaccgtagatcacatattgatgaaaagccgtacaagtgcaacgaatgcggtaaaattttcggccacaacactagcctgttcctgcataaagctttgcatactgcagataaaccgtatgagtgtgaagaatgcgacaaagtcttctctcgaaaaagccatctggaaacccacaaaatcatctataccggaggcaaaccttacaaatgtaaagtgtgcgacaaggcctttacctgcaactcatacttagcgaagcatactataattcatactggggaaaagccttataaatgtaacgagtgtggtaaagtgttcaatcggctgtccaccctcgctagacaccgcagactgcacaccggagagaagccgtacgagtgtgaagagtgtgaaaaagtgttctcgagaaaatcacacctcgaacgccataaacgcattcatacaggggagaagccttacaagtgcaaagtgtgcgacaaagctttcgcatacaattcttatttggccaaacatagtatcatccacaccggagagaagccctacaagtgcaatgaatgcggcaaggtctttaaccagcagtctactttagcgaggcaccatcgcctccacaccgcggagaaaccgtacaagtgtgaagagtgtgacaaggtgttcagatgcaagtcacaccttgaacgtcatcgaagaatccatacaggtgagaaaccctacaagtgcaaggtctgcgacaaggccttccgatctgacagctgtcttacggagcatcaacgggtgcataccggcgagaagccctatatgtgcaacgagtgcggcaaagttttcagcaccaaggccaaccttgcttgtcaccacaagctgcatacagcagaaaagccctacaagtgcgaggagtgcgagaaagttttctctcgcaaaagccatatggagagacaccggcgcattcacaccggagagaaaccttacaagtgcaaggtgtgtgacaaagccttccggagagatagccatcttgcacaacaccagcgtgtccacaccggcgaaaagccgtacaagtgcaacgagtgcggaaaaacattccgccaaacctctagcctgataatacatcggagattgcacacaggagaaaagccctataagtgtaatgagtgtgggaaaacctttagccagatgagcagcttggtgtatcaccataggcttcattcaggagaaaagccttacaaatgtaatgaatgcggtaaggtattcaaccagcaagcacatttagcccaacaccagcgcgtgcacactggagaaaagccctacaagtgcaacgagtgcggtaagaccttctcgcaaatgtccaatcttgtctatcatcacagactccactccggcgaaaaaccttag

SEQ ID NO: 21398 - DNA, 2607 bp, Artificial Sequence
  Description of Artificial Sequence: Synthetic coding sequence
atgcggggcgccgccagcgccagcgtgcgggagcccacccccctgcctggtagaggtgcaccaagaacaaaacctcgagcaggcagaggacccacagtgggcacgccggccactcttgctcttcctgcaagagggcgcccccgttcccgcaacggcctggcttccaaaggtcagaggggcgcagcccccaccggcccaggtcatagagccttgccctcaagagataccgccttgccacaggagcggaacaaaaagctggaggccgtcggcactggcattgaacctaaagcaatgagccagggacttgttacatttggcgatgttgccgtggacttctcacaagaggagtgggagtggcttaaccccattcagagaaatctctaccgaaaggtgatgctggagaactatcgtaatctggcctccttgggcctgtgtgtctccaagcccgatgtcatttctagcctagagcagggaaaagaaccatggactgttaaacgcaaaatgacacgcgcatggtgtcctgatctgaaagccgtgtggaagataaaagagctgcctctgaaaaaggacttctgtgaaggcaagctttcgcaggccgtcatcaccgagcgcttgactagttataacctggagtactccttgctgggcgaacactgggactatgacgcgctctttgagactcagcctgggctcgtcacaatcaagaacttagcagtggattttcggcagcagttacatccagcacagaaaaatttctgcaagaacggaatatgggaaaacaacagtgatctgggctcagctggtcactgtgtggccaaaccagatttggtgagtctcctcgagcaagagaaagagccttggatggtgaagcgggagctcacagggagtctgttttctggccagcgaagtgttcacgaaacgcaggagctgtttcctaaacaggattcctatgccgaaggggtgacagatcgaaccagcaacaccaagctagactgttcttccttccgagagaactgggattctgattatgtattcggtcgcaaacttgccgtggggcaagaaactcagtttcgacaggagccgatcacccacaacaagactttgagcaaggaacgcgagcggacatataacaaatccggtcggtggttctatctggatgacagtgaagagaaggtacacaatagggatagtattaaaaatttccagaaaagttccgtcgtaattaagcagaccggcatttacgcaggcaaaaaactgttcaagtgcaacgagtgtaagaaaacattcactcagtcctcttctctaacggttcaccagagaatccacacaggagagaagccctataagtgtaacgagtgcggcaaggcattttctgatggatcctcgttcgctcgccatcaaaggtgccacaccggcaaaaagccatacgaatgtatcgaatgcgggaaggccttcattcagaacacctcccttatcaggcactggcgctattatcacactggggagaaaccttttgattgcatcgattgtggcaaggccttctcagaccatataggactgaaccaacatcgaagaatccacacaggcgagaaaccatataaatgtgatgtctgtcataagtcctttcggtacggaagttcactaactgtgcaccagaggattcatactggcgaaaaaccctatgagtgcgacgtgtgcaggaaagcgttctcccaccacgcgtcccttacgcagcaccaaagggtgcattcaggcgaaaagccctttaaatgtaaagagtgcggcaaggccttccgtcagaacatccacctggctagtcacctgaggatccacactggggaaaagccctttgaatgcgcagaatgcggaaagtcgttttccatctcctctcagcttgctacacatcaacggatccacacaggtgagaagccatatgagtgcaaagtctgcagcaaggctttcacacagaaagctcatctagcacaacaccagaagacccacacaggcgagaaaccttacgaatgtaaggagtgcgggaaggcattctcccagaccacccatctcatccagcatcagcgagtgcacacaggcgagaagccatacaagtgtatggagtgtggtaaggcctttggagacaacagctcttgcactcagcaccagagattacataccggacagaggccctacgagtgtatcgaatgtggaaaggccttcaaaaccaagagctccctgatttgccaccgccgctctcacactggggaaaagccctatgagtgcagcgtgtgcggtaaggcgttctcacaccgtcagtcactgtcagttcatcagcggatccatagtgggaagaagccgtatgagtgtaaggagtgcaggaagacatttatccagatcggacatcttaaccagcacaagagggtgcacactggcgagaggtcttataattataagaagagtcgtaaggtttttcggcagacagcacacttggcacatcatcagcgcattcacacaggcgaaagtagcacttgcccttccttgccgtcaacctcgaatcccgtggacctcttcccgaaattcctgtggaacccgtccagtctaccctcgccctag

SEQ ID NO: 21399 - DNA, 1629 bp, Artificial Sequence
  Description of Artificial Sequence: Synthetic coding sequence
atgggcgacatcttcctgtgcaagaaggtggagagccccaagaagaaccttagggagagcaagcagcgggaggaggatgacgaagaccctgatcttatctacgtcggcgttgagcacgtgcacagggacgccgaggtgctcttcgtggggatgatttctaacagtaagcctgtggtgagcaacattctgaatcgcgtcactcccggttccaaatcacggagaaaaaagggccactttagacagtacccagctcacgtgagtcagcctgcgaaccatgtcacaagcatggccaaagccattatgccggtttcgttgtctgaggggcgtagtactgattctccggtcactatgaagtcctcttctgagccaggatacaaaatgtcttcaccgcaagttgtgtcacctaactattcagatagtttgccccccgggacccagtgcttggtgggagcaatggtatcagggggcggaaggaacgagagcagcccagactcaaaacgccttagcacttcagatatcaactcaagagacagtaaacgcgtgaagctgcgtgatggtattcccggtgttccttcactggccgtcgtccccagtgatatgtcatccacaatttccactaacacaccctcgcaaggaatttgcaacagctccaaccatgtgcagaacggtgtgacattcccgtggcctgacgctaatggcaaggcacatttcaacttaaccgaccccgagagggctaatgaaagtggcctcgctatgacagatatcagcagcctggcttcccagaacaagaccttcgaccccaaaaaagagaacccgattgtgctcttatccaacttttactacggacagcacaagggggacggacagcctgaacagaaaactcacactacgttcaagtgcctcagctgcgtgaaggttctcaaaaacatcaaatttatgaatcacatgaagcaccatcttgagttcgaaaagcaacgtaacgactcctgggaagaccatacaacttgtcaacattgccataggcagttcccaacaccttttcagctccaatgccatatagattccgttcacatcgctatggggccttcagctgtatgtaaaatctgtgaactcagcttcgaaaccgaccaggtgttgctgcaacatatgaaggatcaccacaagccaggggaaatgccgtatgtttgccaggtgtgccactaccgttcatcagtcttcgccgacgtggagacacatttcagaacctgtcatgaaaataccaaaaacttgttgtgtctattttgcctgaaactttttaagaccgctatcccgtatatgaaccactgttggcgtcattcgaggcgccgcgttctgcagtgttccaagtgcagattgcagtttctcactttaaaggaagagatcgagcacaagactaaagatcaccaaacatttaaaaagcctgagcaactacaggggttccctagagaaaccaaagtgatcatccagaccagtgtgcagcctggctcatccggtatggcctctgtcattgtgtctaacaccgatcctcagagctcgcccgtaaaaaccaagaagaaaaccgctatgaacactagagatagcaggcttccctgcagtaaagactcctcttag

SEQ ID NO: 21400 - DNA, 1632 bp, Artificial Sequence
  Description of Artificial Sequence: Synthetic coding sequence
atggagcagagctgcgaggaggagaaggagcccgagccccagaagaacattcaggaaacaaaacaggtcgacgatgaggatgctgagctgatattcgtgggggtggagcacgttaacgaggatgcagaactgattttcgtgggcgtgactagcaactctaagccagtcgtgtccaatatcctaaaccgtgtgaccccagggtcctggtctcgtcgcaaaaagtacgaccacctaagaaaagacacggcccgcaagctccagcctaagagccacgagactgtcacctcagaggccgtgactgttctccccgcctcccagctggaatcaaggtccacagacagtccgataataattgaacctttatccaagcctgactacagaaactcttcccctcaggtcgtcccaaacaactcatcagaactccccagccctttgattactttcacagatagcttacaccacccggtgagcacagcactttccgtgggcggaatcaatgaaagtccccgagtctcaaaacaactgtctactttcgaggttaactctatcaatccaaagagagcaaagctgcgggatgggatcatagagggtaatagctccgcatccttcccttccgatacgttccacaccatgaatacccaacaatccacaccctccaacaacgtgcatactagccttagtcacgtgcaaaatggagccccgttcccggcagcctttcctaaggacaatattcatttcaaacctattaatactaatttagatagggaaaatgaattagctaagactgacattctctcccttacatcccagaacaagacattcgacccgaagaaggaaaatcccatcgtgctgctgtctgatttctactatggccagcacaaaggcgaggggcagcccgagcaaaagactcatacgacattcaagtgcctgagttgtgtaaaggtgcttaagaacgtgaaattcatgaatcacgtgaaacaccatctggaattcgagaagcagaggaatgactcatgggaaaaccatactacctgccagcattgtcacaggcagttccccactcctttccagctacagtgtcacatcgagaacgtacatacggctcaagagccatcgaccgtttgtaaaatctgtgagttgtccttcgagaccgatcaagtcttgctccagcatatgaaagaccaccacaagcccggagaaatgccatacgtctgtcaggtgtgtcactaccgctcttctgtgtttgctgacgtggagacccattttcggacatgccacgagaataccaaaaatttgctctgccctttttgtctcaaaatctttaagactgctacgccgtacatgtgtcactatagaggacactgggggaagagcgcacatcagtgctcaaagtgcaggctgcaattcctcacttttaaagagaagatggaacataagacccagtgccatcaaatgttcaagaagcccaaacagctggaggggctcccaccggagactaaagttactattcaggtgagtctcgagcccctccagccgggatctgtggatgttgcctctatcacggtgagcacatctgatagtgaaccctcgcttcctcggtcaaagagtaagatctctaaaaagtctcattag

SEQ ID NO: 21401 - DNA, 1632 bp, Artificial Sequence
  Description of Artificial Sequence: Synthetic coding sequence
atggagcagagctgcgaggaggagaaggagcccgagccccagaagaacatacaggagaccaaacaggtcgatgacgaggatgcagaattaatcttcgtgggggtcgagcacgtcaacgaagacgccgagcttattttcgtcggagtgacctccaacagcaagcctgtcgtctcaaatatcctgaatcgggtcactccaggatcatggtctaggcggaaaaaatacgaccatctgcgtaaagatacagctcgcaaactccagccaaaaagccacgagacagtcaccagcgaggcggtgacagtgctacctgccagccagcttgaatcccgaagcaccgacagtccaatcatcatcgagcctctgtccaagccagattaccggaactcaagtccacaggtggtgccaaataactcaagtgagctcccgagcccattgatcacattcacggatagcctccatcacccggtgagcaccgcgctgagcgtggggggcatcaacgaaagtccacgggtctcgaaacagttgagcacttttgaggtgaactcaattaacccgaaacgcgccaaattacgtgacggaatcatcgagggtaactcttctgcatcattcccttctgataccttccacactatgaatacgcagcaatctactccaagcaacaatgtgcacacctcactatcacatgtgcaaaacggcgccccgttccctgctgcgtttcctaaagataatattcactttaaacccatcaacacgaacctcgaccgtgaaaatgaactggccaaaactgacatcttatcgctaacgagtcaaaataagacattcgatcccaaaaaggaaaatccgattgttctgcttagcgatttctattacggtcagcacaaaggggagggccagccagagcagaaaacccacactacctttaagtgcttatcctgcgtcaaggtcctcaagaatgtgaagtttatgaatcatgttaaacaccacctcgaattcgaaaagcagcgcaatgactcctgggagaaccacaccacgtgccagcattgccacagacagtttcctaccccgttccagttgcaatgccacattgagaacgtccatacggcacaggaaccctctactgtttgcaaaatttgtgaactaagcttcgaaaccgaccaggtactgctgcagcatatgaaggatcaccataagcccggtgagatgccttacgtgtgccaggtttgccactacagatcttcagtgtttgcggatgtggagacacactttcgtacttgccacgagaacaccaaaaatctgctgtgccctttctgcctgaagattttcaagacagcgactccctatatgtgtcattaccggggacactggggcaagtctgcccatcagtgttccaaatgtagactgcagtttctaacattcaaggagaagatggagcataagacccaatgtcatcaaatgtttaaaaaaccaaaacagctcgagggactgccgcctgaaactaaggtaactatacaggtgtccctggagccccttcaacccggttctgtcgatgtggcctccatcaccgtgagcacctcagatagtgaaccttctctgccccgctcaaagagcaaaatcagcaagaagtcccattag

SEQ ID NO: 21402 - DNA, 1833 bp, Artificial Sequence
  Description of Artificial Sequence: Synthetic coding sequence
atggacgacgacaagcccttccagcccaagaacatcagcaagatggctgaactgtttatggaatgcgaagaggaggagctggagccatggcaaaagaaagtcgaagagactcaagacgaagatgatgatgagttgattttcgtcggtgagatttctagtagcaagccagccatcagcaacatccttaataggggacacagctcgagctcaagcaaggggattaaaagcgagcctcatagccctggaatacctgagattttccgcaccgctagtcagaggtgcagggacccccctagtaacccagtggctgcaagcccccggttccacctggtcagcaaaagcagccagagtagcgtcaccgtggaaaacgcctccaaacccgacttcacaaaaaattcccaagtcgggtccgacaattcttctatcttactgtttgattcgactcaggaaagtctgccaccctcacaggacatcccggccatattcagagaaggcatgaagaacacctcttacgtgcttaagcatccctccacctccaaggtgaactccgtgactcctaaaaagccaaaaacttctgaggatgttccccaaatcaaccccagcacttcgctccccctcattgggtccccacctgttacatcatctcaggtgatgctgtcaaagggcactaatacatcctcaccatacgatgcaggggcagactatctgcgggcctgtccaaagtgcaacgtgcagtttaaccttcttgatcccttaaagtatcatatgaagcattgctgcccggatatgatcaccaagtttctgggtgtgattgtcaagtcagagcgcccgtgcgatgaggataaaaccgatagtgagacgggaaagctgattatgcttgtgaatgaattctattacggaagacatgagggggtcacagaaaaggagcctaaaacatatactacttttaagtgcttctcctgctctaaagtccttaaaaataacatacgctttatgaaccacatgaagcaccacttggagttggagaaacagaacaatgagtcatgggaaaaccacacaacctgccagcactgttacagacagtatcctacaccattccagctgcaatgccacatcgagtctacccatacaccgcacgagtttagcacgatttgtaagatttgcgaactgagcttcgagacagaacatatcttgctacagcacatgaaagacactcacaagccgggtgaaatgccctatgtgtgccagaagaagggagtgcatcgatgcccaaaatgccggttgcagtttctgacatctaaagaaaaagccgagcataaagcccagcaccgcacttttattaagcctaaggagctcgagggcctgccgccaggcgcgaaggtgaccattagggcctcgttgggccctcttcagtctaagcttcctacagcacctttcggctgtgctcccgggacgtccttcctccaggtgacacctcccacttcccagaacactactgcaaggaacccgaggaagtcaaacgcgagtcgtagcaaaacttccaagctacacgccactacatcaactgcatccaaggtaaatactagcaaaccccggggaagaatcgcaaagtccaaggccaagccatcatataagcaaaagcgacaaaggaaccgcaaaaacaaaatgagcttggccctgaaaaatattcggtgtagaaggggcattcataaatgcattgaatgtcatagtaagataaaagactttgcatctcactttagcatatatatacattgttccttctgtaaatacaatactaattgtaacaaggcatttgtgaaccacatgatgtag

SEQ ID NO: 21403 - DNA, 2214 bp, Artificial Sequence
  Description of Artificial Sequence: Synthetic coding sequence
atggacgacgacaagcccttccagcccaagaacatcagcaagatggcagaactatttatggagtgtgaagaagaagaattggagccatggcaaaaaaaggtcgaggagactcaggacgaagatgatgacgagctcatctttgtgggagagattagctcaagtaagcctgctatttcaaatatcttaaacagaggtcattcgagctcgtcttctaagggcataaagtcagagccccactcgcccggtatcccggaaatcttccgaacagcatcccagagatgcagagatcccccctcgaacccggtagcggcctcaccgcgctttcacctagttagtaaaagcagccaatcttcagtgactgtggaaaatgcatcaaagccggacttcaccaagaacagtcaggtcggatccgacaacagctctatccttctcttcgactccactcaagagagtttgcccccgtcccaggacataccagctatttttcgggagggaatgaagaatactagttatgttctaaagcaccccagtacatctaaggttaattcagtgacccccaagaagccaaagactagtgaggatgtgccccagattaacccatcaacgagtctgccgctaatcggctcacccccagttactagttcacaagtgatgctcagcaaaggtacaaatacttcgtctccctatgacgcgggggcagactacctcagagcctgcccaaagtgcaatgtccaatttaacctgctcgaccctctgaagtaccacatgaagcattgttgccccgacatgataacaaaatttttaggagtcatcgtcaagtctgagagaccctgcgatgaggacaaaaccgacagcgagactgggaaactgattatgctcgtcaatgaattctattacgggcgtcacgaaggggttaccgagaaagagcccaagacctataccacctttaagtgtttctcttgctcaaaggttttgaagaataacatccgtttcatgaaccatatgaagcaccatctcgagctggaaaaacagaataacgagtcctgggaaaaccacactacatgccagcattgttaccgacagtaccccactccttttcagctgcaatgccatattgaatccacccacacgccccatgagttttccaccatctgtaaaatttgtgagctgtctttcgaaactgagcatattctcttgcagcacatgaaagatacacataagcctggagagatgccctatgtgtgccaggtttgtcaattccggagcagcactttttctgatgtggaagctcacttcagggcagctcacgaaaataccaaaaacctgctgtgcccattctgcctcaaggtctctaaaatggcgacaccctacatgaaccactatatgaagcaccagaaaaagggagtacacagatgcccaaaatgtagacttcaattcttgaccagcaaggagaaggctgagcataaggcccagcaccgtaccttcattaaacctaaggaactggaaggccttccccctggcgcgaaggttactatccgcgcctcactgggccctctgcagagcaagctccccaccgccccctttggttgtgcccccggcacttcattcctacaggtcacgcctccaacgtctcaaaacactactgccaggaatcctaggaagtctaacgcctcgcgaagtaaaacatctaagctacacgcaaccacaagtacagcgagcaaagtgaacactagcaaacctagaggtaggattgctaagtctaaggccaaaccctcctataagcaaaaacggcaaaggaatcggaagaacaagatgtccttagctctaaaaaatatacggtgccgtaggggaatccataagtgcatcgaatgtcattcaaagatcaaggatttcgcttctcatttttccatctacatacattgctcgttttgcaagtacaataccaattgcaacaaggcatttgttaatcacatgatgtctagtcacagcaaccaccccggtaaacgattttgcatcttcaagaagcacagcgggaccctgagaggaattacacttgtgtgccttaaatgtgacttcctagctgactcctcaggcctcgaccgtatggctaagcacctcagtcaaaggaagactcatacctgtcaggtgatcatagaaaacgttagcaaaagtactagtacttcagaaccaacaactggctgctccctgaaatag

SEQ ID NO: 21404 - DNA, 1833 bp, Artificial Sequence
  Description of Artificial Sequence: Synthetic coding sequence
atggacgacgacaagcccttccagcccaagaacatcagcaagatggccgaattatttatggagtgtgaggaagaagagctggaaccatggcagaagaaggttgaggaaacacaggatgaagatgacgacgaattaatttttgttggcgaaatctccagcagtaagccggcaatcagcaatatcctgaatcgcgggcacagttcaagcagttcaaaggggattaaatcggaacctcattcgcccggtatcccagagatatttcggacggcgagtcaaaggtgcagagacccaccctcaaatccagtcgcagcatccccaaggttccacctcgtttctaaatcatcacaaagtagtgtgacagttgaaaatgcctctaaacctgactttaccaagaactcacaggtaggctctgataattcctcaattcttctgttcgattccactcaagagagtctgccaccaagccaagacattcctgccatctttcgggagggcatgaaaaacacatcgtacgtcctcaagcacccctctacatcgaaggtcaattccgttactccaaagaagccaaagacgtctgaagatgtacctcaaataaatccaagcacttccctacccctgatcgggtcaccacctgtgaccagcagtcaggtcatgttgtctaaggggacgaatacatccagcccatatgatgcgggcgcggactacttacgcgcctgcccaaagtgtaatgtccagttcaacctgttggatccactcaagtatcacatgaaacactgctgtcccgatatgatcaccaaatttctcggcgtaattgtcaaatcagagagaccctgcgatgaagacaagactgactccgagacagggaagttaatcatgctggtgaacgagttctattacggacgtcacgaaggcgtgacagaaaaggagcctaagacctacactacatttaagtgttttagttgctcaaaagtgctgaaaaacaacatccggttcatgaatcatatgaagcatcatctcgagctcgagaagcaaaataacgaaagctgggaaaaccatacaacgtgtcaacactgttaccggcaataccccacaccattccaacttcagtgccacatagagtcgacacatacccctcacgagttcagcacgatctgcaagatttgcgagctgtcctttgagactgaacacattttacttcagcacatgaaagatactcataagccaggcgaaatgccctatgtttgtcagaaaaaaggagtgcataggtgtccgaagtgtagactgcagtttctcacctctaaggagaaagcagaacataaagcacagcaccgtactttcataaagcctaaggagctggaaggcctccctccgggcgcaaaggtgaccatccgcgcttcacttgggccacttcagtctaaactgcccacagcgcccttcggatgcgctcccggcacttccttcttgcaagttacaccgcctacgagtcagaacacaacggccagaaacccccgcaaatctaacgcctcccggtcgaaaaccagcaagcttcatgccaccactagcaccgccagcaaggttaatactagcaaacccaggggcagaatcgctaagagcaaggccaagccttcttataagcagaaaaggcagagaaatagaaaaaataagatgtccctagccctgaagaatatccggtgtaggcgaggtatccataagtgcattgagtgccactccaagatcaaagactttgcaagtcacttcagcatctatattcactgtagtttctgtaaatataatacaaactgcaataaggcctttgtgaaccatatgatgtag

SEQ ID NO: 21405 - DNA, 909 bp, Artificial Sequence
  Description of Artificial Sequence: Synthetic coding sequence
atggccggcatgagcgagagcagcttcctgagcaagcggcccagcacgagtgaggtgaataatgttaaccctaaaaaacctaagcctagcgagagcgtgtccggcgccaactcatctgcagtgctgccctcagtaaagagtccaagtgtgacatcgtcacaggcgatgctggccaagggcaccaacacttcatctaaccagagcaagaatggcaccccatttccccgggcttgccctaagtgtaatattcattttaatcttttagatccactgaagaaccacatgaagtattgctgtccagacatgattaataactttctcggtctggctaaaaccgagttctccagcacagtgaataaaaatactacgatcgactctgagaagggtaagctgatcatgctcgtcaatgatttctattatggaaagcacgagggagacgtgcaggaagaacaaaagacccacaccacttttaaatgctttagctgtctgaaaatcctgaaaaataacattaggttcatgaaccacatgaagcaccacctcgagctggaaaagcagagcagtgaaagttgggaaaaccatacaacatgtcagcactgctacagacagttcccaacaccattccagctccaatgccacattgaatcaactcatacaccccacgagttcagcaccatctgtaaaatatgcgagctcagtttcgagaccgagcacgtgctcctgcaacacatgaaggataaccacaagcccggggaaatgccctacgtgtgccaggtgtgcaactaccgttctagctctttctccgacgtggagacacattttaggaccagtcacgagaacaccaagacttgctatgcgagattcgcgtcaaagctgcttaagttgcaacatcacatatgcattataatctag

SEQ ID NO: 21406 - DNA, 2940 bp, Artificial Sequence
  Description of Artificial Sequence: Synthetic coding sequence
atgggcgacaaccccttccagcccaagagcaacagcaagatggccgagctgtttatggagtgtgaggaagaggagttggagccctggcagaagaaggtcaaagaagtggaagacgatgatgacgacgagcccatttttgtgggggaaatttcctcttcaaagccagctatcagcaacattctcaatagagtcaacccttcctcatatagccggggcttgaagaacggggcattgtcacgcgggatcacagccgcctttaaaccaaccagccagcattacactaacccaacttcaaatcccgttccagcttcacccattaacttccatccagaatcccggagttctgattccagtgtcattgtgcagcccttctcaaaacccggctatataaccaattcatctcgggtggttagcaataagtcttctgagttgctgttcgaccttacgcaggacacagggctgagccactatcagggcggtcctactctcagcatggcaggtatgagcgagtcttcattcctctccaagcgaccctccaccagtgaggttaataacgtgaaccctaagaagccaaagccatcggagagtgtgtctggggcaaatagctcggccgtgctcccctccgttaagagtcccagtgtgacctcgtcccaggctatgctggccaagggcactaacacttcttctaaccagtctaagaacggaacacctttccccagggcttgtccgaagtgcaacatccactttaacctgctggatcctctgaaaaatcacatgaaatactgttgccccgacatgattaacaattttctgggactcgcgaaaacagagttctccagcacagttaataaaaatacaaccattgatagtgagaaggggaaactgattatgctggtaaacgatttttactacggcaaacatgagggagacgtgcaggaagaacagaagacgcatactacctttaaatgcttctcctgcttgaagattttaaaaaataacattagattcatgaatcatatgaaacaccacctcgagctggagaaacaaagctccgaaagctgggaaaaccatactacctgtcaacattgctacaggcagttcccgacaccattccagctgcagtgccacatcgagagcacccacactccacacgaattctcaaccatctgcaagatctgcgagcttagttttgagaccgaacatgtgctgctgcagcatatgaaggacaaccataagcctggagaaatgccctatgtctgtcaggtctgcaattaccggtcttcttcattcagtgatgtagaaacccactttagaaccagccatgaaaacacaaaaaacctgttgtgccccttctgtctgaaggtgattaaaattgccaccccctacatgcaccactacatgaaacaccagaaaaaaggcattcatagatgtacgaagtgccgtctgcagttcttgacttgcaaagagaagatggatcataagactcagcaccataggacgtttattaagcccaagcagctggaagggctcccccccgggaccaaagtcacaatcagggcatcggtggggcctttacaatctggcgcatcacccactccaagcatttccgcctctgcatcaacattacaattatcccccccccgcactaaaaatatcaccgcaaaaaaccctgccaagagcaacacctcaaagccaaatactgttaaatctaacgcctcaaaaccaaacaccagcaaacctaacggctcaaaatctaagtacaaacctaagattagcaacatgcagaagaagcagtcaaccctggcctcttctaataaaaaaagcaaagtgaatacagccctccgaaatcttaggtaccggcgcggtatccataaatgtattgagtgttgttccgagatcaaagacttcgcaaatcacttccctacatacgtccattgcagcttctgtagatacaacaccagttgttcaaaggcctatgtgaaccatatgatgagtttccacagcaatagaccttccaaacgcttctgtatttttaaaaaacattccgagaacctgagggggatcacattggtgtgtctcaactgtgatttcttaagcgatgtaagcggccttgataatatggcgacccatctcagccagcataagacacatacctgccaggtggtgatgcaaaaagtttcagtgtgcatccccacttccgaacacctgtcagaattaaagaaagaagccccggccaaagaacaagaaccagtcagcaaggaaatagccagacccaacatggctgagcgagagaccgaaacttctaacagtgaatctaagcaggacaaggctgcgtctagcaaggagaaaaacggatgcaatgctaactcctttgagggatcctcaactactaagagtgaagaatccattaccgtgtcagataaagaaaatgaaacatgtttggccgatcaggagacaggttccaagaatatcgtgtcctgcgactcgaatatcggagcagacaaggtcgaaaagaagaaacagatacagcacgtgtgccaggaaatggaattaaaaatgtgccagtcttctgagaacataatcttatccgatcaaattaaagaccataacagtagcgaggcccgtttctcaagcaagaacatcaaggacctgcggctcgcatcagacaatgttagtatcgatcaatttcttcgaaagcggcatgaacccgagtcagtgtctagcgacgttagtgagcagggctccatccaccttgagcccttgaccccttccgaggtgctggagtatgaggccacagaaatcctgcagaaagggagtggggatccctctgccaagacagacgaggtagtatctgaccagactgacgatatcccaggcggtaataatccatcgacgacagaagctaccgtggacctggaggacgagaaggagcgtagctag

SEQ ID NO: 21407 - DNA, 1266 bp, Artificial Sequence
  Description of Artificial Sequence: Synthetic coding sequence
atgctggtgaacgacttctactacggcaagcacgagggcgacgtgcaggaagaacagaaaacccatacgacctttaaatgcttttcatgtctgaagattctcaaaaataacatccgttttatgaatcatatgaagcaccatttggaactagaaaagcagtcaagcgagtcgtgggagaatcacaccacatgtcagcactgttatagacagttccctactccattccaactgcaatgccatattgaaagtactcataccccccacgaattcagtaccatctgtaaaatttgtgagctgagttttgagaccgagcatgttctcttgcagcacatgaaagacaatcataagcccggtgagatgccttatgtgtgccaggtttgcaactaccggtccagctcctttagcgacgtggaaacacactttcggaccagtcatgagaacactaaaaatctgctgtgtccattctgtctcaaggttatcaagatagccacaccatatatgcatcattatatgaaacaccaaaaaaaaggcatacacaggtgtacaaaatgtcgactgcagttcctgacatgtaaagagaaaatggatcacaagacacagcatcacagaaccttcatcaagcctaaacagctggaggggcttccacctggcaccaaggtgacgatcagagcttccgtgggtcctttgcagtctggagcttcaccgacaccgagcatctccgccagtgcctctacactgcagctgagccctccaaggacaaagaacattaccgcgaaaaaccctgccaaaagtaatacgtctaaacctaacaccgttaaatccaatgctagtaagccaaatacaagtaagcctaacgggagtaagtcgaagtacaaacctaaaatctcaaatatgcagaaaaagcagtcaaccctggcaagtagcaataagaaaagtaaggtgaataccgctctgaggaatctgagatatagacgcgggatccacaagtgcatcgagtgttgttccgaaataaaagacttcgccaaccatttccccacatatgtgcactgttccttttgccgctataatacctcttgttctaaagcatatgttaaccacatgatgagttttcactctaaccgtccatccaaaagattctgcatctttaagaaacattccgagaacctgagatgcgtgggggggcaaatcgagtgtgacctacccaagctgcacaagctggtggtggaaccccggctcaccctcggcctgcttacaccgaacttctag

SEQ ID NO: 21408 - DNA, 2901 bp, Artificial Sequence
  Description of Artificial Sequence: Synthetic coding sequence
atggccgagctgttcatggagtgcgaggaggaggagctggagccctggcagaagaaggtgaaggaggtcgaggacgacgacgatgacgagccaattttcgtgggagaaatctccagttcaaagcccgcgatttctaacatcctgaatagagtgaatcccagctcttatagcagaggtttgaaaaacggggccctcagtcgcgggattactgcagccttcaagccgacgtcccagcattacactaacccaacctccaaccctgttccagcatccccgataaatttccatccggagtccaggagttctgacagttcggtcattgtccaaccctttagtaaacccgggtacatcacaaattcctctcgcgtggtatccaacaaaagcagtgagctcctttttgatttgacccaagataccggcctttcgcactaccagggaggccctaccctttcaatggctgggatgtccgaatctagctttctgtccaagcggccttccacctcagaagttaataacgtcaacccaaaaaagcccaaaccctcagaatctgtgagcggcgccaatagcagcgcggtgctcccatctgtaaagtcaccttcagtgacttctagtcaggccatgttggccaaaggcactaacacatccagtaatcagagcaagaatggcactccctttccacgcgcctgtcctaagtgcaacattcacttcaatttgctcgatcccctgaagaaccatatgaaatactgttgtcctgatatgatcaataactttcttggactcgcgaagacagagttctccagtactgtgaacaagaatacgacaatcgattctgagaaaggcaagttgatcatgctggtgaatgatttttattatggcaagcacgagggggacgtccaggaggaacaaaaaacacacaccactttcaaatgcttctcatgtctgaaaatcttaaagaacaacattcggtttatgaaccacatgaaacaccacctggaacttgaaaaacagagctccgagagctgggaaaatcacacgacctgtcagcattgctatcggcagttccccaccccctttcagctgcaatgtcatatagaatccactcacaccccacacgagttttctaccatatgtaagatctgcgagctgtcttttgagaccgagcatgtgctgctccaacatatgaaggacaatcacaaaccgggagaaatgccgtatgtttgtcaggtgtgcaattacaggagtagcagcttctccgacgtcgagacacacttcaggacctctcatgagaatactaagaacctcctttgccccttttgtctcaaggtgattaagattgcaaccccctacatgcaccattacatgaaacaccagaaaaaaggtattcaccggtgtacaaagtgtagactacagtttctaacttgcaaggaaaaaatggatcacaaaacccaacatcaccggaccttcatcaagcccaagcagttggagggcttgcctcccggaactaaggtgacaattagagcatcggtcggccccctgcagagtggcgccagccccaccccctcaatttccgcgtccgctagcacgttacagctatcccctccgcgaacaaaaaacatcacagccaagaatccggccaaatcaaatacatccaaaccgaacaccgtgaagtccaatgcctcaaaaccgaatacatcaaagccgaacggatctaagtctaagtataaaccaaaaatcagcaatatgcagaagaagcagtcaacactcgcgtccagcaataaaaagtcaaaggtcaacactgcattgcgcaacttgagatacagacgtgggattcacaaatgcatcgaatgttgctccgaaatcaaagactttgcgaaccatttcccgacatatgtgcattgttcattttgtcggtataatacttcttgtagcaaggcctacgtgaaccatatgatgtcttttcacagcaatcggcccagcaaaagattctgtatcttcaaaaaacactctgagaatctccgggggattactctagtgtgcctaaactgcgattttctgagcgatgtgtccgggcttgataacatggctacacatttgtcacagcataagactcacacttgccaggttgtgatgcagaaggttagcgtctgcattccgaccagcgaacacttgagcgaactgaagaaggaggctccagccaaagagcaagagccagtgagcaaagagatcgccaggcccaatatggccgagagggaaaccgagacttctaactctgaaagcaaacaggataaggcggctagcagcaaggagaaaaacggttgtaacgcaaattcattcgagggaagctccaccaccaagagcgaggagagtatcactgtgtcggacaaagaaaatgagacctgcctggccgaccaggagacagggtctaagaacatcgtgtcatgtgactcgaatataggagccgacaaggtggagaaaaagaaacagattcagcatgtttgtcaagagatggagcttaagatgtgccaatcatctgaaaatatcattctgtccgaccagatcaaagaccataattccagcgaggccagattctcgtccaaaaatattaaggatttgcggcttgcttcggataatgtcagcattgatcagttcctgcgaaagagacatgaacccgagagtgtcagttccgatgtctctgagcagggtagtatacatctagaaccactaaccccgagcgaggtgctggaatatgaagcaactgagatcttgcagaaagggtccggtgacccctctgctaagacagatgaagtcgtgagcgaccagactgatgatatacctggaggtaacaatccctcgaccacagaggctacagtggatctggaggacgaaaaggaacggagctag

SEQ ID NO: 21409 - DNA, 2244 bp, Artificial Sequence
  Description of Artificial Sequence: Synthetic coding sequence
atggccgagctgttcatggagtgcgaggaggaggagctggagccctggcagaaaaaggtgaaggaggtggaggatgacgatgatgacgagcctatttttgttggagaaatctctagtagcaagccagcaatatctaacatcctaaacagagtgaatccatcatcatatagtcgtgggctgaagaacggggctctctctaggggcatcacggccgccttcaaaccaacaagccagcactacactaaccccaccagcaatcccgtacccgctagtcctatcaacttccaccccgagagccgcagtagcgacagcagcgtaattgttcagcctttctccaagcctggctatattaccaatagcagtagagtcgtcagtaacaagtcttccgaactgctgttcgacctgactcaagataccgggttaagccattatcaaggaggtccaaccctgagcatggccggcatgtcagagagcagcttcctcagtaaacgccctagcaccagcgaggtgaataatgtgaatccaaagaagccaaaaccttctgaaagtgtttcaggggcaaattccagcgctgtactcccatccgtgaaatccccttccgtgacttcctcccaggccatgctggccaaaggcaccaacacttccagcaatcagagcaaaaatggcacaccattcccaagagcgtgccccaaatgtaacatccatttcaacctccttgatcccctcaaaaatcatatgaagtactgctgccctgacatgattaacaattttctgggactggctaaaactgaattctcctccacagtgaataaaaacaccactattgattcagagaagggtaagttgattatgctcgtcaatgacttctattacggtaagcatgaaggcgacgtacaggaggaacagaagactcatactacattcaaatgtttttcctgtctgaagattttgaaaaataacatacggttcatgaaccacatgaagcatcacctggagttagaaaaacagagcagcgagagctgggagaaccataccacgtgccaacattgctatcgccaatttccaaccccattccaactgcagtgccatattgaaagcacacacactccccacgaatttagtacaatttgcaagatctgcgagctgtcctttgaaactgaacatgttctactgcaacatatgaaggacaaccacaaacctggcgaaatgccctacgtgtgtcaagtgtgcaactaccgcagttcttctttctccgacgttgagacacattttcgcacaagccacgaaaacacaaagaaccttttgtgccccttctgcctcaaggttattaagatcgccacaccctacatgcaccattatatgaaacaccagaagaaaggtatccaccggtgcactaagtgccggttgcagttcctgacctgcaaagaaaaaatggaccacaaaacacagcaccataggacttttattaagccaaagcagctggaaggattgcctccgggcaccaaagtgaccatccgcgcaagcgttggccctttgcagtctggcgcgtccccaaccccttctattagtgcttccgcctctactctgcagctttcccccccgaggaccaaaaacataactgctaagaaccccgccaaatctaacacctcgaagcctaacaccgtgaagtctaatgcctcaaagcctaacaccagtaaaccaaatggatccaaatcaaagtataagcccaagatttccaacatgcagaaaaaacagtctactctggcctccagcaacaagaaaagcaaggtgaataccgctttaagaaacttgaggtaccgccgtggcatacacaagtgcattgaatgctgctccgagattaaggatttcgccaaccatttccctacctatgtccactgtagcttctgtaggtacaatacttcttgttctaaggcatatgtaaaccacatgatgagcttccactccaaccggcccagcaaacggttctgcattttcaagaagcactcagaaaaccttagggggattacactagtatgcttgaattgtgacttcctttctgacgtaagcggtctcgacaatatggcgacacacctcagtcagcacaagacccacacctgccaggtggttatgcagaaagacgccgaggctgcccagaggttccagaaaatttcaagggtttatcttgattctgtaccgctgaggtggacacagctaatgcccgttctgtccttccaaggtatgtag

SEQ ID NO: 21410 - DNA, 243 bp, Artificial Sequence
  Description of Artificial Sequence: Synthetic coding sequence
atgggcgacaaccccttccagcccaagagcaacagcaagatggccgagcttttcatggaatgcgaggaggaggaactcgaaccgtggcagaaaaaagtcaaggaagttgaagacgacgatgacgatgagcctatcttcgtaggggaaatctcgtcttccaaaccagccatttctaatattttaaaccgggtgaatccctctagctactctagaggcctcaagaatggtgcccttagcagatag

SEQ ID NO: 21411 - DNA, 477 bp, Artificial Sequence
  Description of Artificial Sequence: Synthetic coding sequence
atgggcgacaaccccttccagcccaagagcaacagcaagatggccgaactgtttatggagtgcgaggaggaggaactggaaccgtggcagaagaaggtcaaggaagtggaagacgatgacgatgatgagcccattttcgtgggggagatatcatcaagcaaacctgccatctccaacatccttaatagagtcaatccctcatcctattcacggggcctgaagaacggtgctctcagtaggggcatcacagccgcttttaagcctacctcccagcactacaccaaccctacaagcaatcccgtgcctgcttccccgatcaatttccatcctgagtcgcgctcctcagatagctctgtcatcgtacagcctttctcgaagccagtgagtgtgagcaaaacaatcaggcctgcgcagggctctattgggtgttgtctgtctataagcacagtgccatcatataattccggtttatcctag

SEQ ID NO: 21412 - DNA, 2901 bp, Artificial Sequence
  Description of Artificial Sequence: Synthetic coding sequence
atggccgagctgttcatggagtgcgaggaggaggagctggagccctggcagaagaaggtaaaagaagtggaggacgatgacgatgatgaaccaattttcgtcggtgaaatctcatcctctaaacccgcaatatctaatattctgaaccgagtgaacccctcgagctacagcagggggctgaagaacggagcccttagccgcggcattactgctgcatttaagccaacatcccaacattatactaatccaactagtaaccccgtgcctgcatcccctattaactttcatcctgagtctaggtccagtgacagtagcgttatcgtgcaacctttcagtaaaccaggatatatcacaaattctagtcgagtggtgtctaacaagtcctctgaactcctgtttgacctgacacaggacactggcctgtcccactaccagggcgggcccactctgtccatggcaggcatgtccgagtcctctttcctatctaagcgtcccagtactagcgaggtgaacaacgtgaatcctaaaaagcctaaaccttctgaatcagtgtctggcgctaactcatcagccgtgctgccttctgtgaagtccccatccgttactagtagtcaggccatgctagctaaaggaaccaatactagttctaaccaatctaagaacggcacaccttttcccagggcatgtcccaaatgcaatatccacttcaatctgcttgatccgcttaaaaaccacatgaagtactgctgtccagacatgataaacaatttcctgggcctggccaaaaccgagttttcctcaacagttaacaaaaatacaaccatagattcagaaaagggtaaactaatcatgttggtcaacgatttctattatgggaaacatgaaggagacgtacaggaggaacagaaaacacacactactttcaagtgtttctcttgcctcaagatcctcaagaataacattagatttatgaatcacatgaaacatcatctcgagctagaaaagcaatcctctgagagttgggagaaccatacaacttgccagcactgctataggcagttcccgactccatttcaactccagtgccacatcgagagcacacacacccctcatgagttctcaactatatgtaagatctgcgaactgtctttcgagacagagcatgtgctactgcagcatatgaaagacaatcacaaacctggggagatgccctacgtctgccaggtgtgcaattatcgaagctcctccttctccgatgtcgagacgcatttcagaacttcgcatgagaatactaaaaacttattgtgcccattttgtttgaaggtaattaagattgcgaccccttacatgcatcactatatgaaacaccagaagaaggggattcaccgctgcaccaagtgccgcctgcagtttttgacctgcaaagagaaaatggatcataaaacacagcaccacaggaccttcatcaagcccaaacagctggaaggtctgccccccggtaccaaggttactattcgagcgtctgttggccctcttcaatctggcgcctcgcccacaccttcaatctctgcgtccgctagtaccttacagctttcccccccacgtacaaaaaatattaccgctaagaatccagcaaagagtaacacgtctaagccgaacactgtaaagtccaacgcctccaaaccgaatacttcaaagccaaatggtagtaagtcaaaatacaaacctaaaatctcgaacatgcagaagaagcagagcacattggctagtagcaacaagaagtccaaagttaataccgccttgaggaaccttcgctaccggaggggtattcataaatgtattgagtgctgtagtgaaattaaggactttgctaaccatttcccgacgtacgttcactgcagtttctgtagatacaacaccagctgctcaaaggcatatgtgaaccatatgatgtctttccacagtaacagaccatccaaacgcttctgcatctttaaaaaacattctgaaaatctccggggtattacgcttgtgtgcttgaactgtgacttcttaagtgacgtttctggactggacaatatggctacacacctgtcccagcacaagacccatacttgtcaggtcgtcatgcaaaaggtctcagtgtgcattcctacatccgagcacttaagcgaattaaagaaggaggcgccagccaaagaacaagaaccagtgtctaaggagatcgcccgtcccaacatggcggaaagagagaccgagacttcaaactctgagagcaagcaggacaaggcagcatcctcgaaggaaaaaaacggatgcaatgcaaacagttttgaaggcagttctactacaaagtccgaggagtccattaccgtgtccgacaaggagaacgagacctgtttggccgatcaggagactggatcaaagaacatcgtgtcgtgcgattccaacattggcgcagacaaagtggagaagaagaagcagattcagcatgtgtgccaggaaatggagctaaagatgtgtcagtcatctgaaaatatcatcctgtctgatcaaattaaggaccacaactctagcgaagccagatttagcagcaagaacataaaagacttgaggcttgcctccgacaacgtcagcatagatcagtttcttaggaaacgccatgagcccgagagcgtgtcttcagacgtctcagagcaggggtccatccatttggagccactgactccatctgaagttctcgaatacgaggctaccgaaatcttgcaaaaggggtctggcgatccatcagccaaaaccgacgaagttgtttctgaccagaccgacgacatacccggcggtaacaatccttcgaccactgaggctactgtcgatcttgaggatgagaaggagcggagttag

SEQ ID NO: 21413 - DNA, 2688 bp, Artificial Sequence
  Description of Artificial Sequence: Synthetic coding sequence
atgaagatcggcagcggcttcctgagcggcggcggcggcaccggcagctcgggcggctcaggttcaggaggaggtggctccggtgggggcggaggaggtggatccagcggcagacgcgcggaaatggaaccaacgtttcctcagggtatggtgatgttcaatcaccgcctgccacccgtgacctcgtttactaggccggctggtagcgctgcgccacctcctcaatgcgtgctgtcctcttcgacaagcgcagcaccagccgcagagccccccccaccgcccgcaccggatatgacgttcaagaaagaaccagcagcatccgccgccgcctttccctcacagcgcacgagttggggctttctccagtctttggtgagcatcaagcaggagaaacccgctgatcctgaagaacagcaaagtcatcatcaccaccaccaccatcactacggcggactgttcgccggagccgaggagaggtctcctggactcggagggggcgagggaggcagccatggtgtcattcaggacctttccatcttgcatcagcacgtgcagcaacagccggcacagcatcatcgagacgttctgctgtctagcagttcccggactgacgatcaccatggcaccgaggagccaaagcaggacacgaatgtaaaaaaggccaagagaccaaaacctgagtcccaagggatcaaggccaaacgaaagccttccgctagctctaaaccctcactggtgggagatggagaaggcgcaatcctttcccccagtcagaaacctcacatctgcgaccattgctccgctgcatttcgatcatcataccatcttcgcagacacgtgctaatccacactggcgaacgacccttccaatgttcccaatgttccatggggtttatacaaaaatacctgctgcagagacacgagaagatccattctcgcgagaagccattcggctgcgaccagtgttcaatgaaattcattcagaagtaccacatggagcgccacaagaggacccactccggagagaagccctataagtgcgatacctgtcagcaatacttttcaaggactgatagactactcaagcaccggcggacctgcggggaggtcatcgttaagggggccactagcgccgaacccggaagttcaaatcacacaaatatgggaaatctcgccgttctcagccagggaaacacatctagctctcgaagaaagacaaagagtaaaagtatcgctatcgagaataaagaacagaagacagggaaaactaacgaaagtcagattagtaataacattaacatgcagtcttacagcgttgaaatgcctactgtgagctctagcggaggaattatcggtacaggcatcgatgaactgcaaaagcgtgtgcccaaactcatattcaaaaaaggatctcggaaaaatacagataaaaattacttgaacttcgtgtcgcctctccccgacattgtgggccaaaagtcactgtctggtaagccgtcagggtcactggggattgtgagtaacaactcagtggagacaatcggcctgttgcagtccaccagtggcaagcagggtcagatctcctctaattacgacgacgccatgcaattcagcaaaaagagaaggtatctccccactgcctcctccaacagcgccttcagcatcaacgtgggtcacatggtatcccaacaatcagttatccagagtgcgggcgttagcgttctggataatgaagctcccttatccctgattgattcttccgcactgaacgccgaaattaaatcctgccacgataagtcaggcattcccgacgaggtcctgcaatccatcctggaccaatactctaataagtcagagtctcaaaaagaggatccattcaatattgcagagcccagagtggatctgcacacgtcaggggagcacagcgaattggtgcaagaggagaatctgtccccaggtacacagacaccctctaacgacaaggccagcatgctccaagagtactctaaatatctccagcaggcgtttgaaaagtccactaacgcctcatttaccctgggccatggcttccagttcgtgtccctctctagtccactccataatcacactctattcccagagaagcagatctacaccacctcacccctggagtgcggtttcggccagagtgtgacttccgttctgccaagctccctgccaaagcctcccttcggcatgttgtttggaagccagcctggattatatctgagtgcccttgatgccacacaccagcagctgaccccctcccaggagttagacgacctgatcgattcccagaagaatctcgagacatcatctgcttttcaaagcagttcccagaaactgacatcacaaaaggagcagaaaaacctggagagcagtaccggtttccagatcccaagccaggagctcgcaagccagatcgaccctcagaaggacatagagccccgtacaacctaccaaatagagaactttgctcaggcctttgggagccaattcaaatccgggtcccgtgtcccaatgacctttatcaccaattctaacggagaggtcgaccacagagtacgaactagcgtctctgatttcagcgggtatactaacatgatgtccgacgtttctgagccttgcagtacccgggtgaagacacccacatcccagtcgtaccggtag

SEQ ID NO: 21414 - DNA, 2580 bp, Artificial Sequence
  Description of Artificial Sequence: Synthetic coding sequence
atgaagatcggcagcggcttcctgagcggcggcggcggcaccggcagctcaggaggatcggggtcagggggaggcggcagtggcggaggtggaggaggcgggtctagtgggagacgggctgagatggaacctacctttccccaggctcctgctgctgagccacctccaccgccagctccagatatgaccttcaagaaggaaccggccgcaagtgccgccgcatttccaagccagaggacctcctgggggtttcttcaaagtctagtttctatcaaacaggagaagccggccgatcccgaggagcagcagtctcaccaccatcaccaccatcaccactatggaggactgttcgccggggcagaggaacgctcaccgggattgggtggaggggagggcgggagtcatggcgtcatccaggacctgagcatcctgcaccaacacgtgcagcagcagcctgcccagcaccaccgggacgtcctgctgagtagttcctctcggaccgacgaccaccatggaactgaagaacccaagcaggatactaacgtgaaaaaggcaaaacgaccaaagccagagagccagggtattaaggcaaagcggaagccttccgcttcatcaaaaccctctctggtgggagatggtgaaggcgcaattttgtccccttcacagaagccacatatctgtgaccattgctctgctgcgtttagaagcagctaccatctaagaagacatgtgctgatccatactggagagagaccatttcaatgctcgcagtgctccatgggattcatccagaagtacttgctgcagaggcacgaaaagattcacagccgggagaaacctttcggatgcgatcagtgctcaatgaaatttattcagaagtatcacatggaaaggcataagcgcacccatagtggcgagaagccttacaaatgcgatacctgtcaacaatacttttcaagaactgatcggctgcttaaacatcggcggacatgcggagaggtgatcgtgaagggcgccacatccgccgagcccggctcaagcaatcacaccaacatggggaacctggccgtgctttctcaggggaacacgagtagcagtcggcgtaagaccaaatccaaatccatcgccattgagaacaaagagcagaaaaccgggaaaactaacgaaagccagatttcaaacaatatcaacatgcagtcctactctgtggagatgccaaccgtcagctcttccggtggaatcatcggcaccggcatagacgaactgcagaaaagggtgcctaagctcatcttcaagaaaggtagtcggaagaatacagacaagaactacctgaattttgtttctcctctgcccgacattgtggggcaaaagtctctatcgggcaagccctcagggagcctgggaattgtcagtaacaattccgtggagacaattggccttctccagtctacttctgggaagcagggtcaaattagctcaaactacgatgacgccatgcagttctcaaagaaaagaagatacctgccaaccgcatccagtaattcagccttcagtatcaacgtaggccatatggtcagccaacagagtgtgatccagtccgccggtgtctccgtcctggataatgaggctcctctgtctctcatcgattcttctgcgctaaacgccgagatcaagtcctgccacgataagtcagggatcccggacgaagtgctgcagtccatactggatcagtatagcaataaaagtgagtcccagaaggaagatccattcaatatcgccgagcctagagttgatctgcacacttctggggaacacagcgagcttgtgcaggaagaaaaccttagccccgggacccaaactcccagtaatgataaagcctcaatgttgcaggagtacagtaaatatctgcagcaggcatttgagaagagcacaaacgcaagctttactctcggccatggctttcaattcgtgagtttgagcagtccgctccacaatcacaccctattccctgaaaaacaaatttataccaccagcccattagagtgcggtttcgggcaatctgtgacatcagtattaccttcgagcctccctaaacccccattcgggatgctgttcggctctcagcctggtctctatctgtccgctctggacgccacacatcagcagctaacccccagccaggagcttgatgacctgatcgactctcagaaaaacctcgagacatcatccgcgtttcagtccagcagtcagaagctaacttctcagaaagagcagaaaaatttggaaagtagcactgggtttcagatcccatctcaggagctcgcaagtcagatcgacccgcagaaagacatcgaaccaagaacaacatatcagatcgagaatttcgcccaggcgtttgggagtcaatttaaatctgggtcccgagtgccaatgacatttataaccaattccaatggcgaagtggaccaccgggtacggacaagcgtaagcgacttttcaggctacaccaatatgatgtcagatgtgagtgaaccttgctctacacgcgtgaagactcccacgtctcagagttaccggtag

SEQ ID NO: 21415 - DNA, 2688 bp, Artificial Sequence
  Description of Artificial Sequence: Synthetic coding sequence
atgaagatcggcagcggcttcctgagcggcggcggcggcaccggctccagtgggggatcaggctccggcggaggagggagcggaggcggtggaggcggaggcagttccgggcgtcgcgcagagatggaaccaacatttccccagggcatggtgatgttcaatcatcgacttcctcctgtaacctcattcactcggccagcagggtccgcggctccacccccacaatgcgtgctttccagtagcactagtgcggctcctgcagctgagccacctcccccacctgccccagacatgacgttcaaaaaggaaccagcagccagtgccgctgcattcccgtcccagcggaccagctggggctttctgcagtcgctcgtcagcatcaagcaagagaagcccgctgatcctgaggagcaacagagccaccaccatcaccaccatcaccattacgggggcttattcgcaggtgctgaagagcggagccccggtcttggcggaggtgaaggaggctctcatggagtgatccaggatctgtctattctacatcaacacgtccagcaacagccagcccagcaccaccgcgatgtgctgttgtcatccagcagcagaaccgatgaccatcatggcacagaggagcctaaacaggacactaatgtcaagaaggcaaagcgaccgaagcccgagtcacaggggattaaagcaaaaaggaagccctcagcctcctcaaaaccatccttagtcggggacggtgagggtgctatcctgagtccatctcagaaaccacacatttgcgaccattgttctgccgccttcagaagttcttaccatttgcggcggcacgtgttaatccacaccggcgaacgtccgtttcagtgcagccagtgctcaatgggctttatccagaagtacttgcttcagcggcacgagaagatacatagtcgggaaaaaccctttgggtgtgaccaatgttctatgaaattcatccaaaaataccacatggagcggcataagaggacccactctggggagaagccttacaagtgcgacacctgccagcagtatttctccagaactgaccggctactgaagcataggcgtacatgtggcgaggtaatcgtgaagggagctacttccgccgaaccaggatcaagcaaccataccaacatgggaaacttagccgtgctgagccaaggtaacacatcctctagccggcgcaagaccaagtccaagtcaattgccatagagaataaagaacagaagacgggtaagaccaacgagtctcaaatctccaacaatataaatatgcagtcctatagcgtagaaatgcctacagttagttcttctggcggcatcattggcacgggaattgatgagctccaaaagcgtgtgcctaagctgatcttcaagaaggggtcccggaagaatactgataagaactatcttaattttgttagtcctctgcctgacattgtggggcagaaatccctcagcggtaagccctctgggagcctgggcatcgtgtccaataattccgtggagacaattggtctgttgcagtcaacctcagggaaacaggggcagattagcagcaactacgacgacgcaatgcagttctctaagaaaagacggtatctccccaccgcttcctcaaatagcgccttctctattaatgtgggtcacatggtgtcccagcagtctgttatccagtcagcaggagtgagcgtactggataacgaggcccccctgtcactgatcgattctagcgcactgaatgcagagatcaagtcctgtcatgataaatccggcatacccgatgaggtcctccagtctattctggatcagtattccaacaagagtgaatctcagaaagaagaccccttcaacatagcagagcctagggtggatttgcataccagtggcgagcactctgagttggtacaggaagaaaacctgtcaccaggtacccagacgccttctaacgacaaggcctcgatgctgcaggagtactcaaagtatcttcaacaagcctttgagaagagcaccaatgctagctttactcttggccacggattccagttcgtgtcactgtcatcccccctccacaaccacactctgtttcctgaaaaacagatttatacaacttctcccctggaatgtgggtttgggcagtctgtgacatccgtgctaccctccagcctgccgaagcctccgtttggcatgttgtttggctcgcagcctgggctctacctgtcagcattggatgccacccaccaacagctgacaccttcacaagagctggatgacctgatcgattcccagaagaatctcgaaacttcttccgcattccagagcagtagccagaagctaaccagccaaaaagagcagaagaatttggagagctccaccggatttcagattccttcccaggagcttgcgtctcagatcgacccacagaaagatatcgaaccacggactacctatcagatcgaaaatttcgcccaggcgtttggctcacagtttaagtctggttcgagagtgcctatgacatttatcactaattcaaatggcgaagtggaccaccgtgttcggaccagcgtgtctgattttagtggctataccaatatgatgagtgatgtttccgaaccttgtagcacacgagtgaaaacccccaccagtcagagttatcgatag

SEQ ID NO: 21416 - DNA, 1803 bp, Artificial Sequence
  Description of Artificial Sequence: Synthetic coding sequence
atgggcttcatccagaagtacctgctgcagcggcacgagaagatccacagtagagaaaagccttttggatgtgatcagtgctcaatgaaattcatacagaaataccacatggagagacataagcggacccactcgggtgaaaagccctacaagtgtgatacctgtcagcagtatttttcgagaactgatcggctcctgaaacaccggaggacctgcggcgaagtaatcgtaaagggcgctacctcggccgagccaggctcaagcaaccacacgaatatgggcaacttggctgtgctctctcagggaaatacaagctcttctcgaaggaagacaaagtctaagagtattgccatcgagaataaggagcagaagaccgggaagacgaatgaaagtcagataagcaataatataaatatgcaatcctactccgtcgagatgcctactgtctcatcaagtggcggcataatcgggaccggcattgatgaactgcagaagcgcgtgcctaaactcattttcaaaaaaggctcccggaagaacaccgataaaaattatctgaactttgtcagcccactccccgacattgttgggcaaaaatccctatcggggaaaccgagcggcagtctgggaattgtgtccaacaactcagtggagaccataggcctgcttcagtctacatctgggaagcagggccagatcagcagtaattacgatgatgctatgcagttcagtaagaagcggcggtatctgcctacagcttcaagcaattcagctttttccataaatgtcggtcacatggtgtctcaacagagtgtcatccagagtgccggtgtttcggtgctggataacgaggccccactgtctctgattgacagtagtgccctaaatgcggaaatcaagtcatgtcacgacaagtctggcattcctgacgaagtacttcaatccattctggatcagtatagcaataaaagtgaatcccagaaagaggacccgtttaacatcgcagagccgcgggtcgatttacacacctcgggggaacatagcgaactggtgcaggaggaaaatctcagtccaggaacacagacaccttccaacgataaagcctccatgctacaagagtatagcaaatatttacagcaggcattcgaaaagagtactaatgcctcattcactctggggcatggctttcagtttgtgtcgctgtcaagccccctccacaaccacactctctttcccgagaagcagatctacacgacgagccctttggagtgtggatttggccagtccgtgacctcagtactgccaagttctctgcctaagccaccatttggcatgctcttcggctcacagccaggactttacctgtccgctttagacgccacccaccagcagttaactccaagtcaagaactggatgatctcattgactctcagaaaaatctcgaaacaagcagcgctttccagtcttccagccagaaactgaccagccagaaagagcaaaagaacctcgagagttccaccggcttccagataccatcccaagagctggctagccagatagacccccagaaggacatcgagcccagaaccacatatcaaattgagaacttcgcccaggcctttggctcacaattcaaatcaggcagtagggtaccaatgactttcattacgaactccaacggggaagtggatcatagagtcagaacatccgtttcggatttctcaggctacacaaacatgatgagcgatgtctcagagccatgtagcacgcgggtgaaaacccccacttctcagtcttaccgttag

SEQ ID NO: 21417 - DNA, 2016 bp, Artificial Sequence
  Description of Artificial Sequence: Synthetic coding sequence
atgcagttcgtgagcacccggccccagccccagcagctgggcatccaaggcctggggctggactcaggctcatggtcgtgggcccaggccctgccaccagaagaggtctgccatcaggagcctgctctgcggggtgaaatggccgaaggcatgccccctatgcaagcccaagagtgggacatggatgctagacgcccaatgccctttcagttccctccgttcccggaccgcgcaccagtctttcccgatcggatgatgcgcgaacctcaactgcccaccgccgaaatttccctgtggactgtagtcgcggctatccaggcagttgaacgtaaagtggatgctcaggccagccaactgctaaatctggagggccgcacaggaactgctgagaaaaagcttgccgattgcgagaagaccgcggttgagttcggcaaccacatggagtcaaaatgggctgtcctggggacactactccaggagtatggcctcttgcagagaaggctggagaaccttgaaaatctcctcaggaaccggaatttctgggtgttgcgcctacccccagggtctaagggcgaggcaccaaaagtgccagtcacatttgtggatattgccgtatattttagtgaagacgagtggaagaacctcgatgagtggcagaaagaactgtacaacaatcttgtcaaagagaactataagaccctcatgtctcttgatgcggaggggtcagtgcccaagccggatgcgcctgtgcaggccgaacctcgagaagaaccgtgcgtttgggaacaaaggcatcctgaggagcgcgaaataccaatggacccagaagctggagctgagccactggttcccgcacaagacgccagctctcaggtaaagagggaggatactctgtgtgttagaggtcagcgaggtctggaggagcgcgccataccgactgaatctatcacagactcgccaatctccgcccaagacctgctgagcaggatcaaacaggaagaacaccagtgcgtctgggatcagcaggatctcgcagaccgcgatattccgacggatccaaatagtgaatcccttattagtgcccatgatatcctttcttggatcaagcaggaggaacaaccctatccatggggaccgagggatagcatggacggtgaacttggcctggacagtgggccaagtgacagtttgttgatggtgaagaacccacctcccgcacctccacagccccaaccgcagccgcagccaccgcagccacagctccagtcacagccacagcctcaaagtttaccacccatcgcagtggctgaaaaccccggaggtcccccaagcagaggtttactggatgacgggttccaggttctgcctggggagcggggatctggggaggcccctcccggaggtgatcgaagtacaggaggaggggggggagacgggggtggaggcgggggtggggctgaggcaggaacgggggccggaggcggatgtgggagctgctgccccggaggtctgcgcaggtcactcctcctccacggggctaggagcaagccgtattcatgccctgaatgtggcaaaagtttcggcgtgaggaaaagcctaattattcaccatcgatcccacacgaaggagagaccttacgaatgcgcggaatgtgaaaaatcttttaattgtcactccggactgatccggcaccagatgacccacaggggagagaggccgtacaagtgctcagaatgcgaaaaaacttattcaaggaaagaacatctccaaaaccaccagagactgcatactggtgaacgccccttccagtgcgcgctgtgcggaaagtcttttattaggaagcagaatctactgaaacatcagcgcatccacactggcgagcgcccctacacatgcggggaatgcggtaagtccttcagatataaagaatctctgaaggatcatctcagggttcactccggaggaccaggtcccggggctcctcgccaactccctccacctcctgagagagattag

SEQ ID NO: 21418 - DNA, 975 bp, Artificial Sequence
  Description of Artificial Sequence: Synthetic coding sequence
atgcgggagccccagctgcccaccgccgagatcagcctgtggaccgtggttgccgccatccaggccgtggagcgtaaggtcgacgctcaggccagccagcttttgaacctcgaaggtaggacaggaaccgccgaaaagaaactggctgactgcgagaaaactgccgtggaattcgggaaccatatggaatcaaaatgggcggtccttggcactctcctacaggagtatggtctcctgcaaagacgactcgagaatctcgaaaaccttctaaggaatagaaacttttgggtcctgcgcctgccacctggttcaaagggagaagccccgaaggtcccagtgacttttgtcgacattgccgtatattttagcgaggatgagtggaaaaatctagatgaatggcaaaaggaactatataataacttggtcaaggagaattacaaaacactgatgtccctggatgctgaaggctcagtgccgaagcctgacgcccccgtgcaggctgagcccagctatagttgcccagaatgcggcaaaagttttggcgtgagaaaatcactgattattcaccatagatctcacaccaaggagcggccttacgaatgtgcggagtgtgagaaatcatttaactgccacagtggcctgattcgtcatcagatgacccatagaggcgagcggccatacaagtgctccgagtgtgaaaagacatactcccgcaaagagcaccttcagaatcaccagcgcctgcatacaggggagcggccattccagtgtgcactgtgtggcaaatcattcattagaaaacaaaacctcctaaagcatcaacggatccataccggcgaaagaccttacacatgtggcgaatgtggcaaatccttcagatacaaggaaagcctaaaggaccatcttcgagtgcactctgggggtccagggccaggcgcgcctaggcagttaccgccacctccagagagggactag

SEQ ID NO: 21419 - DNA, 1392 bp, Artificial Sequence
  Description of Artificial Sequence: Synthetic coding sequence
atgcagttcgtgagcacccggccccagccccagcagctgggcatccaagggctggggctggactcgggctcttggtcctgggcccaagctttgccacccgaagaagtatgccaccaggagcctgcgttacggggtgagatggcggagggcatgccgcctatgcaggcccaggaatgggatatggacgcacggagacccatgcccttccagtttcctccttttccagatagagccccggtgtttcctgatagaatgatgcgcgagccacagctgcccacagctgaaatcagcctgtggacggtggtggccgcaatccaggccgtggaaaggaaggtcgacgcccaagctagccagcttctcaatctggaaggcaggactggcaccgctgaaaagaagttggcagattgtgaaaaaactgcagtggagttcgggaaccacatggagagtaagtgggcagtattgggcaccctcttacaagaatatgggctcctccaacggcgactggaaaatttagagaacttactgcgaaaccgtaacttctgggtgttgcgcctcccccctggatccaagggggaggcccctaaggtcccagtcacctttgttgatatcgctgtgtacttctctgaagatgaatggaaaaacctggacgaatggcagaaggagctgtacaataatctggtcaaggaaaactacaagacattaatgtccttggacgctgagggttctgtccctaaaccggacgccccggtgcaggccgaacccagagaggaaccatgtgtctgggagcagagacaccctgaagaaagggaaattccaatggaccccgaggccggcgccgaaccactcgtccccgctcaggatgcgagttctcaagttaagagagaagatacactgtgtgtcagaggacaaagaggcctggaggaacgggctataccaaccgagagcattacggacagtccaattagcgctcaggatctccttagccggatcaaacaggaagaacaccagtgcgtatgggaccagcaggatctggccgaccgcgatatcccaacagatccaaactccgagtcactaatttcggcccatgacattctctcgtggataaagcaggaagaacagccatatccttggggaccgagagattccatggacggagaactcgggttggacagcggtccatctgactctttgttgatggtcaagaaccctcctcccgccccaccacagcctcagcctcagccccaacccccccagccacagcttcaatctcaaccccagcctcagtcactgcctcccatcgcagttgccgaaaaccctggaggtcctccttcccggggacttctcgacgatgggttccagccccatcagggcgctgcgttacgggttaggtag

SEQ ID NO: 21420 - DNA, 252 bp, Artificial Sequence
  Description of Artificial Sequence: Synthetic coding sequence
atgttcgagagctgcagcggcttcagcggcttctgcgccagccccattgaagaaagtcacggagctttaatttctagctgtaattcccgaacaatgaccgacggactggtgactttccgcgatgtggccatcgatttctcgcaggaggaatgggaatgcctcgatcctgcacagagggatctgtatgtcgatgtgatgctagaaaactacagcaaccttgtgtccctggggaaggtcatttgcttaaagtag

SEQ ID NO: 21421 - DNA, 2040 bp, Artificial Sequence
  Description of Artificial Sequence: Synthetic coding sequence
atggagagccggagcgtggcccaggccggcgtgcagtggtgcgaccttggcagcttgcaggcccctccccctggattcaccctgttttcctgtctgagcttactgtccagctgggactacagttccggattctccggcttttgtgcttcgccaatcgaagaaagtcacggagctcttattagctcgtgtaattctaggaccatgaccgatgggttagtgactttccgggacgtggcgattgatttctcacaggaagaatgggaatgtcttgatccagcccaacgcgacctgtacgtagacgtcatgttagaaaactattcgaaccttgtatccctggatctagagtctaagacctatgagaccaagaaaatcttctctgaaaacgatatcttcgaaatcaattttagtcagtgggaaatgaaggataagagcaaaaccctggggctggaggcatccatttttcggaacaattggaagtgtaagagcatctttgagggcctgaaggggcatcaggagggatacttcagccagatgatcatcagttatgaaaagattccttcctaccgaaaaagcaaatcgctcacacctcaccagaggatccataacactgaaaagagctatgtttgcaaagagtgcggcaaggcatgttctcacggatctaagctggtgcaacacgagaggacccatactgctgaaaagcacttcgagtgcaaagagtgtggaaagaattacctgtccgcataccagctcaatgtacatcaacggttccataccggcgagaagccttatgaatgtaaagagtgcggcaagaccttcagctgggggtcttcgctggtcaaacatgaaaggatacacaccggtgaaaaaccctacgaatgcaaagaatgcggcaaagccttctctaggggctatcacctcacccagcaccagaaaattcacacaggggttaagtcctacaagtgcaaggagtgtggtaaggcttttttttggggatcttcactggctaagcatgagatcatccacaccggcgaaaagccatacaaatgtaaggagtgcggaaaggccttttcacggggctaccagctaacccagcaccagaaaatccatacggggaagaaaccctacgagtgtaagatttgcggtaaggcgttttgttggggataccaactgacaagacaccaaatttttcatactggggagaaaccttacgaatgcaaggaatgtggtaaggcctttaactgtggctcatcccttattcaacacgaaagaatacacacaggtgaaaagccgtacgagtgcaaggaatgtggtaaagccttttccagaggttatcatctgtcccagcaccagaagattcacacaggggagaaaccatttgagtgtaaggagtgcggaaaggcctttagttggggctcaagtctggtaaaacacgaacgagttcacacgggagagaaaagccacgagtgcaaagagtgtggcaagaccttctgctcggggtatcagttaacacgtcaccaggtgtttcacaccggggagaagccttatgagtgcaaggaatgtgggaaggcctttaactgcgggtcgagcctggtccaacatgaacggatccacactggagagaaaccgtacgagtgcaaggagtgcggaaaagcgtttagtcgcggataccatttaacacagcaccagaaaattcacacaggcgagaaacctttcaagtgcaaggagtgcggaaaagcattcagttgggggtcaagcctcgtgaagcacgaacgggtgcacactaatgaaaaatcatacgaatgcaaagactgcggcaaggcctttggctcagggtatcagctgagtgtacatcagaggttccatactggggaaaaactttaccagcggaaagaatttggcaagacctttacgtgtgggagcaaattagttcacgagagaactcattcaaatgataagccctacaagtacaatgagtgcggcgaagccttcttatggactacttactctaacgaaaaaatcgatacagatgaaactctatag

SEQ ID NO: 21422 - DNA, 1782 bp, Artificial Sequence
  Description of Artificial Sequence: Synthetic coding sequence
atgaccatgttcaaggaggccgtgaccttcaaggacgtggccgtggtgttcaccgaggaagagttgggattgttggacgtaagccagagaaaactgtatcgcgatgtgatgctggaaaactttagaaatttgctgtccgttgggcaccaactctctcaccgggacactttccacttccagagggaagagaagttttggattatggaaacagctactcagcgcgagggcaatagcggcggaaaaatccagaccgaattagagagtgtgccagaaacggggccccacgaagagtggtcgtgccagcagatctgggaacagacggccagcgagctgactaggccccaggactccatcagctcttcccagtttagtacccagggtgacgtgccttctcaggtagacgccgggctctcaatcattcacattggcgaaacacccagcgagcatggcaaatgtaaaaaattcttcagtgatgtgtctattctggatctgcaccagcagctgcattccggcaaaattagccacacctgcaatgagtacaggaaaagattttgctattctagcgcgctgtgcttacaccagaaagtgcacatgggggagaaaaggtacaagtgtgacgtttgtagtaaggcatttagccagaactcccagttacagacacatcagagaattcacactggggaaaaaccgttcaagtgtgaacagtgcgggaagtcattttcgaggcggtcgggtatgtacgttcactgtaagttgcatacaggcgaaaaaccccacatttgcgaggagtgtggaaaagcattcatccataactcgcaacttcgggagcatcagaggattcacacaggggaaaaaccgtttaagtgttacatctgcggaaagtccttccactcaaggtccaacctcaacaggcattcaatggtgcatatgcaggagaagagttttcgatgtgatacttgctctaacagctttggacagaggtctgccctgaatagccactgtatggaccacactaaggaaaagctgtataagtgcgaagaatgcgggagatcttttacttgtaggcaagacctgtgtaagcaccagatggaccacactggtgacaaaccgtataattgcaacgtatgcggcaaaggctttagatggtcctcctgtctgagcaggcatcagcgcgtacacaatggcgagaccaccttcaaatgtgatggttgtggtaagcggttttatatgaatagccaggggcattcccaccagcgagcttatcgcgaggaagaactttacaaatgccagaaatgtggcaagggttacataagtaaatttaatctcgacctccatcagcgggtgcatacaggcgaaaggccatacaattgtaaggaatgcggaaaatctttccgttgggctagtggaattctcagacataagcggcttcataccggagagaagcctttcaagtgtgaggaatgcggtaaacgatttaccgagaatagcaagttgagattccaccagcgcattcacaccggggaaaagccctacaagtgcgaggaatgtggtaaagggtttcggtgggcgtcaacccaccttactcaccagcgtctacattcacgtgaaaaactgttccagtgtgaggattgcggtaagtcttccgaacattcaagttgtctccaggatcagcagtcagaccatagtggtgagaagacttctaagtgcgaggactgtgggaagcgatatgagagaagattgaatcttgacatgattctgtcactgtttttgaacgatatctag

SEQ ID NO: 21423 - DNA, 2739 bp, Artificial Sequence
  Description of Artificial Sequence: Synthetic coding sequence
atgatcaagttccagatggtgaccttcaaggacgtggccgtggtgtttaccgaggaggagctgggcctgttggactctgtccagcgaaagctgtatcgggacgtcatgctcgagaatttccggaatctcttgctggtggcccatcaacctttcaaaccagatctgatctcacaactggagcgcgaagagaaactcctaatggttgagactgaaaccccccgcgatggttgctccggccggaaaaatcagcagaagatggaatcaattcaggaagttaccgtctcttacttctcacccaaagagctttcaagtcggcagacctggcaacaatccgcgggtggtttgatcagatgccaggatttcctgaaagttttccagggcaagaactcccagctgcaggaacaggggaatagcctggggcaggtctgggcggggattcccgtccaaataagcgaggacaaaaattacatttttactcatatcggtaatggcagcaactatattaagtctcaaggttatccaagttggagagcgcatcatagctggcgtaagatgtatttaaaggaatcccacaactatcagtgccggtgccaacagatttcaatgaaaaaccacttctgcaagtgtgattcagtctcctggctgtctcaccataacgataaacttgaggtgcatcgaaaggagaattacagttgtcatgactgcggggaggatataatgaaagtcagtctgctgaaccaggaatccatccagaccgaagaaaagccttatccttgcaccggctataggaaggcctttagcaatgattcatcgtcagaagttcaccaacagttccacctggagggtaaaccatacacttactcaagctgtggaaaaggctgcaattattccagcctgctgcatatccaccagaatatcgagcgagaagatgacattgagaattcccacctgaagtcctaccagcgggtccacactgaagagaaaccatgtaaatgcggtgaatacggcgagaacttcaatcactgctcacctttgaatacgtatgagttgattcatacgggcgagatgagctacaggcataacatttacgagaaggcttttagccacagtttggatctcaacagtattttccgtgtgcacacacgcgacgagccccacgaatatgaggagaacgagaatgttttcaatcaaagcagctgcctccaggtccaccagaaaatccacacagaagaaaagttgtataccgatattgagtatggtaaatcatttatctgcagttctaatttagacatccagcatagggttcatatggaagagaatagctacaacagtgaggagtgtggtaacggtttctctctggccagccatttccaggacctgcagattgtccatactaaggaacagccctataagcggtacgtgtgcagcaactcgttctcacataacctctatctgcagggccaccctaagatccacattggggaaaaacctcgtaaagagcacgggaatgggttcaattggagttcaaagctcaaggaccaccagagagtccacaccgggcaaaagccctataagtgcaacatctgcgggaagggcttcaatcatcggtcagtcctgaatgtgcaccagcgagtccacaccggggagaaaccttacaagtgcgaagaatgcgataagggtttttcccgctcatcttatctacaggcgcaccaacgagttcatacaggcgagaagccgtacaaatgtgaagaatgcgggaagggctttagtaggaattcatacttgcaggggcatcagcgggtgcacacaggcgagaagccttacaagtgcgaagagtgtggaaaggggttttcacgttcatcacatctccagggccatcagagagtacacacaggcgagaaacccttcaagtgtgaggagtgcgggaagggcttttcctggtctttcaacctgcagatacaccagcgggtccataccggtgagaagccatacaagtgtgaggaatgcgggaaggggttttccaaggcatcaaccttgctggcgcatcagagggtgcataccggggagaagccttaccagtgcgatgagtgcggtaagtcttttagccaacgctcataccttcagagtcaccagtcagtgcattctggagaaagaccttatatctgcgaagtgtgcggcaaaggatttagtcagcgtgcctacctccaaggacatcagagagtgcacacccgtgtgaagccttacaagtgcgagatgtgcggcaaaggctttagccagtcgagtcggcttgaggcacatagaagagtccacacagggggtaagccttataaatgcgaggtttgcaccaaaggcttctcagaaagcagccgtctacaggcccaccagagagtccacgtggaaggtcgtccctataaatgcgagcagtgcgggaaaggcttttcgggctactcttccttgcaggcacatcacagagtccacactggcgaaaaaccttacaaatgcgaggtttgtgggaagggctttagccagcgcagcaacctgcaggctcatcaaagagtgcacaccggggagaaaccctacaaatgtgatgcctgcggtaaaggattccggtggtccagcggattattaatccatcagagggtgcactcaagcgataaattttataaaagcgaagactacggcaaggactatcctagtagtgaaaatctccatcgcaatgaggattcggttctgttctag

SEQ ID NO: 21424 - DNA, 1773 bp, Artificial Sequence
  Description of Artificial Sequence: Synthetic coding sequence
atgatcaagttccaggagcgggtgaccttcaaggacgtggccgtggtttttacaaaagaagagctagccctcctggacaaggcacagatcaatttgtatcaggatgtgatgcttgagaactttagaaatctcatgcttgtgagggacggaattaagaacaatattctaaatctgcaagccaagggactgtcctatctgtcgcaggaggtacttcattgctggcagatctggaagcagaggattcgggatttaaccgtatctcaggattacattgtgaacctccaggaagagtgctcccctcatctggaggacgtgagcctgtctgaggaatgggcaggtatttcgcttcagatctccgaaaacgagaattatgttgtgaatgccattatcaagaatcaggatattaccgcgtggcagtcgctcacacaagtgctgacccctgagagttggaggaaggccaacattatgacagagcctcagaactctcaaggtcgatacaaagggatctatatggaagagaaactctacaggcgagctcagcacgacgactcactgagctggacttcttgtgatcatcacgaatcacaggagtgcaagggcgaagatcctggacggcacccaaactgcggtaagaacctaggcatgaagagcacagtcgagaagagaaatgcagctcacgttctgccacagcccttcccctgtaataattgtggcgtggcctttgcagatgatacggatcctcacgtacatcactccacgcatctgggggaaaagtcatataaatgtgatcaatacgggaagaacttctcacagagccaagacttaatcgtccactgtaagacccactccgggaagaccccctatgagtttcacgagtggcccatgggctgcaaacagagctcagaccttcctaggtatcagaaggtgagttccggcgataagccgtacaagtgtaaggaatgcgggaagggctttaggaggtccagttcgttgcacaaccatcaccgggtacacactggggaaatgccatacaagtgtgacgaatgcggtaaaggctttgggttccgcagtctgctgtgtatccatcagggagtgcataccggcaagaaaccgtataaatgcgaggaatgcgggaaaggattcgatcagtcctctaacttgttggtgcatcagagggttcataccggagagaagccatacaagtgtagtgagtgtgggaagtgctttagtagctcatctgtgcttcaggtgcactggagattccatacaggggagaagccctataggtgcggggagtgcggcaagggcttctctcagtgcacacacctgcacatacatcagcgggtccatacaggggagaagccctacaaatgcaacgtctgtggcaaggacttcgcctacagcagcgttcttcacacacatcagagagtccataccggcgagaagccatataagtgcgaagtatgcggcaaatgtttcagttatagttcatattttcacttgcaccaaagggatcatattagagagaaaccttataaatgtgatgagtgtggtaaggggttctctaggaactcagatctgaatgttcatctgcgagtccacacccgggagagaccttacaaatgcaaggcctgtggcaaagggttctcccggaactcttatttgttggcccatcaacgggtgcacattgatgaaacacagtacacccattgtgagcgcgggaaggatttgctaacccaccagagactgcatgaacagagagagaccctgtag

SEQ ID NO: 21425 - DNA, 2742 bp, Artificial Sequence
  Description of Artificial Sequence: Synthetic coding sequence
atgaccaagttccaggagatggtgaccttcaaggacgtggccgtggttttcaccgaagaggaattaggattactcgattctgttcagcggaaactgtatcgggacgtcatgctcgagaactttcgaaacctacttcttgtagcgcaccagccatttaagcctgacctaattagccagcttgaacgcgaagaaaagctgcttatggtcgaaactgaaacccccagggacggctgcagcggcagaaagaaccagcaaaagatggagagcatacaggaagttacggtatcttattttagccccaaggaattaagctcccgtcaaacatggcagcagtccgctggaggcctgatccggtgccaggactttctgaaggtgttccaggggaagaactctcaactgcaagagcaaggtaactccctgggacaggtttgggccggtataccagtacagattagtgaggacaaaaactatatcttcacccacattggaaacggctcgaactacataaagagccagggttatccctcctggcgtgcacaccacagctggaggaagatgtatcttaaggaatcccataactaccaatgtagatgccagcagatcagcatgaaaaaccacttctgtaagtgtgattcagtgtcatggttgagccatcacaatgacaagctggaagtccatcggaaggagaactattcatgccacgactgtggagaagatataatgaaagttagcctattgaatcaggagtcaattcagacggaagaaaagccttatccctgtaccggctataggaaggcctttagcaacgattctagcagcgaggtccaccagcagtttcacctagagggcaaaccctatacttactcatcctgcggaaagggctgtaactactcatcactactgcacatccatcaaaacatagaaagggaggatgatatcgagaatagccacctgaaatcctatcagcgtgtacataccgaagagaagccctgcaaatgcggagagtatggcgagaatttcaatcactgttccccccttaatacatacgagttgatccacacaggtgaaatgtcatacaggcacaatatttacgaaaaagcatttagtcatagcctcgatctgaacagtatctttcgcgtccatacacgtgacgagccccatgaatacgaggaaaatgaaaatgtgttcaatcaatctagttgtttgcaagtccatcagaagatccacactgaagaaaagctgtataccgatatagagtacggaaaatcatttatctgttccagtaatctcgacattcagcatagggttcacatggaggagaactcctataactcagaggagtgcggtaacggctttagtcttgcaagtcactttcaggacctccagatcgtacatacgaaagagcagccctataagcgatacgtgtgttccaactcattcagtcacaatctgtatctgcaggggcacccgaaaatccacattggcgagaagccccgaaaggaacacgggaatggattcaactggtcctccaagctaaaggatcaccagcgggttcacacaggtcaaaagccatacaagtgtaacatctgtggaaagggcttcaatcacagatctgtccttaacgtgcaccagagagtgcacacaggggagaaaccttacaaatgtgaggaatgcgacaaagggttttcaagaagctcttatctgcaagctcatcagagagtgcatacaggtgaaaaaccttacaagtgcgaggagtgcggcaagggcttcagcaggaattcctacttacagggccaccagcgcgtgcacacaggggaaaaaccatacaagtgtgaggaatgcggaaaaggattctccagatcatctcacctccaaggacatcagagagtccatactggcgagaaaccgtttaaatgcgaagagtgtgggaagggtttcagttggtcttttaacctccaaattcatcagcgcgtccacacaggggagaagccgtacaaatgtgaggagtgcggtaagggattttctaaggcatccactctgcttgctcatcagcgtgtgcatacaggagaaaagccctatcagtgcgatgaatgtggcaagtctttcagtcagcggagttacctgcagagtcaccagtcagtccattctggcgagagaccttatatttgtgaggtgtgcggtaagggcttttcccaacgcgcttatcttcaaggacaccaacgcgttcacacgcgtgttaagccatacaaatgtgagatgtgcggaaaaggctttagtcagtcatcaaggctggaggcccacaggcgtgtccacacaggggggaaaccttacaagtgcgaggtgtgtaccaaagggttttccgagtcatctcggctgcaagctcatcaacgcgtgcacgtggaagggagaccctacaagtgtgaacagtgcgggaaggggttctccggctattcctccctgcaggcacaccaccgcgtacacaccggcgagaagccctacaaatgtgaagtttgtggcaaggggttctctcagaggtccaacctgcaggctcaccagcgcgtacacacaggggagaagccatacaaatgtgatgcatgtgggaagggcttccgctggtcatcagggctactcattcatcagagagtgcattcttcagacaaattctacaaatcagaggactacggaaaagattacccgtccagtgagaatctgcacaggaatgaagacagcgtcctattttag

SEQ ID NO: 21426 - DNA, 2724 bp, Artificial Sequence
  Description of Artificial Sequence: Synthetic coding sequence
atggtgaccttcaaggacgtggccgtggtgttcaccgaggaggagctggggctcctcgatagcgtgcagagaaagctctatcgtgacgtcatgctagaaaactttaggaatctcttgttggtcgcacaccagcctttcaagccagacttaatctcccagctggagagagaagagaagttactaatggtggaaacagaaacgcccagggacgggtgttcaggcaggaaaaaccaacagaagatggaatctattcaggaagtgaccgtcagttacttttcgccaaaagaactaagctcccggcagacctggcagcaatcagccggcgggctcattcgatgccaggatttcctcaaggtgttccagggaaagaactctcagctgcaggagcaaggtaatagcctcggacaggtttgggctgggatccccgtacagatctccgaggacaaaaactacatttttactcacatcggtaacggctcaaactacattaagtctcaggggtatccttcctggagagctcatcacagttggcggaagatgtacctcaaagagtcgcataactaccagtgccgctgtcagcaaattagtatgaaaaatcacttttgcaagtgcgactcagtctcctggttatcccaccataatgacaaactagaggtgcataggaaggaaaattattcttgccacgactgcggcgaggacatcatgaaggtgtctctgttaaatcaggaatctattcaaaccgaagagaagccttacccttgtacaggttatcgcaaagccttttccaacgactcatcctcagaggtccatcagcagttccacctcgagggaaagccctacacctacagttcgtgtggaaaaggttgtaattatagcagcctgctccatattcatcagaacatcgagagagaagatgatatcgaaaatagtcatctcaaatcttaccaaagagtccatactgaggagaagccatgtaaatgcggggaatacggggaaaattttaatcattgctcacctctgaacacttacgagctgattcatactggagagatgagttaccgtcacaacatctacgagaaggcgttctctcactccctggatctcaactcaattttccgagttcacacaagggacgagccccacgaatacgaagagaacgaaaacgtgttcaaccaatctagctgtctccaggtgcaccagaaaatccacactgaggaaaagctgtatacagatattgaatatggcaagtctttcatctgttccagcaatctggatatccaacaccgcgttcacatggaggagaactcgtataattccgaagagtgtggaaatggattctctctggccagccacttccaggacttgcagatcgttcacacgaaggagcagccatataagagatacgtgtgctctaacagtttcagtcacaacctgtacctgcagggccatccaaagatccacattggtgaaaagccccggaaggagcatggaaatggctttaactggagcagtaaacttaaagatcatcaacgcgtccataccgggcagaaaccgtacaagtgcaatatctgtgggaaggggttcaaccacagatcagtgttgaatgtgcaccagagagtgcataccggtgaaaagccatacaaatgcgaagagtgcgacaagggattcagtcgttctagttacctccaggcccatcagagagtccataccggcgaaaaaccctataagtgtgaagagtgtgggaaagggtttagcaggaactcctacctacaggggcaccagagggtgcacacaggcgagaagccatataaatgcgaggaatgcggcaaaggattctctcgctccagccacctgcagggccaccagagggtgcacaccggggagaagcccttcaaatgtgaggaatgcggcaaaggctttagctggtcgtttaacctgcagattcaccagcgcgtccacactggggagaagccctataaatgcgaagagtgtggaaaaggcttctcgaaagccagcaccctcctggcccaccaaagagtgcacactggagagaaaccataccagtgcgacgagtgtggtaagtcttttagccaaaggtcctatcttcagtcccaccagtccgtgcactctggagagagaccatatatctgtgaggtctgcgggaaaggattttcccagagagcttacctccagggccatcaaagagtccacactagggtaaagccgtacaaatgtgaaatgtgtggcaaagggttttctcagtcctcaaggctagaggcacaccgacgggttcacaccggtggcaaaccttacaagtgcgaggtttgtacaaaagggttcagcgagagtagtcggctccaagctcaccaacgagtccacgtggagggacgcccttacaagtgtgaacagtgtggaaaagggttttctggttattcctccctccaggcacatcacagggtgcacactggagaaaaaccttataagtgtgaggtatgtggaaagggtttttcgcagcggagtaatctccaagctcatcagcgggtccacacaggagaaaagccttataaatgtgacgcatgcggaaaaggttttcggtggtcgagtggattgctgatccaccaacgcgtacatagcagtgataagttctacaagtcagaggactatggcaaggattacccctcatccgagaatttacatcggaatgaagactcagtcctcttctag

SEQ ID NO: 21427 - DNA, 2742 bp, Artificial Sequence
  Description of Artificial Sequence: Synthetic coding sequence
ctgaccgtgtgccaggagatggtgaccttcaaggacgtggccgtggtgtttaccgaggaggagctgggcctgctagactccgtccagaggaaactctacagggacgtgatgttggaaaacttccgcaacctgctgctcgttgctcaccagccatttaagcccgatctgatctcccagcttgaacgcgaagaaaagcttcttatggttgagaccgaaacaccccgggacgggtgttctggcaggaagaatcaacagaagatggaaagcatccaggaggtgactgttagctatttctctcccaaagaactctcttcaagacaaacgtggcagcagagtgccggaggactcatacgctgccaggacttcctcaaggtgttccaaggaaagaacagccaattgcaggagcaaggcaactccctagggcaggtgtgggccgggattccggtgcagatatccgaagacaagaactatattttcacgcatattgggaacgggagcaattacataaaatcacaggggtacccatcgtggcgcgctcaccatagctggaggaagatgtatctcaaggaaagccacaattaccagtgccggtgccagcaaatctccatgaaaaaccacttctgtaagtgtgactctgtctcctggctaagccaccacaatgacaaactagaagtccacagaaaggagaattacagctgtcatgactgcggggaagatattatgaaggttagtctgctgaatcaggagtctatacagacagaagagaagccctacccctgcaccggatataggaaggctttctctaatgactccagtagcgaagtgcatcagcagtttcatctcgagggaaagccctacacatactccagctgtgggaagggctgcaactactcatctctgctgcatatccaccagaatatagagagagaagatgacattgaaaattcacatcttaaatcataccagcgggtgcatacggaggagaagccatgtaaatgcggggagtacggagagaatttcaaccactgtagccctttgaacacatatgagctcatacatacaggagagatgtcttatcgccacaacatctatgagaaagccttttcccattcactggatcttaattccattttccgggtacatactcgcgacgagcctcatgaatatgaggaaaacgaaaacgtctttaaccagtcatcatgcctgcaggtacatcagaagattcacactgaagagaaactgtacacggatatagaatacggaaaatcttttatctgctcgtcaaatctagacatccagcacagagtgcatatggaggaaaacagttacaactcagaggaatgcggcaatggttttagcctggcgagtcactttcaggacctgcaaatcgttcacaccaaagaacagccctacaagcgatacgtgtgtagcaactcttttagtcacaacctgtacctgcagggccaccctaagatccacatcggcgagaaaccgcggaaggagcacggcaacggctttaattggagttccaagctgaaggatcatcagagagtgcacacagggcaaaagccctacaaatgtaacatctgtgggaaagggtttaaccacagatccgtcctgaatgtccaccaacgagtgcatactggggagaaaccctacaagtgtgaggaatgcgataagggatttagccggagttcttacctccaggcccaccagcgggtccacaccggagaaaagccctataaatgcgaggaatgcggaaagggcttctccaggaactcatatcttcagggacaccagcgcgtccacaccggggaaaagccatacaaatgtgaagaatgcggaaaaggtttctccaggagttcacatctgcaggggcaccagagggtgcacaccggcgaaaaacccttcaaatgcgaggaatgtgggaagggattctcttggagcttcaatctgcagatccatcagcgagtgcacaccggagagaaaccctataaatgtgaggaatgtggcaaggggtttagcaaagcttccacactgctcgcacatcaacgggtacacactggcgagaaaccctatcagtgcgatgagtgcggcaagtctttcagccagcgaagctatttgcaaagccaccagtcagtccatagcggggagcgcccctacatttgtgaagtttgcggtaaaggcttcagccagcgcgcttaccttcaaggtcatcagcgcgtgcatactcgggtcaagccttacaagtgcgaaatgtgtgggaagggcttttctcagtcaagtaggctcgaggctcaccgtcgggtgcatactggaggcaagccatacaagtgcgaagtgtgcactaaggggtttagcgagagctccaggctgcaggcccaccagcgcgtgcatgttgagggaaggccttacaagtgtgagcagtgtgggaaaggctttagcggctactcaagcctgcaggcccaccacagagtgcatacaggggaaaagccgtataaatgcgaagtgtgcggaaaaggcttttcccaacggagtaacttgcaagcccaccagagagtccacacaggggagaaaccatacaagtgtgatgcttgcggaaagggatttcgatggagctctggcttattgatccatcagcgagtccacagcagtgataagttctacaagtcagaggattacggcaaggactacccaagctccgaaaatctccatcgcaacgaggattcagtactcttttag

SEQ ID NO: 21428 - DNA, 2793 bp, Artificial Sequence
  Description of Artificial Sequence: Synthetic coding sequence
atgggcctgggcccccggagcctgcccttcagccggaagcggaagcggaagatgaccaagttccaggagatggttacgtttaaggatgtggctgtggtattcaccgaagaagagcttgggcttttagacagcgtgcagcgcaagctgtatagagacgtgatgctcgagaattttagaaatttactgctggtcgctcaccagccattcaagccagacctgatatcacaactggaacgtgaggaaaaattgctcatggtagaaacagaaacaccgagagacggctgctcaggccgcaagaaccagcagaaaatggagtccatacaagaagtgacagtgtcctactttagccctaaggaactttcctctcgccaaacctggcagcagtcagccggaggactaataaggtgtcaggactttctgaaggtatttcagggtaaaaactcacaattgcaggaacagggcaactcattaggccaggtgtgggcagggattcctgtacagatcagcgaggacaaaaattatattttcactcacattggaaatggctccaactacatcaaaagccaggggtatccttcatggcgggcccaccattcctggagaaaaatgtacctgaaggagtctcataattatcagtgtcgctgccagcagatcagtatgaagaatcacttctgcaagtgcgatagcgtgagttggcttagccaccacaatgataaactggaggtgcacagaaaagaaaactacagctgtcacgactgcggggaggacataatgaaagtcagcttgctaaaccaggagtctattcagaccgaagagaaaccctacccatgcacggggtacagaaaagcattttcaaacgactcctcctcagaggtccatcaacagtttcacctcgaggggaagccctatacctatagctcatgcggaaaaggatgtaattattcatctctgttgcatattcaccaaaatattgagcgagaggacgatattgagaattcccatctgaaaagctaccagcgtgtgcacacagaagagaagccctgtaagtgcggtgagtacggtgaaaatttcaaccattgtagccctttgaacacctacgagctgatccacacaggcgagatgtcgtatagacataatatatacgaaaaagcatttagtcatagcctggatctcaacagcattttccgtgtccacacacgcgacgagccacacgagtacgaagaaaatgagaacgtctttaatcagagctcctgcctccaggttcatcagaaaatccacactgaggagaagctgtataccgacatcgagtacggcaagtcgttcatctgcagtagcaacctggatatccagcaccgagtccacatggaggaaaactcatacaactcggaggagtgtggaaacggatttagtctggcttcccattttcaagatcttcagattgtccatacgaaggaacagccttataaaaggtacgtatgtagcaactctttctcgcacaatctgtatctgcagggccatcccaagatccacattggtgaaaagccaagaaaagagcatggaaacggattcaattggagctctaagctcaaggatcaccaacgggtgcacaccgggcagaaaccatataaatgcaatatttgcgggaaaggcttcaatcacaggtcagtgctgaatgtacaccaacgagtacacactggcgagaagccttataagtgcgaggagtgtgacaagggcttttcacggtcatcatatctgcaagcccaccagagagtgcatacaggggagaaaccatacaaatgcgaggagtgcggaaagggattctctagaaactcttatctgcaggggcatcagagagtgcatacgggggagaagccctacaagtgcgaggagtgtggcaaagggttctctcgtagtagtcacctgcagggccaccagcgtgtacacaccggggaaaagccgttcaagtgcgaggagtgcgggaaaggcttcagttggtcttttaaccttcaaatccatcagcgcgtccatactggagaaaagccttacaaatgcgaagaatgtggtaaggggttctcaaaggcctctacactgcttgcccatcaaagagtgcacaccggagagaaaccctaccaatgcgatgaatgcggaaagagcttcagccaacgatcctacctgcagtcccatcaatcggtgcattcaggcgagagaccatacatctgtgaggtttgcggaaagggttttagccagcgcgcctatttgcaggggcatcagcgggtgcatactagagtcaagccctacaaatgtgaaatgtgcggcaagggattttcccaatcaagtaggttggaagctcaccgacgggtgcacactggagggaagccctacaagtgtgaggtgtgtactaagggattctccgaatcctccaggctgcaggctcatcaacgagtgcacgtggagggccggccttataagtgcgagcaatgcgggaaggggtttagcggatatagcagtcttcaggctcatcatcgtgtgcacactggcgagaagccttacaaatgtgaggtgtgcggaaagggcttctcccagcgctctaatctccaggctcaccaacgagtccacactggggagaaaccgtacaaatgtgacgcctgtgggaagggattcagatggtcatcggggctgctcatccatcaacgggtgcactcctcagacaagttctataagagtgaggattatgggaaagattacccctcttcagaaaacctgcatagaaatgaggactcggtactgttctag

SEQ ID NO: 21429 - DNA, 1842 bp, Artificial Sequence
  Description of Artificial Sequence: Synthetic coding sequence
tgcagcagcgccttccccgagagctgccccttccagaaggaggacggtatgatcaaattccaggtgcgtctgtcaaacctgcaggaacgtgtgacatttaaagacgtggcggtggtgtttaccaaagaggaactcgcactgctggacaaggcccagattaacctgtatcaggatgtgatgcttgagaattttcggaatctcatgctcgtgcgcgacggaatcaaaaacaatatactgaacttacaggccaaggggttgtcatatctgtcccaggaagtgctgcactgttggcagatatggaagcagagaatcagagacttaacagtgagccaggattacatcgtgaaccttcaggaggaatgcagtcctcacctagaagacgtgtcgcttagtgaagagtgggcggggattagtcttcagatttcggagaatgaaaattatgtcgtcaatgcaattattaagaaccaagatatcacagcctggcagtctctgacccaggtactgacccccgagtcatggaggaaggccaacataatgacagaaccccagaactcacaaggccggtataaaggcatttacatggaggaaaaattgtacagaagggctcaacacgacgactccctgagttggacctcatgtgaccaccatgagtcccaggaatgtaaaggcgaagaccctggaaggcatcccaactgcggtaagaatctgggcatgaaatccaccgttgagaaacgaaacgcagcgcatgtgctgcctcagcctttcccctgcaacaactgcggcgttgcatttgctgacgacaccgacccccatgtccaccattcaacccacttgggggaaaaaagctataaatgcgaccagtatggcaaaaacttttcacagtcccaggatctgatcgtgcactgcaagacccacagcggtaagacaccatacgaattccatgaatggcctatgggctgcaagcaatccagtgatctaccaaggtatcaaaaggtcagctcaggagacaaaccgtacaaatgtaaggaatgcgggaaagggtttcggaggagctcctcattacacaaccatcaccgggtccataccggggagatgccctataaatgcgacgaatgtggcaaagggtttgggttccgcagccttctgtgcatccaccagggggtccatacaggaaaaaagccatataaatgcgaggagtgcgggaaaggatttgatcagtcctcgaacctgctggtccaccagagggttcataccggcgagaagccgtacaaatgcagtgagtgcggcaaatgcttcagcagctcaagcgtgcttcaagttcattggcggtttcatactggggagaagccttaccggtgtggggagtgtggcaaagggtttagccagtgcacacacctgcacatccaccagagagtccacaccggcgagaagccgtacaagtgcaatgtttgtggtaaggacttcgcttactcaagtgtcctccacacgcatcagcgtgtgcatacaggtgaaaaaccttacaagtgcgaagtgtgtggcaagtgttttagctacagttcctatttccatctgcaccagcgcgaccacatcagagaaaaaccctacaagtgtgacgaatgtggtaagggtttctctcgtaatagtgacctaaacgtacatcttagagtgcacaccagggagcgcccctacaaatgcaaggcgtgcggcaaaggtttctcgcgcaacagttacctgctggcccatcagagagtgcacatcgacgagacgcaatacacccactgcgaacggggaaaggacctgttaactcaccagcgactgcatgagcaaagggagacgttgtag

SEQ ID NO: 21430 - DNA, 426 bp, Artificial Sequence
  Description of Artificial Sequence: Synthetic coding sequence
atggagaccgacctggccgagatgcccgagaagggcgccctgagctctcaggattcacctcactttcaggaaaagtcaacagaggaaggcgaagtggctgcgctgcgccttacagctcgatcgcaggagacagtcaccttcaaggatgtggcaatggactttacacccgaggagtggggcaaactggaccccgcccaacgggacgtgatgttggagaattaccgcaatctggtgagcctgtggctgcctgtcagcaaacctgaatcatacaacctcgagaacggaaaagaacctttgaaattagaacgaaaagctcctaagagctcatactcagcggtagccgtgattattctgttcttgatcccttatgttcacctggagagttggtttagggaaatcactggaagaaggatatcacggtcttag

SEQ ID NO: 21431 - DNA, 1566 bp, Artificial Sequence
  Description of Artificial Sequence: Synthetic coding sequence
atggagaccgacctggccgagatgcccgagaagggcgccctgagctcccaagatagcccacactttcaggagaagtctactgaggaaggcgaggtggctgcccttagactcaccgcccgctctcaagaaacagttaccttcaaggatgtggctatggacttcacccccgaagagtggggcaaactggaccccgcccagagagatgtgatgctggaaaactaccgtaacctggtgtctctgtggctccccgtgtccaagcccgagtcttacaaccttgagaatggcaaagagccattaaaattagagcgaaaggctccaaaaagctcgtatagcgacatggaaacaagaccccagagcaaggacagtacctccgtgcaggacttctcaaaagctgagtcctgcaaagtggccataattgatcggctgactcggaactccgtctacgattctaacctggaggctgccttggagtgcgagaattggctggaaaatcagcaagggaatcaggagagacatcttagggaaatgttcacccacatgaattcactgtcagaagagaccgaccacaagcatgatgtttattggaagtcctttaatcagaagtccgttctgattaccgaggatcgggtgccgaaaggaagttacgcattccacaccctcgaaaagtcattgaagcaaaagagcaatttaatgaaaaagcagcggacatataaggagaaaaagccgcacaagtgtaacgactgtggcgagctcttcacctaccacagcgtgttaatccggcaccaaagggtgcacactggcgaaaaaccctatacgtgcaatgagtgcggcaagagcttctctcacagggctaacctcactaagcaccaacgaacacacactagaatactcttcgagtgctctgagtgtaagaagaccttcaccgagagtagctctctggctacgcatcagaggatccatgtgggggaacggccctacgagtgcaacgagtgtggaaaaggatttaatcgctccactcacctggtgcagcatcagctgatccacaccggcgttaagccttatgagtgtaacgagtgcgacaaggccttcattcactcctccgcactcattaagcatcagcggactcatactggcgaaaagccttataaatgtcaggaatgcggcaaagccttctcccattgtagcagcctcacaaaacaccagcgtgtccataccggcgaaaagccttacgaatgcagtgaatgtggaaagacattctcccaatccactcatcttgtgcaacatcagcggatccataccggcgagaagccctatgagtgcaacgagtgcggtaaaacattcagcagatctagcaactttgctaaacaccagcgaatccatattggcaaaaaaccctataagtgtagtgaatgtggcaaggcattcatacacagtagtgcactcatccagcaccagagaactcacacgggagaaaagcctttccggtgtaacgagtgtggcaagtcctttaaatgttccagcagcttaattcgacatcagcgggtgcatacagaagaacagccttag

SEQ ID NO: 21432 - DNA, 1536 bp, Artificial Sequence
  Description of Artificial Sequence: Synthetic coding sequence
atgggcgccctgagcagccaggacagcccccacttccaggagaagtcaaccgaggaaggggaagtcgccgccctgcgactgacagctaggagccaggaaacagtgacctttaaggatgtcgccatggatttcacgccagaggagtggggaaagctggatcccgcccaaagagacgtgatgctggaaaactataggaacctggtgtcactgtggttacccgtatctaagcccgagtcctacaacctcgaaaatggtaaagaacctctgaaactggaaaggaaggctcccaagtcctcctacagcgatatggagacaaggccccagtccaaagattcgacaagcgtgcaggatttttctaaggcagaaagttgcaaagtggccattatagaccgcctcacccgcaattccgtgtacgactcaaatctggaagccgccttggagtgcgagaattggctggagaaccagcagggcaaccaggagagacatctcagggaaatgttcactcacatgaattctctcagcgaagagactgaccataaacatgatgtctactggaaaagcttcaaccagaaatctgtgcttattactgaggaccgagtgcctaaggggtcctacgccttccacactctcgagaagtcactgaaacagaaatctaacctgatgaagaaacagcgcacatataaggaaaagaagccacacaaatgcaacgattgtggcgagctgttcacatatcacagcgttcttattaggcatcagcgagtgcacactggagaaaagccttatacctgtaacgagtgcgggaaatccttctcccatcgagcgaatttgacaaagcatcaacgtacacacacaagaattctttttgaatgttccgagtgcaaaaagacattcaccgagtcttcaagtctggcaacccatcagcggatccatgtgggagagcgaccctacgagtgcaatgaatgtggtaagggatttaataggtcaacgcatctggttcagcatcaattgatacataccggggtgaaaccctacgagtgtaacgagtgcgataaggccttcattcattcctctgcccttataaagcaccagcgcacccatactggcgagaagccctataagtgtcaggagtgcggtaaggcgttcagccactgtagtagcttaactaagcaccagagggtgcacacaggcgaaaaaccttatgagtgctcggagtgtggaaaaaccttttctcaatctacccaccttgtacagcatcagaggatccacaccggggagaagccttatgaatgtaatgagtgtggaaaaacattcagcagatcctctaattttgccaagcatcagaggatacacattggcaaaaaaccttataaatgtagtgaatgcggaaaggctttcattcattcatctgccctgatccaacatcagagaactcacacaggagagaagcccttccggtgcaatgagtgcgggaagagcttcaaatgcagctccagcctcattcgccatcagcgggtgcatactgaggagcaaccttag

SEQ ID NO: 21433 - DNA, 1566 bp, Artificial Sequence
  Description of Artificial Sequence: Synthetic coding sequence
atggagaccgacctggccgagatgcccgagaagggcgccctgagctcccaggacagccctcacttccaggagaagagtactgaggaaggagaagttgccgccctgagactaacagcccgcagtcaggaaacagtaacattcaaagacgtggccatggactttaccccggaggagtgggggaagttggaccccgcacaaagagatgtgatgctggaaaactaccgaaacctggtatcactgtggctgcctgtttcaaagcccgaaagctataacctcgaaaacggtaaagaaccactgaaactcgagcggaaagcgcccaaatccagttactctgacatggagacccgcccccaatctaaggacagcacttccgtccaggatttcagcaaagcagaatcctgtaaagttgctatcatagatcggctcaccaggaattctgtttatgatagcaatctggaggccgctctggagtgtgagaactggctggaaaaccagcagggcaatcaggaacgccatttgagagagatgttcacccacatgaactcactgtccgaggagaccgatcataaacacgatgtgtactggaaaagcttcaatcagaagagcgtgctcattactgaggatagggtacccaagggctcttatgcttttcatacactggaaaagtcgctcaagcagaaatccaacttaatgaaaaaacagagaacatataaggaaaaaaaaccacataagtgcaatgattgcggcgaactcttcacctatcactcggtccttatccgacaccaacgtgttcatactggcgagaagccatacacttgtaacgagtgtggtaagagcttttctcacagagcgaaccttacaaaacaccagaggactcacacaagaatattgttcgagtgctcagagtgcaaaaagacgttcacagaatcatcatcattagcaactcatcagagaattcatgttggtgagaggccttatgaatgcaatgagtgtgggaagggttttaataggtcaacccacctggtgcagcaccagcttattcacacaggggtgaagccctatgaatgtaacgaatgtgataaggcctttattcacagctctgctctgattaagcaccaacgaactcacaccggggagaagccatacaaatgtcaggagtgtgggaaggcgttttcccactgttcatccctgaccaagcaccagcgggtccacacaggagagaagccctatgaatgctccgaatgtgggaaaacatttagtcaaagcacccatctggtgcagcaccagcgcatacacacaggagaaaagccgtatgaatgcaacgagtgtggaaaaacattctccaggtcatccaacttcgcaaaacaccagaggattcatatcggcaaaaagccctacaagtgttccgaatgtgggaaggccttcatacacagttctgcgctcattcagcatcagcggacccacactggggagaagccattcaggtgtaacgagtgcggcaagtcatttaaatgttcttcctctctgattcggcatcagcgcgtacacactgaagagcaaccttag

SEQ ID NO: 21434 - DNA, 1566 bp, Artificial Sequence
  Description of Artificial Sequence: Synthetic coding sequence
atggagaccgacctggccgagatgcccgagaagggcgccctgagcagccaggactctccacactttcaagaaaagagcaccgaggaaggcgaggtcgccgccttacggttgaccgcgcgatctcaggaaacagtgacttttaaggatgtagccatggacttcacacctgaagaatggggaaagctcgaccctgctcagcgagatgtgatgctcgagaactatcgaaatttggtttctctctggcttcctgtttcgaagccagaatcatacaacctcgagaatggaaaggaacccttaaagctggaacggaaagcccccaaaagctcctatagtgatatggaaacgaggcctcagtccaaagatagcacctctgtgcaggacttcagcaaagccgagagttgcaaggtggcaattattgatcgactgacaagaaactccgtgtacgatagcaacctcgaggctgctctagaatgcgaaaactggctggagaaccaacaggggaatcaggagaggcacctgagagagatgttcacccacatgaattcactgagcgaggaaacggatcacaagcatgacgtctattggaaaagcttcaaccagaagagcgtgttaatcactgaggacagggtaccaaaagggtcctacgcattccacaccctcgaaaagtctctcaaacagaaaagcaatctgatgaagaaacagaggacatataaagagaagaaaccacacaaatgcaacgattgtggggagctatttacctatcatagtgtcctgatcaggcaccagagggtgcatacgggggagaagccatacacttgtaatgagtgcggaaagagcttttctcatagagccaatcttaccaaacaccagaggacacacacacgtatcttatttgaatgctccgagtgcaagaagacatttaccgaatctagttctcttgcaacccatcagcgaatccacgtgggcgagcgtccttacgagtgtaacgagtgcggcaaggggtttaatcggagcacccacctcgttcaacaccagctcatccatactggcgtgaaaccttacgaatgtaatgaatgtgataaagccttcatacactcctccgccttgatcaagcatcagcgaacccacaccggtgaaaagccctacaaatgtcaggagtgcggaaaggctttcagccactgctcttctttgaccaagcatcagagagtgcacacaggtgagaagccatacgagtgctcagagtgtggaaagactttttcacagtcaacacacctggtacaacaccagaggattcacactggggaaaagccctacgagtgcaacgaatgcggcaaaaccttctccagaagctccaactttgctaagcaccaacgcatccacattgggaagaagccgtataagtgtagcgaatgtgggaaagcctttattcacagcagcgccttaatccagcaccagaggacacacactggagagaagcctttccggtgtaacgaatgcggtaaatccttcaaatgcagctcctcgttgatccgacatcagcgggtgcataccgaggagcagccgtag

SEQ ID NO: 21435 - DNA, 1569 bp, Artificial Sequence
  Description of Artificial Sequence: Synthetic coding sequence
atggagaccgacctggccgagatgcccgagaagggcgtgctgagcagccaggacagccctcatttccaggagaaaagcactgaagagggcgaggtagccgccttaaggctgactgcccggtctcaggccgccgccgccgcggcggctcccggcagcagatccctgcgcggggttcacgttcctccacccctccacccggcccccgctcgggaggaaattaaaagtacctgcagcctgaaggcctgtttttccctgtcacttaccctgacgtattatcgaactgcgtttctgctgtcaacagagaacgaaggtaacctgcacttccaatgcccttctgacgtggagacccggccacaatctaaagattccacatcggtgcaagatttttccaaggctgagtcatgtaaagtggccatcatcgaccgcctgacgcgcaactccgtgtatgactcaaatctggaggcagccctggaatgcgagaactggctggagaagcaacagggaaaccaagaacgtcatctgcgcgaaatgttcacacacatgaacagcttaagcgaagagacagaccatgaacatgatgtgtactggaagagcttcaaccagaagagtgtgctcataactgaagatcgggttcctaaaggctcgtacgcttttcacacgctggagaaaagcttgaagcaaaaaagcaacctaatgaagaagcagagaacgtataaagaaaaaaaaccacataaatgtaacgactgcggagaattgtttacctgtcattcagtccacatccagcaccagcgggtgcataccggtgagaagccgtatacatgcaacgagtgtggaaagagttttagtcatagagccaacctgactaaacaccaacggactcatacccggatcctgtttgaatgccgtgagtgcaaaaagactttcacagaaagctccagtctcgctacccaccaacggattcatgtgggagagaggccatacgagtgcaatgaatgtggaaaaggctttaaccgcagcacccacttagttcagcaccagctgatacatacaggcgtaagaccctatgagtgtaacgagtgcgacaaagccttcatacactcctcggccctcataaaacatcaacgtacacataccggagagaaaccttacaaatgccaggagtgtgggaaggccttctcccactgttccagcttgacaaaacaccaacgtgttcataccggagagaaaccctacgaatgttctgaatgtgggaagacgttttcgcaatccacacatctcgtgcagcaccagagaatccacacaggggagaagccctacgaatgttccgaatgcggaaaaacgttcagtcagagctccaattttgctaagcaccagcgtatacatatcgggaagaagccttataaatgttctgagtgtggcaaagccttcattcacagcagcgctctaatccagcaccagagaacacacaccggtgagaagccatttagatgcaatgaatgtggcaagagcttcaagtgcagcagcagcctgattcggcatcaaagggtccacacggaagagcagccatag

SEQ ID NO: 21436 - DNA, 2286 bp, Artificial Sequence
  Description of Artificial Sequence: Synthetic coding sequence
atgctggccagcagcaagcggatgaacagcagcagccggagccagattttgctgcgctggaaaagtgacaaagcccagtccggaccttacaatgtggagaaagaaattctcacctcacggtttctgcgggataccgagacctgtcgccagaacttccgaaacttcccttaccccgatctagcaggtccgcgaaaagcactaagtcaacttcgcgaattgtgcctgaagtggttgcgccccgaaatacatagtaaagagcaaatcctggaattgctggtgttagagcagttcctcaccattttacctggcgaagtccgtacctgggtaaaaagccagtatcctgagagcagcgaagaagcagtcacgctggtggaagacctgactcagattttggaggaggaagccccacagaactcaacactgagtcaggatacgccagaggaagatccaagaggaaagcacgccttccagactgggtggttaaacgacttggtgacaaaagagtctatgactttcaaggacgtcgcagttgacatcacacaggaagactgggaactgatgagaccagtgcagaaggagttgtacaaaacagtcacgctgcaaaattactggaacatggtatcactgggtttgactgtgtataggcctacagttataccgatcctggaggagccctggatggtgattaaggagatcctggaaggcccgagccctgaatgggagacgaaagctcaggcatgcactcctgtcgaggacatgagcaagttgaccaaagaagagacccatacaattaagctggaggactcatacgactacgacgatcgattagagagaagggggaaaggtgggttctggaaaatccacaccgacgagagagggttctcattgaaaagtgtgctgagccaggaatatgatccaacagaggaatgtctcagcaagtatgacatttatcgaaacaattttgaaaaacactccaatcttatcgttcagtttgacacacaactagacaacaagacgtctgtgtacaacgagggtagagcaacttttaaccacgtctcatatgggatagtccataggaagatcctaccaggagagaaaccttacaagtgtaatgtatgcggaaagaagtttcgcaagtatcccagcctgcttaaacaccagtcaactcacgcaaaagaaaaatcttatgaatgtgaggagtgcggcaaagaattccggcacatatcttccttgattgcacatcagagaatgcacactggcgagaagccttatgagtgtcaccaatgtggcaaagccttcagccagagggctcatttaaccattcaccagcggatccacacaggagagaaaccttacaagtgtgacgactgcgggaaggacttcagccagcgggctcacctgacgattcatcaaaggacgcataccggcgagaaaccatataagtgcttggaatgcgggaaaaccttcagccattcatcctcccttatcaaccaccagcgcgtccacacaggggagaaaccctatatttgtaacgagtgcggaaaaactttctctcaatcaacccacctgctccaacaccagaaaattcacacgggcaaaaagccttataagtgcaacgagtgctggaaagtgttctcacagtccacttatttgattcgtcaccaacggatccactctggcgagaagtgttacaaatgcaatgaatgcgggaaggccttcgcccactcctccactctgatccaacaccagactacccacacgggggagaagagctacatatgcaatatctgtgggaaggctttctcccagtcggctaacttaacccaacaccacagaacacatactggagaaaagccctacaagtgctcggtgtgtggtaaggcattttcccagagcgtacacctgactcaacaccaacggatccataacggcgagaagccattcaagtgtaatatctgtggaaaggcctatcgccagggagccaacctaacccagcatcagcgaatccatacaggggagaaaccatacaagtgcaacgagtgtggtaaagccttcatctacagctccagtctcaaccagcatcagcggacacacacaggggagaggccttacaagtgcaatgaatgtgataaggacttttcccaacgcacctgtttgattcagcaccagcgtatccacaccggggagaagccttatgcttgtaggatttgcggaaagacgtttacgcagagcacaaatctcatccaacatcagagggtgcacactggcgctaaacataggaattag

SEQ ID NO: 21437 - DNA, 2286 bp, Artificial Sequence
  Description of Artificial Sequence: Synthetic coding sequence
atgctggccagcagcaagcggatgaacagcagcagccggagccagatactgctgcggtggaaaagtgataaggcacagagcggaccctataacgttgaaaaagagatcctgacttcccgattcttaagggacactgagacatgccgccaaaattttcgcaacttcccctaccccgacttagctggacctaggaaagcattatcacagctgagagagctctgcttgaagtggctgaggcccgagattcattcaaaggaacagatcctggagctgctggttctggaacagttcctgactatccttcctggcgaagttaggacatgggtgaaaagccaataccctgagtctagtgaggaggccgtcacattagtggaggatctcacccaaatcctcgaggaagaggccccccagaattccaccctttcgcaggatactccggaagaggacccgcgtgggaagcatgcatttcagacgggctggctaaatgatttagtaacgaaggagtctatgacattcaaagacgtggctgtggatattacacaggaggactgggagctgatgagaccggtgcagaaggagctgtacaaaacagtcaccctccagaattattggaatatggtaagcctgggcctcactgtttaccgacctacggttattccaatcctcgaggagccctggatggtgattaaggaaattctggagggaccctccccagagtgggagacgaaagctcaggcatgtacgcctgtcgaggatatgagtaaactcacaaaggaagagactcacactataaagttggaagacagctatgactatgatgatcgattggaacggcggggaaaggggggcttttggaaaatccatactgacgaaagaggtttttctctgaagtccgtccttagtcaggaatatgatcccactgaagagtgcctctcgaaatacgacatataccgaaacaatttcgaaaaacactccaacttgattgtgcaatttgacactcaactggacaataaaaccagtgtctataatgagggtagggccacatttaaccatgtgagctacggtattgtgcataggaagatcttgcccggagaaaaaccttataagtgtaacgtgtgcggaaaaaagttccgcaaatacccctcccttttgaaacatcagtctacacacgccaaggaaaaaagctatgaatgcgaagagtgcgggaaggagtttagacatatatcatcgcttatcgcgcaccagcgcatgcacactggagagaagccctacgaatgccaccaatgtggaaaagccttcagtcagagggcacacctgaccatccatcagcgcattcacacaggggagaaaccatataagtgtgatgactgcgggaaggacttctcacaaagggcccaccttaccatacaccagaggacccacactggcgagaaaccctataaatgcctcgaatgtggaaaaacattttctcactcaagttcacttatcaaccaccagcgtgtgcacacaggagagaaaccctacatttgcaacgagtgcggcaagacattcagtcagagtactcatctcctgcaacatcagaaaatccacaccggtaaaaagccctacaaatgcaatgagtgttggaaggttttcagccagagtacatacttgatacgacaccagcgcattcactctggagagaagtgctacaaatgtaatgagtgcggcaaggcctttgcacatagtagcacgcttatccaacatcagactacccatacaggtgaaaaatcctacatatgtaatatttgtggcaaggctttctcccagtcagccaatctcacccagcatcaccggacccacacgggagagaagccatataagtgctcagtatgcggaaaagccttttcccagtcagtgcaccttacgcagcatcagcgtatccacaatggcgagaaaccgttcaagtgcaacatctgcggaaaggcttaccggcaaggcgcaaatctgactcagcaccagagaattcacacgggcgagaagccatacaagtgtaacgagtgcggcaaggcattcatatactcatcctcactgaaccagcatcagcgtactcacaccggggaaaggccatataagtgcaatgaatgtgacaaggatttctcgcagcgaacatgtctaattcagcaccaaagaatccataccggggagaagccttatgcctgcaggatatgcgggaaaacattcacccagtctactaatttgatccagcatcagcgggtgcatactggcgcgaagcacaggaactag

SEQ ID NO: 21438 - DNA, 174 bp, Artificial Sequence
  Description of Artificial Sequence: Synthetic coding sequence
atgctggccagcagcaagcggatgaacagcagcagccggagccagatcctcttgagatggaagtcagataaagcccagtcaggtccttataatgttgagaaggagattctgacctcacgttttctgcgcgacacagaaacctgcaggcagaactttagaaactttccttattag

SEQ ID NO: 21439 - DNA, 8157 bp, Artificial Sequence
  Description of Artificial Sequence: Synthetic coding sequence
atggccgacgaggaggccgagcaggagcggctgagctgcggcgagggtggttgtgtggcagagttacagcgtcttggcgagagacttcaagaactagagcttcagttgagggaaagcagagtgcctgccgttgaggcagccacagactattgccagcagttgtgccaaacccttctcgaatatgcagagaaatggaagacgagcgaggacccgctccccctgctggaggtctacactgtggctatccagagttacgttaaggctaggccctatctgacatccgaatgcgagaacgtggcgctggtcctcgagcgcttagctctgtcatgtgtggagctgctgctctgcctgcctgtggagctcagcgacaagcaatgggaacagttccagacactagtccaggttgcccacgaaaaactcatggagaacggctcgtgtgagctgcactttctcgctacgttagcccaggagaccggcgtctggaaaaaccctgtgctgtgtaccatcctcagtcaggagccactggacaaggacaaagcctttgagggccccattttgttggacatgaggatcaagcatctgatcaaaacgaaccaactttcacaggctaccgcgctcgccaagctttgctcagatcatccggaaattgggatcaaaggaagcttcaagcaaacctatttggtgtgcctctgtactagtagccccaatggtaagctcatcgaagagatttccgaggttgattgcaaggacgcgttggagatgatctgcaatctggaatctgagggcgacgagaagagcgccctggtgctgtgcacagcgttcctcagtcgccagctgcaacagggcgacatgtattgtgcttgggagcttactttgttctggagcaagttacagcagagagtcgagccgtccatccaggtctatctagaacggtgtcgccaattgagccttctgactaaaacggtctatcatattttctttctgatcaaagtgattaatagtgagacggagggagctgggctggctacatgtattgagctgtgcgtgaaagcccttcgcctggagtcaactgaaaatactgaagtcaaaatctcgatctgtaaaactatttcttgcctgttgcccgacgacctcgaggtgaagagggcctgccagttgtccgaatttctgattgaacccactgttgatgcctactacgctgtcgaaatgttatataatcaaccagatcagaaatatgacgaagagaacctgccgatccctaatagtttacgttgcgagttgctgctcgtgctgaagacccaatggcctttcgaccccgaattctgggattggaagactttgaaacggcagtgcctggcgctgatgggtgaagaggcatcaatagtgtcgagcatagatgaactgaatgacagtgaggtgtatgagaaagttgtcgactatcaggaagaatccaaggaaacatctatgaatggtctgagtggcggagtgggagccaattcaggcctgcttaaggacatcggggacgaaaagcaaaagaagcgcgagatcaagcagctgcgcgaaagggggtttatctccgcacgcttccgcaattggcaggcctacatgcaatattgtgtgttgtgcgacaaagagttcttgggccaccggattgtgagacacgcacaaaagcattataaggatggcatatactcttgtccgatctgtgcaaaaaacttcaactctaaagaaacatttgtccctcacgtgacactgcacgtgaagcagagtagcaaagagcgactagccgccatgaagcctctccgacggctgggccggcctcccaagataactacaacaaatgagaaccaaaagactaataccgtggccaagcaagagcagcggccgatcaagaaaaattcactgtattcaactgacttcatagttttcaacgataacgatggctcagacgacgaaaacgatgataaagataagtcttacgaaccagaggtgattcccgtgcaaaagcctgtcccagtgaatgaattcaactgccccgtcaccttctgcaaaaaaggatttaagtacttcaagaatcttatcgcgcatgtgaagggccacaaggataatgaagacgcaaagcggtttctcgagatgcagagcaagaaagtcatctgccagtattgcaggcgtcattttgtgtcggtgacacatctgaacgaccatctgcagatgcactgtgggagcaagccctacatctgcatccaaatgaagtgtaaggcaggatttaattcctacgccgaactgcttacacatcgtaaggaacatcaagtcttcagagctaaatgtatgtttcccaaatgtggacgcatcttctctgaagcctatctcttatatgatcatgaggctcagcactataacacctacacctgcaagttcactggatgtggcaaggtgtataggtctcagggggagctggagaagcacctcgacgaccactctacccctccagagaaagtcctgccccctgaagcacagctgaattcctccggcgactccattcagccttctgaggtgaatcagaacaccgctgagaatattgagaaagagcgaagtatgctgccctctgagaacaatattgagaattcattattggcagataggagtgatgcttgggataagtcgaaggccgaaagtgccgtaaccaagcaggaccaaataagcgcatctgaattgcgccaggctaatggcccactgtcaaacggactggagaatccagccacaacaccactactgcagagttccgaagtggcagtcagtataaaggtgagtctgaaccaaggtatcgaggataatttcggcaagcaggaaaattctacagtagaaggcagcggagaagctctcgtgaccgacttgcatacccccgtggaggacacctgtaacgatttgtgccaccctggctttcaggagcggaaggaacaggattgtttcaacgatgcgcatgtcacccaaaactctctcgtcaactctgagacacttaagatcggagacctcacaccccagaaccttgaacgccaggtgaataatctgatgaccttctctgtacagaatcaggccgccttccagaataatctgcccacttcaaagtttgaatgcggtgataatgtgaaaacatctagcaatctgtataacctacccctcaagacgctggaatctattgcttttgtcccacctcagagcgatctgtcaaattctctcggaaccccgtccgtgcctccaaaggcccctgtccagaagttcagctgtcaagtcgagggctgcacacgaacatataatagcagccagagcatcggcaagcatatgaaaaccgcgcatccagatcagtacgccgcgtttaaaatgcagaggaaaagcaagaaaggacagaaagcaaacaatcttaatacgcctaataacggaaaatttgtctattttctaccatccccggtgaattccagcaatccattttttacctcccagacaaaggcaaatggcaatcctgcttgctcagcccagctgcaacacgtgtctccccccattttcccagcgcatctggcttctgttagcaccccattgctgtcttctatggagtctgttattaaccctaacataacgtcacaggataagaacgaacagggcggtatgttatgcagccagatggaaaacctgccttccaccgccttgcccgctcagatggaagacctgacaaaaactgtcttgccactcaacatagattccggatccgatccttttttaccactgcccgcagaaagctccagcatgagtctgttcccttcccccgcagactccggaactaattcagtgttttcccagctggaaaacaatacaaatcattactcatcccagatcgagggtaatacaaattcatctttcttgaagggaggaaatggggaaaatgctgtgtttcccagtcaggttaacgtggcaaataacttctcctcaaccaatgctcagcaatctgctcccgaaaaggttaaaaaagaccggggccgagggcccaacggcaaagaacgcaagccaaaacacaacaagagggctaaatggccagccattatacgggacgggaaattcatatgttctcggtgctaccgcgcattcaccaacccacggagcctcggaggccatctgtcgaagcggtcttactgtaagcctctggatggagcagagattgcccaggagctgctacagtctaatgggcagccctcactgttggcaagtatgattctctccaccaacgcagtaaatctgcagcaaccacagcaatccacattcaatccagaggcgtgctttaaggacccttcattcctgcaactcctagcagagaacagatcacctgcattcttaccaaacacctttccccgttcaggcgttacaaacttcaacacctctgtttctcaagaaggaagtgagattatcaaacaggcattagagactgcaggaatcccgtctaccttcgaaggcgcggagatgctgtcacacgtgtcgaccggatgcgtgtcagacgcatcccaggtgaatgctactgtcatgccaaaccctacggtcccacctctcctgcacactgtttgccacccaaacacgcttctgaccaatcaaaatcgcacctccaactctaaaacgtcatctatcgaggagtgttccagcttgcctgtctttcctacaaatgacctcctgctgaagaccgtcgagaatggcctgtgctcatcaagttttcccaatagcggaggaccttcccagaacttcacaagtaactcatccagagtttccgtcatctcaggcccccaaaacaccaggagtagccacctcaataagaaagggaattccgcgagtaagcggcgaaaaaaggtggctccacctttgatcgccccaaacgcttctcagaatctggtgacctctgacctcacaacaatgggattgatcgccaagtccgtggagatacccaccacaaacctgcactccaacgtcatcccaacctgtgagccgcagtccctcgttgaaaatctgacacagaaactcaacaatgtcaataaccagttattcatgacagatgtgaaagaaaattttaaaacctcattggagtctcataccgttctggctcccttaaccctcaagacagaaaatggtgattcccaaatgatggccctgaatagctgtactacaagtattaatagcgaccttcagatctccgaggataacgtaatacagaattttgagaagactctggagataattaaaacggctatgaatagccaaatcctggaagtcaaaagtgggtcacagggtgctggagagacaagtcaaaatgctcagattaattataatatccagctccctagtgtgaatactgttcaaaacaataaactgccggatagcagcccgttttcatcctttatatcagtgatgcctactaaatcaaatattccccaatccgaagtgagccacaaagaagaccagatacaggaaattctggagggtctgcagaagcttaaacttgagaacgaccttagtaccccagcctctcagtgcgtcctgataaatacaagcgtcactctgacaccgacaccagttaagagtactgccgatatcactgtcatccaaccagtgagtgaaatgatcaatattcaattcaacgataaggtgaacaagccatttgtctgccagaatcagggatgtaattattccgctatgaccaaagatgccctgttcaagcattacggcaagattcaccagtacacacctgaaatgatcctggagataaagaagaatcagctcaagtttgcaccgttcaaatgtgtggttcccacatgcactaagacctttacaaggaatagtaatctcagagcccactgtcagcttgtccaccactttactaccgaggaaatggtgaaactcaagattaaaaggccctatggacggaagagtcagagtgagaacgttcccgccagcagatcaacacaagtcaaaaagcagctggccatgacggaggaaaataagaaggaatcccagcccgccctagaactgcgagccgaaacccagaatacccattctaacgtagcagtcatccctgaaaagcagctagttgaaaaaaagtcacccgataagaccgagagctcacttcaggtgattacagtgacctcggagcagtgcaataccaacgcattgaccaatacccagaccaaggggagaaaaatcaggcggcataagaaggagaaagaggagaagaaaagaaagaaaccagtttcccagagccttgagtttcccacgcgatactccccttatcgaccttatagatgtgtgcaccaggggtgctttgcggccttcacaatccaacagaatctcatccttcattaccaggcagtacacaagtccgatcttcctgcattctccgctgaagtcgaggaagaaagcgaggcggggaaggagtccgaagagactgagacgaagcaaaccctcaaagagttccgatgtcaggtgtcagactgctcgaggatattccaggctattacagggctgatacaacactacatgaagcttcacgagatgacccctgaggagattgagtcaatgaccgccagcgtggatgtgggtaaattcccctgcgaccagctggagtgcaaatcatcattcaccacttatcttaattatgtggtgcacctggaagctgatcatggcataggcctgcgagcatcgaagacagaggaggacggcgtatacaagtgtgactgtgagggatgcgacaggatctatgctacaaggagcaatctgctgcgacatatctttaataagcacaacgacaaacacaaggcacatctaatccgaccacgcagattaacaccggggcaggaaaacatgagctcgaaggccaaccaggaaaagtcaaaaagcaagcacagaggaacaaaacactcacgctgcgggaaggaaggcataaagatgccaaagactaagagaaaaaaaaaaaacaatttagagaacaagaatgccaagatcgttcagatcgaggagaataagccttatagccttaagcgaggaaagcatgtatatagcataaaggctagaaatgatgccttgtccgagtgtacctcgcgattcgtcacccagtacccgtgcatgataaaagggtgtacctctgtggttacctcggagtccaacattattcggcactacaagtgccataagttatcaaaagcctttacctcacagcaccggaatctgttaatcgtctttaagcgctgctgcaactcccaggtcaaggagacatccgagcaggaaggcgccaagaacgacgtgaaagattctgatacatgcgtctcggaaagcaatgacaactctcgtaccaccgccacagttagccaaaaagaagtcgaaaagaacgagaaagatgagatggatgaattgactgagttgttcattaccaaactgataaacgaagactcaacttccgttgaaacacaggctaacacctcttctaatgtctccaacgatttccaggaggacaacctgtgccagtccgagcggcagaaagcgtcaaatctgaagagggtgaacaaggaaaaaaatgtcagtcagaacaaaaagcggaaagtggagaaagctgaaccagcttccgctgcagaattaagttccgttcgcaaggaggaggagacagctgtcgccatccaaactatcgaagaacatcccgcatcttttgattggtctagcttcaaacccatgggttttgaggtgtcattcctgaaattcttggaggagtccgctgtaaagcagaagaagaacaccgataaggaccaccctaatacgggcaataaaaaaggatcacacagcaatagccggaaaaacatcgataagaccgcggtgacctccggtaaccacgtctgtccatgtaaggagagtgagaccttcgtgcagtttgccaatcccagtcagctgcagtgtagcgacaacgtaaagattgtcctggacaagaacctgaaagactgtaccgaactggtcctcaaacagctccaggagatgaaacctacggtatctcttaaaaagctggaggtccacagtaatgacccagacatgagtgtcatgaaagatattagcatcgggaaagccactggccgcggacagtactag

SEQ ID NO: 21440 - DNA, 8172 bp, Artificial Sequence
  Description of Artificial Sequence: Synthetic coding sequence
atggccgacgaggaggccgagcaggagcggctgagctgcggcgagggtgggtgcgttgcggagctccaaagacttggagagcgcctgcaggagttggaactgcagctacgcgaatcccgggttcccgcagtggaggcagccactgattattgccagcagctgtgtcagactctccttgagtacgctgaaaaatggaagactagcgaagatccactccccctactggaggtttataccgtggcgattcagtcctacgtgaaggcccgaccatacctcacatctgaatgcgaaaatgtagccctggtcctagaaagattagccctctcttgcgtggaactcctactgtgcttacctgtggagctgtccgataaacagtgggagcagttccagactctggtgcaggttgcacatgagaagctgatggaaaatggttcctgtgagctccactttttagccactctggcacaggaaacgggagtatggaagaacccagtgctgtgtacgatcttgtcacaggagcctttagacaaggacaaggtgaacgagtttctggcattcgaggggcccatccttctggatatgaggatcaaacacctcataaagacaaatcagctgtcacaggccacagcattggccaagctgtgttcagatcatccggagatcggcatcaaaggctctttcaagcagacatatctggtttgtctgtgtaccagctcacctaatggcaaattgatcgaagagatcagcgaggtggattgcaaggatgccctcgaaatgatatgcaacttagagtcagagggcgacgaaaagagcgctcttgtgctttgtacagccttcctctccaggcaactccaacaaggagacatgtactgcgcttgggaactgaccctcttctggtccaagcttcagcagagagttgaaccctccatacaggtctatttagaaagatgcaggcagttaagtcttttaaccaaaactgtgtaccacatcttcttccttattaaagtgataaatagcgagacggaaggagcaggacttgccacttgcattgagctgtgcgttaaagccctacggctggagagtaccgaaaatacagaggtaaagatatcaatctgcaaaactatctcttgtctcctgcccgatgacctggaagtgaaaagagcctgtcagctgagtgagttcctcattgagccgactgtcgacgcgtattacgccgtcgaaatgctgtataaccaacccgatcagaagtacgacgaagagaacctgccaatccccaattcactgaggtgtgagctgttgttggtgttaaaaacccagtggcctttcgatccagagttttgggattggaaaacattgaagagacaatgcctggctctcatgggagaggaagcttcaattgtaagttccatagacgaattgaacgacagtgaggtgtacgagaaggtggtcgactaccaggaggagtctaaggaaaccagtatgaacggactgtctggaggtgtgggggcgaacagcggtttgttaaaagacattggcgacgagaaacagaaaaaacgggagattaagcagctccgggaacgcgggtttatatcagcccgttttagaaactggcaagcttacatgcaatactgcgtcctatgtgataaagagttcctaggtcacaggatcgtccgccatgctcaaaagcattacaaagatgggatatactcttgccccatctgtgccaaaaatttcaattccaaagaaaccttcgttccacatgtgacactgcatgtcaaacagtcatcaaaggaacgactggcagccatgaagccgcttcggcgcctcgggcgaccaccaaagatcacaactaccaacgagaatcagaaaactaacaccgtggccaaacaggaacagaggcctatcaagaagaacagtttgtactctactgacttcatcgtctttaacgacaacgacgggtcagacgatgagaacgacgacaaggataaaagctacgaacctgaggtgattccggtgcagaaaccagtcccggtcaacgaattcaattgccccgtgactttttgcaagaaaggcttcaaatatttcaaaaacctgatagctcacgtgaaagggcacaaagataatgaggatgcaaagcggtttctggagatgcagtccaagaaagtaatctgtcagtattgcaggcggcatttcgtgagtgtcacacacctcaatgaccacttgcagatgcactgtggatcaaagccctacatctgcatccagatgaagtgtaaggccggttttaactcctatgccgagctcctgacacacagaaaagaacaccaggtgtttcgtgctaaatgtatgttcccaaagtgcggacggatcttttccgaggcttacttactttatgaccatgaagcacagcactacaatacatatacgtgcaagtttacgggatgcggcaaagtgtataggtcacagggagagctggagaaacacctggacgaccacagcactccaccagagaaggtcctgccccccgaggcacaactgaattctagtggagactcgattcagccatctgaagtaaatcagaatacagccgagaatattgaaaaagagcggagcatgctgccatctgaaaataacattgaaaacagcctcctggcagacagatccgatgcctgggacaaatccaaagcagaaagcgcagtgacaaaacaagatcagatttcagcttctgagctcagacaggctaacggtcccctctcgaatggcctggagaacccagctactactcctcttcttcaatcatccgaagtcgccgtgtccatcaaggtctccctcaatcagggaattgaggacaatttcgggaagcaggaaaattctactgtggaggggagcggtgaggcactcgtaacagatctgcacacgcctgtcgaagacacatgcaatgacttatgtcacccagggttccaggaaagaaaggagcaggattgtttcaacgatgcacatgtcactcagaacagtttggtaaacagcgagacattgaagatcggcgacttaactccccaaaatttagaacgccaggttaacaacctgatgactttctctgtgcagaaccaggccgctttccagaacaatctgccaacttccaagtttgaatgcggcgacaacgttaaaactagctctaatttgtataacctcccactcaaaacattggaaagcattgcctttgtgcctcctcagtctgatctgagcaactccctgggcaccccttctgtcccccctaaggctccagtccaaaaattctcgtgtcaggtggaaggctgcacccgcacctacaactcctcccaatccattggcaagcatatgaagaccgctcaccctgatcagtatgctgcgtttaaaatgcagcggaaatctaagaagggacaaaaagctaataacctgaatactccgaacaacgggaagttcgtctactttttgccttctccagtgaactcatctaacccattttttacctctcagaccaaggcgaatggcaaccctgcatgctccgcccagttgcaacatgtatcccccccaattttccctgcacacctggcctccgtaagcaccccactgctgtcctctatggaaagcgtgatcaaccccaacattaccagtcaggataaaaacgagcaaggcggcatgttgtgcagtcagatggagaatctaccctcaacagctctgcccgctcaaatggaagacctcaccaaaacagtactgcctttaaacattgactctggcagcgatccattcctacctctgccggccgaatcatctagcatgagtctctttccctccccggctgactctggcactaacagtgtgtttagccagcttgaaaacaatacgaatcactatagctcccagatcgaggggaacaccaactcttctttcctgaaaggcggaaacggtgaaaatgctgtgtttcctagccaggttaatgtcgcgaacaactttagcagtaccaacgcccaacaaagcgccccagagaaagtcaagaaagatcggggaaggggtccaaacggcaaggagcgtaagcctaagcacaacaaacgggcgaaatggcctgcgatcattagagatgggaagtttatttgctccaggtgctaccgggcctttactaacccccgcagtctgggaggccacctatctaaacggtcttactgtaagccgttggacggagctgagatcgcccaggaactcctccaatctaacggccagccttcactcttagcttccatgatcctgagtaccaatgcagtgaatctgcaacagccacagcagtcaacatttaacccggaggcttgcttcaaggaccctagttttctgcagctacttgccgaaaaccgcagccctgcgtttctccctaacacatttccgcgaagcggggtaaccaacttcaacacgtcagtctcgcaagagggctccgagattatcaagcaagctctggaaaccgccggcataccctcgacgttcgagggggcggaaatgctgtcccacgtgtcgaccggctgtgtctccgacgcttcccaagtcaatgctaccgtcatgccgaaccctactgtgccccccctgctccacactgtgtgccatcctaataccctgctcaccaaccagaataggacttcaaactcaaaaacgagctcaatagaggaatgtagtagcctcccagtgttcccgacaaacgacctgttactcaaaacagtcgagaacggcctgtgctccagttcattcccaaatagtggcggcccttcacagaacttcacgagcaacagcagtagggtcagtgtgatttccggccctcaaaatacccgctcctcccacttgaataaaaagggcaactcagcaagtaaacgtcgtaagaaagtggcacctccgctgatagccccaaatgctagccagaacttggtgacctcagatcttaccacgatgggactgatcgcaaagtcagtggaaattcccacaaccaacctccactcgaatgtgatacctacttgcgaaccacagagtctggtcgagaatctcacccaaaagttgaacaatgtgaacaaccagctattcatgaccgatgtgaaagagaacttcaagaccagtctcgaaagtcacacagtgctcgcgcctctgactcttaagacagaaaatggcgattcccagatgatggctctgaacagttgtacaacctctattaattctgatctccagatttctgaggataatgtcattcagaacttcgaaaagactcttgagataattaaaacggctatgaactcgcagatacttgaggtcaaatcaggctcccagggagccggggagacttcacaaaatgcgcagattaactacaacatccaactgccttctgttaatacagtgcagaacaataagcttcctgacagctcacccttcagcagctttatctccgttatgccaacaaagagtaatataccgcagagcgaagtctcgcataaggaggaccaaatccaagaaatccttgaaggcctgcagaagcttaaactcgagaatgaccttagcacccccgcttcccagtgtgtgctgattaacacaagcgtaaccttgacgcctacacctgtcaagtccaccgcggatattactgtcatccaaccagtaagtgagatgatcaatattcaattcaacgataaagttaacaaacccttcgtgtgtcagaaccagggctgcaactactctgctatgactaaagacgcattgttcaagcactatggaaagatccatcaatacacgcccgagatgatcttggagatcaaaaagaaccaactgaagttcgcgccattcaaatgcgttgtgcctacatgcacaaaaactttcacacgtaatagtaacctgagggcccactgtcagttagtgcaccactttaccactgaagagatggtgaagctcaaaatcaagaggccatacgggcgtaaatcccagagcgagaacgttcccgcttccaggtccacacaggtgaagaaacagctggccatgactgaggagaataaaaaggagtcccaacccgctctcgaacttagagcagaaacccagaacacccactcgaacgtcgcagttatccctgagaagcagctagtagagaagaagtcacccgataaaaccgagtcttccctgcaggtgatcaccgtcacttccgaacagtgtaatacaaacgctctgacgaatacacagacaaagggaaggaagatcaggcgccacaaaaaggaaaaggaagagaaaaagcggaagaagccagtatcacaaagcctggagttcccaacccggtacagtccctatagaccctacaggtgcgtacaccaagggtgttttgcggctttcactattcaacagaacctgatcctgcattaccaagctgttcacaagtccgacttgcccgctttttctgcagaagtggaagaagaatctgaagccgggaaggaaagcgaggagacagagacaaaacaaactctgaaggagtttcggtgccaggtatcggactgctcccgaatatttcaagccattactggattgatacagcactacatgaagttgcacgagatgacccctgaggaaatcgagagcatgacagccagtgttgacgtcgggaagttcccctgcgaccagctggagtgcaaatcctcctttaccacatatctgaattacgtcgttcatctcgaggctgatcacggaatcggccttagagcctcaaagacagaagaagacggcgtttacaagtgcgattgtgaaggttgtgatagaatatatgccacccgatctaatctgctgaggcacatcttcaacaaacataatgacaagcacaaagctcacctgatcaggccgcgaaggcttactcctggtcaggaaaacatgtccagtaaagccaaccaagaaaagagcaaaagcaagcacagagggaccaagcactcaaggtgcgggaaggagggcatcaaaatgcccaagacaaagaggaagaagaaaaacaatctggagaacaagaatgctaaaattgtgcagatcgaggaaaataaaccatactccctcaagcgtggcaagcacgtgtacagtatcaaagcccggaatgatgcgctttccgaatgcacgagccgttttgtgacacagtacccttgcatgataaaagggtgcacgtccgtagtcacctccgaaagtaacattatcagacactataaatgtcacaagctgagcaaggcctttaccagccaacaccggaatctcctaatagtgtttaaaaggtgttgcaattcccaagtgaaggaaacttccgagcaggaaggcgcaaaaaacgacgtgaaggattctgacacctgcgtgtccgaatctaatgacaatagtagaaccacggcaacagtgtctcagaaagaggttgagaagaacgaaaaggatgaaatggacgagctcacggaattgttcatcactaagctgatcaacgaggattctacatcagtcgagactcaggccaacactagcagtaatgtgagtaatgactttcaggaggataacctgtgtcagagtgaaagacaaaaggcttccaatctgaagcgcgtaaataaggagaagaacgtgtctcaaaacaaaaagagaaaagtggagaaggctgagcctgcctctgcagccgaactatctagtgttcgcaaggaagaggaaacagctgtggcaatccagacaatcgaggagcaccccgcgagcttcgactggtcctcctttaagccaatgggatttgaagtcagtttcttgaagtttctggaggaatcagccgtgaagcagaagaaaaatacggataaggaccaccctaataccgggaataagaaaggtagccatagcaattccagaaaaaacatcgataaaaccgccgttaccagcgggaaccacgtgtgcccctgcaaggagtctgaaacctttgttcagttcgcaaaccccagtcaactgcagtgttctgacaatgtcaagatcgtattagataagaatcttaaggactgcactgaattggttctcaaacaacttcaggaaatgaagccaactgtgtccctaaaaaaactggaggtgcattccaacgatccagatatgtctgtcatgaaggacatttccatagggaaggccacaggcagaggccagtactag

SEQ ID NO: 21441 - DNA, 3201 bp, Artificial Sequence
  Description of Artificial Sequence: Synthetic coding sequence
atggagggcctgctgcactacatcaaccccgcccacgccatcagcttgctgtcggcacttaatgaggagcgattgaaaggtcagctatgtgatgtgctgttgattgtcggagaccagaaattccgggctcacaagaatgtgcttgcagcgagctccgagtactttcaatctctttttaccaataaggagaatgaaagccagactgtatttcagttggacttctgtgaacccgacgctttcgacaatgtacttaactatatctattcatcttctctctttgtggagaagagtagtctagccgccgtgcaagaactcggatacagccttgggattagcttcctgactaatattgtgagtaaaacgccacaagcaccgtttcccacctgtcctaaccgtaagaaagtattcgtcgaagatgatgagaattcttctcagaagcggtctgtcattgtgtgccaaagtcggaacgaggcccaaggcaagacagtgagccagaaccagccagacgtatctcacacgtccagacctagccctagtattgctgtgaaggccaacaccaataagccacacgtgcccaaacctatcgagccgttgcataatctgagtctgacagaaaagtcttggccaaaggactcctcagtggtgtatgctaaatccctggagcactctggcagtctcgatgatcctaacagaatttccttagtcaagcgtaacgccgtcctgccaagcaaacctttacaggacagggaagccatggacgataaaccgggtgtatcaggacagctgccaaagggcaaagctcttgagctggccctgaagcggcccagacctcccgtgctctcagtgtgcagctcttcagagactccctatctcctcaaggagaccaacaaggggaacgggcagggggaggacagaaatctcctctactacagcaagctgggcctggtcatcccgagttcagggtcagggtcggggaaccagagcattgaccgttccggaccactagtgaagagccttctgcggcgctcactaagtatggattcccaggtcccggtttattctccaagcatagatttaaagtcatctcaaggttcaagttccgtttcatcggacgcccctggtaatgtgttgtgtgcactcagtcagaaaagctcactcaaggactgttctgagaaaacagccctggatgacagaccccaagtgctgcagccccatcgtcttaggtccttctcagcctcccagagtactgatcgggaaggagcttcacctgttaccgaggtgagaataaaaaccgagcctagcagtccactatccgatccctccgacatcattcgagtgacagtcggggacgccgcgaccaccgccgccgcttcttccagttctgttacacgagacttatcactgaagacggaggatgatcagaaagacatgtctaggctccctgctaagagacgattccaggctgaccgcagactcccattcaaaaagctgaaagttaatgaacatggtagtcctgtcagtgaagataatttcgaagaaggatcaagccccacactgctcgacgcagactttccagacagtgacctcaataaggacgagttcggagaacttgaggggactagacccaacaaaaagttcaagtgcaagcattgccttaagatatttaggagtactgcaggtctccataggcatgtcaacatgtaccacaaccccgaaaaaccttacgcgtgtgacatatgtcacaagagattccacacaaatttcaaggtttggacacactgccagacccagcacgggatcgtcaagaatccgtccccggcaagttcctctcacgctgtcttggacgaaaaatttcagcgtaagcttattgacattgttagagagcgtgaaatcaagaaagcgctgatcattaagctccgccgaggtaagccaggcttccagggccaatcgtcatcgcaggcgcagcaggtcattaaacgaaatcttcggtctcgcgccaaaggcgcctatatctgcacttactgtggcaaggcgtatcggtttttgtctcaattcaaacagcatattaagatgcaccccggggagaagccactcggcgtaaacaaggtcgccaaaccaaaagagcacgcccctttagctagtcccgttgagaacaaggaggtttaccagtgcaggctgtgcaacgctaagctttcgtctttactagaacagggaagtcacgagcgactatgcagaaatgctgcagtgtgcccatactgcagcttgcgcttcttttcccccgaacttaaacaggaacatgagtctaagtgcgaatataagaaattaacttgcctcgagtgtatgcgtacctttaaatcttctttctccatatggcgacaccaggtcgaggtccataatcaaaacaatatggcgccgacagaaaacttttctctgcccgtgctggaccacaatggtgatgtgacggggtcaagtagacctcaatctcaacccgagccaaataaggtgaatcacatcgtgacaacaaaagatgataacgtcttttctgacagcagcgagcaggtgaatttcgacagcgaagattctagttgcctccctgaggacctgagtctgtccaagcaactcaagattcaggttaaagaagaacctgtggaagaggccgaagaagaagcccccgaggcttcaacagcgcctaaggaagccggtcccagtaaggaggcgagtctttggccctgtgaaaaatgcggcaaaatgttcaccgttcataaacagctggagcgtcaccaggagctgctgtgctccgtgaagccctttatatgtcatgtgtgtaacaaggcatttcgaacgaattttaggttgtggagccactttcaatcccatatgagtcaggctagcgaagagagtgcacataaagagagcgaggtgtgtcctgttcccactaatagcccttcaccaccccctttgccgcctcccccccccttgcctaagatacagccactggaacccgacagtcctacggggctcagtgagaacccaactcctgccacagaaaaattattcgttccacaagaatctgatacactcttttatcatgctccaccgctgtcagctatcaccttcaagcgccagttcatgtgcaagctgtgtcatagaacgtttaagacagcattttcgctgtggtctcatgagcagacccataactag

SEQ ID NO: 21442 - DNA, 150 bp, Artificial Sequence
  Description of Artificial Sequence: Synthetic coding sequence
atggagggcctgctgcactacatcaaccccgcccacgccatcagcctccttagcgccctgaacgaggagagactgaaagggcagctatgcgacgtgctgctgatcgtcggcgaccagaaattccgagcacacaagaatgtgctggcctag

SEQ ID NO: 21443 - DNA, 3201 bp, Artificial Sequence
  Description of Artificial Sequence: Synthetic coding sequence
atggagggcctgctgcactacatcaaccccgcccacgccatcagcctgctttccgcacttaacgaggagagactgaagggacagctgtgcgatgtcctcttaattgttggcgatcaaaagtttcgggcccacaagaatgtcctggccgctagcagtgaatatttccaatctctatttaccaataaagaaaacgagagtcagacagtgtttcaactggatttttgcgagcctgacgctttcgacaatgtcttgaattacatttactcgtccagccttttcgtggagaaaagctctttggccgccgtgcaggagctgggctactccttgggtatttcttttctgacaaacatcgtaagcaagacccctcaggcaccctttcccacttgtccgaaccgcaagaaagtgttcgtggaggatgacgagaattcgagccaaaaaagaagcgtgatcgtatgccagagccggaacgaagctcagggcaaaaccgtaagtcagaatcagcccgacgtcagccatacctctcgacccagcccttcaattgctgtgaaggcaaataccaacaagccccacgttcctaagcctattgaacccctgcacaacctctcactgacagaaaaatcttggcctaaagactcaagcgtcgtctacgccaagtctctggagcacagcgggagcctggacgacccaaaccggatctctttagtaaagaggaatgcagtgctccctagtaaaccccttcaggatagggaagctatggacgacaagcccggcgtgtctggccagcttccgaaagggaaggctctggagctggcactaaagcggccaaggccacctgtgttgtccgtatgttcttcttcagagacgccttatctcttgaaggaaacaaacaaagggaacggacagggggaggaccggaatctcttatattattccaagctggggcttgtgatcccctcctccggaagcgggagtggaaaccagtccatcgatcgctcaggccctctggtgaaatcattacttcgacggagcctgtcgatggattcccaagtgcctgtgtacagcccctccatagatcttaagagtagccagggtagcagctccgtgtcatctgatgcacccggtaatgtgctgtgtgctctgtctcagaaaagttctttgaaagactgtagcgaaaagaccgccctagacgatcgccctcaggtactgcaacctcaccgcctgcggtcattttctgcaagtcagtctaccgaccgtgagggcgccagcccagtcacagaagttagaattaaaactgagccatcttcacctctctccgatcccagtgatataatcagggtcacagtgggggatgcggcgaccactgccgctgcctcctcatcttctgtcacacgggatttatctctgaagacagaagatgaccagaaggacatgagccgcctgccagccaagcgaaggttccaggcagaccgtcgtcttccatttaagaagctgaaggtgaacgaacacggatcacccgtgagtgaagataatttcgaggaaggctcgagccctacgctcttagatgcagacttcccagactcagaccttaataaagatgaattcggagagttggagggtaccagaccaaacaagaagttcaaatgtaagcactgcttaaaaatctttaggtctacagccggcctgcataggcacgtcaatatgtatcataaccccgagaagccttacgcctgcgatatctgccataagcgttttcatacaaattttaaggtctggacgcactgtcagacccagcatgggattgtgaagaatccttcgccagccagttcatctcacgctgtcctggatgagaagttccagcggaaactgatcgacatcgtccgggagagagagatcaagaaggctctcatcattaagctcaggcgcgggaaacccgggtttcaaggacaatcgtcctcccaggcacaacaagtcatcaagaggaacttgcgctcccgtgccaagggggcgtacatatgtacctactgtggtaaggcataccggtttctgtcccagttcaagcagcacattaagatgcatcccggggagaaacctctcggggttaacaaagttgctaagccaaaagaacacgcccccctggcttccccggtggagaacaaagaggtgtaccagtgtagactctgcaatgccaagttgtcctcattgttggaacaggggtctcatgaacggctgtgcaggaatgccgccgtgtgtccctattgctcgcttagattcttcagtccggagctgaaacaggagcacgagagcaaatgcgaatacaaaaaattgacgtgcctggaatgtatgcgcacatttaagtcttccttctcaatctggcgccatcaggtggaagtccataaccagaataacatggcacccacagagaacttctccctaccagtgcttgatcacaacggcgatgtcacgggctcttccaggcctcagtcccagcctgagcccaataaagttaaccatattgtcaccacaaaggacgacaatgtcttcagcgactcgagcgaacaggtgaacttcgatagtgaggattcttcctgccttcccgaggatttatccctaagcaagcagcttaaaatacaggtgaaagaagaacccgtcgaggaggcagaggaagaggcacctgaagcaagcactgctccaaaggaggccggcccatcaaaagaggctagtttgtggccttgtgagaaatgcgggaaaatgttcaccgtgcacaagcagctggagaggcaccaggagctactgtgcagcgtcaagcctttcatctgtcacgtgtgcaacaaggcattccggacgaacttccgcctgtggtctcattttcagtcacatatgagccaggctagcgaggaatctgctcataaggaaagcgaggtgtgccctgtccctacgaattccccttctcctcctcctctgccaccacccccacctctgcctaaaatccagccccttgaacccgactcaccaactggactgtcagagaacccaaccccagccactgaaaagcttttcgtgcctcaggagtccgatactctgttctaccacgccccccccctatccgctatcaccttcaaaaggcagtttatgtgtaaactgtgccatagaacattcaagacagcctttagtttgtggtcacacgaacagacacacaactag

SEQ ID NO: 21444 - DNA, 2598 bp, Artificial Sequence
  Description of Artificial Sequence: Synthetic coding sequence
atggagggcctgctgcactacatcaaccccgcccacgccatcagcctactgagtgccctcaacgaagagcgcctgaagggacagctttgcgacgtcctcttaatagtgggcgaccagaagttcagggcccacaagaatgtcttggccgcttcatcagaatacttccagtctctctttaccaacaaggagaatgagtcacagacggtgttccagctggacttctgtgaacccgacgccttcgataacgttctgaattatatctatagttcgtcgctttttgtagaaaagtctagtttggcagctgtacaggagctaggttactccctcggtatctcgtttctcacaaacattgtgtctaagactcctcaggctccctttcctacttgccctaatcggaaaaaggtgttcgtcgaagacgacgaaaattccagtcagaaacggtctgttattgtgtgccaaagtagaaacgaagcccaagggaagacagtgtcccagaaccagcctgacgtgtctcacacttcccgtcctagccctagcatcgccgtgaaagctaataccaataagcctcacgtcccaaagccgatcgaacctctccataacttaagcctgactgagaaatcatggcccaaagattcatcagtggtctatgcaaaaagtctggagcatagcggctcactggacgaccccaacaggatatcccttgtcaagaggaacgccgttttaccttctaagccactgcaggaccgtgaagcgatggacgataaacctggagtgagcgggcagctgcccaagggcaaggccctcgagctggccctgaagaggccacgaccgcccgtactcagcgtgtgtagctcgtctgaaaccccttacctgctcaaagagaccaataaagggaatggccagggggaggaccgtaaccttttgtactacagcaaattggggctcgtgatcccctcctctggatccggttctggcaaccaatccattgatcggagcggcccactggtcaaaagtctgttgagacgaagtctgtcaatggatagccaagtccccgtgtattcaccatctatcgatcttaagagcagtcaggggtcatcttctgtatcttctgatgctcccgggaatgttctctgtgcactctcgcagaaatcttcccttaaagattgctccgaaaaaaccgccttggacgatcgcccacaggtgctacaaccccaccgtctcaggagcttttccgctagtcagtctaccgacagagagggggcaagtcctgtcaccgaagtccgcattaaaacagaacctagctctccccttagcgacccctctgacattataagagtcaccgtgggagatgcagccactacagctgccgccagctcttcctcagtcactagggatctctcattaaagactgaagatgaccagaaggatatgagcagattgcccgcaaagcggcggttccaggccgaccggcgccttcccttcaaaaagcttaaggtaaacgaacacggttcacccgtgtcggaggacaactttgaggaggggtcatcaccaactctcctggacgccgattttccagattccgatctaaacaaagacgagttcgagcagggcagtcatgagcggctctgcaggaacgcagccgtatgcccctactgtagcctgcggttcttttcccctgagctcaagcaggaacatgagtctaaatgcgaatacaagaagctaacctgtctggagtgcatgaggacattcaaatcttctttttcaatctggcgccaccaggtggaggttcataaccagaacaatatggccccgaccgagaatttttcactgcctgtgctggaccataacggcgacgtcacaggaagtagtcgccctcagtcccagcccgagcccaataaggtgaaccacattgtgaccacaaaagatgataacgtcttctccgactcgagtgagcaagtcaacttcgacagcgaggatagttcttgtttgcccgaggacctgtcattgagcaagcagttaaagatccaggtcaaggaggaacccgtagaggaggccgaggaggaagctcctgaagctagcacggctccaaaggaggccggtccgagcaaagaggcctcactgtggccttgtgagaaatgtggcaaaatgttcacagtgcataaacaactggaaaggcatcaggagctgttgtgctccgttaaaccctttatctgccacgtgtgtaacaaggcctttaggacaaattttaggctgtggtcccatttccagtcacatatgtcacaggcttccgaggagagcgcccataaagaatcagaggtctgccccgtgcctaccaacagcccatctcccccccctctgccacccccaccacctttgcctaagatccagcccttggagccggatagccccacaggcctgagcgagaatccgacacccgcaacagagaagttgttcgtgccccaggagagcgatactctattttatcacgccccgcctctctctgccattacctttaagagacagttcatgtgcaaactgtgccaccgaactttcaaaaccgcattcagcctttggagtcatgagcaaacccacaattag

SEQ ID NO: 21445 - DNA, 3201 bp, Artificial Sequence
  Description of Artificial Sequence: Synthetic coding sequence
atggagggcctgctgcactacatcaaccccgcccacgccatcagcctcctaagcgcactcaatgaagaacgcctgaaggggcaactttgcgacgtccttctgatagtgggagaccaaaaatttagagcacacaagaacgtcctggcagctagctccgagtacttccaatcactgttcacaaacaaagaaaacgagagtcagactgtattccaactggatttttgcgaacccgacgcatttgacaacgtgttgaattacatatacagctctagcctgttcgtcgagaagtcctcactggcggctgtgcaggagctgggatactccttaggtatcagcttccttacaaatatcgtgtccaaaaccccgcaggcccctttcccaacatgtcccaatcggaagaaggtgtttgttgaagacgatgagaattcctcccagaagcgctcagtaattgtctgtcagtccagaaacgaggctcaggggaagaccgtgtcacaaaatcaacctgatgtgtcacacactagcaggccctcacccagcattgccgtgaaagccaacacaaacaagccgcacgttcctaaaccaattgaaccactgcataacctttcactgactgaaaaaagctggcctaaagactcttctgtggtatacgccaaaagtctggagcactctggtagcttggacgaccctaatcggattagcctggtgaagaggaatgctgtgttgccatcaaagcccctccaggatagagaggccatggacgataagcctggcgtgtccggtcagctgccgaagggcaaggcgttagagcttgcactcaaaagaccacggcccccggttctgtcagtttgcagctcctcagaaacaccctacctgctgaaagagacgaacaagggtaacggccagggggaggaccgcaatctgttgtactattccaaattaggcctggtgatcccttcctcgggcagtgggtcaggaaatcagtctatcgaccgctcaggaccgctggtgaagtcactgttgagacggtccctttctatggattcacaggtgcccgtctactcgcctagtattgatctgaagtccagtcaggggtcgtcttcagtatcctcagatgcccccggcaacgtactctgtgctctttctcagaaaagctcactcaaagactgctcggaaaaaacagcactagacgaccggccacaggtgctgcaacctcaccggctgaggtccttttctgcctctcagagtacggatcgggagggggcttcacccgtaacagaggtgaggatcaagaccgagccttcatcgcccctctccgacccaagcgacatcatccgcgtcactgtaggtgatgcagccacaacagcagccgctagcagttcctcggtcactcgtgatctctccttgaaaacagaggatgaccagaaggacatgtctcgactacctgccaagcgaagatttcaggctgaccggaggctgccctttaaaaagctcaaagtgaatgagcatgggagtcctgtgtcagaagacaatttcgaggaagggtccagtcctacattactggacgcggatttcccggattccgatctcaataaagatgagtttggagaactggagggtactcgacctaacaagaaatttaagtgtaagcactgcctgaagattttccggtctaccgcgggactccaccgtcacgtcaacatgtatcataatcccgagaaaccctatgcttgtgacatatgtcacaagcgatttcatactaactttaaagtttggacacattgccagacgcagcatggaatagtaaagaatccatccccagcatcttctagccacgctgtgctcgacgaaaaattccagcggaagttgatcgacatcgtaagagagagggagataaaaaaggcccttatcatcaagctgcgacgcggtaaacctggttttcaaggacaatcctcctcccaggcacagcaggtcattaagaggaacttgcgatctcgcgctaaaggtgcatacatttgtacatactgtggtaaggcctaccgcttcctcagccagttcaagcagcacatcaagatgcacccaggcgagaaaccacttggagtgaacaaggtagctaaacccaaggaacacgcccccctagccagcccagtcgagaacaaagaagtgtatcagtgccgcctgtgcaatgccaaactatcaagccttctggagcagggttcccatgaacgcctgtgcagaaatgccgctgtttgcccttactgcagcctgcggttcttcagtcccgaattaaaacaggaacacgaaagcaagtgtgagtacaagaagctgacctgtctggagtgtatgaggacgtttaaatcatcattctcaatttggaggcaccaggtggaggtgcataatcaaaataatatggcacctaccgagaatttcagtctgccagtgctcgaccacaatggggatgtgacaggatcatcacgccctcaatctcagcccgagcctaacaaagttaatcatatcgtgacaactaaagatgataacgtgttcagcgacagttcagaacaggtaaatttcgattctgaggactccagctgtctacccgaggatctgagcttgagtaaacagttgaaaattcaggtgaaggaagagcccgtggaggaagcggaagaggaagctccagaagcgtccacggcccccaaagaagccggccccagcaaagaggcatcattgtggccatgtgagaagtgtggcaaaatgttcaccgttcacaagcagctggaaaggcaccaggagctcctgtgcagcgttaaacccttcatttgccatgtgtgtaacaaagcattcaggacgaatttccggttgtggagtcacttccagagtcatatgtcccaagcatctgaggagtcagcgcataaggagtccgaggtttgtccagtcccgacaaattcacctagcccacccccgcttccacccccccccccattacccaagatacagccactggagcctgacagcccaactgggctcagcgagaatccaacccccgcgacagagaagctgttcgtgccacaggaaagcgatacactattctatcatgcccccccactctccgccattacatttaaacgtcagttcatgtgcaagctgtgtcatcgcactttcaaaaccgccttttccttatggagccacgagcaaacacacaactag

SEQ ID NO: 21446 - DNA, 360 bp, Artificial Sequence
  Description of Artificial Sequence: Synthetic coding sequence
atggagggcctgctgcactacatcaaccccgcccacgccatcagccttctaagcgccctgaatgaagaacggcttaaggggcaactttgcgatgtgctgctcattgttggagaccagaagtttcgtgctcataagaatgtacttgctgcttcttcagaatacttccagtccctgttcacaaataaagagaacgagtcccaaacagtttttcaactggacttctgcgagcctgacgctttcgataacgtcctgaactacatctactcctcttcactttttgtggagaagtcatccctggctgctgtacaggagttaggctatagcctaggtataagctttttaactaatattgtttcctag

SEQ ID NO: 21447 - DNA, 150 bp, Artificial Sequence
  Description of Artificial Sequence: Synthetic coding sequence
atggagggcctgctgcactacatcaaccccgcccacgccatcagcctgctgagcgcactaaacgaagagagactgaaaggtcagctctgcgacgtgctgctcattgtgggtgaccagaaattccgcgcccataaaaatgttctggcatag

SEQ ID NO: 21448 - DNA, 1872 bp, Artificial Sequence
  Description of Artificial Sequence: Synthetic coding sequence
atggcccacaagtacgtgggcctgcagtaccacggcagcgtgacctttgaggacgtggccatcgcttttagtcaacaagagtgggagtcccttgactcatctcagagaggtctctaccgcgacgtgatgttggagaactacagaaacctcgtatccatgggacacagtcgctcaaagccccacgtgatcgctctcctggaacagtggaaggagcctgaagttactgtaaggaaagatgggaggcgatggtgcactgacctgcagctcgaagatgatactataggttgtaaagagatgcctaccagcgaaaactgcccaagctttgcacttcatcagaaaatatctcgacagaaacctagggagtgccaggaatatggtaaaactctgtgtcaggatagtaaacctgtgcagcacgagaggatccactcatctgagaagcccaatcggtgcaaagaatgtggaaagaacttttccaacggacatcaacttacaattcaccaacgtctgcacgttggggagaaaccctacaaatatgagaaatgtgggaaagctttcattagtggttccgcattcgtaaagcacgggcggatacacactggggagaagcctctcaaatgcaagcagtgcggtaagaccatctcagggtcttaccagctgaccgtccacaaaagcatacacactgggaagaaaccgtatgaatgcggggaatgcggaaaggcttttctggtctatgggaagcttactcggcaccaatcaacacataccggggagaagccctttgggtgtgaagagtgcggtaaggccttttcaacttttagttatctggtccaacaccagcggatacatacttcagagaaaccatacgagtgtaaagaatgcggtaaggctttttcaacctcctcaccactggcaaaacaccagagaatccacaccggagagaaaccctacgaatgcaaagaatgcggcaagtcctttaccgtatatggccagctgacacgccaccagtcaatccacaccggggagaaaccgttcgagtgcaaagagtgtggaaaagctttcaggttgagctcctttcttcatgcacatcaacgtatccatgctgagatcaagccctacggctgcaaggaatgcggcagaactttttcgcgggcctcctacttggtgcaacatggaagactgcatactggcgaaaagccatatgaatgtaaggagtgcggcaaagcattctccactggctcatatctggtgcaacatcagcggattcacaccggagagaaaccgtatgagtgcaaagagtgtggcaaagcttttatatcacgtcaccagctgacagttcatcagagagtccacacgggcgaaaaaccctacgaatgtaaagagtgtggtaaagcatttcgtgtacacgtgcatctcactcagcaccgcaagatccatacggacgttaagccctacgaatgtaaggagtgtgggaagaccttctcccgtgcgtcatatctcgttcagcactcgcgcatccacaccggcaagaagccttacgaatgcaaagaatgtggcaaagccttttccagcgggtcttacttggtgcagcatcaaaggatacacacgggcgagaaaccctacgagtgtaataaatgcggtaaagcattcactgtgtatggccagctgatcggacaccaatccgttcatacaggggagaagccattcgagtgtaaggagtgcggcaaggccttccgactgaattcctttctcacagagcaccagcgcgtgcacaccggagagaaaccgttcaagtgcaaaaaatgcggcaagaccttcaggtatagcagcgcccttaaggtgcatcttcgcaagcatatgtctgtcatcccctag

SEQ ID NO: 21449 - DNA, 945 bp, Artificial Sequence
  Description of Artificial Sequence: Synthetic coding sequence
gagtgcggcaaggccttcagcaccttcagctacctggtgcagcaccagagaattcacacatccgagaagccttatgaatgcaaggagtgcggtaaggcattttcaaccagctcccctctggctaagcaccaacgtatacacactggggagaagccttatgaatgcaaagaatgtggtaaaagctttactgtctatggacaactcacgcgtcatcagagcatccatacaggagaaaaaccattcgaatgtaaggagtgcggtaggaccttcagccgagcaagctacttggttcagcacggacggttgcacaccggcgaaaaaccatacgaatgcaaggaatgcggcaaagccttttcaacagggtcatatttggtgcagcaccagcgtattcacaccggagagaagccctacgaatgtaaagagtgtggcaaggccttcattagccgacatcagcttacagtgcaccagagagtgcataccggcgaaaagccatatgagtgtaaggagtgcggcaaggcgtttcgcgtgcatgtgcacctgacgcaacataggaagatccacacagacgtgaaaccctacgaatgcaaggagtgcggtaagacattttcacgagcctcctatctagtacagcacagccgcatccacaccgggaagaaaccctatgagtgtaaagaatgtggaaaagcgttctcttccggatcctacctggttcagcatcaaagaatccacaccggcgaaaagccctatgagtgcaataaatgcggaaaggccttcaccgtttacggtcagctaatcgggcatcagtctgtgcacacaggcgagaaaccttttgagtgcaaggaatgcggcaaagcattcaggctcaattctttcctgacggagcaccagagagtgcacactggtgaaaagcccttcaagtgcaagaagtgcggaaagaccttttag

SEQ ID NO: 21450 - DNA, 1629 bp, Artificial Sequence
  Description of Artificial Sequence: Synthetic coding sequence
atggagcccaaggacctgcagctggaggacgacaccatcggctgcaaagaaatgcccacatctgagaactgtccatctttcgctctgcaccagaaaatctccaggcagaagcccagggaatgccaggagtacggaaaaaccctttgtcaggattctaagccggtgcaacacgagcggattcacagttccgagaagcccaaccgatgtaaagaatgcgggaaaaacttctctaatggccatcagctgacgatccatcaacggctacatgtaggagagaagccctacaaatatgagaagtgcggcaaggcctttatcagcgggagtgcttttgtgaagcatggcaggattcataccggagaaaaacctctcaaatgcaagcaatgtggcaagacaatctctggtagttaccaattgacagttcataagtccatacacacaggcaagaagccttacgaatgtggagaatgtggcaaggcctttctggtatatggaaagctcaccaggcaccaaagcacgcacacaggcgagaagccatttggatgcgaggaatgcggcaaagccttttccaccttctcatacttggtgcagcaccagcggatccacacttccgagaagccctacgaatgtaaagaatgcgggaaagctttcagcacctcttctccccttgccaaacatcagcgtattcacaccggcgaaaagccatacgagtgtaaagagtgtgggaaatcttttaccgtgtatggtcagctgacccggcaccagagcattcacaccggagagaaaccttttgagtgtaaagagtgcggaaaggccttccgattaagtagttttctgcacgctcaccagagaatacacgctgagattaagccatatggctgtaaggaatgcggtagaacattcagccgagcgtcatacctcgtccagcatgggcgccttcataccggcgagaaaccctacgaatgcaaagagtgtggcaaggccttctccaccgggtcatatctagtccagcaccagcggatccacaccggcgaaaagccctacgagtgtaaggagtgtggcaaagctttcataagcaggcaccagcttacagtccaccagagggtgcatactggggagaaaccctatgagtgtaaggaatgcggcaaggcttttcgtgttcacgtgcacctgacccagcatcggaaaatccatactgatgttaaaccatacgaatgcaaggaatgtggcaagactttttctagagccagttacttagttcagcacagccggattcatacagggaaaaagccttatgaatgtaaagagtgcggcaaggccttctccagcggctcctacctggtacagcaccagcgaatccacaccggcgaaaagccatatgaatgtaataagtgcggcaaagccttcactgtgtacggccagttgattggccaccaaagtgtgcatactggcgaaaagcccttcgagtgcaaggagtgtggaaaagccttcagactcaatagtttcctgacagagcaccagcgggttcacacaggggagaagccttttaaatgcaagaagtgcgggaaaacatttagatatagcagtgcacttaaagtgcacctgcgcaaacacatgtccgtcattccctag

SEQ ID NO: 21451 - DNA, 1875 bp, Artificial Sequence
  Description of Artificial Sequence: Synthetic coding sequence
atggcccacaagtacgtgggcctgcagtaccacggcagcgtgacctttgaggacgtggccatcgcattcagtcagcaagagtgggagtctctggattcatcacagagggggttgtaccgagatgtcatgttagaaaattatcgcaaccttgtgagtatggctggccacagccgatcaaagcctcacgtgattgccctgctagagcagtggaaagagccggaggtaaccgtacgtaaggacgggagaaggtggtgcacagatttgcagctggaggacgacacaatcggatgcaaagagatgccaaccagtgaaaattgcccctcgtttgcgctccatcagaaaatcagccggcagaagcctagggagtgccaagagtatggaaaaaccttgtgtcaggactcaaaacccgtgcagcatgagcggatacactcctcagagaaaccaaataggtgtaaagagtgcggcaagaacttcagcaatggccaccagctgaccatccatcaaagacttcatgtgggcgagaaaccgtataagtatgagaaatgtggtaaggccttcatcagtggttccgcttttgttaagcacggccgcatacacactggagaaaagcccctgaagtgtaagcagtgtggcaagaccatcagcgggtcgtatcaactgacagtgcacaagagcatccacaccggtaagaaaccatatgagtgtggcgagtgcggtaaggcttttttggtgtatgggaaactaacaagacaccaaagtacacataccggggagaagccgtttggatgcgaagagtgtggcaaagcgtttagcacattttcgtatttggtgcaacatcaaagaatccacaccagcgagaagccatatgagtgcaaagaatgtgggaaagccttctcaacatcctccccgctggcaaagcaccagaggatacatacaggggaaaagccatacgagtgcaaagagtgtgggaaatctttcacagtgtacggtcagctgacccggcaccaatccattcacaccggagagaagcctttcgaatgtaaagagtgcggaaaagcctttaggctctccagctttttgcacgctcatcagcggatccatgcagaaatcaagccatatggctgcaaggagtgtgggcggactttttcccgggcatcctacctggttcagcacggtagacttcacaccggggaaaaaccctatgagtgcaaagagtgcgggaaagccttcagcacaggcagctacttagtgcagcaccagaggatacacacaggggaaaagccatacgaatgcaaggaatgcggtaaagcattcataagcaggcaccagctcacagtgcatcaaagggtccacactggtgagaagccctacgagtgcaaagagtgcgggaaagcctttagggtacatgtgcatcttacccagcaccgcaaaattcataccgatgtgaaaccatacgagtgcaaagagtgcggcaaaacattttctagagcctcttatcttgtgcaacactctagaatccataccggtaagaagccctatgagtgtaaggagtgcgggaaggccttttctagtggctcttacttagtgcaacatcagaggatacatacgggagagaagccttatgagtgtaataaatgtggaaaggcttttaccgtgtatggtcagctaattgggcatcaaagcgtgcatacaggagagaaaccatttgagtgcaaagagtgtggcaaggctttccggctgaattcattcctgacagaacaccagagggtgcacaccggcgaaaagcctttcaagtgcaaaaagtgcggaaaaacattcagatactcttctgctctgaaggttcacctgaggaaacacatgagcgttatcccttag

SEQ ID NO: 21452 - DNA, 1872 bp, Artificial Sequence
  Description of Artificial Sequence: Synthetic coding sequence
atggcccacaagtacgtgggcctgcagtaccacggcagcgtgaccttcgaagacgtagccattgcttttagccagcaagaatgggagtctctcgatagctcccaacgaggtttgtacagagatgtgatgttggagaactaccgaaacctggtgagtatgggacacagccgttcaaagcctcacgttatcgcactcttggagcagtggaaagaaccagaggttacagtcaggaaggatggcaggcggtggtgtacagatctgcagctagaggatgacactatcgggtgtaaagaaatgccaacttctgagaactgtccctccttcgcactgcaccagaagatttcccggcagaaacctcgggaatgccaggaatatggtaagactctttgtcaggactcaaagcctgttcagcacgagaggattcattcctccgagaaacctaatcgctgtaaagaatgcggcaaaaattttagcaatggccatcagctgacaattcaccagagactgcatgtgggtgagaaaccgtacaagtatgagaagtgtggaaaagccttcatctctggttccgcctttgttaaacatggtcggatacacactggcgagaaacccctgaagtgcaagcagtgcggcaagaccatcagcggcagctaccagctgacagttcacaagagcatccatactggcaagaaaccctacgagtgtggagagtgtggaaaggcctttctggtgtacggtaaacttacccgtcaccagagtacgcataccggagagaagccctttggctgcgaagaatgcggcaaagcattctctacgtttagctacttagtgcaacaccagagaattcacacatctgaaaaaccttatgagtgcaaggagtgcggcaaagcgttctccacgtcaagccccttagcaaagcatcaacggatccacacaggagagaagccttatgagtgcaaggaatgtgggaagtcctttactgtttatggccaactcacgcgccatcagtcaatccataccggggaaaaaccatttgagtgcaaagagtgtggtaaggccttcagactatcatcctttctgcacgcccaccaacggatccacgccgaaattaagccctatggctgcaaggagtgcggacgaacattctccagagcttcttacttggtgcaacatggccggctgcataccggcgaaaagccatacgagtgtaaagaatgtgggaaggcgttttctaccggcagctacctcgtgcaacaccagaggatccatactggagaaaagccctatgaatgtaaagaatgtggaaaggctttcattagcaggcaccagctgaccgtccaccaaagagtgcacactggtgaaaagccctacgagtgtaaggagtgcggaaaggccttccgggttcatgtgcatctgacacagcaccgtaaaatacataccgatgtgaaaccgtacgagtgtaaggaatgcggaaaaacattctcacgtgcatcatacctcgtgcagcacagcagaatacacaccggaaagaagccctacgagtgtaaggagtgcggaaaagccttcagtagcgggagctatttggtgcagcatcagcggatacatacaggcgagaaaccttatgagtgcaacaaatgtgggaaagcattcacggtgtatggccagcttattggccaccagagcgtgcacaccggagaaaaacccttcgagtgcaaggagtgcggaaaagctttccgcctgaactcatttctcacagaacatcagcgggtgcacacaggcgagaaaccgttcaagtgtaagaaatgtggaaaaacattccgatacagctccgccctgaaagtgcacctaaggaagcacatgtcagttatcccatag

SEQ ID NO: 21453 - DNA, 1560 bp, Artificial Sequence
  Description of Artificial Sequence: Synthetic coding sequence
atggcccgggacctggtgatgttccgggacgtggccgtggacttctcccaggaggagtgggagtgtctcaactcttatcagaggaatctttacagggatgtcatcctcgaaaactatagcaatttggtctctctggcaggatgctctatctctaagccggatgtaattacattgctggagcagggaaaggaaccgtggatggttgttcgggatgaaaaacgcagatggactctggacttggagtctcgttacgatacaaaaaagttgtttcagggtaaggatatctatgaaatgaacctgtctcagtggaaggtcatggaacggatcaagtcctgtggcctcgaggaacaggagtctcctcacgaagtctgcttcagacaggtgaccaagacaacatcagagaaaatgccgacttatcggaagttaacttcgctacccctgtatcagaagtctcataacagggaaaaaccttatgagtgcggggaatgtggaaaggccttccgggtccgtcagcagctgactttccaccaacgcatacacaccggtgagaagccttatgagtgtaaggagtgcggaaaagctttccgccaatgtgcacacttatcccggcatcagagaattcacacaagcgataaactgtacgaatgcaagaaatgtgggaagattttcacatgcgggtccgacctacgagtgcaccagaggatccacatcggagaaaagccttatgaatgcaaggagtgtgggaaggcgttccgggtgcgcgggcaattgaatcttcaccagcgcatccacacaggtgagaaaccatacgagtgtaaagagtgtggcaaagcctttaggcagtacgcccatcttaccaggcatcagcgactgaacatcgcggagaaatgttacgagtgtaaagaatgcgggcaggcatttctctgttctacaggtctccgcctgcaccataagttgcatacgggggagaagccctatgagtgcaaggaatgcggcaaagcttttagggtgagacagcagctgacacttcaccaaaggatccacaccggagagaaaccttatgactgtaaagaatgtggaaaaacctttagtcgaggttatcacctcaccttgcatcagagaattcacaccggagagaaaccatacgagtgtaaagaatgccagaagtttttcaggcgatattcggagttgatttctcaccagggtattcatatcggggaaaaaccttacgagtgcaaagaatgtggaaaggcttttcgactcttttctcagctgacccaacaccagtcgattcattttggagaaaaacctttcaaatgcaaggaatgcgaaaagaccttccggctgttgtcccagcttacgcaacatcaaagcatccatactggagagaagccttacgattgcaaggaatgtggaaaagcttttcgtcttcactcttcacttatccagcaccaacggatccattctggcgagaaaccatacaagtgcaaagaatgcaaaaaagcatttcggcagcattctcacctgacttatcatcagagaattcacaacgtgacctag

SEQ ID NO: 21454 - DNA, 1560 bp, Artificial Sequence
  Description of Artificial Sequence: Synthetic coding sequence
atggcccgggacctggtgatgttccgggacgtggccgtggacttctctcaggaggaatgggagtgtctgaattcttatcagaggaatttgtaccgcgatgtcattcttgaaaattactctaatcttgtctctctcgccggctgctccatttcaaaaccagatgtgattacgctgcttgagcagggaaaggaaccttggatggtcgtacgtgacgagaagaggcgatggacattggatcttgagtcaaggtatgacactaaaaaactgttccaaggtaaagacatttacgaaatgaatctgagtcagtggaaggtcatggaacgcattaagtcatgtggactcgaagaacaggagagtccacatgaggtgtgcttccgacaggttaccaagactacttcagaaaaaatgcccacctaccgaaaattgacatctctaccactctaccaaaagtctcacaacagggaaaagccatatgagtgtggcgaatgcggcaaggcatttcgggtgcgacagcagctgacattccaccagaggatacacactggagaaaagccttacgagtgcaaagagtgcgggaaagcatttagacaatgcgcacacctatctcggcaccagagaatccatacctctgacaagctttacgaatgcaagaaatgcggaaaaatttttacctgcggcagtgacttgcgggttcaccagcggattcatataggcgagaagccatatgaatgcaaggaatgcggtaaagcctttcgtgtcagagggcaactcaatctgcaccagcgaattcataccggagaaaaaccatatgaatgtaaggagtgtgggaaagcttttcgacagtatgcccatcttactaggcatcagaggctcaatattgccgagaaatgctatgaatgtaaggaatgtggacaagcctttctgtgcagtactgggttacgattgcaccacaaacttcacacaggtgagaaaccatacgagtgtaaagaatgtggcaaggcttttcgggtccgacaacagctcaccttgcaccagcgtatccacaccggggagaaaccctacgactgtaaagagtgtgggaagaccttctcaaggggctaccacttgaccctgcaccagaggatccacacaggcgaaaagccctacgagtgcaaggagtgccagaaattctttagacggtattctgagctaatatctcatcagggtattcacattggcgagaagccttacgaatgtaaggagtgtggcaaagcttttcggttattctcccagctcacgcagcatcagtcaattcactttggggaaaaacctttcaaatgcaaggaatgcgaaaaaacattccgattgctgagccagctcacccagcaccaatctatccatacgggagagaaaccatacgactgtaaagaatgcgggaaggccttccgcctacacagcagtttgatccagcaccagcgcattcacagtggcgagaaaccatacaagtgtaaggaatgcaagaaggcattccgacagcactcacacttgacttatcatcagcggatacataacgtcacatag

SEQ ID NO: 21455 - DNA, 1305 bp, Artificial Sequence
  Description of Artificial Sequence: Synthetic coding sequence
atggcccgggacctggtgatgttccgggacgtggccgtggacttcagtcaggaagagtgggagtgtttgaacagctaccagcgaaacctgtaccgggatgtgattctcgagaactattccaacctcgtttccctcggctgttctatatccaagccagacgtcataaccttattggagcaggggaaagagccttggatggtggtaagagacgaaaaacgtaggtggacactggaccttgagagtaggtatgacactaagaagctcttccagggcaaggatatctatgagatgaacctttctcagtggaaggtgatggagagaatcaagagttgcggacttgaagaacaggaaagtcctcatgaagtctgcttcagacaagtcacaaagaccacttcggaaaagatgccgacttaccgaaagctaactagtttgcccctatatcaaaaatcccacaacagagagaaaccctacgagtgcggggagtgcggtaaggcttttagggttaggcagcagctcacattccaccagcgtatacatactggagaaaaaccatatgagtgcaaggaatgcggtaaagcattccgccagtgtgctcatctgtcccggcatcagcgcattcatacctctgacaaattatatgagtgcaagaagtgtggcaaaattttcacatgcggttctgatttacggctgcaccacaagctgcataccggggagaagccgtacgaatgtaaggagtgcggcaaggcgttccgcgtccgtcagcagttaacactgcaccaacgaatccataccggtgagaagccctacgattgcaaggaatgcggcaagacgttttcacggggataccatttgaccttacaccagagaatccacacaggcgagaagccatatgagtgtaaggagtgccaaaaattcttccggcggtacagcgaactcatttcacaccaggggattcacatcggggaaaaaccatacgagtgcaaagaatgcggcaaggccttcagattatttagccagctgacgcaacatcaaagcatccacttcggcgaaaagccattcaagtgtaaggagtgcgaaaagacctttagattgctgtctcagctgacccagcaccagtctatccatacaggcgagaaaccttatgattgcaaggaatgcggcaaggcttttcggctccattcttccctgatccaacaccaacgcatccactccggtgaaaaaccttataagtgcaaggaatgcaagaaggcgtttcgccagcacagtcatcttacgtaccatcaacggatacacaacgttacctag

SEQ ID NO: 21456 - DNA, 1560 bp, Artificial Sequence
  Description of Artificial Sequence: Synthetic coding sequence
atggcccgggacctggtgatgttccgggacgtggccgtggacttcagtcaggaggagtgggaatgtctaaattcgtatcagcgtaatctgtatagagatgtgatcctggagaattattctaacctggtatccttagcgggttgttcaattagcaagcccgacgtgattacactccttgaacagggaaaggagccgtggatggtggtaagggatgagaaacggcgttggacgctggatttggaatctagatacgacactaaaaagctattccagggcaaggacatctatgagatgaatctgtcccagtggaaggtaatggagcggatcaagtcctgtgggcttgaagaacaagagtctcctcatgaagtctgtttccggcaggttaccaagaccacatctgagaagatgccaacttacagaaaactgacaagtctgcctttgtaccagaaatcccataatagagaaaagccatacgaatgcggtgagtgcggaaaggcgttccgtgtgcgacagcagctgacgtttcatcagcgcatccacactggggagaagccctatgagtgcaaggagtgtggtaaagcgttccgccagtgtgcgcacctgtcccgacatcaacgcattcataccagcgataaattgtatgaatgcaaaaagtgcggcaaaatctttacttgtggttccgacctgagggtccatcagaggatccacatcggagagaaaccctatgaatgtaaagaatgtgggaaagccttccgggtgagaggccagcttaatctccaccagaggatccacactggtgagaaaccatatgaatgtaaggagtgcggaaaagctttccggcagtatgcgcatctcactagacatcagcgcctgaatattgccgaaaagtgttacgaatgcaaggaatgcggacaagcctttctatgctcaacagggcttcgcctccatcataaactgcacacaggcgaaaagccctacgagtgtaaggaatgcgggaaagcgtttcgtgtcaggcagcagctcacacttcatcagcgcattcacactggagagaagccttacgactgtaaagagtgtggcaagacctttagccgaggataccacttaaccctgcaccaaaggatccacacgggcgagaagccctacgaatgtaaagaatgccagaaatttttccgacgctacagcgagttaatatctcaccaggggatacacatcggtgaaaagccttacgagtgcaaggaatgcgggaaagcttttagacttttctcccaactaacccagcatcaatccatacacttcggcgagaagcccttcaaatgtaaggaatgtgagaagacatttcgcctgcttagccagctcacacagcaccagtctatccataccggcgagaagccatacgactgcaaggagtgcggcaaggctttccggttgcactctagcttaattcagcatcaaagaatacacagcggcgaaaaaccctacaaatgtaaggagtgcaaaaaagcctttcggcaacatagtcatctaacctatcatcagagaattcacaacgtgacctag

SEQ ID NO: 21457 - DNA, 2001 bp, Artificial Sequence
  Description of Artificial Sequence: Synthetic coding sequence
atgcaggaggtggtgctgctggacgagagcagcggcccccccagccagttgctgtggacgcgtcaagacactcagcttccgcaagagagcgctctgctgcccgcaccctacccagcttttacaaaggatgggtcacagggcaacctcccacaagccgatatcacactgatgtcccaagcccaggagtcagtcacatttgaagatgtggcagtcaatttcacaaacagggagtggcagtgccttacgtacgcccaaagacacctgtacaaagatgtgatgctggaaaactacggtaatatggtgtcattgggattcccgttccctaaacccccactcatcagccacctcgagagggaggtcgacccatgtgttcaagaccctcaagaccgcgagtccctctcttgcagttaccccgttagcgccgacaagatgtggcctgaaaacgaaaaagcgagctcccagcaggaaatctttgaaaatggcgaggcttactggatgaaattcaatagtctcctgaaagtggattcccgggaccccaaggttcgcgaggtttgtgtgcaggatgtcaagctggaaaaccaatgggagacatccattagggagaaactgcgtgaagagaaagagggatccgaggaggtgacgtgtaagaagggaaaaaaccagaaggtcctctcaaagaacctaaatccgaatagcaagcactctcagtgcaataaagtgctgatcgctcaaaaactgcatgaatgcgctcggtgtggaaaaaatttcagctggcacagcgacctgattctgcacgagcagatccattccggagagaaaccccatgtgtgtaacgagtgtggcaaagcatttaaaactaggaaccaactttcaatgcatcgaataattcacactggagaaaagccatttaattgtacccagtgcgggaaagccttcaattccagatccgcgctgtgccggcataagaagactcattctggggagaaaccccacgaatgtagggattgtggcaaggccttcaagacacggaatcgcctctgtatgcatcagctgatccatactggcgagaaaccatacaagtgcaactgttgtggaaaagcttttcagttcaaacactcgctaactatccatggccggattcacacaggcgaaaaaccatacgagtgtgaggaatgcggcaaggcattttccgggagctctgatctgactaaacatattcgcattcatacaggggagaggccgtatgaatgttccaagtgcggacgtgctttttctcgcagcagcgatcttagtaagcacaaaaggattcatacgagagagaagcattatggctgcccccaatgcggtaaggatttttctattaaagccgagctgacaaaacaccggaggatacacacagaggagaaaaggtacagatgcgaagagtgcggcaaagcctttcggcacaactgcaaacgtagagctcacgagagagagcacacgggggagaaaccttaccagtgcagagactgtggcaaaacctttcaggataaacactgtctgacaatacatcagcggatccacaccggcgaaaagccttacaagtgcctggagtgtggaaaagcattctctggtaagtcaaaccttactaaccacaggcggatccacactggagagaaacctcacaagtgtgaggtatgcggcatggcttttcatcactccagcgtgttgaggcagcataagcggatccacacaggtgaaaagccatacacgtgcagcgaatgtggaacttcttttagacaaggttctgccctcatcggacacaaaagggtgcacaccggcgaaaaaccctacgaatgcgaggagtgcgggaaagccttccgggtcagcagcaacctgactggccacaaaaaacgaaagcatcaggtctggagtactcacgagttggatggctcccggaagagcttgtctcctgtgaccgtcagtcagacttctgtagtttccattctaacatcagcatag

SEQ ID NO: 21458 - DNA, 2001 bp, Artificial Sequence
  Description of Artificial Sequence: Synthetic coding sequence
atgcaggaggtggtgctgctggacgagagcagcggcccccccagccagcttctctggacgcgccaggatacccagttgcctcaagaatcagcattgctgcccgccccttaccctgcattcacgaaagacggatctcagggcaacctgccacaagccgatatcacactgatgtcccaggcccaagagtccgtcacctttgaagatgtggccgtcaacttcacaaaccgcgaatggcaatgccttacctacgcccagcggcatctctacaaggatgttatgttggagaattatggcaatatggtctctctcggctttccatttccaaagccaccactgatcagccacctcgagcgcgaagtcgatccctgcgtccaagatccacaggatagggagtcgcttagctgctcctaccccgtaagtgctgacaaaatgtggcccgagaatgagaaggcatcttcacagcaagagattttcgaaaacggcgaggcgtactggatgaaattcaactctctcttaaaggtagactcccgtgatccgaaggtgagagaggtatgcgttcaagacgtcaaactcgaaaaccaatgggagacgtcaattcgtgaaaaactccgcgaggaaaaggagggctcagaagaggtcacatgcaaaaagggtaagaaccagaaggtactgtcaaaaaacctgaatccaaattcaaagcattcacagtgtaacaaagttctgattgcccagaagctgcatgaatgtgccagatgcgggaaaaatttctcatggcactccgacctgatcctgcatgagcagattcatagcggagaaaagccccatgtatgcaatgagtgtggaaaagcttttaaaactagaaaccagctcagcatgcatcgaataatccacacaggagaaaaaccattcaattgtacccagtgtggaaaagcctttaacagcaggagtgccctttgccgacacaaaaaaactcatagcggtgagaaacctcacgagtgcagggactgcgggaaagcctttaaaacccgtaatagactctgcatgcatcaattgattcatactggtgagaaaccctacaagtgtaattgttgcggcaaggccttccaattcaagcactccctgacaatccacggccgaatacacacgggcgagaaaccttacgagtgtgaggaatgtgggaaggcttttagcggatcatcagatctcaccaagcacattaggatccataccggcgagcgcccttacgaatgttcaaaatgtggtcgggccttctcacggtcttccgatctcagtaagcataaaaggatccacacgcgcgagaaacattatggatgtcctcagtgtggaaaggacttcagtataaaggcagagctcactaagcatagaaggatacacaccgaggagaaacgctacagatgcgaagagtgcggaaaggcctttcggcacaattgcaagcgaagggcccacgagagggaacacaccggtgagaaaccttaccaatgtcgcgattgcggaaagactttccaggacaaacattgcttaaccattcatcagaggatccacaccggtgagaaaccatataaatgtctggaatgtgggaaagccttctctgggaaatcaaatctgactaatcataggaggatacacaccggcgagaaaccacacaaatgcgaggtgtgcgggatggcctttcatcattccagcgtgctacgccagcataagcgcatccataccggtgagaagccctatacatgctcagaatgtggaactagttttaggcaaggtagcgcactgataggtcataaaagagtgcacacaggggagaagccttatgaatgcgaagagtgcggtaaggcctttcgggtgagttccaacctcaccggacacaagaaacgcaaacaccaggtttggtctacacacgaattggatggatcgagaaaaagtctatcacccgttactgtgtctcagacgtcagttgtgagcattctgacatctgcctag

SEQ ID NO: 21459 - DNA, 2001 bp, Artificial Sequence
  Description of Artificial Sequence: Synthetic coding sequence
atgcaggaggtggtgctgctggacgagagcagcggcccccccagccagctgctgtggactagacaggacacacagttgccacaggaatcggccctcctaccggccccctatcctgcttttaccaaagacggcagccaaggaaacctcccacaggctgacattactctgatgtcccaggctcaagaatctgtcacttttgaggacgtggcagtcaacttcactaatcgggaatggcagtgcttgacctacgcacagcgccacctgtataaggacgttatgctggagaattacggtaacatggtctctttgggttttccctttccaaaacccccactcatatcccacctggagagagaagtggacccttgcgtgcaggatccccaggacagggaatcattaagttgtagttacccggtttccgctgacaagatgtggccagaaaatgagaaggcctcctcacagcaggagattttcgagaacggcgaggcctattggatgaagttcaactctttgctgaaagtcgactccagagatcccaaggtgcgtgaggtgtgcgtgcaagacgtgaagcttgaaaaccaatgggaaacctcaattcgcgagaagttgcgggaggaaaaagagggcagcgaagaggtgacatgcaagaagggcaagaatcaaaaggttttgagcaaaaatctgaaccccaattcaaagcattcacagtgtaacaaagtgctgatcgctcaaaagctccacgagtgcgcacgttgtgggaagaatttttcttggcattccgacctcatcctgcacgaacaaatacattccggagaaaagccccacgtttgtaatgaatgcggcaaggcatttaaaactagaaatcagctgtctatgcatcgaatcattcacactggcgagaagccctttaattgcacacagtgcggtaaggcattcaacagcaggtctgctttatgtagacacaagaagactcattctggggaaaagccacatgaatgtagagactgtggaaaggccttcaagacacgaaaccggctgtgtatgcaccagttaattcacacaggcgaaaaaccttataagtgcaattgctgtggcaaggcttttcaattcaaacacagtctgaccatccacggccgcattcatactggggaaaaaccatacgagtgtgaagagtgcgggaaggcattcagcggctcctccgacctgacaaagcatattagaatccacacaggtgaacgcccttacgagtgtagcaagtgcgggagagcttttagtagaagtagcgacttaagtaaacacaagcggattcacacccgcgagaaacactatggatgcccacagtgcggcaaggacttttctattaaggccgagctgaccaaacaccgtcggatccataccgaggaaaagcggtatcggtgcgaagagtgcgggaaggccttcaggcacaactgtaagcgtcgggcccatgaacgggaacacacgggcgagaagccatatcagtgtcgggactgtggcaaaacatttcaggataagcactgcctgaccatccatcaacgcatccataccggtgaaaaaccttacaagtgcttggagtgcggtaaggctttcagcggcaaatcaaacctcacgaaccacagacgcatccatacgggcgagaagccccacaagtgtgaggtctgcggaatggcgtttcaccactcttccgtgttgcgacaacacaagcggatccataccggcgaaaagccctacacctgtagtgagtgcggtacgtcatttcgacagggatcagcgctaattgggcacaagagggtccacaccggagaaaagccatacgaatgcgaggagtgcgggaaagccttcagggtgtccagcaatctgacgggccataaaaagcgtaaacatcaggtgtggtcaacccacgagctggacggttccaggaagagtctatcacccgtaaccgttagccaaacaagcgtagtgtcaatccttactagcgcttag

SEQ ID NO: 21460 - DNA, 2001 bp, Artificial Sequence
  Description of Artificial Sequence: Synthetic coding sequence
atgcaggaggtggtgctgctggacgagagcagcggcccccccagccagctgctttggacaaggcaagacacacagttgcctcaagaaagtgccctccttcccgccccttatcctgccttcacaaaagacggttcacagggtaatctccctcaagccgatattacccttatgtcccaggcacaggagagcgtgacctttgaggacgtggccgtcaattttacgaatcgcgagtggcaatgccttacctatgcccagcgtcacttgtataaggacgtaatgcttgagaattacgggaacatggtctcgctgggatttccttttcccaaaccgccactgataagccacctggaacgcgaggtagacccatgcgtccaggatcctcaggaccgcgagtccctgtcctgttcttaccctgtgtctgctgacaagatgtggcctgaaaatgaaaaagcctcaagccagcaggaaattttcgaaaatggagaggcctattggatgaaattcaactccctgctaaaggtcgactccagagatcctaaagtgagagaggtctgcgtccaagacgtcaagctggagaaccagtgggaaacttcaatcagagagaagcttagagaggagaaagaaggtagtgaggaagttacatgtaaaaaagggaagaatcagaaagtgttgagcaaaaatcttaatcccaatagcaaacacagtcagtgtaataaagtcctcatcgctcaaaaacttcatgagtgcgccagatgcgggaaaaacttcagctggcattcggatctgatactccacgagcagatccacagcggcgaaaagccgcacgtgtgtaacgagtgtggaaaagcttttaagacccgcaatcaactttctatgcatagaatcatacatactggggaaaaaccttttaactgcactcagtgtggcaaagccttcaactccagatccgccctgtgcagacacaagaaaacccattccggcgagaagccccacgagtgtagggattgtggcaaagcatttaagacacgcaacagactgtgcatgcatcaactcatccatacaggagagaagccttacaagtgcaattgttgtggtaaggcctttcagttcaaacattcactgacaatacacggacgcatccatacaggagagaagccctatgaatgtgaagaatgcggtaaagctttctctggctctagcgaccttaccaaacacataaggatacacaccggggaaagaccctatgagtgctcaaaatgtggccgggctttttccaggagtagtgacctgagtaagcacaagcggatacataccagagaaaaacactatggatgtccccagtgcggcaaggatttttcaatcaaagctgagttgacaaagcacaggagaatccacactgaggagaaacgttaccgttgtgaagaatgcggtaaagctttccgtcataactgcaagaggcgggcccacgaaagggagcatacaggagagaagccatatcaatgtagggattgtggcaagacctttcaggataaacattgcctcaccatccatcagcggatccataccggtgagaagccttataagtgtctggaatgtggaaaggcctttagtggtaaatccaaccttaccaaccaccggcgcatacacactggtgagaagccacacaagtgtgaagtctgtggaatggcctttcaccactctagtgtgctgcggcagcataaaaggatccataccggcgagaagccttacacatgctcggagtgcgggacttcctttcgccagggaagtgccttgatcggccacaagcgagtacacaccggggaaaaaccttacgagtgtgaagagtgtgggaaggcctttcgggtgagcagcaatttgacgggtcataagaaacggaagcaccaagtgtggtcaacccacgagttggacggaagtcgtaagtcattgtcaccagttactgtgagtcagacctctgtggtgagcattctaacctctgcctag

SEQ ID NO: 21461 - DNA, 2001 bp, Artificial Sequence
  Description of Artificial Sequence: Synthetic coding sequence
atgcaggaggtggtgctgctggacgagagcagcggcccccccagccaattattgtggaccaggcaggatactcagctgccccaggagagcgccctactgccggccccctatcccgcttttacaaaagacggcagccagggcaatctcccgcaggcagacattacactgatgagtcaagcccaggaaagcgttacgtttgaggacgtggccgtgaactttaccaaccgtgagtggcagtgtctgacttacgctcagagacatctttataaagacgtgatgctggagaattacggaaacatggtgtcccttggctttccattcccaaagcctccgctgattagtcatcttgagcgtgaggtggatccctgtgtacaggacccccaggatcgcgagagtctaagctgctcctaccctgtgtcggcagacaagatgtggcctgagaatgagaaagccagtagccagcaggagatctttgagaatggggaagcctactggatgaaatttaattctcttctcaaggtggattcacgcgatccgaaggtgcgtgaggtctgtgtgcaagatgtcaagctagagaaccaatgggagacctctataagagagaagcttcgcgaagagaaagagggatctgaggaggtgacttgcaagaaaggcaaaaatcaaaaggtcctctccaagaatttaaatccaaatagcaaacactctcagtgtaataaagttctcatcgcgcaaaagctgcacgagtgcgcacgctgtggaaagaatttctcctggcactctgatctgattctgcatgaacaaattcactcgggcgaaaagcctcatgtttgtaatgagtgcggaaaggcatttaaaacaaggaaccagctgtccatgcatcggatcatccacaccggggagaagccatttaattgcactcaatgcggaaaggcgttcaactcccggagcgcgctctgcagacataagaagactcactccggagaaaaaccacatgaatgcagagactgcgggaaagcattcaaaaccagaaacagattgtgtatgcaccagctgatccacacgggcgagaagccatacaagtgtaactgctgcggcaaggcttttcaattcaaacattctctcactattcacggcaggatccacacaggggagaaaccctatgagtgcgaagagtgtggtaaggctttttctgggtcatcggatcttacaaagcacattcggatacacactggagagagaccgtatgaatgtagcaaatgtggacgggcattttcacggtcatcagacctctcgaagcacaaacgaatacacaccagagaaaaacattatggctgtcctcaatgcgggaaggacttctctattaaggccgaactgaccaagcacagacgcatccatacggaggaaaagcgctataggtgcgaggaatgcggtaaggctttcagacataattgcaaacgcagagcccatgagagggagcataccggagagaaaccttaccagtgtcgggactgtggaaaaacatttcaagataagcattgtctgaccatccatcaaaggatccatactggagaaaagccctataaatgcctggaatgcggcaaggcttttagcgggaagtccaatctcacgaaccacaggcggatccacaccggcgagaaaccccacaaatgcgaagtctgcggtatggcgtttcaccacagcagtgtgctgcgtcaacataaaagaatccatactggcgaaaagccctacacatgttcagaatgtggtacatcctttcgccagggaagcgccctaattggacacaagagagtgcacacaggcgagaagccatacgaatgtgaagagtgtggtaaggctttccgggtgagctcaaacctcactggtcacaagaaacggaaacaccaagtatggagtacgcacgaacttgacggcagcagaaaatctctgtctccagttactgtgtcccagacctcagtcgtgagcatcctgacctccgcctag

SEQ ID NO: 21462 - DNA, 2001 bp, Artificial Sequence
  Description of Artificial Sequence: Synthetic coding sequence
atgcaggaggtggtgctgctggacgagagcagcggcccccccagccaactcctctggaccaggcaggatacacagctgccacaggagagcgcgttgctgcccgctccatatcccgccttcactaaggacgggagtcagggcaatctgccacaggccgacataacactgatgagtcaggcacaggagtcagtgaccttcgaagacgtggcagtcaatttcaccaaccgcgaatggcagtgcctgacgtacgctcagaggcacctctacaaggatgtcatgctagagaactatgggaatatggtttctctcggcttcccatttccaaaaccaccactgataagtcatctcgaacgcgaagtcgatccgtgtgttcaggatccacaggaccgggagtcccttagttgctcctatcccgtcagtgccgacaagatgtggcctgagaacgaaaaagcaagctcgcaacaggaaatttttgaaaacggcgaagcgtattggatgaagttcaactctctgttgaaggtagactccagagatcccaaggtgcgggaagtgtgcgtgcaggacgtgaagctagagaaccagtgggaaactagtattagagagaagctacgcgaagagaaagagggctcagaggaggttacctgcaagaaagggaaaaatcagaaagtgctgtcgaagaacctcaatcccaattccaaacattcgcagtgtaataaagtgctcattgcgcagaaactccatgagtgtgctcgctgtgggaagaacttctcctggcactctgatctgatactgcacgaacagatacattccggcgagaagccgcacgtgtgcaatgagtgcggaaaagcctttaaaactcgcaaccagctctcaatgcacagaattatccacaccggcgagaagccattcaattgtacacagtgcggaaaggctttcaattctcgctctgctctctgccgccacaaaaagacccattcaggggagaagcctcatgagtgtcgggactgtggaaaggcctttaagactcgtaatcggctgtgtatgcaccagctgattcacacaggcgagaagccctacaaatgtaactgttgtggaaaggcgttccagttcaagcattctctcactattcacggtagaattcacactggcgaaaagccatatgaatgtgaagaatgcggaaaggccttcagtggatctagtgatctgacgaaacacatcaggattcataccggcgaaaggccatatgaatgtagcaaatgtggcagggctttctccaggagtagcgacctgtcaaaacacaaacggattcacaccagggaaaagcactacggatgcccacaatgcggcaaagatttctctatcaaggcagagcttacaaagcacagacggattcacacagaagagaagcggtaccggtgtgaagaatgtgggaaagctttccgccataactgtaagcggcgcgctcatgagcgtgaacacactggcgaaaagccttaccagtgccgcgattgtggaaaaacattccaagacaagcattgtctgactatccaccagcgcatccatacaggagaaaaaccttataagtgccttgagtgcgggaaggccttcagcggaaagtccaacttaaccaaccatcggaggatacatacgggcgaaaagcctcataaatgtgaagtatgtggcatggccttccatcattctagcgtcttacggcagcacaagcgcatccacaccggggaaaagccctacacatgcagcgagtgcggcacctcctttcgacaagggagcgccttgatcggccataaaagggtgcacacaggagagaagccttacgagtgcgaggaatgtggcaaggcatttcgggtcagctcaaatctaaccggtcataagaagaggaagcaccaagtctggagtactcacgagttagatgggagccgcaagtccctctctcctgtgaccgtgtcccagacttccgttgtttctatcctcacctcagcatag

SEQ ID NO: 21463 - DNA, 1725 bp, Artificial Sequence
  Description of Artificial Sequence: Synthetic coding sequence
atgctggagaactacggcaacatggtgagcctgggcttccccttccccaaacccccactgatttcccacctggagcgggaggttgacccatgtgtccaagatcctcaggacagagagtctctcagttgctcttatcctgtgtctgccgataaaatgtggccagaaaatgaaaaggcgagttctcaacaggagatttttgagaacggagaggcctactggatgaagtttaacagtctgttaaaagtcgactctagagacccaaaggttagagaggtgtgcgtgcaggacgtgaaattggagaaccagtgggaaacttcaatcagagagaaattaagggaggagaaagagggatcagaagaagttacttgcaaaaagggcaagaaccagaaagtgctgagcaagaacctcaacccaaattcaaaacactcacagtgcaataaggtgctgatcgcgcagaaactacacgagtgtgcaaggtgcggaaagaacttttcttggcacagtgacctgattttgcacgaacagatccattccggcgagaagccgcacgtgtgcaacgagtgtggaaaagccttcaagaccagaaaccaattgtctatgcatcgaatcatacacacaggtgaaaagccattcaactgtacacagtgcggcaaggcattcaattctcgctcggcattgtgcaggcacaagaagactcactccggggaaaagcctcatgagtgtagagattgtggaaaagcattcaaaactagaaatcggctctgcatgcaccaactgattcataccggagagaagccctacaagtgcaactgctgcggcaaggcttttcagtttaagcattccttaacaatccatggacggatccacaccggcgagaagccttatgaatgcgaggaatgcggcaaggctttttctggttcttctgaccttacaaagcacatccggattcacaccggcgaaaggccctatgagtgctccaagtgcggcagagctttctccaggtcttccgatctgagtaagcataaaaggatccatactcgcgaaaaacactatggctgcccccagtgtggcaaggacttttcgatcaaggctgaactgaccaagcatagaagaattcacacagaggagaagcggtatagatgcgaagagtgcggcaaagcatttagacataattgcaagaggagagctcatgaaagagaacacaccggtgaaaaaccttatcagtgtcgcgactgcgggaagaccttccaagataagcactgcctcaccattcaccagagaattcatacaggagagaagccttacaaatgtcttgagtgcggcaaggccttttctggaaaatctaatcttaccaatcacagaagaatacacaccggcgagaaacctcataagtgcgaggtctgcggaatggcatttcaccatagctcagtgctgcggcagcacaagaggattcatactggggagaaaccttatacctgctctgagtgtggtaccagttttaggcaaggctccgctttaatcgggcataagagggttcacaccggggagaagccctatgagtgcgaagaatgtgggaaggcctttcgagtgagctctaatctcacgggccataaaaaaaggaaacatcaggtatggtccacacacgagttggatggttccaggaagtctctttcgccagttaccgtaagtcagactagtgttgtgagtattctcacctcagcatag

SEQ ID NO: 21464 - DNA, 1725 bp, Artificial Sequence
  Description of Artificial Sequence: Synthetic coding sequence
atgctggagaactacggcaacatggtgagcctgggcttccccttccccaagccccctcttatttcacaccttgaacgcgaggtagacccttgcgtgcaagaccctcaggacagagaatctttgagttgtagctaccccgtgtctgccgataagatgtggcccgaaaacgagaaggctagcagtcaacaggagatattcgaaaacggtgaggcttattggatgaaatttaatagcctgctaaaggtcgattctcgagatccaaaggtgcgggaggtctgcgtgcaggatgtgaagctggagaaccagtgggagacctcaatcagagaaaaattaagggaggaaaaggaagggtctgaggaggttacttgcaagaaaggtaaaaatcagaaggtcctgtcaaaaaatttgaatccaaacagcaaacatagccagtgtaataaggtgctaatcgctcagaagctgcatgagtgtgctcgctgcggcaagaatttctcctggcactcagacttgatcctgcatgagcagatacacagcggcgagaagccgcacgtttgcaacgagtgtggcaaagccttcaagacaaggaatcaactctctatgcatcgcatcatccacaccggggaaaaacccttcaactgtacacagtgcggaaaggcattcaactctagatccgccctctgtcgtcataaaaaaactcatagcggagaaaagccacacgagtgccgtgactgcgggaaggcatttaaaacgagaaatcggctgtgtatgcaccagctcattcataccggtgagaaaccttacaagtgcaactgctgcgggaaagcctttcagtttaagcactctcttacaattcacggaaggattcacactggcgagaagccctatgaatgcgaggagtgcggcaaagctttttcaggcagctccgacctcacaaaacacatcagaattcatacgggcgagaggccgtacgaatgcagcaagtgcggtcgggcgtttagtcgctcctcagacctgagcaagcataaaagaatccacactcgagagaagcattacgggtgcccgcaatgtgggaaagatttcagcatcaaggccgagctaaccaagcaccggagaatccacactgaggaaaaacggtataggtgcgaggagtgcggaaaggccttcagacataactgcaaacggagggcccatgagcgggaacatacaggcgagaaaccttaccagtgccgcgattgcggcaagacatttcaagacaaacactgcttgacaatccaccagaggattcacacaggtgagaaaccttataagtgcttggagtgtgggaaggccttctcaggtaaaagcaacctcacgaatcataggcgtatccacacaggtgagaaaccccacaaatgtgaagtatgtggcatggccttccatcacagttcggtgctgcggcaacataaacgtattcacaccggcgaaaagccctatacttgctcagagtgcggaaccagtttccggcaagggtctgccctgatcggccacaagcgcgttcacacaggcgaaaaaccatacgagtgcgaggagtgcggcaaggcctttcgggtatccagcaatctgacgggtcacaagaaacgaaagcatcaggtttggtcgactcatgagctcgatggttcgaggaagagcctctcacccgtgacggtctcccagacatcagtggtttctatcctgacctctgcctag

SEQ ID NO: 21465 - DNA, 1725 bp, Artificial Sequence
  Description of Artificial Sequence: Synthetic coding sequence
atgctggagaactacggcaacatggtgagcctgggcttccccttccccaagccaccactgatctctcatctagagcgcgaagtggatccatgcgtgcaggaccctcaagaccgggagtcgctcagctgcagttaccctgtaagcgctgacaaaatgtggcccgaaaacgagaaggcatcttcccagcaagaaatttttgagaacggcgaggcctactggatgaagttcaattcactgctcaaggtcgacagtcgtgatcccaaagtccgggaagtctgtgtccaagatgtgaagcttgagaatcagtgggagacatccatccgagaaaaactgagggaagagaaagagggaagcgaggaggtgacgtgcaagaagggtaaaaaccagaaggtgctctcaaaaaacttaaatcctaactcaaaacattcccagtgtaacaaggtgctgattgctcagaagctgcacgaatgtgcccggtgcggaaagaattttagttggcattctgatctcatcctacacgagcagatacatagtggcgaaaaaccacacgtgtgcaacgagtgtggaaaggcatttaagacacggaaccagctcagtatgcaccgcattatccataccggagagaagccctttaattgtacacaatgcggcaaggccttcaattctagatcagctctttgtcgtcacaaaaagacccattcaggtgagaaacctcatgagtgtcgagactgtgggaaggcctttaagacccgcaatcggctgtgcatgcatcagctcatacacactggggaaaaaccctacaaatgcaattgttgtgggaaggctttccagtttaagcatagtttgacaatacacggcaggatccacacaggtgaaaagccttacgagtgtgaggagtgtggtaaagctttttccgggtccagcgacctgactaaacatatcagaatccataccggtgaacgaccgtatgaatgtagcaagtgtgggagagcctttagccggtctagcgatctgagcaagcataaacgcattcatacaagggaaaagcattacggatgtccccagtgtgggaaggatttctccataaaggcagagctgaccaaacaccgaagaattcacactgaggaaaaacgctaccgctgcgaagagtgcggaaaggcttttcggcacaattgtaaaagaagagcccatgaacgcgagcacacgggtgaaaagccttatcagtgtcgcgactgcggcaaaacttttcaggacaaacactgtctcacgatccaccagagaatccataccggcgaaaaaccatacaaatgcctcgaatgcggtaaggccttttctggtaaaagcaacttgactaaccataggcgaatccacaccggcgagaaaccccataaatgcgaggtatgcggaatggcgttccaccacagttccgtgctgaggcagcataaaagaattcacaccggggaaaagccctacacatgcagcgagtgcgggactagtttccgtcaaggatctgccctcataggccacaagcgcgtccataccggagagaaaccatatgaatgtgaggagtgtgggaaggctttccgcgttagttcgaatttgacaggccacaagaaaagaaagcaccaagtgtggagtacacacgagctcgatggctctcggaaatcactgtctccagttaccgtttcccaaacctcagttgtgtccattttgacatctgcatag

SEQ ID NO: 21466 - DNA, 1725 bp, Artificial Sequence
  Description of Artificial Sequence: Synthetic coding sequence
atgctggagaactacggcaacatggtgagcctgggcttccccttcccaaagccacctctgatctcacatcttgaaagagaagtggatccttgtgtccaggacccgcaggatagggaatcactttcgtgttcttatcctgttagcgctgataagatgtggccagagaacgagaaggctagtagtcagcaggagatttttgagaatggggaagcttactggatgaagtttaactctctgcttaaagttgatagccgcgacccaaaggtgagggaggtatgcgtgcaggacgtgaagcttgagaatcagtgggagacttcaatccgagaaaagctgcgtgaggaaaaggaagggagcgaggaagtaacttgtaagaaagggaaaaaccaaaaggtgctttctaagaacttgaaccccaacagcaaacattctcagtgcaacaaggtattgatcgcccagaagcttcatgagtgtgctcgctgtgggaaaaactttagttggcacagcgaccttattcttcacgagcagattcatagtggagaaaagccacacgtctgtaatgagtgtggaaaagcattcaaaactcggaatcagctgtcgatgcaccgcataattcacacaggtgagaagccattcaattgcacccagtgtggtaaggcttttaactctcgaagtgccttgtgcagacacaaaaagactcactcaggggagaaacctcatgaatgtcgagactgcggtaaggccttcaaaactagaaaccggctgtgcatgcaccagctgattcatacaggggaaaaaccgtacaaatgtaactgctgcggcaaggccttccaatttaagcattctctgaccatccatggacgtatccacactggagaaaagccctacgagtgcgaggaatgtgggaaggcgttcagtggtagttccgatctgacaaaacacatccgcatacacacaggcgaaaggccctacgagtgctccaaatgtggaagagcgtttagtaggtcatcagatctcagcaagcacaaacgcatccacacacgagaaaagcactacggttgtccccagtgcggaaaagacttctcaattaaggccgagcttaccaaacaccgcagaatacacactgaagaaaaacgatacaggtgcgaggagtgcggaaaagcattcaggcacaattgtaaaagacgggctcatgaacgcgagcacactggagagaaaccttatcaatgtcgggactgcggaaagacatttcaggataaacactgtctgacaattcatcagaggatacataccggagaaaagccctataaatgcttggagtgtggaaaagcctttagcgggaagtctaatctcaccaatcatcggagaatacacacaggcgagaaaccccacaaatgtgaggtctgcggcatggcctttcaccactctagtgtgttaagacaacacaaacgcatccacaccggagagaagccctatacctgttctgagtgtggcacatctttcaggcagggctccgccctcatcggccacaagagggtgcataccggcgaaaaaccctatgagtgcgaggagtgcggcaaggccttccgcgtgagttccaatttaaccggacataagaagcggaagcaccaggtgtggtcaacccacgagttggacggaagcaggaagtctctcagtcctgttacagtctctcagaccagcgtggtgtccatactgacttccgcatag

SEQ ID NO: 21467 - DNA, 1725 bp, Artificial Sequence
  Description of Artificial Sequence: Synthetic coding sequence
atgctggagaactacggcaacatggtgagcctgggcttccccttcccaaaaccacccctgatttcacaccttgaaagggaagtggacccctgtgtgcaagacccccaggatcgcgaaagcttgtcatgcagctatcccgtgtcagccgacaagatgtggcctgaaaatgagaaagcgtcaagtcagcaggagatcttcgaaaatggggaagcttattggatgaagttcaacagtctcctcaaagtggattcccgagatcccaaggttcgggaggtgtgtgtccaggatgttaagctggaaaatcagtgggaaacctccatacgtgagaaactccgtgaggaaaaggaagggtccgaagaagtcacatgcaaaaaaggtaaaaatcagaaagttctctctaaaaatctcaaccccaatagcaagcattcccagtgcaataaggtacttatcgcccagaagctgcacgagtgcgcccggtgtggcaaaaactttagctggcattcagatctcattcttcacgaacagatacacagcggagaaaagccccatgtttgcaacgagtgtgggaaggcgtttaaaactcggaaccagttgtcaatgcatcggataatccatacaggagagaaaccatttaactgtacacaatgcggaaaggcatttaattcccgctccgcgctgtgtcgccataagaaaactcacagcggagagaagccccatgaatgtcgggattgtggcaaagcattcaagactcggaacaggctctgtatgcaccaactcattcataccggcgagaagccctacaagtgcaactgctgcggtaaggccttccaatttaagcacagcttgacaattcatgggcgaatccacacgggtgagaaaccgtatgagtgtgaggagtgcggcaaggcttttagcggaagctcagatcttacaaagcacatccgtatccataccggggaaaggccatacgagtgtagtaaatgcggacgcgcgtttagcagatcttctgacttgtcaaaacataagagaatccacacccgggaaaaacactacggctgcccacaatgtggaaaggatttctcaatcaaggccgagctcaccaagcataggcgtattcatacagaagaaaaaaggtatcgatgtgaagagtgcggcaaagcatttaggcacaactgcaagcgacgggctcatgagcgagagcacaccggggaaaagccctatcagtgccgggactgtggaaagacgtttcaagacaagcattgtctgacaatccaccaacggattcatacaggagaaaaaccctacaagtgtctcgagtgcggcaaagccttctccgggaaatctaacctgacaaatcaccgacgtattcacacaggagagaagcctcacaagtgcgaggtgtgcgggatggcctttcaccattcatccgtactgcgccagcataagagaatccacacaggtgagaagccatacacatgctcggaatgcggaacttctttcagacagggcagcgccttgataggacataaaagagtgcacactggggagaagccatatgagtgcgaggagtgcggaaaagcattcagggtttcgagcaacttgacaggccacaagaagcggaaacaccaggtctggtctacccacgagctagacggcagcagaaagtcgttatcaccagtgaccgtgagccaaacatctgtcgtctcgatcctcacttcagcctag

SEQ ID NO: 21468 - DNA, 1725 bp, Artificial Sequence
  Description of Artificial Sequence: Synthetic coding sequence
atgctggagaactacggcaacatggtgagcctgggcttccccttcccgaaaccgccactgatatctcacctggagagagaagttgatccttgtgtacaggaccctcaggatcgggaatccctcagttgctcctatcccgtgtctgcagacaagatgtggcccgaaaacgaaaaggcctcatctcagcaagagatttttgagaacggcgaggcctactggatgaaatttaattcgctcctcaaagttgacagcagggatcctaaggtccgggaggtctgtgtgcaggacgtgaagctggagaaccagtgggagacttccattcgcgagaaactgcgggaggaaaaggaggggagtgaagaagtcacttgtaagaaagggaagaaccaaaaggtgctgtctaagaatctgaatcctaattccaaacattcccagtgcaataaagtgctaatcgctcagaagctacacgagtgtgctcggtgcgggaaaaacttcagctggcacagcgatctaatcctccacgaacagattcattctggcgagaagccccatgtctgcaatgagtgtgggaaagcctttaagacccggaatcagttgagcatgcaccgaatcatacatacaggcgagaaaccttttaattgcacacagtgcggaaaagcttttaattctcggtctgctttgtgtagacataagaaaacgcactctggcgaaaagccccatgagtgccgcgactgcggaaaggcctttaagacgcgcaacaggttgtgcatgcatcagctgatccacactggtgaaaaaccctacaaatgcaactgttgcggcaaagccttccaattcaaacatagcttgacaattcatggacggatccataccggcgagaagccatatgagtgtgaggaatgtggcaaagcattctcgggatcttccgatctcaccaaacatattaggattcacactggggagcgtccttacgaatgtagcaagtgtggcagggccttctcccggtctagcgatctgtctaaacataagcgaatccatactagagagaagcactacggttgcccccaatgtggtaaagatttttctataaaagctgaactcactaaacatcgacgtatccatactgaggagaagagatatagatgcgaggagtgcgggaaggcttttagacacaactgcaagagaagagcacatgagagggagcacacaggtgagaaaccataccagtgtcgagattgtggtaaaacattccaagacaagcactgcctgacaattcatcagcgtattcacaccggggagaagccttataagtgtctggagtgtggtaaagcattctcagggaaatctaacttaactaatcacagacggattcacaccggagagaaacctcacaagtgcgaagtctgtgggatggcttttcatcacagctccgtgttacggcaacacaagagaatacataccggagaaaaaccttacacctgttctgaatgtgggacctctttcaggcagggctcagctctgattggtcacaaaagggtacatacaggcgagaaaccttacgagtgtgaagagtgtgggaaggcctttcgcgtgagtagcaacttgacagggcataagaaaagaaaacaccaagtctggtctactcacgagctggacgggagcagaaaaagtctctccccagtaaccgtgtctcagacctctgtcgtgtccattctgacttcagcatag

SEQ ID NO: 21469 - DNA, 1749 bp, Artificial Sequence
  Description of Artificial Sequence: Synthetic coding sequence
atgagcgagagctggcagcagcccccccagacccagccccagcagcctcagccgcctcaaccgcagcatcacgccgagccacctcccgccctggccgaacatactctcccaccagggactgccgaaaatcctctggggtgtgcagtctacgggatcctcttgcagccagatcccggcctacagccacctcagcacgcaccgctgcaggccgccggcgagcctgggccaaagtgcggggtgtgcggtcacgacctagcacatctttccagcccccatgaacatcaatgcctagccggccacgacagatcattccaatgtacgcagtgccttaaaatcttccaccaggccacggatctgttggagcaccagtgtgttcaggcggagcagaaacctttcgtatgtggagtgtgcaagatgggctttagtctgctgacctccctcgctcagcaccactcgtcacactcaggattggtaaaatgctcgatctgcgagaagacttataagcccgctgaggctgcggagcctgccactactgccgcccctagtttgccagctgcaccggcgcctagcacagtgaccccagccgagcaggccgataaaccatatagttgccccatctgccagaagccctttaagcacctttcagaactgtctcgacacgagcggatccatactggtgagaagccatataagtgcacactttgcgacaagtctttttcccagagttcgcacctcgttcatcataaaagaacacattcctccgaacgcccctacaagtgcgctgtgtgtgagaaaacttttaagcaccggtctcatctggtgcgccatatgtatgcccactctggcgaacaccatctgttccgatgtaatgtgtgtgagctccactttaaagagtctagcgagcttctgcagcacccttgtacaccctctggcgagaggccatttcgctgtggagagtgtcaaaaggctttcaagagaccctccgacctccgtcagcacgaaagaacccactccgccgaaagacctttcaagtgcgacctgtgtcccatggggtttaagcagcagtacgcactgatgcgtcacaggaggacccacaaaaccgaggaaccctttaagtgcggtctttgtgagaagggttttggccagccatcacacctactgtaccaccagcatgtccacactctggagaccctgtttaagtgccctgtttgtcagaaagggttcgatcagagcgccgagctgctgagacacaagtgtctcccgggggctgcggaacgccccttcaagtgcccagtctgtaataaggcctacaagcgagcctctgccttgcagaagcaccagctggcccattgtgcggcagcagagaagccattgcggtgtaccctttgtgaacgacggttttttagctcgagcgagttcgtgcaacacagatgtgacccagctcgtgagaaacctcttaagtgtcctgactgcgagaagcgatttaagtacgcctctgatctccagcgacacagaagagtgcacactggagagaagccttacaaatgcccaaactgtgacaaggcatttaaacagagggaacacctgaataagcaccaaggcgtgcacgcgagggagcagcaatttaagtgcgtgtggtgtggagagcgattcttggacgtggctctcctccaggaacattctgcccagcactcagccgcagccgctgcggctgagggtgcatatcaggtagccgcttgtctaccctag

SEQ ID NO: 21470 - DNA, 1209 bp, Artificial Sequence
  Description of Artificial Sequence: Synthetic coding sequence
atgtacaccagcgaggagaagtgcaaccagcggacccagaagcggaaaatctacaatgtgtgcccccgaaaggggaagaagatcttcatccatatgcacgaaattatacaaatcgacggacacatctaccagtgcctagagtgcaagcagaacctgtgcgagaatctcgccctaatcatgtgcgagcgcacccacacaggggaaaaaccatacaaatgcgatatgtgtgagaaaacttttgtccaaagcagcgatttgacctcccaccaacgaatacataactatgaaaaaccgtacaagtgttctaaatgcgagaagtccttctggcaccatctggtgttgtctgggcaccagcggacccatgccggaaagaagttctatacttgcgatatctgcggaaaaaactttgggcagtccagcgatctgctagtgcaccagagaagccatactggcgagaaaccgtatctgtgtagcgagtgtgataagtgcttctctaggtctactaacctgatccgccaccgccgaacccacaccggggaaaaaccctttaaatgtttggaatgcgaaaaggctttcagcggcaaaagcgaccttatttcacatcagcgcactcataccggagagcgcccgtataaatgcaacaagtgtgaaaagagctatagacacaggtcggcttttattgtgcataaacgagttcataccggggaaaagccatacaagtgtggcgcatgcgagaaatgctttggtcagaagagtgacttgattgtccaccaaagggtacacaccggcgagaaaccctacaagtgcctagagtgtatgcggagttttacacggagcgcaaatctgatacggcatcaggctacccacacccacactttcaagtgtttagaatatgagaagagctttaactgttcatcagacttgatagtccaccaacgcatccacatggaagaaaaaccacaccaatggtctgcatgtgagagcggtttcctcctcggtatggactttgtggctcagcagaagatgaggactcagaccgaagagctgcattataaatatacagtgtgtgacaaatctttccatcagtcttccgcgctgctgcagcatcaaaccgtccgcatcggtgagaaacctttcgtgtgtaacgtatccgagaagggactggaattgtctccacctcacgccagcgaggctagtcagatgtcttag

SEQ ID NO: 21471 - DNA, 1662 bp, Artificial Sequence
  Description of Artificial Sequence: Synthetic coding sequence
atggccttcgaggacgtggccgtgtacttcagccaggaggagtggggactcctggacacagcacaaagagcactgtatagacgtgtcatgctggataattttgctcttgtggctagtctcgggctgagcacctctcgccctagagtggtaatccagcttgaaagaggggaggagccatgggtaccaagtggcactgatacaaccctgtcacgtaccacttaccgccggcgtaatcccgggagttggagtctcactgaagaccgtgacgtcagcggtgagtggcctcgagccttcccagacacgccccctgggatgaccacatccgtgttccccgtggctggcgcatgccacagcgtgaagtcactgcagcgtcaaagaggggctagtcctagccgggagcggaagccgaccggcgtttctgtaatatattgggaacggcttctgctagggtccgggagtggccaggcttccgttagtttacgcttgacttcacccttaagacctcccgaaggcgtgaggttacgcgagaagacattgactgagcatgctctgttgggtcgccagccccggactcctgagcggcagaagccttgcgcccaggaggttcccggccgcactttcggtagcgctcaggatttagaggctgctggaggccgtgggcaccacaggatgggggcagtatggcaagagccccaccgtctgctgggcggccaggagccaagtacctgggatgagttgggagaggcactgcacgccggcgagaaatcttttgagtgcagggcgtgttcgaaagtgttcgttaaatcctcggacctcctgaagcacctaagaacccacaccggtgaaagaccatacgagtgcgcccagtgtggtaaggcttttagtcagacctctcatctgacacagcatcagcgcattcactcaggcgagaccccgtacgcctgtccagtgtgtggcaaagctttccggcatagtagctctttagttaggcaccagcgtattcacaccgccgaaaaatccttccggtgctctgagtgcggaaaggcattcagccacgggtcaaacctgtcccaacacaggaagatacatgcaggcggccgtccatatgcatgtgcacagtgcggaaggcgcttttgtcggaatagccacctaattcagcatgagcgaacacataccggggagaaaccgtttgtctgtgccttgtgtggcgccgcgttctcccaggggtcttcactctttaaacatcagagagtccacaccggcgagaagcccttcgcttgcccacagtgcggcagggccttctcacatagttccaacctcacccagcatcaactgctccacaccggggaaaggccctttcgatgcgttgattgtgggaaagccttcgccaagggcgcggttcttctctcccaccggcggattcataccggagaaaaaccgtttgtttgcactcaatgtgggcgcgcctttcgggagcgacccgctctgttccaccatcaacgtatccacaccggagagaagacagttagacgctcaagggcctccctgcaccctcaggcgcggtctgtggccggcgcgagtagcgagggggcgcccgctaaagaaaccgaaccaactccggccagcggtccagcggcggtgtcacagcccgctgaggtgtag

SEQ ID NO: 21472 - DNA, 861 bp, Artificial Sequence
  Description of Artificial Sequence: Synthetic coding sequence
atggccttcgaggacgtggccgtgtacttcagccaggaggagtggggcctgttggacacagcacagcgtgccctatacagaagggtcatgctcgataattttgcgttggtagcttccctcggcttgagcacttcccgaccaagagtagtgattcagcttgagcgcggcgaagagccttgggtcccaagcggcaccgacaccacattatccagaacaacgtacaggcgacgcaacccaggctcctggtccttgacagaagatcgggacgtaagtggggagtggccaagggccttccccgacaccccacccggcatgactacatccgtgttccccgttgcaggagcctgtcactccgttaaatcactccagaggcagcgcggcgcctcaccatctcgcgaaagaaagccaaccggagtttctgtgatttattgggaaagacttcttctcggttcaggctcaggtcaagcatcagtgagcttgcgattaacttcccccctccggcctcccgagggggttcgactgcgcgagaagaccttgacagaacatgctttattaggcagacagccgcggacacccgagcggcaaaagccatgtgctcaggaggttccgggaaggacttttggtagtgcacaagacctcgaagctgcaggaggacgaggccaccaccgcatgggggccgtgtggcaggagccgcatcgactgttaggtgggcaggaaccctctacttgggacgagcttggcgaagcccttcatgcaggtgaaaagtctttcgaatgtcgggcctgttccaaggtatttgtgaagtcgtcagatcttttgaaacacctgcggaccagggtgaggcagggcttgcctgcctag

SEQ ID NO: 21473 - DNA, 993 bp, Artificial Sequence
  Description of Artificial Sequence: Synthetic coding sequence
atgggcgccgtgtggcaggagccccaccggctgctgggcggccaggagccaagcacctgggacgagctgggggaggccctgcacgcgggcgaaaaaagcttcgagtgccgagcgtgcagcaaggtgtttgttaagtccagtgacctcctgaaacacctaaggacacacacaggagagaggccatatgaatgcgcgcagtgtggaaaggccttctctcagacttcccacctgacacagcatcagaggatccattctggcgagacgccttacgcctgtcccgtttgtggcaaggccttccgacattcatcctctctggtacgccaccagcggatccacacagccgaaaaatcgttccgctgcagtgaatgtgggaaggcctttagccacggaagtaatttgtcgcagcacagaaagatacatgctggcgggcgcccctatgcctgtgcccaatgtggccggaggttctgtcggaattcccacttaatccagcacgagagaactcacacaggcgagaaacctttcgtgtgcgcgttgtgtggcgctgccttctcccaggggtcatccctgtttaaacaccagagagtgcacaccggagagaagccgtttgcctgcccacagtgcgggcgcgctttctctcatagctcgaatctcactcagcaccaactgttacacactggcgagcggccattccggtgcgttgattgcggcaaagcctttgccaagggcgcagtactcttgagccacaggcgaattcatacgggcgaaaaaccatttgtctgcacacagtgcggccgtgcgtttcgggagagaccagctctgtttcatcatcagcgaattcataccggcgagaaaacagtacggaggagtagagcttccctgcaccctcaagccaggtctgttgccggtgcgtcctctgagggggcccccgccaaagaaacagagcccacaccagcctccggacctgccgccgtgagccagccagccgaggtgtag

SEQ ID NO: 21474 - DNA, 1662 bp, Artificial Sequence
  Description of Artificial Sequence: Synthetic coding sequence
atggccttcgaggacgtggccgtgtacttcagccaggaggagtggggactgctcgatacggcccagagagctctgtatcgcagagttatgctggacaactttgcactcgtggcatccttaggactgtcaacatctcgtcccagggtagtcattcagctcgaacggggtgaagagccctgggttccctcagggacagataccacactttcacgtacgacttatcggcggaggaatccaggatcctggagtttgacggaagatcgagacgtgtctggggagtggccacgcgcctttcctgacaccccgccaggcatgaccacttcagtgtttcccgtagccggagcctgccatagcgtaaaatccctgcagaggcagcgtggtgccagccctagtagggagagaaaaccaaccggagtcagcgtgatatactgggagcggttactgctgggatccggatccgggcaggccagtgtcagtctgcgactcacctctccccttagacccccagaaggcgttagactgagggaaaaaactcttacagagcatgccctcttgggccgccagcccaggacacccgaaaggcagaagccatgtgcccaggaagtgcccggtcgaactttcggctccgctcaggatctagaagcagccgggggacgcggccaccacaggatgggggcggtgtggcaggaaccccatcggctcctgggaggtcaagagccgtccacatgggatgagctgggtgaggccctccacgccggggagaaaagcttcgagtgtagagcttgcagtaaggtctttgtcaagagttcagatctgcttaaacatctgaggacccataccggagagagaccttacgaatgtgcccagtgtggaaaggcctttagccagacaagccatctaactcagcatcaaagaatccactctggagagacaccctacgcatgtcctgtgtgcggcaaagctttccgccactctagctcattagtcagacatcagaggatacacacagctgagaaaagttttcgctgctccgaatgcggcaaggcatttagccacggctccaacctgtcccagcatcggaagatccatgccgggggacgtccctatgcatgtgcacagtgcgggcggagattttgtcgcaattcccaccttatccagcatgaaaggacccataccggagaaaaaccttttgtctgcgctctttgcggcgcagcatttagccaaggaagctcactgtttaaacatcaacgggtgcataccggagagaagccctttgcttgcccacagtgcggacgcgccttctcacactctagcaacttaacccagcatcagctccttcacaccggcgagagaccctttaggtgtgtggactgcggtaaggcctttgctaagggtgcggtcctgctatcgcacagacggatccatactggtgaaaaaccatttgtttgcacgcaatgtggccgggcattccgagagagacccgctctgtttcaccatcagcgcatccatacaggggagaagacagtgcgtcggtcccgcgcctctttgcacccgcaagccagaagtgtggctggcgcatcttctgagggcgcgccagcaaaggagactgagcccacacccgcatcaggcccagctgccgtgtctcagcccgctgaagtttag

SEQ ID NO: 21475 - DNA, 1605 bp, Artificial Sequence
  Description of Artificial Sequence: Synthetic coding sequence
atgggcgtgcccagcgtggtgagcgccatccccatccgggccgactgctcaagtaaaccccagcccctgctacaaggtcagccacatctatatttctcccctaagctcttatgtcagttgcggggctctttcctcccagtgcacagcgcttgtcccggtccgttgctgaccaggatgcctcaggctacaacagtatctctccctcttggcagctggagtttgacagaggacagggacgtctcgggcgagtggcctcgggcttttccggatacaccgcccgggatgactacatcggtgtttccggtggcaggcgcctgccacagtgtgaagagcttgcagagacagcgcggcgcttctccctccagagaaaggaagcccacaggggtctccgttatttactgggagaggctgctactgggttccggatcgggtcaggcttcagtctccttgcgccttacctctcctttgaggcccccagagggagtgcggctgagagaaaaaaccttgactgaacatgctctgcttggccgtcagcctcgaacacctgagcggcaaaagccatgcgcccaggaggtccctggacgcaccttcgggtcagctcaggatcttgaagctgcaggagggaggggccaccaccggatgggtgccgtttggcaggagcctcaccggctgcttggcggacaggagccttcaacttgggacgagctaggcgaagccttacatgctggagaaaaaagttttgagtgccgggcctgtagtaaagtcttcgtgaagagctcggacctgctgaagcacctgcggactcacaccggagaaaggccatatgaatgcgcacagtgtgggaaagcattttctcagacgtctcatttaacacagcaccagcgcatccattccggcgaaaccccctacgcatgtccagtgtgcggcaaggccttcagacattcatcaagtttggtacgacatcaacgaatccacactgccgaaaaaagttttagatgttctgagtgcggcaaggccttttcgcacggcagcaacctctcacagcatagaaagattcacgccggtgggcgcccctacgcctgtgcacagtgcggcagacgattttgtaggaactctcatctcatccagcacgaacgcactcatacgggcgaaaaaccatttgtatgcgccctctgcggggcagcattctctcagggtagcagcttatttaaacatcagagggtacatactggggagaagcccttcgcctgtcctcagtgtggtcgggctttttcccatagctccaatctgacccagcaccagctgctccatacgggcgaacgtccattccgctgcgtcgattgtggtaaggccttcgctaaaggggcagtgctgctcagtcataggagaatccatacaggggagaaaccgttcgtctgtactcagtgtgggcgggcctttagagaaagacccgcgctcttccatcatcaaaggatacatacgggcgaaaagaccggtgatcccggtcctgcctgtaccccccggcccggattgttgcctggacaccatcagaaagtgcggcagaggaggaaaccatctccacttcccccccgggcccagccgtag

SEQ ID NO: 21476 - DNA, 1635 bp, Artificial Sequence
  Description of Artificial Sequence: Synthetic coding sequence
atgaccttcgaggacgtggccgtgtacttcagccaggaggagtgggggctcctggataccgctcaacgggctctgtatagacatgttatgttggaaaattttaccctcgtgactagcctgggcctcagcacatctcggccaagagtggtgatacagctagagcgcggagaggagccatgggtgccatccgggaaggatatgaccctggctagaaatacatacggacggctgaattcagggtcctggtccctgacagaagaccgggacgtctcaggagagtggcctcgggctttccccgataccccacctggcatgaccacatctgtgttcccggtggcagatgcctgtcactccgtcaagagtctccagagacagcccggtgcctctccctcccaagagagaaagcctactggggttagtgttatctactgggagagactgctgttgggaagcagatccgatcaagccagcattagcttaagactaacaagcccactcagacccccgaagagtagtcggccacgcgaaaagacttttaccgagtacagggtgccagggcgtcagccacggacaccggagcgtcagaaaccctgtgcgcaggaagtgcctggcagagcatttggtaacgcatctgacttaaaggccgcctcagggggccgcgatagacgcatgggcgcagcttggcaagagccccacaggcttctcggggggcaggaaccatccacatgggacgagctaggcgaagcccttcacgccggggaaaaatcttttgagtgtcgggcctgctcaaaagtcttcgtaaaaagtagcgaccttctcaagcacctgagaacacatacgggggagagaccctacgagtgtacacagtgtggtaaagcattttcccaaacttctcacctgacccagcatcagaggatacactcaggggagaccccctatgcttgtccagtttgtggtaaggcctttaggcattcctcctctcttgttaggcatcagcgcatccataccgcagagaagtcatttaggtgcagcgaatgtggcaaggcattcagccacgggagcaacctctctcagcatagaaaaatccatgcagggggacgcccctacgcttgcgcacagtgtggtcgtagattctgcaggaatagtcatctcattcaacatgagcggacgcacactggggaaaagcctttcgtttgcgccctttgcggcgcggctttcagccaaggttcatctctgtttttgcaccagcgggttcacaccggggagaaaccgttcgcttgcgctcagtgcgggagatccttcagccggagcagcaatctgacccagcaccagttgctgcacaccggggaacgacccttcagatgtgttgactgtggaaaaggtttcgccaagggggccgtactgctgtctcatcgtcggatacacaccggcgaaaagccttttgtctgtactcagtgcggcagagccttccgggagcgtcctgcactcctccatcatcagaggatccataccacagagaaaacaaatgccgccgcccccgactgtacgcctgggcccggctttctgcagggacaccacaggaaagtccgtagaggtggtaagcctagtccagtccttaaacctgccaaagtatag

SEQ ID NO: 21477 - DNA, 1605 bp, Artificial Sequence
  Description of Artificial Sequence: Synthetic coding sequence
atgggcgtgcccaccgccgtgagcgccacccccgtgcgggccgacgcatcttctaaaccgcaaccgctgcttcagtcacaaccacatctgttcttcttccccaagttactttccagattgctggggtcaccgctgcccgtacatagtgcttgccccggcccgctgctgaccaggatgccccaggcaacaactgtctcactgaggcttggatcttggtctttgacggaggaccgcgatgtctcaggagagtggccccgtgctttcccggacactcctcctggcatgaccacatccgtgttccctgtggcagatgcatgccatagcgtgaagagcctccagcgccaaccaggggctagtccttcgcaggaacgaaaacccaccggggtgagcgttatttattgggagagattgcttctcggctcacggtctgatcaggctagtatttccttgagactaacgagccctctgcgcccccccaaatccagcaggccccgggagaagacctttacagagtacagagtccccggcagacaaccacgaaccccagagagacagaagccctgcgcgcaggaggttcctgggcgggcttttggaaacgcgtccgaccttaaagctgcttccgggggtagagaccggcggatgggcgctgcttggcaggagccacaccgactgctgggcgggcaggagccttctacctgggatgaactaggagaagccctgcacgctggcgagaagagcttcgagtgcagagcctgtagtaaggtattcgtgaagagtagcgacctgctgaaacatctgaggactcatactggtgaacgaccatacgagtgtactcagtgcgggaaagcgttttcccaaacttctcacttaacgcaacatcagcgcatccactccggggaaacaccatacgcctgtccagtctgcggcaaggcctttcgccactcaagttcactggttcgtcaccagcggatccacaccgccgaaaagagcttccgctgcagcgagtgtggcaaggctttcagccatggatcaaatctgagccagcaccggaaaatacatgcagggggtcgaccgtatgcatgtgcacagtgcggcaggagattttgcagaaactcacatctcatccaacacgagcggacacatactggagagaagccgtttgtgtgcgcgctatgtggagctgccttcagtcagggatcctccctattcctgcaccagagggtccacaccggcgagaagccattcgcctgtgctcagtgcgggaggagcttctcccggtcatctaatctcacgcaacatcagctgcttcatacaggagagcgcccgttcagatgcgtcgattgtggcaaggggttcgcaaaaggagccgtgcttctttcccacagacgaatacatactggagagaaaccatttgtctgcacccagtgcggaagagcattccgggagaggcccgctcttttacatcaccagcgaatacacactacagagaaaactaatgccgcggctcctgattgcacaccgggtcctggttttctgcagggccaccaccgcaaggtgcggaggggcggaaagccctctcccgtgctgaagcctgccaaggtctag

SEQ ID NO: 21478 - DNA, 1635 bp, Artificial Sequence
  Description of Artificial Sequence: Synthetic coding sequence
atgaccttcgaggacgtggccgtgtacttcagccaggaggagtggggactccttgataccgcccagcgagcattatacagacatgttatgttagagaactttacacttgtcacctctctgggtttgagcactagccgacctcgagtcgtgatacaattggaacgcggagaggagccctgggttcctagcggcaaagatatgacattggcccggaacacctatggacggctgaacagcggtagctggtctttgacagaagatagagatgttagtggggaatggcctcgagctttcccggacaccccgccaggaatgactaccagtgtatttcccgtagctgacgcttgtcactctgtgaagagccttcagagacagcctggagcttctccatcacaggagcgtaagccaacaggagtcagtgtgatctattgggagcggcttctgcttggcagccgctctgatcaggcaagcatttccctgcgactcacgtctcccctaaggcctcctaagagctcacgaccacgggagaaaaccttcaccgagtatcgggttcctggtcggcaaccacggacccctgagcggcaaaaaccgtgcgcacaagaagtcccgggcagggcatttgggaacgcttcggacctgaaagcagcctctggtggtcgagataggagaatgggagcagcgtggcaagaaccacataggcttcttggggggcaggaaccatcaacttgggatgaactgggtgaggctctccatgccggggagaagagcttcgagtgccgcgcatgctcaaaagtgttcgtgaaaagcagtgatcttctgaagcatctccgtacacataccggtgaaaggccctacgagtgtacccagtgtgggaaggcattctcacagacttcgcatttgacgcaacaccagcgcatccacagtggcgaaaccccttatgcttgtcccgtttgcggaaaggcttttcgacactcgtcttcccttgttaggcaccaaagaatacacacagcagagaagtcctttcgctgctccgaatgtgggaaagccttttcgcacggcagcaatctgagccaacatcgcaagattcacgctggaggaagaccttatgcctgtgctcagtgcggcaggagattctgtaggaatagtcacttgatccaacatgagaggacccatacaggagagaagccttttgtttgcgctctctgtggcgccgccttttcacaaggcagcagtttattcctgcatcaaagggtccatacgggtgaaaagccgttcgcctgcgcccagtgtggtaggtcgttttcccgcagttctaacctcactcagcaccagctcctgcacacaggagaaagaccattccgttgtgtggattgcggaaagggattcgctaagggggctgtcctgctttctcatcggaggattcataccggggagaagccattcgtctgtactcagtgtgggagggctttccgagaacggcccgccctgctgcaccaccaacgaattcacactacggaaaagacaaacgctgccgcacccgattgtaccccaggcccggggttcctgcaaggtcatcaccgcaaggtcaggcgcggcggcaagccctcgcctgtcctgaaacctgctaaagtgtag

SEQ ID NO: 21479 - DNA, 1749 bp, Artificial Sequence
  Description of Artificial Sequence: Synthetic coding sequence
atggacttcgaggacgactacacccacagcgcctgccggaacacctaccaaggctttaatggtatggatcgtgactatggcccaggctcatatggaggcatggaccgggattacggtcacgggtcctacggcggacaacgctcaatggacagttacctaaaccagtcctatggtatggacaaccactctggagggggaggtgggagtcggtttggtccatatgagtcatacgatagcagatctagcctgggagggagggacctctataggtcaggttatggcttcaatgaaccagagcaaagcaggtttgggggctcctacggcggcagatttgagtcctcttatagaaacagcttggattcattcggaggacgcaatcaaggcgggagctcctgggaggcaccttattccagaagtaaacttcggcctggattcatggaagatcgtggccgtgaaaactatagctcctacagtagcttctcctcacctcatatgaagcccgccccggtcggatcccgaggccgaggaacaccggcttacccagagtcaacttttggcagcagaaactacgacgctttcggcgggccctcaacgggtagaggccgaggacgaggtcacatgggcgacttcggttccatccaccggcccgggatcgttgtggattaccagaataagagtaccaatgtcaccgtggcagcggcccgaggcataaagcgcaaaatgatgcagccgtttaataagcccagcgggacctttatcaagaagccaaagctggcaaagcccatggagaagatttctctaagcaagtcacccaccaagaccgaccctaaaaacgaggaagaagaaaagcggcgaatcgaagctagaagggaaaagcagcgcagacgtagggagaagaacagcgagaagtatggcgatggctatcgcatggctttcacgtgcagcttctgcaaatttcggaccttcgaggagaaggatatcgagctgcatcttgagtcttcaagccaccaagaaactctggaccacatacagaaacaaacaaagttcgacaaagtagtcatggaattcctgcatgagtgtatggtgaacaagttcaagaaaacctctatccggaaacaacagacaaataatcagaccgaggtggtaaaaatcattgaaaaagatgtaatggaaggggttacggtggatgatcatatgatgaaagtggagacggtgcactgcagtgcttgctcagtgtacattcccgctcttcactcctctgttcagcagcacttaaagagccccgaccacattaaagggaagcaggcatacaaggaacagattaaaagggaatctgttttaactgccacgtccatccttaataacccgatcgttaaagctcgatacgaaaggttcgtcaagggggagaatccattcgagattcaggatcacagccaagatcagcagattgaaggcgatgaagaggatgaggagaagatcgacgaacctatcgaggaggaggaagatgaagacgaagaagaggaggccgaggaggtgggtgaagtcgaggaagttgaggaagtagaggaagtgagggagggaggcattgagggcgagggaaatatccagggcgttggtgagggtggtgaggtaggcgtggtcggagaagtggagggagtgggagaggtcgaggaagtcgaggaactagaggaggaaacagccaaggaagagcctgcggacttccctgtggaacaacctgaagaaaattag

SEQ ID NO: 21480 - DNA, 213 bp, Artificial Sequence
  Description of Artificial Sequence: Synthetic coding sequence
atggacttcgaggacgactacacccacagcgcctgccggaacacctaccagggcttcaatggcatggatcgggattacgggcctggatcctacggtggcatggaccgagattatggtcatggcagttatggcgggcagcgcagcatggactcatatttgaatcaaagctatggtatggataaccattctggtggcggcgggggctctcgatag

SEQ ID NO: 21481 - DNA, 1482 bp, Artificial Sequence
  Description of Artificial Sequence: Synthetic coding sequence
atggacttcgaggacgactacacccacagcgcctgccggaacacctatcagggcttcaatgggatggatagagattacggccccggcagctatggagggatggatcgagattatggacatggctcatatggaggacagcgatccatggattcctatttaaaccagtcctatggaatggataatcattcaggcggagggggaggttcgtcattttctagtcctcacatgaagccagccccagttggatcacggggccggggaacgccggcctacccagagtcaacctttgggtcaaggaactatgatgcttttggcggcccttcaacaggcaggggccgcggtcggggtcatatgggggatttcggcagcatacaccgaccaggaatcgtagtcgactatcagaataaaagtaccaacgtcactgtggccgccgctcgcgggatcaagagaaagatgatgcagcccttcaataaaccttccggcacttttatcaagaagcccaagctcgctaagcccatggagaagatcagcttatctaagtctccgactaaaaccgacccaaaaaacgaggaagaggagaaacggcggatagaggcacgacgagagaaacagcggcgcaggcgcgaaaaaaattccgagaaatacggagatgggtataggatggcatttacatgctccttctgcaaatttaggacatttgaagaaaaggacatcgagctccatttggagagctcctcccaccaggagaccctggaccatattcaaaagcaaaccaaattcgacaaagtcgtgatggaattcctgcacgagtgtatggtgaacaagtttaaaaagactagtattagaaagcagcagacgaataaccagaccgaagtcgtgaaaatcattgaaaaggatgtgatggaaggggtgaccgtggacgatcacatgatgaaagtggaaacagtgcactgcagcgcttgctctgtctacattccagctctccatagttctgtgcagcaacacctaaagtcccccgatcacatcaagggcaaacaggcctacaaggagcagatcaaacgcgagagcgtcctcactgcaacaagcatcctgaacaacccaatcgtgaaggcaagatacgaacgcttcgtcaagggagaaaacccatttgaaatccaagatcattcacaggaccaacaaatagagggagacgaggaggacgaagagaaaattgacgaacccatcgaggaagaggaagacgaggatgaggaagaagaagccgaagaggtgggagaggtcgaggaagtagaggaagtcgaggaagtgcgggagggagggatagaaggcgaaggtaatatacagggggttggcgaggggggggaggtcggcgttgtgggcgaggtggaaggagtcggggaggtggaagaagtggaagagctcgaggaggagaccgcaaaagaggaaccagcagatttcccggtcgagcagcccgaggagaattag

SEQ ID NO: 21482 - DNA, 1749 bp, Artificial Sequence
  Description of Artificial Sequence: Synthetic coding sequence
atgatgttcaaccgggactacacccacagcgcctgccggaacacctaccaagggttcaacggcatggaccgagactatgggcccggcagctatggaggaatggatagggattatggccacggctcatacggcggccagaggtccatggactcctatcttaaccaatcctacggcatggataaccactcaggggggggcgggggaagccgtttcgggccttacgaaagctatgatagccggagttccttgggcgggcgcgacctctatcggtccgggtacggtttcaacgagcctgaacagagtcgctttggcggctcctatggcggccggttcgagtcttcatacaggaacagtcttgactctttcgggggacggaatcagggaggctcatcgtgggaggccccatattcccgctctaagctacgacccggcttcatggaagaccggggacgcgaaaactattcctcttatagttcatttagctccccacatatgaagccagctcccgtgggatccaggggaagagggactcctgcgtaccctgaatctaccttcggatcacggaactacgacgcatttggcggaccatccacgggtcgtggacgcggcagggggcatatgggggacttcggctctatacacaggccaggaatagtggttgactatcaaaacaaatctacaaacgtgacggtggcagccgcgcgagggatcaaacgcaaaatgatgcagccctttaataagccctctggtaccttcataaaaaagccaaagctagctaagccgatggaaaagatctcgctctctaaaagtcctaccaagaccgaccctaagaacgaggaagaagagaaacgccgaattgaggccaggcgagaaaagcagcgcaggcgtcgtgagaagaactccgagaagtacggagatggctaccggatggctttcacttgtagcttttgcaagtttcgcacttttgaggaaaaagatatcgaactgcacctcgaaagttctagccatcaggagactttagatcatatccagaagcagactaagttcgacaaagtggtgatggaatttctgcacgaatgcatggtcaataagtttaaaaagacgagcatccgtaagcagcagactaacaaccaaactgaggtggttaagatcatcgagaaagatgtgatggagggtgtgactgttgatgatcatatgatgaaggtcgaaacggtgcattgcagcgcctgctctgtctacatacccgccttacactcctccgtccagcagcatctgaaaagtcccgaccacattaaggggaagcaggcctataaggagcagattaagcgcgaatccgtcctcacggccactagcattcttaataatcctatcgttaaggcccgatacgaaaggttcgtcaaaggggaaaaccctttcgagattcaagatcattcccaggaccagcaaatcgaaggagatgaggaagacgaagaaaaaatcgatgaacctatcgaagaagaagaagacgaagacgaggaagaggaagctgaagaagtcggggaagtggaagaagttgaggaagtggaagaagtgagagaaggaggaattgaaggcgaaggcaacatacagggcgtgggcgaaggcggcgaagtgggggtcgtcggcgaggtggagggagttggagaggtagaagaagtggaggaactggaggaggagacagcgaaggaggagcccgcggatttccctgtagaacagcctgaggagaattag

SEQ ID NO: 21483 - DNA, 1131 bp, Artificial Sequence
  Description of Artificial Sequence: Synthetic coding sequence
atgggcgacttcggcagcatccaccggcccggcatcgtggtggactatcagaataagtccactaatgtgactgtagccgcggcccggggcatcaagaggaaaatgatgcaaccttttaacaagcctagcggaacgtttatcaaaaaaccaaagctcgcaaagcccatggaaaagatttccttatccaagtcacccacaaagacagaccctaagaatgaagaagaagagaaacggcgaatagaggcccggagagagaaacaaagaagacgccgggaaaagaacagcgagaagtatggcgatggctaccgaatggctttcacctgttccttttgtaagtttcgcacgttcgaggagaaggacatagagttacatttggagtccagtagccatcaggagacccttgaccacatccaaaagcagactaagtttgataaggttgttatggagtttctgcacgagtgcatggtaaataagttcaaaaagacatctatccgcaagcaacagaccaataatcagacagaagtggtgaagattattgaaaaggatgtgatggaaggagtcacagtagacgaccacatgatgaaagtcgagactgtccattgctccgcatgctctgtatacatcccggctctacatagttccgtgcagcagcatctgaaatctcccgatcatatcaagggaaagcaggcctataaggagcagatcaaacgagaaagcgtcctcactgcgacaagtatcctcaataatcccatcgtgaaagccaggtacgaacggttcgtgaagggagaaaatccttttgaaatccaagaccactctcaggaccagcagatcgaaggagatgaggaagacgaagagaagattgatgagcctatcgaggaggaagaagacgaggatgaggaggaagaagccgaagaggtaggtgaggtggaggaggtggaggaggttgaggaggtgcgtgagggaggcattgaaggggagggaaacattcagggtgtgggggagggcggcgaggtgggagtggtgggagaagtagaaggagtgggagaggtcgaagaggtggaggagttagaagaggagactgccaaagaggaaccagcggatttcccggtggagcagcctgaggagaactag

SEQ ID NO: 21484 - DNA, 1626 bp, Artificial Sequence
  Description of Artificial Sequence: Synthetic coding sequence
atgcggctgaagatgaccacccggaacttccccgagcgggaggtgccgtgcgacgttgaagtggagaggttcaccagagaagttccttgcttgtcttccctgggcgatgggtgggactgtgagaaccaggagggacacctcagacagtccgctctgaccctggagaaacccggcacgcaggaggccatctgtgagtaccctggcttcggagagcacctgattgcctcatctgacctgccacctagccaacgggtcttggccacaaacggctttcatgcccctgatagcaacgtgtctggcctggattgcgaccctgctctgccgagttacccaaagtcgtatgcagataaacgaactggagatagcgatgcttgtggaaaaggttttaaccattccatggaggtgatccacggtcgcaatcctgtacgagaaaaaccctacaagtatccagagtcggtgaagtctttcaaccactttacatctctgggacatcagaagattatgaagagggggaagaagagttatgagggcaaaaattttgagaacatatttacactgtcaagctcattgaatgagaaccaacgaaacttacctggcgaaaaacaatacagatgtaccgagtgcgggaagtgcttcaagcggaattcgtcactggtgctgcatcaccgcacccataccggggagaagccatacacctgcaacgaatgtggcaaatcattcagcaaaaactataacctgatagtgcaccagagaattcacaccggggagaaaccatacgagtgttccaagtgcggtaaggcattctccgacggtagtgcgctgacccagcatcagaggatccatacaggcgagaagccgtacgaatgtctggaatgtgggaaaacatttaatcggaacagttcgcttattctgcatcaacgtacccacaccggcgaaaaaccttatcggtgcaatgagtgcggtaaaccattcaccgatatctctcatcttacagttcacttacgcatccacacaggggagaagccctacgagtgctccaaatgcgggaaagccttccgtgacgggtcctaccttacacagcatgagcggacacatacgggggagaagcccttcgaatgcgctgaatgcggtaagtcatttaataggaacagtcatctcattgttcaccagaaaatacacagtggcgaaaagccgtacgaatgcaaggagtgcggcaagaccttcattgagagcgcctatcttatcagacatcagcgaatccatacaggcgagaagccgtatggttgcaaccagtgccagaaactgttcagaaatatcgctggcctgatcagacaccagcgcactcacaccggcgagaagccatatgaatgcaatcagtgcggtaaagcttttcgcgattcttcttgcctcaccaaacaccagcgcatccacaccaaggagactccataccagtgtccggaatgtggtaaaagcttcaagcaaaacagccacctcgcagtccaccagcgcctgcatagtagggaggggccttctcggtgccctcagtgcgggaagatgttccagaaatcttctagcctcgtgagacatcagagggcccatctgggcgagcagccgatggagacatag

SEQ ID NO: 21485 - DNA, 1626 bp, Artificial Sequence
  Description of Artificial Sequence: Synthetic coding sequence
atgcggctgaagatgaccacccggaacttccccgagcgggaggtgccttgcgacgtggaagtcgagagatttacacgggaggtgccgtgcctgtcttccctgggcgacggatgggattgcgaaaatcaggagggacatttgcggcagagtgccctgaccctggagaaaccaggaacacaagaagccatatgtgaatatccaggctttggagagcaccttatcgcttccagtgaccttcccccttcccagagggtgctggcgacaaatggcttccacgcaccagatagcaacgtgagcgggctggattgtgaccccgcccttccgagttatcccaagagttatgcagataaacgcactggagattcggatgcttgtggtaaggggtttaatcactcaatggaggtgattcacggccgcaaccccgtgagggaaaagccatacaagtatccagagtcagttaagtcatttaaccacttcacctcactcggacaccagaaaattatgaaaagaggtaaaaagagctatgagggaaagaactttgaaaacatctttacactgtctagttctcttaacgaaaaccaaaggaatctgccaggggagaagcagtacaggtgtacagagtgcggaaagtgctttaaacgcaacagctctcttgtcctccatcaccgtacgcatacaggtgaaaagccatacacatgcaacgagtgcgggaagagttttagtaaaaactataatctgattgtacatcaaagaatccacactggggagaaaccttacgagtgtagcaagtgcggtaaggcattctccgacggatcagcgttgacgcagcatcaacgcatccacacgggcgaaaaaccgtacgagtgtctagaatgcggaaaaaccttcaaccggaatagcagcctaatacttcatcagagaacccatactggtgaaaagccgtatcgctgtaatgagtgcggaaaaccttttaccgacatctctcatttgacagtccaccttcggatccataccggagagaaaccctatgagtgctcaaagtgtggcaaggcatttcgggatggcagctacctcacccaacacgaacgcacacacaccggcgagaagccatttgagtgcgccgaatgcggtaagtcattcaacaggaattcccaccttatcgtccaccagaaaattcacagcggggaaaagccttacgaatgtaaagaatgcggcaagaccttcattgaatcagcctacctcatccgccatcagcggattcacaccggggagaagccatatggctgcaaccagtgtcagaagttattcaggaatatcgccggcttaattagacatcagcgaacccacacaggggagaagccgtatgagtgcaaccagtgcggcaaggcctttcgtgattctagctgcctcaccaagcaccaacggattcacactaaggaaacaccctaccagtgccccgaatgcggtaagagtttcaagcagaacagccatctcgctgtgcatcaacgcctgcatagcagggagggtccttccaggtgtcctcagtgcggtaaaatgtttcagaaatctagtagtcttgtgcggcaccagagggcccatctcggagaacaacccatggaaacttag

SEQ ID NO: 21486 - DNA, 1626 bp, Artificial Sequence
  Description of Artificial Sequence: Synthetic coding sequence
atgcggctgaagatgaccacccggaacttccccgagcgggaggtgccgtgcgacgtggaggtggaacgttttacacgggaggtcccatgcttaagcagcctaggcgacggctgggactgtgaaaatcaggagggtcacctgaggcagtccgccttaacactggagaagcctggtacccaggaggccatctgcgaataccctgggttcggcgagcacctgatagcctcaagtgatctgcccccatcccagcgcgtactggccacaaacggcttccacgcccctgatagtaacgttagtggattagactgtgatccggccctgccatcctatccaaagtcctacgccgacaagcgaacaggagattctgacgcatgtggaaagggcttcaatcacagtatggaggtgatccacggccggaacccagtgagagagaaaccgtacaagtatcccgagagtgtcaaaagcttcaaccactttaccagtctcggacatcagaagattatgaagcgcggaaagaagagctacgaaggaaagaatttcgaaaatatctttaccttgtcttcctccctcaacgaaaaccaacggaatctaccgggggagaaacagtatcgttgcaccgagtgcggcaaatgcttcaaacgcaactcctcactggttctccatcaccggacccacacaggtgagaagccatatacttgtaacgagtgcggaaaaagcttcagtaaaaattataatctgattgtccaccagcgtatccacaccggggaaaagccatatgaatgttctaagtgcgggaaggcgttctctgacggatcggctctcacacaacaccagcgaatacacaccggcgagaagccgtatgaatgtctagagtgcggcaagacattcaaccgcaacagctccctgatcctgcatcagaggacacatacaggtgagaaaccctatcggtgcaatgagtgcggtaaaccattcactgacatctcgcatctgacagtgcatttgaggattcacacaggtgagaagccatacgagtgctcgaagtgtggtaaagccttcagggacggctcttatctgactcaacacgagaggactcacactggagaaaagcccttcgagtgtgctgagtgtgggaaaagctttaatagaaatagccacttgatcgtgcaccaaaaaattcactcaggcgaaaaaccctatgagtgtaaagagtgtggaaaaacatttatcgagtctgcatatctcatcagacaccagcgtatccacacaggagagaagccctacggctgcaaccaatgccagaaactgttccgcaatatcgcaggactgatccggcatcagcgtactcacaccggggaaaagccatatgagtgtaaccagtgtgggaaggccttcagggacagctcctgccttaccaagcaccagcgcatccacaccaaggagacaccttatcagtgccctgagtgtggcaagtctttcaagcagaactcgcacttagccgtgcaccaacgcctgcacagcagagaggggccctcccgctgccctcagtgtggaaaaatgttccagaagtctagctcactggtgagacatcagagggcgcatttgggcgagcagccgatggaaacttag

SEQ ID NO: 21487 - DNA, 2043 bp, Artificial Sequence
  Description of Artificial Sequence: Synthetic coding sequence
atgaagatgaagaagttccagatccccgtgagcttccaggacctgaccgtcaatttcacccaagaagagtggcaacagcttgatcctgcccagcggctcctgtaccgggatgtcatgctggagaattacagcaatttagtcagcgtgggataccacgtctccaagcctgacgtgattttcaaattagaacagggagaggaaccatggatcgtagaagagttctccaatcagaactatccagacattgatgatgcccttgaaaagaacaaggagatccaggataagcacctgacacagactgtgttcttttctaacaaaacactaattaccgagcgtgagaatgtgttcggtaaaacccttaatctggggatgaattctgttcccagcaggaaaatgccatataagtgtaatcccggcggtaactctctgaagacaaactcggaagtcattgtggcgaagaaatcgaaagagaatcgaaagatccccgacggctactcgggatttgggaagcacgagaagtctcatttaggaatgaaaaaatatcgttacaaccctatgagaaaggcctccaaccagaatgagaatctcattcttcatcagaacattcagatcctgaagcagccattcgactataacaagtgcggaaagaccttcttcaagcgagccatcctgatcacccaaaagggcaggcagacagagcgcaagcccaatgagtgtaatgagtgccgcaaaacattttcaaagcgctcaactctgattgtccaccagcggattcatactggggagaagccctacgtatgctccgactgtcgaaagacattcagagtcaagacgagcttgacccggcataggcgaatccatacaggagagaggccatatgagtgctccgaatgccggaagaccttcatcgataagtctgccctgattgtgcatcagaagatccatggaggcgagaaaagctacgaatgtaatgaatgtggaaaaaccttcttcaggaagagtgcacttgcagagcactttagaagccataccggtgagaagccctatgaatgtaaagagtgcggtaatgccttttcgaagaaatcgtaccttgtggtccaccagcggactcatagaggggagaagcccaacgagtgcaaggaatgcggcaaaacattcttctgccaaagcgctctcacagctcaccaacgcatccacacaggggaaaagccctacgaatgctcagagtgcgagaagacctttttttgtcagagcgctttaaacgttcaccgtcggagccataccggggagaaaccctacgagtgttctcagtgcggcaagttcttgtgcacaaagtcagcgctgatagcccaccagattactcaccggggcaagaaatcctacgaatgcaacgaatgcgggaagtttttctgtcacaaatccacactgacaatccaccagaggacccacactggagaaaaacatggtgtgtttaacaaatgtgggagaattagcatagtgaaaagcaactgttcccaatgcaagagaatgaacaccaaggagaatctttacgaatgttctgaacatggccacgcagtctctaaaaattctcacctgatcgtacaccaacgaaccatttgggaaaggccttatgagtgcaacgaatgcggccgaacatactgcagaaagtctgccctaacgcaccatcaaagaactcataccggccagcgaccctacgagtgtaatgagtgcggcaagacattctgtcagaagttcagtttcgttgagcaccagcggactcacaccggagagaagccttacgaatgtaacgagtgcggcaagagtttttgtcacaagagcgcattccgcgtgcaccggcggatccacaccggggaaaagccttacgagtgtaaccagtgcgggaagacatatagacggttgtggactctgacggagcatcagaagattcacacaggagagaagccttacgagtgcaataagtgtgagaagacattccggcataagtcgaacttcctcttacatcagaaaagtcacaaggagtag

SEQ ID NO: 21488 - DNA, 1929 bp, Artificial Sequence
  Description of Artificial Sequence: Synthetic coding sequence
atgctggagaactacagcaacctggtgagcgtgggctaccacgtgtcaaaacccgatgtgatctttaaactggagcagggggaggaaccttggattgtggaagagttctccaaccagaactatccggatatcgatgatgctctcgagaagaacaaggaaattcaggacaaacaccttacccaaaccgtgttcttcagtaataagactctcatcacggaacgcgaaaatgtgttcgggaagacacttaacttaggaatgaacagcgtgcctagcagaaaaatgccgtataaatgcaacccaggaggcaatagcctgaagaccaattcagaggtgatcgtggccaaaaagtccaaagaaaaccgcaagattcctgatggttactccggtttcggcaagcatgagaagtcgcacctgggaatgaaaaagtaccggtacaatcctatgcgaaaagctagcaatcaaaacgaaaaccttatcttgcaccagaacattcaaattttgaagcagccttttgattacaataaatgcgggaaaaccttctttaaacgcgccatcttgatcactcagaaggggcgccagactgagagaaagccaaatgagtgcaatgaatgccggaaaacatttagtaagcgatccacacttattgtccaccagcgcatccacacgggggaaaaaccatacgtatgctctgattgccggaagaccttcagggtcaaaacctcactgactagacaccgccggattcatacaggcgaacggccgtacgagtgctccgagtgtaggaagacgtttattgataagtcagcattgatcgtgcatcaaaagatccacgggggggaaaagtcctacgaatgtaacgaatgcggaaagactttttttaggaaaagcgcccttgctgagcacttcagaagccacaccggagaaaaaccctacgaatgcaaggagtgcggaaacgcattttctaagaaaagctatctggtggttcaccagaggacccatcgtggagagaagcctaatgagtgcaaggagtgtgggaagacatttttctgtcagagcgcgctgacagctcaccagaggattcacacgggagaaaagccctacgagtgttccgagtgcgaaaaaaccttcttttgtcaaagcgccctgaatgtgcacaggagatcccacaccggagaaaagccttacgagtgttcccagtgcggcaaattcctctgcaccaagagcgccctaattgctcaccagataacccacagaggaaagaaaagctacgaatgcaatgaatgcgggaagttcttctgccacaaaagtacactgacgatccaccagaggacacataccggagaaaagcatggcgtgtttaataagtgcggacggatcagtatcgtgaagtccaactgttctcagtgcaagaggatgaacacaaaagagaacctatatgaatgcagtgagcacggtcacgccgttagtaagaatagccatcttatagtgcaccagcggacaatttgggagaggccatatgagtgcaatgagtgcgggaggacttattgtcggaagtctgctctcacacaccatcagcgcacccacacaggccaacggccttacgaatgtaacgaatgcggcaaaactttttgccagaagttcagcttcgtagaacatcagcgaactcacaccggtgaaaaaccatatgagtgtaacgagtgtggaaagagtttctgccacaaaagtgctttcagagtgcatcggcgcatacacactggcgagaagccatacgaatgcaaccagtgcggcaaaacataccgcaggctgtggactttaaccgaacaccagaagatccataccggcgaaaaaccatatgaatgcaataagtgtgagaaaacctttcggcataagtcgaacttccttctgcatcagaaaagccataaggaatag

SEQ ID NO: 21489 - DNA, 2256 bp, Artificial Sequence
  Description of Artificial Sequence: Synthetic coding sequence
atgggcccccagggcgcccggcggcaggccttcctggccttcggcgacgtgacggtggattttacacagaaggaatggagactgctgtcaccggcgcagcgggctctctatagggaagtcactctggagaactacagccacctggtttctcttggaatcctgcacagcaaacctgagctgattcggcggcttgagcagggcgaagtgccttggggagaggaacgccggcggcgccctggtccatgcgcaggtatctatgcggaacacgtccttcgcccaaagaacctcggcttagcccaccagaggcagcagcaactgcagttctcggaccagtcctttcagtctgacacagcggaggggcaggaaaaagagaagtctactaaacctatggcgttttcctctccacccctgaggcatgcagtctctagccgtaggcgtaattctgtcgtggaaattgaatcttcacagggtcagcgcgagaacccaacagagattgataaggtgctgaaaggtattgagaatagtagatggggcgctttcaagtgcgccgagaggggccaagacttctcccggaagatgatggtgattattcacaagaaggctcactcccgccagaagctttttacctgtagagagtgccaccagggctttagggacgaatccgcactgctccttcaccagaatacgcacaccggagaaaagtcctatgtgtgttccgtctgtggtcgcgggtttagcctcaaagccaatttgttaaggcatcagaggactcattctggagaaaagccattcctctgcaaggtatgcggcagaggttacactagcaagagctacctcacagttcacgagaggacccacacaggcgagaagccctatgagtgccaggagtgtgggcggaggtttaacgataaatctagttataacaagcacctgaaggcccacagtggggagaagccctttgtttgcaaagaatgcggaagagggtacacaaacaagtcatacttcgtcgtccacaaacgcatccatagtggggagaagccctacaggtgccaggaatgtggcaggggattctcaaacaagtcacatttgattacccaccaaaggacccatagtggggagaagcctttcgcctgtaggcagtgcaaacagagcttctctgtgaagggctctctactcagacatcagaggacccacagtggcgagaaaccctttgtttgtaaagattgcgagagatctttctctcaaaagtccacgctggtgtatcaccagcgtacacattctggtgagaaaccttttgtctgtagagagtgcggccagggattcatccagaaatctactctggtcaaacaccaaatcacccatagcgaggaaaaacccttcgtatgcaaggattgcgggagggggttcatccagaagtctacctttaccttgcaccaacggacacattctgaggagaaaccttatggctgccgtgaatgtgggcggagatttcgcgacaagtctagttataataagcacctccgggcccacctgggcgagaaaagattcttctgtagggactgcgggaggggatttactctgaagcctaacttgaccatccaccagcggacccattcaggtgaaaagccattcatgtgcaaacagtgtgaaaagagcttctccctgaaggcaaacctgctgcggcatcagtggactcattccggagagcggccattcaactgtaaagattgtggacgtggatttatcctgaagagtacactgttgttccaccagaagacccattctggggaaaagcccttcatctgctctgaatgtggacagggattcatctggaaatctaacttggtcaaacatcagctagcccacagtggtaaacagcctttcgtctgtaaagaatgtggaagggggttcaattggaagggcaatctgctgactcatcagcggacccattcaggtgagaagcccttcgtgtgtaacgtgtgcggacagggcttttcctggaagaggagcttaacacgacaccactggagaatacactcaaaggaaaaacccttcgtgtgccaggagtgcaaacgcgggtatacctcgaaatccgatctgactgtacacgagaggatccatactggggaacgcccctatgagtgccaagagtgcgggcggaagttctcgaacaagtcctattactcaaagcatctcaaacgccacctgcgcgaaaaaaggttttgcaccggctcagtgggcgaggcctctagctag

SEQ ID NO: 21490 - DNA, 1920 bp, Artificial Sequence
  Description of Artificial Sequence: Synthetic coding sequence
atgggcccccagggcgcccggcggcaggccttcctggccttcggcgacgttactgttgacttcacccagaaggagtggcgcctactgtctccagcccaaagggccctgtaccgggaagtcaccctggagaattactcccacctggtgtccttgggcatcctgcattctaagccagagcttattcggcggcttgaacagggtgaggtgccctggggggaggaacgtcggaggcgccccggcccctgcgcaggcatttacgccgaacacgtgctgcggcctaagaatcttggactggctcaccagagacagcagcagctgcagttctctgaccagtcctttcagtccgacacagctgagggacaggaaaaggagaagtctacaaaacccatggccttcagcagtccaccacttagacacgcagtgtccagcagaaggcggaatagtgtagtggagatagagagcagtcagggccagagggagaatccaacagaaattgataaggtactgaaagggatcgagaactcaaggtggggcgcctttaagtgcgccgagcgcggtcaggacttctctagaaagatgatggtgattattcacaagaaggcccacagccggcaaaagctgttcacctgccgagaatgccatcaaggctttcgggatgaaagtgccctcttgctgcaccagaacacacacacaggtgagaagagctacgtgtgttccgtgtgcggccgggggtttagcctaaaggcgaacctgctgagacaccagaggacacactccggtgagaagcccttcctctgtaaggtgtgtgggagaggatacacaagtaaatcctacctgactgtacatgagcgaacacacactggtgagaaaccttatgagtgtcaggagtgtggcaggcgctttaatgataaaagctcttacaataagcacctgaaggcccactctggcgagaaaccatttgtgtgcaaggagtgtgggcggggctacacaaataagagttattttgtggtccataaacgcattcattcgggggaaaaaccatatcggtgccaagagtgtggacgcggctttagcaacaagtctcaccttataacacatcaacgaacacacagtggagaaaagccatttgcttgtaggcagtgcaagcagtctttcagcgtaaaagggagcctcttgcgccaccagaggacccatagcggagagaagccgttcgtgtgtaaagattgtgagcggagcttttctcagaagagcacactggtttatcaccagcgcacgcatagcggggagaagccattcgtctgccgagagtgcgggcagggcttcatccagaagagtacccttgtcaagcaccagatcacccattcggaagaaaaaccatttgtttgcaaagactgcggacgtggttttatacagaagtcgacttttaccctgcaccaacggacacatagcgaagagaagccctacggatgtagggagtgtgggcgccgctttcgcgataagtccagctataataagcacctgagggcacatctgggggaaaagcggttcttctgcagggactgcggacgcggcttcaccctcaagcctaatctgacgatccatcagcgcacacattcgggtgagaagcctttcgtgtgcaatgtgtgcggccaggggttcagctggaaacgaagcctgactcggcatcactggagaattcactccaaagagaagccattcgtttgtcaggagtgcaagaggggctatacatctaaaagcgacctgaccgtgcatgaacggattcatacaggagagcgtccatatgaatgtcaggaatgtggtcgcaaattcagcaataaaagctattacagcaagcatctgaaacggcatctgagagagaagcggttctgtactggaagcgtaggggaggccagttcatag

SEQ ID NO: 21491 - DNA, 2256 bp, Artificial Sequence
  Description of Artificial Sequence: Synthetic coding sequence
atgggcccccagggcgcccggcggcaggccttcctggccttcggcgacgtcaccgtggatttcacacagaaagagtggcgtctactgtctccagcacagcgcgccttgtatagagaagtgactctcgagaattacagtcacctcgtgtctcttgggatattacatagcaaacctgaattaatcaggaggctcgaacagggcgaagtgccttggggggaagagcggcgcagacggcctggtccttgtgccgggatttacgccgagcatgtgttaagaccgaagaatctgggactggcccaccagagacagcagcaactgcagttcagcgatcaaagttttcagagcgatactgctgagggtcaggagaaggagaagtccactaagcctatggccttcagctcccctccattgcgacacgccgtatcatcgagaaggcgcaacagtgtagtggaaatagagtccagtcagggccaaagagaaaaccctaccgaaatcgataaggttttgaaggggatcgagaactcacgttggggcgcgtttaaatgtgctgagcgcgggcaggatttcagcaggaaaatgatggtcatcatccataagaaggctcactccaggcagaaactgttcacttgtcgggaatgtcaccagggcttcagagacgaatccgcactgctactgcatcagaacactcatacaggcgagaagtcttatgtgtgttccgtgtgtgggcgagggtttagcctgaaagccaatctgttgagacaccagcggacgcactcaggcgagaaaccttttctatgcaaggtgtgtgggcgcggctatacaagtaagtcatacctgacggtgcacgaacgcacacataccggcgaaaaaccgtatgagtgccaggaatgtggcaggcggttcaatgacaaatctagttataacaagcacctgaaggcacactctggcgagaagccctttgtatgcaaggagtgcggcaggggctataccaacaagtcttactttgtggtccataaacgcatacactcaggggagaaaccgtacagatgtcaggaatgtggccggggcttttcaaacaaaagccatctcatcacacatcagagaacacacagtggtgaaaagccctttgcctgtaggcaatgcaagcagtctttctccgtcaagggcagcctgcttaggcaccaacggacgcacagcggggaaaaaccattcgtctgtaaggactgcgagaggagtttttcccaaaaatccaccctggtgtaccatcaacgaacccacagcggggagaagccctttgtgtgtagggagtgtggacagggattcatccagaaatctactctggtaaaacaccagattacccacagcgaggagaagccgttcgtctgcaaggattgcgggcgtggcttcattcaaaaatccaccttcacactccatcaaagaacacattctgaggagaaaccctacggatgtcgggagtgcggcaggcgatttcgtgacaagtcctcatataataaacatcttagggcacatcttggagagaagagattcttctgcagagactgtgggaggggcttcaccttgaaaccaaacctcactatccatcagagaacacactcgggtgagaaaccatttatgtgcaaacagtgcgagaagagtttttcactcaaagcaaatctgctgcgccaccagtggacacactccggagagaggccctttaactgtaaagactgcggacgcgggtttattctgaagagcacgcttctctttcatcagaagacccacagcggcgagaaaccctttatttgtagcgaatgcggtcaaggcttcatatggaagtccaatctggtcaagcaccagttggcccacagtggcaaacaacctttcgtatgcaaggagtgtgggcgcggcttcaattggaagggaaacctattgacacatcagcgtacccacagtggagaaaagcctttcgtgtgtaacgtctgtggccagggcttttcctggaaaagatccctgactcggcaccattggcggattcacagtaaggagaaacccttcgtttgtcaggagtgcaaacgtgggtatacaagcaagagcgatttgaccgtgcacgagaggatccatactggcgaacgcccgtacgaatgccaggaatgtggtagaaaattcagcaataaatcatactactctaaacacctcaaaaggcatctgcgggaaaaaaggttctgcaccgggagcgtaggcgaggccagctcttag

SEQ ID NO: 21492 - DNA, 2160 bp, Artificial Sequence
  Description of Artificial Sequence: Synthetic coding sequence
atgggcccccagggcgcccggcggcaggccttcctggccttcggcgatgtgactgttgatttcacgcagaaagagtggcggctcctgtctcctgcccagcgcgcgttgtatcgcgaggtcactctggagaattacagccatttggtgagcctgggcatctatgctgaacacgttctgagacccaaaaacctaggacttgcccaccaaagacaacagcaactgcaattttctgatcaaagctttcagtcggatactgctgaggggcaagaaaaggagaagagcacaaagcccatggcattttcaagtccccccctgaggcacgccgtctcttctcgtcggcgaaattccgttgttgaaatcgagtcttcccagggtcaacgggaaaatcctaccgagatcgataaggtccttaagggtattgaaaactcacggtggggagcattcaagtgcgccgaacggggacaggatttttcccggaaaatgatggtaattatccacaagaaggctcatagtcgacagaagcttttcacttgccgagagtgtcaccaggggttcagagacgagagtgcactgttgctgcatcagaatacccacacaggtgagaagagctatgtgtgttcagtgtgcggccggggcttttcacttaaggccaacttgctgcggcatcagcgaactcactcaggggagaaaccattcttgtgcaaagtgtgcgggagaggatataccagcaaaagctacctcacagtgcacgagcgaacccacaccggagagaaaccttatgagtgtcaagaatgcggcagaagatttaatgataagtccagttacaataaacatcttaaagcccattctggcgaaaaaccatttgtgtgtaaagagtgcggtagggggtatactaacaagtcctacttcgtggtgcacaagaggattcattccggagaaaagccctaccgctgtcaggagtgtggcagaggttttagcaataaaagccacctcattacccaccaacggactcatagcggcgaaaagccattcgcctgcaggcagtgtaaacaatccttctctgttaaagggtctctgctgcggcaccaacgaacccactctggtgagaagccattcgtctgcaaggactgtgaaagatcattttctcagaaatccactttggtttaccaccagaggacacacagcggagagaaacctttcgtgtgccgcgagtgtggccaggggttcattcagaaatctaccctcgtgaaacatcagatcacccattcagaagagaagccttttgtttgtaaagactgcggccgtggcttcatccaaaagagcactttcacactccaccaacgcacacacagcgaggaaaaaccctacggctgtagagaatgcggaagacgcttcagagataaatcctcttacaataaacacctgcgggctcacctcggtgaaaagcgctttttttgtcgggattgcggccgcgggtttactttgaaacctaatctcactattcatcagagaacgcactcaggggagaaaccattcatgtgtaaacagtgcgagaagtcgtttagtctgaaagctaatctgctgaggcaccagtggacacactctggcgagcgtccatttaactgcaaggactgcggccggggctttattttgaagagcactttactctttcaccagaagactcactccggggaaaagcccttcatatgctctgagtgcggtcagggatttatttggaagtcaaatctggtcaagcatcagttggcacactcaggcaagcagcccttcgtgtgtaaagagtgtgggagaggattcaactggaaagggaatctgcttacccatcagaggacgcattcgggtgaaaaacctttcgtatgtaacgtatgtggacaaggcttctcttggaagcgcagtctcacgagacaccactggcggatccactctaaggagaagcccttcgtctgtcaggagtgcaaacgtgggtacacctcgaagtcagacttgacagttcatgaacggattcataccggcgaaaggccatacgaatgtcaagagtgtgggagaaaattttcaaataagtcatactatagcaagcatctcaaacgacatctgagagagaagaggttttgtacaggtagcgtgggtgaggccagttcctag

SEQ ID NO: 21493 - DNA, 2544 bp, Artificial Sequence
  Description of Artificial Sequence: Synthetic coding sequence
atggcccaggccatcttcgaggccctggagggcatggacaaccagacagttttagcagtgcaaagtctgctcgatggtcaaggagccgtcccagaccccacaggacagtccgtgaacgctccccccgctatccagcctctggacgatgaggacgtcttcctgtgcggtaaatgtaaaaagcaatttaacagtctgcctgcattcatgacccataagcgcgaacagtgccaaggcaacgctcccgccctggctaccgtctctctcgccacaaactctatctacccccctagcgctgcccctacagccgtgcagcaagccccgactcccgctaatcggcagataagcacctacattacagtgcccccgagccctttgattcagactttggttcagggcaatatccttgtgtcagacgatgttctgatgagcgctatgtcagctttcacgtcgctcgaccaacctatgccccaaggccctcctcccgtgcagtccagccttaacatgcactccgtgccttcttacttaactcagcccccaccgccacccccccctccacctcctttgcctccaccccctcctcctcagcccccaccaccacctcctcaaagccttggcccgcctggccgtcctaacccaggtgggaacggggtcgtggaggtgtattctgccgccgccccactggccggaagcggaaccgtcgagatccaagctctcggaatgcaaccttatccccccctcgaagtgcctaaccaatgtgttgaacctccagtctacccgaccccaaccgtttactcacctgggaagcaggggttcaaaccgaagggccctaatccagccgcacccatgacgagcgccacggggggcaccgtcgcaaccttcgactcacctgcgactttgaaaacacgccgtgcgaaggccgccggtaagcccaaagcgcaaaaattaaagtgttcttactgtgataagtctttcactaagaactttgacctacagcagcatattaggagccacactggagaaaaacctttccagtgtatcgcctgtggaagggctttcgcccagaaatcaaacgtcaagaagcacatgcagacacataaagtttggcctccaggtcactccggcggcactgtgtccaggaactctgtcactgtgcaggtgatggccctgaacccatcacgtcaggaagatgaggagagtacgggcttagggcagcccctccctggcgctccacagccccaagccctctctacagcgggcgaggaagagggggacaaacccgagagtaaacaggtggttttgatcgacagctcatatctctgtcagttttgcccatccaaattctccacatacttccagctgaagagccacatgacccaacacaaaaatgagcaggtttataaatgtgtggtgaagagctgcgctcagacattccccaagttggacacttttctggaacacatcaagtcccaccaagaagagttgagctacagatgtcatttatgcggcaaagacttcccatctctctatgatctcggtgtacaccaatactctcacagtctgctccctcagcacagtcctaagaaggacaacgccgtctacaaatgcgttaagtgcgtgaacaaatactccactcctgaggccctggagcatcatctccagacggctacccataacttcccttgcccccactgtcaaaaggtgttcccctgtgaaagatatctccggagacatctgcctacacatggctcggggggaaggtttaagtgtcaggtctgcaaaaagttctttagacgagagcactatttaaagctgcacgcacatatacacagcggagagaaaccatataagtgcagcgtgtgcgaaagcgccttcaacaggaaggacaagctgaagcgccacatgctgatccacgagccctttaagaagtacaaatgccctttttcaacccacacaggatgtagcaaagaattcaacaggccagacaagctgaaagcccatatactcagtcatagcgggatgaagctgcacaagtgtgctctgtgtagcaagtctttcagccggagggcccacttggctgaacatcagcgggcacacaccggcaactacaagttccggtgtgcaggctgtgctaaaggatttagccgccacaaatacctgaaggaccatcgatgccgtcttggcccacagaaagataaggacctgcaaactcgccgccccccccagcggcgagctgcaccaagatcctgcggatccgggggaagaaaggtgctgacaccactgcctgatccgctgggcctggaagaactaaaggatactggggcaggccttgtccccgaggcggtccccggcaagcccccatttgctgagcctgatgccgtgcttagcattgttgtcggaggagccgtgggcgctgagaccgagcttgtcgtgcctggacacgccgaagggcttggcagcaacctggctctggcagaactgcaggctggcgcggagggaccttgcgcaatgcttgctgtccctgtttatatccaggctagcgagtag

SEQ ID NO: 21494 - DNA, 2565 bp, Artificial Sequence
  Description of Artificial Sequence: Synthetic coding sequence
atggcccaggccatcttcgaggccctggagggcatggacaaccagacggtcctcgcagtgcagagcttattggacggacagggagcagttcccgaccctacagggcagagcgtgaacgcgccccctgccatccaacctctcgatgatgaagacgtctttctgtgcggaaaatgcaaaaagcagttcaatagcttgcctgcttttatgacccacaagagggagcagtgccaaggaaatgcccccgccttggccaccgtctcacttgccactaacagcatttaccctcccagcgctgccccgacagccgtgcagcaggccccgacacccgctaatagacagatttccacgtacattaccgttcctccttccccactgattcagacattagtacaaggcaatattctggtttctgacgacgtgttgatgtcagcaatgtccgcattcacatccttagatcagcccatgccccaaggccccccccccgtgcagtcctccctgaatatgcacagcgtgccaagttatctgactcaaccccctccccctcccccacctcctcctcctctgccccctccccctcccccacaacctcctccacccccaccccaaagtctcggaccgccaggtcggccaaatcctggtggaaacggggtggtcgaggtgtattctgccgctgcgcccctcgctggcagtggcaccgtggagatccaggctctcggcatgcagccatatcctcctttagaggtgcccaaccagtgtgtggagccacccgtctatcctacaccaacagtgtactcccccgggaaacagggattcaagccaaaggggcctaacccagccgccccaatgacgtccgcaaccggtggcactgttgccacctttgactcacccgctacactgaaaacacggcgcgctaagggtgcaaggggtttgcctgaggcagcggggaaacccaaggctcagaagctgaaatgctcatactgcgataagagctttactaaaaatttcgatctgcagcaacacatcagatcacacaccggcgagaagccctttcagtgtattgcctgtggccgagctttcgcgcagaagtcaaacgtcaagaaacacatgcaaactcataaggtctggccacccggccacagcggtgggactgttagccggaatagtgttactgtgcaggtcatggcacttaaccctagtagacaagaagacgaggagtccactggattagggcaaccactgccaggggcaccacagcctcaggcattgagtaccgccggggaggaagagggggacaaaccagagtcaaaacaggttgttctaattgattcttcgtacctctgccagttctgcccctcaaaattttcgacctatttccaactgaagtctcatatgacccagcacaagaacgaacaggtttacaagtgtgttgtgaagtcctgtgcccagacgtttcctaaactagacacattcctggagcacatcaagtcacatcaagaggagcttagctaccggtgtcatctttgcggaaaagactttccaagcctgtacgacttaggggtccaccagtatagtcacagtctgttaccacaacattcaccaaaaaaagataatgctgtgtacaaatgcgttaagtgtgtaaacaagtattcgaccccagaggctctggagcatcacctgcaaacagccacccataatttcccgtgtccacattgccaaaaggtgttcccatgcgaaagatatctgcgtcgccacctcccaacccacggcagcggcgggaggtttaagtgtcaggtgtgcaagaagttttttcgacgggaacactatcttaagcttcatgcccatattcatagcggggagaaaccctataaatgtagcgtttgtgaatctgccttcaacaggaaggataagttaaagcgacatatgctgatccatgagcctttcaagaagtataagtgtccatttagcacccatacaggttgttctaaagagttcaatagaccagacaagttgaaagcccacattctgtcccactccggcatgaagctccacaaatgcgccctctgctcaaagtccttcagtcgcagggcacacttggcagaacaccagcgagcacacaccggaaattacaaattccggtgcgctggctgtgcgaagggtttcagccggcacaagtacctaaaggaccatcgctgccgtctcgggccacagaaggataaggacttacaaactaggcggcccccccagaggcgggcggcaccaagaagctgtgggagcgggggtagaaaggttctgactccactgcccgaccccctgggcttggaagaattgaaggatactggcgctggactggtgcccgaggccgtccctggcaaaccaccttttgcagaacccgacgcagttttgtctatcgtagttgggggggccgtcggcgcggagacagagctcgtggttcccggtcacgccgagggcctgggctctaacctggccttggccgagttgcaggcgggcgctgaaggcccgtgcgctatgctggccgtgccagtttacattcaggcttccgagtag

SEQ ID NO: 21495 - DNA, 1800 bp, Artificial Sequence
  Description of Artificial Sequence: Synthetic coding sequence
atgatgctgccctaccccagcgccctgggcgaccagtactgggaggagatattgttaccaaaaaacggggaaaacgtagaaacaatgaaaaagcttactcagaatcacaaagccaaaggactcccgtcgaacgatacagattgccctcagaaaaaggagggaaaagctcagatcgtggtcccagtgacctttagagacgtgactgtgatcttcacagaggcggaatggaaaagactatctcctgagcagcgcaacttgtacaaagaggtgatgctggagaattaccgcaacctattgtctctcgccgagcccaaaccagaaatatacacatgcagctcctgcttattggccttcagttgtcagcaattcctctcccagcacgtccttcagattttcctgggcttatgcgctgaaaatcactttcaccctggcaactcctctcccggccactggaaacaacagggccagcagtactcccacgtctcctgctggtttgagaacgctgagggacaggaacgcggcggcgggtcaaagccttggagtgcccgaaccgaggagcgcgagacctctcgcgcgttccctagtcccctccagcgccagagcgcatccccgaggaaaggcaatatggtggtggagacggagccctcatcagcccagcggccaaatcccgtgcagttagataagggactcaaagaattggagactctaagatttggagcaatcaattgcagagaatatgagcctgaccataatctggaaagcaactttattaccaatccaaggacactgctgggtaagaagccatatatatgctccgattgtgggagaagtttcaaagacaggtcaacgctcattcgccatcataggatccattccatggaaaaaccgtatgtttgcagcgaatgcgggcgaggtttctcacaaaagagtaacctgtccaggcaccagcgcacccactccgaggaaaaaccatacttgtgcagagaatgtggacagtcatttcgttctaaatcgatcctgaacagacaccagtggacccattctgaggaaaaaccttacgtttgttccgaatgtgggcgggggttcagcgagaaaagtagcttcatccgccaccagagaacacattccggcgagaagccatacgtgtgtctggagtgcggtcgaagcttctgcgacaaaagcactctgcgaaagcatcagaggattcatagcggggagaagccttatgtgtgcagagagtgtggcagagggttcagccagaactctgatctcataaaacaccaacgcacacacctggatgagaaaccttatgtgtgccgcgaatgcgggcgcggattctgcgataagagtacgttaattatacacgaaaggacacatagcggggaaaagccttacgtctgtggcgagtgtggtcgcgggttttctcggaaatccttgctgcttgttcatcagcgaactcattccggcgagaagcactacgtgtgcagggagtgtaggagaggattttcccaaaaaagtaaccttattcgtcaccagcggacacactccaacgagaagccatatatctgtagggaatgtggccgcggcttttgcgataagtcaactttgattgtccatgagaggacccactctggggagaagccatatgtgtgctccgagtgtgggagggggttttcacgcaaatccctgctcctggtgcaccagaggacacatagcggagagaaacactatgtgtgtagggaatgtggccgcggcttttcccacaaatctaacctgattagacaccagcgaacgcactag

SEQ ID NO: 21496 - DNA, 357 bp, Artificial Sequence
  Description of Artificial Sequence: Synthetic coding sequence
atgatgctgccctaccccagcgccctgggcgaccagtactgggaggaaatactcctgcctaagaacggtgaaaacgtggagaccatgaaaaagttaacacaaaatcacaaggctaagggcctaccttcaaacgataccgattgcccacaaaaaaaagagggtaaagcacaaatagtcgttccagtcacctttcgggatgttaccgttatcttcaccgaggccgaatggaaacgtctgtcacccgagcagagaaatctctataaagaagtcatgttggagaactatcgcaacctgctcagccttggccaggaaatcgagacaatcctggctaacattgttaagtcccatctgtactag

SEQ ID NO: 21497 - DNA, 306 bp, Artificial Sequence
  Description of Artificial Sequence: Synthetic coding sequence
atgatgctgccctaccccagcgccctgggcgaccagtactgggaggaaatcctccttccaaaaaatggagagaacgtggagaccatgaaaaagctgacacaaaaccacaaagccaagggcctgcccagcaacgataccgactgcccccagaaaaaagagggaaaagcccagattgttgttccggtgaccttcagggacgtcaccgtgatatttacagaggccgaatggaagagactttcacctgaacagcgtaacttgtacaaagaggtgatgttggaaaattataggaacctgctttcgctgtag

SEQ ID NO: 21498 - DNA, 435 bp, Artificial Sequence
  Description of Artificial Sequence: Synthetic coding sequence
atgatgctgccctaccccagcgccctgggcgaccagtactgggaggaaatcctcctgcctaaaaacggagagaacgtcgaaaccatgaaaaaactgacacaaaaccacaaagccaaggggttgccctcaaatgacacagactgccctcagaaaaaagagggaaaagcacagattgtggtcccggtgaccttcagggatgtgacagtgatcttcaccgaagccgagtggaagcgcctgtctcctgaacagaggaatctgtataaagaggtcatgctggaaaattatagaaatcttctatccctggcggaacccaagcctgaaatctatacttgcagcagttgtctgctagccttttcatgccaacagtttctttcccagcatgtgctgcaaattttcctggggctctgtgccgagaatcatttccacccaggatag

SEQ ID NO: 21499 - DNA, 342 bp, Artificial Sequence
  Description of Artificial Sequence: Synthetic coding sequence
atggagaacctgaccaagcacagcatcgagtgcagcagcttccggggtgattgggagtgcaagaaccagttcgaacggaaacaaggttcccaggagggccacttctctgagatgatcttcactcccgaagatatgcctaccttcagcatacagcaccagcgtatacatacagatgaaaaactcctcgagtgcaaggagtgtgggaaggatttttcgtttgtaagtgtgctagtcagacatcagcgcattcatactggcgaaaaaccttatgagtgcaaggaatgcgggaaggcgttcggttcaggcgccaatctggcctaccaccagagaattcatacttag

SEQ ID NO: 21500 - DNA, 759 bp, Artificial Sequence
  Description of Artificial Sequence: Synthetic coding sequence
atggccttcagcagcggcagcgccctgacccggcaccagcggatccatacaggggagaaaccttacatttgcaacgaatgcggtaaagccttcagcttcggcagcgccctgacaaggcatcagaggatccacacgggcgagaaaccatatgtctgcaaggaatgcggcaaagcctttaacagcggaagcgatctgactcagcaccaacggatccacactggggaaaaaccctacgagtgcaaggagtgtgagaaggcatttaggagtgggagcaaactcatccagcatcagcgtatgcacaccggggagaagccttatgaatgtaaagaatgtggcaaaactttcagtagtgggtccgacttgacccagcaccatcggattcacacaggcgaaaagccttacgagtgtaaggagtgcggcaaggctttcggatctgggagcaaacttatccagcaccagctcatccacactggtgaacggccctacgagtgcaaagaatgcggcaaatctttttcgtccggcagcgccctcaaccggcatcagaggatccataccggagagaagccttacgagtgcaaagaatgcggcaaggctttctattctggcagtagtctgacccaacaccagcggatccacaccggtgagaagctctacgagtgcaagaattgtggaaaagcctacggtcgggattcagaatttcagcagcacaaaaagtcccataatgggaaaaaactctgcgagctcgaaactataaattag

SEQ ID NO: 21501 - DNA, 1467 bp, Artificial Sequence
  Description of Artificial Sequence: Synthetic coding sequence
atggagaacctgaccaagcacagcatcgagtgcagcagcttccggggcgattgggaatgcaagaatcaattcgagcgaaaacaaggttcccaggaaggccacttttctgaaatgatatttacccctgaagacatgcctacgttcagcatccagcatcagagaatacatactgatgaaaagcttctcgagtgcaaagaatgcggaaaggacttctccttcgtgagcgtgctggtgagacaccagcgcatccacacaggcgagaaaccatacgagtgtaaagaatgcggcaaagcgttcggctcaggggcaaacctcgcataccaccagaggatccatacgggcgagaagccattcgaatgcaaggagtgcggcaaagcattcgggtctggcagcaatttgactcatcaccagagaattcacaccggcgagaagccttatgaatgtaaggaatgcggtaaggcgttcagcttcggcagcgggttgattcggcaccaaataattcattctggagagaaaccgtatgagtgtaaagaatgcggcaagagcttttcatttgaatccgctctcattcggcaccacagaatacatactggtgagaaaccatatgaatgcatcgactgcggcaaggccttcggaagcggatccaatctgacacagcatcgtaggatccacactggcgagaaaccatacgaatgtaaggcctgcggcatggccttcagttccggcagcgccctgacacgacaccagaggatccataccggggaaaagccctacatttgcaatgaatgtgggaaggctttctcattcggtagcgcactgacccgacaccagcggatccatacgggcgagaaaccctatgtctgcaaggagtgtgggaaggctttcaattctggaagcgacctgacccagcatcagcgtattcataccggggaaaaaccttatgaatgtaaggagtgtgaaaaggcatttaggtctggttccaaacttatacagcatcagcggatgcacactggcgaaaagccatatgaatgtaaagagtgcggaaagactttcagcagcggatctgatctgacccagcaccataggatccacaccggggagaaaccatacgagtgcaaggaatgcggaaaagccttcgggagcgggtctaagcttatccagcaccagctaatccataccggggaacgcccctacgagtgtaaggagtgcgggaaaagtttctctagtggctcagccctcaaccgacaccaaagaattcataccggagagaagccgtatgaatgcaaagaatgcggtaaagcattttactctggttcctccctgactcagcaccagcggattcacaccggtgagaagctgtacgaatgtaagaactgcggtaaggcctacggtcgtgacagcgagtttcagcagcataagaagtcacacaatggcaagaaactttgtgagcttgaaacaattaattag

SEQ ID NO: 21502 - DNA, 1467 bp, Artificial Sequence
  Description of Artificial Sequence: Synthetic coding sequence
atggagaacctgaccaagcacagcatcgagtgcagcagcttccggggagactgggagtgtaaaaatcagtttgagaggaagcagggctcacaggagggacacttctcagaaatgatttttacccccgaagacatgcctacgttcagcatacagcatcaaagaatccacacagacgagaaactgctggagtgcaaggaatgtggcaaagatttttcttttgttagcgtgctggtccgacaccaacggatccacaccggggagaaaccttacgaatgtaaggagtgtggaaaggcattcggaagtggagcaaacctcgcctaccaccagagaatccacaccggcgaaaagccattcgaatgtaaggaatgcggaaaggcctttggtagcggctcaaatcttacccatcaccagcgaatccataccggagagaaaccctacgaatgcaaagagtgtggcaaagcattctcttttggttccggtttaatccgacaccaaataatacattctggcgaaaagccatacgaatgtaaagagtgtgggaaatcgttctcttttgagtcagctctcatcaggcatcatcggatccacactggcgaaaagccttacgagtgcatcgactgcggcaaagctttcggttccggatctaacttgacccagcatcgtaggattcacactggcgagaaaccctacgagtgcaaggcatgtggaatggcattctcttcagggagcgcccttacgcggcatcagagaatccatactggtgaaaagccctacatctgcaacgaatgtggaaaagccttctcctttggcagcgctctgactaggcaccagcgtatacacactggagaaaagccttatgtatgcaaagagtgcgggaaagcttttaatagcggttccgacctgacacaacatcagaggattcacaccggcgaaaagccttacgaatgcaaagaatgcgagaaagccttcagatcagggagcaaactgattcaacatcagaggatgcataccggcgagaagccctacgagtgtaaggagtgcgggaagacattctctagcggttccgatctgacacagcaccatcggattcacactggggagaagccctacgagtgtaaagagtgcggtaaggcgttcgggtcgggctccaagctgatccagcatcagttgatacacactggagaacgaccttacgagtgtaaagagtgcggtaagagcttctcaagcggctcagctctaaacagacaccaacgtatccacacgggggagaagccctacgaatgtaaggagtgcgggaaggcattttactccgggagtagtttaacacaacatcaaaggattcatactggcgagaaactttatgagtgcaagaactgcgggaaagcttatggacgggactctgagtttcaacagcacaagaagtcacataacggaaaaaaactgtgcgagctggaaaccatcaactag

SEQ ID NO: 21503 - DNA, 228 bp, Artificial Sequence
  Description of Artificial Sequence: Synthetic coding sequence
atggagaacctgaccaagcacagcatcgagtgcagcagcttccggggggactgggagtgcaagaatcagtttgagcgaaagcaaggtagtcaggagggacatttttccgaaatgattttcacaccagaagacatgccgacctttagcattcaacatcagcggatacataccgacgagaaactgttagagtgcaaggagtgtggaaaggacttttcattcgtctcctag

SEQ ID NO: 21504 - DNA, 1467 bp, Artificial Sequence
  Description of Artificial Sequence: Synthetic coding sequence
atggagaacctgaccaagcacagcatcgagtgcagcagcttccggggcgattgggagtgtaagaaccagttcgaaaggaagcagggatcacaggaggggcatttttccgaaatgatctttacgcctgaggacatgcccacctttagtatccaacatcagaggattcacactgacgaaaagttgctggaatgtaaggagtgcgggaaagatttcagcttcgtttccgtgctggtacgccatcagcgaatccatacgggagagaaaccctacgagtgtaaggaatgtggaaaggcctttggcagcggcgcgaatttggcttaccaccaaagaatccacactggagaaaagcccttcgaatgcaaagagtgcggcaaagcttttgggtccggctcaaaccttacgcatcaccagcgcattcacaccggtgagaaaccttacgaatgtaaagaatgcggcaaagccttttccttcggatcaggtctgatacgccatcagattatccattcgggggaaaaaccatatgagtgtaaagagtgcgggaaaagcttcagcttcgagagcgctcttatccgacaccacagaattcacaccggggaaaaaccctacgaatgcattgactgtggcaaggcatttgggtcgggctcaaatctaactcaacatcgacgcattcacaccggggagaaaccctatgagtgtaaggcctgcggcatggctttctcatccggatctgcgctgacaaggcatcagagaatccatactggggagaagccctacatatgcaatgagtgcggcaaagctttcagctttggttccgccctgactagacaccagcggatacatactggggagaaaccctacgtgtgcaaggaatgcggcaaggcattcaattccggtagtgatctcacgcagcaccagcggatccatacaggggagaaaccatatgagtgcaaggagtgcgaaaaagcatttcggtccggttctaaattgatacagcatcagcgaatgcacacaggggagaagccttacgaatgcaaagaatgcgggaagacattctcgtccgggtcagatctaacccagcatcacagaatccataccggtgagaagccctacgaatgtaaagaatgtgggaaagcctttggatcagggtctaagcttatccagcatcagttaatacacactggtgagcgcccatatgagtgcaaggagtgcggaaaatctttcagctccgggtcagccctgaaccgccatcagcggattcatactggtgagaaaccatatgagtgtaaggagtgtggaaaggctttctacagtggatccagcctgacacagcaccagagaatccatacgggtgaaaagctgtatgagtgcaagaattgtggaaaagcctacggaagggactctgaatttcagcagcacaagaaatcacataatggaaagaaactttgcgaactggagacaataaactag

SEQ ID NO: 21505 - DNA, 960 bp, Artificial Sequence
  Description of Artificial Sequence: Synthetic coding sequence
atggagtaccccgcccccgccaccgtgcaggccgccgacggcggcgcagcgggtccttacagctcctcagagttgctagaaggccaggagcccgacggcgtccggtttgacagggagagggctaggaggttgtgggaggccgtgtccggcgctcagccggtaggccgagaggaggcccagttctttccacactctagaactgtcattcctatcctggtcctctcagagacttacagtttgtgccaccccgttgaacacatgatccaaaaaaaccagtgtttgttcactaatacccagtgtaaagtttgttgcgcactactgatcagtgagagtcagaagttggcccactaccagtcgaagaaacacgcgaataaggtcaaacgatatctggccatccacggcatggaaaccctgaaaggcgaaactaagaaactggactccgatcagaagtcaagccgctcaaaggacaagaaccagtgctgtccaatctgtaatatgacattctcctccccagtggtggcgcaaagccattacctagggaagacgcacgcaaaaaacctgaaactcaaacagcagtccaccaaagtggaagctctgcatcagaatagagagatgattgacccagataaattttgtagcctgtgccacgcaacattcaacgatccagtgatggcccagcagcactacgtcgggaaaaaacaccggaaacaggaaacaaagctcaagctgatggcgcgatatggtcgcctggccgatcctgctgtgaccgacttccccgccgggaaaggttatccctgtaagacctgcaaaattgtgttgaactccatcgaacagtatcaggcccatgtatcaggctttaagcacaagaatcaatcacctaaaaccgtcgccagctctctaggtcaaattcccatgcagaggcagccaattcagaaggattctactacattggaggactag

SEQ ID NO: 21506 - DNA, 885 bp, Artificial Sequence
  Description of Artificial Sequence: Synthetic coding sequence
atggagtaccccgcccccgccaccgtgcaggccgccgacggcggcgctgcaggcccctattcttctagtgaactgctggaaggccaggagcccgacggagttcgattcgatcgggagagagctcggaggctatgggaggcagtaagcggggctcagccggtggggcgcgaagaagtggagcatatgatacagaagaaccaatgtctgttcaccaatacccagtgcaaggtgtgttgcgctttactcattagcgagtcgcaaaagctcgctcactatcaaagcaaaaagcatgccaacaaagtaaagcggtacctcgccatccacggaatggaaactctgaaaggagagaccaaaaaattggactcagatcagaagtcaagccgaagcaaggacaaaaaccaatgttgccctatctgtaatatgaccttctcctcccccgtggtcgcacagtcccattatctagggaagacccacgccaagaatctcaaacttaagcagcagtccaccaaagtcgaggctctgcaccagaacagagagatgatagaccctgacaaattctgctctctgtgccatgccaccttcaacgatcctgttatggcccagcagcattacgttgggaagaaacatcgaaaacaggagactaagctcaaactaatggccagatatggaagactggcagatccagccgtgaccgattttcctgctggaaaaggttatccttgcaagacctgcaaaatcgtgctaaattctatcgagcagtaccaggcacacgtgtccggttttaagcacaagaaccaatcccccaaaacggtcgcctcctcgctaggccagatcccaatgcagaggcaacccattcagaaggactcaactactcttgaagactag

SEQ ID NO: 21507 - DNA, 960 bp, Artificial Sequence
  Description of Artificial Sequence: Synthetic coding sequence
atggagtaccccgcccccgccaccgtgcaggccgccgacggcggcgccgcaggtccctattcctcttcagaactgctagagggacaggagcccgacggggtccggttcgacagagagcgcgcccgccgactgtgggaggcagtgtctggggcccagccggtgggcagagaggaggcccagttttttccacacagccgaactgtgatccccatcttggttttgagtgagacctacagcctgtgccatcccgttgagcatatgattcaaaagaatcagtgtctctttacaaatactcagtgtaaagtctgttgtgccctgctgatctctgagtcccagaagctcgctcactaccagtccaaaaaacatgctaataaggtcaaacgttacctagcaatccatgggatggaaacattaaagggagaaacaaagaaattggatagcgatcagaagtcttccaggagcaaggacaaaaaccaatgttgtccaatctgcaatatgactttttcatccccagtggttgcccaatcccactacctgggaaagacccacgctaaaaacctcaaactaaagcagcagtcaactaaggtggaagccctgcatcagaatcgggaaatgattgacccggacaaattttgcagcctgtgccacgccacgttcaatgatcccgtcatggctcaacaacactacgtgggaaagaagcaccgcaagcaagagaccaaactgaagctgatggcacggtacggccgtctcgctgatcccgctgtgactgactttccagctggcaaggggtacccttgtaaaacctgtaagatcgttctgaactcgattgaacaataccaggcacacgtctctggcttcaagcacaagaatcagtcgcctaagaccgtcgcatcctctctgggccaaatcccaatgcagcgccagcctattcagaaggactccacaaccctggaggactag

SEQ ID NO: 21508 - DNA, 789 bp, Artificial Sequence
  Description of Artificial Sequence: Synthetic coding sequence
atggagtaccccgcccccgccaccgtgcaggccgccgacggcggcgctgccggtccctatagttcctctgagctgctggaggggcaggagcccgacggagtcagattcgatcgcgaacgtgcccggcgcctgtgggaagcagtgtcaggcgctcagccagtcgggagagaagaggtggagcatatgatccaaaaaaatcagtgtctgtttaccaacacccaatgcaaagtctgttgcgctcttttaatctctgagtcccagaagctcgctcactaccagagtagtcgatcaaaagacaaaaatcagtgctgccctatttgcaacatgactttctccagtccggtcgtcgcccagtcccattacctgggcaagacacacgccaagaacctgaagctcaagcagcaaagcacaaaggttgaggctctacatcagaacagagagatgatcgatcccgataagttctgttccctgtgccatgctaccttcaacgacccagtcatggcgcagcagcactacgtgggcaagaagcaccggaaacaggagactaagcttaagctcatggcacggtacggacgcttggctgatcccgccgttactgatttcccagccggcaagggctatccgtgcaagacttgcaaaattgttcttaattccatcgagcagtatcaggcccacgttagtgggttcaagcataaaaaccaaagccccaagactgtggccagctcactgggtcagatcccgatgcagaggcagcccatacagaaagactccacaaccttagaagattag

SEQ ID NO: 21509 - DNA, 591 bp, Artificial Sequence
  Description of Artificial Sequence: Synthetic coding sequence
atggagtaccccgcccccgccaccgtgcaggccgccgacggcggcgcggccggcccatactcttcgagtgagctgttagagggccaggagcccgacggggtcaggttcgaccgcgagcgcgccagaagactgtgggaagccgtttccggcgcccagcccgtcgggagggaagaggccctatcaaaaagactgaccaatcctttcctagtggcttctaccctcgcacttcatcagaatcgagaaatgattgatcccgataagttctgcagcctgtgccatgcgaccttcaacgatcccgtgatggctcagcagcattacgtgggcaaaaagcaccggaagcaggagaccaagttgaagctcatggctcggtacggaaggctggctgaccctgcggtgacagactttcccgccggcaagggttacccctgtaagacgtgcaagatcgttctgaattcaatcgagcagtatcaggctcatgtgtccggtttcaagcataaaaatcagagtccaaaaaccgtggcaagtagtctcggccagatccccatgcaacgccagcctatccagaaagattcaaccacactggaagactag

SEQ ID NO: 21510 - DNA, 933 bp, Artificial Sequence
  Description of Artificial Sequence: Synthetic coding sequence
atggagtaccccgcccccgccaccgtgcaggccgccgacggcggcgccgctggcccctactcctccagcgagctcctggagggtcaagaaccagatggcgtgcgtttcgatagagaaagagctaggcgactttgggaagccgtttcgggggcgcagcccgtcggtcgggaggaggttgaacatatgatccagaagaatcagtgtctgtttactaatactcaatgcaaggtatgctgcgcactgctcatttcggaaagtcagaaactagctcactaccaaagtaagaagcacgcgaacaaggtgaagaggtatctggccatccatggaatggaaaccctgaagggggaaaccaaaaagctggactctgaccaaaaaagctctcgttccaaagataaaaaccaatgttgtcccatatgcaacatgacattttccagcccagtggtggcgcagtcacactatcttgggaaaacccacgccaagaacttgaagctcaaacagcagagtaccaaagttgaagctctgagcaaacgcctgacaaatcctttccttgttgcgagcactcttgctctccaccagaatagggaaatgatcgaccctgacaaattttgttcactttgtcatgccacttttaacgacccagtgatggctcagcagcactatgttggcaaaaaacatcgcaagcaagaaactaaattgaagttgatggcccgatacggcagacttgcagacccagcggtaactgattttccagctggcaaaggttatccctgcaagacttgcaagattgtgctgaattcaattgagcagtaccaggcccatgtatccgggtttaagcataaaaaccagtcccctaaaacagttgcctcctctctcggccaaatacccatgcagcgtcagcccatccagaaagactctactaccctagaggactag

SEQ ID NO: 21511 - DNA, 357 bp, Artificial Sequence
  Description of Artificial Sequence: Synthetic coding sequence
atggagtaccccgcccccgccaccgtgcaggccgccgacggcggcgctgcagggccgtattcttccagcgagttgctggagggtcaagagcctgatggggtcagatttgacagggagagggctagaagattatgggaggccgtctctggggcacagcccgtggggagggaggaagcaggcaaaggctacccttgcaaaacctgcaaaatagtactgaacagcatcgaacagtaccaagcgcatgtgtcagggtttaagcataaaaaccaaagtccgaagactgtggcatcttccctggggcaaataccaatgcaacgacagccgattcagaaggattctaccacactcgaggactag

SEQ ID NO: 21512 - DNA, 2520 bp, Artificial Sequence
  Description of Artificial Sequence: Synthetic coding sequence
atggccctgacccagggccaggtgaccttccgggacgtggccatcgagttcagccaggaggagtggacgtgcctggacccagctcaaaggaccctctaccgggacgttatgctggagaactatagaaatttggcctctctaggcattagttgcttcgatctgtccattattagtatgttagaacagggcaaggaaccgtttactctggaatcccaggtgcaaatcgctggcaatcctgacggctgggaatggataaaagccgtaataacagctctgtccagtgagttcgttatgaaggaccttctgcataagggtaagagcaacacaggcgaggttttccagaccgtgatgctcgagaggcaagaatcccaggatatcgagggatgcagctttcgggaagtgcaaaagaatactcacgggttggaataccagtgccgggacgctgaaggtaattataaaggcgtgttattgacacaagagggaaatttgacccacggaagagacgaacacgacaagcgcgacgctcgtaacaagctgatcaagaatcagctcgggctgagtctgcaatcccacttgcccgaattgcagctgttccagtatgaggggaaaatctacgaatgcaaccaggtggagaagagctttaacaacaattcgagtgtatctccaccacaacagatgccctataatgtcaagacacacatttccaaaaagtacttgaaagattttatctcctccctgctgctaactcagggccagaaggccaacaattgggggagtccatacaagtcaaatggctgtggcatggtgttcccgcaaaatagtcacctggcgagtcatcagcggtctcacaccaaagaaaagccctataagtgctatgaatgtgggaaggccttcagaactcggagtaatctcaccacccaccaggtcatacatactggagagaagaggtacaaatgtaacgaatgcggtaaggtgttctcacgtaacagccagctgtctcagcatcagaagatccatactggagaaaagccatacaaatgcaacgaatgcggtaaggtattcactcagaattcgcacctcgttaggcaccggggtatccataccggcgagaaaccatacaagtgtaatgagtgtggcaaagcctttcgcgctagaagctctctggctatccaccaggcgactcatagtggcgagaaaccttataaatgcaatgaatgcggtaaagtgtttactcaaaactcccacctgacaaatcactggcgtattcataccggggagaaaccttataaatgcaacgagtgtggaaaggcatttggcgtgcgctcctccctagcaatccaccttgtgatacacacaggcgagaaaccatataagtgccatgaatgcggaaaagtgttcaggagaaacagtcatctggcccgccaccagctgatccacacaggcgagaagccatataaatgtaatgagtgcggcaaggccttccgcgcgcatagtaatctgaccacacatcaagtgatccacaccggtgagaaaccatacaaatgcaatgagtgtggaaaagtcttcacacaaaacagccacttagcaaatcatcagaggatccacacgggcgttaaaccttatatgtgcaacgaatgcgggaaagccttcagcgtgtactcgagtctgactacccaccaggttattcacaccggggaaaaaccctacaagtgcaacgagtgtggcaaggtattcacacagaattcccatctggctagacatagggggattcatacaggggaaaaaccgtataagtgtaatgagtgcggtaaagtattccggcataactcttatcttagtcggcaccagcgtatccacactggagagaagccctacaagtacaacgagtatggaaaggccttctctgagcattcaaacttaactactcatcaagtcatccacacaggcgagaagccgtataagtgtaacgagtgcggcaaagtattcacgcagaattcccatctggctcggcaccgaagggtgcataccggcggtaagccctaccagtgcaacgagtgcggcaaggctttcagccagaccagcaaactcgctagacatcagcgggtccatacaggggaaaaaccctacgaatgcaaccagtgcggtaaggccttcagcgttcggagctcactgactactcatcaggccatccacacaggcaagaaaccatacaagtgcaacgagtgtgggaaggtattcactcagaacagccatttggcacgccaccggggcatccacaccggggaaaagccttacaagtgtaatgaatgcggcaaagccttctcccagaccagcaaactagctcgacatcagcgaattcataccggcgaaaagccatacgaatgtggtaagccgttctcaatatgtagttctctgacaacgcaccaaactattcacacgggcggaaagccttacaaatgcaacgtctggaaggtcttgaagtccgagtttaaaccatgtaagccctcccagaattcctag

SEQ ID NO: 21513 - DNA, 282 bp, Artificial Sequence
  Description of Artificial Sequence: Synthetic coding sequence
agccggaacagccagctgagccagcaccagaagatccacaccggcgaaaagccttacaaatgtaacgaatgtgggaaggtctttacgcagaactcacacctcgtgaggcatagggggatccatacaggtgagaaaccctacaagtgtaacgagtgtggtaaacctttttccatctgctcgtctctgacaactcaccagacaatacacaccggaggaaagccttacaagtgtaatgtctggaaagtgctgaagtctgagtttaagccatgtaagcctagttag

SEQ ID NO: 21514 - DNA, 2523 bp, Artificial Sequence
  Description of Artificial Sequence: Synthetic coding sequence
atggccctgacccagggccaggtgaccttccgggacgtggccatcgagtttagccaggaggaatggacttgcctcgatcccgctcagcggaccctgtatcgagacgtgatgctcgaaaactatcgcaatctcgcttccctggccgggatttcctgttttgacctgagcattattagcatgctcgagcagggaaaagaacctttcacgttggagtctcaggtccaaatcgctgggaacccggacggctgggaatggataaaagccgtgatcaccgccctgagttccgaatttgtgatgaaggatcttttgcacaaagggaaaagtaacaccggagaggtatttcaaaccgttatgctggagcgacaagagtcacaggacatcgagggatgttcttttagagaagttcaaaaaaatacccatggactggagtatcagtgtcgcgacgctgaagggaactacaaaggggttctcttgacccaggaagggaatttgacccacgggagagacgagcatgacaagcgtgatgccaggaataagctaatcaagaatcagctgggcttaagtctccagtcccacttgccagaactccaactcttccagtatgaggggaagatttatgagtgcaatcaagtcgaaaaatcctttaataacaacagttcagtatctccaccgcaacagatgccgtataacgttaaaacccatatcagcaaaaaatacttgaaggacttcattagcagcctgctgctgacacagggacagaaggccaataactggggatccccatacaagagtaatggatgtggcatggtatttccgcaaaactcccacctggccagtcaccagcggagccataccaaggagaaaccatacaagtgttatgaatgtggaaaggcttttcgcacacgatcaaacctcaccactcatcaagttatccacactggggagaaaaggtataagtgcaacgagtgcggcaaggtcttttccagaaattcacagctcagccagcaccaaaagatacatactggagaaaagccgtacaagtgtaatgaatgcggcaaggtatttacccagaactcacacctcgtgagacataggggcatccatactggagaaaaaccatacaagtgcaatgaatgcggtaaggcatttcgggctaggagcagcctggcgatccatcaggccactcattctggtgagaagccctataagtgcaacgagtgcggcaaggtgtttacccaaaactcacatttaactaaccactggagaatccacaccggcgagaaaccctacaagtgcaatgagtgtggcaaggcattcggcgttagaagttctctcgctatccacctggtaattcacactggggaaaaaccctataagtgccacgaatgtggcaaggtctttcgccgcaacagccacctggcacggcaccagttaattcatacaggagaaaaaccatacaagtgcaatgaatgtggcaaggcgttccgcgcccacagcaacctgaccacacaccaggtgattcacacaggtgagaaaccatataagtgtaatgagtgtggaaaggtttttacccagaactcgcacctcgctaaccaccagcgaattcataccggggtcaagccctacatgtgcaacgaatgtggtaaagcgttttccgtttactctagtctgaccacgcaccaggttattcataccggcgaaaagccatataaatgcaacgaatgtggtaaggtcttcactcagaattcccacctggcccggcacagaggaatacacaccggagagaaaccctacaaatgcaatgagtgcggcaaggtgtttaggcataactcctatctgtcacggcatcagcggattcacacaggcgagaagccgtacaaatacaacgaatatggaaaagccttctcagagcacagcaacctgacaacgcaccaggtgattcacaccggcgaaaagccttacaagtgtaatgaatgcgggaaggtgtttacgcagaactcccacctagcaaggcaccggagagttcacacaggtgggaagccatatcaatgcaacgagtgtggaaaggcctttagtcagaccagcaagcttgcccgccaccaaagggtccacacaggtgaaaagccttacgaatgtaatcagtgtggaaaagcattttccgtgaggtcctcactgaccacacaccaggcgatccacacaggcaaaaaaccttacaagtgtaatgaatgcgggaaagtcttcacacaaaactcacatttggccagacatcgagggattcataccggcgaaaaaccttacaagtgtaatgagtgcggtaaggcatttagtcagacatctaaactcgcccggcaccaaaggatccacactggtgagaagccctatgaatgtgggaagcccttctccatatgcagctcactgacgactcatcagactatacacactgggggcaaaccctacaaatgtaatgtgtggaaggttctgaagtctgaattcaagccttgcaagccatctcagaacagctag

SEQ ID NO: 21515 - DNA, 1599 bp, Artificial Sequence
  Description of Artificial Sequence: Synthetic coding sequence
atgatccaggcccaggagagcatcaccctggaggacgtggccgtggatttcacttgggaagaatggcagctgcttggcgccgcccaaaaggacttgtacagggatgtgatgctggaaaattattccaacctcgtggcagtgggctaccaggctagtaagccagacgccctgtttaaactggagcaaggagagcagctgtggacaatcgaggacggcatccactctggggcgtgctctgacatatggaaggtggaccatgtgctggagagactgcagtcagaatctctggttaataggagaaaaccctgccacgagcatgatgcctttgagaatatagttcactgcagcaagtctcagttccttctcgggcagaaccacgatatctttgacctacgtggtaaatccctgaagtctaaccttaccttggtgaaccagtccaagggatacgagattaaaaactctgtcgagttcactggaaacggcgattcctttctgcatgccaaccacgagcgcctgcatactgcaattaaattcccggcatcccagaaactgatatcgaccaaaagtcagtttatctcaccaaagcaccagaagaccagaaagctggaaaagcaccacgtctgttctgagtgtggcaaggctttcattaaaaagtcctggctgactgaccatcaagtcatgcacaccggcgagaaaccccatagatgttccctctgtgaaaaagccttcagcagaaaatttatgctcacggagcatcaaaggactcacaccggcgagaagccatacgagtgccccgagtgtggcaaagccttcctgaagaagtcacgcctgaacatccaccagaaaactcacaccggcgagaaaccctacatctgttccgaatgcggaaaagggtttattcagaaggggaatctgatcgtccaccagcgcattcacacaggagaaaaaccctacatttgtaacgagtgtggaaaagggtttatccagaagacctgccttattgcccaccagcggttccatactggaaaaacgccattcgtctgtagcgagtgcgggaagtcatgcagtcagaagtccggcttaataaagcatcaacgaatccacacaggcgaaaaaccattcgagtgcagtgagtgcgggaaagcattttcaactaaacaaaagttgattgtgcaccaacgcacccataccggagagcggccttacggatgcaatgaatgcggcaaggcatttgcttatatgtcttgtctggtcaagcacaaaagaattcatacccgggagaagcaggaggccgcgaaagtggagaaccccccagctgagcgccattcttccctgcatacaagcgacgtcatgcaagaaaagaatagtgccaacggcgcaaccacacaggtgcccagcgtggcaccacaaacgtccctgaacatttctggactattggccaataggaacgtggtgctggtgggtcagccagtagtgaggtgcgctgccagcggtgataacaggggcttcgcccaggatagaaatctggtaaatgcggtgaacgtcgtcgtgccaagtgtcataaattacgtcttgttctacgtgacggaaaacccttag

SEQ ID NO: 21516 - DNA, 1818 bp, Artificial Sequence
  Description of Artificial Sequence: Synthetic coding sequence
atggccgccggccagcgggaggcccggccccaggtgagcctgacctttgaggacgtggcagtgctgtttaccagagacgagtggcggaagctggcaccctcccagcggaacctatatcgagatgtgatgctggagaattataggaacctggtgagtttgggactgcccttcactaagcctaaagtcatctctctcctacaacagggtgaggacccatgggaggtagagaaggacggctcaggcgtctcttcactggggagtaaatcctcccacaaaactactaaaagcactcagacccaggacagcagcttccaaggtctcatcctgaaaagatcgaaccgcaatgtgccttgggacctgaagttggaaaagccttatatctatgaagggaggctcgaaaagaagcaggacaagaaaggttcatttcagatcgtgtccgccactcataagaagattcccacgatcgagcggagccataagaataccgaacttagccagaatttctcaccaaagagtgtgttgatcagacaacagatcctgcctagagagaagacaccgccaaagtgtgaaatacaggggaattcactcaaacagaactcccaactgctgaaccagccaaaaattacagccgataaaagatacaaatgttctctgtgtgaaaagacatttattaacacaagctccctgcgcaagcacgaaaagaaccatagcggagaaaagctgtttaaatgtaaggaatgtagcaaagccttctcgcaaagttcagcactgatccagcatcagatcacccacacaggggagaagccgtacatctgcaaggaatgtggaaaagcttttacccttagtacaagcctctataagcatctgcggacgcacactgtggagaaatcgtatagatgcaaagagtgtggcaagtctttctcgcgacggtctggcctgttcatccatcagaagatccacgcagaggagaatccttgcaaatacaaccccgggcgcaaagcctcgtcttgcagcacatcactgagtggctgccaacgtatccatagtcgaaagaagtcttatctctgcaacgagtgtggtaacacgtttaagtcctctagcagtctgagataccatcagcgcattcacacaggagagaagcctttcaagtgttccgaatgcggccgcgctttctctcaaagtgcttctctcattcaacatgagcggattcacacgggagagaagccgtaccggtgtaacgaatgtggaaagggttttacctccatcagtaggctgaacaggcacagaattattcacaccggtgaaaaattttacaactgcaacgagtgtgggaaggctctgtcttcacattcgactttgataattcatgaaaggattcataccggtgagaagccttgtaaatgcaaagtatgcggaaaggcctttagacagagctcagccttgatccaacatcagaggatgcacaccggggagcgcccatacaagtgtaatgaatgcggaaagactttcagatgtaactcgtctctcagtaatcaccagagaatacatactggcgagaagccctatagatgcgaggagtgcgggatttcttttggacagtcgtccgccttgatccagcacaggcgcatacataccggtgagaaacctttcaagtgtaatacttgtgggaaaaccttcaggcagtcctcttctcggatagcccatcagcgaattcatacaggcgaaaagccttatgaatgcaacacatgtggcaagctgtttaaccatcgatcctctcttactaaccattataagatccacatcgaagaggacccttag

SEQ ID NO: 21517 - DNA, 408 bp, Artificial Sequence
  Description of Artificial Sequence: Synthetic coding sequence
atggccgccggccagcgggaggcccggccccaggtgagcctgaccttcgaggacgtggcggttttgtttaccagggacgagtggcgcaaacttgctcctagccagagaaacttgtaccgcgacgtgatgctcgaaaactataggaatctggtctcactgggtctgcccttcaccaagcccaaagtaatcagtctgttacagcagggagaggatccctgggaggtggagaaagacggatctggcgtttcctctctgggttcaaagagttcacataaaactacgaaatcgactcagactcaggattctagttttcaggggttgattctgaagcgatccaaccggaacgtcccctgggatctaaagctcgaaaagccctatatctatgagggacgcctggagaaaaaatag

SEQ ID NO: 21518 - DNA, 1839 bp, Artificial Sequence
  Description of Artificial Sequence: Synthetic coding sequence
atggccgccggccagcgggaggcccggccccaggtgagcctgaccttcgaggacgtggctgttctgttcacctgggatgagtggcggaagctggcaccatctcaaagaaatctctacagggatgttatgctggagaattatcggaatctggtgtccctcggtcttagttttacaaaacccaaggtgattagcttgctccaacagggtgaagatccctgggaggtcgagaaggatagtagcggcgtaagcagcttggggtgtaaatcaactcctaagatgaccaagtccacgcagacccaggactcgttccaggagcagatccgaaagagactaaaacgggatgagccgtggaatttcatttcggaacgatcatgtatctatgaggagaaactcaagaaacagcaagacaagaatgaaaacctgcaaattatctccgttgcccacacgaagatcctcaccgtcgaccgctcgcacaagaatgtcgagttcgggcagaatttctatctcaagtctgtctttatcaagcaacagagatttgctaaagaaaaaaccccctccaagtgcgagattcagcgaaatagcttcaagcagaacagcaacttgctgaatcaaagcaaaatcaaaaccgccgaaaagaggtacaagtgtagtacctgcgaaaaggctttcatccataactcaagcctgcgcaagcatcaaaaaaatcacacaggagagaaactgttcaagtgtaaagaatgcttgaaggccttctcccaaagcagcgcccttatccagcatcaacgcacacatactggggagaaaccttacatttgcaaggaatgcgggaaggccttttcacactcagccagcctctgcaaacaccttagaacccatactgtagagaagtgttacagatgcaaggaatgtggcaagagtttctctaggcggagcgggctcttcattcaccagaaaatacacgcccaagagaatcctcacaaatacaatccaggccgcaaggccagttcctactcgacatccttgagtgggtctcagaagatccatctgagaaagaagagttatctgtgtaatgaatgcggcaacacttttaagtctagcagctccctgagataccatcaacgcatccacactggagagaagccttttaagtgcagtgagtgtggcagagccttctcccagagtgcctcactcattcaacacgagcgtatacatacaggggaaaaaccatataggtgcaacgaatgtgggaagggttttacttccatctctcgcttaaaccgacatcgaattattcacaccggggagaagctctataactgtaatgaatgtggtaaggccttgagcagccactctacactcattatccatgagcggatacatacaggagaaaagccctgtaaatgcaaagtgtgcggcaaagcctttagacagagttcagctttaattcaacaccagaggatgcacaccggagagagaccctataagtgcaatgaatgcgacaaaacctttaggtgcaattcctcgctatcaaaccatcagcgaatacatacgggggaaaaaccataccgctgtctggaatgtggtatgtcttttggccagagtgccgccctgattcagcatcaacgcattcacacaggcgaaaaacctttcaagtgcaacacctgcgggaagacttttcgtcagtcaagttcactcattgcacatcagcgcatccacacaggtgagaagccatatgaatgcaacgcgtgcgggaagctattcagccaacgatcatctctgaccaatcactacaaaattcatatcgaagaggattccttaaaagctgatcttcacgtttag

SEQ ID NO: 21519 - DNA, 405 bp, Artificial Sequence
  Description of Artificial Sequence: Synthetic coding sequence
atggccgccggccagcgggaggcccggccccaggtgagcctgaccttcgaagacgttgctgtactgtttacctgggatgaatggcgaaaactggccccatctcagcggaacctgtaccgcgacgtgatgctggagaattatcggaatctcgtgagccttggcttgagcttcacaaaaccgaaagtgatctcccttttgcagcagggagaggatccttgggaggtggaaaaggacagtagcggcgtcagtagtttgggctgtaaatctacaccaaaaatgaccaaaagcacccagacacaggactcatttcaggagcagatccggaaaagactgaaacgggatgaaccatggaactttatctcagaacgctcctgtatctacgaagaaaaactgaaaaagcagtag

SEQ ID NO: 21520 - DNA, 1665 bp, Artificial Sequence
  Description of Artificial Sequence: Synthetic coding sequence
atggccgtggacctgctgagcgcccaggagcccgtgaccttccgggatgtggctgtcttcttttcccaggatgagtggttacacctcgacagcgcacagagagccctgtacagagaagtcatgctggagaattatagttccttagtgagcctagggattcccttctctatgcctaagttgattcatcaactccagcaaggagaagacccatgtatggtggaacgcgaggttcccagtgacaccaggttgggctttaaaacatggctcgaaactgaggcgctgccacatcgacaggacatttttattgaggagacgtcccaaggcatggttaagaaggaatccataaaagatggccattgggatatcaacttcgaagaggccgtggaattcgaatccgagatcgaagaagagcaggaaaagaagccgctgaggcagatgatcgactcgcatgagaagacaatttcagaggatggtaaccacacctcactggaactggggaagtccctgttcactaacaccgccctcgtgactcagcaatccgtgcctatcgaacggatacccaacatgtactacactttcggtaaagattttaagcagaatttcgatctgatgaagtgcttccaaatttaccctggaggaaagccacatatctgtaatgagtgcggaaaaagcttcaaacagaacctgcaccttatcgagcatcagaggatccacaccggcgaaaagccctacaaatgtaatgaatgtgaaaagacattttcccatcggtcttccctgctgtctcaccaaaggatacataccggtgaaaagccttacaagtgcaacgagtgtgaaaaagcattctccaatagcagtacactgattaagcatctgagagtgcatactggtgagaagccatatcgatgtcgcgaatgtggtaaagcgtttagtcagtgcagtacactcactgtgcatcagcgcatccatacaggcgagaagttgtataaatgcggagaatgcgagaaggctttcaattgccgggccaagctccatcgtcaccagagaattcacaccggcgagaagccttataagtgtagtgaatgtggtaaaggatattctcaatttacatcattggccgaacatcagaggttccataccggcgaacagctgtatacctgcctcgagtgtgggcgcacattcacgagaatcgtgactttgattgagcaccaaagaatccataccgggcaaaagccgtaccagtgcaacgaatgcgagaaagccttcaatcagtatagcagcttcaatgagcaccggaagattcataccggagaaaaactatacacctgcgaggagtgcgggaaggcatttggatgtaagagcaatctgtatcggcatcagagaatccacaccggagagaaaccttatcagtgcaaccagtgcggtaaggcattttcacagtatagttttctgaccgaacacgagagaatccatactggggagaagctctacaaatgtatggaatgcggaaaggcctattcatacaggtccaatctctgtcgccacaagaaggtgcatacaaaagaaaaattgtacaaatggaaagaatacgggaaacctttcatctgttctagctccctcacccaatatcagcgtttttttaagggcgacaaagcttatgaggtctag

SEQ ID NO: 21521 - DNA, 1707 bp, Artificial Sequence
  Description of Artificial Sequence: Synthetic coding sequence
atgcggcggagcgtgctggtgcggaaccccggccacaagggcctgcggcctgtgtatgaagaattggactcggatagtgaggatctggatcccaaccctgaagacctcgaccctgtgtctgaggacccagagcctgacccggaggatctcaacactgtacctgaagacgtggacccaagttatgaggatcttgaaccggtgtcagaagatttggatccagacgccgaggcacccggcagtgagccccaagaccccgatcctatgagttcaagtttcgacctcgaccccgacgtgataggtcccgtgccgttgatcctcgatccaaattcggacaccctttccccgggtgatcctaaagtggatcctatcagctccggcctgacagccacacctcaggtccttgccacgtcaccagctgtgttgcctgctccggcgtcccctcccaggcctttctcttgccccgactgcggcagagctttccgtaggtcctccggcttgagccagcaccggaggacacacagcggggagaagccctataggtgcccagattgcggcaagagcttctctcatggagccacactagcacagcaccggggcatccacacgggcgcccgcccataccaatgtgccgcatgtggcaaggcttttggatggaggagcaccctgctgaagcaccggagtagccatagtggtgagaaacctcatcattgccccgtttgtgggaaagctttcggccatggaagcctgctggcacagcaccttagaacacacggcggccctagaccccataagtgccccgtctgcgcaaagggattcgggcagggatcagctctactgaagcacttacggacacacactggcgagcgaccttacccgtgtcctcaatgtggtaaggcctttggacaatcaagtgccctactacagcaccagcggacgcacaccgccgagcgaccatatagatgtcctcattgcggaaaggccttcggtcaatctagtaacctgcagcaccatcttcggatccatactggtgaaaggccatatgcctgtcctcattgctccaaagctttcggacaaagttctgcactgctccagcaccttcatgtgcatagtggagagcggccctaccgttgccaactttgcggtaaagcctttggccaggccagtagcctgactaaacataaaagagtgcatgagggggccgcagccgcggccgccgccgctgcggctgccgctgccgctgctgccgccggattggggctgggtcctgggctgtcaccagctagtatgatgcgcccgggtcaggtgagcctgcttggacctgatgctgtctccgtgctgggaagcggcctgggcttatcacccggcacttctagtggcaggaatcccgaccccggatctgggccagggaccttgcccgatccttctagcaagccactgccaggctcccggagtacgccttcacccactccagttgaaagctcagatccaaaagcgggtcatgacgcagggccagatctcgttccctctcctgacctggatcccgtccctagccccgatcccgatccagtgcccagccctgacccaaatccggtgtcctgccctgacccatgcagccccacccgggggacagttagtcccgccctccctacaggcgagtctcccgagtgggtccaagagcagggcgctttactgggaccagatgggtag

SEQ ID NO: 21522 - DNA, 1707 bp, Artificial Sequence
  Description of Artificial Sequence: Synthetic coding sequence
atgcggcggagcgtgctggtgcggaaccccggccacaagggcctgcggcccgtttacgaagaattggactcggatagtgaggatctcgatccaaatccagaggacctggacccagtgtcagaggatcctgaacccgaccctgaggacttaaacacagttcccgaggacgtcgacccatcatacgaagatctagaacccgtgagcgaagacctggatccggatgctgaagcccctgggtcagaaccccaagatcccgaccccatgagttcctcctttgacttggatcctgatgtcatagggccagtccccttaatcctggatcccaatagcgacacactctccccaggcgatcctaaggtcgatcctatttcatcgggactcaccgccacaccacaagtgttggctacaagtcccgccgtacttccagcccctgcgagccccccacgaccatttagctgcccggactgtggacgcgcctttagacgaagttcaggcctgtcgcagcaccggaggacacactcaggggaaaaaccctaccgatgccctgactgtgggaaaagcttttcccatggtgccacactggcacaacatcgaggcatccatacaggcgccaggccatatcagtgcgccgcttgcggcaaggcattcggatggagatcaacccttctgaaacatcggtccagccattccggcgagaagccccaccactgtccggtatgcggtaaggcctttgggcatgggagcctgctagcccagcacctcagaacacacgggggtccgagacctcacaagtgcccggtgtgtgccaaaggctttggtcaggggtctgctctactcaagcatttgaggactcacaccggagagcggccctatccatgcccacagtgcgggaaggctttcggccagtcttcagcccttctccaacatcagcggacccatacagccgagaggccataccgctgcccccattgcggtaaagctttcggccagtcttccaatctgcagcaccatctacgtattcacaccggagagcgcccctacgcctgtcctcactgtagtaaggcgttcggccagtctagcgccctgctgcagcacctgcacgtgcacagtggggagcggccttaccgttgtcagctgtgcggcaaagcgttcgggcaagcatcaagcctcacaaaacataagcgcgttcatgaaggtgctgccgcagccgcagccgccgcagccgccgccgccgcggcagccgcggctggtctcggtctgggccctggactcagccccgcttcaatgatgcgccccgggcaggtgagccttctaggccctgacgctgtgtctgtactaggcagcggattgggcctcagccccggaacaagttccggcagaaaccctgacccggggtccggacctggcacattgcctgacccttcttccaagcctctgcccgggtctcggtcgacaccttctcccacaccggtggagagcagcgatcccaaggctggtcacgacgccggaccagacctggttccatcccctgacctagatcccgttcctagccccgacccagaccctgtgccttcccctgatcccaaccctgtgtcttgccctgatccttgttctcctacccgtggcaccgtctcccccgccctgcctacaggagagagcccggagtgggtacaggagcagggcgccctgttaggaccagatggatag

SEQ ID NO: 21523 - DNA, 1707 bp, Artificial Sequence
  Description of Artificial Sequence: Synthetic coding sequence
atgcggcggagcgtgctggtgcggaaccccggccacaagggcctgcggcctgtgtacgaagaactagattccgactcagaggacctggatccaaacccagaagacctggacccagtcagcgaagatcccgagcccgacccagaggaccttaataccgttcccgaggacgtggaccccagctatgaagatctggagccagtctccgaggacctggaccctgacgctgaggctcctggcagcgagccgcaggatccagacccgatgtcaagcagtttcgatctggatccagacgtgatcggccccgttcccctgattctggaccccaattccgacacgctgtctcccggagatccaaaagtggacccaatcagctctggactgacagccaccccccaggtgcttgcaacatctcccgctgtactccccgccccagcgtcacctcccagaccattcagctgccccgactgtggacgggcttttagaagaagctctggcctcagccagcatcgtcgcacacacagcggggaaaagccctaccggtgccccgattgtgggaagtccttttcccatggggcaactctggcccagcaccggggcatccataccggcgccaggccgtatcagtgtgcagcttgtggtaaagcgtttggatggcggtccaccctcttaaaacaccgcagcagccatagtggtgaaaagccccaccactgcccggtgtgcggcaaagcctttggccacggttcgctcctcgctcagcacctgcggacgcatgggggtcctagaccacataagtgccctgtatgtgcaaaaggcttcgggcagggaagtgctttgctgaaacatctgaggacacatactggcgagcgtccctatccttgtccccaatgcgggaaggcgttcgggcagagctccgctcttctgcagcaccaacggacacacacagcagaacggccttaccgctgcccccattgtggcaaagcgtttggccaatcttctaatctgcagcaccacctcaggattcatacgggagaacgcccttacgcctgtccacactgttcaaaggccttcggccagtcatccgccttgctgcaacatctgcatgtgcactccggcgagagaccatatcggtgccagctgtgtgggaaggccttcggacaggcctccagtttgaccaagcataagcgagtacacgaaggagcagccgccgcggccgctgccgcagctgccgcggctgctgctgctgcggccggtctaggattagggcccggactttcgcccgcatccatgatgcggccgggacaggtttctctcctcggaccggatgccgtgtcagttctgggcagcgggctgggattgtcccctgggactagcagcggacggaatcctgaccctggaagcggccctggcacactgccagatcccagttccaaaccattgccggggtctaggtctacccccagcccaactcctgtagagagttctgacccaaaagcgggacatgatgcagggccggatttggtgcctagtccagacctggaccctgttccatcccctgatccagatccagtgccatctcccgatcctaacccggtcagctgtcccgatccttgcagccctactagagggacggtgtctccagccctgcctaccggagagtcaccagagtgggtccaggagcagggagcactcctagggcccgacgggtag

SEQ ID NO: 21524 - DNA, 1263 bp, Artificial Sequence
  Description of Artificial Sequence: Synthetic coding sequence
atgagccggagcagccccagcggcaagggccacagccggatggccgagccccgcttcaataatccatacttttggccacctcccccgaccatgcctagccaactggataatttagtcctcatcaacaagatcaaggagcagctgatggctgaaaagatcaggccgccccatttgccgccaacaagtgcctccagccaacagcctctgttggtgcccccagctccagccgaaagcagtcaggccgttatgtcactcccgaaattgcagcaggtgccagggctacatccccaggccgtcccacagcctgatgttgcacttcacgctcgccccgctactagtaccgtgaccgggctgggcctgtctacacgcaccccgtccgtgtcaacttccgagagcagtgcaggggcaggaaccggaaccggcacatccaccccctcaaccccaaccaccacctctcagagtagacttattgcctccagcccgacacttatatctgggattacttcaccccccctgctggattccataaagactattcaggggcatgggcttctggggcctccgaaaagcgagcgtggtcgcaagaagattaaggccgagaatcctggcggacctcccgtgctggtggtaccttatccaatcctagcatccggggagactgcaaaggaaggcaaaacatatcgatgtaaggtttgtccgctgacatttttcactaagtctgagatgcaaattcatagcaagtcccacactgaagcaaagccacataagtgtcctcactgctctaagtccttcgcaaatgcttcatacctggctcagcatttacgcatccatttgggtgtgaagccctatcactgctcttactgcgacaagagctttcggcagctcagccatctccagcagcatacacgaatacataccggggaccgaccctacaagtgccctcacccgggctgcgagaaggcgttcacacagctctcgaatcttcagtcacaccagcgacaacacaataaagacaagccatacaagtgtccaaactgttaccgcgcctattcagatagtgcctctctgcagatccaccttagtgcccatgctataaagcatgcaaaagcctattgttgctccatgtgtggcagagcatacacttcagagacctaccttatgaaacatatgagcaagcacaccgtggtggaacatcttgtgagccaccattctcctcagaggacggagagcccaggcattcccgtgaggatctcactcatctag

SEQ ID NO: 21525 - DNA, 1263 bp, Artificial Sequence
  Description of Artificial Sequence: Synthetic coding sequence
atgagccggagcagccccagcggcaagggccacagccggatggccgagccccgattcaacaatccatacttctggccccctccacctacgatgcccagtcaattagacaatctggtgctgatcaacaaaattaaggagcagctgatggcagagaagatccggccgcctcatctgccccccacttcagcctccagccagcaacccctgctagtccccccagcccccgctgagtcaagccaagccgtcatgtccttacccaagttacaacaggttcctggactgcatccccaggctgtgccacagccagatgtcgctctgcacgcccggcccgccacatcaacggtgaccggtctgggtctgagtacgagaaccccaagtgtcagtacaagtgaaagtagcgctggtgcagggacagggacaggcaccagcaccccttctaccccaactactactagtcagagcagactgattgctagttcgccaaccttgatcagtggaataacctccccaccactgctggactcgatcaagacaatccagggccacggtcttttggggcctcccaagtccgaacgcggaaggaaaaagatcaaagcggagaatcccggtgggccacccgtgttagtcgtgccatatccaattctggctagcggggagaccgcgaaagagggaaaaacatatcggtgcaaggtttgtcccctgacattttttacaaaatcagagatgcagatccattctaaatcccatactgaggctaagccccataagtgtcctcattgcagcaagtctttcgctaatgcctcctacctggcgcagcatcttcggatccatctaggcgtcaaaccctaccactgctcctactgtgacaaatcttttcgccaactctcccatctgcagcagcacacccggatacataccggcgaccgcccatacaagtgcccccatcctggatgcgagaaggcgttcacgcagttgtctaatctgcagtcacaccagagacagcacaacaaagataagccctataaatgcccaaactgctatagggcttactctgactctgcaagcctccagattcacctgtcagctcatgcgatcaaacacgcaaaagcttactgctgctctatgtgcggcagagcttacacttccgagacttatctcatgaagcacatgtcaaagcacactgtagtggaacacctagtctctcatcactcccctcagcgtaccgagagccctggaatacctgtcaggatatctttaatttag

SEQ ID NO: 21526 - DNA, 2235 bp, Artificial Sequence
  Description of Artificial Sequence: Synthetic coding sequence
atgcagaaggagatgaagatgatcaaggacgaggacgtgcacttcgatcttgccgtcaagaagactcccagcttcccccattgcctacagcctgtggcaagtcgtggaaaagccccccagaggcatccattccccgaagcactgcggggcccgttttctcagtttcggtacgaaccacctccgggagatctcgatggctttcccggcgtatttgaaggcgctgggagcaggaagaggaaatctatgccgactaagatgccatataaccatccagcagaggaagtcaccctcgccttgcatagcgaagagaataagaatcatgggctccctaacctccccctgctctttccacagccgcccagaccgaaatatgattctcagatgatcgatttgtgtaatgtggggttccaattctataggagtttagagcacttcggcggaaagcctgtgaagcaggaaccgatcaagccgtccgcagtgtggccacaaccgacacctacaccattcttgcctaccccatatccatactatcctaaggtccaccctggattaatgttcccatttttcgtgccctctagcagcccctttccgtttagcaggcacacatttctgcccaagcagcctccggaacctttattgcctcgaaaggccgaaccccaggagtccgaggaaacaaaacagaaagtcgaacgggtggatgtgaatgttcagattgacgattcctactacgtggatgtgggtggatctcagaagcggtggcagtgccctacttgtgagaaaagctacacttcaaagtacaacctcgtcacccacatcctcggccacagtggaatcaaaccacacgcctgtacacactgtggtaagctcttcaagcagctctctcacctgcatacacatatgctgacacaccagggtacccgcccgcacaaatgtcaggtctgccacaaggctttcactcagacttcccacctaaagagacacatgatgcaacacagtgaggttaagccacacaactgtcgcgtctgtggacggggcttcgcctacccgtctgaattgaaagcacacgaggccaaacacgcctctgggcgagaaaatatctgtgttgaatgtggcctagatttccctacgctggctcagctgaagcgccatctaaccacccatagaggccccatccaatacaattgcagcgaatgcgacaagacattccagtatccaagccagctccagaaccacatgatgaagcataaggacatcaggccatacatctgcagcgaatgtggcatggagtttgtgcagccccatcatctgaagcaacattctctgacacacaagggcgtgaaagagcacaagtgtggaatttgtgggcgggagttcacccttctggctaacatgaagagacacgtgttgattcataccaacatacgggcttaccagtgtcacctatgctacaagagtttcgttcagaagcagaccctcaaggcccacatgatcgtacacagcgacgtgaaacccttcaaatgcaagctttgtggaaaggagtttaacaggatgcacaatttaatgggccacatgcacttacacagcgattccaaacccttcaagtgcctgtactgccctagcaaattcacgttgaagggcaatttgactagacacatgaaggttaaacatggcgttatggaaaggggactgcactcgcagggactgggccgggggaggatcgcactggctcagaccgccggcgtgttgaggtccctcgaacaagaggaaccctttgacctgtcccaaaaacgccgcgccaaagtccccgtgttccagtcagatggcgagtccgcacaagggagccactgccatgaggaggaagaggaggacaactgttacgaggtcgagccatacagccctggtttggctccacagagccagcagctgtgcacaccagaggacctctcgacaaagtccgaacatgctcctgaggtccttgaggaggcttgcaaagaggagaaggaagatgctagtaagggagaatgggagaagcgctctaaaggcgacctcggcgccgagggaggtcaggagagggactgtgccggaagagatgagtgcctgtcactcagggcgtttcagtcgacacgcagaggtccatctttctccgactatctttatttcaagcacagagacgagagcttaaaagaattgctcgaaagaaagatggagaaacaagccgtgctcttaggcatctag

SEQ ID NO: 21527 - DNA, 717 bp, Artificial Sequence
  Description of Artificial Sequence: Synthetic coding sequence
atgaagaacgtggccaacaccgtgaccatcagccacatcctgccccatataaaaattatccacacagaggaaaaacccgacaagtgtgaagagtgcaacaaagtgttcaattggtcctcaactcacactaaatacaaaaggatccatacagaagacaagttctataaatacgaggaatgcgacaagtccttcaagaatatctctaccctgattacgcataagatcatctatgtagtagagaagttttacaagtgtgaggaatgtgggaaggtgttctttttcttcctcaagtggagtttgacattgtcaccaaaactggagtgcaacggggccatatccgtccattgtaatctgagattattaggttcttcggacagcctggcgagcacatcccaggccgcaggtatcgccggggcctgtcaccacgcccagctgatttttgtgttcctcgtggagactggatttcatcatttcgatcaagccggatttgaattgctgacctcgtctgacccccctgcattggcttcacaatccgccccaaagtgctgggattacaagcacgaaccgctgtcccctgtggagtgcggcaaagtgttcaacaagctgtccaaccatactggggagaagttgtacaaacccaagcggcacgactcagctcttgagaatacactgaatttctcgaaacacaaaaggaaccactcagtcaagaaaccatag

SEQ ID NO: 21528 - DNA, 1686 bp, Artificial Sequence
  Description of Artificial Sequence: Synthetic coding sequence
atgatcaccagccagggcagcgtgagcttccgggacgtgaccgtgggcttcactcaggaggagtggcaacacctcgaccctgcccaacgtaccctgtatagggatgtgatgctagagaattactcacatttggtttctgtggggtattgtataccaaaacctgaagtgattctgaagctggagaaaggggaggagccgtggattctggaagagaaatttccctcccaaagccacctggaactcattaatactagccgcaattactccatcatgaagtttaatgagtttaataaaggggggaaatgtttttgcgatgaaaagcacgaaattatccactccgaagaggagcctagcgagtacaataaaaatggcaattcattctggctgaatgaggacttgatctggcatcaaaaaataaaaaattgggaacaatccttcgaatacaatgaatgcggcaaagcttttcctgagaatagtttatttctggttcacaagcgaggatataccggtcagaaaacatgtaaatacacggaacacggtaagacttgcgacatgagcttcttcatcacccatcaacagacgcacccacgagagaaccactacggaaacgagtgcggagagaacattttcgaggagtccatcctcttagagcatcagtccgtgtacccatttagccagaaactgaatctgactcctatccagaggacccattcaatcaataatataatcgagtataatgagtgtggtacattcttctcagagaagctagtgctccacctccagcaacggacacacactggcgagaagccatatgaatgccatgaatgtggcaaaacattcacccaaaaaagtgcccatactagacatcagagaacccacacgggaggcaagccatatgagtgccatgaatgcggcaaaacattttacaaaaatagcgacctgatcaagcaccagcggatccatacaggcgagaggccgtacggctgtcacgaatgcggaaaaagcttcagcgagaaatccaccctcacacaacaccagcggacccacacaggcgaaaagccatatgagtgccacgagtgcggaaaaactttctctttcaagtccgtgttaacagtgcatcagaaaacgcacacgggcgaaaaaccctatgaatgttacgcatgtggcaaggctttcctcaggaagagcgatttgattaaacatcaacggatacacaccggagaaaaaccgtacgaatgtaacgagtgcggtaagtctttctcggagaaatccactcttactaaacatctgcgcacacacacaggcgagaaaccatatgaatgcatccagtgcggaaagttcttttgctactattcgggctttaccgaacatctgaggcgacataccggagagaagcccttcgggtgcaatgagtgcgggaagacattccgccagaagtctgccctgatcgttcaccagcgcacacatataagacaaaaaccctatggctgcaatcagtgcgggaagagcttttgtgtaaagagcaagctgatcgctcaccaccgcactcacactggggaaaagccctacgaatgcaatgtttgcggcaagtcgttctatgtcaagagcaagttaaccgtgcaccagagaatccatctgggtaggaatcctatcaacgtagtgaacgaaggcaattattctggctag

SEQ ID NO: 21529 - DNA, 1686 bp, Artificial Sequence
  Description of Artificial Sequence: Synthetic coding sequence
atgatcaccagccagggcagcgtgagcttccgggacgtgaccgtgggatttacccaagaggaatggcagcacctcgatccggcccagagaacactctacagagacgttatgcttgaaaactatagccacttggtctccgtgggctactgcattcccaaaccggaggtaatcctgaaattggagaaaggtgaggagccttggatcctcgaagagaaatttccatctcagagccatcttgaactgatcaatacatctcgcaattattccattatgaagttcaacgagtttaacaagggaggaaagtgcttctgtgacgagaagcatgagatcattcactcagaggaagagcctagtgaatacaataaaaatggcaattctttctggctaaatgaggacctaatatggcatcagaaaataaagaattgggaacagagtttcgagtacaatgaatgtggtaaggcgtttcccgaaaatagtcttttcttggtccataagcgcgggtacaccggccagaaaacatgtaagtatacagagcacgggaagacatgtgatatgtctttcttcatcacacatcagcaaacccacccaagggaaaaccactatgggaacgaatgcggagaaaatatcttcgaggaatccatcctgttggaacatcagagtgtgtaccctttttcgcaaaaactgaatctgacaccaattcagaggacacatagcattaataacataattgagtataatgagtgcggcaccttctttagcgagaagctcgtgcttcatttacagcagaggacccacaccggagaaaagccctatgagtgtcacgagtgcgggaagacatttacccaaaaaagtgctcatacgagacaccagcgtacgcataccggcgggaaaccgtatgagtgccacgagtgtggaaagaccttctacaaaaacagcgacttgataaagcatcaacgtattcacacaggcgaacgcccctacggatgtcacgagtgcggaaaaagttttagtgaaaaaagcacgctgactcagcaccagagaactcacaccggtgagaagccttacgaatgtcacgagtgcggcaagacattctctttcaagagtgtgctcaccgtgcatcagaaaacacatacaggcgagaagccctacgagtgctacgcgtgcggtaaagcctttctccgaaagagcgacctaattaagcaccaaagaatccacaccggtgaaaagccgtacgagtgtaatgaatgtggtaaatccttctcggagaagagcacgctgactaagcaccttaggacacacaccggcgaaaagccgtacgaatgcatccaatgtggtaaatttttttgctattactcaggctttactgaacacctccgcagacacacaggcgaaaagccattcggttgcaatgaatgtgggaaaaccttccgccaaaaaagcgctcttattgtgcatcagaggacacacatcaggcagaaaccatatggctgtaatcaatgcggaaaatccttttgcgtgaaatctaaattaatcgctcatcaccggacccatacaggtgagaagccctacgagtgtaatgtgtgcgggaaatcattctatgtcaaaagtaaactgactgtgcaccaacgaattcatctgggacgaaatcctataaatgtcgtgaacgagggaaattacagcggatag

SEQ ID NO: 21530 - DNA, 1188 bp, Artificial Sequence
  Description of Artificial Sequence: Synthetic coding sequence
atgcggaacatcatgtacttcggcggcacctgccagagccccgccctccctgctctcgtgcggccaccagcacctcccctccaacccagcttggatatcaagccctttctgccttttccattggacaccgctgctgccgtcaatctattcccgaatttcaacgccatggacccaatccaaaaggcggtgatcaaccacacattcggggtgcctctgccgcacaggaggaaacaaattatatcgtgcaacatttgccagcttaggtttaattctgactcacaagcagccgcacactataaagggaccaagcatgcaaagaaactaaaggcactcgaagctatgaagaataagcaaaagtctgtgaccgctaaggacagtgccaaaacaacattcaccagtatcactaccaatactattaacacctcttcagacaagacagatgggacagccggcacccctgccatttccacgacaacaactgtggagatccgcaaatcctccgtgatgacaactgagatcacctcgaaagtggaaaaaagcccgactactgcgaccggaaattcatcctgtccttcaacggagaccgaagaggaaaaggcaaaacgccttttgtattgttcgttatgcaaggtcgccgtgaattccgccagccagctggaagcccacaactcaggaaccaagcacaaaaccatgctcgaagcgcggaacggaagtggcaccatcaaggcctttccccgagccggggtaaaggggaaaggccctgtgaataagggtaatactggcctccaaaataaaactttccattgcgagatctgcgatgtccacgttaattccgagacgcagttgaagcagcatatttccagtaggcgccacaaagaccgtgccgcgggcaaaccgccaaagcccaagtatagtccatataataagctgcagaagactgctcaccctctcggtgtgaaactggtgttctctaaggaaccttctaaaccccttgcgccccggatcctcccaaatcccctcgctgccgctgccgctgctgctgcagtcgccgtctctagtccatttagtctccggacggcgcctgcggcgacactttttcagacttccgccttgccaccagccctcctgaggcccgcccctggtccaatacgcactgcacacacaccagtgttgtttgccccttattag

SEQ ID NO: 21531 - DNA, 1077 bp, Artificial Sequence
  Description of Artificial Sequence: Synthetic coding sequence
atggagagcctgcggggcaacaccgcccagggccccaccaacgaggaagactataagaatgaaggccagctgtctaggcagacgaagtgccccgctcagaagaaaagttcattcgaaaacaccgttgtcagaaaagtgagcgtgactctgaaagaaattttcacaggggaggaaggccccgagagtagtgagttcagcctctctcccaatttggacgcccagcaaaagattcccaaggggcacgggagcccaatctcccgaaagaattcaaaggacaatagcgatctgatcaagcaccagcgtcttttctcacagagaaagccctgcaagtgcaacgagtgtgagaaggccttcagttaccagtccgacctgcttgtacacagtagaatccacggcggagagaagcccttcgagtgcaacaaatgtggaaagtccttcagtcggagtacccacctaatcgaacatcagaggacacacaccggagagaaaccttacgaatgtaacgagtgtgggaaggccttctcccgcagcacacacctgtctctgcaccagcggatccacactggagaaaaaccttatgagtgttctgagtgcgggaaggctttcagccgcagcaccaacctaagtcaacaccaaaggacacatacgcaagaaagaccatacaaatgcaatgagtgtgggaaagctttcggcgaccggagcacaattatacagcatcagcggatccatacaggcgagaatccttacgaatgttctaagtgtggcaaggcatttagttggattagtagcctgacagagcaccagagaacccatactggtgagaatccttacgaatgctccgagtgcggtaaggtcttttcccgctcctcctcattgactgaacaccagaggatacactcgggggagaaacctcatgaatgtcgggtctgcggcaagggctttagccggtccagttcccttatcattcaccaacggactcataccggagagaaaccttacaagtgcaacgattgcggcaaggctttctgccaaagttcgacgctgattcgccaccagcatctacataccaaagagtag

SEQ ID NO: 21532 - DNA, 402 bp, Artificial Sequence
  Description of Artificial Sequence: Synthetic coding sequence
atggagagcctgcggggcaacaccgcccagggccccaccaacgaggaggattataaaaacgaggggcaactaagccgtcagacaaagtgtcccgcccaaaagaagtcctctttcgaaaataccgtggtgcgcaaggtgtccgtgaccctgaaggagatattcaccggtgaagagggtcctgaatccagtgagttctctttgtcacccaatttagatgctcagcagaagattcctaaaggtcatggctcacctattagcagaaaaaacagcaaggataatagcgacctcattaagcaccagagactgttctctcagaggaagccctgtaagtgcaacgaatgtgagaaggctttttcatatcagtcagacttgctggtccatagcaggattcacggaggctag

SEQ ID NO: 21533 - DNA, 1686 bp, Artificial Sequence
  Description of Artificial Sequence: Synthetic coding sequence
atgaacagcagcctgaccgcccagcggcggggcagcgacgccgagctagggccatgggtcatggcagcaagatcaaaagatgccgccccttctcagcgagacggcctgctccccgtgaaggtcgaagaggatagcccagggtcttgggaacctaactacccagctgcctcccccgaccccgagacctctagactgcatttccgacaactgaggtatcaagaggtcgcagggcccgaagaggctttaagcagactccgcgaactgtgcaggagatggttaagaccggaactgttgagcaaagaacagatcttagaactgctggtactcgaacaattcctcactatcctaccggaagagctccaggcgtgggttagagagcattgcccagagtccggagaggaggctgtagccgttgttagagcactgcagagggccctggacggtacctcatctcagggaatggtgacattcgaagacacagccgtaagtctcacgtgggaggagtgggaaagactagaccctgcacgacgcgacttttgcagggagagcgcacaaaaagacagcggttcgactgttcccccaagcctcgagtccagggtggagaacaaagaattaatcccgatgcagcagatccttgaagaagcagagccccaaggccaattacaagaggcctttcaggggaagaggccacttttttcaaagtgtggctcgacacatgaagatagggtggagaagcagtcgggcgatccactgccactgaaattggaaaattctcccgaggctgaaggcctcaactccatctcagatgtaaataagaacggcagcattgagggggaagactcaaagaataatgagcttcaaaattctgctaggtgctcaaacctcgtgttgtgtcaacacatccctaaagctgagcgacctactgactccgaagaacacgggaacaagtgtaagcagagcttccatatggtgacctggcatgtgctaaagccccacaagtctgattctggagattccttccaccacagcagcttgtttgagacacaaaggcagcttcacgaagagcgaccatacaagtgcggcaattgtggcaaaagcttcaagcagagatcagacctgtttaggcaccagcgcatacacaccggcgaaaagccttacgggtgccaagaatgcggtaaatccttcagtcagtctgcagcccttaccaaacatcagagaacccacacaggagagaaaccctatacttgtctgaaatgtggcgagaggtttagacaaaactctcatctcaacaggcatcagtcgacacactcccgggacaagcatttcaagtgcgaggaatgcggtgagacatgccatatctcaaacctgtttcgtcatcagcggctgcataaaggggaaagaccatacaagtgcgaggaatgtgagaaaagctttaaacaaagatctgacctgttcaagcaccaccggattcatactggcgagaagccatacggatgctcagtgtgtgggaagagatttaatcagtccgcaaccctgatcaagcaccaaaggattcacaccggggagaagccatataagtgcctggagtgcggcgagcgcttccgtcagtcgacacatctgatccgccatcagcgaatccatcagaataaagtgttatcagccggcaggggcggatcgcgcctctag

SEQ ID NO: 21534 - DNA, 489 bp, Artificial Sequence
  Description of Artificial Sequence: Synthetic coding sequence
atgaacagcagcctgaccgcccagcggcggggcagcgacgccgagctgggaccttgggtcatggcagctcggtccaaagatgcagcgcccagccagagagatggcttacttcccgtgaaagtcgaagaggacagccccggctcatgggaacccaactacccagctgcttccccagaccctgagacaagtcggctccacttccgccagttgagatatcaagaagtggccggtccagaagaagcactgtctcggttacgcgaactctgcagacgatggttaagacctgagttgttaagcaaagaacagatcctcgaactgttggtgctcgagcaatttctgactatcctgccagaggagcttcaggcctgggtgagggagcattgtcctgagagtggcgaagaagctgtagctgtggtgagggcattacagagagccctggacgggaccagttcgcaggtctggaaagcagagtggcggactaaatcttag

SEQ ID NO: 21535 - DNA, 1416 bp, Artificial Sequence
  Description of Artificial Sequence: Synthetic coding sequence
atgaagggcaactacgagagcctgatcagcatggactacgccatcaatcaaccggatgtcctgagtcagatacagccggagggcgagcacaacaccgaagaccaggcagggccagaagagtctgaaattcctactgacccaagcgaagagccagggatctctacttctgacattctaagctggatcaagcaggaggaggaaccacaggtgggagcaccacctgagtctaaagaatcagacgtatataaatcaacgtatgcagatgaggaactcgtgataaaagctgagggtttggccagatcatccctctgcccagaagttcccgtgccgttcagtagccctccagccgctgccaaggatgcattcagcgatgttgcattcaaatcgcagcagagtacctcgatgacaccctttggaagacccgctaccgatcttcctgaagcttctgagggtcaggtgactttcacccagttaggtagttaccccctacccccccctgtcggggaacaggtattttcttgccaccattgtgggaaaaacctatcccaggacatgcttctcacacaccagtgctctcacgctacagagcaccccctgccctgtgcgcagtgtccaaagcactttacgccacaagcagatctgtcttccacttcccaggatcatgcatcagaaacaccgcccacatgccctcattgtgctcgcactttcacgcatccatcgcgactcacgtaccatttacgcgttcacaatagtaccgaacgaccattcccatgccccgattgtcctaagaggttcgctgaccaggccagactgaccagccaccggagggcccatgcctccgaacggccattccgctgtgcacagtgtggcaggagcttctcacttaagatatcactcttactccaccagagagggcacgcccaagagcgcccgttcagctgtcctcagtgcgggattgattttaatgggcactccgccctgataaggcatcagatgatccacacgggagagcgtccgtacccttgcacagactgcagtaagagctttatgaggaaggaacacttactgaaccataggcgcctccacacgggagaacgcccattttcctgtccccattgtggcaagtcctttatccggaagcaccacctcatgaaacatcaaagaattcacaccggagaacggccttacccatgctcttactgcggtcgctccttcaggtacaagcagacgctgaaagatcatctgcggtcaggacacaacggggggtgcggtggcgattccgatccctccggacagcctcccaacccgcccggcccacttataactggtttggaaacctcagggcttggcgtgaacactgaggggttagaaacgaaccagtggtatggcgaaggaagcggagggggcgttctgtag

SEQ ID NO: 21536 - DNA, 1416 bp, Artificial Sequence
  Description of Artificial Sequence: Synthetic coding sequence
atgaagggcaactacgagagcctgatcagcatggactacgccatcaatcaaccggatgtgctctctcagatccagccagagggcgagcataataccgaggatcaggcaggccccgaggagtctgaaatccctaccgacccctctgaggaaccagggataagcacatcggacatcctatcttggatcaagcaggaggaagagccccaggtgggcgccccaccagagtctaaggagagcgacgtgtacaagtctacatatgccgatgaggaattggtgatcaaagccgaggggctcgcacgtagcagcttatgtccggaggtgccggtgccttttagctccccgcctgctgctgcaaaggacgctttttcagatgtcgcattcaagtctcaacagagtacttccatgacgccttttggacggcctgctaccgatctgcctgaagcctccgagggacaggtcacattcacccaactcggctcctaccccctgcctcctccggtcggggaacaagtgttctcttgccaccattgcgggaagaatctgtctcaggacatgctgttgacgcaccaatgttctcatgctaccgagcaccccctcccatgcgctcagtgccccaagcactttaccccccaggcagatctgtcaagcacttcgcaggatcacgcctctgaaacgccccccacatgcccccattgcgcgcgaacgtttacacatccctcccgcctcacatatcatttgagagtgcataattcaactgaaaggcctttcccttgcccagactgtccgaaacgcttcgctgaccaagcaaggttgaccagtcacagacgggcccatgcgagcgaacgacctttccggtgcgcacagtgcggacgttctttttcactaaagatctctcttcttcttcaccagaggggccacgcgcaggagcggcccttcagctgcccacagtgtggaatagactttaacgggcatagcgctctgatccgtcatcaaatgatacacacaggcgagcggccgtacccctgcacagattgtagcaagagcttcatgagaaaagaacatttattaaatcataggcggctccacactggagaacgcccctttagctgtccacattgtggaaaaagcttcataaggaaacaccacttaatgaagcaccaacggatccacacaggcgagaggccatacccctgttcctactgtggacgtagtttcagatacaaacaaactcttaaagaccacttgcggtctggtcataacggtggatgcgggggcgacagtgacccctctgggcagccccctaatcctcccggtcctcttatcacaggcctggaaacgtctgggttaggcgtgaacaccgaggggctagagactaaccaatggtacggcgaaggcagtggggggggggtcctgtag

SEQ ID NO: 21537 - DNA, 1416 bp, Artificial Sequence
  Description of Artificial Sequence: Synthetic coding sequence
atgaagggcaactacgagagcctgatcagcatggactacgccatcaatcagcccgacgtgctctctcagatccagcccgaaggagagcacaacacagaggaccaggcgggacccgaggagtcagaaatccccactgatccctctgaagagccaggtatttctacgagtgacatcctgtcctggattaagcaggaggaggagcctcaggtcggggctccccctgagtccaaagaaagcgacgtgtataaaagcacatatgccgatgaggagcttgtgatcaaggctgaagggttagccagaagtagcctgtgtcccgaggtccctgtcccattctctagccctcctgcagcggcaaaggatgccttttcagatgtggcattcaaatcacagcagagcacctctatgacaccatttggtagacctgctaccgaccttccagaggcatctgagggtcaggttacctttactcagttaggttcctacccactccccccccccgttggtgagcaggtgttctcatgccaccactgtggcaagaatctgtcacaggacatgttgctgactcaccagtgcagccacgcaaccgaacatccgttaccctgtgcacagtgccctaaacacttcacacctcaagccgacttgtctagtacctctcaagaccatgctagtgaaaccccaccgacttgtccccactgcgctcgcaccttcactcacccttcccgattgacctatcatctgagagtgcacaattccaccgaaaggccattcccttgtccagactgtcctaaaagattcgccgaccaggctaggcttacatcccatcgtagggctcacgcgagcgagagaccatttcgatgtgcccagtgtggacggtcgttctccttgaagatttcacttttgttacatcagaggggacacgcgcaagagaggccattctcttgtccccagtgtggaatcgacttcaatggccacagcgctctgatacgccaccagatgattcatactggcgaacggccgtatccctgtaccgactgttcaaaatctttcatgcgcaaggaacacctgcttaaccaccgccgcctgcacacaggagagcgtcccttttcctgtcctcactgcggcaaatccttcattaggaaacatcatctcatgaaacaccaaagaattcatactggggagagaccctatccatgtagctactgcggtaggtctttcagatacaagcagactcttaaggatcacctgagaagcgggcacaatgggggctgcggtggtgattccgacccttccgggcagccgccaaatcccccgggacctctgatcacagggctggagacaagcggactcggcgtaaatacagagggtttagagaccaatcagtggtatggggaggggagtggtggcggtgtgctgtag

SEQ ID NO: 21538 - DNA, 1929 bp, Artificial Sequence
  Description of Artificial Sequence: Synthetic coding sequence
atggccgaggccgcccccgcccccaccagcgagtgggacagcgagtgcttgacttcgcttcagcccctacccttaccaacgccaccagccgcaaacgaggcccacctgcagacagccgcgatatcattatggaccgtagtggcggcagtccaagccatcgagagaaaagtggagatccactcgagaagactgctgcatcttgagggaaggaccgggacagccgagaaaaaactagcctcttgtgaaaagactgtgacggaactgggaaaccagttagaaggtaagtgggcggtgctgggcaccctcctccaagaatacggtcttctccagcggcgtctggaaaacctcgagaacctgctaaggaaccgtaacttttggatcttgcgtcttccccctgggatcaagggcgacatacccaaggtcccggtcgcctttgacgatgtttccatttactttagtacacctgagtgggaaaagcttgaggaatggcagaaagagctgtataagaacattatgaagggcaattatgaatccttgatttcgatggactacgcaatcaatcagcccgatgtcttgtcccagatccagcccgagggcgagcataacaccgaagaccaggcaggccccgaggaatccgagattccaaccgatcctagcgaagagcccggaatcagcacttcggacatactgtcctggatcaagcaggaagaagagcctcaagttggcgccccaccagagtctaaggaatcagatgtgtacaaatccacctatgctgatgaggaactagtgataaaagctgagggactcgccagatcaagtctgtgcccagaggtgccggtaccattctcatccccaccagcagctgctaaagacgctttctcagacgttgcattcaagtcccagcaaagcacgtccatgactcctttcggacgcccagcaacagacctccccgaagcctccgaggggcaggtgacatttactcagctcggctcttaccccctgcccccaccagttggtgaacaggttttctcatgccatcattgcgggaaaaatctgagccaggacatgctcctcacccatcaatgttctcatgccactgagcacccactgccttgtgctcagtgccctaagcacttcacaccccaggccgacctgtcttctactagccaagatcatgcttccgaaacccctcccacctgtccacactgcgcccgtaccttcacacacccatctaggctgacttatcatctgagggtgcacaactctaccgaacgacctttcccctgcccggactgtcctaagcgctttgctgaccaggcaagactgacttcccaccgccgcgcacatgcgagtgaacggccctttcgttgcgcccagtgcggtagatccttttctttaaagatctctttgcttctgcaccagcgtgggcatgctcaggagcgtccatttagctgtccccagtgtggaatcgatttcaacgggcatagcgcgctgattaggcaccagatgatccacacaggggagaggccctacccctgtacagattgctccaaatctttcatgagaaaggagcatcttctgaaccataggagactgcacactggtgaacggccattcagctgccctcactgtggtaagtcattcattaggaagcatcacctgatgaaacaccaaagaatacatacaggcgaaagaccttatccgtgcagttattgtggccggtcatttcggtacaagcagaccctgaaggaccatctgcgctccgggcacaatggaggatgcgggggcgattccgatcccagcggccagccgcccaacccccctggacctctgattacaggtctggaaacttcagggctgggggtcaacacagaggggctggaaaccaaccagtggtatggcgagggcagcggaggtggtgtgctgtag

SEQ ID NO: 21539 - DNA, 1416 bp, Artificial Sequence
  Description of Artificial Sequence: Synthetic coding sequence
atgaagggcaactacgagagcctgatcagcatggactacgccatcaaccagcctgacgtgctcagtcagattcagcctgagggcgagcacaacactgaagatcaggctggccccgaagagagtgaaatccccacagacccatccgaggagcctggcattagcacatcagacatcctctcatggattaagcaggaggaggagcctcaagtgggtgcacctccagaatcaaaggagagcgatgtgtataaaagtacctacgcggatgaggagctggtaataaaggcggaaggactggcccgatcgtcactgtgtcctgaggtccccgtaccgttttccagtccgcccgccgctgccaaagatgctttcagtgatgtggctttcaaaagccagcaatctacaagtatgacacctttcggccgacccgctactgatctgcccgaagcctccgaaggccaggtgacgtttacccagctgggtagctaccctctcccccccccggtaggggagcaggtgttctcctgccaccactgtggaaaaaacctttctcaggatatgctgttgactcaccagtgttcacatgccaccgagcatccccttccatgtgcccagtgcccaaaacactttacgccgcaggcagacctgtcctctacgtcgcaggaccatgccagcgaaaccccacccacatgtccgcactgcgcgcgcacatttacacatccgagccgattgacttatcaccttcgagtgcacaattctaccgagcgcccttttccctgccctgattgtcctaagaggtttgctgaccaggcacgcctcacatcgcatagacgggcccatgcgagcgagaggccttttcgctgcgctcagtgtggcagatccttcagccttaaaatctcactgcttctacaccagcgcggccacgctcaggaacggccattttcctgccctcaatgcgggattgattttaacggccactctgcattgattcggcaccagatgattcacaccggcgaacgaccgtacccgtgcacggactgctccaaatcattcatgcgcaaagaacatctgctgaatcatagaagattgcacaccggcgaaaggcctttctcttgtccacactgcgggaaaagttttatccgcaagcatcacctaatgaaacatcaaagaatccatactggggagcgaccatacccctgctcctattgtggacgctctttcaggtacaagcagacccttaaggaccatctgcgtagtgggcataacgggggatgtggaggggacagtgatccctctggccagcctccaaatccccccggccctcttattactggcctggaaacttcaggactcggggtgaatacagagggactagaaacaaaccagtggtacggtgaggggtcaggaggcggagttctgtag

SEQ ID NO: 21540 - DNA, 1416 bp, Artificial Sequence
  Description of Artificial Sequence: Synthetic coding sequence
atgaagggcaactacgagagcctgatcagcatggactacgccatcaaccagccggacgtcctgtcccaaatccagccggagggtgagcataatactgaagaccaagcaggcccagaggaaagtgaaatcccgactgatccgagcgaagagccaggaatctccacttccgatattctgagttggatcaagcaggaagaagaaccccaagtaggcgcaccccccgagagtaaggagagtgatgtatataagagtacgtatgcagacgaagagttggtcattaaagccgaggggttagccagaagctcactctgcccagaagtgcctgtgcctttcagctctcctcccgcagctgctaaagacgctttcagcgacgtcgcatttaaatctcagcagtccacatcaatgactccctttggccggcctgctactgatctccccgaggcctcggaaggccaggtgacattcacgcagttgggatcctaccccctgcccccgcctgtcggggagcaggtcttcagttgccaccactgtgggaagaatctgagccaagacatgctactcactcatcagtgcagtcacgcaactgagcacccgctgccttgtgctcagtgtcccaaacacttcacgccacaggctgatttgtcttctacatcccaggatcacgcctcggagacccccccaacctgcccacactgtgcacgcaccttcacacatccaagccgactgacatatcatctgagagtgcacaactctactgagcgacctttcccgtgtccagactgccccaaaaggttcgccgatcaggcaaggcttacctcccaccgaagggcacacgcctccgagaggccattcagatgcgctcaatgcggcagatctttctccttgaaaatctcactgttgttacaccaaaggggacatgcccaagaaaggcccttctcatgtcctcaatgtggcatagacttcaacggtcacagcgccctcatccgccatcagatgattcataccggagagcgcccttacccctgcactgattgctccaaatccttcatgaggaaagagcatctactcaaccaccggcggctgcatacgggggaaagaccgttcagctgtccccattgcggtaagagtttcatccggaagcaccatttaatgaagcaccagaggattcacactggagaaagaccctacccttgtagctactgcggacgatccttccgttataagcagacactcaaagatcacctgcgttcaggtcacaatggtggctgcgggggggactctgatccatctggccaaccacccaatccacctgggccattgattactgggctggaaaccagcgggttgggagttaacaccgaaggcctggaaaccaatcagtggtacggagaaggttctggcggaggggtcttatag

SEQ ID NO: 21541 - DNA, 1944 bp, Artificial Sequence
  Description of Artificial Sequence: Synthetic coding sequence
atgatcggcctgatccagggccggcggctggccgagcagaccagcgaatgggactcagagtgcctgacttctctgcagcctctccctcttcccacacctcccgcagccaatgaggctcacctgcagaccgcggctatctcgctctggaccgttgtggcagcagtccaggccatcgaacgcaaagtcgagatccatagtaggaggttgctccatctcgaggggcgcacaggaacggccgagaagaaactcgcctcttgtgaaaaaaccgtgacggaactaggcaaccagttggaagggaagtgggctgtccttggtacactgcttcaagaatacgggttgttgcagcggaggcttgagaatctggagaatctgctccgaaatcggaacttctggatcctacggctacctccaggaatcaagggcgacattccaaaggtccctgtagcgttcgatgacgtgtccatatatttttccacacctgagtgggagaaattggaggagtggcagaaggagttatataaaaatatcatgaagggcaactacgaatcattgataagcatggattatgcgattaatcagccggatgtgctctctcaaattcagccagagggtgaacataacacagaagatcaggccgggcctgaagaaagtgagatacccacagaccctagcgaggagccaggcatatctacctccgacattctgtcatggatcaaacaagaggaggaaccacaggttggcgctccaccagaaagtaaagagagcgacgtatataaaagtacttacgccgacgaagaactcgtgataaaagctgaaggacttgcccgatcctctctctgccccgaggttcccgtgcccttctccagcccaccagccgccgcgaaggatgccttttctgacgtcgctttcaaaagccagcagagtactagcatgacaccattcggaaggcctgctacagatctcccagaggcgtcagaaggccaggtgacatttacacagctgggaagctacccactcccacctcctgtcggggagcaggttttcagctgtcatcactgtggtaagaatttatctcaggatatgttactaactcaccagtgcagtcacgcaacagaacacccgttgccatgtgctcaatgtcctaaacattttacccctcaggctgacttatctagcacatcacaggaccatgcctccgaaactcctcctacgtgtcctcactgtgctagaacattcacacatccctccaggttgacttaccacctgcgtgtccacaactccacagagaggccattcccatgtccggactgccctaagcggttcgcggatcaagctcgattgacatcccatagacgggcacacgcttccgaaagaccctttaggtgcgctcagtgtggacgcagttttagccttaaaatttcattactgctgcatcagcgcgggcacgcccaggagaggcccttcagctgcccgcagtgtgggattgatttcaacggtcactccgctctcatccgccatcaaatgattcatactggagagagaccatacccatgtaccgattgctccaaaagctttatgagaaaagaacaccttctcaaccatcggcgactccacacaggggagcgaccattttcttgccctcattgtggcaaatcttttatcagaaagcatcatcttatgaaacaccagagaatacacactggcgaacgcccgtatccttgctcctactgcggccgttcatttaggtacaaacagaccctaaaggatcacctaagatccggccacaacggtgggtgtggaggggacagcgatccttccggtcagccccctaatcccccaggccctcttatcactggtctggagacatcgggcctaggcgttaatacggaaggactcgagaccaaccagtggtacggggaaggctctggaggcggtgtcctctag

SEQ ID NO: 21542 - DNA, 6747 bp, Artificial Sequence
  Description of Artificial Sequence: Synthetic coding sequence
atgatggacagcgagaacaagcccgagaacgacgaggacgagaagatcaacaaggaagcacaggacctgactaagttatccagccataacgaagatggtgggccagtttccgacgtcatcgcatcattccccgagaacagtatgggaaaaagaggcttttcagagagctccaattccgattctgttgtgataggggaagataggaacaagcacgcaagcaagagacggaaactggacgaagcggagccacttaagtctggtaagcagggtatttgtcgtctcgaaacctcggaatctagtgtgacggagggtggaatcgcgctggacgaaactggcaaagagacttttctgtcggattgcactgtcggtggcacctgcctcccgaacgccttgagcccatcatgtaacttttccactatcgatgttgtgtctctgaaaaccgacaccgagaaaaccagcgcgcaggagatggtcagcctggatttagagcgagagagcccctttcctcctaaggagatctctgtgagttgcaccatcggtaacgtggacaccgtcctgaaatgcagtatttgcgggcacctcttttcttcttgctctgatctcgagaaacatgctgagtcacacatgcagcagcccaaagagcacacatgctgccattgtagtcacaaagccgaatcgtcttccgcgctccacatgcatatcaaacaggctcatggcccgcagaaagtcttcagctgcgacctgtgtggcttccagtgcagcgaggaaaacttgctaaatgctcactacctgggcaaaactcatctccgcagacagaacctggccgctcgggggggatttgtgcaaatactgactaagcaaccattcccaaagaagagccgcactatggccactaagaatgtccactctaaacctcgcaccagcaagtcaatagccaaaaactccgatagtaagggcctgcgtaacgtggggagcactttcaaggacttccggggctctatcagcaaacagagtggtagctcatcagagctgctggtggagatgatgccctccagaaataccctcagtcaggaggtggagatcgttgaggaacatgttaccagcctcggactcgctcagaacccagaaaaccagtcaaggaaactggataccctcgtcaccagcgagggcctgctggagaaattagagtccaccaagaataccttgcaagcagcacacgggaactctgtgacatcgcggcccaggcctgagcggaacatactcgtgctgggaaacagttttagacgcaggtcctcaaccttcactctgaagggccaggcgaagaagcgttttaatctgctgggaatcaagcgtggaactagtgagactcagcggatgtatatgaagcatctgagaacccagatgaagacgcacgacgcagaatccgtgctgaagcacctggaggcttgctctagcgtgcagagagtttgcgtaaccacatccgagacgcaggaggccgaacaggggcaggggagcgcccgcccgccagattctggcctacactcacttacagtcaagccagccagcggttcacagacgttatgtgcttgcaccgactgcggacaagtggccaccaacaggacagacttggagattcatgtgaagaggtgccacgccagagaaatgaagttctattgtcgcacctgtgatttctcgtctatgagcaggcgagacctcgacgaacatctgcacagcaatcaacaccagcagacagcgtccgtactgtcctgccaatgttgctcatttatttctcttgacgaaatcaacctgcgggaccatatgaaagagaagcacaatatgcacttcctttgtaccccctgtaatctattctttttatctgagaaggatgtcgaggagcataaggctacagagaagcacattaattcactggtgcaacctaagaccttacaatcgagcaattcagacctcgttctccagacacttccactctcaaccctggaaagcgagaatgcaaaggagagcatggatgattcagggaaggcgtctcaggaagagccactgaagtcccgggtgtcacatggcaacgaggtgagacatagctcaaagcctcagtttcagtgtaagaagtgtttttataaaaccagaagcagcacggtgttaacgcgacacatcaaacttcggcacggacaagattaccattttttgtgcaaagcgtgtaatctctactccttaagcaaggagggtatggagaaacatataaagagaagcaaacacctggagaacgccaagaagaacaatatagggctgtccttcgaggagtgcatcgagcgggtttgcataggggccaatgataagaaggaggaattcgacgtatctggcaacgggagaatcgaggggcacattggtgttcagttacaggaacactcctacttagaaaaaggaatgttggcatcagaagagctgtcccagtcgggcgggtctaccaaagatgatgaactggctagtacaacaacgcctaaacgtggcagacccaaggggaatatttcacggacctgctctcattgtggccttttggctagcagtattaccaatttgacagtgcacatcagaaggaagcactcgcaccagtacagctacctgtgcaaggtctgcaaatactatactgtcacaaaaggtgacatggagagacattgtgcaaccaaaaaacataagggtagagtagagatcgaggcgtccgggaagcactctagcgatatcatagttgggcccgaggggggtagcctggaggccggtaaaaagaatgctgggagcgccgttacgatgagtgatgagcacgcgaataagccagccgaatcccctacatctgtgcttgagaagcctgaccgcggaaatagcattgaagcagaggtcgagaacgtgttccattctcttgacggcgaggtgaatagtcacctgctcgacaagaaggaacaaatcagctctgagcccgaagattttgcccagcctggcgacgtctacagccagcgtgacgtcaccggcaccggggagaacaagtgtctccactgcgagttttctgcccattcttctgcatccctggagctgcacgtaaagcgcaaacatacaaaggagtttgagttctattgcatggcttgcgattactacgccgtcacacgccgggagatgacccgtcacgcagcgacagagaaacacaagatgaagcggcagagttatctcaattccgcaaatgtcgaggcaggctccgccgatatgtcaaaaaacatcattatgcccgaggaagagcaccagcagaattctgaagaattccagatcatttctggccagccttccgataccctaaagagtcggaacgcagccgactgctctatcctcaacgaaaatacgaacctggacatgtcaaaagtcttgtgtgccgctgactctgtcgaggtcgagacagaagaagagtctaacttcaatgaagatcattcattttgcgagacctttcagcaggcacccgtgaaggataaagtccgtaaacccgaagagatgatgtcgcttacaatgtctagtaactacggatctccatcccggttccaaaacgaaaacagcggctcttctgccttaaactgtgagaccgccaagaagaaccacgaaataagtaatgacgctggcgagctaagggtgcattgtgagggcgagggaggcaacgcgggtgatggaggtggtgtcgtgccacacagacacttgtgtccagtgaccttggatggtgaacgaagtgccgagagccccgttttggtcgtaactagaattacccgggaacagggaaacctggagtcgggggggcagaaccgtgtggcacggggacatggattggaggacctaaagggagttcaggaggatcctgtgctcgggaataaggagatcctgatgaactcccagcacgaaaccgagtttatcttggaggaggatggccctgcctcagactctacagtggaaagttcagatgtgtacgaaactataatcagtatagacgacaaaggtcaggccatgtactcattcgggagatttgattcctctataatccggataaagaacccagaggacggcgagctgatcgatcagagtgaagagggactgatagcgactggcgtgaggatttctgagttgcctctcaaggattgcgcccagggagtcaagaaaaagaaaagcgaaggcagctccatcggggagtccacgaggatcaggtgcgacgactgtgggtttttagctgatggtctgtctgggctgaatgtgcatatcgctatgaaacacccaactaaggaaaagcactttcactgtctgttgtgcggtaagagcttctacaccgagtctaatctccatcagcatctagccagtgctggacatatgcgcaatgagcaggcatccgtggaggagctcccggagggtggcgccaccttcaagtgtgtgaaatgtactgagccctttgattccgaacagaatctgtttttgcacatcaagggccagcatgaagagctccttcgggaagtcaataagtacatcgttgaggatacggaacagatcaatagagagagggaagaaaaccaaggaaatgtctgtaaatattgtggaaagatgtgtagatccagcaatagcatggctttcctcgcacatattagaacgcacaccgggagcaaacccttcaagtgcaaaatttgtcattttgccacggcccagctgggggatgctcggaatcacgttaaacgccacttgggcatgagagaatataaatgccacgtgtgcggggtggcctttgtcatgaaaaaacacttgaatacccacttactcggcaaacacggagtgggaacccccaaggaacggaagttcacatgccatctttgtgaccgatccttcacagaaaaatgggcactcaacaaccacatgaagctccacacaggagagaagccctttaaatgcacgtggcccacttgtcattattcctttctcacggcctctgctatgaaagatcactaccgcacacatactggggagaagtccttcctgtgtgacctgtgcgggtttgccggaggaacgaggcacgcgctcaccaagcaccgaagacagcacactggcgagaaaccttttaagtgtgatgagtgcaacttcgccagtacgactcaaagccaccttaccaggcataagcgggttcacaccggagagaaaccctatcgttgcccctggtgcgattatcgatccaactgcgcagagaatataagaaaacacattctccacacaggcaagcatgagggcgttaaaatgtacaattgtcccaaatgcgattacggcaccaacgtccccgtggagtttcggaaccacctcaaggagcagcatccagacattgaaaatcctgatttggcttacctgcacgcaggcattgtttcaaaatcctacgagtgtcggctgaaaggccagggggcgacttttgtggaaacggatagcccattcaccgcagctgccctcgcagaggaacccctcgttaaggaaaagccactgcggtcttcacgcaggccagcccctcccccagagcaggttcagcaggtcataattttccagggttacgatggcgagtttgccctggatccctccgttgaggaaactgccgctgcaaccttgcagacactggcaatggccggccaggtggcccgagtggttcacatcacagaggacggacaagtaattgctacatcacagagcggcgcccatgtgggcagcgttgtgccaggccctatcctgcctgaacagcttgctgatggggccactcaggtggtggttgtgggaggcagcatggaagggcacggtatggatgaatccctgtcccccggcggtgctgtgattcagcaagtaactaagcaagagattcttaacctgagcgaggctggcgttgcccctcctgaagccagcagtgctttggatgcactactctgcgccgtaacggagctgggtgaggtcgagggtagagctgggctggaagagcaggggaggccaggagctaaggacgttctcattcaactacctggacaggaggtaagccacgtggccgcagacccggaggctcctgaaatccagatgtttccgcaggctcaggaaagccctgccgctgtggaggtcctcactcaggtggtccatccttccgccgccatggcttcacaggagcgagcccaagtggcttttaagaaaatggtacagggcgtgctccagtttgccgtttgcgataccgccgctgccgggcagctggtgaaggacggagtgactcaggtggtggtctcagaagaaggggctgtgcacatggtagccggggaaggggcccaaattatcatgcaggaggcccaaggagagcacatggacctcgtggagagcgatggggaaatttcccagatcatcgtcaccgaggaactcgtccaggcgatggttcaagaatcctcagggggcttcagtgagggcactactcattatatccttactgagctacccccaggagtgcaggacgagccaggcctgtactctcatacagtgctagaaacggcggatagtcaggaactgttacaggcgggggccactctggggaccgaagccggggctccaagtcgtgccgagcagctggccagcgtcgtcatttacacccaagaaggtagctcagccgctgccgccatccaatcacagagagagagcagcgagttgcaggaggcgtag

SEQ ID NO: 21543 - DNA, 4983 bp, Artificial Sequence
  Description of Artificial Sequence: Synthetic coding sequence
atgatggacagcgagaacaagcccgagaacgacgaggacgagaagataaacaaggaggcccaagaccttacgaaactctcgtcacataatgaagacggcggacccgtgtccgacgtaatcgctagcttccctgagaattctatgggtaagagaggtttttcggagagctcaaatagcgactccgtcgtcattggggaggataggaataagcacgcgtctaagcggcggaagttggatgaagcagaaccactaaaatctggcaaacagggaatctgccgactcgagacttctgagtcctctgtgaccgaagggggaatcgccttggacgagaccgggaaggagacatttctcagtgactgtaccgtgggtggtacctgcctcccgaatgccctttcacctagctgcaacttcagtaccatcgacgttgtgtctctgaagactgacaccgagaagacttccgcacaggagatggtcagcctcgacttagaacgcgaatcacccttcccgcccaaagagatttcagtgtcctgtaccattgggaacgtggataccgtgctcaaatgcagtatctgcggccacctgttttcctcttgctccgacctggagaagcatgcagaatctcatatgcaacagcctaaggaacatacttgttgccattgctcccataaggccgaaagcagctctgccctgcacatgcatattaagcaggcgcacggacctcagaaggtgttttcctgcgacctgtgtggtttccagtgctctgaggagaatctcctgaacgcccactatctggggaaaacccatctgaggcgacagaatttggcggccagaggaggctttgtgcagatcctcaccaaacagccctttccaaaaaagtctaggaccatggccactaagaacgtgcattcaaagccacgcacctcaaagtccattgccaagaatagtgattccaaaggtcttagaaatgttggtagtactttcaaagattttaggggcagcatttctaagcagtcaggaagctccagcgagctgctcgtggaaatgatgccctcacggaatacactgagccaagaagtggagattgttgaggagcacgtcacttctctgggtctggcccagaatccagagaatcaatccagaaagctggataccctggtcacctcagagggactgctcgagaaactggaatccactaagaatacattacaggctgctcatgggaacagcgttacttctagaccgagacctgagagaaacatcctggtcctgggtaacagttttcggcgcaggagctctaccttcaccctcaaggggcaggccaaaaagaggtttaaccttttaggcatcaagcgaggaacctctgagactcagcgtatgtatatgaaacatctcaggacacagatgaagactcacgatgctgagtccgttcttaagcaccttgaggcctgtagtagcgttcagcgcgtgtgtgtcactacaagcgaaacacaggaggccgagcagggccagggttccgcaaggccacctgacagcgggctgcactctctgactgtaaagccagcctccggaagccagacactgtgcgcctgtaccgattgtgggcaggtggcgacaaaccgcaccgacctagaaatccacgtcaaacggtgccatgcccgagaaatgaagttctactgtcgcacatgcgacttcagctccatgagcaggagggacctagacgaacatctgcactccaatcaacaccagcagactgcgtcagtgctgagctgccaatgctgcagttttattagccttgacgaaatcaacctgagagatcacatgaaggagaagcataacatgcattttctgtgcacaccatgcaacctgttcttcctctccgagaaggatgtcgaggaacataaggcaactgaaaaacacataaactccttggtgcagcctaagacccttcagtcttccaattccgacttagttttgcagacattacccctgtcgacactcgagagcgaaaacgccaaagagagcatggacgatagcggaaaagcttcccaggaagaaccactgaagtcgagggtctcccatggcaatgaggttagacacagttctaagccacaattccaatgcaagaagtgcttttacaagaccagatcatctaccgtgctgactaggcacatcaagttacggcacggtcaagattaccacttcttgtgcaaggcctgcaacctgtattccttgtctaaggaaggaatggaaaagcatatcaaaagatctaagcacctggagaacgccaagaagaacaacatagggttgagttttgaggagtgtattgagcgagtgtgcatcggtgctaacgacaaaaaggaagaatttgacgtctcgggcaatggccgaattgagggtcatatcggcgtccagctgcaggaacactcatacttagagaagggcatgcttgcttctgaagagctttcccagtcaggtggtagtactaaggatgatgagttggcctccactactacccctaagagaggcagacctaaagggaacatttctagaacctgttctcattgcggcctgctggccagcagtatcactaatcttaccgtgcacataagacgcaagcattcacatcagtacagttatctgtgcaaggtgtgtaagtactatacagtcactaagggcgatatggaaagacactgtgctaccaaaaagcacaaagggcgcgttgaaatagaagcgtcggggaagcacagttccgacattattgttggccccgaaggaggctccctggaagctgggaaaaaaaacgcaggcagtgctgtcactatgtccgatgagcacgccaataaacccgcagagtcccccaccagtgtgctcgagaagcccgatcgtggcaatagtatagaggccgaggtcgagaatgtctttcactctctagatggggaagttaatagccatttgttggataaaaaagagcagatctcctcggaacccgaggacttcgcgcaacccggcgacgtatactcacagcgagatgttaccgggaccggcgagaataagtgcctgcattgcgaattcagtgcgcacagttcagcctcactcgagctgcacgtgaaacggaagcatacgaaggagttcgagttctactgcatggcctgcgactattacgctgtgaccagacgggaaatgacccgccatgccgccactgagaagcacaagatgaagagacagagctacctgaattctgcaaacgtagaggcaggcagtgctgatatgagtaagaatattatcatgcccgaggaagaacaccagcagaatagtgaggaatttcaaataatcagcggacaaccctcagacacgctgaagtcgagaaatgcagcggattgctctatcctaaacgagaacacaaatctagacatgtccaaggtgctgtgtgcggcagacagtgttgaggtggaaaccgaggaggagtctaactttaatgaagaccattccttctgcgagacattccagcaggcccctgtgaaggacaaagtgaggaaacccgaggagatgatgtcactaacaatgtcttcaaattacggctcaccctctcgttttcagaacgaaaactccgggtcttctgcactcaactgtgaaaccgccaagaagaaccacgagatttctaatgacgccggcgagttacgggtgcactgtgagggagaaggaggaaacgcaggtgatggggggggagtggtcccacatagacacctgtgtcccgtcaccctggacggtgagagaagcgcagagtccccagtactcgtcgttacacgcatcactcgggaacaaggaaacttggaaagtgggggacagaaccgcgtcgctcgaggacatggtctggaagatctgaagggggtacaggaagaccctgttttgggtaacaaggagatactcatgaactctcagcatgagaccgaatttatccttgaggaggacgggcctgccagcgactccactgtggagagttccgatgtatacgagacaattatctctattgatgacaaaggccaggccatgtatagctttgggcgcttcgattcctcaattatcaggatcaagaatccagaagacggcgagctcattgaccagtctgaagagggcctgatagctaccggagtgcgtataagcgagctccctctgaaagactgtgcccagggtgtcaagaaaaaaaagagcgaagggagtagcatcggagaatccacccgtataaggtgcgacgactgcggtttcctggctgacggtcttagtgggctaaacgtgcatatagctatgaagcaccccacaaaggagaaacattttcattgccttttgtgcgggaaatctttctataccgaaagcaacttacatcaacacctggccagcgctggacacatgcgaaatgagcaagcctcggttgaagagctgccggaggggggtgctaccttcaaatgcgtgaaatgcactgaaccttttgattccgaacagaatcttttccttcacataaaaggacagcatgaggagctccttcgggaagttaataagtatatcgtggaagatacagaacagataaatcgagagagagaggagaaccagggcaacgtgtgtaagtattgcgggaaaatgtgccgaagcagtaatagcatggccttccttgcacacatcagaactcatacaggaagcaagccgtttaagtgtaagatttgccacttcgcgactgcgcagctgggggacgcccgcaatcatgtcaagcgccacctgggtatgagagagtataaatgccacgtttgtggagtggcttttgtcatgaaaaagcatctgaatactcacctcttgggcaagcacggggtgggaaccccaaaggagcgggtgaaagtcgcatacagaaaaattggaactctgccaggtatacagaataacaggaacgccagcagtgccagtgaggcacaaagtctctgcgagcacttctcttag

SEQ ID NO: 21544 - DNA, 5448 bp, Artificial Sequence
  Description of Artificial Sequence: Synthetic coding sequence
atgatggacagcgagaacaagcccgagaacgacgaggacgagaagatcaataaggaggcgcaggatctcacaaaactgtcatctcacaacgaagatggtgggcctgtttcggacgtgatcgcctccttccccgagaattcaatgggcaaacgtgggtttagtgaaagctctaattctgactcagtggtgataggagaagaccgcaataaacatgccagcaaacgccgaaaactggacgaggcggagcctctgaagtccggaaagcagggcatctgccggctggaaaccagtgagagttctgtgaccgaagggggtatagctctggacgagacaggcaaggagacctttctatcggactgtactgtagggggcacctgcctgccaaatgccctgtccccgagctgtaactttagcacgatcgatgttgtgtcactgaaaactgataccgagaaaacctccgcccaggagatggtcagcctggacctggaacgtgagagcccttttcccccgaaagagatctctgtctcttgcactatcggtaacgtcgatacagtgttaaagtgttccatctgtggacatttgttttcttcgtgcagtgatctggagaagcatgctgagagtcatatgcagcagccgaaagagcacacttgctgccactgctcccacaaagccgagtcatcctccgcactccatatgcacatcaagcaagcccatggaccccagaaggtgttctcgtgtgatctgtgcggctttcagtgtagtgaagagaatcttcttaatgcacattacctgggtaagacccatctccgacggcagaatctggccgcaaggggcggcttcgtgcaaattctgacaaagcagcccttccctaagaaaagcaggacaatggccacgaagaatgtgcatagcaagccaaggacgagtaagtcaatcgccaaaaacagcgactcaaaaggcctgaggaacgtgggttcaacctttaaggattttcgaggtagtatatctaaacagagcggatcctccagtgaactcttagtcgagatgatgccaagccggaatacccttagtcaagaggtggagatcgtcgaagaacacgtgacatccctggggctggctcagaaccccgagaatcagtcacgcaaattggatacactcgtcactagcgaaggactgctggaaaagctcgagagtaccaagaacaccctccaagctgcgcatggcaactcagtaactagtaggcccaggcccgaaagaaacatactggtacttggcaactccttcagacgccgaagctccacatttacactcaagggccaggccaaaaagaggttcaatctcctaggaattaagcgcggtacctcggagacacaaaggatgtacatgaaacatctacggacacaaatgaagactcacgacgccgaatctgtgcttaagcatctggaggcctgctcttctgtgcagcgagtgtgtgtcacaaccagtgagacacaggaagcagaacagggtcagggttccgcacgacctcctgacagcggtctccatagcctgactgtaaaacctgcctcaggaagccaaacactctgtgcttgtaccgactgtgggcaggtggccaccaaccggacagacctcgaaattcacgtcaaacgctgccatgcacgcgaaatgaagttttactgccggacctgtgacttcagttctatgtcacgacgagatctcgatgagcatttgcacagcaaccagcaccagcaaacggctagcgttctgtcttgtcaatgctgttctttcatctccctagatgaaataaatttacgggaccacatgaaggagaagcacaatatgcattttctgtgtactccttgcaatctgttttttctgtcagaaaaggatgttgaggaacataaggctactgagaaacatatcaacagtctcgtacagcctaagacgctgcagtcttcgaattcagatctggtgctgcaaactctgccattgagcaccttagaatccgagaatgccaaggaatcaatggacgattccggaaaggcttctcaggaggaaccattgaaatcgagagtttcacacggcaacgaggtgcggcacagttccaagccccagttccaatgtaaaaagtgcttctataagaccaggagcagcaccgtcctaaccagacatattaagctgaggcatggccaggattaccactttctctgcaaagcttgtaatctgtatagtctcagtaaggagggcatggaaaagcacattaaacggagcaagcatctcgaaaacgctaaaaagaataacatcggactgtcattcgaagagtgtatagagcgggtctgtataggagctaacgacaaaaaggaggaattcgatgtgtccggcaacgggcggattgaagggcacataggagtgcagttgcaggagcatagttatctggaaaagggaatgttggcctctgaggagctgtcacaaagcggtgggagtacgaaggacgacgaattagctagcacgactacccctaagaggggccggcccaagggcaacatcagcaggacttgctcacactgcggtctgctggcgagttcgattacgaacttgaccgtgcatattagaagaaagcactcacaccaatacagctatctctgcaaggtgtgtaagtactacaccgtaaccaaaggagatatggagagacactgcgccaccaaaaagcacaagggacgcgtcgagatcgaggcctccgggaaacattcctcagacatcatcgtcgggcccgaagggggttccctggaggctggaaaaaagaacgctggctccgccgtgaccatgtcagatgagcatgccaataaacccgccgagagccctacctcagtactggaaaaacccgataggggaaactcaatcgaagcagaggtagaaaacgtgtttcactctctcgacggggaggtgaactctcacctcctggacaaaaaggaacaaatttcttcagagcctgaagacttcgctcagccaggtgacgtgtactctcagcgagacgttacaggaaccggcgaaaataagtgtttgcactgtgagttttctgcccattcaagcgctagccttgaactccacgtgaaacgtaagcataccaaagaattcgagttttattgcatggcatgcgattactacgcagtcacccgccgcgaaatgacccgtcacgccgccactgagaagcataagatgaaaaggcaatcttacctgaacagtgcaaacgtggaggcaggatcagccgatatgtcaaaaaacatcatcatgcccgaagaggaacatcagcagaatagtgaagaattccagatcatcagcgggcagcccagtgacaccctaaagtccagaaacgcggccgattgctcaatcctcaacgagaatacaaacctggatatgtccaaggttctgtgcgccgcggactctgtggaagtggagaccgaggaagaaagcaacttcaacgaggatcactctttttgtgaaactttccaacaggcccccgtgaaggacaaagtgcgcaagcctgaagaaatgatgagccttacaatgtcgtcaaactacggtagcccaagtcgcttccagaatgaaaatagcggcagctccgccctgaattgcgaaactgccaaaaaaaatcacgagatctcaaacgacgctggcgaactccgagtccactgcgagggagagggcgggaatgccggggacggtggcggtgttgtcccacaccgccatctctgcccagtgacactggacggagaacgatccgcagaaagtcccgtcttagttgtgaccaggataacgcgcgaacaggggaatctggagtctggtgggcaaaatcgggtcgccaggggccatggcctcgaggacctgaagggtgtgcaggaggacccagtgctgggaaataaagagattctaatgaactcccagcacgagaccgaattcattttagaagaggacgggcctgcatcggacagcacggtggagtccagtgatgtatatgaaacgatcatcagcattgatgataagggtcaggccatgtactctttcggacgattcgactccagcatcataagaattaagaatccagaggatggcgagctgattgaccagtcagaggagggccttatagcaactggcgtacgcatctccgaattgcccctcaaagattgcgctcagggtgtgaaaaaaaagaagtccgagggatcaagtattggtgagtctactcgcatcagatgcgatgattgcggatttctcgctgacggcttatcaggccttaatgtgcatattgccatgaaacaccctactaaagagaaacatttccactgcttactctgcggtaagtccttttacacagagagcaacctgcaccagcacttagcctcggccggccatatgagaaacgagcaggctagcgtggaggagctgcccgaagggggggccacgtttaagtgcgtgaaatgcactgaacctttcgattcagagcagaacctgtttttgcacattaaaggacaacatgaagaattgttaagggaagtgaacaaatatatcgtggaggacacggagcagatcaatcgagaaagggaagagaaccaggggaatgtttgcaagtactgtgggaaaatgtgtcggtccagtaacagcatggcttttctcgctcacatccgcacgcataccggcagcaagccatttaaatgcaagatctgtcatttcgcgacagcacagctcggcgacgcgcggaatcacgttaaacgccacctcggaatgagagagtataaatgccatgtctgtggggtcgcctttgtaatgaagaagcatctcaacacacatctcctggggaaacatggagtgggaactcctaaagagcggaagttcacctgccacttgtgcgatagaagtttcactgagaaatgggcattgaacaaccatatgaagctgcatactggtgagaagccatttaaatgcacatggccgacatgtcactacagttttcttacggcgagtgccatgaaagaccactatcggactcacaccggcgagaaaagcttcctttgtgacttgtgtggctttgcaggcggcacacggcacgccctcaccaagcacagaaggcagcatacaggagagaagcctttcaaatgcgacgaatgcaactttgctagtaccacacaatcccacctcactcgccataagcgagtgcatactggcgagaaaccataccgctgcccctggtgcgactatagatcaaactgcgctgaaaatatcagaaagcacattctacacactgggaaacatgagggggtcaaaatgtataactgccccaaatgtgactacggaaccaacgtgcccgtggagtttaggaaccacctcaaggagcagcacccagatatagaaaatccagatctggcttatctccatgccggcaaaggtcagaagctctag

SEQ ID NO: 21545 - DNA, 4983 bp, Artificial Sequence
  Description of Artificial Sequence: Synthetic coding sequence
atgatggacagcgagaacaagcccgagaacgacgaggacgagaagataaataaggaagcccaggatctgactaagcttagctcacacaacgaggacggcggcccagtgagcgacgttattgcaagtttccccgaaaactcaatgggtaaacggggcttttctgagagttctaattcagacagcgttgtgattggtgaagaccgtaataagcacgcttctaagcgacggaaattggacgaggctgaacccctgaagtctggcaaacaggggatctgccgcctggagacgagtgagtcttctgttactgaaggcgggattgctctggatgagacaggaaaggagaccttcttgagtgactgtactgtgggaggaacatgtcttccgaatgccctctccccttcctgcaacttcagtaccatagatgtggtctctctgaaaaccgacaccgaaaaaacgtccgcacaggaaatggtatccctggatttggaacgcgagagtccctttcctcccaaggagatcagcgtgagctgtaccatcggaaacgtagatactgtcctcaaatgttctatttgcggccacttattctcttcatgctcagatctggagaagcatgccgagagtcacatgcagcagcctaaggagcacacctgttgccactgcagtcacaaagcagaaagctctagcgcactgcacatgcacatcaagcaagctcacgggccgcagaaggtctttagctgtgatctgtgtggttttcagtgctccgaggaaaatctactaaatgcccattatttgggtaaaactcacttgcgccgccagaaccttgctgcaaggggaggttttgtccagattttgacaaaacagccgtttccgaagaaatctcggactatggccacaaaaaacgtgcacagtaagccccggacttccaagagtatcgcaaagaatagtgattcgaagggactgaggaacgtgggcagcacgtttaaggattttagaggcagcatcagcaagcaatctggctcttcttctgagcttctggttgaaatgatgcctagtcggaataccctttcccaggaggtggagatagttgaagaacatgtcacttccttggggctggcccagaatcctgaaaaccagtccaggaaacttgacactctcgttacctctgagggactcctggagaagcttgagagtactaagaatacccttcaggctgcccatgggaatagcgttacatcccggccaaggccagagcgtaacatcttggttttaggcaattcgtttcggaggcggtctagcacatttacactgaaaggccaggcaaaaaaaaggtttaacctgctgggcatcaagagaggaacgagcgaaacgcaaaggatgtatatgaaacatttgcgcactcagatgaagacccacgacgccgagtctgtgctgaagcatctcgaggcctgctcatccgtccagcgagtatgcgtcactacctcagaaacgcaggaagccgagcagggacaggggagcgcccgccctcctgattccggcctgcactcgttgactgttaagccggcttcaggctcgcagaccctttgcgcatgcactgattgtggacaagtggccacaaacaggactgatctggaaattcacgtgaagagatgccacgcccgcgagatgaaattctattgccgtacttgcgacttctctagtatgtcccgtcgggacctggacgagcatctgcatagcaatcagcaccaacagactgcgagtgtcctgtcatgccagtgttgttccttcattagcctggatgagattaacctgcgggaccacatgaaagaaaagcacaatatgcactttctgtgcaccccctgcaacctctttttcctttcagagaaagacgtggaggagcacaaggccaccgagaaacacataaatagccttgtgcagcccaagaccttacaatctagcaacagcgacctagtgctgcagactctaccactatccactctggaaagtgagaacgccaaggagagcatggacgactctggaaaagcctcacaggaggaaccattgaagagccgggtctctcatggcaacgaagttcgacattcaagtaaacctcaatttcaatgcaagaaatgcttttataagaccagatcgtctacggtcttgactcgccacattaaactaaggcacggacaggattaccacttcctatgtaaggcttgcaacttatactctttgtctaaagaagggatggagaaacacattaagcggagtaaacatctggagaacgcgaaaaagaataatattggcctctcctttgaggaatgtatcgaaagagtgtgtattggtgcaaacgacaagaaggaggaatttgatgtgtcagggaatgggcggattgagggacatatcggggtgcagttgcaggaacactcatatttagagaaggggatgttagcttctgaagagctgagtcagtctggcggctctaccaaggacgacgaactggcttcaacaaccacacccaagcgcgggaggcccaaaggcaatatttcccggacatgtagccactgcggcctcttggccagcagtatcacaaacttgacagtgcacatccggcggaagcactctcatcagtattcttatttgtgtaaggtttgcaaatactacactgttacaaagggagatatggagaggcattgtgccacaaagaaacataaggggcgggttgagattgaagcaagcgggaagcattccagcgatataatcgtgggacccgagggcggatcattggaggccggcaaaaagaatgctggtagcgccgtgacaatgtccgatgagcatgctaataaaccagcagaatcaccaaccagtgtgctcgaaaaaccagatagaggtaactcgattgaagccgaagtcgagaatgtgtttcacagtctcgacggcgaagtaaatagtcaccttctcgataaaaaggaacagatatcctccgagccggaagactttgcccagcctggggacgtctatagccaacgggatgtgaccgggaccggagaaaataagtgcttgcactgcgagttctccgcgcactcatctgcttccctggagctccacgttaagcgcaagcacactaaggagtttgaattctattgtatggcctgtgactactacgccgtcactcgcagagagatgacccggcacgctgctacggagaagcacaagatgaagcggcagtcctatctcaattccgccaacgttgaagccgggagtgccgatatgagcaaaaatatcatcatgccagaagaagaacaccagcagaattctgaggagtttcagataatcagcggccaacccagtgatacccttaagtctagaaacgcggcggattgttccattttaaatgagaacacaaacttagatatgtcaaaagtattgtgcgccgctgactcagtggaagttgagacggaggaggagtccaacttcaatgaggaccactccttttgcgagacattccagcaggctcctgtgaaggacaaggtccgtaagccagaggagatgatgtcgttaaccatgagctcaaattacgggtccccatctcggtttcagaacgaaaacagtggcagctccgccctgaactgcgagactgctaaaaagaaccacgagataagtaacgacgctggcgaacttcgggtgcactgtgaaggcgagggagggaacgctggtgatgggggcggagtagtgcctcaccgtcacctatgtccggttaccctggacggggaacgtagtgctgagtcacctgtgctcgtggtgacaagaataacgagagagcagggaaatctggagtcagggggccagaatagggtggctcggggccatggattggaagacttgaagggggtgcaggaggatccggtcctgggcaacaaagagatcctcatgaactcacagcatgagaccgagttcattcttgaagaagatggccccgcttctgacagcactgtggaaagctccgatgtttatgaaacaattatttctattgacgataagggacaggcgatgtacagcttcggaagattcgactctagcattatccggatcaaaaacccagaggatggggaactgattgaccagagcgaggaaggtttaatagcaacaggggtgagaatctccgagctccccctgaaggattgtgcccagggagtgaaaaagaaaaaaagcgaaggcagtagcatcggagagtcaacaaggatcaggtgtgatgactgtggtttcttagctgatggcttaagcggcctgaatgttcacatcgccatgaagcacccgacgaaagagaaacattttcattgtctgctgtgcggcaagtccttctataccgagagcaacctccaccaacatctagcctccgcaggtcatatgcgcaatgaacaggccagtgtggaagagctgccagaagggggagccacctttaagtgcgtgaaatgtacggagcccttcgattcagaacagaatctgtttctacatataaagggtcaacacgaggagctgcttcgagaagtcaataagtacatagtggaggatacagaacagattaacagggagcgggaggaaaatcaggggaatgtgtgcaaatactgtgggaagatgtgtagatccagcaacagcatggcttttcttgcccacatcagaacacatactggctctaagcctttcaaatgtaaaatctgtcactttgctactgcccagcttggtgatgctcgaaatcatgttaagcggcatctgggtatgagagaatacaaatgccacgtatgcggagttgccttcgtgatgaagaagcacctgaacacgcatctgctaggaaagcacggagtgggcacacctaaggaacgagtgaaggtggcctatcgaaaaattggaaccctccctggcattcagaataatagaaatgccagcagtgcaagcgaagcgcagtccctgtgcgaacattttagctag

SEQ ID NO: 21546 - DNA, 2163 bp, Artificial Sequence
  Description of Artificial Sequence: Synthetic coding sequence
atggaggaggccgaggagctgctgctggagggcaagaaggccctgcagctcgccagggagccccggttgggcctagatctaggctggaaccctagcggtgagggctgcactcagggtttaaaagatgtgccaccagagccgacccgcgacatcctggccctcaaaagcctgccccggggcctggcactgggcccctctcttgccaaagagcagcgcctcggagtttggtgcgtaggcgatcctttacaacccggcttattgtggggacctctggaggaagaatccgcgtcaaaagaaaagggcgaaggagtgaagccacgccaagaggagaatctgtccctagggccctggggagacgtatgtgcatgtgaacagagcagtggctggactagcttggtgcagagaggtcggctggagtctgagggcaatgtcgcacctgtgaggatctctgagaggctgcatcttcaagtttaccagcttgttcttcctggctctgaactcctgctttggccccagccatcttctgaaggcccatcactcactcaacctggcctcgataaagaggctgcagtggctgttgtgaccgaggtggagtccgctgtgcagcaggaagtggcatctccgggcgaggacgcggcagaaccttgcatcgaccctggatcgcaatccccatctggtatccaggcagaaaacatggtttctccagggctaaagtttccgacgcaggatagaatctctaaagatagtcagccccttggtcctctgctccaggatggggacgtggatgaagagtgcccggcacaggcgcagatgccgcccgagctccagtcaaactccgcaacacagcaagacccagacgggtcgggcgcttctttcagttcgagcgctagaggtacccagccacatggatatttagccaaaaagctgcactccccaagcgaccaatgccctcccagggccaaaacccctgaacctggagcccagcagtctggctttcctacattaagccgctcccccccagggcctgccggttccagcccaaaacagggacgtagataccggtgcggagagtgcggaaaagccttcttacaactgtgccacctaaaaaaacacgcctttgtccacacaggccataagccttttctctgcaccgaatgtggcaagtcttactcaagtgaggaatcattcaaggcccacatgttgggccacaggggggtccgaccctttccctgcccacagtgcgataaggcatacggcacacagagagatctgaaagagcatcaggttgtgcactccggggccaggccgtttgcttgcgatcagtgcgggaaggctttcgcccgccgaccttccctgaggctgcaccgcaagacacatcaggtcccagccgcaccagccccatgtccctgtcctgtgtgcggcagacccttagcgaatcaagggagcctccggaatcatatgcggctacatactggagaaaaaccgtttctttgcccacattgtggacgtgcctttcgccagcggggtaacctgcgcggacacttacgcttgcatactggagaacggccctacagatgcccgcattgcgccgacgcattcccccagctgcctgaactgcgacgccacctgattagtcataccggagaggcacatctgtgtccagtgtgcgggaaggcactgagagatccacacacattgagagcacatgagcgcctgcatagcggagaacggccatttccatgtccccaatgtggccgagcctacacgctcgcaaccaaactgcggcgacatctcaagtcccacttggaggacaagccttaccgatgtcccacatgcgggatgggttacaccctcccccaaagcctgagacggcaccagctgtcgcatcgccctgaggccccatgcagccctccaagtgtgcctagcgcagccagcgagcccaccgtggtcctgctccaagcggagccccaactcctagacacacaccgggaggaagaggtgagtcctgctagagacgtagtagaagtgactatttctgagagtcaagaaaaatgctttgttgttccggaggagccagatgctgctcccagccttgttctgatacacaaggacatgggcctgggagcatgggccgaagtcgtggaagttgagatgggaacatag

SEQ ID NO: 21547 - DNA, 597 bp, Artificial Sequence
  Description of Artificial Sequence: Synthetic coding sequence
atggagaagcccgccggccggaagaagaagacccccaccccccgggaggaggccgacgttcaaaagtctgccctccgggaagagaaggtgagcggtgacagaaaaccacccgaacggcctaccgtgccccggaaaccacgaaccgaaccgtgcctgtcacctgaagatgaagaacacgtgttcgatgcctttgatgcttcctttaaggacgatttcgaaggtgtgcctgtgtttatcccgtttcagcgaaagaagccatatgagtgtagcgagtgcggccgcatctttaaacataagaccgatcacataaggcatcagcgggtgcacaccggtgaaaagccttttaagtgcgctcagtgcggtaaagccttccggcacagtagcgacgtgactaagcaccagcgtactcacaccggagagaagccctttaaatgtggggaatgcggaaaggcctttaactgtgggtcaaatctgttgaagcatcagaagacccacacaggggaaaagccatacgagtgcacacactgcgggaaggcctttgcttactctagttgcttgatccgacaccaaaaacgtcatccaagaaagaagccctag

SEQ ID NO: 21548 - DNA, 597 bp, Artificial Sequence
  Description of Artificial Sequence: Synthetic coding sequence
atggagaagcccgccggccggaagaagaagacccccaccccccgggaagaggctgatgtacaaaaatccgcactgagagaggagaaagttagcggcgatagaaagccgccagagcgaccaacggtgccaaggaagccgcgtactgagccttgtttaagtcctgaggatgaggaacacgtgtttgatgcattcgatgccagcttcaaagatgatttcgaaggagttcccgtcttcattccatttcagcgcaagaaaccatacgaatgtagcgagtgtgggaggatctttaagcataaaaccgaccacattcgccaccagcgtgtgcatacaggcgaaaagccattcaaatgcgcccagtgtggcaaggctttccgtcactcttctgacgtcacgaagcaccaaagaacccatacaggagagaagccctttaaatgcggagagtgcggtaaggcatttaattgcgggagcaacctcctcaagcaccagaagacacatacgggcgagaaaccctatgagtgtacacattgcgggaaagccttcgcctactcatcttgtctaataaggcaccaaaagcgtcaccctcgaaaaaaaccttag

SEQ ID NO: 21549 - DNA, 597 bp, Artificial Sequence
  Description of Artificial Sequence: Synthetic coding sequence
atggagaagcccgccggccggaagaagaagacccccaccccccgggaggaagccgacgtccagaaatcagctcttagggaggagaaggtatctggtgacaggaaacccccagagcgaccgacggtgcctagaaagccccggaccgagccatgtctaagcccggaggatgaagagcatgtcttcgatgcctttgatgcaagctttaaggatgatttcgagggcgtgcccgtatttataccatttcagaggaagaaaccatacgagtgttccgagtgtggacgaatcttcaagcacaagactgaccacattcgacaccaaagagtgcatactggcgagaagccctttaagtgtgctcagtgtggaaaagcttttaggcattcctccgacgtcacgaaacaccaacgcacacacacaggagaaaagccttttaaatgtggggaatgcggtaaagccttcaattgtggaagcaatctactgaagcatcagaagactcatactggcgaaaaaccatatgagtgcactcactgcggaaaagccttcgcgtacagttcatgcctcatcaggcatcagaagagacatcctcgaaaaaagccgtag

SEQ ID NO: 21550 - DNA, 1296 bp, Artificial Sequence
  Description of Artificial Sequence: Synthetic coding sequence
atgctgagcgacgagctggagagcaagcccgagctgctggtgcagtttgtgcaaaatacaagtatccctctcggtcagggtctggtcgagtcagaagccaaggacatcacatgcttgtccttgctacctgtgacagaggccagcgagtgttctcgattaatgctgcccgatgacactacaaatcactctaatagctcaaaggaggtgcctagttctgctgttctccgatcgctgcgcgtcaatgttggacctgatggggaggaaacaagagcccagacggtgcaaaagtcaccggaatttctttctactagcgaatccagcagcctcctccaggatttgcaaccctccgactccacctcattcattttgctcaatctcacacgtgcaggtctaggcagctcagccgagcacttggtgttcgtgcaggacgaggccgaagacagcggcaacgactttctgtcttctgagagcacggatagcagtattccttggtttcttcgagtccaggagttggcccatgattctttgatagccgctacccgagcccagttggccaagaatgctaagacatcgagtaacggagagaacgtccacctgggttccggagacggacagtctaaagattccggcccactgccccaggtagagaagaagttgaagtgcacagttgaggggtgtgatagaactttcgtttggcccgcacattttaagtaccacctgaagactcacaggaatgataggtccttcatttgtcctgctgagggctgcggcaaaagcttctatgttctgcaacgcctgaaggtgcatatgcgcacacacaacggtgagaaacccttcatgtgccacgagtcggggtgtggaaaacagtttaccaccgctggaaatctgaagaaccatagacgcattcataccggcgagaagcccttcttgtgtgaagcgcaaggctgcggtaggtcgttcgcggaatactctagcctgcgtaagcacctggtcgtccactcaggcgaaaagccacaccagtgtcaggtttgcggcaagaccttctcacagagtggcagccggaacgtccatatgcgcaagcatcacttacaattaggggccgccggatctcaggaacaggaacagactgaggtgctcgccgagggttcaccacggagcctgtccagcgtccccgacgtgactcatcacctggtgactatgcagtccggtaggcagagttacgaagttagcgtcttgacagcagtaaacccccaggaattactaaatcagggcgacctgactgagagacgtacatag

SEQ ID NO: 21551 - DNA, 1278 bp, Artificial Sequence
  Description of Artificial Sequence: Synthetic coding sequence
atgctgcccgacgacaccaccaaccacagcaacagcagcaaggaggtgccttcaagtgccgtcctaaggtctttgagagtgaacgtcggacctgatggcgaggaaacccgcgcccaaactgtgcaaaagagcccagagttcctgtccacctctgagtcatcgtcacttctgcaggacttgcagccgtctgattccaccagttttattcttctgaacctgacccgagcgggcctgggctccagtgccgagcacttagtcttcgttcaggacgaagcggaggactcagggaacgattttttaagctccgaatcaacggattcgtcaataccatggttcctccgcgtgcaggagttggcccacgattctctcattgctgctacaagagcgcagctggccaaaaacgccaagactagctcaaacggagagaacgtacatcttggcagcggagacggacagagtaaggactccggtccattaccacaggtagagaagaagttgaagtgtaccgtggaaggctgcgatcgtacttttgtgtggcctgcccactttaaataccacctcaaaacccacaggaacgaccgatccttcatttgcccggccgaaggatgtggcaaatccttctacgtcctccagcggcttaaggtccacatgcgaacccataacggggagaaaccatttatgtgccatgaatctggctgcggaaaacagtttacaacagcagggaacctgaagaatcacagaagaatccacaccggcgagaagccgttcctctgcgaagcacaaggctgcggcagaagcttcgccgagtatagttcactaagaaagcacctcgttgtgcacagcggtgaaaaaccgcaccaatgtcaggtctgcggcaagaccttttcacaatctggatcccgaaacgtacacatgcgaaagcatcacttgcagctcggcgccgccggatcacaggagcaggagcagaccgccgagccactgatgggctcgagtctactggaagaggccagtgtgccctcaaagaatctcgtatctatgaacagccaaccctccctgggaggcgaatctctcaatctgccaaacaccaactccattcttggagttgatgacgaggttctcgccgagggatctccccgctcactgagcagcgtgccagacgtcacccaccacttggtcactatgcaaagcggacggcagtcctatgaggtgtctgtgctgaccgctgtgaatcctcaggagctcctgaatcagggcgatctgacagagcgcaggacatag

SEQ ID NO: 21552 - DNA, 1551 bp, Artificial Sequence
  Description of Artificial Sequence: Synthetic coding sequence
atgctgagcgacgagctggagagcaagcccgagctgctggtgcagtttgtgcagaacacgagtattccattgggccagggactcgtggaaagcgaagcaaaggacataacttgtctatctctccttcctgttacggaggcatcggaatgctctaggctgatgttaccagagccggtcccctggcgggaggaggacggaaagagcggctgttctgatcttaatgacactactaaccacagcaattcgagcaaggaagtaccatccagtgccgtcctgagatccctcagagtgaacgtgggacctgatggcgaggagacccgggcccagacagtacagaagtctccagagtttttatcaacttccgagtcttcaagcttactgcaggaccttcagccaagcgactccacctctttcatattgctcaaccttacaagagctggcttaggtagctctgctgagcatcttgtcttcgtccaagacgaagctgaagactcggggaatgattttttgtccagtgagagtaccgacagcagcattccctggttccttagggtgcaggagctagctcacgactctctgatcgctgctacaagagctcagctggctaagaacgccaagacttctagcaatggtgaaaacgtccatctgggctcgggggatgggcagagtaaagattccggccctctgccccaggtggaaaagaagttaaaatgcacagtggaaggctgcgataggacattcgtgtggcctgcccattttaagtatcatcttaagacacacagaaatgatcgttctttcatctgtcccgcagagggctgcggcaaaagcttctatgtgctccagcgcctcaaagtgcatatgcgtacccataacggagagaagccctttatgtgtcacgagtctggctgtggcaagcagttcactacggctggtaatctgaagaatcatcggaggattcataccggcgaaaaacctttcctgtgcgaagctcagggatgcggccggtcattcgccgagtacagcagcctgcgcaagcatctcgtggtgcactccggtgagaagccacatcagtgtcaggtgtgcgggaagacatttagccagtccgggagccgcaacgtgcatatgcgaaaacatcatctgcagctgggggctgccgggagccaagagcaagagcagacagcagagcctctgatgggctccagtttactcgaagaggccagtgttccctctaaaaatctggtgagcatgaacagccaacctagtcttggaggcgagtcactaaatcttcctaataccaattccatacttggcgtagatgacgaggtacttgcagaaggctcccctaggtccttgagttctgtgcccgacgtaactcatcacctggttactatgcagtctggccggcagagttacgaggtttctgtcctgacagccgtgaatcctcaggaaagtctagcacccctgcctagattagagtgtagcggcgcctttagcgcgcattgtaacttgtgcttaccgggatcttccgactcacctgctagcgcgtcttag

SEQ ID NO: 21553 - DNA, 1404 bp, Artificial Sequence
  Description of Artificial Sequence: Synthetic coding sequence
atgctgagcgacgagctggagagcaagcccgagctgctggtgcagttcgtccagaatacttctattccgcttggacaggggctggttgaatcagaagccaaagacattacctgtctgagccttctgccagtcacagaggccagcgaatgctcacgtctcatgctcccagacgatactacaaatcactccaattcaagcaaggaggtccctagtagcgcagttctgagatctctgcgtgtgaatgtgggcccagatggtgaagagtttctatccacgagcgagagctcttccctccttcaggacctgcagccctcagactccaccagtttcattctgctgaatcttacacgggcaggcttgggcagctctgccgaacatttggtcttcgtacaggatgaagcagaggactctgggaatgacttcctctccagcgagtctaccgactctagtatcccctggttcctgcgcgtgcaagaacttgcacacgacagccttatagccgcaactcgcgcgcagctggcaaaaaatgcaaagacgtcgtcaaacggggaaaacgtccatctgggcagcggagacggacaatctaaagactccggacctctcccacaggtggaaaaaaaactcaagtgcacagtggaaggctgtgacagaaccttcgtctggcccgcacattttaaataccaccttaaaacccataggaatgaccgtagcttcatctgccctgctgaagggtgcggtaaaagtttctatgtcctacagagactgaaggtgcatatgagaactcacaatggcgagaaacccttcatgtgccatgagtcagggtgtggcaaacagtttaccacagcgggcaatctgaagaaccataggcgcatccataccggagaaaagccgttcctctgcgaggcccaaggatgcggcagatctttcgcagagtattctagcctgcgcaagcatcttgtagtgcacagcggcgagaagccccatcagtgtcaggtgtgcgggaaaacattctcacaatccggcagtagaaacgtccatatgcgcaagcaccatctgcagctcggggccgcaggcagccaggagcaggagcagaccgctgagccgctaatgggtagcagcctgctggaggaggctagtgtcccgtccaagaacctcgtgtctatgaacagccagccttctttaggcggcgaaagcctcaaccttccaaatactaattctatactgggggtcgacgacgaggtgctagccgaaggcagtccgcgcagcctgtcctcagtccccgacgtgactcaccacctggtgaccatgcagagtggaagacagtcttacgaggtaagtgtgctgacggctgtgaatccccaagaactgctgaatcaaggcgacctgacagagcgtcgcacttag

SEQ ID NO: 21554 - DNA, 1218 bp, Artificial Sequence
  Description of Artificial Sequence: Synthetic coding sequence
atgctgagcgacgagctggagagcaagcccgagctgctggtgcagtttgtgcagaacacgagcatccccttaggccagggcctggttgagagtgaagccaaagacataacatgcttgagtctgctccccgttactgaggcttccgagtgcagccgccttatgctgcctggtctgggaagctccgccgagcatctggttttcgtgcaggatgaagctgaagacagtggaaacgattttctgtctagtgagtccaccgacagttcaattccctggtttttacgggtccaagaactggcacatgatagcctcatcgccgcgaccagggcgcagcttgctaagaacgctaagactagctctaacggcgagaacgtccacttgggatcaggagacggacagagcaaggactcgggacccctgccccaggttgaaaaaaagctcaaatgcaccgttgaaggctgcgatcgaacgtttgtatggcctgcacactttaagtaccatttgaaaacacacaggaacgatcgtagcttcatctgccccgccgagggttgcggtaagagtttctacgttttacagagattgaaggtgcacatgcgcacacacaatggagagaaaccctttatgtgccatgagtcagggtgtggcaagcagttcaccacagccgggaatctcaaaaaccaccggcggatacataccggcgaaaaaccctttctctgcgaggcccagggttgcggcaggtcgtttgcggagtatagctccttgcggaagcacctggttgtccattctggagagaagccccaccaatgtcaagtctgcggaaaaactttcagccagagcgggtccagaaatgtgcatatgcgaaaacaccatcttcaattaggcgctgctggttcacaagaacaggagcagacggccgagcctctcatgggatcatcacttttagaggaggccagtgtgccttccaagaatcttgtgtcgatgaattctcagccctccctgggcggcgagagtttaaaccttcctaatacaaactctattctgggggttgacgatgaagtcctcgctgaaggttcaccacggagtctgtcatcggtcccggacgtgacccaccacctggtcaccatgcagagcggtagacagagctatgaggtctcagtgctgactgccgttaacccccaggagctgctgaatcagggagatttaactgaacgccgcacctag

SEQ ID NO: 21555 - DNA, 213 bp, Artificial Sequence
  Description of Artificial Sequence: Synthetic coding sequence
atgctgagcgacgagctggagagcaagcccgagctgctggtgcagtttgtccagaatactagcatccctttgggccaggggctggtggagtcagaggctaaagacatcacgtgtctgtctctgctgcctgttaccgaggccagcgagtgttcgcgtctcatgctcccagacgacaccactaaccatagcaattcctcaaaagaggtaccctag

SEQ ID NO: 21556 - DNA, 1437 bp, Artificial Sequence
  Description of Artificial Sequence: Synthetic coding sequence
atgctgagcgacgagctggagagcaagcccgagctgctggtgcagttcgtgcaaaacacaagtataccactggggcaggggctggtcgagtcggaagctaaagatatcacttgtctgagcctactgcccgtaacagaggcctccgagtgcagcagacttatgttgcccgatgacactacaaatcatagcaattcttccaaagaagtgccatcgtctgccgtgttgcggagcctgagagtgaacgtagggcccgatggtgaggagacccgggcccagactgtgcaaaaaagccccgagttcttgagtacgtcggagtcttcaagcctgctccaggatctccagccctcggactctacaagcttcatcctgcttaatctaacaagggcaggcttaggcagctcggcagagcatctagtgtttgtgcaggacgaggccgaggattccggaaacgacttcctcagctctgagagcaccgacagctccattccttggtttctgcgggtgcaggagctggcgcatgattccctaatagccgccacaagggcacagctcgcaaaaaatgctaagacaagttctaacggagaaaacgttcatttggggagcggcgatggccaatcgaaggatagcgggccactgccgcaggttgaaaagaagttgaaatgcacagtggagggttgtgatcggactttcgtgtggccagcacattttaagtaccacctgaaaacgcaccgcaacgacaggtccttcatatgccctgctgaagggtgtggcaaatccttctacgtgctgcagaggctcaaggtccatatgaggacacacaacggagaaaagcccttcatgtgtcacgaaagtgggtgcggaaagcagtttacaactgctgggaatctgaaaaaccacaggaggatccatacaggagaaaaacctttcctgtgcgaagcgcagggctgcggccgatcttttgctgagtactcatcgcttcgtaaacacttagtggtgcacagtggagagaagccccatcaatgtcaggtctgcggaaagactttttcccagtctgggtctaggaatgtgcatatgcgtaagcatcacctgcaactcggtgccgccggatcacaggagcaggagcagaccgccgagccgttgatgggttcatcccttctcgaagaagcaagcgtgcctagcaagaatctggtttcaatgaattcacaacccagcctgggaggcgaaagtctcaatttgcccaatacgaatagcatattgggcgtggatgatgaggtgttggccgaaggctcacctaggagcctgtcatcagtgcctgacgtgacacaccatctggtaacaatgcagtcgggtaggcagtcgtacgaggtgagcgtgttaactgccgtcaaccctcaggaactgctgaatcagggcgatctaactgaacggaggacctag

SEQ ID NO: 21557 - DNA, 225 bp, Artificial Sequence
  Description of Artificial Sequence: Synthetic coding sequence
atgctgagcgacgagctggagagcaagcccgagctgctggtgcagtttgttcaaaatacctcaattcctctcggacagggattggtagagtctgaggccaaggatattacttgtttaagccttctacctgtgaccgaggcttccgagtgtagtcgcttgatgttgccagacgacacaacaaaccactctaacagctccaaggaggtgccttccagtgccgtgtag

SEQ ID NO: 21558 - DNA, 381 bp, Artificial Sequence
  Description of Artificial Sequence: Synthetic coding sequence
atgctgagcgacgagctggagagcaagcccgagctgctggtgcagttcgtacagaatacatctatcccactcgggcagggcctggttgaatccgaagccaaggatattacatgtttaagtctgctgcctgtgaccgaggccagcgagtgcagtaggctgatgcttcccgatgatactactaatcacagcaacagcagtaaagaggtcccatcctctgccgtcttgcggtccctgcgcgtcaacgttggacctgatggagaggaaactcgtgctcagacagtgcagaagtcacccgaatttttgtccaccagcgagtcatcttccttacttcaggatctccaaccctcagattctacgtctttcatattgcttaatttatag

SEQ ID NO: 21559 - DNA, 819 bp, Artificial Sequence
  Description of Artificial Sequence: Synthetic coding sequence
atgctgagcgacgagctggagagcaagcccgagctgctggtgcagttcgtgcaaaatacctccattccactggggcagggcctcgtcgaaagcgaagcaaaggatattacatgtctttcattgctgcccgtcacggaagctagcgaatgctcccgcctgatgctgcctgatgatacaacgaaccactctaatagtagtaaagaggttccttcctccgccgtgctgaggagcctgagggtcaatgtgggacccgacggcgaagagactcgagcccagactgtccaaaagtccccagagttcctttcaacctcagagtcctcaagtctcctccaggacttacagccgagtgattcaacaagctttatcttgttaaacttgacccgagcaggtctggggtcgtctgccgagcacttggtcttcgtgcaggacgaggccgaggactcaggtaacgattttttatcatctgagtcaacagattcctctataccttggtttctgagagtccaggaattggcccatgactcacttattgcagccacacgcgcccagttggccaagaacgctaagactagttctaatggggagaacgtccatttaggatctggggacgggcagtccaaagattccggtccattaccgcaggtggagaaaaaactgaaatgtactgtggaaggatgcgaccgcacttttgtctggcctgctcactttaagtatcatcttaagacccatcgaagactatgggagaagctactttgcgccgccgaagcggaaggtgcgcacgaggacccacagtggagggaggcactgtacgtaccctag

SEQ ID NO: 21560 - DNA, 939 bp, Artificial Sequence
  Description of Artificial Sequence: Synthetic coding sequence
atggaggagaagcccagcggccccatccccgacatgctggccaccgccgagcccagcagctcagagaccgataaagaagtcctgtcccccgcggtgcccgccgccgcccccagttcaagtatgagtgaagagcccgggcctgaacaagcagctacgccccctgtgtgggaacgtggaggggcgggcgggatgcagcagggaagctcacccgcgcctgatagttgccagcccggacctggacctagccctggcctcacaagtattgtgagtgggacatcagaagatctcaggccgccgaggagacggcctccccctggtaagcagataccatgctcgtccccgggctgttgtctgtcttttccaagtgtgcgggacctggctcagcacttgaggactcactgtcctcccactcaaagcttggagggtaaactatttcgctgtagcgctttgagctgcaccgagacatttccctctatgcaggaacttgtggcccatagcaagctgcattacaagccaaaccgctacttcaaatgcgaaaactgcctgcttagattcagaacacataggtctctgttcaaacacctgcatgtctgcgccgaacatgcgcagtcccccgccccacccccaccaccggctctagaccgcgaaccacctgctcctgaaaggccccccgaggtagatcccgcgtcagcccccggcctgccattccctctgctggagcccttcaccacacctgcacccgcaccaaccgggcctttcttaccatacctcaatcccgcacccttcgggttgagccctcctaggctgcgaccattcctcgccgctgctccaggccctccggcaagttctgctgcggtatggaagaaatcccagggggcagggtcatcacctaggcgccctcaaggaggcagcgacgcccccagcggcgcctgccggtag

SEQ ID NO: 21561 - DNA, 1173 bp, Artificial Sequence
  Description of Artificial Sequence: Synthetic coding sequence
atggaggagaagcccagcggccccatccccgacatgctggccaccgccgaaccatcttcctctgaaacggacaaagaggtgctaagcccagccgtcccagccgccgcaccatcaagcagtatgtcagaggaacctgggcccgaacaggccgccacccctcctgtatgggaacggggtggtgccgggggcatgcaacaaggcagcagccctgctccggattcatgccagcctggcccggggccatctcccggcctgacaagtatcgtatcaggtaccagcgaggacctgaggccccctaggaggagacctcctcccgggaagcaaattccgtgttcgtctcctggctgctgcctttcattcccatctgtaagggatttggcccaacacctcagaacccactgccctcccacacaaagccttgagggcaagctatttcgctgctctgcactgtcctgtaccgagaccttcccatccatgcaagagctggttgcccacagcaagctccactataagccaaacagatactttaaatgcgaaaactgtttgctccgttttcgtacacaccgttccctctttaagcatttacacgtttgcgcagagcacgcccagagccctgcccctccacccccccccgctctcgatagagagccccccgcacctgaaaggccccctgaggtggaccccgcctcggcccctggtctccccttccctctgcttgagcccttcacaacgcctgctccggcccctacaggaccattcctgccctatctgaaccctgcaccgtttgggctgtcaccacctagactgcgaccattcttggcagcggctcctggcccacctgccagctcggcggccgtgtggaaaaagagtcaaggcgccggatccagtccgcgacgcccacaagggggaagtgacgccccctcagggcacgccgctccctcccgcatcgtttgggagcataccaggggacgctattcttgcatgcagtgcgcgtttagcacggcgtccaggcctgccatgactctgcacctggaagatcataggccaggcgctcctgccgccccggctgcaggccccccaaggccggacgccccagccgaccccgcgcccctggcccctaaagtgtcccctctcctttctgagggagaacttcctgtgttttcccagctttag

SEQ ID NO: 21562 - DNA, 1785 bp, Artificial Sequence
  Description of Artificial Sequence: Synthetic coding sequence
atggccgccgccgtgctgcgggacagcaccagcgtgcccgtgaccgcagaagccaagttaatgggctttacacagggatgtgtcacatttgaggacgtcgccatctatttctcccaagaggagtggggactgctggatgaggctcagaggctgctctatagggatgtcatgctggagaactttgcactgatcaccgctctcgtctgttggcatggaatggaagacgaggagactcctgagcagtccgtgtctgtagagggagtgcctcaggtacggacaccagaggcatcacccagtactcagaagattcagtcctgcgacatgtgtgtgccctttctaactgatattctgcacctgacagacctacccggtcaggagttgtatctgacaggcgcctgcgcggtcttccaccaggaccagaaacaccactcggcagagaagcccttggagagcgacatggacaaggcttcgtttgttcagtgctgcctctttcatgagtcaggaatgcccttcacgagttctgaggtgggcaaagattttctggcacccctggggatcctgcaaccccaggctatagccaactatgaaaaacccaacaagatcagtaagtgtgaagaagccttccatgtgggaatatcccactataagtggtcacagtgtcggagagaaagcagccataaacacacttttttccatcctcgcgtatgtacaggcaaaaggctgtacgaatcctcaaagtgcggcaaggcatgctgctgtgagtgcagtctggtgcagctgcagagggtgcatcccggggagcgcccgtacgaatgcagcgaatgtggcaaatcttttagtcagacttcgcatctcaacgaccacagacgcatccacaccggcgaacgaccctacgtgtgcggtcaatgcggaaagagctttagtcagcgggctaccctgataaaacatcatagggtgcacacaggcgaaagaccctatgaatgcggggaatgcggcaaatccttctctcaaagttccaacctaatagaacattgtcggattcataccggggagcgcccatatgaatgtgacgaatgcggtaaagccttcggctcaaagagcactctggtgcgtcaccagcgaactcacacgggtgaaaagccctatgagtgcggagagtgcggaaagttatttcggcagagcttcagcctggtcgtccaccagcgaattcataccaccgcacgaccatatgagtgtggtcagtgcggcaaaagtttttctctaaaatgcgggctcattcagcatcagctgatccattcaggagctcggccttttgaatgtgacgagtgcggaaaatcgtttagccaaaggacgactttgaacaagcaccacaaagtgcataccgccgagcggccatacgtatgcggcgaatgcggaaaagcgtttatgtttaagtctaagttagtacggcatcagcgcacccataccggggagcggccttttgagtgcagcgaatgcggtaagttcttcaggcagtcctataccctggtcgagcaccagaaaattcataccggactcagaccctacgattgcggacagtgtggtaaaagctttatccagaaaagcagcctgatccaacaccaggttgtgcatactggtgagcgtccttacgaatgcggcaaatgcggcaaatcatttacccagcactccggactgattcttcacaggaagtcgcacactgtggaaaggccacgcgattctagcaagtgtggcaagccttactcccctcgcagcaacatcgtatag

SEQ ID NO: 21563 - DNA, 1434 bp, Artificial Sequence
  Description of Artificial Sequence: Synthetic coding sequence
atggccgccgccgtgctgcgggacagcaccagcggctgcgtgaccttcgaagacgttgcaatctattttagtcaagaggagtggggtctccttgacgaggctcaaagactgctttatagggatgtcatgctagaaaactttgctctcataactgcccttgtctgttggcacggaatggaggatgaggagacccctgagcagtctgtcagcgtcgagggcgtaccacaagtccggactcccgaggccagccccagcacgcaaaaaattcagagttgtgatatgtgtgttccttttctcacagacatccttcatctcaccgatctaccgggccaagagttgtatctgaccggggcatgtgccgtgttccaccaggaccagaaacaccattccgccgagaagcctctagagagcgatatggataaggcaagcttcgtccagtgctgcctttttcacgaatccggcatgccctttaccagctccgaggtgggcaaagactttctagcccctttaggtatcttacagccccaagccatagctaactacgagaagccaaataagatctccaaatgcgaagaggcatttcacgtcggaataagccactacaagtggagccagtgccgcagagaaagctcacacaagcatacgttttttcatccacgggtgtgtacaggtaagcggctgtatgagtcctccaagtgtggcaaggcgtgctgttgcgagtgttccctcgttcagttacagcgggtgcaccccggagagcgcccttatgagtgcagcgaatgcgggaagagcttttcccagaccagccatctcaacgaccacagacgcatacatacgggggaacgtccctattacgaatgcggcgagtgcggtaagagctttagtcaatccagcaatttaattgaacattgccgaatacataccggcgaacggccctacgagtgtgacgagtgtggcaaggccttcggttcaaagtccacgctggtccgacaccaacgaactcacaccggcgaaaaaccctacgagtgcggcgagtgcggcaagctgttccggcaatccttctccctggtggttcaccaacgcattcacaccacagctaggccctacgaatgcggccagtgtggaaaatcattttcactgaagtcaaagctcgtgaggcatcagaggactcacaccggagaacgaccgtttgagtgttccgagtgcggcaaattttttcggcagtcctataccctcgtcgaacaccagaaaattcacaccggacttagaccatatgactgcggccaatgtggcaagtccttcattcagaagtccagcttgattcaacaccaggtggtgcatactggggaaaggccatatgaatgtggaaagtgcggtaagagcttcacccaacacagtggcctgattctccacaggaagagccatactgtttag

SEQ ID NO: 21564 - DNA, 1419 bp, Artificial Sequence
  Description of Artificial Sequence: Synthetic coding sequence
atgggcttcacccagggctgcgtgaccttcgaggacgtggccatctacttttcccaagaggagtggggtttactcgacgaggcccagagactgctctatagggatgttatgctggaaaatttcgcactgattactgcgctcgtgtgttggcatggcatggaagacgaggaaacgcctgagcagtcggtttccgtagagggcgtgccacaagtcaggacgcccgaggcttcacccagcactcagaagattcagtcatgcgatatgtgcgtgccattccttacagacatactccatttgactgacctccccggccaggagctctatctgacaggagcttgcgcggtgttccaccaggaccagaagcatcactctgccgagaagcctctggagtcagatatggataaagccagctttgtgcagtgttgccttttccatgaaagtggcatgcccttcacttcaagcgaagtaggaaaggacttcttggctccccttggtatcctacagcctcaggccattgcaaattacgagaagcctaataaaatttcaaagtgcgaggaggctttccacgtcggtatctcacactacaagtggtcccagtgcaggcgagagtcatcacataaacacaccttcttccacccccgtgtctgtacgggtaagagactgtatgagagttcgaagtgcggcaaagcctgttgctgtgaatgcagcctggtacaactccaaagggtgcatcccggtgagcggccctacgagtgtagcgaatgtgggaagtccttctctcaaaccagccatctgaacgatcaccggagaatccacacaggagaaaggccctatccttacgagtgcggggagtgcgggaagctgtttcggcaatctttcagcctagtagttcatcagcgcattcataccaccgcacgcccctatgagtgcggccagtgcgggaagagcttcagcttgaagtgcggactgatccaacaccaactgattcactccggtgcaagacctttcgaatgcgacgaatgcggcaagtctttttctcaacggaccacccttaataagcatcacaaagtacacacggcggaacggccttatgtctgtggagagtgcgggaaggccttcatgtttaaatcaaaactcgtgaggcatcagcgaacgcatactggggaaagaccattcgagtgctccgagtgcgggaagttttttcgtcagtcttatacgcttgttgagcaccagaaaatccatactgggttacgaccctacgactgcgggcagtgcggaaagtccttcatacagaagtctagtctgattcaacatcaggtcgtgcatactggcgagagaccatacgaatgcggaaagtgtggtaagtcatttacgcagcacagcggcttaattttgcatcggaagagtcacacagtctag

SEQ ID NO: 21565 - DNA, 1728 bp, Artificial Sequence
  Description of Artificial Sequence: Synthetic coding sequence
atggccgccgccgccccccggcggcccacccagcagggcaccgtgactttcgaggatgttgctgttaatttctctcaagaagagtggtgcctgctgagtgaggcacagagatgcctgtatagggacgtgatgttggaaaatctcgcgcttataagttctttgggatgctggtgtggctcaaaggatgaggaagccccgtgcaagcagcggattagtgtgcagagagaatctcagtcgaggactcctagagccggggtcagtccgaagaaagctcatccgtgcgagatgtgtggcttaatcctggaagacgtgttccattttgcagaccaccaagaaactcatcataaacagaagctcaaccggtcaggggcatgtgggaagaacctagatgacaccgcatatctccaccagcatcagaaacagcatattggggagaagttctatcggaagtcagtacgtgaggcttcttttgtgaagaagcgcaaattacgagtttcccaagagccattcgtgtttagggagttcgggaaggatgttctcccgtcatccggcctctgtcaggaagccgctgctgtggagaagacagacagcgagacaatgcatggccctccgttccaggaaggaaaaacaaactattcctgcggcaaaaggaccaaggcctttagcaccaaacactcggttattccccaccaaaagctatttaccagagatggctgctacgtgtgttcggattgtggtaagtccttctcgcgatacgtcagcttcagcaaccaccagcgggatcacacagctaaggggccgtatgattgcggggagtgcggcaagtcctattctcgtaagtccagccttattcagcaccagcgagtgcatacgggtaaaacagcttatccgtgtgaggagtgcggtaaaagcttcagccaaaaaggctccttaatctcgcatcagcgggttcacactggggaaagaccgtacgaatgtcgcgaatacggtaagtctttcggacaaaaggggaacctgatccagcaccagcagggtcatacgggtgaaagagcctatcattgtggcgagtgtggtaaatcatttcgtcagaagttctgctttatcaaccaccagagagttcataccggcgagagaccctacaaatgcggcgagtgcggtaaaagcttcggacagaaaggaaacctggtgcagcaccagagagggcataccggcgagcgcccctatgaatgtaaggaatgtggaaagagtttccgatatcggtcccacctgaccgagcaccagagactgcacactggggagaggccttataactgtcgcgagtgcggaaaactgttcaacaggaaataccatctgctcgttcatgagcgggtgcacacaggtgagcgcccgtacgcatgcgaagtttgtggaaaactgtttgggaataaaaattgtgtgaccattcaccagcgcattcacactggcgagaggccctatgagtgcaatgagtgcggcaagtccttcctaagcagctcagctctccacgtccataagcgagtgcactccggccagaagccgtataagtgtagtgaatgcggcaaatccttcgctgagtgctcgagcctgatcaagcatagaagaattcacaccggtgagcggccctacgagtgcacaaaatgcggaaagactttccaaaggtcatccacgctcctgcaccaccagagcagtcaccgcagaaaggccctgtag

SEQ ID NO: 21566 - DNA, 1131 bp, Artificial Sequence
  Description of Artificial Sequence: Synthetic coding sequence
atgcacggcccccccttccaggagggcaagaccaactacagctgcggaaagaggacaaaagcctttagcaccaagcactcagtgattccccaccagaaactgttcacaagagatgggtgttacgtgtgctccgattgcggtaagtcattcagcagatacgtgagtttttcgaaccaccagagggaccataccgccaaaggcccttacgactgcggcgagtgcggaaagagctattcacgcaagagtagccttattcagcatcaacgagtacataccggaaagacagcctacccgtgtgaagaatgtgggaagtccttctcccagaaaggcagcctaatttctcatcaaagagtgcatacaggcgaaagaccctacgagtgtagggagtacggcaagtcttttggccagaaaggtaatctgatacaacaccagcaggggcatactggggagcgcgcttaccattgcggggagtgcggcaagagcttcagacagaagttctgcttcatcaatcatcagagagttcacaccggggagcgtccatacaaatgtggcgaatgtggaaagagctttggtcagaagggcaatttggtgcagcatcagcgcggacacactggagaacgaccttatgagtgtaaggaatgtggaaagagcttccgatataggagccacctcactgagcaccagcgcctgcacactggcgagcgtccctataactgcagagagtgcggaaagttattcaacagaaaatatcacctgctggtgcacgaaagggtacatactggcgaacggccgtacgcctgcgaagtttgcggaaaattgtttgggaacaaaaactgtgtcaccatccatcaaagaatccacacgggcgaaaggccgtacgaatgtaacgaatgcggaaagtctttcttgtcctcttcagctttgcacgtccacaaacgagttcactcgggacagaaaccgtacaagtgttctgagtgtggcaagagcttcgctgaatgttcaagcttgattaaacatagacgcatccataccggggagagaccttatgagtgcaccaagtgtggaaaaactttccagagatccagtacgctgcttcatcatcagagcagtcatagacgaaaagcactctag

SEQ ID NO: 21567 - DNA, 2031 bp, Artificial Sequence
  Description of Artificial Sequence: Synthetic coding sequence
atgcagggcaccgtggccttcgaggacgtggccgtgaacttcagccaggaggagtggtcactgctctctgaggttcagcggtgtttatatcatgacgtgatgctggaaaactgggtactgatatctagtctaggttgttggtgtggctctgaagatgaagaagccccttcgaaaaagagcattagtatccagcgagtctcgcaagtgtctaccccaggcgcgggcgtctcccccaagaaggctcatagttgcgagatgtgcggggctatcctcggcgacatcctccatctggccgaccaccagggaacgcatcacaagcagaagttgcacaggtgcgaagcctggggcaacaaactgtacgattctagcaatcgcccacaccagaatcagtatttgggggagaagccgtatagatcaagcgtcgaggaggctctgtttgttaagcgctgcaagttccacgtcagtgaagaatcatctattttcatccaatcagggaaagacttcttgccaagctctggacttctgctgcaggaagctacacacaccggagagaagtcaaatagcaagcccgaatgcgaatccccatttcagtggggagatactcactactcatgtggagaatgtatgaaacatagcagcaccaagcacgtgtttgtccagcagcagcggcttcccagccgcgaagagtgttactgctgggaatgcggcaagagtttctctaaatacgactctgtgagtaatcatcagcgcgtccatacaggtaaacgcccatacgagtgtggagagtgcggtaagtccttttctcacaagggaagcttggtacaacaccagcgggttcacaccgggaagcgaccctacgaatgcggagaatgcggcaaatcctttagccataaaggctccctggtgcagcatcaaagagtgcacaccggcgaacggccgtacgagtgcggagagtgcggaaagtccttcagtcaaaatggtacactgattaaacaccagcgagtgcataccggcgaacgaccctatgaatgcgaagaatgtggcaaatgctttacccagaagggtaacctcattcagcaccagcgcggacacacttcggagcgtccctacgaatgcgaagagtgcgggaaatgctttagtcagaaagggacattgaccgagcatcatagggtgcacacccgggagaggccatacgaatgtggcgaatgtggtaagagcttcagccggaaaggtcacctccgcaaccaccaacgcggccacaccggggagcgtccatatgagtgcggtgaatgtggcaaatcatttagcagaaaaggcaacctgatccaacatcagcgcagtcacacaggcgagcgtccctacgagtgtagagagtgccgcaaactgttccggggcaaaagtcacctgatcgaacaccagcgtgttcatactggagagcgcccttacgaatgtaacgagtgtggaaagtcattccaggacagttccggattccgggtccatcagagggtccatactggcgagaagccgtttgaatgcagcgagtgcggcaagtcgttcccccagagctgcagtctgttgcgccacagacgggtgcataccggtgagcgcccttacgaatgcggggaatgcggaaaatccttccaccaatctagttccctgctcagacatcaaaaaacacatacagctgagcgcccctatgagtgtcgagagtgtggcaagttcttttcgtccctcctggagcacagaagagtgcatacaggcgaacgtccctacgagtgcagggagtgcgggaagacgtttactcgccgatccgctcactttaaacaccagcgcctacacacacggggcaaaccgtacgagtgttctgagtgcggcaagtcctttgcagagacattttccttgaccgagcacagaagagtccatacaggagaaagaccatatgagtgctcagagtgcgggaaatctttccataggtcctcctctctgcttcgtcatcaacgggtgcacaccgagaggtcgccatataagtag

SEQ ID NO: 21568 - DNA, 2094 bp, Artificial Sequence
  Description of Artificial Sequence: Synthetic coding sequence
atgcaggagggcctgcaccggatgacctgggactgcatcgccatcggcagccatgaaaattctgtccagggtactgtcgcctttgaagacgtagctgtgaattttagtcaggaagagtggagtctactgtctgaagtccagcgctgcctctaccacgacgtcatgctggaaaactgggtgttaatcagcagtctgggctgctggtgcggaagcgaggacgaggaggcacctagcaagaaatccatatccatacagagggtgagccaggttagcacacccggcgctggcgtgtccccaaaaaaggcgcattcttgcgaaatgtgtggagcaattctgggggacattctccatctcgccgatcaccagggcactcatcacaaacagaaattacaccggtgcgaggcgtgggggaataaactatatgactcatcgaatcgaccacatcaaaatcaatacctaggtgagaaaccctaccggtcatctgtagaagaggcattgttcgttaaacgttgcaaatttcatgtctcggaagaatcttctatctttatccagtctggcaaggattttctcccttccagtggcctgctgttacaagaggccacccacacaggggagaaatcaaacagcaagcctgaatgtgaatcgccattccagtggggggacacccactactcatgcggggagtgcatgaagcatagcagcacgaaacatgtgttcgtccagcagcaacggttgccatcgcgcgaggaatgttactgctgggagtgtggtaaatcattctccaaatatgatagtgttagcaaccaccaacgtgttcacacaggtaaacgaccatatgagtgcggtgagtgcggtaagtctttcagtcataaggggagcttagttcagcaccagagagttcatacaggcaaaaggccttatgaatgcggcgagtgtggaaagtccttttctcacaaggggtcactggtccaacatcagcgtgttcacacgggcgaacgcccatacgagtgcggagagtgcggtaagagcttctctcagaatgggacgttgatcaaacaccagcgggttcatactggtgaaagaccctatgagtgcgaggagtgtggcaaatgctttacccagaaaggaaatctgatccagcaccagcggggccatacatccgagcgcccctacgagtgcgaagagtgtgggaaatgtttttcccagaaggggaccctgacagaacaccacagagtgcatactcgtgaaaggccctatgagtgcggggaatgtgggaagtcattcagtaggaaaggacatctgcggaaccatcaacgcgggcacaccggagaacggccctatgaatgcggcgaatgcggtaagtccttttccagaaaaggaaacctgatccagcaccaaaggtctcacaccggggaacgaccatacgagtgtcgagaatgtcgcaaactgttcagaggtaaatcccaccttatcgagcaccaaagggtgcacactggcgaacgcccatacgaatgtaatgaatgcggtaaaagttttcaggattcctcaggtttcagagtgcaccagagggtgcacacaggcgagaagccctttgagtgctcggagtgcggaaagtcattcccccaaagttgctccttgttgagacatagaagagtccatactggagaacggccctatgagtgcggggaatgtggcaagtcttttcaccagagttcctccctcctgcgtcaccagaaaacacataccgccgaaaggccttacgagtgtagggaatgtggcaagtttttttctagtctgttagagcacagacgggtccatactggagagcgaccctacgagtgcagagagtgcgggaaaaccttcactcggcgcagtgcccatttcaaacaccagagactgcatacgcggggaaagccttatgagtgctcagagtgcggaaagtcatttgctgaaactttttcattgactgagcacaggagggtgcataccggagagcgaccctacgagtgtagcgaatgtggtaagagtttccatcggtcttcatccctgctgcgccatcagcgcgtccacaccgagagatcaccatataaatag

SEQ ID NO: 21569 - DNA, 1929 bp, Artificial Sequence
  Description of Artificial Sequence: Synthetic coding sequence
atggccgccgccgccctgcggctgcccgcccaggtggtgggcgtggaccagaagatgcgacgccatctgctgaggagggcttttctgtataaagaatgcctgcgctccgccctgttggggcaggtgagccccaaaaaggcccatagctgtgagatgtgtggagccatccttggggacatcctgcatctcgccgaccaccaagggacccatcataagcagaaactacatcgctgtgaagcctggggtaacaagctgtatgacagcagcaatagaccacaccagaatcagtatctgggggagaagccttatagaagcagcgtggaagaggcactctttgtgaagaggtgcaaatttcatgtgtccgaagaaagtagcatcttcattcagtccggcaaggacttcctgccttctagcgggctcctgcttcaggaggccacccacactggagagaagtcaaatagcaagcctgaatgtgagtcccctttccagtggggagatacccactattcctgcggcgaatgcatgaagcattcgtccactaaacacgtgttcgtgcagcaacagcgcctgcctagccgagaggagtgctattgttgggagtgtggtaaatcattctcaaagtacgatagcgtttcaaatcaccagagggtgcacacgggtaaacggccatatgagtgcggtgagtgcgggaaaagctttagtcataagggctcacttgtgcagcaccagcgcgtgcataccgggaagaggccttatgagtgcggggagtgcggtaaaagcttttcacacaaggggagcttagtacaacaccagagggtgcatacaggcgagcgaccctatgagtgtggtgagtgcggcaagtccttctcgcaaaacgggaccttgatcaaacaccaacgggtgcatacaggcgagagaccctacgaatgcgaggagtgtgggaagtgttttacacagaagggtaacctgatccagcaccagcgcggccacacatcagaaaggccatatgaatgcgaggagtgtggcaaatgttttagtcagaaagggacattaacagagcatcatcgggtgcacactagagagagaccgtatgaatgcggagaatgcggcaaaagtttttcacggaagggccacctccgcaaccaccagcgagggcacacaggcgagaggccatatgaatgcggggaatgcggaaagtcattttcgcgcaagggcaacctcatccagcatcagagatctcataccggcgaacgcccgtatgagtgcagagaatgtagaaaactatttcgaggtaaaagccatctgatcgagcatcagcgcgtgcatactggcgaaaggccatacgaatgcaatgaatgtggtaaatccttccaagactccagcggatttagagtccaccagagagtgcacaccggcgaaaaacccttcgaatgttccgaatgtggtaagtctttcccccagtcatgcagtctcctgagacacaggcgggtgcataccggagaacgcccatatgaatgtggtgagtgcggaaagtccttccatcagtcctccagcctgctccggcatcagaagacacatactgctgaacgaccttacgaatgcagagagtgtggaaaattcttctcttctctgcttgaacaccggcgtgtgcatacgggagaacgaccttatgagtgtcgggaatgcggcaagacattcacacgccggtccgcgcattttaaacaccagcgtctccacacgcggggaaaaccctacgagtgcagcgaatgtggtaagagttttgccgaaactttctctctcaccgagcaccgcagagtacacacgggagagcgcccctatgagtgttccgaatgtggcaaatcattccataggagttcttccttgctgcggcaccagagggtgcatacagagagatctccatacaagtag

SEQ ID NO: 21570 - DNA, 1083 bp, Artificial Sequence
  Description of Artificial Sequence: Synthetic coding sequence
atgcccgagctggtggtgaccgccctgctggcccccagccggctgagtctcaaattactcagggcattcatgtggtccctggtgtttagtgtggcactagtggctgccgctgtgtatggttgcatcgccctgacccatgtgctgtgtaggccgaggagaggatgctgcgggcgacgtagatccgccagccctgcctgtctttcagatccttctctcggagaacacggatttttaaacttgaagtcatcaggtctacgcctccactacgtgagcgctggtcgagggaacggacctctgatgctgttcctacatggtttccccgagaactggttcagttggcggtatcagctgcgagagttccagagcagattccatgtagttgcggttgacttaaggggatatggcccctccgacgctcctagagacgtggactgctacactatcgatttgctactggtggacatcaaagacgtgatattaggcctgggctactccaaatgcattttagtagcccacgattggggcgccctcttagcctggcatttttcaatatactaccctagcctcgtggaaagaatggtagtggtcagcggagccccaatgagtgtctatcaagattactccctccatcatatcagtcagttcttcaggtcacattatatgtttttgtttcaactcccatggcttccagaaaagctgctttctatgagtgatttccagattctcaaaaccactttaacgcaccggaagacagggatcccctgtctgaccccctctgagctcgaagccttcttgtacaatttttcccaacctgggggcctgactgggccactgaattactaccgaaatttgtttaggaactttcccttggagccccaggagctgaccactccaaccttgttactgtggggggaaaaggatacctacctcgaactgggactggtggaagctattggtagcagattcgttcccggccggcttgaagcccacatcctccccggcatcggccactggatcccccaatcaaacccccaggagatgcaccagtatatgtgggcgtttctgcaggacctgctggattag

SEQ ID NO: 21571 - DNA, 1290 bp, Artificial Sequence
  Description of Artificial Sequence: Synthetic coding sequence
gaccccgtgcagggctacgtgaccttcgaggacgtggccgtgtacttctctcaggaagagtggaggctccttgacgatgctcagaggttattataccgaaatgtcatgcttgaaaacttcaccttgttggcttccctcggaaaacaccccgaactgggatcagccttcccaccctttcctcgagagagatccctcgcagtcagcctcatggatctgattccgggaggcctgagtgtccagctgtcccatcagtgcgactgttgtttgaccgtgttgtttctggtgctacacgtgagcccttcccatcaacagaacccatcggcagtggcttttactgagtgtgtcgttgtagggatggaaaggctgctgagcagcaacattcagcagcaccaaaaacaacattgcggagagaagcctctcaagcgccaagagggccgagtgccagtgctccgctcttgcaaagtgcacttgagcgaaaaatccctgcagagtcgagaggtgggcaaggctctgctaatttcgagtggcgttctgaagcatcaagtcacacataccggcgaaaagagtcaccgatctagcaagtcacgagaggcgttccacgccggcaagcgacactacaaatgttccgaatgcgggaaagcctttggacagaagtacctactagtgcagcatcagcgactccacaccggagagcggccgtatggctgttccaattgtggaaagtctttctctaggaatgcccacctcatcgaacaccagcgagtccacactggggaaaaacctttcacctgtagtgagtgcggaaaagccttcagacataattctaccctggtacaacatcataagatccacaccggtgttcgaccctacgaatgtagcgaatgtggaaaacttttcagctttaatagcagcctgatgaagcaccagcgcatccatacaggtgagcgcccttacaaatgttccgagtgtgggaagttttactcacacaagtcaaacttaatcaagcattggcgggtgcacaccggggagcgcccatataagtgcagtgattgcggcaaatttttcacccaatgctcctcgctcatgcagcaccagaaggtacatacaggtgaaaagccattcaaatgcaacgagtgcggcaggttcttcagggaaaatagcaccctcgtacgccatcaaagggttcataccggtgccaagccctacgagtgcagggagtgcggtaaatttttcagccaatcgagtacattgatgcaacaccggaaagtgcacataggcgagaaaccctag

SEQ ID NO: 21572 - DNA, 1437 bp, Artificial Sequence
  Description of Artificial Sequence: Synthetic coding sequence
atggccgccgccgccctgcgggaccccgcccaggtgcccgtggccgccgacttgttgactgatcacgaggaacagggctacgtgacttttgaggacgtagccgtctatttcagccaggaggagtggagattactggacgatgctcagcgtcttttgtatagaaatgtgatgctggaaaacttcactctgctcgcttccctgggttgttggcatggtgccgaagctgaagaggcacctgaacaaattgctagcgtcggactgttaagcagtaacatccagcagcatcagaagcagcactgcggagaaaaaccacttaaacggcaggagggccgcgttccagtcctcaggtcttgcaaggtgcacttatctgagaagtcactgcagtctcgtgaggtgggtaaagcactcctgatcagtagcggggttttaaagcaccaagtcactcataccggggagaagtcgcacaggtcgtctaagtcacgcgaggcctttcacgctgggaaaaggcattataaatgctctgaatgtggaaaggcctttggtcagaagtatctgttagtacagcatcaacggctgcatgcaggcaagaagacgtatgagtgcagtgagtgtggcaagctttttcgagatatgagcaacctgttcatacaccagatcgttcataccggggaacggccctacgggtgcagcaattgtgggaaatctttctcgaggaacgcgcacctgattgagcatcagagagtgcacacaggggaaaagccttttacgtgcagtgaatgtggaaaggccttcaggcacaatagcactctggttcagcatcacaagattcacaccggcgtcagaccatatgagtgcagtgagtgcggcaagctgttttctttcaacagctctctgatgaaacatcagcggatccacacaggagaaaggccttacaaatgttccgagtgtggcaagttttatagtcacaagtcaaatctaattaaacattggcgggtgcacacaggcgaacggccatacaaatgcagcgattgcggtaagttctttacccagtgcagttcactcatgcaacatcagaaagtccacaccggggagaaaccgtttaaatgtaatgagtgtggccggttctttagggaaaattctacactggtgcgccaccagcgggtgcacacaggtgctaaaccctatgagtgtagagaatgtggcaagtttttttcccagtcatctacactgatgcaacaccgaaaagtccacatcggggagaaacccttcaagtgcaatgagtgtggacgcctgtttcgcgaaaactccagtctcgtcaagcaccagcgagtccacacaggggccaaaccatacgagtgtagggaatgtggcaaattcttccggcataacagctctctcttcaagcaccggcggatccacaccggggagatgcagtag

SEQ ID NO: 21573 - DNA, 1329 bp, Artificial Sequence
  Description of Artificial Sequence: Synthetic coding sequence
atggccgccgccgccctgcgggaccccgcccagcagggctacgtgactttcgaggacgtcgccgtatacttctctcaggaagagtggcggctactggacgatgctcaacggcttttgtaccgtaacgtgatgctggagaatttcactctgctggcttccctcggacttgcctcttctaagacccacgaaataacgcagctggaatcttgggaggaacccttcatgccagcctgggaagtcgtgacatctgccatcccgcgcggctgttggcacggtgccgaggccgaggaagcccccgaacaaattgcctccgtaggtctgttgagctcaaacattcaacagcatcagaaacagcactgcggggaaaaaccactaaaacggcaggaggggagggtgcccgtgttaaggtcttgtaaggtgcacttgtctgagaagagcctgcaaagcagagaagtcggcaaggcactgctcatctcgtccggggtgctcaaacaccaggtcacccatactggcgagaagagccacaggtcttcgaagtcaagggaagccttccacgccggaaaacgccactacaagtgctccgagtgtggcaaggcttttggacagaagtacctcctcgtgcagcaccagaggctgcacgcagggaaaaaaacctacgaatgctcggaatgcggaaagctcttcagagacatgtccaatctgtttatccatcaaatcgttcatacaggggagagaccttacggctgcagcaattgcggaaagtctttttctagaaacgcacatttgattgagcaccaaagagtgcatacaggagaaaaacctttcacgtgctccgagtgtggtaaggccttccgtcacaattcaacattagtccaacaccacaagatccataccggggtcaggccatatgagtgctcggaatgcggtaaactcttctcctttaattcttccctgatgaagcatcagcgcattcatacgggagagaggccatataaatgttcggaatgtggaaagttctatagtcacaagtctaacttgatcaaacactggcgcgtacacaccggcgaaaggccctataaatgttcagattgcggcaaattctttacccagtgtagctccctaatgcagcaccagaaagtccatactggagagaaaccatttaagtgtaacgaatgtggacggtttttcagggaaaactcctctctggtaaagcatcagagggttcatacaggcgccaagccatacgagtgtagggaatgtggtaagtttttccgccacaacagctccctattcaagcatcgcaggatccacaccggcgagatgcagtag

SEQ ID NO: 21574 - DNA, 1395 bp, Artificial Sequence
  Description of Artificial Sequence: Synthetic coding sequence
atggccgccgccgccctgcgggaccccgcccagggctacgtgaccttcgaagatgtcgccgtttatttttcccaggaggagtggcggcttctggatgacgctcagaggttactctacagaaacgtgatgctggagaactttactttgctcgcctctctcgggtgctggcacggagccgaagccgaagaagcacctgaacagatagcctctgtgggcctgctttcaagcaatatccaacagcaccaaaaacagcattgtggagaaaagccactaaaaaggcaggaggggagagtgcctgtactcaggagttgtaaagttcaccttagcgaaaaaagcctccaaagccgtgaagttggtaaagctctcttgatctcttctggcgtgttgaaacaccaggtgacccatactggagagaagagccacagaagttctaagagtagggaggctttccacgccggcaagcggcattataagtgttccgagtgtggaaaggctttcggacagaagtacctgttggtgcagcatcagcgcctccatgcagggaagaagacatacgaatgctccgagtgcggcaagttgtttagggacatgtcaaatctttttatccatcaaattgtgcatacgggagagcggccatatggatgcagcaattgtggcaagagtttttcacgtaacgctcatcttatcgagcaccagagagtccacacgggtgagaagcccttcacttgtagcgaatgcggtaaggctttcaggcacaattcaactttagtccagcatcacaagattcatactggtgtgcgaccctacgagtgcagcgaatgtggcaaattatttagcttcaacagctctctcatgaaacaccagagaatccataccggagaaaggccatataagtgtagcgagtgcgggaagttctacagccacaaatctaatcttatcaaacactggcgcgtccacactggcgaacgcccttataaatgttccgattgtggaaagtttttcacccaatgctcaagcctgatgcagcaccagaaggtgcacactggcgaaaagccttttaaatgcaacgagtgtggtaggttcttccgggaaaacagcacgctggtgcgtcaccaaagagttcacacgggcgccaaaccctacgagtgccgggagtgcggcaaatttttcagtcagtctagtactctgatgcaacacaggaaggtccatataggtgagaagcccttcaagtgcaatgagtgcgggcgtttgtttcgggagaattctagcttagtgaaacaccagcgcgttcacaccggcgccaaaccctacgaatgcagggaatgcggcaaattctttagacacaacagtagcttatttaagcatagaagaattcatacaggggaaatgcagtag

SEQ ID NO: 21575 - DNA, 1536 bp, Artificial Sequence
  Description of Artificial Sequence: Synthetic coding sequence
atggccgccgccgccctgcgggaccccgcccaggtgcccgtggccgccgacctgctgacggaccacgaagagcagggttacgtaacatttgaggacgtggctgtatacttttcgcaggaggaatggcggttgcttgatgacgctcagcgactcctgtacagaaatgtcatgctggaaaacttcacattgctggcgtcgctgggcctcgccagctctaagactcatgagatcacccaacttgagtcctgggaggagccttttatgcccgcatgggaagtggtgactagtgcaatcccccgcggctgttggcacggcgctgaggcagaggaagccccagagcagatagcctctgtcggcttactatcgtctaacatccagcaacatcagaagcaacactgtggcgagaagccgctcaagaggcaggaggggagggtgccagtgttgaggtcttgtaaggtccatttgagcgagaagagcctgcaatcaagggaggttggtaaagccctcctgatctcctctggcgtcctcaaacaccaggtgacgcacacgggcgagaaatctcacagatcgtctaaatcccgcgaggcctttcacgccggaaaaaggcactacaagtgctcagaatgcgggaaggcttttggtcagaaatacctgctggttcaacatcaacgattacatgcagggaaaaagacctacgaatgttcagagtgtggaaagctcttcagagacatgtcaaacctcttcatccatcaaatagttcacactggcgaaaggccttatggctgtagtaattgcggcaagagtttttccagaaatgcccatctcatcgaacatcaaagagtgcacaccggggaaaaacctttcacatgttcagaatgcggtaaagcctttcgtcataattcgaccttggtccagcaccataagatacatacaggcgtgcgcccatatgagtgttcagaatgcggcaagcttttttcctttaactctagcctgatgaaacaccagaggatccacactggggagcgcccgtacaaatgcagtgaatgcggaaagttttactcgcacaaatctaacctcattaaacattggcgagtccataccggagagaggccatataaatgtagtgattgtggcaagtttttcacgcagtgctcgtctctcatgcagcaccagaaggtgcacaccggggaaaagcctttcaaatgcaatgaatgcggccggttcttcagagagaattctactctggtgaggcaccaacgtgtgcacactggggccaagccctacgagtgccgggaatgtggtaagtttttcagccagtccagcactctgatgcagcatcggaaggttcacataggagaaaaacctttcaagtgcaatgagtgcggcagactgttcagggaaaactcctccctcgtgaagcaccaacgtgtccataccggtgccaaaccatatgaatgccgcgaatgcggcaaattctttcgtcacaattcctccctgtttaagcaccgtcgaatacacacaggtgagatgcagtag

SEQ ID NO: 21576 - DNA, 1497 bp, Artificial Sequence
  Description of Artificial Sequence: Synthetic coding sequence
atggccgccgccgccctgcgggaccccgcccagcagggctacgtgacatttgaggacgtcgcggtatacttttcccaagaggagtggcgtctcctcgatgacgcccagagattgttgtaccgcaatgtaatgctcgaaaattttactctactcgccagcctaggcctggccagctctaaaacccatgagatcactcagttagaatcttgggaagaaccttttatgcccgcgtgggaagtggtgacctctgccatccctcgcgggtgttggcatggagcagaagccgaagaggcgccagagcagattgcttctgttggtcttctgagttcaaacattcagcagcatcagaaacaacactgcggcgagaagcctctgaagcgtcaggaaggtcgggtccccgtgctgcggagttgcaaggtccatctttcagagaagtctttgcaatcccgcgaggtaggcaaagcgctgctgataagctctggcgttctgaaacatcaagtgactcacacgggcgagaaatctcatcgttccagcaagagccgtgaagcatttcatgccgggaaacgacattacaaatgttctgagtgtgggaaagcatttggacagaagtacctgctcgtacaacaccagcgcctacacgccggaaaaaagacttatgaatgtagcgaatgcggcaaattatttagggacatgagcaacctatttattcaccagattgtacatactggtgaacgcccatacgggtgtagcaactgtggaaaatctttctcccggaatgcacacctgattgagcaccagcgagtgcacaccggggaaaagccattcacctgctctgaatgcgggaaggcattcaggcacaactcaactcttgtacagcaccataagatacacaccggcgtcagaccttatgagtgttctgagtgcggtaagctcttttcattcaatagttccctgatgaaacaccagcgcattcatacaggagaacgcccctacaagtgtagcgagtgcggaaagttctactctcacaaatcgaacctgattaagcactggcgggtgcatactggtgagaggccatacaaatgctccgactgtggtaagttctttacacaatgctcatcactgatgcaacatcagaaagttcacactggggagaaacccttcaaatgtaatgaatgcgggcgcttctttagagaaaatagtactctcgttcgacatcagcgcgtccataccggcgcgaaaccttatgaatgtcgagaatgtggcaaattcttttctcagagcagtaccttgatgcagcaccgcaaagtgcatattggcgagaaacctttcaaatgtaatgaatgtggtagactgttccgggagaatagtagtttagttaagcaccagagagtccacaccggagccaagccatatgagtgccgcgaatgcggtaaattttttaggcacaattcatccctgttcaagcatagaaggatccatacaggtgagatgcaatag

SEQ ID NO: 21577 - DNA, 477 bp, Artificial Sequence
  Description of Artificial Sequence: Synthetic coding sequence
atggccgccgccgccctgcgggaccccgcccaggtgcccgtggccgcagacctcctaaccgaccacgaagaagggtacgttacgttcgaggatgttgcagtgtacttcagtcaggaggaatggcgcctgctggacgatgcccagcgcctgttgtacaggaacgtcatgctcgagaactttacccttctggcctccctggggtgctggcacggcgccgaggctgaggaagcacccgaacagatcgcatccgtcgggctgttggaagttctcgcgaagcagggaggatgttcaggaaagaagacttacgaatgtagcgagtgtggcaagctgtttagggatatgtccaacctcttcattcaccagattgtgcacacgggggagcgtccctacgggtgtagcaactgcggcaagagctttagccgcaacgcacatctgattgagcatcagagggtccacacaggcgagaagcctttttag

SEQ ID NO: 21578 - DNA, 1494 bp, Artificial Sequence
  Description of Artificial Sequence: Synthetic coding sequence
atggccgccgccgccctgcgggaccccgcccagggctacgtgacctttgaagatgtcgccgtgtatttcagtcaagaagagtggcgcctgctcgacgacgcccagcgtctgctttaccggaatgtaatgcttgagaattttacactgctggcctcactaggtctcgcgtcttcaaaaacacacgagataacgcagctggagtcctgggaggagcccttcatgcctgcctgggaggtcgtgactagtgcaataccgcgaggatgttggcacggtgctgaggcagaagaggctccagagcagattgcttcagtgggacttttgtcatctaacatacaacagcaccagaaacaacactgtggggagaagcctttaaaaaggcaggaaggccgcgtgcccgttttgaggtcttgtaaagtccacttgtccgagaaaagtttgcagagcagggaggttgggaaggccctgctcatttcttccggtgtcctgaaacaccaggtgacccacacaggggaaaagtcccacaggagcagcaagtcccgcgaggcctttcacgctggaaagcggcactacaagtgcagcgagtgtggaaaggcttttggacagaagtacctgttggttcaacaccagcgcttacatgctggaaaaaagacttacgagtgctctgagtgcgggaaactgttccgcgacatgtcaaatctgttcattcaccaaattgtgcacacaggtgagagaccgtacggatgttcaaattgtgggaaatccttctctagaaacgcacacctgattgaacaccagcgagtccacaccggcgagaaaccgtttacttgctcagagtgtgggaaggcgtttagacataacagtaccctggtgcaacaccacaaaatacacactggtgtgcgtccatatgagtgctctgaatgtggtaaactcttttcctttaacagctcactaatgaaacaccagaggattcatacgggagagaggccctacaaatgtagtgagtgtggaaagttctacagccataaaagcaacctcatcaagcattggcgggtccatactggtgaacggccctacaaatgctccgattgcggaaagttcttcactcaatgcagtagcctgatgcaacaccagaaggtgcacacaggcgaaaagcctttcaaatgcaacgagtgtgggaggttcttccgagagaatagtaccctggtgagacaccaacgcgtccacacgggggccaaaccctatgagtgccgggagtgcggcaaatttttcagtcagagctccactctgatgcagcaccgaaaggtgcatattggagaaaagccattcaaatgtaacgagtgtgggcggctgttcagagagaactcttcactagtgaagcaccagcgcgtccacactggtgccaaaccctatgagtgccgtgaatgtggtaaatttttcagacacaactctagcttgttcaagcatcgtaggatccacaccggcgagatgcaatag

SEQ ID NO: 21579 - DNA, 1335 bp, Artificial Sequence
  Description of Artificial Sequence: Synthetic coding sequence
atggccgccgccgccctgcgggaccccgcccaggtgcccgtggccgcagacttactcacagatcacgaggagcagggctacgtcacattcgaggacgtcgcagtttatttttctcaggaggagtggcgcctcctcgatgacgcccagaggctgctctatcgcaatgtgatgctggaaaactttaccctgctcgcctctttgggcctcgcttcctccaagacccacgaaataacccagctcgagagctgggaagaacccttcatgccagcttgggaagtcgtgacctcagctattcctcggggatgttggcacggggctgaggcagaagaggcaccggaacagattgctagcgttggcctgctgtcctcaaatatccagcagcaccagaaacagcactgcggcgaaaaaccacttaaacgtcaagaggggagagtgcccgtccttcgatcttgcaaggtgcatctctcggaaaaaagtttacagtctcgggaggtcggtaaagcactgctgataagctctggagtactgaaacatcaggttacacacactggcgagaaatctcatcggtcatcgaagtctcgcgaagccttccacgccggtaaacgtcattataaatgcagcgagtgcggcaaggccttcgggcagaaatatttgttagtccagcatcaaagacttcatgcaggtaaaaagacttacgagtgcagtgagtgtggtaaactgttccgcgacatgtcaaatctgttcattcatcagattgtgcatacaggcgagaggccgtacggatgttccaattgtggtaagtccttctcgcgtaacgcgcacctcatcgaacaccagcgggtccacaccggtgaaaagccattcacctgttcagaatgcggtaaggcattccggcacaatagcaccctggtacagcaccataagatacatacgggtgtgcgtccgtacgagtgtagcgaatgcggtaagctgttctcattcaattcaagcctgatgaagcatcagagaatccacacaggagaacgcccctataaatgttccgagtgcgggaagttctactcccacaaaagtaaccttatcaaacactggagagttcatacaggagaaagaccttacaagtgctcagactgcggtaagttctttacccagtgctcttccctgatgcagcaccaaaaagttcatacgggcgagaaaccattcaagtgtaacgaatgcggtcggttctttagggagaactcaacccttgtgcgccatcagcgagtgcacaccggagccaaaccctatgagtgtagagagtgtgggaagttctttagccagtcaagcactctgatgtag

SEQ ID NO: 21580 - DNA, 366 bp, Artificial Sequence
  Description of Artificial Sequence: Synthetic coding sequence
atggccgccgccgccctgcgggaccccgcccagcagggctacgtgacatttgaagacgtggccgtctacttctcgcaggaggaatggcgtctgttggatgatgcccagagactactttatcggaatgtaatgctggaaaatttcaccctccttgcaagcctgggctgctggcatggggcagaagcagaggaggcaccggaacagatcgcatcagttggtttgctatcaagcaacattcagcagcaccagaagcagcactgcggcgagaagcctttgaaacggcaggagggcagagtccctgtcctcagatcctgcaaggtccacctatcggaaaaaagcctgcagtcccgagaagtcggaaaatag

SEQ ID NO: 21581 - DNA, 408 bp, Artificial Sequence
  Description of Artificial Sequence: Synthetic coding sequence
atggccgccgccgccctgcgggaccccgcccagcagggctacgtgacattcgaggatgtggccgtctatttttcccaggaggagtggaggctgctggacgatgcacagcgtcttctgtaccgaaacgtgatgctggagaatttcactctacttgcaagcttgggattagccagctctaaaactcacgaaatcactcagttggaatcttgggaagagccatttatgcctgcctgggaggttgtgaccagcgccattcctcgcggctgctggcatggggctgaggccgaggaagcacccgaacagattgcctctgtgggtttgttaagcagcaatatccagcagcatcagaagcagcactgtggtgagaagcctcttaagaggcaggaggggcgcgtgccggttctttag

SEQ ID NO: 21582 - DNA, 1611 bp, Artificial Sequence
  Description of Artificial Sequence: Synthetic coding sequence
atggcccggaagctggtgatgttccgggacgtggccatcgacttcagccaggaagaatgggaatgcctcgatagcgcccagagggatctctatcgcgacgtaatgctcgagaactatagcaatctcgtctcactcgacctgccatctaggtgcgccagcaaggacctgtcccctgaaaaaaacacctatgagacagagctatcccagtgggagatgtcagatcgcctggagaactgtgacctcgaggaatccaatagccgggactacctagaagccaagggcaagatggaaaagcagcaggaaaatcaaaaggagtatttcaggcaaggaatgattatttatgacaaaatgagcattttcaatcaacatacatacctgtctcaacattctagatgccactccaccgaaaagccatataaatgcaaagaatgtggcaaggctttcagaagggcatcccatctaacccagcaccagagcattcacacaggggagaaaccatatgagtgtaaacagtgcggcaaggcttttagtcgcgactcccagttgtcacttcaccagagactgcatacaggagaaaagccctacgcgtgtaaagagtgcgggaaagccttcactcagagtagccaacttatccttcatcaccgcatccatacaggcgaaaaaccttataagtgtgaagagtgcggcaaggcttttatcagatcatctcagcttacccgccaccagaaagtgcatacgggggaaaagccttacgagtgtaaagagtgcgggaaagcttttacccagaactcacagctgacccttcaccagcggttgcatactggcgaaaagctgtacgaatgcaaagagtgtcgcaaagtcttcacgcagctcagtcagctcatactgcacaaacgcattcacaccggagagaagccatatgaatgcaaggagtgcggcaaagcattcatttgcggttcccagctgtctcagcaccagaaaattcacaatggagaaaaaccctacgagtgtaaagaatgtggccgggccttcatcagaggcagcctgctcatgcagcaccaacggatccataccggagagaaaccttacaagtgtgaggagtgcggcaaggctttcattcgtggctcccaattaacccaacaccaacgcatacacactaatgagaaaccatacgaatgtaaagagtgtggcaagatgttctcccatggctctcagctaacccagcaccaaagaatacacaccggagaaaagccctaccagtgcaaagaatgtggaaaggcctttaatagaggcagtctgttgacaagacaccagaggatacacacaggggagaagccatatgagtgcaaggagtgcggtaagactttctctagaggatctgaactgacccaacacgagcgcatccacacagcttttctagccggccaacaagaccgttccgatatttacatgtcacggagattcacaaaaagtatctttcctgtctttttctctgttcctaccatgtggacatccaagctggaactccggtattctcacggggattttgaaaatggcatctgggtactgtggattatggaacagaaatacagacggtccctgcagccgtag

SEQ ID NO: 21583 - DNA, 2067 bp, Artificial Sequence
  Description of Artificial Sequence: Synthetic coding sequence
atggcccggaagctggtgatgttccgggacgtggccatcgacttctcccaggaggagtgggagtgcctggactcggcccagagggatctgtatcgtgacgttatgttggaaaactactccaacttggtttctctggatctgccttcccgctgcgccagtaaggatctttcaccagaaaaaaacacgtatgaaaccgaattgagccagtgggagatgagcgacaggctggaaaactgtgatctagaggaatccaattctcgggactatcttgaggctaaaggcaaaatggagaagcaacaagagaaccagaaggagtatttccgccaaggcatgatcatttacgataaaatgtccatatttaatcagcatacttacctcagccagcattccagatgtcactctacagagaagccatacaagtgcaaggagtgcggtaaagccttcaggcgagcctctcatctcacccagcaccagagcatccataccggagagaaaccttacgaatgcaagcagtgcgggaaagcattcagtagggatagtcagctgagcttgcaccaacgcctgcatacgggtgaaaagccctacgcgtgcaaggagtgtgggaaagccttcactcagagttctcagctcatcctgcaccacagaattcacaccggggagaagccttataaatgcgaggaatgcggcaaggcatttattcgtagttcacagctgaccagacaccagaaggtgcatacaggcgagaagccatacgaatgcaaagagtgcgggaaggcgttcacacagaattcacagctgaccctgcaccagcggttgcataccggcgaaaaactttacgagtgcaaagagtgcaggaaagtgtttacccagctcagtcagctgatactgcataagaggatccataccggagaaaaaccgtacgagtgcaaggaatgcgggaaggctttcatctgcggctctcagctatcccagcaccagaaaatccacaacggggaaaaaccctacgaatgcaaggagtgtggtagagcattcatcagagggtctctgctgatgcagcaccagcgcattcacactggtgaaaagccttacaaatgtgaagagtgtggcaaggccttcatcaggggaagtcagctgacacagcaccagcgaattcataccaatgagaagccgtatgagtgcaaggagtgcgggaagatgttttctcacgggtcccagctgacccagcatcagcgcatccacaccggcgaaaaaccgtaccaatgcaaggaatgcggcaaggccttcaatagaggcagtcttctgactaggcatcagagaattcacacaggtgagaagccctacgagtgtaaggagtgcggtaagactttctccagagggtcggagcttactcaacacgagaggattcataccggggaaaaaccttatgaatgcaaggagtgcggcaagtcattcattagaggcagccaattaacccagcaccagaggatccacaccggtgaaaaaccatacgagtgcaaggaatgccggatggcattcacacagtcatctcatctcagccagcatcaacgtctccataccggtgaaaagccttatgtgtgcaatgaatgtgggaaggcattcgcgcgtgggctgctgttgatccagcaccagcggatacacaccggcgagaagccatatcagtgcaaagagtgcgggaaggcattcatccggggctcccagctgacacagcaccaaaggattcacactggagagaaaccatatgagtgcaaagaatgcggtaaagccttttcgcacgggtcacagctgacactgcatcagcggattcataccggagagaagccttacgagtgtcgggagtgcagaaaagcttttacccaatccagccacctttcacgccatcagcggatacataccggagagaagccttaccagtgtaaggagtgcggcaaggctttcacccgaggcagtcagttaacgcagcatcagcgtatacatatcagcgagaagagtttcgaatacaaagagtgtggaatcgacttttcccacgggagccaagtctacatgtag

SEQ ID NO: 21584 - DNA, 1665 bp, Artificial Sequence
  Description of Artificial Sequence: Synthetic coding sequence
atggccgccgccgacctgagccacggccactacctgagcggcgaccctgtgtgtcttcacgaagaaaaaacccctgccggacgcattgtggccgactgcttgactgactgttaccaggactcagtcaccttcgatgatgtggccgttgacttcactcaggaagaatggactttgctagatagtactcaaaggagcctatactccgacgttatgctggagaactacaaaaacctggccactgttggaggccagatcataaagccctccctgatatcctggcttgagcaggaggagtccagaactgtgcaaggcggagtgttacagggctgggagatgcggctcgaaacccagtggagcattctgcagcaagatttcttgcggggtcagacgagcatcggtatacaactcgaaggtaagcacaatggacgcgagctttgtgactgcgagcagtgtggagaggtcttttctgaacatagctgccttaaaacccatgtccgtacccagagtaccggcaatacccacgattgtaaccaatacggaaaggactttctcaccctttgcgaaaaaaccagcaccggcgagaaattgtctgagttcaatcagagtgagaagattttcagcttgaccccaaatattgtataccagagaacatcgactcaggagaaatcctttgagtgttcacattgtggaaaatcattcatcaatgagagctatttacaggcccatatgagaacccataatggggagaagctttatgaatggaggaattacggtcccggtttcattgactcgaccagcttgtccgtactgattgagacgctgaatgctaagaaaccgtataagtgcaaagaatgcggtaaggggtaccggtaccccgcatatttgagtattcatatgcgtacacatactggcgaaaagccctatgaatgtaaagaatgtggcaaagctttcaactattccaatagctttcagatacacggacgtacccacaccggggagaagccctatgtgtgcaaggagtgtggtaaggctttcactcagtactcaggcctgtccatgcacgttcgcagccattccggcgataaaccgtacgaatgtaaggagtgtggcaaaagttttttgacgagcagccgtttgatacagcacatacgaacacatacgggagagaagccatttgtatgcgtggagtgcgggaaagcgttcgccgtttcctccaacctgtctggccatctcaggacacacacagaagagaaagcctgtgagtgtaaaatttgcggcaaagtcttcggatatccttcttgcctcaataatcatatgcgtacccactccgctcaaaagccctacacctgcaaagaatgcggcaaggcatttaactattccactcacctcaagatccacatgaggattcacactggagaaaagccatatgaatgcaaacagtgtggaaaggccttttctcacagctcatcctttcagatacacgagcgtacacacaccggcgaaaaaccctatgagtgcaaggagtgcggcaaagcgttcacatgttctagcagtttccgtatccatgagaaaacacatacagaagagaagccgtataaatgtcaacaatgcgggaaagcttatagccacccgcggagcctgagaagacacgaacaaatacattag

SEQ ID NO: 21585 - DNA, 1665 bp, Artificial Sequence
  Description of Artificial Sequence: Synthetic coding sequence
atggccgccgccgacctgagccacggccactacctgagcggcgacccagtgtgcctgcacgaggaaaaaactcctgccggacgtatagttgcggattgcctgactgattgttatcaggacagcgtcactttcgacgatgtcgccgtggacttcacgcaggaggaatggaccctcctggactctactcagagatcgctgtacagtgatgttatgctggaaaattacaaaaatcttgcgaccgtggggggccaaattatcaagcctagccttatcagttggctggaacaggaggaatcgcgaacagttcagggcggcgtgctccagggatgggaaatgcggcttgaaacccaatggagcatattgcagcaggactttctgaggggccagacttctataggaatccaactcgaggggaaacacaacggacgcgagttgtgcgattgtgagcagtgcggggaagtcttcagcgagcatagctgcctgaaaacccatgtgcggactcagtccacaggtaacactcacgattgtaaccagtacgggaaggactttctgaccttgtgtgaaaagacctcaacgggggagaaattatccgagtttaaccagagtgagaagatcttttccctcacccctaacatcgtgtaccagcgaacaagcacacaggagaaatctttcgagtgtagtcattgcggcaagtctttcatcaatgagtcatatctgcaggcacacatgcgtacccataatggagaaaagctgtatgaatggcggaattatgggcctggtttcatcgactccacctctctctcagtgctgattgagacactgaacgccaaaaaaccttataaatgcaaagagtgcggcaagggttacagatatcccgcctacctctctattcacatgcgaacacatacaggcgagaagccatacgaatgcaaagaatgtggaaaggcgttcaattacagcaactcattccaaatccacggacgcacacacacaggagaaaaaccttacgtgtgtaaggagtgtgggaaagcctttacccaatactccggcttatctatgcacgtgaggagccactccggcgacaaaccatacgaatgtaaggaatgcgggaagagcttcctgaccagtagccgcttaattcaacacatcagaactcacaccggtgaaaagccatttgtgtgcgtagaatgtggaaaggcctttgctgtgagctctaacctgagtggacacctgcgtacgcacaccgaggaaaaagcctgtgaatgtaaaatctgcggaaaggttttcggctatccgtcctgcctcaacaatcacatgcggactcactctgctcagaagccctacacatgcaaggagtgcggtaaagccttcaattactctactcacctgaagattcatatgcgcatccataccggtgagaagccatatgaatgcaagcagtgcggtaaagcgttttcgcactcaagcagctttcaaatccacgaacgaacacacacaggagagaaaccatacgagtgcaaagaatgcgggaaagcctttacttgctcctcaagctttcggattcacgagaagacacatactgaagagaagccctacaagtgccagcaatgtggaaaggcttactcccatcccaggagccttcgtaggcacgaacaaatccactag

SEQ ID NO: 21586 - DNA, 1626 bp, Artificial Sequence
  Description of Artificial Sequence: Synthetic coding sequence
agcgacggcgacatcaacgagcggcgggtgctgacccggagccacctggctgggtggcaattactgatctgtccgatggacagtgtgacattcgatgatgtggccgttgattttacccaagaggaatggaccctactcgacagtacacagcgttcattgtatagcgatgtgatgctcgagaactataagaaccttgcaaccgtcggcggacagataattaagccctccctgatcagctggctggagcaggaggaaagccggaccgttcagggaggcgtgctccagggctgggagatgcgccttgaaacccagtggtctattctgcagcaggacttcctgcgtgggcaaaccagtataggcatccaactggagggtaaacacaatggacgggaactgtgtgactgtgaacagtgcggcgaggtgttcagcgaacattcctgtctgaaaacccatgtgaggacccagagtaccggcaacacacatgattgcaaccagtacggaaaggatttcctgacgctctgcgagaaaaccagcactggggagaaactcagcgagttcaaccagagcgaaaaaatcttctcgctgaccccgaatatcgtgtatcagcgcacttccactcaggaaaaatctttcgagtgtagtcattgcggaaaaagtttcatcaatgagtcctatttacaggctcacatgcgcacacacaacggggaaaagttgtatgaatggcgaaactacggacccggattcatagattcaacatcgttgtccgtactcattgaaactctgaacgctaagaaaccctacaagtgcaaggagtgtggcaaaggctatcggtatcctgcctacctgagcattcatatgcggacccacaccggggaaaaaccttacgagtgtaaggagtgtggcaaagctttcaattatagcaatagcttccagatccacggccggacacacacaggggagaaaccatacgtgtgcaaggagtgtggcaaagccttcacacagtatagcggactgtccatgcatgtacgctcccacagcggcgataaaccttacgaatgtaaagaatgcggcaagtccttccttactagcagtcgcctgattcagcatatcaggacccacaccggagagaagcctttcgtgtgcgtcgagtgcggcaaggccttcgcagtcagctcaaacctgtctgggcacctgaggacccatacagaagagaaggcatgtgaatgtaaaatttgcgggaaggtttttggataccccagctgtcttaataaccacatgagaactcatagtgcgcagaaaccttacacttgtaaggagtgcggcaaggccttcaattacagcacacatctgaaaatacatatgcggatccacacaggcgagaagccttacgaatgtaaacagtgtggaaaagccttctcacattcttcttcttttcagatacacgagagaacccatacaggggaaaagccatacgaatgtaaggaatgtgggaaagcatttacatgtagttcctcattccgcatccacgaaaaaacccatacagaggagaagccctacaagtgtcaacagtgcggaaaggcttacagccatccacggtcattgcgcagacacgagcagatacactag

SEQ ID NO: 21587 - DNA, 2025 bp, Artificial Sequence
  Description of Artificial Sequence: Synthetic coding sequence
atgggccccctgaccttcaccgacgtggccatcgagttcagcctggaggagtggcagtgcctagataccgcgcaacagaacctgtaccgcaatgttatgctggaaaattacaggaacctggtgtttctaggcattgctgtgagcaagcctgatctgattacgtgcctcgagaaggaaaaagagccgtgcaagatgaagcgccacgagatggtagatgaacctcccgtggtctgttctcacttcgcggaggacttctggcctgaacaggacattaaagacagctttcagaaggtgactctgcggcgatacgacaaacgaggtcatgagaatctgcaactgcgaaaaggctataagactgttggggattgcaaactgtataaaggagggtataatggacttaaccagtgtctgacactcacacaaagcaagatgtaccactgtgacatctacgtgaaggtgttttatgctttcagcaacgcagaccggtacaagactcggcacaccggcaaaaaaccttttcaatgtaagaaatgcgggaaatcgttttgtatgctctcccaactaacccaacacaaaaagatacacatcagagagaacacataccggtgtaaagaattcggcaatgcgttcaatcagtcgtccgctttgaccaaccacaagcggatttatgtgggtgagaaacactataggtgcgaggagtgcggtaaagctttcaatcactactctacactgaccaatcacaaaagaattcacactggggagaaaccctacaagtgtaaagaatgcgggaaagctttctcccggtactccacattgacaacccacaagcgaatccactctggagaaaagccttataaatgtgacgagtgcgggaagacattttctatcagcagcaccttcacaaagcacaagatcatccacactgaggagaagccttacaaatgtaaggaatgtgggaaagcattcaatcgatcttccaccctgacaagtcacaagaggatccacactggcgagaaaccctataagtgcgaggagtgcggcaaagcctttaattggtccagcaccttaaccaaacataaggttattcacaccggcgaaaagccttacaaatgcgaggagtgcggaaaagccttcaatcagagctcccgcttaactaggcacaaaaaaattcataccggcgaagagccatacaagtttgagaaatgcggcagggtctttacctgtagttctaccttgacgcaggacaaaaaaatacataccggggagaagccatataactgcgaagaatgcggtaaagtgtttacgtattcttcaacactcactcgccataagagaatccataccgaagagaaaccctataaatgcaacgagtgcggaaaggcttttaatagatcaagccaccttaccagccatagaaggatccacaccggtgagaaaccatataagtgcgaggagtgtggcaaggcctttaagcagtcaagtaatctgaactcccataagaagatccactctggcgaaaagccttataagtgcgaagaatgcggcaaagcctttatccttagctcacggctgacccaacacaagaaaatacacacaggcgagaagccctacaagtgcgaggagtgtggaaaggccttcaatcgatcatcaaggttaacccagcataagaagattcacaccggtgagaagccttataagtgcaagcaatgcgacaaagcttttacgcactcaagtaacttgagttctcataaaaagatccactctggagagaagccatataagtgcgaggaatgtggtaaagctttcaaccgcagcagtcgcctgacacaacacaaaaaaatccacactagagagaaaccttacaagtgcgaggaatgcgctaaggcatttacccgcagctcccgattgacccagcacaagaagatccaccggatgggggtggtggcacacgcctgcaaccccagcacactgggaggacgcggcggccgaatcactcgatccggagaccgagataggccaggatag

SEQ ID NO: 21588 - DNA, 1731 bp, Artificial Sequence
  Description of Artificial Sequence: Synthetic coding sequence
atggacgacctgaagtacggcgtgtaccccctgaaggaggccagcggctgcccgggggcagaaaggaatctcctggtgtattcttacttcgagaaggaaactttaacctttcgcgacgtcgcgatcgaattttccctcgaggagtgggaatgcctgaaccctgcgcagcagaatctttacatgaacgtcatgctggagaattacaagaatttggtctttcttggagtcgccgtctcaaaacaagatcccgttacgtgtttagagcaggagaaggagccatggaacatgaaacggcacgagatggtggacgagccccccgcaatgtgcagctacttcacgaaggacctctggcctgaacaagacattaaggattcgtttcaacaagtgatcttacgccggtacggaaagtgtgaacacgagaacctgcagctgagaaaaggttctgcctccgtcgatgaatacaaagtacataaagagggctataacgagctgaatcagtgtttaaccactacacaatccaaaatctttccatgcgacaagtacgtcaaggtgttccataaattcctgaatgctaatcggcacaagacaagacatacaggcaaaaagccattcaaatgtaagaaatgtgggaaatccttctgcatgctgctccacttgagccagcataaaagaatacacatccgtgaaaacagttaccagtgtgaagagtgtgggaaggcgtttaaatggttctctacgctgaccagacataagcgaatccacaccggtgaaaaaccctttaaatgcgaggaatgcgggaaagctttcaagcagagctccacactcaccacacacaaaattattcatacaggtgaaaaaccatatagatgcgaagaatgtggaaaggcgttcaatcggtcctcacatctgaccacacataagatcatacacaccggggaaaagccttacaaatgcgaagagtgtgggaaggccttcaaccagagctccacactctcaactcacaagttcatccatgccggcgagaagccatataagtgcgaggagtgtgacaaggcattcaaccgttttagctacttgaccaagcacaagattatacacaccggtgagaaaagctacaaatgcgaagaatgcggaaaaggattcaactggagtagcacactcacaaagcacaagcgcatccatacgggggaaaagccctacaaatgcgaagtttgcggcaaggctttcaatgagagctctaatctgaccacccacaaaatgatccatacaggggaaaagccctacaaatgtgaagaatgtgggaaggcattcaataggagcccccagcttaccgcccataaaattattcacaccggtgagaaaccctacaagtgtgaagaatgtggaaaagccttttcccagagcagcatcctgactacgcataagcggatccatacaggagagaagccctataagtgcgaggagtgcggcaaagctttcaacaggtcctccaatctgactaagcacaaaattatccatactggtgaaaagagttacaagtgcgaggaatgcggaaaggcgtttaaccagagttccacattaactaagcacagaaagattcacaccaggcagaagccctacaattgtgaggagtgtgataacacctttaatcagtcatcgaaccttattaagcagaataattcctactggagagagacgctccagatgtctcggatgtgggaaagcttatag

SEQ ID NO: 21589 - DNA, 1563 bp, Artificial Sequence
  Description of Artificial Sequence: Synthetic coding sequence
atgccccagctgagcctgagcagcctgggcctgtggcccatggccgcctctccctggctactcctccttctcgtgggcgcgtcctggctgctggcgcgcatactggcctggacttacacattttacgacaactgttgccgcctgcggtgttttccccagcctccaaaacgtaattggtttctcgggcacctgggcctcatccattcttctgaagagggattgctttacacgcaaagcctcgcttgtacttttggagacatgtgttgttggtgggttggtccgtggcacgcgattgtgaggatctttcatccaacgtatatcaagccagtcctcttcgcgcccgccgccatcgtacctaaggacaaggtgttctatagctttctcaagccctggttgggagatggtttgctgctaagcgctggagagaaatggagcagacatagaagaatgctcactcccgcctttcactttaacattctgaaaccatacatgaagatcttcaacgaatccgtcaatatcatgcacgcaaagtggcagctcttggcttcagagggatcggccagactggacatgttcgagcacatttccttgatgactttggattccctccagaagtgcgttttcagctttgactcccactgtcaagaaaagccgagcgaatacatcgccgccattctggaactctcagccctggtgactaaacgccatcagcagatcctcctttacatcgactttctgtattaccttacacccgatgggcagcgcttcaggagagcatgccgcctggtccacgatttcaccgacgccgtgatccaggagagaaggcgcactctcccaagccaaggagtggatgacttccttcaggccaaagctaagtcaaagaccttagatttcattgatgtgctattgctgtcaaaagatgaggatgggaaaaaactgtctgacgaagacattcgcgccgaagccgatactttcatgttcgaaggacatgatactaccgccagtggcttgtcctgggtgctgtaccatctggcaaagcaccctgagtaccaggagcggtgccgacaagaggtacaagagctgctgaaagaccgcgagcccaaggaaatcgagtgggacgacttggcccaactcccatttctgactatgtgtatcaaggagagcctacggttgcaccctcccgtgccggccgtttcccggtgttgcactcaggatatcgtgctgcccgacggccgggttatcccaaaaggaataatctgtctgatttccgtttttggtacacaccataacccagccgtttggccagacccagaggtgtatgacccatttcggtttgaccctaagaacatcaaggaacgcagccctcttgccttcataccattctccgccggtcctcgtaactgcattggtcaggcgttcgctatggcagagatgaaggtagtccttggactgaccctgctaagattcagagtgctcccagatcacacggaaccccgaaggaagccagagttagtgttaagagccgaaggcggcctgtggctgagggttgagcctctctcctag

SEQ ID NO: 21590 - DNA, 2022 bp, Artificial Sequence
  Description of Artificial Sequence: Synthetic coding sequence
atgatgttccaggacagcgtggccttcgaggacgtggccgtgaccttcacgcaggaagagtgggccctgcttgatccctcacagaagaacctttgtagggatgtaatgcaggaaactttcaggaaccttgctagcattggcaaaaagtggaaacctcaaaatatctatgtcgagtatgaaaacttgcgtagaaacctgcgaattgtgggtgaacggctctttgagtcgaaagaaggtcatcagcacggtgaaatactgactcaggtgcctgacgacatgctcaaaaagaccaccactggtgtgaaatcctgcgagtcttccgtttacggtgaggttggtagcgcacactcatccttgaacagacacatcagggatgatactggccacaaagcgtacgaataccaggaatatggtcagaagccgtataagtgcaagtactgtaaaaagccgttcaactgcctctcttctgtacagacccatgagagggcccacagtggccgaaagctgtatgtatgtgaagagtgtggcaaaacctttatcagccactccaacttgcagaggcatagaatcatgcacaggggagatggcccatacaaatgcaaattttgtggaaaggcccttatgttcctcagcctgtacctgatccacaaacggactcacactggcgagaaaccataccaatgcaaacagtgcggaaaagcattctcacatagttcttcactccgtattcatgagaggacacatacaggcgagaaaccatataaatgcaacgagtgcggcaaggcctttcattcgagtacttgtctgcacgcacacaaaaggacgcacacaggcgagaaaccgtatgagtgtaagcaatgcggaaaggccttctcctcctcacacagcttccagatacacgagcggacgcacactggagagaagccctacgaatgtaaggagtgtggcaaggcttttaagtgcccctcttcagtgcgacgccacgagcggacgcacagccgaaaaaagccctacgaatgcaaacactgtgggaaggtgctctcatacttaaccagctttcagaaccacctcggtatgcacacaggtgagatctcccacaaatgtaagatctgtggtaaagccttctacagtccttcttcactccagacccacgaaaagacacacactggtgagaaaccatataaatgtaatcagtgtggcaaagccttcaacagcagttctagctttaggtatcatgagcgcacccacaccggtgagaaaccatatgagtgcaagcagtgtggcaaggcgttccgctcggcctcgctgttacaaactcatggccgcacccacactggagaaaagccatatgcttgcaaggaatgtggtaagccttttagcaatttttccttttttcagatccacgaacgaatgcacagggaggagaaaccctacgagtgcaaaggttatggaaaaaccttctctctcccctcactctttcaccggcatgagcgaactcacacaggggggaaaacctacgagtgtaagcagtgtggccgcagtttcaattgctcgtctagcttccgctaccacggtagaactcacactggcgaaaaaccatacgagtgtaaacaatgcgggaaagcctttcgaagcgcaagtcagctccagattcatggaagaacacacaccggtgagaagccttatgaatgtaagcagtgtggaaaggcttttggatccgcttcccacctccagatgcatggccgtacacacactggggagaaaccttacgagtgtaagcagtgcggaaaatcatttgggtgcgcgtctcgactccagatgcatggaagaacacacaccggggaaaaaccatacaaatgcaagcagtgcggaaaggcatttgggtgcccctcaaatcttagacggcatggccgcacccacaccggcgagaagccctataagtgcaatcagtgcggcaaagtgtttagatgtagttctcagctgcaagtccatgggcgggcccattgcatcgatacgccatag

SEQ ID NO: 21591 - DNA, 1917 bp, Artificial Sequence
  Description of Artificial Sequence: Synthetic coding sequence
atgcaggagaccttccggaacctggccagcatcggcaagaagtggaaaccccaaaacatctatgtcgaatacgagaaccttagacgcaatctgcgtatcgtcggcgaaaggctgttcgagagcaaagagggccatcaacacggagagatactgacgcaggtgcctgatgatatgcttaagaagaccacaactggagtgaaaagctgcgaatcaagcgtctatggggaggtaggatccgcccactcctcactgaataggcacatccgggacgacacaggccataaggcttatgagtaccaggagtatggtcagaaaccttacaagtgcaagtattgcaaaaaacctttcaactgcttaagctctgtccagacacatgagagagctcacagcggcaggaagctgtatgtctgcgaggagtgcgggaaaacattcatttcacactcaaacctacagagacatcgcattatgcaccggggggatggaccatacaaatgtaaattttgcggcaaggccctgatgttcttgtcattatatcttatccataagcgtacccacacaggggagaagccttaccagtgcaagcagtgtggaaaggctttctcacacagctcaagtctccgtatacatgagaggacccacacaggagaaaaaccctacaagtgtaatgaatgcgggaaggccttccattctagcacttgccttcatgcccacaagcgcacccataccggcgaaaagccatatgaatgtaaacagtgtggaaaagccttctcatcatcccattctttccagatccatgagcgaacccataccggcgagaaaccttacgaatgcaaggagtgcggcaaggcgttcaaatgcccatctagcgttagacgtcacgagcgtacgcactcacgtaagaagccctatgagtgtaaacactgtgggaaggtactcagttatttaaccagctttcagaaccacttgggcatgcacactggtgagatctctcacaagtgtaaaatatgtggaaaggctttctattcccccagcagcctccaaactcatgaaaagacccatacaggagagaaaccttacaaatgtaaccagtgtgggaaggcatttaactcttccagctcttttcgataccatgagcgaacccacacgggcgagaagccatacgaatgtaagcaatgtggaaaggccttccggagcgcctctcttctgcagacgcacggacgcacccataccggagagaaaccttatgcctgcaaagaatgtgggaaaccgttctccaatttcagtttttttcagatccacgagcgcatgcacagagaggaaaaaccgtatgagtgtaaggggtatgggaaaacatttagtctgccatcactgttccatcggcatgagagaacgcatactggaggcaaaacatacgaatgcaaacagtgcgggaggtcatttaactgctccagttctttccgctatcatggccggacccacacaggtgaaaagccgtatgagtgcaagcagtgcggaaaggccttcaggagcgcaagccagctgcagattcacgggaggactcacaccggagaaaaaccctacgagtgcaaacagtgcggcaaagcgtttggatccgcctcccatttgcagatgcacgggaggacacacacaggggagaagccatatgagtgtaagcaatgcggaaagtctttcggatgtgcctctcgattacaaatgcatggacgtactcataccggcgagaagccctataagtgtaagcagtgcgggaaagcttttgggtgcccaagtaatctacggcgccacggccggacccatacgggggaaaaaccatataagtgcaatcagtgtggaaaggtgtttaggtgtagtagtcaacttcaggttcacggtagggctcactgcatcgatacgccctag

SEQ ID NO: 21592 - DNA, 159 bp, Artificial Sequence
  Description of Artificial Sequence: Synthetic coding sequence
atgcaggagaccttccggaacctggccagcatcggcaagaagtggaaaccgcagaacatatatgtggagtatgaaaacctaaggagaaacctccgtattgtgggagagcgacttttcgagtctaaggaaggacaccagcacggcgagatcctgacctag

SEQ ID NO: 21593 - DNA, 360 bp, Artificial Sequence
  Description of Artificial Sequence: Synthetic coding sequence
atgcaggagaccttccggaacctggccagcatcggcaagaagtggaagccacagaacatttacgtcgagtacgagaacctcaggaggaacctgagaatagtcggggaacggctgtttgagagtaaagaggggcaccagcatggcgagattctcacacaggtgccagacgacatgctcaaaaagacaacaaccggtgtcaaatcttgcgagagctcagtatacggagaagtgggaagtgctcactcttctcttaatagacacatcagggatgataccggtcacaaggcttatgagtaccaagagtacggacagaaaccgtacaaatgcaagtattgtaagaagccattcaactgtctgtag

SEQ ID NO: 21594 - DNA, 1458 bp, Artificial Sequence
  Description of Artificial Sequence: Synthetic coding sequence
atgcgggacaaccgggccgtgagcctgtgccagcaggagtggatgtgtcctggccccgcccagagagcgctatatcggggagcaacgcagcgaaaagacagccacgtgagtcttgctactggtgtcccttggggctatgaagaaactaagacactgctggcgattcttagctcctcccaattctatggaaaactgcagacgtgccagcagaatagccaaatttacagggccatggccgagggcctgtgggaacagggtttcctgcgcacccctgagcaatgcaggactaaattcaaaagtctgcagctgagttacaggaaagtaagaagggggcgcgtcccagagccgtgcatcttttatgaagagatgaatgcactcagcgggtcgtgggcctccgccccaccaatggcctcagacgcagtgcccggacaagaggggagcgacattgaggccggggagctgaatcatcagaacggcgagcccaccgaggtggaagatgggacagtggacggggcagaccgggacgagaaagatttccggaacccgggccaggaggttcgaaagctggatttacctgtgctcttccccaatcggctagggttcgaatttaagaatgagatcaagaaagaaaatctaaagtgggatgatagcgaagaagtggaaatcaataaagctcttcagcgaaagtctcggggcgtgtattggcatagcgaattacagaagggcctggagagcgaacctacttctagaaggcaatgtaggaacagcccaggtgaaagcgaagagaagaccccctctcaagagaagatgtcacaccaaagcttttgcgcccgtgataaagcgtgtacccacattttgtgtggaaagaactgtagccagtccgtgcatagtccacataagcccgctctgaaactagagaaagttagccaatgtccggagtgcgggaaaaccttctccaggtcctcttatcttgtcagacatcagcggatccacacaggcgagaagccccacaaatgttccgagtgcggcaagggcttctccgaacgatcaaacctaactgcccatcttcgaacgcataccggggagaggccctaccagtgtggccaatgtggtaagagcttcaatcagtctagcagtctgatcgtccaccagagaacacatacgggcgagaagccataccaatgcatagtttgcgggaagcgattcaacaacagctctcagttcagcgcacaccggaggatccacaccggggaatccccttacaaatgtgctgtgtgcggaaagatctttaacaattcatcacacttctccgctcataggaaaactcataccggggagaagccgtaccgctgttcccactgtgaacgcggcttcaccaaaaactcagccctgacccggcatcagacggtgcatatgaaggcggtgctttctagccaggaagggagggatgcattatag

SEQ ID NO: 21595 - DNA, 2094 bp, Artificial Sequence
  Description of Artificial Sequence: Synthetic coding sequence
atgatggccgccgtgaagagcaccgaggcccaccccagcagcaacaaagatcctacacagggtcaaaagtcggccctacagggaaatagtcccgactctgaagcctcacgtcaacggtttcgccagttctgttatcaagaagtgaccggaccccacgaagcatttagcaagctgtgggagttgtgttgtcagtggctgcggcccaaaactcacagcaaagaagagattcttgagctgttggtcctggagcagtttctgactatcctgcccgaagagatacagacctgggtacgagagcaacatcccgaaaacggtgaggaggccgttgccttggtcgaggacgtgcagcgggcaccgggtcagcaagtgctagactccgaaaaggacctcaaggtgctcatgaaggaaatggcaccacttggcgcaacacgggaaagcctaaggagccagtggaagcaggaagttcagcctgaagaaccaactttcaaggggtcacagagctcccaccagcgccctggcgagcagtctgaagcttggttggcaccacaggctccacgtaatctgcctcagaacactggacttcatgatcaggagacaggcgctgtggtgtggacggccgggagccaaggcccagcgatgcgagataatcgtgccgtctcgctgtgtcaacaggaatggatgtgtcccgggcctgcacagagagccctgtatcgcggcgctacccaacgtaaagattcacatgtcagtctggccaccggagtgccttgggggtatgaagagacaaagacccttctggcaatccttagtagctcccagttttacgggaaattgcagacctgtcagcagaatagccagatctaccgggcaatggcagagggcctgtgggaacagggtttcctgagaacaccagagcagtgcagaaccaagtttaagtcattacagctaagttaccggaaagtcagacgcggacgggttcccgaaccttgcattttctatgaagaaatgaatgctttgtccggctcgtgggcctctgcccctccgatggcctccgatgctgtgcctggacaagagggcagtgacatcgaggcaggcgagctgaaccatcagaacggggagccgaccgaggtggaagatggcactgtggacggcgccgatcgcgacgaaaaggatttccgtaaccccgggcaggaggtgaggaagctggacctgcctgtgctcttccccaaccgacttgggttcgaattcaagaacgagattaaaaaggagaaccttaagtgggatgattccgaggaagtggaaattaacaaagccctgcagcgcaagtcgagaggggtatactggcacagcgaactccagaaaggcctggaaagcgagcccaccagccgccggcagtgccgcaacagtccaggcgaatccgaagagaagactccctcccaagaaaaaatgagccatcagtcattctgcgctagggacaaggcctgcacacacatattatgtggcaaaaactgcagtcaatctgtccattcacctcataagcccgctctgaagcttgagaaggtcagccagtgccctgagtgcggcaagacattctcccgcagctcatatttagtgcggcaccagcggattcatacgggcgagaaaccccataagtgttctgagtgcggaaagggattttctgaaagatcgaacctcactgcacacctgaggacccatacaggtgaacggccctatcagtgtggccagtgcgggaaatctttcaatcaatcttcatccttaatcgtacaccagcgcactcatactggtgaaaaaccgtaccagtgtatcgtctgcggaaagagattcaataactcgagccagttttccgcacatcgccggatccatactggggaaagcccatacaagtgcgcggtgtgtgggaagattttcaacaatagctcccacttttcagctcacaggaaaacccacacgggagagaaaccatatcggtgttctcattgcgagagggggttcacaaaaaatagcgccttgacgcgccatcagacggttcatatgaaggccgtgctctcttctcaggaaggccgggacgctctgtag

SEQ ID NO: 21596 - DNA, 2094 bp, Artificial Sequence
  Description of Artificial Sequence: Synthetic coding sequence
atgatggccgccgtgaagagcaccgaggcccaccccagcagcaacaaggatcctacccaaggccagaagagcgctttacagggcaacagcccagattcagaggcctctcggcagcggtttagacagttctgctatcaagaagtgaccggtcctcacgaggccttctcaaagctgtgggaactgtgttgccagtggctgcgccctaaaacccattctaaagaggagatcctggaacttttagtgctggaacagtttctcaccatccttcccgaggaaatccagacctgggtgagggagcagcaccccgaaaatggggaagaagccgtcgccctcgtggaggatgtccaacgggctcctggacagcaggtactggacagtgaaaaagatctgaaggtgttaatgaaagaaatggcccctctgggagcgacccgcgagtcgcttagatctcagtggaagcaggaggtgcagcccgaggaacctaccttcaaaggcagccagagcagccatcaaagacctggagagcagtcagaggcttggctggcaccccaggctcctcggaacctgccacagaatactgggctgcatgaccaggaaactggcgccgtggtctggaccgccggctcacaggggcccgcaatgagagacaatcgagctgttagtctttgccaacaggagtggatgtgcccagggcccgcacagagagccctgtacaggggtgctacccagcggaaagacagccatgtatctttagcgaccggagtgccctgggggtatgaagagaccaagacactcctcgccatcctcagcagttcgcagttctatggtaagttacagacatgtcagcagaatagccagatttacagggcgatggccgaggggctgtgggaacaagggtttctgcgcacccctgagcagtgcaggacaaaatttaaaagcttacagctatcttaccgcaaggtacgacggggccgggtcccagagccgtgtatattttacgaggagatgaatgctctgtctggctcctgggcgagcgctccccccatggctagcgatgctgtgcctggtcaggaaggctcagatatcgaagctggggagttgaatcatcagaacggcgagcccaccgaggtcgaggatggtacagttgacggtgccgatagagatgaaaaggatttccggaacccaggccaggaagtccgcaaacttgatttgcccgttttgttccctaatagacttggctttgaatttaaaaacgagatcaaaaaagagaacttgaagtgggacgatagtgaagaggttgagattaataaggccctccagagaaagagcaggggagtgtactggcactctgagcttcagaaaggactcgagagtgagccgacttcaagacggcagtgccgcaatagtcccggagagagtgaggaaaaaactccgagtcaagagaaaatgagccaccaatcattctgtgcacgcgacaaggcttgcactcatatcctctgcggaaaaaattgcagccagtcagttcattcacctcataagccagcactcaagctggagaaggtttcgcagtgcccagaatgcgggaagacgttttcgcggtcatcgtatttggtcaggcaccagaggattcacacaggagagaaaccccacaagtgtagcgaatgtggaaagggcttcagcgagcgatccaatctcacagcgcatctgcgtacgcacaccggtgagaggccctaccaatgcggacagtgcgggaagtcctttaatcagagttccagcctgatcgttcaccaacgaacccacaccggcgagaagccgtaccagtgtattgtgtgtggaaagcgcttcaacaactcaagccagttcagtgcccataggcgtatccacactggcgaatccccatataagtgcgccgtttgtggaaagatattcaataattcctctcacttttccgctcataggaagacgcacactggcgaaaagccatatcggtgtagtcattgtgaaagaggattcacgaagaatagcgcattgaccaggcaccagaccgtgcacatgaaggccgtcctgtcctcccaggaggggagggacgcgctctag

SEQ ID NO: 21597 - DNA, 771 bp, Artificial Sequence
  Description of Artificial Sequence: Synthetic coding sequence
atggccgccgtgaagagcaccgaggcccaccccagcagcaacaaggatccaacacagggccagaaaagcgcgttgcaaggcaacagtccagatagtgaagcgtctagacagagatttagacagttctgctatcaggaagtgaccggaccccatgaggccttctccaagctgtgggaattgtgttgtcagtggcttagacctaagacccatagtaaggaggagatcctggaacttctcgtgctggagcaattcctgactatcctgccggaagaaatacaaacgtgggtgagggagcagcaccctgagaacggcgaggaggctgtggcgctcgttgaagatgtgcagagggcccccggccagcaggttctggactccgaaaaggacttaaaggtgctgatgaaagaaatggccccactcggggccacccgggaatctctccgcagtcagtggaagcaagaagtgcaaccagaagaaccaaccttcaagggaagccagagtagccaccagcggccgggtgagcagagcgaagcctggctggcccctcaagccccacgcaaccttcctcaaaacacgggcctgcacgatcaggaaactggcgcagtcgtttggactgctggaagccagggaccggccatgcgggacaatagagccgtttctttgtgccaacaggaatggatgtgccctgggccggcgcagcgagctttatatcgaggggctactcagagaaaggactcccatgtgtctctggcaaccggcgctttggggttatag

SEQ ID NO: 21598 - DNA, 648 bp, Artificial Sequence
  Description of Artificial Sequence: Synthetic coding sequence
atgcgggacaaccgggccgtgagcctgtgccagcaggagtggatgtgccctggacccgcccagcgcgccctgtatcggggggccacacagaggaaagactcgcatgtcagcctggctactggcgtgccctggggctacgaggagacgaaaacgctgctcgccatactgagctcatctcagttctacggaaagctacagacatgccagcaaaattctcaaatttacagggctatggccgaggggctgtgggagcagggatttctccgtactcccgaacaatgccggactaaattcaagtccctccagctgtcatacagaaaagtcagaagaggccgagtgcctgaaccgtgcatcttctatgaggagatgaacgcactctccgggagctgggccagcgcacccccaatggctagcgatgcagtaccaggacaagaaggcagtgatattgaggctggcgaactcaaccaccagaacggcgagcccacagaagttgaggatggcaccgtggacggggccgatagggacgagaaggactttcgaaacccaggtcaggaagtcagaaagctagacctgccagtgctttttcccaaccggttgggcaaaaccccattggcccttatggtgaagggctggcaatccccactgtag

SEQ ID NO: 21599 - DNA, 1227 bp, Artificial Sequence
  Description of Artificial Sequence: Synthetic coding sequence
atggccgagggcctgtgggagcagggcttcctgcggacccccgagcagtgcaggacaaaattcaagtcacttcagctgagctatagaaaagttcgcagaggccgcgttccggaaccctgtatcttctacgaagaaatgaatgctctctctggctcttgggccagcgctcctcctatggcttcggatgcagttcccggccaggaggggtccgacatcgaagccggagagctcaatcatcagaatggagaacccaccgaagtagaagatggaacggtggacggcgcagacagggacgaaaaagatttccggaatcctggacaggaggttcgcaagctggacctgcccgtgctgtttcctaatcgactgggcttcgagtttaagaacgaaataaagaaggaaaacctcaaatgggacgattctgaagaggttgagattaacaaagcactccagcggaagagcagaggagtctactggcattccgagttacagaaggggctggagtcagaacccacgagcagacgacagtgtagaaattctcctggcgagtccgaagaaaaaactccttctcaggagaaaatgtcccaccaaagcttctgtgctcgcgataaagcctgtacgcatattctgtgcggtaagaactgttcgcaatctgtccatagcccacataaaccggccctgaagctggaaaaagtgtcgcaatgtcctgaatgtggcaaaacattctcccgatcctcatatctcgtgcgccatcagcgaattcataccggcgagaaaccccataaatgcagtgaatgcggtaaggggttcagtgagaggtcaaatctcactgcccatctgcgaacacacacaggagaaagaccatatcagtgcggacagtgtgggaagagctttaatcaaagcagcagcctgatcgtgcaccagaggacccatacaggcgagaaaccctatcaatgcatagtgtgcggtaaaagattcaacaactccagccagtttagcgcacatagacgcattcacactggggagagtccttacaaatgtgccgtgtgcggaaaaattttcaataacagcagccatttctcagcccatcgcaagacgcatacgggggagaaaccctataggtgcagccattgcgaaagaggattcaccaaaaattcagcactcacaaggcatcagacagtccacatgaaagcagtcctctctagccaggaaggtagggatgctctatag

SEQ ID NO: 21600 - DNA, 2457 bp, Artificial Sequence
  Description of Artificial Sequence: Synthetic coding sequence
atggacagcgagagcaacatccccagcggcaccatccagagccggaaaggtctccagaacaaatctcagttcaggactatcgcaccaaagattgtgcccaaggtccttacaagtagaatgttgccctgccatagtccctcacgcagtgatcaggtgaatctgggaccttctataaacagcaaactgttagggatgtccactcaaaactacgcgctgatgcaggttgccgggcaagagggaacgttctctctcgtggcacttcctcacgttgcatccgcccagccaatccaaaagcccagaatgtctttaccagaaaatctgaagttgccaatacccaggtaccaacctccacgcaactccaaagcaagccgcaagaaaccgattctgatttttcccaaatcaggatgctccaaggccccagctcagacacagatgtgtccacagatgtccccatccccgccccaccacccggaacttttgtacaagcctagcccgtttgaggaagtcccgtctcttgaacaggccccagcaagtatctccacagctgctttgaccaatggatccgatcatggcgacctgcggcctcccgtcacaaatactcatggctcactaaatcctccagccacccccgctagtagcactcctgaggaacctgcgaagcaggacctcactgccttgagtggcaaggcacactttgtgtccaaaattacatccagcaagcccagcgcggttgcttcagagaaattcaaagagcaggtggacttggccaaaacaatgactaaccttagtcctactatccttgggaatgccgtgcagctgattagcagcgtcccgaagggaaagctgccaattcctccttactcacgcatgaaaacaatggaagtgtataagattaaatctgatgccaatattgccgggttcagtttgcccggacctaaagccgactgtgacaagatcccgtcaactactgagggattcaacgctgcgactaaagtcgccagtcggctaccggtgccacaagtgagccaacagtctgcatgcgaatctgctttctgccctcctactaagctcgacctgaatcacaagacgaaactgaactcaggggccgccaagaggaaagggcgaaaacggaaagttccagatgagattctggcattccagggcaagagacgtaaatatatcattaataaatgccgcgatggcaaagagagagttaaaaatgatccccaggagtttagggaccagaagctggggaccctgaagaaataccggtccataatgcctaaacccattatggtgatcccgaccctggcctcactcgctagtccaacgaccctgcaaagccagatgcttggcggtttgggtcaagacgttctgctcaacaactccctcacccctaagtacctcggttgtaagcaagacaattcaagcagccccaagccaagttcggtgtttaggaacggcttcagcgggatcaagaaaccgtggcacagatgccacgtgtgtaaccaccactttcaatttaagcagcatctgcgggaccacatgaatacccataccaacaggaggccttattcatgccggatctgccggaaatcctacgtgcgtcctggcagtctctcaactcacatgaaactccaccacggcgaaaaccgcctaaaaaagctgatgtgctgcgaattttgcgcaaaagtttttgggcatattcgcgtttactttggtcacctcaaggaggtacacagagttgtcattagcaccgagccagcaccaagcgaactccaacctggggatatcccaaagaaccgggatatgtccgtgcggggcatggaggggagtctggaacgagaaaacaaatcgaacctggaagaggacttcttactgaaccaggccgatgaggtgaaattacaaataaagtgtgggcgctgccagataaccgctcaaagctttgcggaaatcaaatttcatttgttggacgtgcacggcgaggagatcgaaggaaggctgcaagagggaacattccccggaagcaagggcactcaagaggaactcgtccaacacgcgagcccagactggaagcggcatccagagagaggtaagcccgaaaaggtccattcttcatctgaagagtctcatgcttgtcctcggttaaaacgacagctacacttgcaccaaaacggggtggagatgctgatggaaaatgaaggtccccagtcaggaaccaacaaacccagagaaacatgccagggtcctgagtgtccgggtctccacactttcctcctctggagccactcaggctttaattgtctactgtgcgcggagatgcttgggcgcaaagaagacttgctgcaccactggaagcatcagcacaattgcgaagatccttcaaaactgtgggccatcctgaataccgtcagtaatcaaggggttattgaattaagctccgaggccgaaaaatag

SEQ ID NO: 21601 - DNA, 2487 bp, Artificial Sequence
  Description of Artificial Sequence: Synthetic coding sequence
atgcagaacagcgtgagcgtgccccccaaggacgagggcgagagcaacattccctcgggcacgattcaatcgcggaagggcctgcaaaacaagtcccagttcaggacaatagcccctaaaattgtgcccaaagtgctgacttctaggatgttgccctgtcactctccttcccggagcgaccaggtcaacttaggcccctctattaactcaaagctgcttggaatgtctactcagaactacgccctgatgcaggttgcaggccaggagggcacattctccctggtggcgctaccacacgttgcttctgcacagcccattcagaaaccccggatgtcactgcctgagaatcttaaattgccaattcccaggtaccaaccccctcgcaatagcaaggctagtagaaagaagcccatactgatttttcccaaatcagggtgctctaaggcgcccgctcagactcagatgtgcccacagatgtcacctagtccccctcaccaccccgagctgctctacaaaccctccccatttgaggaggttccctctttggagcaagctccagcaagtatctccacagccgcgttgaccaacgggagcgatcacggagacctcagaccccctgtgacaaatacacatggaagtcttaacccccctgcgacacctgccagttccaccccggaggagccggcaaagcaagaccttactgccttatccggcaaagcacacttcgtctccaagataacatcctcaaagccctccgcagttgcctcggagaagttcaaagagcaagtggacctggcaaaaacaatgactaacctgtcgccaaccatcctcgggaacgccgttcagttgataagctcggttccgaagggtaaattgccaattcccccgtattccaggatgaagacaatggaggtgtataagattaagagcgatgcaaatatagccggttttagcttacctggacctaaggccgattgcgacaaaatcccctccaccacagagggattcaacgcagccacaaaggtcgcgagccgactgccagttccgcaggtgtcacagcaatctgcatgcgagtccgctttttgtccaccgaccaagctggatctgaatcacaagaccaaactgaactccggcgccgcaaagcgcaagggcagaaagcgaaaagtgcccgatgagattctggctttccagggtaagagacgcaagtatatcataaataagtgtcgggacggcaaagagcgagtgaaaaacgacccccaggaattcagggatcagaaactgggcaccctcaagaaatatcgctccataatgcctaaaccaattatggtcatccctacattggcttcattagcatcccctacaacactccaaagtcaaatgctcggcggtcttgggcaagatgttctactgaataactcgctgaccccgaagtatctgggttgcaagcaagataattcctcgtctccaaagcccagctccgtgtttagaaatggcttttcaggcatcaaaaaaccatggcatcgatgccacgtctgcaatcaccatttccagtttaagcagcatctgcgagatcatatgaacactcacactaatagacggccatactcatgcagaatttgcaggaaaagctacgtccgccccggatcactttcaacacacatgaaactgcaccacggcgagaataggctgaaaaaactgatgtgttgtgaattctgcgccaaagtgttcggccacataagggtctatttcggccatttgaaggaagtgcatagggtcgtaatctccaccgagcctgcaccaagcgagctgcagcccggcgacatccccaagaaccgtgatatgtctgtaagaggtatggagggaagcttggagcgggagaataaaagtaacctcgaggaggattttctacttaatcaggcagatgaagtgaaacttcagattaaatgcgggcggtgtcagatcaccgcccagtcgttcgcagagatcaagttccatctgcttgacgtgcatggggaagagatcgagggacgactccaggaaggtacctttcctggctctaaaggaactcaagaggaactggtgcagcacgcttcccctgactggaaacgccaccccgaacggggtaagccagagaaagtccacagctccagcgaggaaagtcacgcatgtccaaggctgaagcggcagctccatctacaccagaacggggtggagatgttgatggagaatgagggaccgcaaagcggcaccaataagcctagggagacatgccagggacccgagtgtcccggcctgcacacctttctcttgtggtcccattctgggttcaactgcctgctctgcgccgaaatgcttggcagaaaagaagatctgctgcaccattggaaacatcaacacaattgcgaggatcccagcaagctttgggccattctgaataccgtgtctaatcaaggagtgatcgaactgtcttctgaggcggagaaatag

SEQ ID NO: 21602 - DNA, 1179 bp, Artificial Sequence
  Description of Artificial Sequence: Synthetic coding sequence
atgcccaagcccatcatggtgatccccaccctggccagcctggcctctccgaccaccctgcagtcccagatgctgggcgggttggggcaagacgtattactaaacaactcgttaacgcctaagtacttggggtgtaagcaggataatagcagcagccccaagccaagcagtgtatttcgcaacggcttctcaggtattaaaaaaccatggcatcggtgccatgtgtgcaatcaccattttcagtttaagcagcacctccgagaccacatgaatacacatactaacaggcggccttacagctgccgtatctgccgcaagagctatgtccgaccgggctcattgagtactcatatgaaactccaccatggagaaaatagactgaaaaaactgatgtgttgcgaattctgtgcaaaggttttcggtcacatccgagtgtactttggccatctcaaagaggtgcaccgagttgtgatctccacagagcccgcaccttcagagctgcaacctggtgacattcctaagaatagggacatgtctgtaagaggtatggagggctctttagaacgcgagaataaaagcaacctcgaggaagacttcttgctgaaccaggccgacgaggtgaagttgcagatcaaatgtggccggtgtcaaattacggcacagtccttcgctgaaattaaattccatctgttggacgtgcatggggaagaaatagagggccgacttcaggaggggacctttcccggcagcaaggggactcaggaggagctggttcagcacgccagtccagattggaagcgtcacccagagcggggaaagcccgagaaagtacacagtagctctgaggaaagccatgcctgccccagattgaagcgccaactgcacttgcaccagaatggcgtcgagatgcttatggaaaatgaggggccccagtccggtaccaacaaacctagagaaacctgtcagggacctgagtgcccgggcctccacacgttcctgttatggtctcactccgggtttaattgtctcctttgtgcggagatgcttggtaggaaggaagacctcctccaccattggaagcaccagcataattgcgaagatccatccaagctttgggctattctgaacacggtgagcaatcagggagttattgaactgagtagtgaggctgagaaatag

SEQ ID NO: 21603 - DNA, 2487 bp, Artificial Sequence
  Description of Artificial Sequence: Synthetic coding sequence
atgcagaacagcgtgagcgtgccccccaaggacgagggcgagagcaacatcccgtctggcacaattcaatctcggaagggcttacagaataaaagccaattccggaccatcgcccccaagattgttcctaaggtcctgacttcccgtatgttgccttgtcattctcctagtcggtcagaccaagttaacctgggcccttcgattaacagcaagctgcttgggatgtcgacacagaattatgccctgatgcaggttgctgggcaagaaggaaccttttccctggtagcactccctcatgtggccagcgcccagccgatccagaagcctcgcatgagcctgcctgagaacttaaagctgccgattcctcgctaccagccccccagaaattctaaagccagcaggaagaaacctatccttattttccccaagtcaggatgctccaaagcccccgcccagacccagatgtgcccccagatgtctccctccccccctcaccaccccgagctgctctataagccatcaccctttgaggaggtgccatctttagaacaagctccggcatccatttccacggcagccctcacaaatggtagcgatcatggagacctacgcccccctgtcacgaatactcatggctcccttaatccccccgctacgccagcaagtagcacccccgaagagcccgctaagcaggatctgactgctctgagtggaaaagcccattttgtgtctaagatcactagttccaaaccatctgctgttgccagcgaaaagtttaaagagcaggttgacctcgccaagaccatgacaaatctctcacctaccattttaggaaacgctgtccagctcattagttctgtccccaaaggcaaactgccgataccaccttactcccggatgaagacgatggaggtgtacaagatcaagagcgacgctaacatcgcaggctttagcctgccgggtcccaaagccgactgtgataaaattccgtccacaacggagggctttaatgcggccaccaaggtcgcgagccgtctgcccgtgccgcaagtgagccagcagagcgcttgcgagagcgccttctgccccccaaccaaactcgaccttaatcacaagacaaagcttaactctggagctgccaagcgcaagggcagaaaacgaaaggtgccggatgagatcctagcctttcagggcaagagaaggaagtatatcattaacaaatgccgtgacggtaaggagcgcgtgaagaacgacccccaggaatttagagaccaaaagctgggaaccctgaagaagtatcgatccatcatgcccaagcctatcatggtaatccctacgctcgcctcgcttgcctcacctacgactctgcagtcgcagatgcttgggggactgggacaggacgtgttgctgaataatagcctgaccccaaaatacctcggctgcaaacaggataatagctccagccctaagcccagttccgtttttcgaaatggatttagcggaataaagaagccatggcacagatgtcatgtatgcaatcatcactttcaattcaaacagcatctcagggaccacatgaacactcataccaaccggcgcccatacagctgccggatttgcagaaagtcctatgtgagacccgggagcctgtctacgcatatgaaactgcatcacggagagaaccgtcttaagaagctgatgtgctgcgagttctgtgccaaggtcttcggccatattcgtgtgtatttcggtcacttgaaggaggtgcacagagtggtaatcagtacggagcctgctcctagtgagttacagcctggagacatcccaaaaaacagagacatgtcggtgagaggcatggagggctccctcgagcgagaaaacaaatctaacctggaagaggatttcttgttgaatcaggctgatgaggtgaagctccagatcaaatgtggccgttgtcagattactgcccagagctttgccgaaataaagttccacttgctggacgttcacggcgaggagatcgagggcaggctgcaggaaggcacattccccggcagtaaggggacccaggaagagctcgttcagcatgccagtccagactggaaacggcaccccgaaaggggaaagcctgagaaagtgcattcgagcagtgaagagagtcatgcctgccctaggctaaaaaggcaactgcacctgcatcagaatggcgtagaaatgctgatggagaacgaaggtccgcagagcggcactaataaacccagggagacttgccagggacccgaatgccccgggctgcacacatttttgttgtggtcacacagcggcttcaactgcttattatgtgctgagatgctcggaagaaaagaggatcttctgcatcattggaaacaccagcacaactgcgaagaccctagcaagctgtgggcaatactcaatacagtatccaaccagggcgtgatcgagctttcctcagaagcggagaaatag

SEQ ID NO: 21604 - DNA, 1644 bp, Artificial Sequence
  Description of Artificial Sequence: Synthetic coding sequence
atgcagaacagcgtgagcgtgccccccaaggacgagggcgagagcaatatcccttcaggcaccatccagtcaaggaaggggttacagaacaagagccagtttcgcacaattgcacccaaaattgtgccaaaagtactgacaagtagaatgctgccctgccattcaccatcgcgaagtgatcaggacctgcgccctaccgtcatcaggtacccaccaccccagaaggctctaatgcaacctccccggtggcaggctgggtatctgttccacaaaacaaagctgaactctggcgccgcaaaaaggaagggtagaaagcggaaagtgccagacgagatattggcttttcagggtaaaaggagaaagtacattatcaataagtgccgcgatggaaaggagcgcgtaaaaaacgatcctcaagaatttcgagaccagaagctcggcacgctaaaaaaatatcgcagtataatgcctaaacctataatggtcatccctactctagcctctctggcttcaccaacaacgttgcagtcccagatgctgggggggctcggtcaagatgtactactgaacaattctctgacccctaagtatctggggtgcaagcaggacaacagtagctcacccaaaccgtcatcagtgtttaggaacggattctccggcatcaagaaaccatggcatcgctgtcacgtgtgtaaccatcactttcagttcaagcagcacctgcgggatcatatgaacacccacactaacagaagaccctacagctgccgcatttgtcgaaagtcctacgtacggcctggctccctgtccacccacatgaaactacatcacggagagaataggctcaagaagttaatgtgttgtgaattctgcgccaaggtgttcgggcacatcagggtatattttgggcacctgaaggaagtgcatcgagttgtgatcagcactgagcctgccccctccgagctgcagccaggggacatacccaagaatagagatatgagtgtgcgaggtatggaaggttcactcgagagagaaaacaagtctaacttagaagaggactttctcctcaaccaggctgatgaggtgaagctgcagataaaatgcggccgctgccagatcacggcgcagagcttcgcggagatcaagttccatctgctcgacgtgcatggagaggaaattgaaggaagacttcaggaggggacctttcccggatcgaaggggactcaggaggaattggtgcagcacgcgtctcccgattggaaacgccatcctgaaagaggcaaacctgaaaaagttcactccagctcagaggaatcgcacgcatgcccacgcttaaagcggcagttacacctgcatcagaacggtgtggaaatgctgatggaaaatgagggaccacagtctgggaccaataaaccgcgcgaaacatgtcaaggtccagagtgtccagggctgcacacctttttgttgtggagtcattccggctttaactgcttactgtgcgccgagatgttagggcgtaaggaagatctgctgcaccactggaagcaccagcataactgtgaggacccaagtaaactttgggccatcctaaatacagtgagcaatcagggggtgatcgaactgtcaagtgaggcggaaaaatag

SEQ ID NO: 21605 - DNA, 2487 bp, Artificial Sequence
  Description of Artificial Sequence: Synthetic coding sequence
atgcagaacagcgtgagcgtgccccccaaggacgagggcgagagcaatatcccgagcggaaccatccaaagtcgtaagggactgcagaacaaaagccagttccggaccattgcccccaagatagtgccaaaggtgctcacatctcggatgctgccctgtcacagccccagccgtagcgaccaagtcaacctcggtccatcaatcaattcgaaactgctggggatgtctacgcagaactatgctctgatgcaagtcgctggacaggaaggaaccttttccctcgtcgcgctgccacacgtggccagtgcacagcccatacagaagcctagaatgagtttgccagaaaacctgaaactgcctatccctagataccagcccccaagaaattctaaggcttctcgcaaaaagccaatcttgatatttccgaaaagtgggtgttctaaggctccagcacaaactcagatgtgtccccagatgtctcctagcccccctcaccatccagagcttctctacaaaccgtctccgttcgaggaggttccgtcgttggaacaagctccagcctcaatttctacagcagcattgaccaatggaagcgaccacggcgacctgcgcccgcctgtcaccaatactcacggttctctcaaccccccggccactcccgcatctagcactcctgaagagccagctaagcaagacctgaccgctctgtccggcaaggcacactttgtgtctaagatcactagcagtaaacccagtgccgtcgcatcagagaagttcaaagaacaggtggacttggccaagaccatgaccaatctctcccccactatattaggaaacgctgtgcaactcatctcctccgttccaaagggaaaactgccaatcccgccttatagtcgaatgaagaccatggaagtgtacaaaattaaatccgacgccaacatagcaggattttccttgccaggacctaaggcggactgtgacaagattccaagtactaccgagggttttaacgccgctaccaaggtagcgtcccggctgccggtgcctcaggtgtcgcaacagagcgcgtgtgaatcggcgttttgtccacctacaaaattggatctgaatcacaaaaccaagctcaattctggtgccgccaagagaaagggacggaagaggaaggttccggacgagatacttgcattccaaggcaagcggcgcaaatacatcatcaacaaatgtagggacgggaaagaacgggtgaaaaatgatccacaggaatttagagatcagaagctgggcaccttgaagaaatatcgctccatcatgcctaagcccataatggtgattcctactctggccagcctggcgagccctaccacactacagagtcaaatgctcggcggattggggcaggatgtactgttgaacaattcccttacgcctaaatatcttgggtgtaaacaagacaattcatccagtcctaagccatcgagtgtctttcgcaatggtttctctggcataaagaaaccatggcatcggtgtcatgtgtgtaaccaccactttcagtttaaacagcatctacgggaccacatgaatacccacacaaaccgaagaccttactcatgtaggatctgccggaagtcttacgtcaggcctggcagcctgagtactcacatgaaactgcaccacggagagaacagattaaagaagctgatgtgctgtgagttctgtgcgaaagtgtttggtcatatacgtgtgtattttgggcacctcaaggaggttcatcgggtggtaatttctactgagcccgcacccagcgagctgcaaccgggcgacatccccaaaaaccgagacatgtccgtccgcggaatggaaggttctctcgagcgggaaaacaaatcaaacctggaagaagatttcctcctgaatcaggccgatgaagtgaagctccaaataaagtgcgggcggtgtcagatcactgctcagtcatttgctgaaatcaagttccatttgctggatgtccatggagaagaaattgaggggcgtttgcaggaaggtacatttcccggctctaagggcactcaggaagagctggtccagcacgcatcaccagactggaagagacaccctgagagaggtaaacctgagaaagtgcattcaagttccgaggagagtcacgcatgcccgcgacttaaacgccagctgcacttgcaccagaatggggtggaaatgctcatggagaacgagggcccccagagcgggacaaacaagccacgggaaacttgtcaaggacctgagtgtccaggcctccacacctttttgttgtggtcccatagcgggttcaactgtcttctgtgcgccgagatgctcggcaggaaggaagacttacttcaccactggaagcatcagcataactgtgaggacccctctaagctttgggcaattctgaataccgtgagtaaccagggtgtcattgagctgagctcagaggccgagaaatag

SEQ ID NO: 21606 - DNA, 2487 bp, Artificial Sequence
  Description of Artificial Sequence: Synthetic coding sequence
atgcagaacagcgtgagcgtgccccccaaggacgagggcgagagcaacattccgtcagggacgattcagagccgtaaaggtctgcagaacaagtcacaattccggacaattgctccaaaaatagtccctaaggttctgacaagcagaatgcttccttgtcatagtcccagccgcagcgaccaggttaatctgggcccatctattaactccaagttattaggaatgtccacgcaaaattatgccctcatgcaagtggctggtcaggagggcactttcagcctcgttgctctgccccacgtagctagtgcgcagcccattcagaagccacggatgagcctacccgaaaaccttaaactccccatccctagataccagcccccgcggaattccaaggcctctcgaaagaagcctattctgattttccccaaaagtggctgttccaaagcacctgcccagactcagatgtgcccacagatgagtccaagtccgccccaccacccggagttgctatacaagccctcacctttcgaagaggtaccctcgctagaacaggcccccgcgagcatctctacagctgctcttactaacgggtctgaccacggagacctgaggccacctgtgacaaatacccatggcagcttaaacccgcctgctactcctgctagttcaacacctgaggaacctgccaaacaggacctgacagctctgagcggaaaggcccactttgtctctaagatcactagtagcaagccaagcgcggtggcctccgagaagtttaaagagcaggtcgacttagctaaaacaatgaccaatttatctcctactatacttggaaacgcggtccaactcatttcaagtgtgcctaaaggtaaattgcccatccccccctatagtcgtatgaaaacaatggaggtatacaagatcaagagcgacgccaacattgcgggattttcccttcctgggccaaaggccgattgcgacaagatcccttcgacaaccgaggggtttaatgctgccacaaaggttgcatccaggctgcctgtcccacaagtcagccagcaaagcgcttgcgagtctgccttctgcccacccacaaagctggaccttaatcataagactaaactcaacagtggggccgccaaacgaaagggcaggaaaaggaaagtacccgatgagatactggccttccagggcaagaggcgaaaatacataattaataaatgccgggatggaaaggaacgggtaaagaacgacccacaggagtttcgtgaccaaaagcttggcaccctaaaaaaatatagatcaatcatgcctaagccgatcatggtgatccctaccttggcgagtctggcatcacccacaactctccaatctcaaatgctgggggggctggggcaggatgtactcttgaataatagcctcacgcccaaataccttggttgtaaacaagacaacagctcatctcccaagccctcatctgtgtttcgtaacggcttttctggcataaagaaaccttggcatagatgccacgtatgcaaccaccactttcagtttaagcaacatctgcgcgaccacatgaacactcatactaatcggagaccctacagctgtaggatatgccggaagagctacgtgcggccagggtcactgagcactcacatgaagctgcaccacggggaaaatcggcttaaaaagctgatgtgttgtgagttctgcgctaaggtctttggccacatcagagtatatttcggccacctgaaagaggtgcacagggtggtgatctcaacagaacctgccccatccgagttgcagccgggggatatcccaaagaaccgagatatgtcagtccggggcatggaaggatcactcgaacgtgaaaacaagtcaaaccttgaagaggacttcctgttgaatcaggcagacgaggtgaagctccaaattaaatgcgggagatgtcagattactgctcaatcgtttgccgaaatcaagtttcacctgttggacgtgcacggtgaggagattgagggccgacttcaggagggtaccttccccggatctaagggcacacaagaggaactggtgcagcatgctagcccggactggaaacggcaccctgaaaggggtaaacctgagaaggtgcactctagctctgaagagtcgcatgcttgcccgcgcctcaagcgacagctgcacttgcaccagaacggtgttgagatgctgatggagaatgagggaccgcagtcaggtaccaacaagccaagggagacctgccagggacctgagtgtcccggactccatacattcctgctgtggtcccatagcggtttcaactgtctgctgtgcgctgaaatgttgggtaggaaggaagacctattgcatcactggaaacatcagcacaactgtgaagacccatcaaaactgtgggcgattcttaacacagtcagcaaccagggggtgatcgaactctctagcgaggccgaaaagtag

SEQ ID NO: 21607 - DNA, 2457 bp, Artificial Sequence
  Description of Artificial Sequence: Synthetic coding sequence
atggacagcgagagcaacatccccagcggcaccatccagagccggaaagggttacagaacaagtctcagtttcgcactattgcacccaagatcgtccctaaggtcctgacaagtcgtatgctgccttgtcactccccgagtaggagcgatcaagtaaacttgggccccagcataaatagtaagctcttgggcatgagcacacagaactatgccttaatgcaggtcgcgggacaggaagggacatttagtttggtggcccttccacacgtggccagcgctcaacccattcaaaaaccacgaatgtcactgccggagaatttaaagctgcctattccgcgatatcagcctcctcgtaattcaaaagcctccagaaaaaaaccaatcttgatcttccctaagagcggctgcagcaaggcccccgctcagacccagatgtgcccacagatgagtccttcgccccctcaccaccccgaactgctgtataaaccttctccatttgaagaagtgcctagcctggagcaggcccccgcctcgataagtaccgccgcacttaccaacggttctgaccatggggatcttagacctccagttacgaatacacatggttccttgaaccccccggctactcctgcgtcatccactcctgaggaacctgcgaaacaggacctgaccgcactgagcggtaaagcccatttcgtctcaaaaataacttctagcaagccttctgccgtggcaagcgagaagttcaaggagcaggtggacttggctaagacgatgacaaacctgtctcccaccatcctgggcaacgccgtccagcttatcagcagtgttcccaagggcaagttgccaattccgccctactcccgaatgaagacaatggaggtttataaaattaagagcgacgcgaacatcgccgggtttagtttacccggcccaaaggccgactgcgataaaatcccttccaccactgaagggttcaatgccgccactaaggtcgcctccagattaccagtcccccaagtgagtcagcagtctgcttgcgagtccgctttctgtccccccactaagctggaccttaatcacaaaacgaaactgaattccggggctgctaagcgcaagggtagaaagaggaaggtgcctgatgagattttggcattccagggcaaaagacgaaagtacatcattaacaagtgtagggatggcaaagagcgtgttaaaaacgacccacaggaattccgagaccagaaactcgggacactgaaaaagtatcgatcaattatgcctaagcccatcatggtcattccaactttagcgtctttggcctctcctaccacactgcagagccagatgctcggtggccttggccaagatgttctgctgaacaattcactgacacccaaatacctgggatgcaagcaggacaattccagctctccaaaacctagttctgtttttcgtaatggcttttcaggtattaaaaagccctggcaccggtgtcacgtgtgcaatcaccactttcagttcaagcaacacctccgggaccacatgaacacccatacgaaccgtcggccttattcctgtcggatctgtcgcaaaagttacgtgaggcccggttctctgtccacacacatgaagttacaccatggggagaatcggctgaaaaagctgatgtgctgcgaattctgcgcaaaagtctttggacatattcgcgtctactttggtcacctaaaagaggtgcatcgggtcgttatttcaactgagcctgccccctcggagctacagcctggggatatcccgaagaacagggacatgtccgtccgaggcatggaggggagcctagagcgcgagaacaagagcaatctggaagaggatttccttttaaatcaggcggatgaagtgaagctacagataaagtgcgggcgctgccaaattactgctcagtcctttgcagaaatcaaatttcacctgcttgacgtgcacggggaggaaattgaaggacggcttcaggaaggaacctttcccgggtctaagggaacccaagaggagctcgttcagcacgcctcacccgattggaaaaggcaccctgagcgcggaaagccggagaaagtgcacagtagcagtgaagaaagtcacgcctgtccacgactgaagcgccagctacacttacatcagaatggcgtcgaaatgctgatggaaaatgaagggccccagagtgggaccaataaaccccgggagacctgccagggaccggagtgccccgggctccataccttcctgctctggtcccatagcggtttcaactgcctcctgtgtgcggagatgttgggacgaaaggaggacctcctgcatcactggaagcatcagcataactgtgaggaccccagcaaactctgggccatcctcaataccgtcagtaatcagggtgttatagaactgtcttctgaggccgagaagtag

SEQ ID NO: 21608 - DNA, 2457 bp, Artificial Sequence
  Description of Artificial Sequence: Synthetic coding sequence
atggacagcgagagcaacatccccagcggcaccatccagagccggaagggattgcagaacaaatcacagttccgaactattgcacccaaaatcgttcctaaggtcctgacatcccggatgctgccttgtcacagcccctctcgctccgaccaggtcaacttaggcccctctattaactcaaagctgctgggaatgtccacacagaactacgcgctcatgcaggtggccggtcaagagggcacgtttagtctggttgccctgcctcacgttgcatcagcacagcctattcagaagccccggatgtcgctcccagagaatttaaagctgcccatcccacgctaccaaccgccacgcaactccaaagcctcaagaaagaaacccattctcattttccctaaaagcggttgttcaaaggcgccggcccagactcagatgtgcccgcagatgtcccctagtccgccacaccatcctgagctgctgtataaaccaagtccttttgaggaggtgccatccttagagcaggccccagcctcaatctcaactgccgctttgacaaatgggagcgaccacggtgatctgcggccccccgtgaccaatactcacggatcactgaaccctcctgcaacacctgcgtccagcactcccgaggaacccgcaaagcaggatttaactgccttatcaggcaaagcccactttgtctcaaagattacatcatccaaacccagcgccgtggcctccgagaagttcaaagagcaagtagatctggccaaaaccatgaccaatctgtcccctaccattctgggcaatgcagtgcagttaattagcagtgtacctaaaggtaagttgccaatacctccttattcccggatgaagactatggaagtatataagatcaaatcagacgcaaacattgcagggttctcattgcccggaccgaaggccgactgcgacaagataccgagcactacagaggggtttaacgccgcgaccaaggtcgcctcccgtttgccagtcccccaagtctctcaacaatcagcttgtgaatccgctttctgccctccaactaagctagacctgaatcacaagactaagttaaacagtggcgccgccaagagaaagggtcggaaacgcaaagtccctgacgaaatcctcgccttccagggtaaacgccgaaagtacatcatcaacaagtgtagagacgggaaggagcgggtcaaaaatgatccacaagagttccgcgatcagaaactgggtactcttaaaaagtataggagcatcatgccaaaaccaatcatggtgattccaaccctggcgtcactcgcaagtcccacgaccctccagtctcagatgttaggtggcctcggccaggatgtgctgctgaataattctctcaccccgaagtatttggggtgtaagcaggacaactcaagctcccccaaaccttctagtgtatttaggaatggttttagcggaatcaagaagccctggcacagatgccacgtgtgcaatcaccactttcagttcaaacagcacctgagagatcatatgaatacgcataccaatcgcagaccatacagttgtcgaatctgcaggaagagctatgtgcggcctggtagtctctctactcacatgaagctgcaccatggcgagaaccggctgaaaaaacttatgtgctgcgaattttgtgctaaagtcttcggacatatccgtgtatactttgggcatctgaaagaagtgcaccgagtagtcatctcaaccgaacctgctcctagcgaactgcaacccggcgacatcccgaagaatagggacatgagcgttcgcggtatggaaggttctctggaacgggaaaataagtccaacttggaggaagacttcttgctgaatcaagcggacgaggtgaaactgcagatcaaatgcggtaggtgccagataacagcgcaaagcttcgccgaaatcaagttccacctgctggatgttcatggggaggagatcgagggccgtctgcaagaggggacctttccggggtccaaggggactcaagaagaacttgtccagcacgcctctccagattggaaacgccatccagagagggggaaacctgagaaagttcatagcagctccgaagagtcccacgcttgcccacggctcaagcggcagctacatctacatcagaacggcgtagagatgttaatggaaaacgagggaccacagagtggtaccaacaagccccgggagacctgtcaagggcccgaatgtcctggattgcacactttcctgctttggagccattccggctttaattgtttattatgcgccgagatgcttgggcgaaaggaggacctgctccaccattggaagcatcaacataattgtgaggatccttccaagctttgggccatcctcaatacagtgtcaaatcagggagtgatcgaactgagcagtgaggcagagaagtag

SEQ ID NO: 21609 - DNA, 2340 bp, Artificial Sequence
  Description of Artificial Sequence: Synthetic coding sequence
atgctgccctgccacagccccagccggagcgaccaggtgaacctggggccctctattaatagcaagctcctagggatgagtactcaaaactacgctttgatgcaggtggcagggcaggaaggaacattctctttggtggcccttccacatgtggcctctgcgcagcccatccagaagccgcggatgtctctgcctgaaaacttgaaattacctatccctcgctaccagccccccaggaacagtaaagccagtaggaaaaagcccatactgatatttcccaaatcaggttgctcaaaagcccccgcccaaacccagatgtgtcctcagatgagtccttctccacctcaccaccctgagctgttgtataagccctcccctttcgaggaggtgccctccctcgagcaggcccccgcctccatttcaactgccgctctgacaaatggatccgaccacggcgatctcaggccaccagtgactaatacacacggctctctcaatccaccagctacaccggccagcagtacccccgaagagccggccaagcaggatttgacggccctcagcggcaaggctcattttgtgagtaaaatcaccagttctaaacctagcgccgttgcatccgaaaagttcaaagaacaggtggatctggcgaaaaccatgacaaacttaagccccacaatcttgggaaacgccgtgcagctcatttcttcagttccaaagggaaaattgcctatcccaccctactccaggatgaaaactatggaagtatacaaaataaagagcgatgcaaacattgcgggcttttctctacccggcccaaaagctgactgcgataagatccccagcaccacagaaggcttcaatgccgccaccaaagtggctagcagacttcccgtgccacaagtgtcccagcagagtgcctgtgagagcgctttttgtcccccgacaaaactggatctaaaccacaaaactaaactcaactccggggcagctaagaggaagggtagaaaacgcaaggtgcctgatgagatcttggcgtttcaggggaagagaagaaaatatattatcaacaaatgtcgagacggaaaggagagggttaagaatgacccgcaggaattcagggaccagaagcttggaaccctgaaaaaatatcgcagcattatgcctaaaccgatcatggtgattcccacactagcaagcctggccagccccaccactttacagagtcagatgctggggggcctgggccaggacgttctattaaataactcactgacgcctaagtatcttggttgtaagcaggacaatagttcgtccccgaaaccatcatctgtttttcgtaatggatttagtggtatcaagaagccgtggcataggtgccacgtttgtaaccatcattttcagttcaagcagcatttgagagaccacatgaatacccacaccaaccgacgtccctactcttgtcgcatttgccgcaagtcatatgtccgcccaggatctctgtcaacacacatgaagctccaccatggcgagaataggttgaagaagttgatgtgctgtgagttttgtgcaaaggttttcggccacatcagggtgtattttggtcatctgaaagaggtgcatcgggttgtcatcagcaccgagcctgcgccttccgaacttcagccaggcgacattccaaagaatcgtgatatgagcgtgcgaggcatggaagggtccctggaacgtgaaaataagagcaatctggaagaagatttcttactgaaccaggctgatgaagtgaaactacaaatcaaatgtgggcgatgtcaaattaccgctcagagcttcgctgagattaaatttcaccttctggatgtacacggcgaggagatcgagggaagactgcaggaaggaaccttcccagggtccaagggtactcaggaggagctcgtgcagcatgcatcccccgactggaagcgccaccccgagcgaggcaagcctgagaaagtacactcttcctcagaggaaagtcacgcctgtccccgtcttaagcggcagctccacctccaccagaatggggttgaaatgctgatggaaaatgagggacctcagagcgggacgaacaagccccgggaaacatgtcagggaccagaatgtcctggtctccatacgtttttgttatggtctcactctggtttcaactgtctcctatgcgcagaaatgctaggacggaaagaggatttactccaccactggaaacatcagcataactgtgaggatccaagcaaactgtgggctattcttaacacagtgtccaatcagggggtgatcgaattgtcgagcgaggcagaaaagtag

SEQ ID NO: 21610 - DNA, 1500 bp, Artificial Sequence
  Description of Artificial Sequence: Synthetic coding sequence
atgctgagcctgagccccatcctgctgtacacctgcgagatgttccaagatcccgttgccttcaaggatgttgccgtgaactttacgcaggaggaatgggctctgctagacataagtcagaaaaacctctatagagaagtgatgctggagactttctggaacctcacctccataggaaagaagtggaaggatcagaatatcgaatacgagtatcaaaacccaaggcgcaatttccggagcgtaactgaggagaaagtaaatgagatcaaagaggatagtcattgcggcgagacttttactccggtcccggacgacaggcttaattttcagaagaaaaaggcaagcccagaagtcaagtcgtgcgattcctttgtgtgcgaagtgggtctgggtaactcaagcagcaatatgaatattaggggagacacagggcataaagcatgcgagtgccaggaatatggccccaaaccgtggaaatcacagcagcccaagaaggcgttccgataccatcccagcttgcgcacccaagagcgggatcatacaggaaagaagccttacgcctgcaaagaatgtggcaagaacatcatttaccactccagtattcagcgtcatatggtggtccattctggggacggaccctacaaatgcaagttctgcggcaaggcatttcactgcctgagtctgtatctcattcacgaacgtactcataccggagagaaaccctatgagtgcaagcagtgcgggaaaagcttctcgtacagtgccacacatcgaatccacgaaaggacacacatcggagagaaaccatacgagtgccaggaatgcggcaaggccttccactctccccggtcctgccacaggcatgagagatctcacatgggcgagaaagcctaccagtgcaaagaatgcggcaaggctttcatgtgtccgcgctacgttcgtcgtcacgagcggacgcactctcggaaaaaactgtacgagtgcaagcagtgcggaaaggcattaagttctcttacttctttccagacccacataaggatgcactccggcgagaggccgtatgaatgtaagacatgcggaaaggggttctattccgcaaagagtttccagaggcacgagaaaactcattctggagaaaaaccctataaatgtaagcaatgcggaaaggctttcacccggtcgggcagttttaggtaccatgagcggacacacacaggagaaaaaccttatgagtgcaaacagtgtggcaaggccttccgcagcgcaccaaacctgcagcttcatggacggacgcatacgggtgagaaaccttatcaatgcaaagagtgcggcaaagcctttcgtagcgcctctcagctccggattcatagacgcatccacactggcgagaaaccctatgaatgcaagaaatgtggaaaggcatttcgctacgtgcagaactttaggttccacgaacgaacgcaaacccacaagaatgccctgtggcggaagaccctgtag

SEQ ID NO: 21611 - DNA, 1788 bp, Artificial Sequence
  Description of Artificial Sequence: Synthetic coding sequence
atggaccccgtggccttcaaggacgtggccgtgaacttcacccaggaagagtgggccctgctcgacattagccagcggaagctctacagagaagtgatgctcgaaaccttccgaaacctgaccagtctcggcaagcgatggaaggatcagaatattgaatatgaacatcagaatccccggcgaaacttccgcagcttgatcgaagaaaaggtcaatgagattaaagatgattctcactgcggagagacgtttacccctgtacctgacgaccgcctgaacttccaggaaaaaaaagcatctccagaggtgaagtcttgtgagagcttcgtgtgtggagaggtgggcttgggcaattctagcttcaacatgaacatccgcggcgacattggtcataaagcttacgaataccaggagtatggccccaagccgtgcaaatgccagcagcccaaaaaggccttccggtatcgcccctccttccggacccaagaacgggatcacacaggggaaaaacctaacgcctgtaaggtctgcgggaaaacctttatctcacactctagcgtgcgtcgccatatggtgatgcattccggcgacggcccatacaagtgcaaattttgtggtaaggcatttcactgcctgcgcctgtaccttatacacgaacgtatccacactggtgaaaaaccatgcgagtgcaaacagtgcggaaagtccttttcctactcagcaacccaccgcatacataagagaacccacactggcgagaagccctacgagtatcaggagtgcggaaaggcatttcattcgcccaggtcctatagaagacacgaacggatccacatgggggagaaggcctatcagtgtaaggagtgtggaaaagctttcacgtgtcctcggtatgtgcgcatccatgagagaactcattctaggaaaaatctgtacgagtgtaagcagtgtggaaaggccttgtcaagcctgacctccttccaaacgcatgtgagactgcacagtggagaaaggccatatgaatgtaagatctgtggcaaggacttctgttctgtgaactccttccagaggcacgagaaaatccacagtggtgagaaaccatataagtgcaaacagtgtgggaaggcgttcccgcattctagctccctgcgctatcacgagagaacccacaccggcgagaaaccatatgagtgtaaacagtgtggaaaggcctttcgaagcgcaagtcaccttcgggtgcacggcagaacacacacgggagagaaaccttacgagtgtaaggaatgtggaaaagcattcaggtatgttaacaacctccagtcacacgagaggacacagacacacattaggattcattcaggcgaacgccgctacaagtgcaagatctgcggaaagggcttttactgtccaaaaagctttcagaggcacgagaaaacacatacgggagaaaaactgtatgagtgtaagcagaggagtgtggttccgtcagtggtccccgtccccttcgacatcatgaaagggctgaccctcgagcgcagtcccatcaacgcaagcaacgtcggcaagccttctgagttgtgccaatcattcgagtgtatggtcggcttgaccctgaagagaaacccaatgtccgtgagcaacgatgggaagccctcagaccttcctcatactttcgagtatgtagtggggcataccatggagagaagccctatgcacgtccgcaacgtcggcaacccatcggatctcccgcgtaccttcgagttcatgaaagggcacaagcacacttag

SEQ ID NO: 21612 - DNA, 2082 bp, Artificial Sequence
  Description of Artificial Sequence: Synthetic coding sequence
atggacagcgtggccttcgaggacgtggccatcaacttcacctgcgaggagtgggccttgctcggtccatcacagaaaagcctttaccgcgatgttatgcaagagacaatcaggaatctagactgtattggcatgatttggcagaaccatgacattgaggaggatcaatataaagacctgagacgcaacctgaggtgtcacatggtggaacgcgcttgcgagatcaaagacaactctcagtgcggaggaccctttacccagactcaggactctatcgtgaacgagaaaattccaggcgtagatccgtgggaatcctctgagtgcactgatgtactaatgggccgcagctcacttaattgttacgtacgcgtggactccgagcacaaaccttgtgaataccaggagtatggagagaagccatatacacacacacagtgtggcacagccttcagttaccagccttgcttccaaatccacgagagaccacagcacggcaagaaactttacgactgtaaggaatgtgccagctttagctcgttggagaatctacagcgccatatggcggcccatcacggcgatggcccacgtatctgcaaactctgtggaaacgctttcatttggccaagcttgtttcacatgctcagacggacacatactgaagagaaaccatatgaatacgaacaatgctcaacggccttccccgcctattcatctacactgagacatgagagaacccacagcggagaaaaaccctatcagtgcaagcagtgcggcaaagcattcagctgctcctgttacactcagctctatgagagaacgcataccggagagcagagttatgaatgcaagcaatgtggtaaggccttctaccatctgggcagttttcagcgtcacatgatcgttcatactggcgacggaccccataagtgcaagatatgcggaaagggcttcctctctcctagtagtgttcgccggcataaaagaacacacaccggtgagaaaccttacgaatgtaagtattgtggtaaggcctttagtgactgtaccggattccggcgacatatgatcactcacactggggatggaccacataagtgcaaagtgtgcggaaaggcgtttgactcaccctcgctgtgcaggcgccacgagacaacacatactggggagaagccctacaaatgcgaatgcggcaaagccttctcagatttctactatttccgaaatcacgagactacacatacaggagagaaaccttataagtgtaagcaatgcggaaaggcctttatctgctgcacctatcttcagattcacgaaaggattcacaccggagaaagaccatataagtgcaaacagtgcgggaaagccttccgtagtagtaattatattagggtgcacgagaaaacccataccggcgaaaagccatatgagtgcaaacagtgcgggaaggcactgtcccatctgaaatcatttcagagacacatgatcatgcatacaggtgacgggcctcataagtgcaaaatatgtgggaaaagcttcgattcccctagtagtttcaggcgacacgaacggatccacactggggagaggccttataagtgtaaactgtgcggtaagggcttccgaagctcctcttacattcagttacatgagcggacccatactggcgagaagccctacggatgccaacagtgcggaaaagcactgtctgacctgagcagcttcaggagacacatgatcacccacacgggcaacgggccccataagtgcaagatctgcggaaagggcttcgactacccctccagtgtgcagagacacgagcggacacacaccggggaaaagccctatgagtgtaaagaatgcgggaaggcgttttcccacagctcttacttgcggatccacgagcgtgtgcacaccggggaaaaaccctataaatgcaaggagtgcggcaagccttttcattgtccatccgctttccacaagcacgagcgaacccattcaatggaaaaaccgtataagtgcaaggaatgcggagaggcgttccattgcatctcaagttttcataaacacgagatgacccattag

SEQ ID NO: 21613 - DNA, 1881 bp, Artificial Sequence
  Description of Artificial Sequence: Synthetic coding sequence
atggtggagcgggcctgcgagatcaaggacaacagccagtgcggcggcccctttacccaaacccaggacagtatcgtgaacgagaaaatacccggcgtcgacccctgggaatcgtcagagtgcactgatgttttgatgggaagaagctcactgaactgttacgtccgcgtggactcagagcataagccatgtgagtaccaggagtatggagagaagccgtacactcatactcagtgcggcaccgcattttcttatcagccttgctttcaaatccatgagcgcccccagcacggcaaaaaactatacgactgtaaagagtgtgcatcatttagtagcttggaaaacctccagagacatatggccgctcatcacggagatgggcccagaatatgtaagttatgtggaaatgcttttatatggccaagccttttccatatgctgcggaggactcacacggaggagaagccttacgaatatgagcagtgctctactgcttttcctgcttatagcagtacactgcgtcacgaacggactcatagcggagagaaaccataccagtgcaaacagtgcgggaaggccttttcgtgcagttgttatacccagctttatgagaggacacacacgggcgagcaaagctacgagtgtaagcagtgtggaaaggccttttaccatctcggtagctttcagcggcatatgatagtccacaccggagatggtcctcataagtgtaagatctgcggaaagggcttcctgtctccttcatcagtcaggcgccacaagaggacgcatacaggagaaaagccttatgaatgcaaatattgcggaaaggccttttcagactgcactggcttccggcgccatatgattacacatacaggtgatggccctcacaagtgtaaggtatgcggtaaagcttttgactctccgtccctgtgccgccgtcacgagaccacccacaccggggagaagccgtataagtgcgaatgtgggaaagcgttttcggacttctattactttcggaaccacgagactacacatacaggcgaaaagccgtacaaatgcaagcagtgcggcaaagcttttatttgctgcacctatctgcaaattcatgaacgcatccataccggggaaaggccttataagtgtaagcagtgcgggaaagcttttagatcttccaactacattcgcgtgcatgagaaaacacacacgggagaaaaaccgtatgagtgcaagcagtgtgggaaggctctgagtcacctcaagtccttccaacgacatatgataatgcacaccggtgacgggcctcacaagtgcaagatctgcggcaaatcctttgacagtccctccagttttcggcgccacgaaagaattcacaccggcgaacgtccctataaatgcaagctctgcggcaaaggcttcagatctagtagttatatccagctgcacgagcggacccatacaggcgaaaagccctacggctgtcaacaatgcgggaaggcgttgtccgacctctcttcattcagacgtcacatgatcacacataccggtaatggtccgcacaagtgtaaaatctgcggaaaggggtttgattatccaagctccgtgcagcgccacgagcgtacccacacgggggaaaaaccatacgaatgcaaggagtgcggaaaagccttttcccactcatcctatctgagaattcacgagagggtgcacaccggggagaaaccttataagtgcaaagaatgcggcaagcctttccattgtccgtctgctttccacaaacacgaacggacccactctatggagaaaccttataagtgtaaggaatgcggggaggcttttcactgtattagctcgttccacaaacacgagatgacacactag

SEQ ID NO: 21614 - DNA, 1884 bp, Artificial Sequence
  Description of Artificial Sequence: Synthetic coding sequence
atgatcgtgttcggcggcgaggaccggagcgacctgttcctgcccgatagccagactaatgaggagagaaagcagtatgattcagtagccttcgaagatgtcgccgtgaacttcacacaggaggaatgggcactccttggtcccagccaaaagtcactctatcgggacgtgatgtgggagactatccgcaacctggactgcattggcatgaaatgggaggatacaaacatagaggatcagcacagaaaccctaggcggtcgctgagatgccatataattgagaggttcagcgagagcaggcagcccgactccacggtgaacgaaaagccgcctggtgtggacccatgcaaatcatcggtatgcggtgagattatgggctgttcctttctcaactgctacattacattcgatgcaggacataaacctgacgagtgccaagagtacggcgagaaaccccatacgcacaagcaatgcggaaccgcatttaactatcaccatagtttccaaacacaagagcgcccccacaccggcaagaaacgctacgactgcaaagaatgtgggaagaccttttcatcctctgggaacctcagaagacacattattgttcagaggggcggcggcccctacatttgcaagctatgcggcaaggctttcttctggcctagcctgttcaggatgcacgaacgaacccatacaggcgaaaaaccgtacgagtgcaaacagtgttgtaaagcctttccaatatactcctcctaccttcggcatgaacggacacacacaggcgagaagccctatgagtgtaagcattgctccaaggcctttcccgattactcatcatacgtgagacatgaaaggacacataccggggagaaaccctacaagtgtaaacggtgcggcagggccttctctgtgagcagttcactacggatccatgagcgaactcacaccggcgagaagccatacgagtgtaagcagtgcggcaaggcctttcaccatctaggatcatttcaaagacacatgatccgtcatactggtgacggaccacacaaatgtaaaatctgtggcaaagggtttgattgtccaagctcccttcagtcccacgagcgtacccatacaggtgaaaaaccgtatgagtgcaagcagtgtgggaaggcgctctcccatcattcatccttccgaagtcacatgataatgcataccggtgatgggcctcacaaatgcaaggtatgcggaaaagcctttatttatccatcagtgtttcaaggacacgagcgcacgcataccggagagaagccctacgagtgcaaagagtgtggtaaggctttccggatctcatcttccttgcggcgccacgaaactacacatacaggcgagaaaccatataagtgcaagtgtggtaaagctttcatcgatttctatagcttccagaatcatgagaccactcacactggcgagaagccttacgaatgtaaggagtgcgggaaagccttttcctgctttacgtacctctctcagcacaggaggacacacatggctgaaaaaccctacgagtgtaagacttgcaaaaaggcgttctcccatttcggcaatcttaaggtgcacgaacgtatccacactggagaaaagccttacgagtgtaaagagtgtcggaaggcattctcatggttgacgtgcctgcttaggcacgagaggatccacaccggtaaaaagtcctacgagtgccagcagtgcgggaaagccttcacacgaagtcgattcttgagaggccatgaaaagactcataccggggaaaagatgcatgaatgcaaagaatgcggaaaggccttatccagcctgtcaagcctccacaggcacaagcgtacacactggcgtgataccctgtag

SEQ ID NO: 21615 - DNA, 1677 bp, Artificial Sequence
  Description of Artificial Sequence: Synthetic coding sequence
atgaagtgggaggacaccaacatcgaggaccagcaccggaacccccgaagatctctacgctgccatataattgaacgattctccgagagcagacaaccggatagtactgtcaacgagaaacctccaggcgttgatccctgcaagagcagcgtgtgtggagagattatgggatgcagcttcttgaattgctacattacatttgatgccggccacaaacctgatgagtgtcaggagtatggagaaaagccccatactcacaagcagtgtgggacagctttcaattaccaccacagttttcagactcaggaaagaccgcacaccggaaagaaaagatacgattgtaaagaatgtggcaagaccttctcttcctcagggaatctaagaagacatatcattgtccagaggggcggcggcccatatatttgcaaactatgcggcaaggcatttttctggccttcattgtttaggatgcacgagagaacacacaccggcgagaagccttatgagtgtaagcagtgttgcaaagcatttccaatatattcatcttatctgagacacgaacgaacacataccggcgagaaaccatatgagtgtaagcattgctctaaggcctttccagactactcgtcatatgtcagacacgagcgcacacatacgggagaaaaaccctataagtgtaagcgctgcggtagagctttcagtgtatcatcatcattgcgaattcacgagcggacccacaccggagaaaaaccgtatgaatgtaaacagtgcgggaaagccttccaccacctgggctcatttcagagacacatgattcgacataccggagacggacctcacaagtgtaaaatctgcggaaaagggtttgattgtccctcctccctgcagagccatgaaaggacccacactggtgagaaaccttacgagtgcaaacaatgtggcaaagctctgtcgcatcactctagtttccgcagccatatgatcatgcacaccggggacggtcctcacaagtgtaaggtttgcggcaaggcctttatctacccaagtgtcttccagggccacgagagaacacataccggcgagaagccatatgagtgtaaggaatgtggtaaagctttcagaatatcctcttccctccggagacatgaaacaacccacaccggggaaaaaccatataaatgcaaatgcggaaaggcattcattgatttctactcctttcagaaccatgaaaccacacacaccggcgagaagccctacgagtgtaaagagtgcggaaaagcctttagttgtttcacctatctgtctcaacatcgacgcacacacatggccgaaaagccatacgaatgtaagacgtgtaaaaaagccttctcccactttgggaatcttaaagtgcacgagaggattcacacaggtgaaaagccatacgaatgtaaggaatgtcggaaggcctttagctggctcacatgtctgctgaggcacgaacggattcacactggcaaaaagtcatacgagtgccagcaatgtggtaaagcatttactcggtcccgttttctgcgcggacacgaaaagacccatactggcgagaaaatgcacgagtgtaaggaatgtgggaaagcgctgtcaagtctgtcatctctccacagacacaagaggactcattggagagacactctgtag

SEQ ID NO: 21616 - DNA, 2016 bp, Artificial Sequence
  Description of Artificial Sequence: Synthetic coding sequence
atggccagcgtggccctggaggacgtggccgtgaacttcacccgggaggagtgggccttgctgggcccatgccagaagaacctgtacaaggatgtgatgcaggaaactattcggaatttggactgtgttgtgatgaagtggaaagatcagaatattgaagaccagtatcggtacccccgtaagaatttgcggtgtcgcatgctagagaggtttgtggagtctaaagacgggacgcagtgcggtgaaactagttcacaaatacaggattcaattgtgaccaaaaacacactgcccggcgtgggtccgtgcgagagtagtatgagaggcgagaaggtcatgggtcattcttctttgaattgttacattagggttggggccggacacaagccacatgagtaccacgagtgcggcgaaaagcccgacacccataaacagcgcggcaaggcattcagctaccacaactctttccagacccacgaacgattgcacaccggtaagaagccatatgattgtaaggaatgcgggaagtccttctcatctctgggcaatctccagaggcatatggcagtgcaacggggagatgggccctacaagtgtaagctgtgtggtaaagcgttcttttggccctcgctactgcatatgcatgagcgcacgcatacaggggaaaaaccctacgagtgcaagcaatgttcaaaggctttttccttctactcaagctatcttcgccacgaacgaactcacacgggtgagaagccttatgagtgtaaacagtgtagcaaagcctttccgttctactccagttacctgcgccatgaaaggacccacacgggcgagaaaccctacaagtgcaagcagtgctcgaaggcttttcccgatagctcttcctgtctaatccacgaacgcacgcatacaggcgaaaaaccctacacctgcaagcagtgtggcaaagctttttccgtgagtggatctctgcagcgccacgagaccacccactccgccgaaaagccttatgcgtgccaacagtgcggtaaggccttccaccacttagggagctttcagcgacatatgatccggcatactggtaacgggccacataagtgtaagatttgtggtaagggctttgactgcccctcttctctgcagtcacatgagagaacacacaccggtgaaaaaccttacgaatgtaagcagtgtgggaaggccctgagccaccgctcaagcttccgctcacatatgattatgcatacaggcgatggacctcacaaatgcaaggtatgcgggaaggccttcgtatatcccagcgtgtttcaacgccacgagagaacacatacggcagagaagccatataaatgtaagcagtgtggcaaagcatacaggatctcttcctccctccggagacatgaaactacacatacgggggagaaaccttacaagtgcaagctcggcaaagcttgcatcgacttttgcagcttccagaatcataaaactacacacacgggtgaaaaaccttacgagtgtaaggagtgtggcaaagccttctctaggttcagatatctctcgcggcacaagagaactcacactggggaaaagccttacgaatgtaagacttgccgcaaggcattcggacactatgataaccttaaagtccatgaacgcatacacagtggcgaaaagccctatgaatgtaaggaatgtggcaaagcattcagttggctgacctgctttctccgacacgaacgtatccacatgcgcgagaagagctacgaatgccctcagtgcggaaaagcttttacacactcaaggttcctgcaaggccatgaaaaaactcatacaggagaaaacccttacgaatgcaaggagtgcgggaaggcctttgccagtctgtcatcactccatcgacacaagaaaactcactggaagaaaacccatactggggagaatccatacgagtgtaaggagtgtggaaaagctttcgcctcattatcatcgctgcacaggcacaagaaaactcactag

SEQ ID NO: 21617 - DNA, 1932 bp, Artificial Sequence
  Description of Artificial Sequence: Synthetic coding sequence
atggccagcgtggccctggaggacgtggccgtgaacttcacccgggaggagtgggccctactggggccctgtcagaaaaacctgtacaaggacgtgatgcaggagacgattaggaatctggactgtgtggttatgaagtggaaagaccaaaacattgaagatcagtacagataccccaggaagaacctgcggtgtcgtatgctggagcgatttgtcgagtccaaagatggaactcagtgtggggaaacctcctcccagatccaggacagtatagtgaccaaaaatacactgcccggcgttgggccttgcgagagttccatgaggggggagaaggttatgggacattcatcactcaactgctatatcagagttggcgccgggcacaaacctcacgagtatcatgaatgcggggaaaaacccgatacccataaacagcgggggaaggccttttcctaccataattccttccaaacccatgagcgtctgcatacggggaagaagccatatgattgcaaagaatgcggaaagtccttttcatctctcgggaatctgcagagacatatggccgtgcagcgcggcgacggcccatataagtgtaagctttgtggtaaagcttttttttggcccagtctactccatatgcatgagaggacgcatacaggcgagaaaccctatgagtgcaagcagtgtagcaaagcgtttagcttctactcttcttacttacggcacgagcgcactcacacaggcgagaaaccatatgagtgtaaacaatgtagtaaggcttttcctttctactcttcttacctgcgccacgagcgcactcatacaggggaaaaaccatacaaatgtaagcagtgctcaaaagcgttccctgattcctcaagctgtctcatccacgaacggacacatacaggggagaaaccatacacttgtaagcaatgcgggaaggcattctctgtctccggatccctccagagacatgaaaccacccattccgccgagaagccatatgcctgtcagcaatgtggtaaagcattccaccatcttggctcattccagagacacatgatccgtcacacaggcaacgggccacacaagtgcaagatttgcggcaagggcttcgactgcccttcaagtctccaaagtcatgaaaggacacacacaggcgagaaaccatatgaatgcaaacaatgtgggaaggccctgtcccatagatcctcattcagatcacatatgatcatgcacacaggggatggaccccataaatgcaaagtctgcggaaaagccttcgtttaccccagcgttttccaacggcatgaacgaacacataccgctgagaagccatataaatgtaaacaatgcgggaaggcatataggatcagtagctccctgcgcaggcacgagacgactcataccggggaaaagccatacaagtgtaagttgggaaaggcatgtattgacttttgcagctttcaaaaccacaaaactactcacaccggcgagaagccatacgagtgtaaagagtgcggaaaagcttttagtcgatttcgctatttgagtcgccataagcggactcacactggggagaagccctatgagtgtaaaacttgtagaaaagcttttggtcactatgataacttgaaagtacatgagcgcatacatatgcgcgaaaaaagctatgaatgtccccagtgtggtaaggccttcacacacagccggttcctccaaggccacgaaaagacccacaccggggaaaatccctacgagtgcaaagaatgcgggaaagcttttgctagtctatcgagccttcatcggcacaaaaagacgcactggaagaaaacccatacgggggagaacccttatgaatgcaaggagtgcggtaaagcgtttgccagcttgtcttcactgcacagacataagaagacccactag

SEQ ID NO: 21618 - DNA, 1053 bp, Artificial Sequence
  Description of Artificial Sequence: Synthetic coding sequence
atgccccccggccggtggcacgccgccagcagcggccccgtgttcgaaggagcccgtctacagactgtgaagaaagaggaagaggatgaatcttatacgcctgttcaggcagcccgcccacaaaccttaaatcgccccggccaagagctgttcagacagctttttaggcagctgcgctatcacgaaagctctggcccactggaaacactcagtcggctgagggagctgtgtagatggtggctgcgtcccgacgtgctgagcaaggcacaaatcttagagctgctagtattggagcagtttctgtcaatactccccggtgagctccgagtgtgggtgcagctgcataatcctgaatctggagaggagtggccttgctggagaagttgcagaggcactcttatgggacatccgggagggactagggctccagaaccaagatgcgcactcgacggatacagatccaggtctgctcaaatctggtctttagcctcacctctccggtccagttcagcgctgggcgaccacttagagcccccttatgaaatagaagcgcgagattttctggcaggtcagtctgacaccccggcagcgcagatgcccgcgttgtttcctagagagggatgccctggagaccaggtgacccccacaaggtcccttactgcacagttacaggaaaccatgacatttaaggatgtcgaggtgacattctctcaagatgagtggggatggctcgactctgcgcagcgaaatctctatcgggatgtgatgctggagaattatcgcaacatggcgtctctcgtgggtcccttcaccaagcctgccctgataagttggctcgaagccagagaaccctggggcctgaacatgcaggcggctcagccaaaggggaacccggtagccgctcctactggggacgacctgcagtctaagaccaataaatttatcctcaatcaagaacctctcgaggaagctgaaactctggctgtgtcttcaggatgccccgcaactagcgtgtccgagggaattggtcttcgcgaaagcttccagcaatag

SEQ ID NO: 21619 - DNA, 3096 bp, Artificial Sequence
  Description of Artificial Sequence: Synthetic coding sequence
atgccccccggccggtggcacgccgcctaccccgcccaggcccagagtagcagggaacgtggtcgtctccagacagtgaaaaaagaggaggaagacgaatcgtacacacctgtccaagccgccagaccccagacactgaaccgccccggacaggagctgttccgccagctgttcagacagctgcgctaccacgagtcttctggcccactcgagacactctctcgattaagggaactatgcagatggtggctgaggcccgatgtgctgtcgaaggcccagattctagagctgctggttctcgagcagtttttgtccatattgcccggggagctccgcgtctgggtacagctgcacaatccagaaagcggcgaggaagcggtggctctgctggaggaactccagagggacctcgacgggacttcatggcgagacccaggtcctgcgcagagccctgatgtgcactggatggggacaggtgccctcaggtctgcacagatctggtccctggcgtcaccgcttagaagttcttcagcactaggcgatcacctcgagcccccctacgagatcgaagcccgggattttctcgctggtcagtccgacacacccgccgctcagatgccggctctcttccctagagagggctgtcccggagaccaggtgacccctacaaggtcactgacagcccaattgcaggagaccatgactttcaaggatgtggaagtaacattttcacaagacgagtggggttggctggattctgcacagcggaacctttatcgcgatgttatgctcgagaattacaggaacatggcctctctggtgggaccgtttaccaaaccagcgctcatttcttggttggaggcgagagagccttggggcctcaacatgcaagccgcgcagccgaaaggaaacccagtggcggctcctacaggggacgaccttcagtcaaaaactaataagtttatcttaaaccaagaaccactggaagaggctgagacattggccgtgagcagcgggtgtccagctacatctgtttctgaggggatcggactgcgggagtcctttcagcagaaatccagacagaaagatcagtgcgagaacccaatccaggtgagggttaagaaagaggaaacaaacttttcgcatcgcactgggaaggacagtgaagtttccggttccaactcccttgatttaaaacatgttacttacctgagggtttccggtaggaaggaatcactaaagcatggctgtggaaaacactttcgaatgagcagccaccactatgattataagaaatatgggaagggcctccgacatatgatcggaggattctctctgcatcagaggattcatagcggtctgaagggcaacaagaaggatgtttgtgggaaggactttagcctgtctagtcaccatcagcgaggacagtctctgcacaccgttggtgtgtctttcaaatgcagtgactgtgggcgcacattctcccactccagccatttagcatatcaccagcgactacatacgcaggaaaaggctttcaagtgtagggtgtgcggtaaggcctttcgttggtcaagtaactgtgccagacacgagaaaattcacacaggggttaagccatataaatgtgatctgtgcgagaaagcctttcggagactctctgcctatcggctgcatagggagactcacgccaagaaaaaatttctcgagctgaaccaatacagggccgcactcacatactcctctggatttgaccaccatctcggcgaccagtcaggggaaaagctgttcgattgcagtcagtgtcgcaagagctttcactgcaagtcttacgtactggaacaccaacggatccacacacaagagaagccttacaagtgtactaaatgtagaaagacattccgatggaggagtaacttcactcgacacatgagactgcatgaggaggagaagttctataaacaggatgagtgtagggaaggattccggcagagccctgactgttcacagccacagggcgctcccgcagttgagaagacctttctgtgtcaacaatgtggcaagactttcactcgaaagaaaaccctcgtagaccatcagcggatccatacaggagaaaaaccttaccagtgctctgactgcggaaaagatttcgcttatagatccgcatttatcgttcacaagaaaaagcatgccatgaagaggaagcccgagggcggcccctccttctcccaagacaccgttttccaggtgccacagtcaagccattccaaggaggagccttacaaatgctcacaatgcggcaaagctttccggaaccactcttttctcctaatccaccagagagttcataccggtgagaagccatacaaatgccgcgaatgcgggaaggccttccgctggtcttctaacctgtaccgacaccagcggattcactccctgcagaaacagtatgactgccacgaatctgaaaagacacctaacgtggaacccaaaatactgacaggtgaaaaacggttttggtgtcaggagtgcggtaagacatttaccagaaaaaggacactattggatcacaaaggtattcactctggagaaaaacggtataaatgcaacctgtgcggcaagagctacgatcgcaattacagactcgtgaaccatcagcggattcatagcacagagcgcccatttaagtgtcagtggtgtggtaaagaatttataggacggcacaccctcagctctcaccaaaggaagcacaccagggctgcccaggcggagcggagccctcctgctcggtcgagctcccaggacaccaagctgagactccaaaaactaaaaccaagcgaagagatgcccctggaagactgcaaagaggcttgcagccagagcagtaggctaactggattacaagacatctctattgggaagaagtgccataaatgtagtatctgtggcaagacttttaacaagagcagccaattaatatcgcataaacggtttcatacgcgagagcgcccttttaaatgttccaaatgcggtaagacgtttagatggtccagcaacctggcccggcatatgaagaaccacatccgagactag

SEQ ID NO: 21620 - DNA, 3096 bp, Artificial Sequence
  Description of Artificial Sequence: Synthetic coding sequence
atgccccccggccggtggcacgccgcctaccccgcccaggcccagtccagccgggagcgcggccgcctgcaaaccgtcaaaaaggaggaagaggatgaatcatacacacccgtccaggcggcccggccgcaaacactgaaccgtccaggtcaggaactcttcagacagctgtttagacagctgcggtatcatgagtcttcagggcccctcgaaacgctgtcccggctgcgggaattatgtcgatggtggctgaggcctgacgtgctaagtaaagcccagatacttgagctattggtgctggaacaatttctgtccatattacctggcgaactgcgggtgtgggtgcagttgcataaccccgagtcaggggaggaagctgtcgccctgctcgaagagctgcagagagacctcgacgggaccagttggagagacccaggcccagcccagagtcccgatgtgcactggatggggaccggcgctctacggtccgcacagatctggagtttggcctcacccctgaggtctagctctgccctcggcgatcacctggaaccaccttacgagatcgaggccagagattttctcgccggtcaaagcgatactccagcggctcagatgcccgcattatttccacgtgaaggatgccctggcgatcaggttaccccaacgcgttctctcactgcccagttgcaggagaccatgacatttaaggacgttgaagtaacttttagccaagacgaatggggatggctggattctgcccagcgaaacctctacagagacgttatgctcgagaattaccggaatatggcctcactggtggggcccttcaccaagcctgcactcattagctggctggaagctcgggaaccctgggggctcaatatgcaggccgcccagccaaaaggcaaccctgtcgccgccccgacaggggatgacctgcaatctaagaccaacaagttcattctcaatcaggaaccactcgaggaagccgagactctcgccgtcagttccggctgtcccgctacaagcgtcagcgaaggtattgggttacgcgaatcttttcagcagaagtcaaggcaaaaggaccagtgtgagaatcctatacaagtcagggtgaagaaagaagagaccaacttttcacacagaacaggaaaggacagtgaagtatccgggagtaatagccttgaccttaaacacgtcacatatctgagggtcagcgggcgaaaagagtccttaaaacatggatgcggtaagcatttccggatgtcctcccaccattatgactacaagaagtacggcaaaggcctgcgacatatgattggaggattctcactacaccagcgcattcattcaggactcaagggtaataaaaaggatgtatgtgggaaagatttttcactgtctagccaccaccagcgcggccagtctcttcacaccgtgggggtctcattcaaatgcagcgactgtggacggacatttagccactcaagtcacctcgcataccatcagagactgcatacacaagaaaaggctttcaagtgtcgtgtttgtggaaaggcattccgttggtcttcaaattgcgccaggcacgaaaaaatacatactggtgtaaagccctataaatgcgacctgtgcgagaaggccttccggcgcctgtctgcttacagactgcaccgcgagactcacgctaaaaaaaagtttctggagctcaaccagtacagggctgctctaacctacagttccggattcgaccaccatctgggcgatcagagcggtgagaaattatttgactgttcccaatgtaggaagtcctttcattgcaagagctatgtgctggagcaccagcgcatacatacacaggaaaagccgtacaaatgcacgaagtgccgcaagacctttagatggaggtccaattttacccgccacatgcgactgcacgaggaggaaaagttctacaaacaggacgaatgccgggaggggttcaggcagtcgcccgactgttcgcagccacagggagcccccgctgttgagaaaacattcctgtgccagcaatgtgggaaaacatttacgcgaaaaaagacactggttgaccaccagcgtattcacacaggtgagaagccatatcagtgttccgactgtggcaaagacttcgcgtatcgctcagctttcatcgtgcataagaaaaaacacgctatgaagagaaagccggagggcggtccctcgttttcacaggacacggtgtttcaggtgccacaaagcagccacagcaaggaggagccctacaaatgctcacagtgcgggaaagccttccggaatcactcatttctgctgatacaccaaagggtccatactggggaaaaaccttataaatgccgggaatgtgggaaagctttcaggtggtccagtaacttatacaggcaccagcgaatccattcccttcagaaacaatacgactgtcatgagtccgaaaagaccccgaatgtggaaccgaagatacttacgggcgagaagcgattctggtgtcaagaatgtggaaagacatttactcgtaagaggacgctgcttgaccacaaagggatccatagcggggagaaacgctacaaatgcaatctctgtggaaaatcatacgatcgcaactataggctggtgaatcaccagaggatacattcaacagaacgaccatttaaatgtcaatggtgtggcaaagagttcattggacgccacactctttcgagtcaccaacgcaaacatacaagagccgcgcaagccgagagatctccccccgcgcgctcttccagtcaagacaccaagctacgtctgcagaaacttaaaccgtcggaagaaatgccactggaggattgtaaagaagcctgctcacaatcctcccgactgaccgggttacaagacatctcgatcggtaagaagtgtcataagtgcagcatctgtggaaaaactttcaacaagtcatctcagctgatttcccacaaaaggttccacacccgcgagcgccctttcaaatgttcaaaatgtggaaagaccttccggtggtcctcaaacctggcccggcatatgaagaaccatatccgggattag

SEQ ID NO: 21621 - DNA, 822 bp, Artificial Sequence
  Description of Artificial Sequence: Synthetic coding sequence
atgccccccggccggtggcacgccgccatcagcagcggccccgtgtttgaaggagcacgggccctgcagactgtaaaaaaggaggaggaggacgagtcttacactccagtccaggccgcaagaccacagacgctgaacagacccggtcaggagttgttccggcagctattcaggcagctgaggtatcatgaatcttctggaccactggagactctgtcaagactgagggaactatgccgatggtggttgcgccccgacgtgctttctaaagctcaaattttggaactactggtcctggagcagtttttgtctatactgcccggcgagctcagagtgtgggtgcaattacataatcccgagagcggcgaggaactctggccatgctggcggagctgcagaggcaccctgatgggccacccaggaggcacgcgagccctaccagaaccaaggtgtgcgctggacggctatagatcccttcgatccgcacagatatggtcactcgcttcccccttaaggtcctcttcagccctgggcgaccatctggaacctccctatgagattgaggcccgggacttcttggcgggacagagcgacacacccgccgctcagatgcctgcgctctttccgagggagggatgtcccggggatcaggtgacgccgactcgctccctgacagcccaactccaagaaaccatgaccttcaaggacgttgaggtcacattttcacaggacgagtggggttggttagactctgcgcagcgtaacctgtatcgtgatgtcatgctggagaactataggaatatggcttccctagggaagtag

SEQ ID NO: 21622 - DNA, 1353 bp, Artificial Sequence
  Description of Artificial Sequence: Synthetic coding sequence
atgcccagccccctgggccccccctgcctgcccgtgatggaccccgaaactacgctagaggaacccgagaccgcacgcctcaggtttcgcggtttctgctatcaggaagtggccggtccccgggaggcgctggcacgtctgagggagctctgctgtcagtggctacaacccgaggcccactcgaaggaacagatgctggagatgctggtgctggaacagttccttgggacgctgccgccagagatccaggcatgggtgcgggggcagcggcctggcagcccggaggaagcggccgcactggttgaaggcctgcaacacgaccctgggcagctactgggctggatcacggcacatgtgctgaagcaagaggtgctgcccgccgctcaaaaaaccgaggaacccctagggagtccacatccaagcggcacagtcgagagcccgggagagggccctcaagatacccggatcgaaggctctgttcaactgtcatgctctgtcaaggaagaaccgaacgtagatgggcaggaggtggccccgagctcaccgccactcgccgcacaatctccagagggtaatcacggacatcaggagcctgcatctacatcctttcacccgcctaggattcaggaggaatggggactcctcgaccgaagtcagaaggagctctactgggatgccatgctagagaaatatggcaccgtggtgtcacttggcctacccccacaccagccggaagcccaagctcagtccgagctgggcatgctactgacgggcaccggggtgtgtagaagcctccgctccggcaacgaaagcgagggccctcccgggtgccccgaggcccagccacctcagggtcccggccccgcggcctgggaggggctgagtggagccgcaacgcccgccccaactgtgaggccgggaacccccccggtgccaacgcaaccaacacccgcagagacccggctggaacccgctgccacgcccaggaaaccgtacacatgcgagcaatgcggcagaggcttcgattggaagtcggtgtttgttatccatcaccgaactcacactagcgggcccggggtccaatcacccggtcttgcgaccggagagtccacagaaaagccaccgcagggcgaggttgcattcccacatcaccccagaaggagcttgacaggtccacgcagctacccttgcgaggagtgcggatgctccttcagctggaaatcacagcttgtaattcaccgtaagtcccacaccggacaacgaagacatttttgttctgattgcggccgtgctttcgactggaagtctcagctggtgatccacagaaagggccaccgacccgaggtgccctag

SEQ ID NO: 21623 - DNA, 1044 bp, Artificial Sequence
  Description of Artificial Sequence: Synthetic coding sequence
atgagcatggaccggaagtggcacccccccgccctgcacctgcagcatagcccactgagaggcaccatggataccaaaaatcagccccctcacccatcgacccacccggggtttaggcggtcgggcggatgctggacagggcaccgccggaactgcaccggcatgcggtgctggaggtcaacggcacaatggtctccatgggtcaggacctctcaaccccatcctgcacccctgcctggagcttgtacccacccagctgctggattggccggacagggcctgtgcgccacatctcctacacagttgtcacacctacctgaggagcaccccgtgacgtatcaaaatcggccgcatccttcatttatgcagacgccatgcctcaccgtaccccctacacgtgccggattgccacctcatcagccggaggcacaagcccagtcggaactgggcatgctgctaacggggacaggggtttgccggagcctgaggagcggcaacgaaagcgaggggccgcctggttgccctgaggctcaaccccctcaaggcccaggtccagcggcgtgggagggcctgtcaggtgctgcaacacctgctccgaccgtgcgcccgggcaccccacccgtccccacccagccaactcctgccgagacacgcttagaacccgcggccacccctcgcaagccatacacttgtgaacagtgtggacgcggattcgattggaaatctgtgtttgtgatccatcaccgaacccacacctctgggcctggcgtccagagtcctgggttggcgactggagaatccactgagaagcccccacagggcgaggtcgctttcccacatcaccctcgccggtctctgaccgggccccgctcttatccttgtgaggagtgcgggtgttctttttcctggaagagccagcttgttatccaccggaagagtcataccgggcagagaagacatttctgcagcgattgcggaagggcctttgactggaaatcccaactcgtgatccatcgcaaagggcaccggccagaagtgccctag

SEQ ID NO: 21624 - DNA, 468 bp, Artificial Sequence
  Description of Artificial Sequence: Synthetic coding sequence
atgcccagccccctgggccccccctgcctgcccgtgatggaccccgaaaccaccctcgaagagcccgagacagcgaggctgcggttcaggggattctgttaccaggaggtggcagggcctcgtgaagccctggcacgcctgcgggaactatgctgccagtggctgcaaccagaagctcatagcaaggagcagatgctggaaatgcttgttctcgagcagttccttgggacattgccgccagagatacaggcctgggtgcgcggacagcgccccggctctccagaggaggcggccgcactggtagaggggctacagcatgaccctggacagcttttaggatggataactgcgcacgtgctgaaacaagaggttctgcccgcagcccaaaagacagaagaaccactgggtgccccaacaccacaggggcagtggagcccactcggcaaggttcctcggacccctgaatag

SEQ ID NO: 21625 - DNA, 1269 bp, Artificial Sequence
  Description of Artificial Sequence: Synthetic coding sequence
atgcccagccccctgggccccccctgcctgcccgtgatggaccccgagaccaccttggaggaacccgaaactgctcggctccggttcagaggcttttgttaccaggaggtcgcagggcctagagaagctcttgctcgccttagagagctgtgttgtcaatggctccaacctgaggctcactccaaagagcagatgctggaaatgctagtcctagagcagttcctgggtacattacccccagaaattcaggcttgggtgaggggccagagacccgggagccctgaagaggccgcagcactggttgaggggctgcagcacgaccccgggcagctcctcggatggattacagcacacgtgttgaaacaggaggttctcccagcggcccaaaaaacagaagaacctctgggatcgcctcacccaagtgggactgttgagtccccaggtgaagggccccaagacacaagaatcgaaggcagtgtgcagctatcttgctcggtcaaagaggagcccaatgtcgacgggcaggaggtcgccccctcctcaccgccactcgcagctcaaagtcccgagggcaaccacggccaccaggagcctgcatctactagttttcacccaccacgtatccaggaagagtggggactcctcgaccgatcacagaaggagctgtactgggatgccatgttggagaagtacgggacagtcgtgagcctgggcctgccacctcaccagcccgaagctcaggcccaatcagagctgggtatgctcctcaccggcactggggtatgtaggtctctgcgaagtgggaatgagtccgaaggcccacccggatgcccagaggcccaacctcctcaggggccaggacccgctgcttgggaggggctctctggcgctgccacccccgccccaaccgtccgcccagggacacccccagtcccgactcagcccacccccgccgaaacccgacttgagccagctgccacaccaaggaagccttacacttgtgagcagtgtggaagaggtttcgattggaagagcgtctttgtgatacatcaccggacacatacttctggacctggggtgcagtccccaggccttgctactggagaaagtactgaaaagcctccacagggcgaagtcgcgtttccacaccaccccaggcggtcactgacaggcccacgcagctatccttgcgaggaatgtgggtgttctttttcttggaagagtcaattagttattcacaggaagtcccatagaccagaagtcccttag

SEQ ID NO: 21626 - DNA, 1353 bp, Artificial Sequence
  Description of Artificial Sequence: Synthetic coding sequence
atgcccagccccctgggccccccctgcctgcccgtgatggaccccgaaacaaccttggaagaaccagagaccgcccgcctcaggttccgaggattctgttaccaagaggtcgccgggccacgggaagccttagccagactgcgggaactatgttgccaatggcttcagccagaagctcacagcaaagagcagatgcttgagatgctagttttggagcagtttctcggcaccctgcctcctgaaatccaggcatgggtaagaggccagcgccccggatcaccagaggaagctgcagctctggttgagggcttgcagcacgaccccggtcagctcctcgggtggattaccgctcacgtcctgaagcaggaggttctgcctgcagcacagaaaacggaagaaccattagggagtcctcaccccagtggcaccgtggagagcccaggggagggaccacaggacacccgaatcgagggctctgtacagctgtcctgctcagtcaaagaggagcctaacgtggatggtcaagaggtggccccttcctccccaccactggctgcccagtcccctgaagggaatcacggtcaccaggagccggctagtacaagttttcatccccctaggattcaggaagaatggggtctactggatcggagccagaaggagctttactgggacgctatgctcgaaaagtatggcactgtcgtgtccctcggcctgcctccgcaccagcctgaggctcaggctcagtctgagctgggaatgctcctgaccgggaccggggtttgtcggtctttacgcagcggcaacgaatccgaaggccctcctggatgtcccgaggcacagcctccgcaggggccgggtcccgcagcctgggagggcctgagtggcgcagccacgccagcgcctactgttagacctggcacaccgccagtgccaacccagcccacacctgcggagaccagattagagccggccgctactcccagaaagccttacacatgcgaacagtgtggaagaggcttcgattggaaatcagtgtttgtcattcaccatcgcacacacaccagcgggccaggcgtacagtctcccggactggcaaccggggaaagtacagaaaagccgccccagggcgaagttgcctttccccaccacccccgacgttctttgacaggcccccgctcttacccctgtgaggagtgtgggtgttctttctcatggaagtctcagctcgtgatacacagaaagagtcacacaggacagcggcggcacttttgtagtgactgcgggagagccttcgactggaaaagtcagctcgttatccaccgcaaggggcacaggccagaggttccatag

SEQ ID NO: 21627 - DNA, 3042 bp, Artificial Sequence
  Description of Artificial Sequence: Synthetic coding sequence
atgggcgaccccggcagcgagatcatcgagagcgtgccccccgccggccccgaagcttctgagtcaaccactgatgagaacgaggatgacatccagttcgtgagtgaagggccccttcggccagtgctggagtacattgacctcgtgtcgtctgatgatgaagaaccaagtacatcctacactgatgaaaatattaagagaaaggaccacatcgactaccagaaggataaggtggcactgacactggcccgtctggctaggcacgtcgaggttgagaaacagcagaaggaggagaagaacagagcatttagagagaagatcgacttccagcatgctcacgggctccaagaactcgaattcatccgcggccactccgacaccgaagcagcccgactctgcgtcgatcagtggctgaagatgcccggcttaaaaaccggaaccataaactgcggtaccaaatctagttttcggagaggcggccacacctgggtcagtggcaaaccaatcctatgccccatcatgcattgtaataaggagtttgacaatggacatctcctactcgggcatctcaagagatttgaccacagcccatgcgatcccacaattactctgcacggacctttttttagttcatttgcctgcgtcgtctgttacaagaagttcgtaacccagcagcaataccgcgatcacttatttgataaagaggccactgatgatggccacaataacaacctgctaccccagataatccagtgctttgcttgtccaaattgctttcttctgttttcacgcaaggaggaatgcagtaagcacatgtctgggaagaaccattttcaccagtcattcaagctgggagataacaaaggcatcgctcacccaatcagtttccctagttttgccaagaaattgttgatcagcctttgcaaggatgtgccattccaggtcaaatgtgtggcctgtcacaaaacgttgcgatcccatatggagctgaccgcacactttcgtgtgcattgcaggaacgccggtcctgtagccgtggctgaaaaatcaatcactcaggtggctgaaaagttcattctgagaggatattgcccagactgtaaccaggttttcgtcgacgaaacatctacccagaaccacaagcagaatagcgggcataaagtccgtgtcataaattccgtcgaggaaagcgttctcttatattgtcacagttccgaaggcaacaaagacccctcttctgacctgcatttactgctggaccagtcaaagtttagcagcctgaaaagaaccatgtccattaaggaatcttccagccttgagtgtatcgccatccccaagaagaaaatgaatctcaaagacaagtcccatgagggggtagcatgtgtccaaaaggaaaagtccgtggtgaagacctggttctgcgaatgcaaccagcgcttcccatccgaagatgccgtggagaagcacgttttttcagcaaacaccatgggctataaatgcgtggtctgcggcaaagtgtgtgacgattccggtgttatacgactacatatgagccgcatccacggaggagcccatttaaacaactttctgttctggtgcagaacctgtaagaaggagctgacacggaaagacaccattatggcccatgtaaccgagttccataacgggcacaggtacttttacgaaatggacgaagtggaaggagagacccttccatccagctccaccaccttggacaacttgacagcaaataagccaagctctgccatcacagtcattgatcactcacccgccaactcttccccccgaggaaagtggcaatgcagaatctgtgaagatatgtttgacagtcaggagtacgttaagcagcactgcatgagcttggccagccataagtttcacagatacagttgcgcacactgcaggaagcccttccataagattgagacgttataccgtcactgccaggacgagcacgacaatgagatcaagatcaagtatttttgcggtctgtgcgatttgatcttcaacgtggaagaggccttcctgtcccactacgaagagcaccacagtattgattatgtgtttgtgtctgagaagacggagacttcgatcaaaactgaagatgacttccctgtcatcgaaactagcaaccagttgacctgtggatgtcgcgaatcgtatatctgcaaggtgaatcgcaaagaggactactcaagatgccttcagattatgctggacaaggggaagttgtggtttaggtgcagtctttgttccgccaccgctcaaaatcttaccgacatgaatactcatatacaccaagtgcataaagagaagagcgacgaggaagagcagcaatatgttatcaaatgcggcacgtgcactaaggctttccatgaccccgagtcggcacagcagcacttccacagaaagcactgtttcctccagaagccctccgtggcacacttcgggagcgagaagagtaacttatataaattcactgcctcagcgtcccatacggagcggaagttgaaacaggccattaattattcaaagagtctggacatggaaaagggggtagagaacgacttgtcttaccagaacatcgggggcaacaccaactggaaacctcctctcaactgcaaaatatataactatctgaatcggatcggctgctttttcctccaccccaggtgctccaaaagaaaagatgccgcggacttcgcaatatgtatgcatgccgggagactggatgagcaactgccaaagcaaataccatttactatactgtctggagaccaagggtttctggagttggagaatcaatttaaaaaaacgcagcgccctgcacacatcctcaatccacaccacctggagggcgatatgatgtgcgcactcctgaatagcatttctgataccacaaaagaatgcgactctgacgacaatatgggagccaaaaataccagcattggagaagagtttatatctacagaggatgtggaactcgaggaggccatccgacgaagtctagaggaaatgtag

SEQ ID NO: 21628 - DNA, 3186 bp, Artificial Sequence
  Description of Artificial Sequence: Synthetic coding sequence
atgggcgaccccggcagcgagatcatcgagagcgtgccccccgccggacccgaagcatccgaatccaccactgacgaaaacgaggacgatatccagtttgtgtccgaaggaccattaaggcctgtcctggagtatattgaccttgtgtcctccgacgacgaggagccttcaacaagttatacggatgagaatattaagcgcaaggatcacatcgattatcaaaaagacaaggttgccctgaccctcgcccgactggccagacatgtcgaagttgaaaagcagcaaaaggaagaaaagaatcgagccttccgcgaaaagatcgatttccagcatgcccatggtctacaggagctggagtttatccggggccatagcgatactgaagctgctaggctgtgtgtggatcaatggctgaaaatgcccggcctgaaaactgggacaatcaattgtggcacgaaatccagtttccggcgagggggtcatacgtgggtcagcggtaagcctattctttgtcccataatgcattgtaataaagagtttgataatggccacctgctgcttggacacctcaaacggttcgatcactctccttgtgaccccaccatcacactccatggcccttttttcagttcattcgcgtgcgtcgtctgttacaagaaattcgtgacacaacaacaatatcgagaccacctgttcgacaaggaggcaactgatgatggccataacaataatttattacctcaaataatccagtgctttgcttgtccgaactgtttcctcctcttttcgagaaaggaggaatgctccaaacacatgtcgggtaaaaatcacttccaccaaagcttcaaactaggagacaacaaggggatcgcacatcctattagtttcccgtcattcgcgaaaaagctactgatcagcctctgtaaggatgtccctttccaggtgaaatgcgtcgcttgccataaaaccctgagatcacacatggaactgaccgcacattttcgagtccactgtagaaatgcaggtcctgtcgctgtcgccgagaagtctataacacaagttgccgaaaaatttattctgcgaggatactgtcctgattgcaaccaggtctttgtcgacgagaccagtacccaaaaccacaaacaaaactcgggacataaggtacgggtgataaactctgttgaggaatcagttttactgtactgccattcttcagagggcaataaggatccctcaagtgatctgcatttactgctcgaccagagtaagttcagtagcttaaaaaggacaatgagcattaaagagagttcctctttagaatgtatcgctatccctaagaaaaagatgaacttaaaggacaagtcccacgagggtgtggcttgtgtgcagaaagagaaatctgtcgtcaagacttggttctgcgaatgcaaccagcggttcccctccgaagatgcagtagagaagcacgtctttagcgctaataccatggggtataaatgcgttgtgtgcgggaaagtgtgcgatgatagcggcgtcatcaggcttcatatgagtaggattcacggtggggcccacctcaacaacttcctattttggtgccggacatgtaagaaagagctgacgcgtaaagacacaatcatggcgcatgtgactgagtttcacaacggccaccgctatttctatgagatggatgaggtggagggtgagactttaccctcctcctcgacaacgcttgacaacttgactgctaataaacctagtagtgccataacggtgatcgatcacagccctgccaattccagcccgcgcggaaagtggcagtgcaggatttgcgaggatatgttcgatagtcaagaatatgtgaaacagcactgtatgagtctggctagccacaaatttcatcggtactcttgtgcgcactgccgtaaacctttccacaaaatcgagacgctctatcggcactgtcaggacgaacacgacaacgagatcaaaattaaatacttttgcgggttgtgcgatctcatctttaatgtagaagaggcgttcctgtcacattacgaggagcaccacagtattgactacgtctttgtgagcgaaaaaacagaaacgtccataaagacggaggacgactttccggtgatcgagacctcaaaccagctgacgtgcggatgccgcgagtcttacatttgtaaagtgaaccgtaaagaggactactcaaggtgtctacagatcatgttagacaaaggtaagctgtggtttagatgtagtttgtgttctgccaccgctcaaaatctgaccgacatgaatactcatatccatcaggtccacaaggagaaatccgatgaggaggagcagcaatatgtgatcaagtgcgggacatgtacaaaggcctttcatgatcctgagagtgctcagcagcattttcacaggaagcactgctttctgcagaagccctccgtggcgcacttcggatctgagaagagcaacctttataagttcacagcaagtgcatctcacactgagagaaaactaaaacaggccatcaattattccaaatctctggacatggagaagggagtggagaacgatctatcataccagaatatcgaagaagagatcgtcgagctccctgaccttgattacctgcggacaatgactcacatcgtcttcgtggacttcgacaactggtccaacttttttggccatctgcccggtcatcttaaccaggggacctttatatggggcttccagggcggtaatacaaactggaaaccccccctaaattgcaagatttacaattacctgaaccgtatcggctgtttcttcctccacccgaggtgcagcaagaggaaggacgctgcagacttcgctatctgcatgcacgcgggccgactggatgaacagttgcccaagcagattccattcactattttgtccggcgatcaggggtttctcgaacttgaaaatcagtttaaaaagacccaacgccccgctcacattctcaaccctcatcaccttgagggggacatgatgtgcgctctgcttaattctatctcagacacaacaaaggaatgcgacagtgacgataatatgggcgccaagaatacaagcattggagaagaattcatcagcaccgaggacgtagagttggaggaagccatccggcggtctctggaggaaatgtag

SEQ ID NO: 21629 - DNA, 1680 bp, Artificial Sequence
  Description of Artificial Sequence: Synthetic coding sequence
atgggcgaccccggcagcgagatcatcgagagcgtgccccccgccgggccagaggcgtcggaatcgactaccgacgagaacgaggacgacatccagttcgtgagcgagggacccctgcgccccgttctggagtatattgatcttgtctcctccgatgatgaagagccttcaacttcttataccgacagaatgcccgagtcaaaggttcctagttccgagaatcatcggccagaaatgtgctcctcttgcaacgtgcctttacccatcggagatagctcgtccttcagcgggagttgtagctccagtcctgagcgcatcgtctcacaaacttcgagcgtggaaaaccccttagagaaccagaagaatgatcaaaacaactccgacacgaaaatatcagagactgagaccttgaagtcatctcagaatttccaaacactcccttcatctcccctcctggtcccccaggaatcacttgcatccagcgaagtgaaggaaaacctccgaatagattcttcatcagctagtcaacatgggagagacgctatcctgtacctgcagacacaggtcgctgagatgtccagagtcattcgtgatttgcagagccggtcatgctttaggttccaccactctagacctagcgaaaactcatccgtcccctgggatatctccacgagcaaggaggagaatctgtccaccgttgaagaggaaaccgattacaaaagtcccagcgccgacgataaggggcagccttccgatccctcacaatccagcttcacaggcctcctgaagagaatggaacagagaggagtcatcaaacgagttactctacaaagtgaggcagagagctgcgagggtaagcctgactgcgtgacgtcaaaaaagcggctggttccccctctgcacccactgcttcgaatcgccaccaccgaggtgtttaaggacccagccgattgtcacccgagttcctttatgggacatagggtatatcctgtcgcaaaagacaccagccctttccagccaaatccacctgctgaggggcctatagttgaggctctcgagcattctaagcggggaaatacaactagtccgctggacagcacctcaaaggagatggaggtgatgggctgccgattttatcacgcggcctcaatagcggctcgcgccgctagttacatggcctacatgacacagtatcagagaaagctttgggaggatatggaggaccttgtccatgaccccgagtttgaccggggaaaagcccggtgtattatctctgacggtatggatgccggcctgtggcagttgtgtacaacaagggatatcatggactctgtggttcgcgtcatggcgatggctattgactataggcggcaagcctggctgcgcctgaccagcctgacgaagaaaactcaagagaagatatcacatttaccttttgacggcacatccttgttcggtcaggacgtgaaggctgtagtggcagaggacaataatattaaggaaaacgattataaagatcacaagtattataaccaacaccgctatttctactcccacgatcagaaagctcattaccataaccgcggctactccaaaggcgattggtataagcctagaaaccatccgtacaggtatcggaaaaaaggggactcacccgagaggcacggctataaaaactag

SEQ ID NO: 21630 - DNA, 1569 bp, Artificial Sequence
  Description of Artificial Sequence: Synthetic coding sequence
atggccgtgagccacctgcccaccatggtgcaggagagcgtgacctttaaagatgtggcgattctttttacgcaggaggaatggggacagctgtccccagcccaaagggctctctatagagacgtgatgctggagaattactcaaacctggtttccctggggctgctcggtccgaaacccgacacgttcagccagctcgaaaagcgggaagtttggatgccagaggacactcccggcggcttctgcttggactggatgactatgcctgcatccaaaaaatccacagtgaaagctgagatacccgaggaggagctcgatcagtggaccattaaggagagattctccagctcatcccattggaagtgcgcgtcgctgctcgaatggcagtgtgggggacaggagatttctctccagcgggtggttctgacccacccgaacactccttcacaagagtgcgatgagagcgggagtacgatgagctcctcactgcattctgatcagtcccagggcttccagccaagtaagaatgctttcgagtgttccgaatgtggtaaggtgttctctaaaagttccactcttaataagcaccagaagatccataacgagaagaatgccaatcagaagatacatatcaaggagaaacgttacgagtgccgggaatgcggaaaggcgtttcatcaaagcacccacctgattcatcatcagaggattcacacaggggaaaagccatatgagtgcaaggagtgcggcaaagcctttagcgtgtcttcctcactcacatatcaccagaagattcatactggagagaagccctttgaatgtaacctctgcggcaaagcttttattcgcaatatacatctggcccatcaccaccgaattcacacaggcgagaaaccatttaagtgtaacatttgtgagaaggccttcgtgtgtcgcgcacacctcaccaagcatcagaatatccattcaggcgagaagccttacaagtgcaatgagtgcggtaaggccttcaatcagtccacatcattcctgcagcaccaacgtatccatacaggtgaaaagccattcgaatgtaacgagtgcggaaaggctttccgggtgaattcttcccttactgagcaccagcgcatacatacaggcgagaagccctataagtgtaacgagtgcggtaaggccttccgggacaacagctcctttgctcgccacaggaagatccacactggcgaaaagccttaccggtgtggcctctgcgaaaaggcttttcgggaccaatcggccctggcacagcatcagagaatccacaccggcgagaaaccatatacctgcaatatctgtgagaaggcattctctgaccatagcgccctgacccagcataagcgtatccacacccgcgagaagccatacaagtgtaaaatatgtgagaaggctttcatacgatctacgcatctaacgcagcaccagcgcatccatacaggtgaaaagccatacaagtgcaacaaatgcggaaaagcttttaatcagaccgcgaatttaattcaacaccagagacatcacatcggggaaaagtag

SEQ ID NO: 21631 - DNA, 1569 bp, Artificial Sequence
  Description of Artificial Sequence: Synthetic coding sequence
atggccgtgagccacctgcccaccatggtgcaggagagcgtgacctttaaggatgtcgccatactgttcacccaggaggagtggggccaactgtcccccgcccaacgagcactgtacagggacgtgatgcttgaaaattacagtaacctcgttagcctgggtctgctaggaccaaaaccggacaccttttctcagctggaaaaacgtgaggtctggatgcctgaggatacaccaggcggcttttgtttggactggatgacgatgcctgcatctaagaagtccacagtcaaggcggagatccctgaggaggagctcgatcaatggaccataaaggagagattcagttcaagttcacattggaagtgcgctagcctccttgagtggcagtgtggaggacaagagatttccctgcagcgcgtggtgttgacccaccccaacaccccaagccaggaatgtgatgagtccggctccaccatgtctagttctctacactccgatcagtcccaaggtttccagccgagtaagaacgcattcgagtgttccgagtgtggcaaagtcttcagtaagtcgagtacccttaacaagcaccaaaagatccacaatgagaagaacgccaatcagaagatccatattaaagagaagcgttatgagtgcagggagtgtggcaaagctttccatcagtcaactcacctgatacatcatcagcgcatacataccggggaaaagccctacgagtgtaaagagtgcggcaaggccttctccgttagttccagcctcacctaccatcagaaaatccatacaggagagaagccatttgagtgtaatctctgcggaaaggcctttattcgaaatatccacctggcccatcaccatcgaattcacactggggaaaaaccctttaagtgcaatatctgtgagaaggcgtttgtatgccgcgcgcatttaactaaacaccaaaatatacatagcggcgagaagccctataaatgcaacgagtgtggaaaagctttcaaccagagcacgtccttccttcagcaccagcgcatccacactggagagaagccgtttgagtgcaatgaatgcggaaaggcttttagggtcaactcatccttaacagaacaccaacggatccatacaggagaaaagccgtacaaatgtaacgaatgtggaaaggcgttccgcgacaattccagcttcgcccgccatcgcaaaatccacaccggagaaaagccctaccgatgtggattatgcgagaaggcgtttagagaccagagtgctttagcccagcatcagcggattcacactggcgaaaaaccctacacctgtaatatatgcgagaaagcattctctgatcatagcgccttgacacagcataaacgcatccacacacgtgagaaaccctataagtgcaaaatctgcgaaaaagcattcatccgctctacccatttgacccagcatcagagaatccacaccggggaaaagccctacaagtgcaataagtgtggaaaggcctttaatcagactgccaatctcatacagcaccaaaggcaccacattggggaaaagtag

SEQ ID NO: 21632 - DNA, 7521 bp, Artificial Sequence
  Description of Artificial Sequence: Synthetic coding sequence
atggaggtgctgcagtgcgacggctgcgacttccgggcccccagctatgaggatctgaaggcgcatatccaggatgtccacacagcatttctgcagcccaccgacgtcgccgaggacaacgtaaatgaattgaggtgcggttctgtgaacgcatctaatcagactgaagtcgaattttcctctataaaggacgagttcgccatcgctgaggatctgagtggccagaacgcaacctctttgggaacaggtggctattacggacactctcctggatactacggccaacatatcgctgccaaccccaaacctacaaataagttctttcagtgtaagttttgcgtcaggtacttccggtccaaaaatctgttgattgaacatacccggaaagtccacggggcacaggccgagggatcctcttctggcccccccgtccctggcagccttaactacaacattatgatgcatgagggtttcggaaaggttttttcttgtcagttttgcacttacaaaagtcctcggagggctcgcatcattaagcatcagaagatgtatcacaaaaacaatctcaaagagaccactgcaccacctcccgccccggcacctatgcccgatccagtcgtgcctcctgtcagtctgcaggacccctgtaaagaactccctgctgaggtggtggaacgatcgatcctggaaagcatggtgaagccccttaccaaatctaggggcaatttctgctgcgagtggtgtagttatcagactccaaggagagagagatggtgcgatcacatgatgaagaagcataggtctatggtgaaaattttgtcatccctgagacagcaacaggagggcaccaacttaccggacgttccaaataagagtgcgccttctcccacttcaaactctacgtatcttacaatgaatgctgcctcacgtgagattcctaatactactgtctcgaactttagagggtcgatgggaaactcaatcatgcgccccaatagtagtgcttctaaattctctcccatgagttacccccagatgaagcctaaatccccccacaactctggcctagtgaacctaacagagaggagcagatatggcatgacagacatgactaactctagcgcagaccttgaaacaaattcgatgcttaacgatagtagcagcgatgaagagttgaacgaaatcgatagtgagaacgggctaagcgcaatggatcaccagactagcggactcagcgcggagcagctgatggggagcgatgggaataagctgctggagacaaagggaatcccctttcgccggttcatgaacaggttccagtgtcctttttgcccattcctcaccatgcatagaaggtctatttcccggcatattgaaaatatacacctttctggtaagacagccgtatacaagtgcgatgagtgtcccttcacttgcaagtcctcgctcaagctgggggcccacaaacagtgtcataccggaaccaccagcgactgggatgctgtcaattcgcagagcgagagtatcagctccagcctcaacgagggggttgtgtcctatgagagttctagtattaatggccgcaagtccggcgtcatgctcgatccactgcaacaacaacaaccacctcagccgcccccccccccaccaccaccaccgcctagtcagccccagcctctgcaacaacctcagcccccccaacttcagcctccccaccaggtgcctccccagccccagactcagccgcccccaactcagcagcctcagccgcctacccaagctgctccattacacccctacaagtgcactatgtgcaactatagcacaaccacgctgaagggtctcagggtgcaccagcagcacaagcactctttttgcgataatttacccaagtttgagggtcaaccctctagccttccactggaaaacgaaaccgactcccatcctagctcctcgaataccgtgaaaaaaagtcagacatcgatcctcggattgtcctccaaaaataacttcgttgctaaagcaagccgcaaactggctaatgactttcctcttgacctctctccggtcaagaagagaactaggatcgatgagatcgcctcgaacctgcagagtaagataaaccaaacaaagcaacaggaggacgctgtaataaacgtcgaggacgacgaggaggaggaggaggataacgaggtcgaaatcgaggtggaacttgatcgcgaagaagaacccactgaacctatcatcgaggttcccacgtcattttccgcccaacagatttgggtgcgggatactagcgagccacaaaaggagcctaatttccgcaacatcacccacgattacaacgctactaatggagcagagatcgagttgaccctcagcgaggacgaagaggactattacggctcaagtacaaacctgaaggatcaccaagtatctaacactgcgttgttaaacacacagactccaatctatgggactgaacacaattcagaaaataccgatttcggcgattcaggccgcttgtattactgcaaacattgcgattttaacaataaatccgcgcgcagcgtctccacgcactaccagcggatgcacccttatatcaagtttagtttccgatacatactggacccaaacgaccattctgctgtctaccgttgtcttgagtgctatatcgactacacaaacttcgaagacctgcagcagcattatggtgaacatcaccccgaagcgatgaatgttctgaattttgaccattcagacttgatataccgctgccgattttgttcctacactagccccaatgtaagatcgctcatgccccactatcagcggatgcatcccacagtgaagatcaataacgcgatgatctttagtagctacgtcgttgagcaacaggaagggcttaacactgagagtcagaccctacgcgagatacttaatagcgcacccaagaacatggccacctccacaccagtggcccggggaggaggcctcccggctacctttaacaaaaatactcccaaaacattcacacccgagtgcgagaaccagaaagatccactggttaacactgtcgtcgtctatgattgcgacgtgtgctctttcgcctcacctaatatgcattcagtgctcgtgcattatcagaaaaagcacccagaggagaaagcctcctactttagaatccaaaagacaatgcgcatggtctccgtcgacagaggctctgccctttcgcagctgagcttcgaagttggcgctcctatgtcccctaaaatgtctaacatgggctccccaccccccccccaaccccccccacccgatctgtccacagagctgtactattgcaagcattgcagctattccaacaggtctgtcgtcggagtgctcgtacactatcaaaagaggcacccagagatcaaagtcaccgcgaagtatatacgccaggcacctccaactgctgccatgatgcggggtgttgaaggaccccaggggtccccaaggccgcctgcacccatccaacagctcaatagatcgtccagcgagcgggacggcccccccgtggagaacgaaatgtttttctgccagcactgcgactacggaaatcggactgtgaaaggcgtgctcatccactatcagaaaaaacaccgcgacttcaaagcaaatgccgatgtgatcaggcagcacacagcgaccatccgaagcctttgtgaccggaaccagaagaagccagcatcttgcgtcctggtttcccctagcaacctagagagggataagaccaagctgcgggcacttaagtgcaggcagtgttcctacacctctccatatttttacgctcttaggaaacacattaagaaggaccacccggccctaaaggccacagttacttctattatgagatgggccttcttggacggactgatcgaagctgggtatcactgcgaatggtgcatttactcacataccgagccaaacggtcttctcttgcactatcagaggaggcaccccgaacactacgtggactacacttatatggccactaaattgtgggccgggcctgacccctcacccccgtcgctcaccatgcccgccgaggcaaagacttaccgctgtcgcgattgtgtgttcgaagcggtgagtatctgggatatcactaatcactaccaggcttttcatccttgggctatgaacggcgatgagagtgtccttctcgatattattaaggaaaaggatgccgtcgagaagccaatactcagcagtgaagaattagccgggccagttaattgcgaaaatagcattcccacgccttttcccgagcaggaagctgaatgtcccgaggacgcacgcttaagtccagaaaagtccctccagttggccagcgccaatcccgctatcagtagcaccccctatcagtgcactgtgtgccaaagcgagtacaacaatctgcacggactcttgacccactacgggaaaaaacatcccggtatgaaggtgaaggcggccgatttcgcccaagatattgatataaaccctggagccgtatacaagtgccgccattgtccgtatattaacaccaggatacacggtgttcttacacactaccagaagcgacacccttctattaaggttacagcagaagactttgtgcacgatgttgagcaatccgccgacatcagccagaacgatgtcgaagaaacgtctcgtattttcaaacaaggttatggcgcataccgctgcaaactctgtccttacacacacggtacgctggaaaagctaaaaatccactacgagaagtaccacaaccaacccgaattcgacgtgttcagtcagagtccaccgaaattgccggtgccactggaaccggagatgacaaccgaagtctctccctcgcaggtaagcatcactgaggaagaagtcggcgaggaacccgtcagcactagtcactttagcacgagccaccttgtttctcatactgtgttcaggtgccaactctgcaaatatttttgttcaacccgcaagggcatcgcacgacattataggattaagcacaataatgtgagggcccagcctgagggaaaaaacaacctgtttaaatgtgcactgtgcgcctacaccaatcccattagaaaggggcttgccgcccactaccagaaacggcatgacatagacgcttactatacccactgtctggccgcctcccggactatctctgacaagccaaataaagtgattatcccatcacctccaaaggacgactccccacaactctccgaggaattgagacgcgccgtggaaaaaaagaaatgtagcctgtgcagcttccaatccttcagcaagaagggtattgtgagtcattatatgaaaagacatccaggggtgttcccgaagaagcagcatgcctctaaactcggcgggtatttcaccgcagtttacgcagacgaacacgagaagccaaccctcatggaggaggaagagcgcggaaacttcgaaaaagcagaggtagagggtgaggcgcaggagattgaatggcttcctttccgttgtatcaaatgctttaaactgtccttcagcacagccgagttgctatgtatgcattacactgaccatcactccagagatctcaaacgtgacttcatcatcctgggaaacggtccacgtttgcagaactcgacctatcagtgtaaacactgcgattctaaattgcagtccaccgccgagttgacatcccacctgaacatccataatgaggagttccaaaagcgtgcaaaacgccaggagcgtagaaaacaattgctttccaagcagaaatacgccgacggcgcatttgccgattttaaacaggagcggccgttcggccatttggaagaggtgcccaaaatcaaggagcggaaagttgtgggttataaatgcaaattttgcgtcgaggtgcatccgacccttcgggccatctgcaatcatttgcgcaaacatgttcagtatggcaacgtgccggccgtctctgctgccgtcaaaggactcagatcccacgagcgctctcatctggccctggctatgtttacgcgcgaggataagtactcttgccaatactgttcttttgtgtcagccttcaggcacaacctggaccgccatatgcaaactcatcacggacaccacaagcctttcaggtgcaaactctgttcctttaagtcgagctataattccagattgaagacacatatcctcaaagcccacgcaggcgagcatgcctacaaatgtagctggtgctcattctcaaccatgactatctctcaactcaaggaacacagcctgaaggtccacggaaaagcactgaccctccctcgcccccgcatcgtgtcactgctatccagccacagccatcattcatctcagaaggcgacaccagccgaggaggtagaagattcaaacgacagctcgtactccgagccccccgatgtgcaacaacagctcaatcactaccagagtgccgctctggctcggaacaatagccgcgtaagtcctgttccattaagtggcgcagcggctggaaccgagcagaaaacagaggcggtgctgcactgcgagttttgtgaatttagcagcggttacatccaaagcataaggcgacattaccgggataaacatggaggtaagaaactctttaagtgtaaggattgtagcttctatacaggctttaagtctgcgttcactatgcatgtggaggcaggccactctgcagtgcctgaggagggtcctaaagatctaagatgtccgctttgtctctaccataccaaatataagaggaatatgatcgatcatattgtgctacacagagaggagcgggtggtgcccattgaggtgtgcaggtctaaactgagtaagtacttacagggcgtggttttccgctgcgacaaatgtacattcacctgctcgagcgatgagagtttgcaacagcatatagaaaaacacaatgaactgaagccctacaaatgtcagctctgctattatgaaaccaagcacactgaggagttagattctcacctgagggacgagcacaaggtcagccggaatttcgagcttgtgggccgggtgaacctggatcagctggaacagatgaaggagaagatggagtcttcctcctcagacgacgaggacaaggaagaagagatgaatagcaaagcggaagatagagaattgatgcggttttcggaccatggagccgcgttaaatacggagaagagattcccctgcgagttctgcggccgagccttctcgcaaggcagtgaatgggagagacatgtgctgcgccacggcatggctctaaacgataccaaacaggtgagtcgagaagagattcatccgaaggaaatcatggagaactcggtgaagatgccaagcatcgaagagaaggaggacgacgaagccataggtatagacttttcacttaagaacgaaacagtagccatctgcgtggtaactgcagacaaatcccttctggaaaatgctgaggcaaaaaaagagtag

SEQ ID NO: 21633 - DNA, 627 bp, Artificial Sequence
  Description of Artificial Sequence: Synthetic coding sequence
tgagagcacagcctgaaggtgcacggcaaggccctgaccctgcccagacctcgaattgtatcgctgttgtcatcacactctcaccactcgtcacaaaaagctactcctgcagaggaagtcgaagatagtaacgattctagctattcagaacctcccgatgtgcagcagcagcttaaccactatcagagtgccgctctcgctcggaacaactcccgggtctcccccgtcccgctgtcaggcgctgctgcaggaacggagcagaagaccgaggctgtcctgcactgcgagttctgcgaattctcatccggatatatccaatccattaggcgtcactatagagacaaacacggcggaaagaagctgttcaagtgtaaggattgctctttctatacaggcttcaagagtgctttcaccatgcacgttgaggccgggcactcggctgttcccgaggagggcccgaaggacttgcggtgccccctgtgcctgtaccacaccaagtataagcgaaacatgattgatcatatcgtccttcatcgcggcaatttgtctaatctggtcttcttggacgcggctggggggcggcaacagcggtggccttcacgggatgccctgagtgagtggcagtag

SEQ ID NO: 21634 - DNA, 7701 bp, Artificial Sequence
  Description of Artificial Sequence: Synthetic coding sequence
atggaggtgctgcagtgcgacggctgcgacttccgggcccccagctacgaagacctgaaggcccacatccaggacgttcatactgcctttttgcaaccaactgacgtggctgaggacaatgtcaacgaactgcgttgcgggtcggtgaacgcgtccaaccaaaccgaggtggaattcagctcaattaaggacgaatttgctattgcagaagacctttcaggccagaacgcgacctccctgggtaccggagggtactacggccatagtccgggttactacgggcaacacatcgccgccaacccaaagccaaccaacaaatttttccagtgcaagttctgcgtccgttatttccggtcaaagaatttgcttatcgaacataccaggaaggtgcatggggctcaggctgaaggctcttctagcggcccccctgtgcctggatcgctaaactacaatatcatgatgcatgaaggatttggaaaggtgttctcttgtcagttctgcacttataagtcgccccggagagcacgcatcatcaagcaccagaagatgtaccataagaacaatctgaaggagactaccgcaccacccccggcacctgctcccatgccagatcctgttgtcccacctgtcagcctgcaggatccttgtaaggaacttccagctgaagtggtggaacgcagcattctggagtcaatggtgaagccactcaccaagagcaggggaaatttctgttgcgagtggtgttcctaccagacaccccgccgcgagcggtggtgcgatcacatgatgaagaaacatcgtagtatggtcaagatcctcagttcgctgcggcagcaacaggaagggaccaacttaccagatgttcctaataagtccgcgccttccccgacgagtaattctacctatctcaccatgaatgcagcctctagagaaattcctaacaccaccgtctccaacttccgggggagcatgggcaactctattatgcggcccaacagctcagcctcgaaattctcacctatgtcctatcctcagatgaagccaaagtctccccacaacagcggattggtgaatctgacagagcggtcgcgctacggcatgactgatatgacgaactcctcggcggacctagaaaccaattctatgcttaatgattcttctagtgatgaagagctgaatgagatagactctgaaaatggtctgtccgccatggaccatcagacatcggggctgtcagcagaacagctgatgggctccgatgggaataagctgctcgagacaaagggcattcctttcaggagatttatgaaccgttttcaatgtcccttttgccccttccttacaatgcaccggagaagcatcagtagacacatcgaaaacatccacctgtcaggcaaaacagcagtctacaaatgcgatgagtgtcccttcacttgcaagagctccttgaaactgggggcccacaagcaatgccacaccggtaccacctccgattgggacgccgtaaattcgcagtctgaaagcatttctagttcattaaacgaaggcgttgtgtcctacgaaagtagctccatcaatggaaggaagagtggagttatgttggatccactccagcagcagcagccaccacagccaccccctccaccccccccaccgccaccatcccagccacagccattacaacagccacagcctccccagctacagccccctcatcaggtcccaccacagcctcaaacccagccgcctccaacacaacagccccagcctcctactcaagcggcgccactgcatccgtataagtgtacaatgtgcaattactccactacaacgctcaagggcctcagggtgcatcagcaacacaagcactcattctgcgataaccttccaaagtttgaggggcagccttctagcctgccacttgagaatgaaaccgacagtcatcctagcagctcgaatacagtaaagaaatcgcagacgtctatacttggcttatcgtccaaaaacaattttgtggccaaagcttctcgcaagttggcaaatgacttcccgctggatctcagtcccgtaaagaagagaacccgaatcgatgagattgcctcaaatctacagagcaagataaatcaaaccaaacagcaggaggacgctgtgataaacgtcgaggacgatgaagaggaagaggaagacaacgaggttgagatagaggtcgagctggatcgtgaggaagaaccaacagaaccaattattgaggtaccaacatctttttcagctcaacagatatgggtacgggacacatcagaaccacagaaagaacccaactttagaaacatcactcatgactataacgccaccaatggcgcagagattgagctcactctgtcagaagatgaggaggactactacggttcaagcacaaacctcaaggatcaccaggttagcaatacagccttactgaatacccagaccccgatatacggcaccgagcacaattcggagaacactgattttggggattcaggacgcctgtactattgtaagcactgcgacttcaacaataagtcagcacggtctgtatctacgcattatcagaggatgcacccctatatcaaattttcctttagatatatcctcgacccaaatgatcatagcgccgtataccgctgcctggaatgttacattgactatacaaacttcgaagacttgcagcagcattatggcgagcaccaccccgaggccatgaatgtgctgaactttgaccacagtgacctgatttacagatgcaggttctgttcatacacgtcccctaatgtgagatccttgatgccgcactaccagaggatgcacccaaccgtgaagattaataatgctatgattttttccagctatgttgtggagcagcaggaagggttgaatactgaatcacagacactgagagaaattctaaattccgctcctaagaatatggcgacttctacaccagtggcacgggggggaggccttccagccaccttcaacaagaacactcctaaaacattcacccccgaatgcgagaatcagaaggaccctttagtcaatacagttgtggtctatgattgcgatgtctgtagttttgccagccctaatatgcactcagtgctcgtgcactatcagaaaaaacaccctgaagagaaggcaagttacttccgcatccagaaaaccatgcgcatggtcagcgtggaccgtggaagcgccctctcacaattatcatttgaggtcggggcccctatgtccccgaagatgtctaatatggggtcaccaccaccgccacagcctccgccccctgacctcagtactgagctctattattgcaaacattgttcatacagcaacagaagcgtggtgggtgtgctcgtgcactaccagaagcgtcaccctgagattaaagtaactgccaagtacattcgacaggcaccacctacagcagctatgatgcgaggcgtggaaggtccccaaggctcccctagaccacctgcgccaatacagcagctcaatcggtctagttctgaacgcgatggccctccagttgaaaacgagatgtttttctgtcagcactgcgactatgggaacaggacagtgaaaggcgttttaatccactaccaaaagaagcatagagacttcaaagccaacgctgacgtgatccgccagcatactgccactattagatctctgtgtgaccgcaaccagaaaaagccggccagctgcgttctggtcagcccaagcaatttggaacgggataagaccaaacttcgagctcttaagtgccgccagtgcagttatacctccccatatttctacgccctgaggaaacacattaagaaagaccacccagcccttaaagccaccgtgacgtctatcatgagatgggccttcctggatgggcttatagaggcaggctatcactgtgaatggtgcatatactctcacacagaacccaatggtctgctcctgcactatcagcgcaggcatcctgaacactacgtagattatacctatatggccacaaaattgtgggcagggccagacccttctccaccatccctcaccatgccagccgaggctaagacttacagatgccgggactgcgtgtttgaggccgtcagcatctgggatatcactaaccactaccaagccttccacccctgggctatgaatggtgatgagagtgttctactcgatatcattaaggagaaggacgcggttgagaagcccattctttcttcggaggaactggccggacccgtcaactgtgagaacagcatcccaactcccttccctgagcaggaggctgagtgcccggaagacgcaagactcagtcctgagaagagcctccagttagctagcgctaatccagccatctcctcgactccatatcagtgcaccgtctgtcaatcagaatacaacaaccttcatggactattaacccattacggtaaaaagcatcctggtatgaaggtcaaagctgctgatttcgctcaggatattgatataaacccaggagctgtttacaagtgtcgccattgtccatatattaataccagaattcacggcgtgttgacccactaccagaaacgccacccaagtattaaagtcacagcagaggattttgtgcacgatgttgaacagtctgcagacatctcacaaaatgatgttgaggaaacctcccggatctttaagcagggctacggagcctaccgatgcaagctgtgtccgtacacccatggaacgttggagaaactgaagatacactacgaaaaataccacaaccaacctgaatttgacgtgttctcgcagtcacccccgaaattgcctgtacccctggagcccgaaatgactacagaggtctcccccagtcaggtgagcatcaccgaggaggaagtaggtgaggagccagtttccacgagccatttctccacatcccacctcgtgagtcacacggtttttaggtgccagctctgtaagtacttttgctccacacgaaaggggatcgccagacattaccggataaaacacaacaacgtgagagcgcaacctgaaggcaagaataatttatttaaatgcgccctgtgtgcatacactaatcctatccgtaaaggactcgctgctcactaccagaaacgccacgacatagacgcttattacacccactgccttgccgcctccaggactattagcgataagcctaacaaagtgatcattccgagcccaccaaaggatgatagcccccagctgtcagaggaacttcgaagagccgtcgagaaaaaaaagtgcagtctgtgctcatttcagagttttagtaaaaagggaatcgtgagccactacatgaaaagacaccccggagtgttcccaaagaaacaacacgcatcaaaattaggaggatattttaccgcagtatacgcggacgaacatgagaagccgaccctcatggaagaggaggagcgcggcaatttcgagaaagccgaagtagagggcgaggctcaagaaattgagtggcttccatttagatgtataaaatgctttaaactgagtttcagcaccgccgaactgctgtgcatgcattacacagatcatcatagccgtgacctcaagagggattttattatactgggcaacggcccacgcctgcaaaacagtacttaccaatgcaaacactgcgatagtaaactgcaatcgacagccgagctgaccagccacctcaacatacacaacgaggagttccagaagcgtgcgaaacggcaggagaggcgtaaacaattgctcagcaagcaaaagtacgcagatggagcctttgcagatttcaagcaggaacggccattcggtcacctggaagaggtaccaaaaatcaaagagcggaaggtagtcggctacaagtgcaaattttgtgtcgaagtacatcccactctacgtgctatttgcaaccacttaagaaagcacgtacagtatggaaacgtgcccgcagtgtctgcagctgtgaaagaagctgatgatccggcccacttattcctcgacggtttggaagccgccaaggacgcctccggggctttggtggggagagtggacggcgagcattgtctgctcgacgggatgctggaagatgaaacacgcccaggaggatatcattgttctcagtgtgacagagttttgatgtccatgcagggactgagatctcacgaaagaagccacctggcactcgccatgtttacaagagaagataaatattcatgtcagtactgctccttcgtctcagccttccgccacaatctggaccgccatatgcagacacatcatggccaccataagcctttcaggtgtaagctgtgctcttttaaatccagctacaactcacgactgaagacccatatcttaaaggctcacgcaggagaacatgcgtataaatgttcatggtgcagtttcagcactatgactatctcccagcttaaagaacattcattgaaggtgcacgggaaagccctaactttaccccggccgaggatcgtcagcctattgagtagccatagtcaccactcctcgcagaaggcaactccagcagaagaagttgaggattccaatgattcctcttactccgagccccctgatgtccagcagcagctgaatcactaccaatcagcggctcttgcccgcaataatagtcgtgtgtctccagtgcccctcagtggtgcagccgccgggaccgaacagaagactgaggcagtcttacattgcgagttctgcgagttctcgtccggctatatacaatccatccgcaggcattaccgagacaagcatggcggtaaaaagctgtttaagtgcaaggattgtagcttctacaccggatttaaatctgcattcactatgcacgttgaggctggccacagcgccgtgccagaagaaggtcccaaggacctcaggtgccctctgtgtctttaccacaccaaatacaagagaaacatgatcgatcatatcgtgttgcatcgggaggaacgagtcgttcctatagaggtgtgtcgtagcaagctgagcaagtatctacagggagttgtctttaggtgtgataagtgtactttcacctgcagtagcgacgaatccctccagcagcacatagagaagcataatgagctgaagccttataagtgtcagctgtgctattatgaaacaaagcacacagaagaactagacagccacctccgggacgagcacaaagtgtctcgaaactttgaattggtggggagggtgaacctcgaccagctagaacagatgaaagaaaagatggagtcctcaagctcagacgacgaggataaggaggaagagatgaatagcaaggctgaggatcgggaactgatgcgcttttcagatcacggggccgcgctgaacaccgagaagcgtttcccctgtgagttctgtggtcgggcattctctcagggctctgagtgggagaggcacgtactgcggcacggaatggcactgaatgacactaagcaggtgagtcgcgaggaaatccaccctaaggaaattatggagaactcagtgaaaatgccctccattgaagaaaaggaagatgatgaggctattgggatcgacttcagcctcaaaaatgagactgtcgccatttgtgttgtgacagccgacaagagcctgctggagaatgccgaagccaaaaaggagtag

SEQ ID NO: 21635 - DNA, 1392 bp, Artificial Sequence
  Description of Artificial Sequence: Synthetic coding sequence
atgcagacccaccacggccaccacaagcccttccggtgcaagctgtgtagcttcaaaagctcttacaacagcagactgaagactcatattctcaaagcccacgccggggagcacgcctacaagtgcagctggtgctctttctctaccatgaccatcagccagctcaaggaacactccttaaaagttcacggcaaagctcttaccctgcctagaccccgcattgtgtcgctgttatcaagtcactcccaccattcctcccaaaaagccactcccgctgaggaagtggaggactccaatgacagtagctactctgagccaccagacgttcagcagcagcttaaccactatcaatccgccgccctagctagaaataacagcagagtcagcccggtccccctgagcggagcagcagctggcaccgagcagaagactgaggcagttctgcattgtgagttttgcgagttctccagcgggtatatccagtccatcagacgccattatagagataaacacggtgggaaaaagttgttcaaatgtaaagattgctcattctacacggggtttaaaagcgcttttacaatgcatgtggaagctggccattccgcagtgcccgaggaaggccctaaagatctgagatgtcctctttgcctgtatcataccaagtataagcggaatatgattgatcacattgtgttgcatcgagaggagcgagtcgtgcccatagaagtctgcagaagcaaactctcaaaatacctccagggagttgtctttcggtgcgataagtgtacttttacttgttcaagcgatgagtcgctgcagcagcatattgaaaaacataacgaactgaagccatacaaatgtcaattgtgttactacgagactaaacatacagaggagctcgattcccacctccgggacgagcacaaagtatctagaaactttgagctcgttggcagagtaaatcttgaccagcttgaacagatgaaagagaaaatggagtctagcagcagcgacgatgaggataaggaggaggagatgaatagcaaggccgaagaccgggagctgatgcggtttagcgatcatggggccgcccttaacaccgagaaaaggtttccttgcgagttctgcggccgagcattctcacaggggagcgagtgggagcgccatgtgctgcggcacggcatggctctgaacgatacaaagcaagtaagcagggaggaaatccacccaaaggagataatggagaatagcgtgaagatgccaagcatcgaggaaaaggaggatgatgaggccattgggatcgacttttctcttaaaaacgaaacagttgccatctgtgtggtgacggcggataaaagtctgctggagaacgctgaggctaaaaaggagtag

SEQ ID NO: 21636 - DNA, 1569 bp, Artificial Sequence
  Description of Artificial Sequence: Synthetic coding sequence
atggccctgccccagggcctgctgaccttccgggacgtggccatcgaattttctcaggaggaatggaagtgtctggaccccgcgcagcgcaccctgtaccgcgacgtcatgctagaaaattatagaaatctagtatctctcgacatctcctccaagtgcatgctgaagacactttcatctacagggcaaggaaacacagaggtgatacatacggggactctgcaccgccaggctagccaccatatcggcgagttctgtttccacgaaatcgagaaggatatccatggcttcgaattccagtggaaggaagatgaaactaacgggcacgctgcaccaatgaccgagattaaggaactggccggttccaccggccaacacgaccagagacacgccgggaataagcgcatcaaggaccaattaggttccagttttcatctacacctccctgagccgcacatctttcagtcggagggaaaaatcggcaatcaggtggagaagagtattaataatgcctcgagcgtgagcacctcccagagaatctgctgtcgacctaaaacccatatctcaaataaatatggaaataacagtttacattcttcattactgacccaaaagtgggaggtgcatatgagagagaagtcatttgaatgtatccagtccttcaagtcttttaattgttccagcctgctcaaaaagcaccagatcattcacctcgaggagaagcagtgcaagtgcgacgtgtgtggtaaagtgtttaaccagaagcggtatctcgcatgccatcgtcgctgccacaccggcgagaaaccatacaagtgcaatgagtgtggtaaaactttcggacacaactcttctctgttcattcacaaggcactccacactggggagaagccatacgaatgcgaggaatgcgacaaagtgtttagccggaagtcccacttggagaggcataagcgaattcacactggggagaaaccatacaagtgtaaggtctgcgacgaggctttcgcatacaacagctacctggccaagcacacgatcttacacactggcgagaagccatacacgtgcaatgagtgcgggaaggtgttcaaccggctgagtactctggccagacatcatcgcctgcataccggtgaaaaaccctataaatgcgaggagtgcgacaaggtgttttctagaaagtctcatctggagcggcaccgaaggatccactccggtgagaaaccctacaaatgcgaagagtgttgcaaagtcttttcgcggaagtctaatttggagcggcacaggcgaatccatacaggcgaaaaaccgtataagtgcaaggtatgcgacaaagcctttcagagggacagccacctggcccagcatcagcgggtgcatactggggaaaagccctacaagtgtaacgaatgcggaaagacctttggacagacctccagtctcatcatccaccgccgactccacacgggggagaagccatacaaatgcaatgaatgcggaaagaccttctcgcaaatgagtagcctggtctaccatcatcgactgcacagcggcgagaaaccttag

SEQ ID NO: 21637 - DNA, 1410 bp, Artificial Sequence
  Description of Artificial Sequence: Synthetic coding sequence
atgctgaagaccctgagcagcaccggccagggcaacaccgaggtgattcacaccggaacactgcatagacaggctagccaccacataggagaattctgcttccacgagattgagaaggatatccacggctttgaatttcaatggaaagaagacgagactaacggccacgcagctccaatgacagaaatcaaggagcttgccggatcaactggccagcacgatcagaggcacgccgggaataagagaatcaaggatcagctcggatcttctttccatctacatcttcctgaacctcacattttccagtctgagggcaagatcggaaaccaagttgagaagagcatcaacaacgcttcaagcgtgtcgacctcacagaggatttgctgtagacccaagactcacatctccaataagtatggcaacaatagcttacactcatccttgctgacccagaagtgggaggtacatatgagggaaaagtccttcgagtgcattcagtcctttaagagttttaactgctcaagcttacttaaaaagcatcaaattattcacctggaggaaaagcagtgcaagtgcgatgtctgtggcaaggtattcaatcagaagagatatctcgcgtgccaccgaaggtgtcacaccggcgagaagccctataagtgcaacgagtgcggcaagacgtttggccataactctagcctatttattcacaaagccttgcacactggcgaaaagccttatgagtgtgaggaatgcgataaggtctttagtaggaagagtcacctggaacggcacaagcggattcacactggggaaaaaccatacaaatgtaaggtgtgtgacgaggcctttgcgtacaacagctatcttgccaagcacaccatacttcatactggggagaaaccttatacatgtaatgagtgtggaaaggtcttcaatcgactgtcaacattggcccgtcaccaccgcctccacaccggcgaaaagccctacaaatgtgaggaatgcgataaagtgttctctcgcaaatcccacctcgagcggcatcgccgaatacatagcggagagaaaccttacaaatgcgaagagtgttgcaaagtcttctctcgcaagtcgaatctggagaggcataggaggatccacaccggtgagaaaccctacaagtgcaaagtgtgtgataaagcattccaaagagactcccacctcgctcagcatcagcgggtacatacaggtgagaagccctacaaatgcaacgaatgcggcaagacattcggacagacaagctcactcataattcatcgacgtttgcataccggtgaaaagccatataagtgtaatgaatgtggaaaaaccttttcccagatgtctagcctggtctatcatcaccgcctgcactctggtgagaaaccctag

SEQ ID NO: 21638 - DNA, 654 bp, Artificial Sequence
  Description of Artificial Sequence: Synthetic coding sequence
gtgttcaaccagaagcggtacctggcctgccaccggcggtgccacacaggggaaaagccctataagtgcaatgaatgcggcaaaactttcgggcataacagcagcttatttatccacaaggcgctgcacacaggagagaagccctatgagtgtgaggagtgtgataaggtgttctctagaaagagtcacctcgagcgccacaaacgaattcatacgggggagaaaccctataagtgtaaagtgtgtgatgaagcttttgcttacaattcttatctcgccaagcacaccatacttcacaccggagagaagccttatacctgtaacgagtgtggcaaagtgttcaaccgcctctcgacactggcccgacaccatcgcctccacacgggcgaaaaaccctacaaatgcgaggaatgcgataaggtattctctagaaagtctcacctggaaagacaccgtaggatcgttgagcgaaatttgaccaatgtaaagaacgttgcaaagttctcctcccagattaaacctgggaaaacccaggaatttatccttgaacgtaatcacacaaacgtgagattcgtgacaaggctgtcgcgcggaattcacacctggcacaacatccgcgagtttatcctggagcggaatcttactagcgtgtag

SEQ ID NO: 21639 - DNA, 1410 bp, Artificial Sequence
  Description of Artificial Sequence: Synthetic coding sequence
atgctgaagaccctgagcagcaccggccagggcaacaccgaggtgatacatacagggaccctccatagacaggcaagtcaccacattggagagttctgttttcatgagatcgagaaggacattcacggcttcgagtttcagtggaaggaagacgaaacgaacgggcacgcggcacccatgactgagatcaaagaactggccggctccaccgggcagcacgatcaacggcacgcgggcaacaaaaggatcaaggaccagctggggtcatccttccatctccacctgcctgaaccacacatcttccagagtgaaggcaagataggcaatcaggtggagaagtctattaacaacgcgtcctccgtctctacttcccaaagaatatgctgtagacctaagacacacatttcgaacaagtatgggaataattctctgcattcctcacttttaacccagaagtgggaggtgcatatgagagagaaatcattcgagtgtatccagagttttaaatccttcaactgttcatctctacttaagaaacaccagataatccacctggaggaaaagcagtgcaagtgcgatgtgtgtggtaaagtctttaaccagaaaaggtacctcgcgtgtcatagacgttgccacaccggcgagaagccctacaaatgcaacgagtgcggtaagacctttgggcataacagcagcctatttatccacaaagctttgcatacgggcgaaaaaccttacgaatgtgaagagtgcgacaaagtgttctctcgaaagagtcatctggaaaggcataagaggatccacacaggcgaaaaaccctacaaatgcaaagtgtgtgatgaggcatttgcttataatagctatctggcaaagcacacaatactccataccggcgagaagccctatacctgtaatgagtgtggcaaagtgttcaacaggctgagcaccctcgcccgccaccatcgcttgcacaccggagagaaaccatacaaatgcgaggaatgtgacaaggtgttttcccgcaagtcacatctcgaacggcaccggcggattcattccggcgagaagccatacaaatgtgaagagtgttgtaaggtctttagcaggaaatccaaccttgaaagacatagacggatccacaccggggaaaaaccttacaaatgtaaggtatgtgacaaagcgtttcagcgagattcgcacctggcccagcatcagcgggtgcatacgggagagaaaccatacaagtgtaacgaatgtgggaaaacattcggccaaacaagctctctgatcatccacaggcgacttcacaccggagaaaaaccctataagtgcaacgaatgtggcaaaaccttctcacagatgtcttctctggtgtaccaccatcggttgcattccggcgagaagccatag

SEQ ID NO: 21640 - DNA, 1569 bp, Artificial Sequence
  Description of Artificial Sequence: Synthetic coding sequence
atggccctgccccagggcctgctgaccttccgggacgtggccatcgagttttctcaggaggagtggaagtgtctggatcctgctcagcgcacactgtaccgggacgtcatgctggagaattaccgcaacttggtgagtttggatataagcagcaagtgcatgctcaagaccctttcatccactggccagggcaataccgaagtgatccatacagggacattgcacaggcaggcaagccatcatatcggcgagttttgcttccacgagatcgagaaagatatccatggattcgagtttcagtggaaagaagatgaaaccaacggccatgctgcccctatgactgagattaaagagctagcaggatcgaccggacaacacgaccagcgccatgccgggaataagcgcattaaggatcagctgggaagctccttccacctgcacctccccgaaccccacatattccaatctgaggggaagattggcaaccaggttgagaaaagcatcaacaacgccagcagtgtcagtacatcccagcggatatgttgccgccctaaaacacacatcagcaacaaatacggtaataactccctccactcttccctgctgactcaaaagtgggaagttcacatgagagaaaaatctttcgaatgtattcaatctttcaagtctttcaactgctcctcacttcttaagaagcatcagatcatccatctggaagagaaacagtgtaaatgcgacgtgtgcggaaaggtgtttaaccagaaacgctatctggcctgccacaggagatgtcataccggcgagaagccctataagtgtaacgagtgtggcaaaacattcggccacaacagcagcctcttcatacataaagccctacacacgggggaaaaaccatacgagtgtgaggaatgcgacaaggtgttttcccggaagagccacctcgaacgacataaacgaatacatacaggagaaaaaccttataaatgtaaggtatgcgacgaggcattcgcctacaattcatatctggccaagcatactatattacacacaggagagaagccttatacctgcaatgagtgcggcaaggtgttcaaccgcttgtctaccctggcacggcatcaccggttacatacaggggagaagccttacaagtgcgaagaatgtgacaaagtattcagccgaaagagccacctcgagaggcatcggcgtattcactccggggaaaaaccctacaagtgtgaggaatgctgtaaagtattttcacggaagtccaacctggaacgccatagacggattcacacaggtgaaaaaccttataaatgcaaggtgtgcgataaggctttccagcgcgatagtcatctggcccagcatcagagagtccataccggggagaagccctacaagtgtaatgagtgtggtaaaacattcggacagactagttctctcatcattcatcgccgactgcataccggtgagaaaccttacaagtgtaatgaatgcggtaaaacttttagtcaaatgtcctctctcgtataccaccatcggttgcacagcggcgaaaagccgtag

SEQ ID NO: 21641 - DNA, 2154 bp, Artificial Sequence
  Description of Artificial Sequence: Synthetic coding sequence
atgaagagccaggaggaggtggaggtggccggcatcaagctgtgcaaagccatgtccctcggctcagtcacctttacagatgtggctattgatttcagccaggacgagtgggagtggctgaaccttgcacaaagatctctatacaagaaggtgatgctcgaaaactacagaaacctggtgtccgtgggtttatgcataagcaagcctgatgtcataagtctgttggaacaggaaaaagatccatgggtcattaagggtggaatgaatagaggactgtgtccagatcttgaatgtgtctgggtcacaaaaagtttaagcctcaaccaggacatttacgaagagaaactgcccccagccattataatggagcgcctcaaatcttatgatctagaatgctcaacgctgggaaaaaactggaaatgtgaagatttgtttgagcgcgagctggtgaatcagaagactcacttccgacaagagacaatcacccatatagatacactgattgaaaagcgggaccattcaaataaatccgggacagtcttccacctgaatactctttcctatatcaaacagatttttccgatggaagagaggatttttaactttcacaccgataagaagtctctgaagacccactccgtggtgaaaaagcacaaacaggatcgaggcgagaagaagttgcttaaatgtaacgactgcgagaaaatttttagcaagatctccacactgaccctccatcaacgcatccatacaggtgaaaagccttacgaatgcatcgagtgtggcaaggcattcagtcaaagtgcccacctcgcccagcaccagcgaatccacaccggcgaaaaacccttcgagtgcaccgagtgcgggaaggccttctctcagaacgcccatttagtgcaacaccagagggtgcacacaggagagaagccttaccagtgtaagcaatgcaacaaggcattctctcagctcgcacacttagcacagcaccagagagtgcatactggggaaaagccttacgaatgcatcgagtgcgggaaggctttctctgactgttcaagtctggcccaccatcgtcggatacataccggaaaacggccgtacgaatgtatcgactgtggcaaggccttcaggcaaaacgcctcccttatccggcacagacggtactaccacaccggggagaaaccttttgattgtatagattgtggaaaggcctttaccgatcatattggcctgattcaacataagcgcacacacacaggagaaaggccttacaagtgtaatgtgtgcggaaaagctttttctcacgggagctccttgacagtgcatcagcgcattcacaccggggaaaagccctacgagtgcaatatctgtgagaaagccttttcccaccgggggtcgctcaccctccaccagcgcgtccatactggtgagaaaccctatgaatgcaaagagtgtggcaaggcctttcggcagtccactcacctggctcatcaccagcgtatccatactggcgagaagccctacgaatgcaaagagtgtagcaagaccttctcacagaacgcgcacctggcacagcaccaaaagatccataccggagaaaagccctacgagtgtaaagaatgtggcaaggcgttctctcagatcgcccacctggtccaacatcagcgggtgcataccggtgaaaagccgtacgaatgcatagagtgtggtaaagccttctcagatggcagttatctcgttcagcaccagcgtcttcatagcggcaagcgtccttacgaatgcctcgagtgcggtaaggcctttagacaaagagcgtctttgatctgtcaccagcgatgtcacaccggcgaaaaaccgtatgaatgtaatgtctgcgggaaagccttcagccatcggaaaagccttactctccaccagcggattcacacgggagagaaaccctacgagtgcaaagagtgttccaaggccttcagccaagtggcccacctcacattgcacaagcgtatccacacgggcgaaagaccctatgagtgtaaggaatgtggcaaagctttccgccaatccgtgcatttggcccatcaccagagaattcataccggcgagtctagtgttatcctgtcatcagcactgccctatcatcaggtgctctag

SEQ ID NO: 21642 - DNA, 2154 bp, Artificial Sequence
  Description of Artificial Sequence: Synthetic coding sequence
atgaagagccaggaggaggtggaggtggccggcatcaagctgtgcaaagccatgtcactgggcagcgtcacgtttacagacgtagctattgattttagtcaggacgaatgggagtggttgaatctggcccagcgctctctgtataagaaagtcatgctggagaactaccgcaacctggtgtccgtcggtctgtgcatatcaaaacccgacgtcattagcctgctcgaacaagaaaaggacccttgggtgatcaagggaggcatgaaccgaggcctgtgtccggatttggaatgtgtgtgggttacaaagtcactgtcacttaaccaagatatctatgaagagaagctgcctcccgctattatcatggaaaggctcaagagctatgacttagaatgttcaacacttggtaaaaactggaagtgcgaagatctgttcgagcgggagctggttaatcagaaaactcatttccgccaggagaccataacgcacattgacacgctcattgaaaagagagaccacagcaataagagcggaactgtttttcacctgaataccctctcctacattaagcagattttccccatggaagagaggatctttaatttccacaccgataaaaagtcgcttaagacacattctgttgttaagaaacacaagcaggacaggggcgaaaaaaagttgctgaaatgtaacgactgtgagaaaattttcagcaagatctcaactttgacactgcaccagcggattcatacaggggagaagccttatgaatgtatcgaatgcggcaaagccttttcacagtcagcccacctggctcagcatcagcgcatccacaccggtgagaagcctttcgagtgtaccgagtgtgggaaggcattctctcagaacgcccaccttgtccagcaccaacgcgtgcacactggtgagaagccctatcagtgtaagcagtgcaacaaagcttttagccagctcgcccacctcgcccaacaccaacgagtgcataccggcgaaaagccttatgaatgcatcgaatgtggtaaggccttctccgactgcagcagccttgcccatcatcgccggatccataccgggaaacgcccatatgagtgcatcgactgtggcaaggcttttcgacagaacgctagccttattcgccatcggcggtactatcacacgggagaaaagcctttcgactgcatagactgtgggaaagccttcactgatcacataggccttattcaacacaagaggacacacaccggcgaacgcccatacaaatgcaacgtttgtggcaaagcttttagtcacgggagctcactcaccgtccaccaaaggatccacaccggggaaaagccctatgaatgcaatatctgtgagaaggcctttagccaccgtggtagtctgacactccatcagagggtgcacacaggagagaagccatacgaatgcaaggagtgtggcaaagcattcaggcagtcaacccatctggcccaccaccagagaatccataccggggagaagccttatgagtgtaaagaatgctctaagacgttcagtcaaaacgctcatctggctcagcaccagaagatccataccggagaaaagccttatgagtgcaaggagtgtggaaaggcattctcccagatcgcccacctcgttcagcaccaacgggtgcataccggggagaaaccttatgagtgcatagaatgcggcaaagccttctcagatggctcatacctggtacagcatcaaagactgcacagcggtaagcgaccctatgagtgcctcgaatgtgggaaggcctttagacagagggctagccttatctgccatcagagatgccatacaggagaaaaaccatatgagtgtaatgtgtgcggcaaggccttcagccataggaagtctttaacgctgcatcagcggatccataccggtgagaagccttacgaatgcaaggagtgcagtaaagcattttcccaagtggctcatctgactctccacaagcgaattcacaccggggagaggccttatgagtgtaaggagtgcggcaaagctttccgacagtccgtgcacctcgcacaccaccagaggatacacactggtgaatcctccgttatcctctccagcgcgttaccttaccaccaggttttatag

SEQ ID NO: 21643 - DNA, 1881 bp, Artificial Sequence
  Description of Artificial Sequence: Synthetic coding sequence
atgaacgtggaggtggtgaaggtgatgccccaggacctggtgaccttcaaggacgtggcaatcgatttttctcaggaagagtggcagtggatgaatcctgcccagaagcgactgtatcgtagcatgatgctcgaaaattaccagtccctcgtctccttgggcctctgtatttctaagccttacgtgatctccctgttggagcagggtagggaaccgtgggagatgacgagcgaaatgaccagaagtccgttcagcgactgggagtcaatatacgtgacgcaggagctccccttaaaacaattcatgtacgacgacgcctgtatggagggaataacttcatatggattggaatgcagcacttttgaggaaaattggaaatgggaggatctgttcgaaaaacagatgggctcccacgaaatgttctctaagaaagagatcataacccacaaggaaacaattacgaaggagacagaatttaaatatactaaatttgggaagtgcatacatttggaaaacatagaggaatccatctacaatcacacctcagataagaagtctttttccaaaaatagcatggtgatcaagcataagaaggtgtatgtaggcaagaaactgttcaagtgcaacgaatgcgacaagactttcacccattctagttcccttaccgtacacttcagaatccatactggcgagaagccctacgcctgtgaggagtgcggaaaagcctttaagcaacgacagcatctggctcagcaccaccggacccacaccggcgaaaaactgtttgaatgcaaggaatgtcgcaaagctttcaagcagagcgaacacctgatccaacaccaacggatccataccggggaaaaaccatataagtgcaaagagtgccgcaaggcttttcggcagccagctcatctggctcagcaccagcggatccacacaggcgaaaagccatacgagtgtaaagagtgtggcaaggccttttccgacggatcttcctttgcccgacatcaacggtgccatactggaaagcggccctacgaatgtattgagtgtggcaaagcctttcgctacaacacttcttttatacggcattggcgatcttaccacactggagaaaagccctttaattgtatcgattgtggcaaggcttttagcgttcacattggcctaatcttgcaccggaggatccacacaggcgaaaagccttataagtgtggggtctgcggcaagaccttctcaagcggctccagcaggacggtccatcagcgtatccatacgggagagaaaccttacgaatgtgatatttgcggaaaagacttcagccaccatgcgagcctgacccaacaccagagagtccatagtggtgaaaagccttatgaatgtaaggaatgcggaaaggcttttagacagaacgtgcacctggttagtcacttaagaattcacacaggagagaagccctatgaatgcaaagaatgcggcaaagctttccgaatctcatctcagcttgctactcatcagcgcatccataccggagagaagccgtacgaatgcattgaatgcgggaacgctttcaagcaaagaagccacctggcccaacatcaaaagactcataccggcgagaaaccatacgagtgcaatgagtgtggaaaggcattttcacaaactagcaatttgacccagcatcagcgcatccacaccggagaaaaaccatacaaatgtaccgagtgtggtaaggccttcagcgattcatcctcttgcgcccaacaccagcgattgcataccgggcagaggccataccagtgctttgaatgtggaaaagcttttcggcggaaactttccctaatttgccaccagcgtagtcatactggcgaagagccctag

SEQ ID NO: 21644 - DNA, 2616 bp, Artificial Sequence
  Description of Artificial Sequence: Synthetic coding sequence
atggccgaggagttcgtgaccctgaaggacgtgggcatggacttcactcttggggactgggaacagctggggctggagcagggcgatacattctgggacacggccctggataactgtcaggatttattcctgcttgatccacccagacccaacctgacatcccaccccgacggaagcgaggacctggagcctttggccggagggtcccctgaagctacctcaccagatgtgaccgagactaagaatagtcccctgatggaagatttctttgaggagggtttttcccaagaaatcattgagatgttgtccaaagacggattttggaattccaattttggcgaggcatgtatcgaggacacatggctggactcactactgggtgacccagaaagcctgctgcgctcagacattgccacaaacggcgagtcacccactgagtgtaaatcgcatgagcttaaacgaggtctcagccccgtgtcaactgtgtctacaggcgaggattccatggtccacaacgtcagcgagaagaccctaactcccgccaagtctaaggagtataggggagagttttttagttactctgatcacagccagcaagactccgtccaggagggggaaaaaccttaccagtgcagcgaatgcggaaagtcgtttagcggatcctacagattaacacagcactggatcacgcatactagggaaaagccgacagtccaccaggagtgtgaacaagggttcgacaggaacgccagcctgagcgtttatccgaagacacacacgggctacaaattctacgtttgcaatgagtacggaacaacattctcacaaagcacttacctgtggcatcagaagacccacactggtgaaaagccgtgcaaaagccaggacagtgatcacccaccctcacacgatactcagccaggagaacaccagaagactcacacagatagtaaatcttacaactgtaatgaatgtgggaaagcatttacgagaatctttcatttgacccgccaccaaaaaatccatacacggaagagatatgaatgttccaagtgtcaagccacattcaacttgcggaagcacctaattcagcaccagaagacacacgccgcgaagaccaccagtgagtgtcaggaatgtggcaagatcttcaggcactcatctttgctcattgagcatcaagcactacatgccggcgaggagccttacaagtgtaatgagcgtggcaagagtttccgccacaacagtaccttgaagatccatcagcgggtacacagcggagagaagccttacaagtgtagcgagtgtggcaaagcattccaccggcatacccatttgaacgaacaccgtcgtattcataccggctataggccacataagtgtcaggaatgtgtgagatctttttcacggccttcccacctgatgagacaccaagcaatccatacagccgaaaagccctatagttgcgcagaatgtaaggaaactttcagcgacaacaataggctggtacagcaccaaaagatgcatactgtgaagaccccctatgagtgccaagaatgcggggagcggttcatttgcggctccacactcaaatgccatgagtctgtgcacgctcgtgagaagcagggattcttcgtctcaggtaagatactcgaccagaaccctgagcagaaggagaagtgtttcaaatgcaataaatgtgagaagaccttctcttgctccaaatacttgacccagcacgagagaattcacacacggggtgtgaaaccattcgagtgtgatcagtgcggtaaggcatttgggcagagcaccagattgatccatcatcaaaggattcactctcgtgtgcgcttatataagtggggcgaacagggcaaggccattagtagcgcttcacttattaaactgcagagctttcatactaaagaacatccatttaaatgcaacgagtgcggcaaaactttctcacactctgcacatttgagtaagcatcagctcattcatgcgggcgagaacccatttaaatgtagtaaatgtgacagagtgtttactcaacgaaattatttggtgcagcacgaaaggacccacgcgagaaaaaaacccctcgtgtgtaacgagtgcgggaaaactttcagacagtcaagctgtctgtccaagcaccaacgcatccattctggggaaaaaccatatgtgtgcgactattgcggcaaagccttcggtctgtccgcagaactcgtgcgacatcaacgtatccataccggggagaagccatatgtttgtcaggagtgcggtaaggcctttacacagtcgagctgcctcagcatacaccgacgggttcacacaggagagaagccctatcgctgcggcgaatgcgggaaagcctttgctcagaaggcaaacttaactcagcaccagcgcatccataccggcgagaagccatactcatgcaacgtgtgtggcaaagccttcgttctgtcagcccaccttaatcagcacctgcgggtgcatacacaagaaaccttgtatcagtgtcaacggtgtcagaaagcttttcgttgtcatagtagccttagccggcaccaacgggtgcataataagcagcaatactgcctatag

SEQ ID NO: 21645 - DNA, 2616 bp, Artificial Sequence
  Description of Artificial Sequence: Synthetic coding sequence
atggccgaggagttcgtgaccctgaaggacgtgggcatggacttcacactaggcgactgggaacagctcgggctggagcaaggagatactttttgggataccgctctggataactgtcaggatctcttcctgcttgaccctcccagacccaacctgaccagccatcccgatgggtctgaagacttggagcccctggctgggggcagccctgaagcaacaagccctgatgtcaccgaaacgaagaattcccctcttatggaagatttttttgaagagggcttcagccaggagattattgaaatgctttcaaaagacggattctggaatagcaacttcggggaggcttgtatcgaggatacctggctggattctcttctgggcgaccctgagagcttgcttcggtcggatatagctacaaatggagaatcccctacagagtgcaagtcacacgaactgaaaaggggcctctctcctgtatctacagtgagtaccggcgaggattcgatggtgcataacgtgagtgagaaaaccctcacaccggctaagagcaaagaatatcgaggtgagtttttctcctacagcgatcactcccagcaggattcagttcaggaaggcgagaagccttaccaatgctcagaatgcggcaagtctttttcaggcagttaccgcctgacacagcactggattactcacacaagggaaaaacccaccgtgcaccaggaatgtgagcaaggatttgatcgtaacgcaagtctgagcgtataccccaaaacccacacaggatataaattctacgtctgcaacgaatacggcacaaccttcagccagagtacctatctgtggcatcagaaaacacacactggcgaaaaaccctgcaagagccaggattccgaccacccccccagccatgacacacaacctggagagcatcagaagacacataccgactccaaaagttacaactgcaacgagtgcggaaaggccttcacccggatcttccacctcaccaggcatcagaagatccatacacgtaagagatacgaatgttccaagtgccaggcgacgtttaaccttcggaagcacctgatacagcaccagaaaacgcatgccgcaaagaccacctcagaatgtcaggagtgcgggaagatttttcggcattcttctctgctcattgagcatcaagcactgcatgccggcgaagaaccctataaatgcaacgagagagggaagtccttcaggcacaacagcacactcaaaatccatcaaagggtgcattccggggagaagccttataagtgcagtgagtgtggaaaggctttccatcggcacacccatcttaacgaacaccgaaggatccacacgggctatcgccctcataagtgtcaggagtgcgtgcgatcattttcccgccccagccacttaatgcggcatcaggccatccacacggccgagaagccgtactcttgtgccgaatgtaaggagaccttcagtgacaacaatcgccttgtgcaacatcagaagatgcacaccgtgaagacaccatatgaatgccaagaatgtggggaaaggtttatatgtggtagcaccctcaagtgccatgagagcgtgcacgcacgtgagaaacagggtttcttcgtatccgggaaaatcctcgatcaaaaccccgagcagaaagagaagtgtttcaagtgcaataagtgtgagaagacgttctcctgctctaagtatctgacccaacatgaacgaattcatacccgcggcgtgaaacccttcgaatgcgaccagtgcgggaaggcctttggacagtccactcggctgattcaccaccagcgaatccattcgagagttcgcttgtataaatggggcgaacagggcaaagccatttcttccgcaagcctcataaaacttcagtcgttccacactaaggagcatccctttaaatgcaacgagtgtgggaaaaccttcagccattcagcacacctgtctaaacaccagctcatccacgcgggcgagaaccctttcaaatgctcaaagtgcgaccgtgttttcacacaaagaaactacctggtacagcatgagagaactcacgcccggaaaaagccgctggtgtgtaatgagtgcgggaaaaccttcaggcagtcctcctgtctatccaagcaccagcgcatccacagcggtgaaaaaccctacgtgtgtgattattgtgggaaagcgttcggactgtccgcggagttggtccggcatcagcggattcatacaggagagaagccttacgtctgtcaagagtgcggcaaagcatttacccagtctagttgtctgtccatacaccgacgagtccacaccggcgaaaagccatacagatgtggagagtgtggcaaagcctttgcccaaaaggccaatctgacccagcaccaaaggattcacaccggggaaaagccctatagctgcaatgtatgcggaaaagccttcgtgctcagtgcccacctaaatcagcatcttagagtccacacacaggagaccttatatcagtgccagagatgtcagaaagcatttcgctgtcactctagcctgagccggcatcagcgcgttcacaataaacaacagtattgtctgtag

SEQ ID NO: 21646 - DNA, 2580 bp, Artificial Sequence
  Description of Artificial Sequence: Synthetic coding sequence
atggacttcaccctgggcgactgggagcagctgggcctggagcagggcgacacattctgggatacagcacttgacaactgtcaggatttgtttctactcgatcctcccaggcctaacctcacgagccacccagacggcagcgaggatttggagcctttggcgggggggtccccagaggccacgagtcccgatgttactgaaacaaaaaatagccccctcatggaggatttttttgaggaaggcttctcccaagaaataattgagatgctcagcaaggatggattttggaactctaattttggcgaagcctgtattgaggatacctggctggactccttactgggtgatccagagagcctgttgcggagtgacattgccactaacggagagagtccaaccgagtgcaaatcccacgagctgaaacgggggctctcccctgttagcacggtctccaccggcgaggactccatggtgcataatgtgagtgagaagaccctaacacccgcgaaaagcaaggaataccggggcgaattcttcagctactctgaccactctcaacaagattcagtacaggaaggagaaaagccttaccagtgctctgagtgtggcaagtcattctctgggagttaccgattaacccagcactggattactcacactcgggagaagcccactgtccaccaggaatgtgaacagggctttgatcgtaacgcgagcctttcagtctacccaaagacacataccgggtacaaattctatgtctgcaacgagtacggaactacctttagccagagtacttatctttggcaccaaaaaactcacaccggagagaaaccctgcaagtcacaggactccgatcatccaccttcccacgatacacagcctggcgagcaccaaaagacccacactgattccaagtcctataattgtaacgaatgcgggaaagctttcacaaggatctttcacctgacccgccatcagaagatccatacaaggaaacggtacgagtgcagtaaatgccaggccacgttcaatcttcggaaacacctcatccagcaccagaagacccacgccgccaagaccacttccgagtgtcaggaatgcggaaagatcttcagacacagctcgcttttgattgagcaccaggcactgcatgcaggcgaggagccgtataagtgtaacgagcgcggcaagtctttcagacacaactcaaccctgaagattcaccagagggtacactccggggagaaaccttacaaatgctctgaatgcggaaaggcattccatcgccacacacacctcaacgagcaccgacgcatacacacaggatacagaccacataaatgtcaagagtgtgtacgatccttctccagacccagccacttaatgaggcatcaagctatccacaccgccgagaagccttattcttgtgccgaatgtaaggagaccttcagtgataacaaccgcctcgtacagcaccaaaagatgcacactgtcaaaaccccttatgaatgtcaggagtgcggtgagaggtttatttgtggcagtacattaaaatgtcacgagagtgtgcatgcgcgggagaaacagggctttttcgtttcaggtaagatcttagatcagaacccagaacagaaggaaaaatgttttaagtgtaataagtgcgaaaaaacattctcttgcagtaagtacctaactcaacatgagcggatccacactcgcggcgtgaaaccttttgagtgtgaccaatgtggaaaagcttttggacagagtaccagactgattcatcatcaaagaatccacagtcgagttcggctgtacaagtggggggagcagggcaaggccatttcctcagccagtctaattaagctccagagttttcatactaaagagcatcctttcaaatgtaatgaatgcggcaagaccttctcccattcggcccacctatccaaacatcaattgatccacgcgggggaaaatcccttcaagtgctccaagtgcgatagagtgtttacccagcgcaattacctcgtgcagcacgaaaggacacacgcaagaaaaaagccactcgtctgtaacgagtgcgggaagacttttcgccagtcaagctgcctttctaagcaccagcggatccactcaggggagaaaccttatgtgtgcgattattgcggtaaggctttcggtctgagcgccgaactcgtccgacaccagcgtatccacaccggagagaaaccatatgtatgccaggagtgtggcaaggcctttacccagtcctcatgcttatcgatacatcggagggtccatactggtgaaaaaccctatcgatgtggcgagtgtggaaaggcttttgcccaaaaggcgaatttaacccaacaccagaggatacacacaggcgaaaagccctacagttgtaacgtctgcggcaaggcctttgtgctgtcagcccacctcaatcagcatctcagagtacatactcaggaaacgttgtatcagtgtcagagatgtcagaaggcctttcgatgccacagctcattgagccggcatcagagggtccataacaagcagcagtactgcctgtag

SEQ ID NO: 21647 - DNA, 2616 bp, Artificial Sequence
  Description of Artificial Sequence: Synthetic coding sequence
atggccgaggagttcgtgaccctgaaggacgtgggcatggacttcacgctcggcgactgggaacagctgggtctggaacagggggacaccttctgggataccgctctggataactgtcaagacttgttcctattagacccacccaggcccaacttgacatcacatcccgatggctccgaagacctggagcccttggcagggggaagcccagaagccacatcccctgatgtcacagagaccaagaattcacctctgatggaggacttctttgaagaaggttttagccaagagatcatagaaatgctgtcgaaggacggattctggaactctaacttcggagaggcctgcatagaggatacctggctggacagtctactcggcgatcccgaaagtctgctccgttctgatatagctactaatggcgaatctccaaccgaatgcaagtctcacgagctgaagcgtggtctctctcctgtgtccaccgtctccaccggcgaggacagcatggtgcataatgtatcagaaaaaacattgactcctgccaaatctaaggagtatcgcggcgaatttttctcttatagcgaccactcccagcaagattctgtacaggagggggaaaagccttatcagtgttctgaatgcggaaagtcattttctggatcttaccgcctcacccagcactggatcactcacacgcgagaaaagcccaccgtccatcaggaatgcgaacaagggttcgatcgcaacgcgagcctctccgtgtaccccaagacccataccggatataaattctacgtctgcaacgagtacggcacaaccttttcccaatctacttacctttggcatcagaagacccacactggcgagaaaccttgtaaatcgcaggatagcgaccatccacccagtcatgatacccagcccggagagcaccagaaaactcacacagatagtaaatcttataattgtaacgaatgtggtaaggccttcacaaggatattccacttgacccgacatcagaagattcacacccgaaagaggtacgagtgttctaagtgtcaagcgacgttcaacctccgcaagcacctcatccagcaccagaagactcatgccgcaaaaacaacctctgaatgccaagagtgcgggaagatctttagacactcctcactcctgatcgagcatcaagccttgcatgccggggaggagccctacaaatgcaatgaacgagggaaaagcttcaggcataattcaacgctgaagattcaccagcgtgtgcactctggtgagaagccctataaatgcagcgagtgtgggaaggcatttcatagacatacccatctcaacgagcacaggcggatccataccggataccgcccccacaaatgccaagagtgtgtgcgctctttttcccggccaagccacctgatgagacaccaagctatccacacagccgagaaaccatacagttgcgccgagtgtaaggagaccttctccgataacaacaggttggttcaacatcaaaaaatgcacacagtcaagaccccttatgagtgtcaggagtgcggcgagcgctttatatgcggtagcactctgaagtgtcacgaatctgtacacgctcgggagaaacagggcttctttgtaagcgggaagatcctagatcagaaccccgaacagaaagagaaatgctttaagtgcaacaagtgtgagaaaactttctcctgctctaagtatttgacacagcacgaaagaattcatacgcgcggcgtgaaacctttcgagtgcgaccagtgcgggaaggcatttggccagagtacccggctcatacaccatcaacgaatccattcaagagtgagactctacaaatggggagagcagggcaaagccatctcctccgcttccctgattaaactacaatctttccacacgaaagagcaccccttcaagtgcaatgagtgtggcaagaccttttcacactctgcacacctgtccaaacaccaattgatccacgctggagaaaacccgttcaagtgcagtaagtgcgacagagtgttcactcagcgtaactacctggtccaacacgagcgcacgcatgccaggaagaaacctcttgtttgtaacgaatgcggtaaaaccttcaggcagtctagctgcctcagcaaacatcaacggattcattcgggcgagaaaccttatgtgtgtgactactgtgggaaggctttcggactgtctgcggaacttgtccgtcaccagcggatacacacaggcgagaagccgtatgtttgccaggagtgcggtaaagctttcacacaatccagctgtctgagtatacacagacgcgtgcacaccggtgaaaaaccttatcgctgtggggagtgcggtaaggcctttgctcagaaggcaaacctgacacagcatcagcgcatacacacaggcgagaaaccctatagctgtaatgtatgcggtaaagctttcgtactgtctgcgcatcttaatcagcatttgcgcgtccatacccaggagacactgtatcaatgccagagatgtcagaaagcgttcaggtgtcattctagcctgagccggcaccagagagtccataataagcagcagtattgtctgtag

SEQ ID NO: 21648 - DNA, 1575 bp, Artificial Sequence
  Description of Artificial Sequence: Synthetic coding sequence
atggccaagcggcccggcccccccggcagccgggagatgggcctgctgacctttcgggatattgcaattgaattttccttggaagagtggcagtgcctggattgcgcccagaggaatctataccgcgatgttatgctggagaactaccggaatcttgtctcgttgggtattgcggtcagtaagccggatctgattacatgcctggagcagaacaaggaaagtcagaacatcaagcggaatgagatggtggccaagcaccccgtcaccaggtctcacttcacccaggacctccagcctgaacaagggataaaggattcgcttcagaaagtaatacctcggacgtatggaaaatgcggtcacgaaaagcttcaattcaagaaatgctgtaagagcgtgggggagtatgaggtgcacaagggtggctacagcgaggtgaatcagtgcctaagcacaactcagaataaaatcttccagacgcataagtatgtgaaggtttttgggaaattcagcaatagtaaccgagataaaacgaggtataccggaaataaacactttaaatgcaataaatacgggaaaagcttttgtatgctgtcacacttgaatcagcaccaggttattcacactcgcgagaaaagttacaagtgcaaagaatgcggaaagagttttaactgtagtagtaatcacactacgcataagatcatccataccggcgagaagccttatagatgtgaggaatgtgggaaggcattctcttggtccgccaatctgacacgccacaagcgaacacacaccggagagaagccctacacttgcgaggagtgcggacaagccttcaggagaagtagtgccctgaccaatcacaaaagaattcatactggcgagcgaccatacaagtgtgaggaatgcgggaaagcgtttagtgtctcttcaacactgacagaccataagaggattcacaccggcgagaagccttgtcggtgcgaggagtgtggtaaggctttttcatggtcctctaacctgaccaggcacaagcgcatccacactagggagaagccctacgcctgcgaggagtgcggccaggcatttagtctttcatcaaacctcatgagacataggagaatccacacaggcgagaagccatacacctgcgaggaatgtggccaagacttcagacgctcatccgccttgacaatccataaacgaatccacacaggcgagcggccctacaaatgtgaagaatgtgggaaagtcttctctctatcgagcacgctgactgaccacaagcggattcataccggagaacgaccctacaagtgcgaagaatgcgggaaggcattctcattaagttcgaccctgacggaccacaaacggatccatactggcgaaagaccctatacatgcgaggaatgcggaaaagcctttaactgctcctctaccctgatgcaacacaaacgcattcacactggagaaaagccttacaaatgtgaagaatgcgagcaagccttcaaatggcactcatctctcgcaaaacataaaatcattcacacgggagagaaaccatataagtgcgaatag

SEQ ID NO: 21649 - DNA, 1857 bp, Artificial Sequence
  Description of Artificial Sequence: Synthetic coding sequence
atggagcgggccgtggagccctggggccccgacctgcaccggcccgaggagcgggagcctcagagaggcgcccgcactgggctaggatcagaaaacgtgatctcacaaccgaatgaattcgagcacacacctcaggaagacgatctgggatttaaagaggaggacctcgcaccggatcacgaggtgggaaacgcttcactgaaaccagagggcattcaaaactgggacgatctgtgggttcagcgggaggggctaggtaaaccgcagccaagggaccggggcccaagattattaggcgaaccgcgctggggccaggccagtagtgaccgggccgccgtatgtggggaatgcggtaagagtttccgtcaaatgagtgacctggttaagcatcagagaacgcacactggggaaaagccttacaaatgtggggtatgcggaaaaggttttggcgattcctcagccaggatcaagcaccagcgaacacacagcggagagaagccctaccgggccaggccaccagcccagggacctcctaaaatacccagatctaggattcctgctggggagaggccgacgatttgcggcgagtgtggtaaatcgtttcgccagtcgagtgacctagtgaaacaccagcgaacacatacaggcgagaagccctataaatgcggtatctgtgggaaaggattcggcgattcatcagcacggattaagcatcagcggacccacagaggcgagcagcctccccgacccgtggtcccccgtcggcaacctagtcgagcagccacagccgctactcaaggacctaaagctcaggacaaaccatacatctgcacggattgtggcaagcggtttgtgttgagttgttccctcttaagtcatcagcggagccacctcgggcccaaaccattcgggtgcgatgtctgcgggaaggagttcgcgcgaggatccgatctggtcaagcacttgcgggttcacacaggggagaagccctacctctgccccgagtgtggaaaaggatttgccgactcctctgctcgcgtgaaacacctcagaacgcattccggtgaaaggccccatgcctgccccgaatgcgatcggacgtttagtctgtcaagcacactcctgagacacaggttgactcacatggaaccacaggacttttcatttccgggataccccctgccggcccttatcccttcacctccacctccacccctgggcacgtcccctccacttacacccaggagcccgtctcactcaggagagcccttcggactacctgggttggaacccgagcctggcggaccacaggccggcgaacctccccccccgttggccggagacaaaccgcacaaatgcccagagtgcgggaaagggttcaggcgatctagtgatcttgtcaagcaccatagggtacacaccggcgagaaaccatacttgtgccctgagtgtggcaagggatttgccgattcatccgctagagttaagcatcttagaacccacagaggagagagagcccgaccaccgcctccaagcacacttctccgcccacataacccacctgggcccgtaccaatggctcccagacctagagtgagagcccagccttccggaccttcacagcctcatgtttgtggattctgtggtaaggaattcccgcgatcctcagacttggtcaaacacagacgtacccatactggggagaaaccatacaagtgtgctgagtgtggcaaggggttcggcgattcttctgctcgtatcaagcatcagcggggtcacctcgtgctgactcctttcggtattggcgatgggagggcccggccactcaaacaggaggctgctactggattggaatag

SEQ ID NO: 21650 - DNA, 432 bp, Artificial Sequence
  Description of Artificial Sequence: Synthetic coding sequence
atggagcgggccgtggagccctggggccccgacctgcaccggcccgaagagcgcgagccgcagcgaggcgcccggaccggcttaggaagtgaaaacgtaatctcccagcccaacgaattcgagcacactccccaggaagatgacctgggcttcaaagaggaagatctggcgcctgaccacgaagtaggcaatgcttcccttaagccagaaggtatccagaattgggacgatctctgggtgcagagggagggcctgggtaaaccacagcccagagataggggccctaggctcttgggagaacctcgctgggggcaggcaagctctgaccgggctgctgtgtgcggcgagtgcggcaaaagctttcgacagatgagtgatctggttaagcatcagcggacacataccggcgagaagccatataagtgtggctag

SEQ ID NO: 21651 - DNA, 444 bp, Artificial Sequence
  Description of Artificial Sequence: Synthetic coding sequence
atggagcgggccgtggagccctggggccccgacctgcaccggcccgaagaaagggagccccagaggggtgcgaggaccggcctgggctccgaaaacgtgatatctcaaccaaatgaattcgaacacaccccacaggaggacgatctggggtttaaggaagaagacttagctccagatcatgaggttggcaatgcaagcctgaagccagagggcatccagaattgggacgatctctgggttcagcgcgagggactgggcaagcctcaaccacgagacagaggcccccgtctcttgggcgagccgcgctgggggcaggcatcttctgatcgcgccgcggtctgtggcgagtgcggaaagtcttttaggcagatgtccgacttggttaagcaccagcgaacgcatacgggcgagaagccatataaatgtggcgtttgcggcaaatag

SEQ ID NO: 21652 - DNA, 2235 bp, Artificial Sequence
  Description of Artificial Sequence: Synthetic coding sequence
atgcaggccgtggtgcccctgaacaagatgaccgccatcagccccgaacctcaaaccctggcatctacagagcagaatgaagtgccacgggtggtcacttccggtgaacaggaagccatcttacggggtaatgctgccgacgctgagagcttccgccagcgattccgctggttttgttacagtgaagttgcaggtccgaggaaagccctatcacagctgtgggaattatgcaaccaatggctacgtccagacattcacactaaggaacaaatcctggagctcctagtgttcgagcagttcctgacaattctgccgggggagattaggatctgggtcaagtctcagcaccccgaaagttcggaagaggtggtgacacttatagaagaccttacccaaatgcttgaggaaaaggatcccgtaagccaggattccacggtctcacaggaagaaaacagcaaagaagacaagatggtgaccgtttgtcctaacacagagtcctgtgaatctatcacactgaaagacgtggccgttaactttagcaggggcgagtggaagaaattggaacccttccaaaaagagctatataaggaagtccttttggagaatctgcgcaacctcgaattcttagactttcccgtttcgaaattggagctgatctctcagctcaaatgggtggagctcccttggcttctcgaggaagtgagtaagtcatctcgactcgacgaatcagctctcgacaaaatcattgagcgttgtctgagggacgacgaccacggactgatggaggaaagtcagcagtattgtggtagtagcgaggaggatcatgggaaccagggcaattcaaaaggccgcgtagctcagaacaaaaccctgggtagcggttcacggggaaagaagtttgaccctgataaatctccctttggtcacaactttaaagaaacatctgatttgatcaaacaccttcgggtgtatctgcggaagaagtcccgtcgttacaacgagtcaaagaagccgtttagcttccacagcgacctagtccttaatcgcaaggaaaagaccgccggcgaaaagtcacgcaagagcaacgatgggggcaaagtcttgtcacactccagcgccctgactgagcaccagaagcgccagaaaattcacttgggcgacagatcacaaaaatgttccaagtgcggtatcattttcataaggagatcaaccctcagtaggcgaaagactcccatgtgtgaaaagtgtcgtaaagattcatgtcaagaggcagcactgaataaagatgaaggcaacgaaagcggcgaaaaaactcacaaatgttcaaagtgcggcaaagccttcggttatagcgcttctttgaccaagcatcggagaatccatacgggtgaaaagccttatatgtgcaacgaatgcgggaaagccttctcagactcttcctccttgaccccccaccaccggacgcattcgggcgaaaaacccttcaagtgtgacgactgtggcaaagggttcaccttgagcgcccatctcatcaagcatcagcggattcacacgggtgaaaagccctacaagtgcaaggattgcggccggcccttctccgactcgtcctctctcattcaacaccagaggattcatacgggcgagaagccctatacgtgttcaaattgtggaaagagcttttcacatagcagctcattgtccaaacatcagcgcatccatactggcgagaagccgtacaagtgtggtgagtgcgggaaggcctttcggcagaatagctgtctgacaaggcaccagcgcattcatacaggcgagaagccctacttgtgtaacgattgtggcatgacttttagtcacttcactagcgtgatatatcatcagcggctgcacagtggcgagaagccatataagtgcaaccagtgtgagaaggctttcccaactcacagtctgctcagccggcatcagcgcatccacacaggcgtgaagccgtacaagtgcaaagagtgcggaaaatctttttctcagagttccagtcttaacgagcaccatcgaatccatacaggtgaaaagccgtatgagtgcaactactgtggggccacatttagccggtcatccattctggtagaacaccttaagattcataccggtcgtagagagtacgagtgcaatgagtgtgaaaaaacgtttaagagcaactctggtcttattaggcaccgcggcttccacagcgcagaatag

SEQ ID NO: 21653 - DNA, 735 bp, Artificial Sequence
  Description of Artificial Sequence: Synthetic coding sequence
atgcaggccgtggtgcccctgaacaagatgaccgccatcagccccgaaccacaaacactcgcctccaccgaacaaaatgaagtccctagagtggtgacctcaggggagcaggaggccattctgaggggcaacgccgctgatgctgagagttttcgacagaggtttcgttggttttgctattcagaagtggccggaccccgcaaggcactgtcccagctgtgggagctgtgcaaccaatggttgagaccagacatccacaccaaggagcaaatcttggagctgctggtgttcgagcagtttctcaccatccttccaggggagatcaggatttgggtgaaatctcagcacccggaatctagtgaggaagtggtcaccctgattgaggacctaacacaaatgcttgaagagaaggaccccgtgtcacaagactccaccgtgagccaggaagaaaactcaaaagaggacaagatggtgaccgtgtgcccaaatacagaaagttgcgagtccattacactgaaagacgtggccgttaatttcagcaggggcgaatggaaaaaactggaacccttccagaaagagttatacaaagaggtcctcctggagaaccttagaaacctggagttccttgatttccccgtttctaagttggaactcatcagtcagctgaaatgggtggaattaccttggctcctcgaagaagtaagcaaatcaagcagactaggaagcgtcatctag

SEQ ID NO: 21654 - DNA, 771 bp, Artificial Sequence
  Description of Artificial Sequence: Synthetic coding sequence
atgcaggccgtggtgcccctgaacaagatgaccgccatcagccccgagccacaaactctcgccagtaccgagcagaacgaagttcccagagtcgtcacctcaggggagcaggaagcaattctgaggggcaatgcagccgacgccgaatcctttcggcagcgcttccggtggttctgctactctgaggtggccgggccccgcaaagctctatcacaactctgggaactatgtaaccagtggttaaggcctgacatccacacgaaggagcagattctggagttactcgtgtttgagcaattcctcacgatactacccggggaaatcaggatctgggttaagagccagcaccccgagtccagtgaggaggtggtcacgcttatagaggacttaacccagatgttggaagagaaggacccagttagtcaggacagcacagtgtctcaagaggaaaacagcaaagaggacaaaatggtgactgtgtgtccgaacacagagtcttgtgaatcaattaccttaaaagatgtggccgtgaacttctcacggggggaatggaaaaagttggagccatttcagaaggagctgtataaggaggtgcttctggaaaatctgaggaatctggaatttcttgattttccagtgagcaagctggagctaatttctcaactcaaatgggtcgagctgccctggctgctggaggaggtgagcaaaagctcccggctggatattcatggcgcagtgaaaaagatgcagatgttttccgaagccgagtag

SEQ ID NO: 21655 - DNA, 537 bp, Artificial Sequence
  Description of Artificial Sequence: Synthetic coding sequence
atgcaggccgtggtgcccctgaacaagatgaccgccatcagccccgaacctcagacacttgcatctacagagcagaatgaggttccccgcgttgtgacatcaggagaacaggaagccatccttcgggggaacgccgccgatgccgagtcctttaggcagcgctttagatggttttgctacagcgaagtggccggcccaagaaaggccctcagtcagttgtgggagttatgtaatcagtggctaaggcccgatattcacactaaggagcagatccttgaactcctggtttttgagcagtttttaactattttgcccggcgagattcgaatctgggtcaaatcccaacatccagaaagctcagaagaagtcgtaaccttgatcgaggatcttacacaaatgctggaagaaaaaggagaaatctaccgttggcgggaggaggccggcgatatagcatccaagagtgaaagcaaattcctgaaaagaaggcaatttaccgccaaggaagagtcagaggtacggtcatgggattgggtgtag

SEQ ID NO: 21656 - DNA, 2451 bp, Artificial Sequence
  Description of Artificial Sequence: Synthetic coding sequence
atgctggagaactacttcaacctgatcagcgtgggctgccaggtgccaaaaccggaagtcatcttttcgttagaacaggaagaaccgtgtatgctggatggagaaatacccagtcagtctaggcccgacggcgacattggttttggacccctccagcagcgaatgtccgaagaggtgtcgtttcaatccgagattaatatcaatctgttcacccgggacgacccctacagcattctcgaagagttgtggaaggatgatgaacacaccaggaaatgcggagagaaccagaacaaacctctttcccgcgttgtgttcatcaataagaagacgcttgccaacgatagtatattcgagtacaaagacataggagaaatcgttcacgtgaatactcatctggtctctagccggaagaggcctcacaattgcaactcttgcggaaagaacctggagcctattatcacgttatataaccgaaataatgcaacagagaactcagacaaaaccattggagacggtgatatttttacccacctgaattcccacacagaggttacggcctgtgagtgcaatcaatgtgggaaaccattgcaccacaagcaggcactcatacagcagcaaaaaatccatacacgcgaatcattataccttttttctgactacgtaaacgtattttctcccaagtcacacgcctttgcgcacgaaagtatttgcgcagaggaaaaacaacacgagtgccacgaatgcgaggccgtctttacacagaaaagccagcttgacggtagccagcgcgtctatgccggaatttgcacagagtacgaaaaagactttagtctgaagagcaataggcagaaaactccctatgaagggaactactataaatgttcggactatgggagggctttcatacagaaaagcgatctttttaggtgccagcggatccatagcggcgaaaagccgtatgagtactccgagtgcgaaaaaaatctaccccagaacagcaatttaaatatccacaaaaagattcacaccggaggcaaacacttcgagtgcacagaatgcgggaaggctttcacccggaagtccacgctgtctatgcaccagaaaattcataccggggaaaagccatatgtatgtacagagtgcggaaaggccttcattagaaagagccactttatcacccacgaaaggatccataccggggagaagccctacgagtgttctgactgcgggaagagctttatcaagaagagccagctccatgtgcaccagagaattcacaccggggaaaatccctttatttgttccgaatgcgggaaggtgttcacacacaagaccaacctgattatccaccagaagattcacacaggtgaacgtccctacatctgcaccgtttgtggaaaggcgtttactgatcgttcaaatctcattaagcaccaaaagatccacactggggagaagccatacaagtgtagtgactgcggtaaaagcttcacatggaaatctagactgaggattcaccagaagtgtcatacaggggagagacactacgaatgttcagagtgtgggaaagccttcatacagaaatccactctgtccatgcatcagcggattcacaggggtgagaaaccttatgtgtgtactgagtgcggcaaggcatttttccacaaaagccattttatcacacacgagagaatccatacaggggaaaagccctatgagtgctctatttgcgggaagtcatttacaaaaaagagccaactgcacgttcaccagcagattcacactggcgagaaaccatatcggtgtgcggaatgtggcaaagcttttactgaccggtccaatttgtttactcaccagaaaatccacacaggggaaaagccgtacaagtgtagtgactgcggtaaagcatttactcgtaaatcagggctccacattcatcaacagagtcacaccggagaaaggcactatgagtgtagcgagtgtggcaaagcatttgcgcgcaagtctaccttaatcatgcaccagaggatccacacaggagagaaaccttatatttgtaatgaatgtgggaaatcattcatccagaaaagtcacctgaatcggcatcggagaatccacaccggcgagaaaccgtatgaatgttcggattgcgggaaaagttttataaagaagtcacaactgcatgaacaccataggatccacaccggcgaaaaaccatacatttgcgctgaatgtggcaaagcgttcactattcgttccaatttgattaagcaccaaaagattcacacaaagcagaagccgtataaatgctccgatctgggcaaagcacttaactggaaaccacagctttctatgccccaaaagtccgacaacggcgaggtggagtgctcaatgcctcagctgtggtgtggggatagcgagggagatcaagggcagcttagcagtatctag

SEQ ID NO: 21657 - DNA, 2559 bp, Artificial Sequence
  Description of Artificial Sequence: Synthetic coding sequence
atgaccaagagcctggagagcgtgagcttcaaggacgtgaccgtggacttctcccgggacgaatggcaacagctggatcttgctcagaagtcattgtatcgggaggtgatgctcgaaaactactttaatttgatctccgtcggatgtcaagtccctaagcctgaagtaattttctcattggagcaagaagaaccatgtatgctggatggcgaaatacccagccagagccgtccggatggtgatataggattcggacccctgcaacagcgaatgtccgaggaagtgtcattccagtccgaaatcaacatcaatctcttcacaagggacgatccttacagcatccttgaagagctatggaaggatgacgagcacacgcggaaatgcggagagaatcagaacaagcccttaagtcgggtcgtctttataaataaaaaaaccctggccaatgattctatcttcgagtacaaggacattggagagatcgttcacgtgaatacccacctcgtgagctccagaaagaggccgcataactgtaatagttgtgggaagaacctggagcctataattaccctgtacaacaggaacaacgctaccgaaaacagtgacaagacaatcggcgacggcgatatttttacacacctgaacagccacactgaggttacagcctgcgaatgcaatcagtgcggcaagcccctacaccacaaacaggccctgatacagcagcagaagattcacactcgcgagtcactgtacctcttctctgactacgtgaatgtgttctccccgaagtcccacgcttttgcgcacgagtctatctgtgcagaggagaagcagcacgagtgtcacgagtgtgaggccgtctttacccagaagagccagcttgacgggtcgcagcgcgtgtacgccggaatttgcactgagtatgagaaggatttcagcctgaagtctaatcgacagaaaaccccttatgaagggaattattacaaatgcagcgactacggacgagcgttcatccaaaaatctgacctgtttaggtgtcagagaatccactcaggtgagaaaccttatgaatactccgagtgcgaaaagaacctaccacagaattcaaatcttaatattcacaaaaagatacacactggcggtaaacatttcgagtgtacagaatgcggcaaggcatttactcgcaaaagtacattgtccatgcaccagaaaatccacacgggtgagaaaccgtatgtatgtacagagtgcgggaaggccttcatacgcaagtctcacttcatcacacacgaacgcatacatactggagaaaaaccctatgaatgttcagactgtggcaaaagcttcatcaaaaaaagccagctgcatgtgcaccagcggattcacaccggagaaaaccctttcatctgcagtgaatgcggtaaggtctttactcataaaacgaatctgatcattcaccagaaaatacacactggcgaaagaccctacatctgtaccgtgtgtggcaaggcatttaccgacagatccaacctgattaaacatcaaaagatccacacgggcgagaaaccatataaatgctccgactgtggcaagtcatttacctggaagagtcgcttacggatacaccaaaaatgccatactggcgagagacattacgaatgctcagagtgcgggaaagccttcatacagaaaagtacactgtcaatgcaccagcgcatccatagaggcgaaaagccctacgtgtgcacagaatgtgggaaggccttcttccacaagagccacttcatcacacacgagagaattcacactggcgagaaaccttacgagtgttcgatctgcggcaagtccttcacaaaaaagtcccagctgcacgttcatcagcagatacacactggggagaaaccataccggtgtgctgagtgcggcaaagccttcaccgaccgttctaaccttttcactcaccagaaaattcataccggagagaagccatacaagtgttccgattgtggaaaagcattcactcgcaaatctggtctacatatccatcaacaaagccatacaggcgagagacactacgagtgctcagagtgtgggaaagctttcgcaaggaagtccaccctgatcatgcaccagaggatccacacaggcgaaaaaccctatatctgtaacgagtgcggaaaaagcttcatccagaagtcccacctgaatagacaccggcgcattcacactggggagaaaccatatgagtgttcagattgtggtaaatcctttattaaaaagtctcagctccatgaacaccaccggatccacaccggcgagaagccttacatctgcgccgaatgtggtaaggccttcacaattaggagtaaccttatcaaacaccagaagatccatactaagcagaaaccctacaagtgttcagatttaggaaaagcgctgaattggaagcctcaactgagtatgccgcagaagtccgacaatggcgaagtggaatgtagcatgccccagctttggtgcggggacagtgagggcgatcaggggcaactgagcagtatctag

SEQ ID NO: 21658 - DNA, 2451 bp, Artificial Sequence
  Description of Artificial Sequence: Synthetic coding sequence
atgctggagaactacttcaacctgatcagcgtgggctgccaggtgcccaagccagaagtgatcttcagcctcgagcaggaggagccttgtatgctagacggggaaattccttctcaatcaaggcccgatggtgacattggcttcggtccattgcagcagcgtatgagcgaggaggtcagtttccagtccgagattaacataaatttatttacgagggacgacccatattccattctggaagagctttggaaggacgacgaacacacaagaaagtgcggagaaaaccaaaacaaaccattgagccgtgtggtgttcataaataagaaaacgcttgcgaacgactctatttttgagtacaaggatataggggaaatcgtgcatgtgaacacacacctggtgagcagccgcaaaaggccacacaactgtaactcctgcggcaaaaatctcgagcctatcatcaccttgtataataggaataacgcgaccgagaacagcgataaaactatcggggacggcgatatctttacacacctcaatagccacacggaagtcaccgcctgcgagtgtaaccaatgtgggaaacctcttcatcacaaacaggctctcatccagcaacagaagatccacacaagggaatcattatatttattctcagattatgtgaatgtttttagccccaagtcccacgccttcgcacacgaaagcatttgcgcagaagagaagcagcacgaatgtcacgaatgtgaagccgtttttacccagaaatctcagctggacggctctcaaagagtgtatgccggtatctgtaccgaatacgagaaagacttctcactgaagtcaaatagacagaagacgccatatgagggcaattactacaaatgttcagattatggccgcgccttcatccagaaaagcgacctgttccgatgccagaggatacatagtggggagaagccttatgaatatagtgagtgcgagaagaacctgccccagaatagcaatttaaacattcacaaaaaaattcacactgggggcaaacatttcgagtgcactgagtgtgggaaggcctttacgagaaaaagtacgctttcaatgcaccagaagattcatactggggagaagccttatgtatgtaccgaatgtgggaaggctttcattcggaagagccattttattacacatgaacgtatccatacgggagaaaagccctatgaatgttccgattgtggcaagagtttcatcaagaaatctcaattgcacgtccaccaacgtattcacaccggcgaaaatcccttcatttgctctgaatgtgggaaagtgttcacgcataagaccaatcttatcatccaccagaaaatccacacaggggaaaggccgtatatttgtacagtgtgtggcaaggccttcaccgatcggtcgaatttgatcaaacaccaaaagatccacacaggtgaaaaaccatacaagtgcagcgattgcggcaaaagctttacatggaagagccggctgcgcatccaccagaagtgtcatacaggagagcgccattacgagtgttccgaatgtggaaaggcctttattcagaaaagtactctgtctatgcaccagcgtatacacagaggggagaagccatacgtgtgcacggagtgtggtaaagcatttttccacaaaagtcactttatcacccatgagcggatccacacaggtgagaaaccttacgagtgttcgatctgcggaaaaagctttactaaaaagtcacagctgcatgtacaccagcagatacatacaggtgagaaaccatatcggtgcgccgagtgcggcaaggctttcacagatcgtagcaacctgttcactcatcaaaaaattcatacaggggagaagccttacaagtgctcagactgtggcaaagcctttactagaaagagcgggcttcatatccatcagcaatcccataccggcgagcgtcattacgagtgcagtgaatgtggaaaggcttttgctcgcaagagcacccttatcatgcaccagaggatacatactggcgaaaaaccttacatttgtaatgaatgtggaaaaagcttcatccagaagtcacacctgaatagacatagacggatacacacaggcgaaaagccttacgagtgttctgactgtggcaaatcctttattaagaagtcgcaactccacgagcatcatcgtatccatactggcgaaaagccgtacatttgtgccgagtgtggtaaggccttcaccataaggtcaaaccttattaaacaccagaaaattcataccaagcagaagccatacaagtgctctgatctcggcaaggcgttgaattggaagccccagctctccatgccccaaaaatctgacaacggagaagtcgagtgtagcatgcctcagctgtggtgtggagattccgaaggtgatcagggccagctgagttcaatttag

SEQ ID NO: 21659 - DNA, 2565 bp, Artificial Sequence
  Description of Artificial Sequence: Synthetic coding sequence
atgagcgtgctgagcctgcccgagagcgtgagcttcaaggacgtgactgtagatttttctcgggatgaatggcaacagctagaccttgctcagaaatccctttaccgcgaggtcatgctggaaaattacttcaacctgatctccgtgggctgtcaggtccccaaacctgaagtcattttcagcctggaacaggaggagccctgcatgctcgacggcgaaatacccagccaaagccggcccgatggcgacattggttttggccccctccaacagcggatgtccgaagaggtgtcttttcagagtgaaattaacattaacctattcactcgagatgacccttactctatcttagaggagctctggaaggacgatgagcataccaggaaatgtggcgaaaatcaaaataaaccgctctcgcgcgtagttttcattaacaagaaaacactggccaacgacagtatcttcgagtataaagacatcggagaaatagtgcacgtgaacactcacttggtcagctcacgcaagagacctcataactgcaactcctgcggaaagaaccttgagcctattattaccttgtacaacagaaacaacgccacggagaacagcgacaagactataggcgacggggacatatttacccatctgaattcacataccgaggtcactgcttgcgaatgcaatcaatgcggaaaaccactgcatcataagcaggcactgatacagcagcaaaagatccacacaagagagagcctttatttgttctccgactacgtcaacgtgttttcaccaaagtcccacgccttcgcccacgagagcatttgcgccgaggaaaagcagcacgagtgtcacgaatgtgaagccgtgtttacccaaaagtcccaactggatggcagtcaaagggtatatgccggcatctgcacagagtatgagaaagacttctccctgaagtcaaatcggcagaagactccctacgaaggtaattactataaatgtagcgactacggtagggcattcattcagaagtcggacctgttccgctgtcagagaattcacagcggtgagaagccatacgagtatagcgagtgtgagaagaatctgccccagaactcaaatcttaatattcacaagaagatacacacaggaggcaagcatttcgagtgcacagaatgcgggaaggcatttacgaggaaaagcactttatctatgcaccagaagatacacacaggggagaagccttacgtgtgtactgagtgtggcaaggcctttataaggaaaagtcatttcatcacacatgaacgaatacacacaggagagaagccgtacgagtgtagcgactgtggtaaatcatttattaagaagtcccagctgcatgtacatcagcggattcatactggggaaaatcccttcatctgttctgagtgtggcaaagtgttcacccacaagactaacctcataattcaccagaagatacatacaggagagcgcccttatatctgcacagtttgcgggaaagccttcaccgataggtccaatcttattaagcaccagaaaatccatacaggagaaaagccctacaagtgttcagactgcgggaaatctttcacgtggaagtccaggctgaggattcatcagaagtgccatacaggagaacgacactatgagtgcagtgaatgtgggaaggctttcatccagaagagtactttgtccatgcatcagcgaatacatcgtggtgaaaaaccatatgtgtgtactgaatgcgggaaagccttcttccataagtctcacttcatcacacatgaaagaatacatacaggggaaaaaccttatgaatgtagtatttgcggaaagagcttcacaaaaaaaagccagctgcacgtgcaccagcagatccataccggggaaaaaccttataggtgtgctgaatgtggaaaagccttcaccgatcgatccaacctgttcacacatcagaagatacacactggggaaaaaccttacaaatgcagtgactgtggtaaagcatttactcgaaagtcagggcttcatattcaccaacaaagccacaccggcgagcggcactatgagtgctccgaatgtgggaaggcatttgctcgaaagagcaccctgatcatgcatcagcgcattcacacaggagagaagccctacatctgtaatgagtgcggcaaatcatttatccaaaagtcacacctcaacaggcaccgcagaattcacacaggcgaaaagccctatgaatgttcagattgtgggaagtcattcataaaaaaatcacagctgcatgagcaccaccggatccacactggcgagaaaccgtatatctgcgcggagtgcgggaaggcattcacaatcagaagcaatcttatcaagcaccagaaaatacatacaaaacagaaaccttataaatgtagcgatcttggaaaagcgttgaattggaagccgcagctgtcaatgccacagaagagcgataacggggaagtggagtgttcgatgccacaattatggtgtggtgactcagagggagaccagggacaactgagctcaatatag

SEQ ID NO: 21660 - DNA, 1326 bp, Artificial Sequence
  Description of Artificial Sequence: Synthetic coding sequence
atggccccccgggcccagatccagggccccctgaccttcggcgacgtcgccgtcgcttttactcgcatcgagtggcgccatctggatgctgcacagagggccctgtatagagacgtgatgctcgagaattacggcaacctggtgtccgtcggcttgctaagttcaaaacccaaactcataacacagctggagcagggcgcggaaccttggacggaggtgcgggaagcaccgagcggcacgcatgccgttgaagattactggttcgagactaaaatgagtgctctgaagcagtccacctccgaggcatccgtgctcggggagaggacaaagagcgtgatgatggagaaagggttagactgggagggccgcagcagcaccgagaagaactataaatgtaaggagtgtgggaaggtgttcaagtacaattcaagttttatctctcaccagcgaaatcatacttcagagaagccccacaaatgcaaagagtgtgggatcgccttcatgaattcatcaagccttttgaatcaccacaaagtgcatgccggtaagcaaccgtatcgatgtatcgagtgcggaaagtttttgaagaaacatagcacattcatcaatcaccagcggattcatagtcgggagaagccacataaatgtatagagtgcggaaagacgttcaggaaaaattcaattctgctgagccatcagagaatacatacgggtcaaaagccctataagtgcaacgattgcgggaaggcctttgctcagaatgccgccctcaccagacatgagcgcatccacagtggggaaaagccgttcaagtgtaacaagtgtggtcgagccttccgcgacaactcaacagttttagagcaccaaaagatacacacgggtgagaaaccataccagtgcaacgaatgtggcaaggcatttcgcaaaagcagcaccctgatctcccaccagcgtatgcatactggggagaaaccctaccattgcagcaaatgcggcaaatcatttcgatacagctcatcattcgcgggccatcaaaagactcattccggcaataagccttatcagtgccgagattgtgggaaggcctttactaaatcatcaaccctcacgggccatcagcggatccatacaggcgagaaaccttaccactgcaagaagtgtgggaaggcttttagacatagctcaggtcttgtagaacaccagcgactgcatacaggagaaaaaccttataaatgtaacgaatgtgggaaagcatttcctcggtcatctgctcttaagcagcataagaagatacacaataaggagcgcgccatgaagtgctcgtag

SEQ ID NO: 21661 - DNA, 1326 bp, Artificial Sequence
  Description of Artificial Sequence: Synthetic coding sequence
atggccccccgggcccagatccagggccccctgaccttcggcgacgtggcggtcgcgttcactaggattgagtggaggcaccttgacgcagctcagagggcactgtatcgcgatgttatgctggaaaactatggaaatttggtgagcgtggggctgttatcctccaagccgaagctgatcacccagcttgaacagggcgccgagccctggaccgaggtgcgggaagctcctagcggtacccacgccgtggaagattattggtttgagacaaaaatgagtgccctgaagcagagtacatccgaagcttctgtccttggcgagcgcaccaagtcggttatgatggaaaaaggactggactgggaggggcggtcaagcaccgagaagaactacaagtgcaaagagtgcgggaaggtgttcaagtacaactcatcttttatctctcaccagcgcaaccacacaagcgagaaaccgcataagtgcaaagagtgtggaatcgcattcatgaattcttcttcactgctgaatcatcataaagttcacgctgggaagcagccctatcgctgcattgagtgcggcaaattcctcaaaaaacacagcacgtttatcaatcaccagagaattcacagtagggagaagccccataagtgtatagagtgtggaaaaacatttagaaaaaacagtatcctgctttctcatcaacgaatccataccggtcagaagccatataagtgcaacgactgcggtaaagctttcgcgcagaacgccgcccttaccagacatgaaagaatccactccggcgaaaaaccattcaagtgtaacaaatgcggtcgggcctttcgcgacaacagcactgtgctggagcatcagaaaatccatactggggagaaaccgtaccagtgtaatgaatgcgggaaagcttttcgaaagtcttccacactaattagccaccaaaggatgcacactggagaaaaaccataccattgcagcaaatgcggaaagagtttcaggtattcatcaagctttgcaggtcatcagaagacccactccggcaataaaccatatcagtgccgcgactgtgggaaagccttcacaaagtcttctaccttaactggtcatcaacgcatccacacaggagagaaaccttaccattgcaagaaatgtgggaaggccttcagacactcgtcaggcctggtcgagcatcaaagactgcatactggagaaaagccctataaatgcaatgagtgcggtaaggcttttccccggtcgagcgccctgaagcagcataagaaaatccacaacaaggagcgtgccatgaaatgctcatag

SEQ ID NO: 21662 - DNA, 1053 bp, Artificial Sequence
  Description of Artificial Sequence: Synthetic coding sequence
atgagcgccctgaagcagagcaccagcgaggccagcgtgctgggcgaacgaaccaaaagcgtgatgatggaaaaaggtctcgactgggagggacggtcctcgaccgagaaaaattacaaatgcaaagagtgtggcaaggtcttcaagtacaactcttcgttcatcagtcaccagcgtaaccacacctcagaaaagcctcataaatgcaaggagtgcggaatcgcctttatgaactcctcttctctgttaaaccatcataaggtgcacgctggaaaacagccttatagatgtattgaatgcggcaagttcctgaaaaaacattctacattcataaatcaccagcggattcactcccgcgaaaaaccacacaagtgcatcgagtgcggaaagacattccgtaaaaattccatccttctgtcacatcaacgcatccataccggccaaaagccatacaagtgtaacgactgcggcaaggcttttgcccagaatgccgcactgacccgtcacgaacgcattcactccggtgagaaaccgttcaagtgtaacaagtgtggccgagcttttcgtgacaactccactgtcctcgaacaccagaagattcacactggcgagaagccttaccagtgcaacgagtgtgggaaagcatttagaaagagctccacactcattagccaccagcgcatgcacacaggtgagaagccttaccactgttcaaagtgtggaaaaagctttaggtactcgtccagctttgctggccatcagaagacccattccggcaacaagccatatcagtgtcgggattgcggaaaagcattcaccaaaagctccaccttgacaggacaccagcgcattcacactggtgagaaaccataccactgtaagaagtgcgggaaggcctttagacactcctccggactggtagaacatcagcgcttacacacaggggaaaagccatacaagtgcaatgagtgcggcaaggccttccccagaagctcagctcttaagcagcataagaaaatccacaataaagagagggctatgaaatgctcgtag

SEQ ID NO: 21663 - DNA, 354 bp, Artificial Sequence
  Description of Artificial Sequence: Synthetic coding sequence
atggccccccgggcccagatccagggccccctgaccttcggcgacgtggcagtggccttcacacgcattgaatggagacacctggacgctgcgcagcgagctctttacagggacgtgatgctggaaaactatggaaacctcgtctctgtgggtctgctgtcttcgaaacctaagttaattactcaacttgaacagggggccgaaccatggaccgaagtgcgcgaggccccttcaggcacccatgccgtcgaggattattggtttgagacaaaaatgagcgctctgaagcaatccacctctgaggccagcgtcctcggcgagcgcactaagtcagtaatgatggaaaagggttag

SEQ ID NO: 21664 - DNA, 1392 bp, Artificial Sequence
  Description of Artificial Sequence: Synthetic coding sequence
atgcccggccccctgcggagcctggagatggagagcctgcagttccgggatgtggccgtggaattctccctcgaagaatggcactgtctggatacagcacagcagaacctatatagggatgtgatgttggaaaattataggcacctagtgtttctgggaattatcgtatcgaaaccggacctcatcacctgcctcgaacagggcataaagcccctcaccatgaaacgtcacgagatgatcgcaaagccacctgtcgtctgttcacacttcgcccaagatctttggcctgagcagtcaatcaaagactcttaccagaaggtgatccttcggaaattcgagaagtgtgggcacggaaatcttcacttcaagaagggatgcgagtcagtggatgaatgtaaattgcacaaacgagggtataatggcctgaatcagtgcctgacaacaactcagtccaagatctttcagtgcgggaagtacgtcaaagtgtttcatcagttttcgaacagtaagagacacaaaaggcggcataccgagaagaaaccgttaaaatacatcgagggtgacaaggcgttcaatcagtcctccacgcacacaacccacaagaaaatcgacacaggagagaagccctataaatgcgaagaatgcgggaaggcattcaaccgttcatctcatcttaccacacacaagattacccacacacgggagaagccatacaaatgcgaggagtgtggaaaggttttcaaatactttagttcattcacaacccataagaagatccactccggcgagaaaccctacatctgtgaagagtgtggaaaggcctttatgtatccttataccctgactacccataagattattcacactggcgagcaaccatacaaatgcaaggagtgcgacaaagccttcaaccatccagccacgctctcaagtcacaagaaaatacatactggagagaaaccctatacttgcgacaaatgtggaaaagctttcatctcttcctctatcctgagcaagcacgagaaaatccacaccggggaaaaaccctacaagtgcgaggagtgtggaaaggccttcaccaggtcctcacacctgacgatgcataagatcatacatacaggcgaaaaaccttacaaatgtgaagagtgcggcaaagcttttacatggagcgccggattacacaaacaccgtcgtacacataccggggaaaagccctacaaatgtgaagaatgcggcaaggcctatactacctcctctaaccttacagagcacaaaaccacgcacaccggggagaaaccatataaatgcaaagaatgcggtaaggccttcaactggtccagcgatctgaataagcataagagaatccatatagggcaaaagcctaggacatag

SEQ ID NO: 21665 - DNA, 1509 bp, Artificial Sequence
  Description of Artificial Sequence: Synthetic coding sequence
gtgagccggtgcatctggagcagccggagccccctgcggtacagcgtgtcatccgctcccagaggacctcccagtgtagcactgtgcccagttggaattggtagatccacggcaaaaatgcctggccctctgaggagcctggaaatggaatccctgcagttccgggacgtagcagttgaatttagcctggaggaatggcactgcctcgacactgctcagcagaatctgtatcgggacgtcatgcttgagaattacagacacttggtttttctgggcatcatcgtgtccaaaccggatttgattacgtgcctcgagcaggggatcaagccgttgaccatgaagaggcatgaaatgattgctaagcctcccgtcgtctgttcccacttcgcccaagatctgtggcccgagcagtccattaaggactcttatcaaaaggtgatcctgaggaagtttgagaaatgcggccatggaaacctgcactttaagaagggctgtgagtcagttgacgagtgcaaactgcataaacgaggttataacggactaaaccagtgcctaacgaccacccagtcaaagatctttcagtgtggcaaatacgtgaaagtgttccatcaattctccaactcaaagcggcataagaggaggcacactgagaagaagcctttgaagtacattgagggggacaaagcatttaaccaatcctccacgcatacaactcacaagaaaatcgatacaggagaaaagccatataaatgcgaagagtgtggaaaggcatttaacaggagctctcacctgactacccacaagatcacccacacgcgcgagaaaccctacaagtgtgaggagtgtggcaaagtgttcaagtacttctcttccttcacgacccacaagaagattcattctggcgaaaagccatacatttgcgaagagtgcgggaaggcttttatgtatccttataccctgaccacgcacaagataattcacactggagaacaaccctataaatgtaaagaatgtgataaggccttcaaccaccccgcaactctttcctcccacaagaagatccatacgggtgaaaagccctacacatgcgacaagtgcggtaaagcattcatctcatcttccatactgtctaaacacgagaaaattcataccggtgaaaagccctacaaatgcgaggagtgtgggaaagctttcacacggagctctcatctgactatgcacaaaataattcatactggagagaagccttacaaatgcgaggagtgcggcaaggctttcacctggagtgctggactgcacaagcaccgccggactcacacaggggagaagccatataagtgcgaagagtgcggtaaggcctacaccactagctcaaacctaaccgagcacaagaccacccacacaggggagaagccttataaatgtaaggagtgtgggaaggccttcaactggagtagtgatctaaataagcacaaacgcatccacatcggccagaaaccgagaacgtag

SEQ ID NO: 21666 - DNA, 573 bp, Artificial Sequence
  Description of Artificial Sequence: Synthetic coding sequence
tgacggccccggccccggacccccagccggggccccagcgacctgaggttccgaggtgaggccgggctcaggcgggtctttttaaagaaggcgggcggctccgtgagcttttctgacgtagccgtgggcttcacgcaggaagaatggcagcacctggactccgcccaaaggaccccttatcgcgatatgatgctggaaaactattctcttttgctgagcgtggggtactgcattacaaagcctgaggtggtgtgcaaactggagcacggccaggtgctttggatcttggaagaggagtcgccatcccagtcccacctggactgctgcatcgatgacgatttgatggaaaaaaggcaggaaaatcaggatcagcacttgcagaaagtagattttgtgaataacaagaccttgacaatggatagaaacggggtgcttgggaagacattctctctcgataccaatcccatcctctctagaaagattcggggaaactgtgactcaagcggcatgaatctgaataacatttccgagttaattatctctaacagatcctccttcgttcgcaatccctag

SEQ ID NO: 21667 - DNA, 1347 bp, Artificial Sequence
  Description of Artificial Sequence: Synthetic coding sequence
atggccagccggccccggccccggacccccagccggggccccagcgacctgaggttcagaggggaggccggcctcagaagggttttcttgaagaaggccggcggaagtgtctctttcagcgatgttgccgtggggttcacccaggaggaatggcagcatcttgatagtgcgcagcgaaccccatatcgtgatatgatgctagagaactacagtcttcttctaagcgttggatattgcatcactaagccagaagtggtgtgtaaactggaacacggccaagtgctatggatcctagaagaggagagtccttcacagtcacatctggattgttgtatagatgatgatctgatggagaaacggcaggagaatcaggaccagcacctgcaaaaggtagattttgtcaataataaaaccttgaccatggaccggaacggcgtccttggtaagactttcagcctggatacaaaccctattctttcccggaaaatcagggggaactgtgattctagtggaatgaatttgaacaacatatcagagctgatcatttctaacagatcttcgttcgtccggaatccagcggagtgtaacgtcagggggaaatttttgttgtgcatgaaacgcgaaaatccttacgcccggggtaagcccttggaatatgatggaaacggaaaagctgtttctcaaaacgaggatttgttccgccaccagtacattcagacactgaaacagtgctttgagtataatcaccgaggatatacagaggagaggaacccaatgaacgctctcaacgtgggcaagctcctggacatcggtcatgcgctgcaatatatcaaagagcacactagggataaaacctatgagtgcaacgagtgcggcaagaacttctgcgaaaaaagcaatttgcatgtgcaccagaggacccatacaggagagaaaccctacggatgtaatgagtgccagaaggcctttggagacaggagcgcactgaaagtgcaccagcgcattcacactggggagaaaccatacgaactgcatcagcggacacatactggcgagaagccatatgcttgctccgagtgtggaaagacattctatcaaaagtccagtctcacaacacaccagcgcacacacacccgcgagcaaccatacgagtataacgagtctttctatcagaacccgaactttaccaaatgtcagcgcgacaatatcgaggagacgctcgtgaacattttgaaggcccagaagcctagcccgtcatggaccagaagcattgcggagaccacacaggtgggcggctcagtctcactgaaagatgtgaccgtagactttacgcaagaggagtggtag

SEQ ID NO: 21668 - DNA, 627 bp, Artificial Sequence
  Description of Artificial Sequence: Synthetic coding sequence
atgatgctggagaactacagcctgctgctgagcgtgggctactgcatcacaaagcctgaggtcgtttgtaagctggagcatggccaggtgctgtggatcttagaggaggagtctccgtctcagagccaccttgactgctgcattgatgatgacctcatggagaagcggcaggagaatcaagatcaacaccttcagaaggtggattttgttaataataagaccctcacgatggacagaaacggtgtgctgggcaaaaccttcagtctggataccaacccaatacttagtcgaaaaattcgagggaactgcgacagcagcgggatgaatctgaacaacatctctgagttaatcatatcaaaccgctcttcctttgtgcggaaccctgctgagtgtaatgtgcggggtaagtttttgctgtgcatgaaacgtgaaaatccatacgcaagagggaagcccctcgagtacgacgggaacggtaaagcagttagccagaatgaagatctgtttagacatcagtacatccagaccctgaagcagtgctttgagtacaatcagtgtggaaaagcttttcacgaggaggcagcctgtagtacccacaagagggtttgctcgtgggaaacactctag

SEQ ID NO: 21669 - DNA, 420 bp, Artificial Sequence
  Description of Artificial Sequence: Synthetic coding sequence
atgatgctggagaactacagcctgctgctgagcgtgggctactgcattactaagccagaggtggtgtgtaagctggaacacggacaggtcttgtggatcctcgaggaagagagtccatcccaatctcaccttgactgctgtatagacgatgatttgatggagaagagacaggagaaccaggaccaacaccttcagaaagtcgactttgtgaataataaaacactcaccatggaccgcaatggtgtcctgggcaagacgttttccctggatacgaaccctatcctgtctcgcaagattaggggaaattgtgactcttccgggatgaacctgaataatatctcagagctgattatctcaaatcgaagttcttttgtccggaacccagccgaatgtaacgtgcggggtaaatttctgctgtag

SEQ ID NO: 21670 - DNA, 360 bp, Artificial Sequence
  Description of Artificial Sequence: Synthetic coding sequence
atgatgctggagaactacagcctgctgctgagcgtgggctactgcatcacaaagcccgaagtggtctgtaaactcgagcacggacaggttctctggatactggaggaagagtcacctagccagtcacacctggattgctgcattgacgatgaccttatggaaaaaaggcaagagaaccaggaccagcacctgcaaaaggtagattttgttaataacaagaccctgaccatggaccgaaatggcgtgcttggtaagacattctcccttgacactaatcccatcctctccagaaagatcagagggaactgtgatagctccggaatgaacctgaataatataagcgagctaatcatatcctag

SEQ ID NO: 21671 - DNA, 1023 bp, Artificial Sequence
  Description of Artificial Sequence: Synthetic coding sequence
atgcccgagtggcccccctgcctgagcgtggcccccgccctggtgattacaatggcagctgggaagggcgctccattgagcccatcagctgagaaccgttggaggctgtcagagccggaactgggcagagggtgcaaacctgtactcctggaaaagaccaacaggctgggtccagaggctgctgtcggccgagcaggacgagacgtgggctctgctgaattggccctgctggtggcacctgggaaacctcgtccagggaagcctcttccccccaaaaccaggggagagcagcggcaaagtgcctttaccgaactgccaaggatgaaggatcgacaggttgatgctcaggcccaggagagagaacacgatgaccctaccggacagcctggggctccccaactgactcagaatataccgcgaggacctgccggcagcaaagtgttttcggtttggccatctggagcccggtctgagcaaagaagcgcctttagtaaacccactaagcggccagccgagcgtcctgagctgacaagtgtatttccagcaggtgagtccgctgacgctctcggcgagctgtcaggcttactgaatacaacagatctggcatgctggggtcgattgagcacacccaaacttctagttggcgacctgtggaatctccaagcgcttccgcaaaacgcaccactgtgtagtactttcttgggcgccccaacactctggctcgaacacacacaggcacaggtccctccgccatccagctcaagtaccacctcctgggccttgcttcctcctaccctaactagtttagggttaagcacccagaattggtgtgctaaatgtaacctctcctttaggctcaccagcgatcttgtcttccatatgaggagccaccacaagaaggagcacgctggacccgatccgcactcacagaagcgtcgcgaagaggccttagcgtgcccagtttgccaagaacattttagagagagacatcacctaagcagacatatgacgagccattcctag

SEQ ID NO: 21672 - DNA, 222 bp, Artificial Sequence
  Description of Artificial Sequence: Synthetic coding sequence
atgcccgagtggcccccctgcctgagcgtggcccccgccctggtgattactatggctgcaggcaagggggcacccctgtctccaagtgctgagaatcgatggcgtctgtctgaaccagagctcggacgcggctgcaagcctgtcctgctcgaaaagacaaacaggctgggcccggaggccgcggtgggtagagctggacgtgatgtgggctccgcagagtag

SEQ ID NO: 21673 - DNA, 360 bp, Artificial Sequence
  Description of Artificial Sequence: Synthetic coding sequence
atgcccgagtggcccccctgcctgagcgtggcccccgccctggtgatcacgatggcagccggaaaaggagcccccctgtcgccatctgctgaaaatcgttggcgactctcagagcccgaactgggcaggggctgtaagcccgtgctcctggaaaagaccaaccggcttggcccggaagccgctgtgggcagggcaggccgcgacgtagggagtgctgaattagctcttttagtggcacccggtaaaccccgccccgggaagcctctgccacctaagacacgcggagagcaacggcagagcgccttcaccgagcttccacgcatgaaggaccgacaggtcgacgcccaggcgcaagagtag

SEQ ID NO: 21674 - DNA, 318 bp, Artificial Sequence
  Description of Artificial Sequence: Synthetic coding sequence
atgcccgagtggcccccctgcctgagcgtggcccccgccctggtgatcaccatggctgccggcaaaggggccccgttgagtccgtccgcagaaaataggtggagactgtctgagcccgagctaggcagagggtgcaagccggtcctcttggagaagacaaaccgcctgggaccagaggcagccgtcggtcgggccggccgcgatgtaggctcagccgagctcgcacttctggtcgcgccaggcaagccacggccaggcaaaccgctgccgcccaaaactcggggcgagcaaaggcagtccgcatttacagagctatag

SEQ ID NO: 21675 - DNA, 261 bp, Artificial Sequence
  Description of Artificial Sequence: Synthetic coding sequence
atgcccgagtggcccccctgcctgagcgtggcccccgccctggtgatcacaatggctgccggtaagggggcgcccttgagcccatccgccgagaaccgctggaggctgtcagaaccagagttgggaagaggctgcaagccagtgcttcttgagaaaacaaacagactggggcccgaggcagccgtgggccgagcaggtagggatgtggggtccgccgaattagccctcctagtcgcaccgggtaaaccccgacccggatag

SEQ ID NO: 21676 - DNA, 210 bp, Artificial Sequence
  Description of Artificial Sequence: Synthetic coding sequence
atgcccgagtggcccccctgcctgagcgtggcccccgccctggtgatcacaatggccgctggcaaaggggctccccttagcccaagtgccgagaatcgatggcgactgagcgaacctgaactgggtagggggtgcaagcccgtgttgttggaaaaaacaaaccgcttaggcccagaggctgcagtgggccgagctggcagagatgtttag

SEQ ID NO: 21677 - DNA, 393 bp, Artificial Sequence
  Description of Artificial Sequence: Synthetic coding sequence
atgcccgagtggcccccctgcctgagcgtggcccccgccctggtgatcaccatggccgcaggcaaaggagcgccactcagtccctctgccgagaatagatggagattgtctgagccagagctcggcaggggctgcaagcctgtcctcctcgagaaaaccaacaggctcggacctgaagccgccgtcggtagggcaggcagggatgtgggctcggcagagctggctctccttgtggctcccggaaagccacggcccggcaagcctttaccccctaagacccgcggggaacagcggcagtctgctttcaccgagttgccaaggatgaaagatagacaggttgatgctcaagctcaggaacgtgaacacgatgaccctactgggcagcccggttag

SEQ ID NO: 21678 - DNA, 1590 bp, Artificial Sequence
  Description of Artificial Sequence: Synthetic coding sequence
atgcggcggaacagcagcctgagcttccagatggagcggcccctggaagaacaggtgcagagtaaatggtcttcttctcagggccgcacggggactggtggatccgatgtgctgcagatgcagaacagcgaacatcacgggcaatctattaaaacgcaaaccgactccatttctctagaggacgtggccgtgaacttcacactggaagagtgggcgctactggaccccggccagcggaatatctatcgtgacgtcatgcgtgctacgtttaagaacctagcctgtattggggagaaatggaaggatcaagacatagaagacgagcataagaatcaaggacgaaatctgcgctcccccatggttgaagcgttgtgtgagaacaaagaggattgcccctgtggaaaaagcaccagccagatccctgacctgaatactaacctcgagacacctaccggcctaaaaccatgcgactgctccgtttgtggcgaggtatttatgcatcaagttagccttaacagacacatgaggtcccatactgagcagaaacccaacgagtgtcacgaatatggggaaaaaccgcacaaatgcaaggaatgcggcaagacattcactcgcagcagttcaataagaactcatgagaggatccatacaggcgaaaagccttacgaatgcaaggaatgtggtaaggctttcgcatttttgttttcttttcgcaaccatatccgaatccatactggcgaaacgccgtatgagtgcaaagaatgcggcaaagcattcaggtatctgacagctttgcgccgtcacgagaaaaaccatacgggagaaaagccgtacaagtgtaagcagtgtggcaaagccttcatatactaccagccttttttgacccacgagagaacacatacgggtgaaaagccatacgaatgtaaacagtgtggcaaggccttctcttgtccaacctaccttcgatctcatgagaaaactcatacaggtgaaaagccctttgtctgccgggaatgtgggcgtgctttcttctctcacagctcccttaggaaacatgtgaagacgcacactggagttcagccttacacatgcaagaagtgcggagaagcattcaaatccagctcctcttgcgaagtacacgagcgaacgcattttggcgaaaaaccgtacgaatgcaagcaatgcgggaaagctttcaattcctcctcttatctgcagcttcatgagcgtgtacacaccggagagaagacttacgagtgtaaagagtgcggtaaggctttcctctatagcactcactttcgaatccacgaacgcactcatacacgcgagaaaccttacgagtgcaagcagtgtggccgggtgttcatatacttttcacacctgcgacggcacgagaggtctcacactggagtgaagccctgtgaatgcaaacaatgtggcaaggcatttacttgcctgaactcactaaaagtccataaacgcatccatacgggagaaagaccttttcagtgcagacaatgtggaaaagccttctcatacagcaaatcactacatgtgcacgaaagaacacactcgagacagaagccgtag

SEQ ID NO: 21679 - DNA, 1314 bp, Artificial Sequence
  Description of Artificial Sequence: Synthetic coding sequence
atgggcgagcggctgttcgagagcgccgagggcagccagtgcggcgaaacgtttacacaagtgcccgaagatatgcttaataagaagacccttcctggcgtcaagtcctgcgaatctggtacctgtggagagatcttcatgggctactctagttttaaccggaacattcgcaccgacacaggacatcaaccccacaagtgccagaagtttctggagaaaccttataagcacaagcagcggcgcaaagctctgtcccacagccattgctttaggactcacgaacgtccacataccagggaaaaacctttcgattgcaaggagtgtgagaaaagtttcatttcgccagcctcaatacgaagatacatggtgactcacagtggggatggcccatacaagtgtaagttttgtggaaaggcacttgactgcctaagtctttacctgactcacgagagaacccacactggcgaaaaaagatatgagtgcaagcagtgtgggaaagctttcagctggcattcatccgtgcgcattcatgagcgcacacacactggcgagaagccttacgaatgtaaagaatgtgggaaatctttcaacttctcttcatctttccgccggcacgagagaacgcacacgggtgagaagccttacaagtgcaaagaatgcggtaaagcttttaattgcccttcctccttccaccggcatgagcggacacacactggagagaagccttacgagtgcaaactgtacggtaaggcgctttcccggttgatcagtttccgacggcacatgcggatgcacactggggaacggccacacaagtgtaagatttgcgggaaagcattctactcaccaagcagctttcaacgacacgagagatctcacactggagaaaagccatacaagtgcaagcagtgcggcaaggcatttacctgctctacttctttccagtaccatgagcgcacgcataccggggagaaaccagatggatgcaagcagtgtggcaaagccttccgtagtgcgaagtatattcgtattcacgggagaactcataccggcgaaaaaccatacgagtgcaagcagtgtggtaaggcgtttcattgcgtgtctagcttccacagacatgagagaacccacgctggggagaaaccgtacgaatgtaagcactgtggcaaggcatttacctgttctatttatattaggatccacgaaaggatacacaccggagagaaaccataccagtgcaaagaatgcggcaaagcattcataagatcctcatactgtaggaagcacgagagaacacacaccattaatatatag

SEQ ID NO: 21680 - DNA, 420 bp, Artificial Sequence
  Description of Artificial Sequence: Synthetic coding sequence
atgggcgagcggctgttcgagagcgccgagggcagccagtgcggcgaaaccttcacacaggttccagaggacatgctgaataagaagaccctccctggggtgaagagttgcgaaagtggaacctgcggtgagatcttcatgggatactcctccttcaataggaatattcggaccgacaccggccatcagccccacaaatgtcagaaattcctcgagaaaccttacaaacataaacagagaaggaaagcactcagtcactcacactgttttcgcacccatgagcgacctcacacgagggagaaaccctttgattgcaaggagtgcgaaaaaagctttatttctccggcctcaatccggaggtatatggtgacacatagcggcgatggcccatataaatgtaagttctgtggcaaggcttag

SEQ ID NO: 21681 - DNA, 1230 bp, Artificial Sequence
  Description of Artificial Sequence: Synthetic coding sequence
atgggcgagcggctgttcgagagcgccgagggcagccagtgcggcgagacttttacccaggtcccagaggacatgctgaacaaaaaaaccctgcccggagtgaaaagctgcgaatcaggtacttgcggcgaaattttcatgggctactcctcatttaatcgcaatatacgcaccgatactggccaccaacctcacaagtgtcagaaatttttggaaaagccatataagcacaaacagcgacggaaggccttgagccacagtcactgcttccggacacacgaacgaccgcataccagggagaagccattcgactgtaaggaatgcgaaaagtcctttatctcacctgcctccatcagacgttatatggtcacacactccggcgacgggccatacaagtgtaagttctgtggaaaggctctggattgtctgtcactgtacctgacacatgagcggacccacacaggagagaaacggtacgaatgtaaacaatgtggaaaggccttttcatggcatagcagcgtgcgcatccatgaaagaacacacacaggcgaaaagccatacgagtgcaaggaatgcggtaagagcttcaatttttctagcagttttcggcggcacgagcgcacccataccggcgagaagccatatgagtgcaagctgtatggtaaggcactgtctaggctgatctctttccggagacacatgagaatgcacaccggggaaaggccgcacaaatgcaagatttgtggaaaggccttctacagcccatcttcattccagcgccacgagagatcccacaccggcgagaaaccctataagtgcaagcaatgcgggaaggcctttacatgcagcacctcattccagtaccacgagcggacacataccggcgaaaagcctgacggatgtaagcagtgcggaaaggcattcagatcagctaaatacatccgcatccacggacgcacccacaccggagagaaaccatatgagtgcaagcagtgcggaaaggcattccattgcgtgtcatcgttccaccgccatgaaaggacccatgcgggggaaaaaccctacgaatgtaaacactgcggcaaggcctttacatgctcaatttatattcggattcacgaaagaatacatactggtgaaaagccatatcagtgcaaggagtgcgggaaagcattcatccggtcctcttactgcagaaagcatgaacgaactcacactataaacatatag

SEQ ID NO: 21682 - DNA, 1596 bp, Artificial Sequence
  Description of Artificial Sequence: Synthetic coding sequence
atgctggagaactaccggaacctggtgttcgtgggcatcgccgccagtaaacctgatttaattacgtgcctggagcagggaaaagagccatggaacgtgaagagacatgagatggtggctgaacctcccgtcgtgtgctcttacttcgctagagatctgtggcctaagcaagggaagaaaaactatttccagaaggtgatcctcagaaggtataaaaaatgtggatgtgagaacctacagctgaggaaatactgcaaatcaatggacgagtgcaaggttcacaaggagtgctataatggtctgaaccagtgcctgacaaccacccagaataagatctttcagtgcgacaagtacgtgaaggtgtttcataagttctctaattctaatcgtcatacaatcaggcacactggcaagaaaagttttaagtgcaaagagtgcgagaaatcgttctgcatgctgagccatttggcacagcacaaaaggattcattcaggagaaaagccatataaatgcaaggaatgtgggaaagcatataatgaaacctcgaaccttagtacccacaaaaggattcacactggcaagaaaccctacaagtgcgaagagtgtggaaaggccttcaatcgtctctctcacctaacaacgcacaaaatcattcacactggcaaaaaaccctacaaatgcgaggagtgcgggaaagccttcaaccagagcgctaacctcactactcacaagaggattcacaccggggaaaagccgtacaaatgcgaagaatgtggccgcgcattctcccaatcaagtacactaaccgcccataagatcatccacgcaggtgaaaaaccctataaatgtgaggaatgcgggaaagcattcagccaatcttccacccttacaactcataagatcattcatactggagagaagttttacaagtgcgaagagtgcggtaaggccttcagccaactgtctcatctgaccacccataaacgtatacactccggggagaaaccatacaagtgcgaggagtgtggcaaggcctttaagcagagtagcaccctgaccacccacaaacggattcatgctggcgaaaagttctacaaatgcgaggtgtgttccaaagcattttcccgctttagtcacctgactacccataagcggatacacacgggggagaagccctacaagtgcgaggaatgtggcaaggcctttaacctgtcatcccagctgaccacacataaaattatacatacaggagaaaagccttataagtgcgaagaatgcggaaaggccttcaaccaatcatctaccttgagtaagcataaggtgattcataccggcgaaaagccctacaagtacgaagagtgcggtaaagccttcaaccagagctcccatctgactacacataaaatgattcataccggggagaagccttacaaatgtgaagagtgtggaaaagcattcaataattctagcattctaaatcgtcacaagatgatccacactggcgaaaaactgtacaagcccgaaagctgcaacaatgcttgcgacaacattgctaaaataagtaagtacaaacggaattgcgccggcgaaaaatag

SEQ ID NO: 21683 - DNA, 1941 bp, Artificial Sequence
  Description of Artificial Sequence: Synthetic coding sequence
atgaacgagtgcaacgtgcacaaggagggctacaacgagctgaaccagtacttgacgactacccaatctaagatttttcaatgtgacaagtacgtgaaggtctttcataagcttcttaattcaaataggcacaacactaagcatacaggcaaaaaaccatttaagtgtaaaaagtgtggtaagtctttctgcatgcttctccacctatgtcaacacaagagaatccacattcgtgagaattcctacagatgcgaggaatgtgggaaggcatttatctggttctccaccttgaccagacatcgtcgagtgcacactggtgagaagtcatacaagtatgaatgcggcaaaagctttaatcaagactctaacttaactacccataagcggattcacacagggcagaagccctacaaatgtgaagagtgtggtacatcattttatcagttttcataccttacccggcacaaacttattcacactagagagaagccatacaaatgcgagcagtacggaaaaacattcaatcagagcagcactttgacaggtcacaagattatacataatggtgagaaaccctataagtgtgaggaatgtggaaaagccttctccatcttttctacccccaccaaacacaagattatacatactgaggaaaagagtcaccgttgtgaagaatattgcaaggcatataaggagagcagccacctcaccacccacaaaaggatccacacaggagaaaaaccctacaaatgcgaagaatgcgggaaggcattttccatcttttcaaccctcacaaaacataaaataattcatacggaggagaaaagccacaggtgcgaggaatgcggaaaagcttataaggaatcctctcacctgaccacccacaaacgcatccataccggtgagaagccttacaagtgcgaggagtgcggtaaaacctttagcgtgttctcgatattgactaaacataaaattatccataccgaagaaaagccttataaatgcgaagagtgcggcaaagcatttaagcggtcatctacactgactaagcacagaattattcacacagaagaaaagccttacaagtgtgaggaatgtggaaaggcctttaatcagtcttcaacactgagcatccacaaaatcatccacaccggggaaaaaccttacaagtgtgaagagtgtggaaaggcgtttaagcgcagttctacattgacgatccacaagatgatccatacaggtgagaagccttacaagtgtgaagagtgcggcaaagcttttaatcgaagcagtcacttaacgacccacaagcgaatccacactgggcataaaccttataaatgtaaggagtgtggaaagtccttttccgtgttctctactctgactaagcacaagatcattcacactgataagaagccctacaagtgcgaagagtgtggcaaggccttcaacaggtcttcaattttgagcattcataagaagattcataccggcgagaagccatataagtgcgaggaatgcgggaaagctttcaaaagatcatctcatctcgccggtcacaaacagatccattcagtgcagaaaccgtataagtgcgaggaatgtggaaaggctttcagtatcttcagcacccttactaagcacaagatcatccataccgaagaaaaaccatacaagtgcgagaagtgcggaaagactttctacagattctctaatctcaatacccataagatcatacatactggcgaaaaaccttgcaaatgcgaggagtgcggcaaagctttcaaccattccagcaatctgatcaaacacaaactgatccataccggcgataaaccatataagtgtgaggcatgcgggaaggctttcaggcggtcctctcatctctcccgccacaagatcatacatatagggattcacaccgaggagacagtgcaaaaatag

SEQ ID NO: 21684 - DNA, 2325 bp, Artificial Sequence
  Description of Artificial Sequence: Synthetic coding sequence
atgcccggcccccccgagagcctggacatgggccccctgaccttcagagacgttgcgatcgaatttagtcttgaagagtggcagtgcctggacaccgcacagcaggacctgtacagaaaggttatgctcgaaaattatcgtaacttagtattccttggtatcgccgtgtcgaagcctgatctggtcacctgtctggagcaggggaaagacccttggaatatgaagggacattcaaccgtggttaagcctcccgttatctgcagccacttcgctgaagacttttgtcccggtcccggcatcaaggactcttttcaaaaggtgattttacgcgagtacgtcaaatgtggccataaggatctccagctccgaaaaggttgtaaaagcatgaacgaatgtaacgttcataaggaaggttataacgaactgaatcagtacttgactacaactcagtccaagatcttccaatgtgacaagtatgttaaagtatttcataagctgctcaattctaaccgccacaatacaaagcacaccggcaaaaagccctttaagtgcaagaaatgtggtaaaagcttttgcatgctgttgcacctctgtcagcacaaacgcattcacataagggagaacagctaccgctgtgaagaatgcggtaaagcattcatctggttctccacactcactcggcataggagggtgcacactggagaaaagagttacaaatatgagtgcggtaagagcttcaatcaggactcaaatttgacgactcacaagcgcatccatacaggtcagaaaccctataagtgtgaagaatgcggcacatccttttaccagttttcatatctcactcgtcacaaattaatccacacccgggagaagccctacaaatgtgagcaatatggcaagacatttaaccaaagctccactcttaccggccacaaaataatccataatggagagaaaccctataaatgcgaggagtgtgggaaagccttctctattttctcaactccaacaaagcacaagatcatccacaccgaagaaaagtcgcacagatgtgaagaatattgtaaagcatacaaggagtcctcccacctgaccacccacaagcgcatacacactggcgaaaaaccttacaaatgtgaggaatgcggcaaggccttttccatcttctcaacattgacaaaacataagatcatccatacagaagagaaaagccaccggtgtgaggagtgcggcaaagcatacaaggaatcttcgcacctcactacgcacaagcggattcacacaggagaaaagccttataagtgtgaggaatgcggaaagacattctctgtttttagcatccttacaaaacataagatcattcatacagaggaaaagccttacaagtgcgaggagtgcggaaaggctttcaagaggtctagcacccttactaaacatcgcatcattcatacagaggagaaaccgtacaagtgcgaagagtgtggaaaggcatttaaccagtcttctacccttagcattcacaagatcatacacacaggcgagaaaccctacaaatgtgaggaatgcggcaaggcttttaaacgcagttctacactgactatccacaaaatgatccacaccggcgaaaagccgtacaaatgcgaggagtgtgggaaagcctttaatcggagttcacacctgaccactcacaaacgcatccataccggtcataagccctacaagtgtaaggaatgtggaaaaagcttcagcgtattctcaacactgaccaagcacaaaatcattcacaccgataaaaaaccatacaaatgcgaggagtgtgggaaggccttcaatcgctcgagcatcctctctattcataaaaagattcataccggggagaagccttataaatgtgaagagtgtgggaaggctttcaaacggtcatctcaccttgcaggacacaagcaaattcactccgtgcaaaagccatacaagtgtgaggaatgcgggaaagccttcagcatcttcagcaccctaacaaaacacaaaatcattcacacggaagaaaagccatataaatgcgaaaagtgcggaaagacgttctaccggttttccaacttgaacactcacaaaattattcacaccggtgagaaaccttgtaagtgtgaggagtgtgggaaggcttttaatcactcctcgaaccttattaaacacaaactgatccacacgggggacaaaccctacaaatgtgaagcctgcggcaaggccttccggcgcagctcacacctgtcacgtcacaaaataatccatattggaattcacaccgaagaaactgtgcagaaatag

SEQ ID NO: 21685 - DNA, 312 bp, Artificial Sequence
  Description of Artificial Sequence: Synthetic coding sequence
atgcccggcccccccgagagcctggacatgggccccctgaccttccgggacgttgcaattgagttcagtctggaggagtggcagtgcttagacaccgcccaacaggatctataccgcaaggtgatgttagaaaactataggaatctggtattcctggcgggcatcgctgtgtcgaagccagacctagtgacctgtctggaacaaggaaaggatccctggaacatgaagggtcattccaccgtggttaagcctccggtcgaaacggggtttcacaggttttctcaggacggtttgtatctgcttacctcttag

SEQ ID NO: 21686 - DNA, 1497 bp, Artificial Sequence
  Description of Artificial Sequence: Synthetic coding sequence
atggagagcccccggggctggaccctgcaggtggcccccgaggagggacaagtcctctgcaacgttaaaactgccacccgtggattatccgagggcgctgtgtctggtggatggggcgcctgggagaatagcacggaggttcctcgcgaagccggcgacggccagagacagcaggctactctgggtgcagccgatgaacaaggggggccaggaagggagttggggccagccgacgggggcagggatggagccggacctcgttcagagcctgcagatagagcccttaggcctagcccactgcctgaggagcccggctgtaggtgtggagagtgtggcaaagccttcagtcaaggctcctacctgctccagcataggagagtccatacaggggagaagccatacacgtgtcctgagtgtggaaaagccttcgcctggagttctaatcttagccagcaccagcggatccattcaggcgagaagccatacgcctgccgcgaatgtggcaaggcattcagggcccactcacagctgatccaccaccaggaaacccattccggactaaaacctttccggtgtccagactgcgggaagagtttcggccgctcaactaccctggttcaacatcgtcgcactcataccggtgaaaagccttatgagtgtcctgagtgtggcaaagccttttcttggaatagtaattttcttgagcacagaagggttcacaccggagcaagacctcacgcatgcagggactgcggaaaggccttttctcagagctcgaacctggcagaacatcttaagattcacgcaggagcaagaccccatgcttgcccggattgtggcaaagccttcgttagggttgcagggctgcgtcagcaccgaaggacgcattcatccgagaagccctttccatgcgccgagtgtggcaaagcttttcgcgagtcttcccagctccttcagcatcaaaggacccataccggagaacgtcccttcgagtgcgccgagtgcggccaagcctttgtgatgggttcatacctcgcagaacacaggcgggtgcacacaggcgagaaaccacacgcctgtgcacagtgcggcaaggccttctcacagaggagtaacctgctgtcccataggagaactcactccggagccaagcctttcgcctgcgcagactgtggtaaagctttcagaggttcatccggcctggcacatcacaggctttcccatactggagagagacccttcgcctgcgctgaatgtggcaaggcattccgtggatcatccgagttgcggcagcatcagcgcctgcacagcggggagcgcccgtttgtctgcgcccactgttccaaggcatttgtgcgcaagtccgaattactgagtcatagacggacacacacgggggaaaggccctatgcatgcggagaatgcggcaagccctttagtcacaggtgcaacttgaatgagcaccagaagagacatggaggcagggccgctccatag

SEQ ID NO: 21687 - DNA, 678 bp, Artificial Sequence
  Description of Artificial Sequence: Synthetic coding sequence
cacagcggcgagaagccctacgcctgccgggagtgcggcaaggccttcagagcacattcacaattgatccatcaccaagagacccacagtggtctcaagccatttcggtgtcctgactgtgggaagagctttggaaggtcaacgaccttggtgcagcaccgcaggacccacaccggggaaaagccatatgagtgtcccgaatgtggaaaagcgttcgtgcgtgtagctggcctacgccagcataggcgcactcattcttctgagaaaccttttccatgcgccgagtgcggcaaagcatttagagagagtagccagctgttacagcatcagcggacacatacaggcgagcgacctttcgagtgcgccgagtgcgggcaggccttcgtgatggggtcgtatctggccgaacaccgccgcgtccacaccggagagaaaccccatgcgtgcgcccagtgcggaaaagctttttctcagagatctaacctgttatcccacaggcgtactcattcaggcgctaaaccattcgcatgcgccgactgcggcaaagcttttcgcgggtccagcggtcttgcccaccatcgcctgtcacacaccggcgagagaccttttgcctgtgccgaatgcggaaaggcttttcggggaagttccgaactgaggcaacaccagcggctccattag

SEQ ID NO: 21688 - DNA, 1497 bp, Artificial Sequence
  Description of Artificial Sequence: Synthetic coding sequence
atggagagcccccggggctggaccctgcaggtggcccccgaggagggccaagtactgtgtaatgtgaagaccgctactaggggcctatcagagggggcggtgtcaggtgggtggggggcctgggagaatagcacagaggttccaagggaagccggggatggccaacgacagcaggctacattgggcgcagccgacgagcaagggggccctggcagggagctggggcccgccgatgggggccgtgatggcgctggccccagaagcgaacccgccgatcgcgcgctgagaccttcaccattacctgaggagccagggtgtaggtgtggggagtgcggaaaggccttctcccaaggctcctatctcttacagcacagaagggtacataccggggaaaagccatacacgtgcccagaatgtggtaaggccttcgcctggtccagcaacctcagccaacatcagcgcattcatagcggtgaaaagccgtacgcttgccgcgaatgcggcaaggctttccgcgcccactctcagttgattcaccaccaagagactcattcagggcttaaaccgttccgctgtcccgattgtggtaagtcctttggacggtcgacaacacttgtgcaacaccgaaggactcacactggtgagaaaccctatgaatgtcccgaatgtggaaaggccttttcctggaatagtaacttccttgagcacagacgagtccacaccggggcacggccccacgcctgtcgagactgtggaaaagccttcagtcagagctctaacctggcagaacacttaaagatccatgccggggcacgtccccatgcctgtcccgattgcggcaaggccttcgtgagggtcgctggactgagacagcacagacgaactcacagtagtgagaaaccgttcccatgcgccgaatgtggaaaagcctttcgcgagtcctcacaactactccagcaccagaggacacacacaggcgagaggcccttcgaatgcgccgagtgtgggcaggcgttcgtcatggggagctacctggctgagcatagaagggtgcacactggcgaaaagccccatgcgtgcgcgcagtgtggtaaagccttctcccagcgatccaaccttttatcccatcgccgaactcactcgggtgccaaaccattcgcctgcgcggactgtggcaaggcattcagaggctcttcagggctggcccaccataggctcagccatactggcgagcggccatttgcatgcgcagagtgcggaaaggctttccggggcagttcagagctgaggcagcaccagcgccttcattccggcgagagacccttcgtgtgcgcccactgctcgaaggctttcgtgcgcaaatcagagctcctgtctcacaggaggacccacaccggcgagcggccctacgcttgcggggagtgtggcaagcctttctctcatcgctgtaatttaaacgaacatcagaaaaggcacggtgggagagctgccccttag

SEQ ID NO: 21689 - DNA, 1419 bp, Artificial Sequence
  Description of Artificial Sequence: Synthetic coding sequence
atgctgaaggagcaccccgagatggccgaggccccccagcagcagctaggtatcccagttgttaaactggaaaaggaactcccgtgggggaggggccgtgaagacccttctcctgaaactttcagacttcgctttaggcagttcaggtatcaggaggccgccggtccccaggaggccctccgcgagctacaggaactgtgtcggcgttggctcaggcctgaactgcacacaaaggagcaaatcctggaactcctggtgctcgagcaatttttgaccattctgccgcgggagttctacgcctggattcgggaacatggtcccgagtctggcaaagcgttggccgctatggtcgaggacctgaccgaacgcgcattggaagcaaaagccgtgccgtgccatcgccaaggcgagcaggaagagactgctctatgccgaggagcgtgggagcccggaattcaactggggcccgtagaggtgaagcctgagtggggaatgccacctggggagggcgtacagggccctgatccagggacggaggagcagctttcacaggatcccggcgacgagacccgtgctttccaggagcagggcggaggaagcaaagaaaaggaggcaaaaccgccccaagaggacttgaagggagccctagtggcattgacatccgaaagatttggggaggccagcctccaaggccccggcttgggcagagtgtgcgaacaagagcccggtggaccggcgggcagcgctccgggactccccccaccacagcatggggccatcccactgcccgacgaagtgaagacacattctagcttttggaaaccatttcagtgtccagagtgtggaaagggattctctcgctcgtctaacctggtgagacatcagagaacccacgaagagaaatcatacggctgtgtcgagtgcggaaagggcttcactctcagggaatacctgatgaagcaccagaggacccacctaggaaaacggccttacgtatgtagcgagtgttggaaaaccttcagtcagcggcatcacctggaagtgcatcagcggtctcacactggcgaaaagccctataagtgcggagattgttggaaatcatttagcaggagacagcaccttcaggtgcaccgcaggacacataccggggagaaaccatacacctgtgaatgcgggaaatcattttctcgcaacgcaaatctggccgtacaccgtcgggcccatacaggggagaagccatacgggtgccaggtttgtgggaagcgattctctaaaggtgaaaggctcgtgcggcatcagagaatccatacaggggaaaaaccatatcactgtccagcctgtggcaggtctttcaatcaaagatccatcctgaataggcatcagaagactcaacacagacaagaacctctggtgcaatag

SEQ ID NO: 21690 - DNA, 1635 bp, Artificial Sequence
  Description of Artificial Sequence: Synthetic coding sequence
atgctgaaggagcaccccgagatggccgaggccccccagcagcagttgggaatccccgtggttaaactggagaaggaactgccttggggtcgcgggcgagaagatccatccccagagacctttcgcctaaggtttcggcagttccgatatcaagaggcagctggccctcaggaggctttaagggaactgcaggagctgtgtaggcgctggctgcggccagaattacacacgaaagagcaaatactggaactcttggtgcttgaacaattcctgaccattctcccacgcgaattctacgcttggattagagaacatggaccagaatccgggaaagcactggccgcaatggtggaggatctcactgaacgcgctctagaagctaaagctgtaccttgccaccgccagggcgaacaggaagagacagccctgtgcagaggagcatgggaacctggaattcagctgggcccggtggaagtgaagcccgaatggggcatgccgcctggtgagggagtgcaggggccagaccctggcaccgaggaacagctatctcaggatcctggagacgagactagagcctttcaagaacaggccctgcctgtgctacaagccgggcccggtttgccagccgtaaaccctcgggatcaggagatggctgcaggcttcttcacggcagggagtcaaggcctcggtccctttaaggacatggccctggcttttcctgaagaagagtggcggcatgtgacgccagctcagattgactgctttggagagtatgtcgaaccacaagattgtagggtgagtcctggaggcggtagcaaggagaaagaagccaaacctccccaggaggacctgaaaggggctttggtcgcattgacaagcgaacggtttggtgaagccagcctgcagggccctggtttaggacgggtttgcgagcaggagcctggggggccagcggggagcgcacctgggctcccgcctcctcagcacggtgctattccactccccgatgaagttaagactcattcgtctttttggaagccctttcagtgtccggaatgcggaaaggggttctcgcgttcctcaaatctggtcaggcatcaacggacccacgaggagaaatcctacggttgcgttgagtgcgggaaagggttcacactcagagaatatttgatgaagcaccaacgaacccacctaggaaagcgaccatacgtgtgcagtgaatgttggaaaaccttttctcagaggcatcacctggaggtgcatcagcgctcccacactggtgagaagccttacaaatgcggcgattgttggaaaagcttcagtcgccgacaacatcttcaggtgcacaggaggacacatactggagaaaagccctacacctgtgagtgcggcaaaagtttttctcgcaacgccaatctagccgtccacagacgggctcataccggcgaaaagccttatggctgccaggtctgtgggaagaggttttctaagggggaaagattggttagacaccagcgcatacatacaggggagaaaccttatcactgccccgcttgcggccggagcttcaaccagagatccatcctcaatcggcaccagaagactcagcatcgacaggaaccactggtgcagtag

SEQ ID NO: 21691 - DNA, 1635 bp, Artificial Sequence
  Description of Artificial Sequence: Synthetic coding sequence
atgctgaaggagcaccccgagatggccgaggccccccagcagcagctcggaattcctgttgtcaaactggagaaagagctgccctggggccgaggccgagaagaccctagtcccgaaacctttcgactcagatttcgccagttccggtaccaagaggcagctggtccccaagaagccctgagggagctccaagagttgtgcagacggtggctgagaccggagctgcacactaaggaacagatcctggaactcctcgttctcgaacaatttctcactattctgccacgtgagttctacgcctggattagagagcatggccctgaaagtggtaaagccttagctgcaatggttgaggaccttaccgagagagcccttgaagccaaggcagtaccttgccacagacagggtgagcaggaagagaccgcattgtgccggggtgcctgggaaccaggaattcaactgggtcccgtcgaagtgaagccagagtggggcatgccgcctggcgagggggtccaggggccagaccctgggaccgaagagcaactctcccaggaccctggggacgaaactagagcttttcaggagcaggctctgccggtgctccaggccggacccggactccccgcggtgaacccccgggaccaagagatggctgctggttttttcaccgccggtagtcaggggcttggcccattcaaggatatggccctcgcattcccagaagaggaatggcggcatgttacacccgctcaaattgactgcttcggtgaatatgtagagccccaggattgccgtgtttcccccggaggtggctccaaggaaaaagaggcaaaaccaccccaggaagacctgaagggagctctggtggccctgacatccgaacggttcggagaggcatccctgcagggcccaggcttgggacgagtgtgtgagcaggaaccaggggggcccgccggcagtgcgccggggctgcctccaccacaacatggcgcaattccgctccctgacgaagtcaagacccactcttccttctggaagcctttccagtgtcccgaatgtggaaaggggttctcaagatccagcaacctggtgcggcaccagcgcacccacgaggaaaagagctacggctgcgtggaatgtggcaaggggttcactcttcgggaatatctgatgaagcaccaacgcacccaccttggtaaacgcccctatgtctgttctgagtgctggaagaccttctctcaacgacaccacctggaggtccaccagagaagtcacacaggagagaagccatacaaatgtggtgactgttggaaatcattcagcagacgtcagcatctccaagtccaccggcgaacacacaccggtgaaaagccgtatacctgtgaatgtggtaaatcattctctaggaatgctaaccttgctgtgcacaggcgagcccatactggagaaaagccttacggctgtcaagtatgtggaaaacgcttttccaagggagagcgactcgttcgccatcagaggatacacacaggcgagaagccgtatcactgtcctgcgtgtggacgatccttcaatcaacgttctatcctgaatcgacaccagaagacacagcatcgacaggaaccactcgttcagtag

SEQ ID NO: 21692 - DNA, 213 bp, Artificial Sequence
  Description of Artificial Sequence: Synthetic coding sequence
atgctgaaggagcaccccgagatggccgaggccccccagcagcagttgggcatccctgtggtgaaactcgaaaaagagctgccttggggacgtggtcgggaagacccgagccccgagacctttagactcaggttcaggcagttcagataccaggaggcagcgggacctcaggaggccttacgcgaattgcaggaactctgtaggagatggtag

SEQ ID NO: 21693 - DNA, 5424 bp, Artificial Sequence
  Description of Artificial Sequence: Synthetic coding sequence
atggccaagcccaccagcaaggacagcggcctgaaggagaagttcaaaattttgctcgggttaggcacccctagaccaaaccccagatccgcagaaggcaaacagactgagtttataatcacagctgagattctgcgagaactgagtatggagtgcggactcaataacagaatcagaatgataggacaaatttgcgaagtggcaaaaacaaaaaaatttgaggagcatgctgtcgaggctctttggaaggccgtggcagacctcctccagccggagaggccactggaggcacgtcatgctgtgcttgctctgttgaaggctatcgtccaggggcagggagagagactgggtgtgttaagagcgctattcttcaaggtgattaaggattatccaagcaatgaagacctgcatgagcgcctagaggtgttcaaagctctgaccgataatggcaggcatataacttatctggaagaagaactggctgattttgtgctgcagtggatggacgttgggctgagcagtgagtttttgctcgtgttggttaacctcgtcaagttcaacagttgctatctagacgagtatatcgcacgcatggtacagatgatctgcctgctctgtgtgcggacagccagctcagtggatatcgaggtctctttgcaggtgctggatgcagtggtgtgttacaattgcctgccggctgaatctcttcccttgttcattgtcaccctctgtcgtaccatcaacgtcaaggaattatgcgagccctgctggaagttaatgcgaaacttactaggaacccacctggggcattctgctatatacaacatgtgccacctaatggaggaccgcgcttacatggaggatgccccccttctgcgtggagctgtattcttcgttggcatggcactgtggggcgctcacagactttacagcctgcgcaactcaccaacttccgtgctgccgtcgttctaccaggccatggcttgcccgaatgaggtcgtgagttatgaaattgtgctgtccatcacgaggcttataaagaaatacaggaaggaactgcaagtcgtggcatgggatatccttctaaatataatcgagcgattgctccagcagctccaaacattagatagcccagagctgcgcacaatcgttcacgacttgcttactactgtggaggagctttgtgatcaaaacgaattccatgggtctcaggagagatactttgagttggttgaaaggtgtgctgaccagagacctgaatcaagcctcctgaacttgatctcttaccgagcccaatccattcaccctgccaaagacggatggattcagaacctccaggccctgatggagcgattcttcagaagcgagtccaggggggccgtgcgaattaaagtcttagatgttctatcctttgtgttacttattaaccgtcaattttatgaggaagagttaatcaatagcgtcgtcatctctcaattgagccacattccagaggacaaggatcaccaggtaagaaaactcgccacgcaattgcttgtggaccttgccgagggctgccatactcaccacttcaactctctgttggacatcatagagaaagtgatggccagatcgctgtccccacctccagagctggaagagcgagatgtggctgcctactctgcctcattggaggatgtgaagactgccgttctggggttgctcgtaatccttcagaccaaactctatactctgcccgccagccacgctaccagagtgtatgagatgctcgtgagccatattcagcttcattacaagcattcttacacactgccgattgctagctctatccggttgcaggcatttgatttccttctgttattacgggcagatagcctgcatagactcggcctgccaaataaagacggggtggtgagattttctccttactgcgtgtgcgattatatggagccagagagagggtctgagaagaaaaccagtggaccactgagtccgccgacaggaccccccgggcccgctccagccggtcccgccgtgcgactgggttcggttccctattctctgttatttcgggtccttctgcagtgtctgaaacaggagtcggactggaaagtgcttaaactcgtcctgggccgactccccgagagcttacgctataaggttctgatatttacttctccatgttccgtcgaccagctctgtagtgccctgtgttctatgctgagtggtccaaagacattggagcggctgcgtggagcaccagaggggttcagtaggacagatctacacctggctgtggtgcccgtactgaccgccctcatttcctaccataattatctcgataagaccaaacagcgggagatggtctattgcttagagcagggcttgatccatcggtgcgcctcacagtgcgtagtggcactgtcaatttgctctgttgagatgccagacataatcattaaagctctgccggtgttggtcgttaaacttacccacatctcagctaccgcttcaatggcggtgccactgttagagtttctgtccacactcgcaaggctcccacatctttaccgaaactttgccgcagagcagtatgcctctgtctttgctatcagtctgccctatacaaacccgtccaagtttaaccagtacatcgtgtgcttggcccatcatgtcatagcgatgtggtttattcgctgcagacttcctttccggaaagattttgtgcctttcattaccaaggggcttcgatccaacgtcctgctgtcctttgatgataccccggaaaaggacagctttagggcgcgtagcacgagtctgaatgaacgcccgaagagtctgcggattgccaggcccccgaaacagggactgaacaattcccccccggtgaaggaattcaaggaaagttccgcagccgaagccttccggtgtcggtcaataagcgtgagtgagcatgtggtgcgctccagaatccaaacgtccctgacgtctgcatcactgggtagtgccgacgagaattccgtcgctcaggctgatgacagtctcaagaatctgcacctggagctcacagagacctgcctggatatgatggcccgatatgtatttagcaacttcactgccgtccccaaaagatcccccgtgggagaattcctgcttgccgggggccgcaccaagacttggctggtgggtaacaagcttgtgaccgtcacgaccagcgtcggcactggcactcgatctctattggggcttgactctggtgagctgcagagcggaccagaaagctcatcgtccccaggggtgcatgtgcggcagaccaaagaagctccagcaaaactcgaatcacaggcaggacagcaggtgagcaggggcgctcgggatcgcgttagaagcatgtctggcggacacggactacgagtgggcgcattggatgtgcccgccagccagttcttgggaagcgcaacgtctcccggaccacggacagccccagccgccaagcctgagaaagcctcagctgggacacgcgttccagtgcaagaaaaaacaaatctggcagcctatgtgccacttcttactcaaggctgggcggaaattctggtccggcgaccgactgggaatacttcgtggctcatgtctctcgaaaatcccctgtcccctttctcttccgatatcaataacatgcctctgcaggagttgagcaatgcactgatggccgccgaacgtttcaaggaacacagggacacagccctgtataaatccctcagcgtgcccgctgccagcaccgccaaacccccacccttgcctaggagcaacactgtagcctcattctcttcattgtaccagagttcctgccagggccagctccacagatcagtgtcttgggccgatagtgccgttgtgatggaggaggggagtcccggcgaggtgcctgtgctggttgaacctcccggcctggaagatgtggaggcggccttgggaatggatcgccgaactgacgcctatagtaggtccagtagtgtgagttctcaggaggaaaaatcacttcatgccgaggagctggtaggcagaggaatcccgatagaaagagtcgttagttccgagggcgggcgtccatcagtggatcttagctttcagccgagccagcccctgtcaaaaagtagctcttcacctgaacttcagacacttcaagacattttgggagaccccggtgataaggccgacgtgggacggctgagccccgaagtcaaggcaaggtctcaatcgggtaccctggatggtgagagtgcagcctggagcgctagcggtgaagattctcgggggcagcccgaaggtccactccctagtagtagcccgcgatccccctctggcctgcgcccgaggggatatactatcagtgactcagccccgtcaagacgtgggaagagggtggaacgcgatgcactcaagtcacgagctaccgccagcaacgcagaaaaggtgcctgggatcaatccaagcttcgttttcctgcagctctaccactcaccattcttcggagatgagtccaataagcccatccttctgcccaacgaatcccagagctttgagagatcagtccaattattggaccaaatccccagctatgatacgcacaaaatcgctgtcctttacgttggggaaggccagtcgaattctgaactggcaatactcagtaatgagcacgggtcatacaggtacacagaattcctcactgggttgggccggctcattgagcttaaagattgccagccggacaaagtgtatttgggaggtctcgacgtgtgcggagaagacggtcagttcacatattgttggcatgatgacattatgcaagcggtgttccatatcgccaccctaatgcccacaaaggatgttgacaaacacagatgcgataagaaaagacaccttggcaacgatttcgtatcaattgtctataatgatagcggagaagattttaagctgggcactattaagggccaattcaactttgtgcacgtgatcgtgacccctttggattacgaatgcaacctcgtctccttgcagtgcaggaaagacatggagggtctggtagacacctcagtggctaaaattgtgtctgatcgcaatctgccatttgtcgcaaggcaaatggcccttcacgcgaacatggcatcccaggtgcaccacagcagatcgaatcctactgacatttacccttccaaatggattgccagacttcggcacatcaagcgcctgagacagagaatttgcgaagaagcggcctacagtaacccaagcttgcccctggtccatcccccatcccacagcaaagcacccgctcagaccccagcagagcccactccaggctacgaggtcggacaaaggaagcgcttgatctcgagcgtggaagacttcactgagtttgtgtag

SEQ ID NO: 21694 - DNA, 1326 bp, Artificial Sequence
  Description of Artificial Sequence: Synthetic coding sequence
atggccaccgtgcccggcctgcagcccctgcccaccctggagcaggatctggaacaggaagagattttgatcgtgaaggttgaagaggacttctgtctggaggaagaaccttctgtggagacggaggacccttctccggaaaccttccggcagcttttccgtctcttttgctatcaagaggtggctgggcctcgggaagccctcagtcgactgtgggaactttgttgcagatggctgcgtccagagcttcgtacaaaagaacaaattctcgaactcctcgtcctcgaacagtttcttaccgttctccctggcgaaattcaagcgcgggtaagggagcagcagcctgaaagcggtgaggaagctgtcgtgctggttgaaggcttacaaagaaagccacgtaagcacagacagcgtgggagtgaacttctgtccgacgatgaagttcctttaggtattggtggccagtttttaaaacaccaggcggaagcccagccagaggatttgagcctggaagaagaagccaggttttcttcccaacagccgcccgcccagctcagccaccgacctcagcgggggccgcttctgtggcccgagcggggtccacctgcccctcgccaccaggagatggccagtgcctccccctttctgtccgcctggtcccaggttcccgtaaatctcgaagatgtggccgtgtatctgtcaggcgaagaacctcgttgtatggacccggctcagagggacgctcccctcgaaaatgaaggccccggcattcagctggaggatggtggcgacggtcgtgaggacgcccctctgaggatggagtggtatcgcgtcttaagcgcccgctgccagggacccgggcatccactcccaggccagcgccctgctcctgtaaggggactggtaagacccgaccaaccaaggggaggaccgccacccggacggagagcttcccatggggccgataagccgtatacctgtccagagtgcggaaagggcttttcgaagacctcacacctgacaaagcaccagaggacccataccggtgagcgaccttataaatgcctcgtgtgcggcaagggattcagcgacagaagtaacttcagcactcaccaaagagtgcatacgggggaaaagccatacccctgccctgagtgcggcaagaggttcagtcagtcttcttcccttgtgatccaccgcagaacgcactcaggagagagaccctatgcctgtacccaatgtggcaagaggtttaataactcgagccactttagcgcccatcgcagaacgcacaccggccatattctgaggagtgggtgcacatag

SEQ ID NO: 21695 - DNA, 648 bp, Artificial Sequence
  Description of Artificial Sequence: Synthetic coding sequence
atgaacagcagccagatcagcctgcggatgaagcacggccgggtgaatatgcaaaaaaaacctagtaaatgctccgagtgcggtaaattttttacccagcgatcctcattgacacagcatcaacgtattcacagaggagagaagccctatgtgtgttcagagtgtgggtcttgctttcggaagcaatctaacctgacacagcacctgcgaattcataccggggaaaaaccctacaagtgtaacgagtgtgagaaggccttccagaccaaagcaattttagtccagcatctcagaatccataccggggaaaagccttacaagtgcaacgaatgtggaaaggcgttctgtcagagcccgtccctcattaagcatcagcggatccacacgggcgaaaagccgtatacgtgcaccgagtgcgggaaggcgttcacgcaaaactcttccctggtggaacacgaacgcacccataccggagaaaagttatataagtgttctgagtgcgagaagaccttccggaaacaagcccatctttccgaacactataggattcataccggcgagaagccttacgaatgcgtggggtgcggcaagtcctttcgacattctagtgcactcttaaggcaccagcggcttcacgcaggagagtag

SEQ ID NO: 21696 - DNA, 816 bp, Artificial Sequence
  Description of Artificial Sequence: Synthetic coding sequence
atgaacagcagccagatcagcctgcggatgaagcacggccgggtgaacatgcagaaaaagccctcgaaatgttccgaatgcgggaaattctttactcaacggtcctccctgacgcagcaccagcgaatccacagaggagaaaagccctacgtctgctctgaatgtggaagttgttttcggaagcagtcaaacctaacacagcacttacgcattcatactggcgagaagccgtataagtgcaacgagtgcgaaaaagccttccagaccaaagcaattcttgtgcagcacttaaggattcacaccggagagaagccatataagtgtaatgaatgcggcaaggcattttgtcaatccccttctctcatcaaacaccaaaggatccacactggcgaaaaaccatataaatgcacagaatgtgggaaggctttcagccagagcatatgtcttacacgccatcagcggtctcactccggcgataaacccttcaagtgcaacgagtgtggtaaagcctttaatcagagtgcctgtttgatgcagcaccagcggattcactcaggcgagaaaccatatacatgcaccgaatgcggcaaggctttcacccagaacagctcactggttgagcacgagcgaacccacacaggagagaaactatacaagtgcagcgagtgtgaaaaaaccttcaggaaacaggcccacctcagcgaacactatcgtatacacacaggcgagaagccttacgagtgcgtagggtgtggaaagtccttccgtcatagctccgctctgctgaggcatcagcgcctgcatgccggtgagtag

SEQ ID NO: 21697 - DNA, 1635 bp, Artificial Sequence
  Description of Artificial Sequence: Synthetic coding sequence
atgctgaacatgcagggcgccgaggagcgggacatccggcgggagacttgccccggatgggtgaacaagaacaagcctgctcttgagcaggatgtgtgtaaaatcgatagcagtggcatagtggtaaagagattccaggaggatgagtaccaggactcaaccttcgaagaaaagtacgcctgcgaagggatgaaagaaaattcccctagggagatcgcagagtcttgcctgtttcaggaagggggctttgggcggataaccttcattcacaaagaagctccaccggaaataatatcccagggttataactttgagaaaagcctcctgctgacctctagcctggtgacacgcctgcgggtctctaccgaggagtctctgcaccagtgggagacgtctaacattcaaaccaacgacatctcggaccagagtaaatgcccaactctttgcacccagaaaaagagttggaagtgcaatgagtgcggaaaaaccttcacccagtcctccagtctgactcagcatcagcgcacccacacgggcgagcgcccttatacttgcgaagagtgtggcaaagctttctcccgctcctcatttctggtgcaacaccagcgtattcacacgggagtcaagccgtacggttgcgaacagtgtggaaaaacctttcggtgtaggagctttctgacccagcatcaaagaattcacaccggagaaaagccctataaatgtaatgaatgtggaaatagcttcagaaatcactcgcacctcaccgagcaccagcggatccacacaggcgagaagccctacaaatgcaaccggtgtggcaaggcattcaaccagaacactcaccttatacaccaccagaggatccatactggcgagaagccctacatctgctcggaatgcgggtccagtttccggaagcatagtaacttgactcagcaccagcggattcatacaggggaaaagcctcacaagtgtgacgaatgcggaaaaactttccaaaccaaggccaacctcagccaacaccagcggatccattctggcgaaaagccatacaaatgcaaagagtgtgggaaggcattttgtcagtccccctctcttattaagcatcaacggattcatactggggaaaaaccgtacaagtgcaaggagtgtgggaaagccttcacccaaagcacacctctaactaaacatcaaaggatacatactggggagcgaccatacaaatgtagcgagtgtggcaaagctttcatccagtcaatttgcctgattcgtcaccagcgatcacataccggtgaaaaaccctacaagtgtaacgagtgtgggaagggatttaaccagaatacttgtctgacacaacatatgcgtatccatactggcgagaaaccttacaagtgcaaggagtgcggaaaggcgttcgcacatagctcctccttaaccgaacaccatcgtacccacacaggagagaaattgtataaatgtagtgagtgcgagaaaacctttcgaaaatatgcgcacctgagcgagcactatcggatccacaccggagaaaagccttacgagtgtatagagtgtgggaagttctttcgccactcgagtgttctttttagacatcagaagctgcactctggcgattag

SEQ ID NO: 21698 - DNA, 468 bp, Artificial Sequence
  Description of Artificial Sequence: Synthetic coding sequence
atgctgaacatgcagggcgccgaggagcgggacatccggcgggagacctgcccagggtgggtaaacaagaacaaacctgctctggagcaggatgtatgcaagatcgactcttccggaatcgttgtcaaacgattccaagaggatgagtatcaggacagcacgtttgaggagaagtacgcttgtgagggaatgaaagagaattctccaagggaaatcgcagaatcttgcttgtttcaggaaggtgggtttggcagaataacctttatccacaaagaagcccctcctgagattatcagtcaaggttataattttgagaagagcctcctgctgacatcttctctggtaacacgtttacgcgtgagcaccgaagagtccttacatcaatgggaaaccagtaatatccagacaaacgacatctcggatcagagtaagtgccccacactgtgcactcagaagaagtcttggtag

SEQ ID NO: 21699 - DNA, 1362 bp, Artificial Sequence
  Description of Artificial Sequence: Synthetic coding sequence
atgctgaacatgcagggcgccgaggagcgggacatccggcgggagacatgtcctgggtgggtaaataaaaacaagccagcattggaacaggatgtgtgtaaaattgatagcagtggcattgtcgtgaagcggtttcaggaggatgaatatcaggacagcacatttgaagaaaaatatgcctgcgaaggtatgaaagaaaattcacctagagagatcgccgagtcatgcttgtttcaagagggaggcttcggtaggatcacattcattcataaggaagcccctccagaaataatatcacagggatataatttcgaaaaatctctgcttttgaccagttccttagtgaccagacttcgagttagcacggaagagtcactccaccaatgggagacaagcaacattcagacaaacgatatttcggatcaatctaagtgccccaccttgtgcacacaaaagaagagctggaaatgcaacgaatgcgggaagacattcactcagtccagctcactgacccagcatcagagaacccacacaggagagaggccgtatacgtgtgaggaatgtggcaaggctttctcacgtagtagcttcctggtccagcatcagcgaatccacactggcgtgaagccatatggctgcgaacaatgcggaaaacactttgatgtggaccatttccttctgagtataaaggaattcactctggagagaaatctgataaacgccatgaatgtaggaatccccagcgcaattactcacattagtcttaatactcgcgagtttaccttagagcgtaacctcatcaacgcaatcggagtgggaagacacagcataagaatccacacactgttcattatcagggaattcacactcgtgcgaagtttgacctacgcagtgaacgtggccctgctgttcgagaacactcagatccttaggaatattagagaattcactttgggaaagaacccaatcaatgtcactaacgtgggtaagctgtcaaagcagagacagacgagcctgagcataagagagtttatcgtggagcgcaaccctatcaacgtgaaaaacgtagcaaaaccatttgttcgagcgcacctgctcctgaatacaagcgagtttatattagaaaaaaatcatatatctgttaagaatgttgcaaagagactgctgagagcccctcattctctcaatattagagagtacattcagggccgagaccctaccaacgctgtgaacgtagtgaagcccagtttcagagcatttgctctgttcggcactcgggaggtcactcttgagaaaaatcccattaacgccatgaacgtagagagggctttgattagaactcctgcttcactgagcatctag

SEQ ID NO: 21700 - DNA, 1635 bp, Artificial Sequence
  Description of Artificial Sequence: Synthetic coding sequence
atgctgaacatgcagggcgccgaggagcgggacatccggcgggagacgtgccccgggtgggtgaacaagaacaagccggcactcgaacaggatgtatgtaaaatcgactccagcgggatcgtcgtgaaacgcttccaggaggacgagtaccaggatagcacttttgaggagaagtacgcgtgtgaaggtatgaaagagaatagtccccgcgagattgctgagtcctgtctgttccaggagggaggctttggccgcataacgttcattcacaaggaagcgcctccagagattatatctcagggctataactttgaaaaaagcctgctgttaaccagctcactggttacaaggctgagagtctcgaccgaggaaagcctgcatcaatgggagaccagtaatattcagaccaacgacatctccgatcagtcaaagtgtcccactctctgtacgcagaagaagtcatggaagtgcaacgagtgtgggaaaaccttcacccagagctctagtctcacacaacatcagcggactcacaccggggaaaggccatacacttgcgaagagtgcggaaaagctttttctaggtcgtcattcctcgtgcagcaccagcgtattcatactggcgtgaagccttatgggtgcgagcagtgcggtaaaactttcagatgtcgctcattcctgacacagcaccagagaatccacacgggggaaaagccttacaagtgtaacgagtgtgggaacagctttcgtaaccacagccacctcacggagcatcagcggattcacacaggtgagaaaccatacaagtgcaacaggtgcggaaaggcatttaatcagaatactcacctgattcaccaccagaggatccatactggtgaaaaaccatacatttgctcagaatgtgggtccagcttccgaaagcacagcaacctgacgcaacatcagcgaatccataccggagagaaaccccacaagtgcgacgagtgtggtaagacattccagactaaagcaaacttgtctcagcatcagcgcatccacagtggtgagaaaccatacaaatgcaaagagtgtggaaaggccttctgtcagtccccaagcctaatcaagcaccagcggatccacaccggggagaagccttacaaatgtaaggaatgcggcaaggcattcacccagtctacacccctgacaaagcaccagaggatacacacgggcgagaggccctataagtgcagcgaatgcggtaaggctttcatccagtccatttgccttatcagacaccagagatcacatactggggaaaaaccctacaagtgcaacgagtgcggtaagggatttaaccagaacacttgtttgactcagcacatgaggattcacacaggtgaaaagccttacaagtgtaaggagtgcggaaaggcattcgctcattcctcatctcttactgaacatcataggacccacacaggagagaagttgtataaatgctctgagtgtgaaaagacattccgcaaatacgcccatttgagtgaacactatcgcattcacaccggagagaagccatatgagtgcatcgaatgtggtaaattctttcggcatagtagcgtcctattccggcatcagaaattgcatagtggcgattag

SEQ ID NO: 21701 - DNA, 1635 bp, Artificial Sequence
  Description of Artificial Sequence: Synthetic coding sequence
atgctgaacatgcagggcgccgaggagcgggacatccggcgggagacctgcccgggttgggtgaataaaaataagccagcgctcgagcaagatgtatgtaaaatcgatagctctggtatcgtggttaagaggtttcaagaagatgagtaccaggactcaaccttcgaagagaagtacgcatgcgaaggcatgaaagagaattcgcctagagaaatcgctgaaagttgtctctttcaagaaggtggatttggaaggataacctttattcacaaggaagccccgccagaaattatcagccaggggtacaattttgagaagtctcttttacttacctctagcctggtgacacggttgcgggtaagcactgaggaatccctccaccagtgggagacatcaaatatacaaacgaatgatataagtgatcagtctaagtgtcccacattatgcacgcaaaaaaagtcttggaaatgcaatgagtgcggcaaaacctttacccagtctagctctttgacccagcatcagcggacccacacaggagaaaggccatacacttgcgaggagtgtggtaaagcattcagtcgcagctctttccttgtgcagcatcagaggatacacaccggcgttaagccatacggatgcgagcagtgcggaaaaaccttccgctgccgcagctttcttacccagcatcagcgcattcacaccggggaaaagccgtataagtgtaatgaatgcggcaattctttccggaatcattctcacctaacggagcaccagcgcattcataccggagagaagccctataagtgtaacaggtgcggtaaggcatttaatcaaaacacccacctcatccatcatcagcgcatccataccggagaaaaaccatacatatgcagcgagtgtggcagctcctttcggaagcactccaacctgactcagcatcaacgaatccacaccggggaaaagccacacaaatgcgatgagtgtggcaagacgttccagactaaggcgaatttgtctcagcaccagagaatccatagcggagagaaaccctataagtgtaaggaatgcggcaaggccttctgccagtcccctagcctgattaaacatcagcggattcacaccggtgaaaagccttacaaatgcaaagaatgcggtaaggcctttacccagagcaccccactgaccaaacaccagcggattcacacgggagaacggccctacaagtgctctgagtgcggcaaagcctttatccaatcaatctgcctgatccgacaccagcgctcccacacaggggagaaaccatataaatgtaacgagtgtggcaaagggttcaaccagaatacttgtctgactcaacacatgcggatccatactggtgaaaaaccatacaagtgcaaggagtgtggaaaagcatttgctcattcttcctccctaacagaacaccataggacccatacaggcgagaaactgtacaaatgctccgagtgcgaaaaaaccttccggaagtatgctcacctgagtgagcattacaggattcacaccggagaaaaaccctacgaatgcatcgaatgtggcaagttctttcgtcacagcagtgttctgtttcggcatcagaaactacacagtggggattag

SEQ ID NO: 21702 - DNA, 1335 bp, Artificial Sequence
  Description of Artificial Sequence: Synthetic coding sequence
atgggccccctgcagttccgggacgtggccatcgagttcagcctggaggagtggcattgcctggacgcggctcagcgtaacttgtaccgcgatgtgatgctagaaaactatcgtaatctgatatttctgggaattgtcgtttcgaaaccaaacttgatcacgtgcctggagcagggcaagaaaccattgacaatgaagcggcacgagatgatcgctaaaccccccgtgatgtactctcacttcgcccaggacctgtggagcgaacagagcatcaaggactcattccagaaggtcatccttaggcgttacgagaagtgcaggcacgataacctccagctgaaaaaggggtgtgagtctgtggatgagtgccccgtccacaaaagaggctacaatgggttgaaacaatgtctggccaccacccaacgcaagatttttcaatgtgatgagtacgttaagttcttacataagttttccaattccaataaacacaagataagggacaccggtaaaaagagcttcaagtgcatcgagtatggtaaaactttcaaccaaagcagcacgagaaccacgtataaaaagatcgacgccggtgagaagaggtacaaatgcgaggagtgtgggaaagcttacaagcaaagtagccatttaacaactcataaaaagatacacacgggggaaaaaccttacaagtgcgaagagtgtggaaaggcttacaaacaaagctgcaatctgacaacccataagattatccatacaggagaaaagccctacagatgtcgcgagtgcgggaaagctttcaatcatccagccacactcttctctcataaaaaaatccacacaggcgagaaaccctataaatgcgacaagtgcgggaaggccttcatctcatcctccacactgaccaagcatgaaataatccacaccggagaaaagccttataaatgtgaggaatgtggcaaagctttcaaccgctcttctaacctgacaaagcataaacggatacacaccggcgatgtgccctataaatgcgacgagtgtgggaagactttcacctggtatagtagcttatccaagcacaaaagagcgcataccggcgagaagccttacaaatgcgaagagtgcggcaaggcctttacagccttttctacactgaccgaacacaagatcatccatacaggcgagaagccctacaagtgcgaggaatgtggcaaggcatttaactggagcagcgctttaaataaacataaaaagatccatattaggcagaagccatgtattgtaaaaaacgtggagaacctgctcaacgtgccgcaacccctcataagtattcgatag

SEQ ID NO: 21703 - DNA, 1239 bp, Artificial Sequence
  Description of Artificial Sequence: Synthetic coding sequence
atgggccccctgcagttccgggacgtggccatcgagttcagcctggaagagtggcactgcctggacgcagcccagcgcaacctctacagggatgtgatgttggaaaactaccgcaatctgatcttcctcgttatgtactctcactttgcacaggatctgtggagcgagcaatcaattaaagactccttccagaaagtgatcttgaggagatatgagaaatgccgccacgacaacctgcagttaaagaaggggtgcgaatcagtggatgaatgtcctgtgcataaaagagggtacaacggcctcaagcagtgcctcgctactacccagaggaagatttttcaatgcgatgagtacgtgaagttcctgcataaattctccaattctaataaacacaagatccgggacaccggtaagaagtccttcaagtgtattgagtacggtaagacttttaatcagagctccactagaaccacttacaagaaaatcgacgctggtgaaaagcgctataaatgcgaagaatgcggcaaagcctataaacagtcctctcatttaactacgcataagaaaatccatacgggagagaagccgtacaagtgcgaggaatgcggcaaggcctacaagcagtcctgtaatcttactacgcacaaaatcattcacaccggggagaaaccataccgctgcagggaatgtggcaaagcttttaaccaccccgcaaccttattctcccataaaaagatccatactggagagaagccctacaagtgcgacaagtgcggtaaagcctttatctctagttctacgctgaccaagcacgagatcatacatactggtgagaagccttataaatgcgaggaatgcggaaaagcttttaacaggtcttcaaaccttacaaagcacaagagaatccatacgggtgatgtaccctacaaatgcgatgagtgcgggaagactttcacctggtattcctcactttctaaacataagcgcgcacacactggagaaaagccgtataaatgtgaggagtgtggtaaggcatttacagccttcagtaccttgactgaacacaagatcatccacacgggggagaaaccttataagtgcgaggaatgcgggaaggccttcaattggtcttccgcgttgaataaacacaagaagatccacatacgacagaaaccttgtatcgtgaagaacgtcgaaaatcttttaaacgtgccacagcccctcattagtattcgctag

SEQ ID NO: 21704 - DNA, 1335 bp, Artificial Sequence
  Description of Artificial Sequence: Synthetic coding sequence
atgggccccctgcagttccgggacgtggccatcgagttcagcctggaagagtggcactgcctggatgccgctcagagaaatctctatcgagatgtgatgctcgaaaactacaggaacctaattttcctgggaatcgtcgtatctaagccaaacctcataacttgccttgagcagggcaaaaagcccctgactatgaagcggcacgagatgattgcaaaaccccctgttatgtactcacacttcgcccaggatctctggtcagaacaaagcatcaaggacagctttcagaaagtgatcttgcgtaggtatgaaaagtgtcgtcacgacaacttgcaactaaaaaagggttgcgagtcagtcgacgaatgtccagtgcataaacgcggctacaacggccttaaacagtgtcttgcaacaacacagcggaagatattccagtgtgatgaatacgtaaaatttctccacaaattctctaattctaacaaacataagattcgcgacactggaaaaaagagctttaaatgcatcgagtacggcaagaccttcaatcagagcagtacgcgaacaacctataagaaaatagacgctggcgagaagagatataagtgcgaagaatgcggaaaggcctacaaacagtcatcacatttaaccacccataaaaagatacacaccggagagaaaccgtacaaatgcgaagagtgtgggaaggcttacaagcagagttgtaacttgaccacccataagattatacacaccggtgagaaaccataccgatgccgagaatgtgggaaggcttttaaccaccccgcaacgctcttcagccacaagaaaatccacactggcgagaagccttataagtgcgacaaatgtggcaaagctttcatttcctcgtctaccctgacaaagcacgagattattcatacaggcgagaagccatataagtgtgaagagtgcggaaaggcatttaaccggagctcgaacttgacaaagcataagaggatacacactggcgatgtaccttacaaatgcgacgaatgcggcaagactttcacctggtattctagcctgtccaagcataaacgagcacatacaggagagaagccctataagtgcgaagagtgcggtaaggctttcaccgctttttcaacgctgacggagcacaagatcatccacacgggggaaaagccatataagtgcgaagaatgcgggaaggcattcaattggtcgtcagcattgaacaaacataagaaaatacatattaggcaaaagccttgtattgtgaaaaacgtggagaatctgctaaatgttccgcaacccttgatctcaatcagatag

SEQ ID NO: 21705 - DNA, 237 bp, Artificial Sequence
  Description of Artificial Sequence: Synthetic coding sequence
atgggccccctgcagttccgggacgtggccatcgagttcagcctggaggaatggcactgtctagatgctgcgcagagaaacctctatagggatgtcatgttggaaaactataggaatctgatatttctggggatcgtggtgagcaaaccaaatctgatcacatgccttgaacaagggaagaagcccttgacaatgaagagacacgagatgatcgccaagcctcctggggggttgtag

SEQ ID NO: 21706 - DNA, 2862 bp, Artificial Sequence
  Description of Artificial Sequence: Synthetic coding sequence
atggaggagagcagcagcgtggccatgctggtgcccgacatcggcgagcaggaggctatcctcaccgccgaatctatcatttccccctcccttgaaattgacgaacagcggaagacaaagcccgaccccctcattcatgtcatacaaaagctcagtaaaatcgtggagaacgagaagtcacagaagtgtctgctcataggtaagaagagaccaagatctagtgctgccacacactcacttgagactcaggagctctgcgagatccccgcaaaagtgatccaatcccctgcagcagacacccgcagagcggaaatgtcacaaaccaattttactccagacacgcttgctcaaaacgaaggcaaagcgatgagctatcagtgtagcctgtgtaaattcctgtcttcaagctttagtgtcctgaaagaccacatcaaacagcacgggcaacagaacgaggttatcttaatgtgctctgagtgtcacattactagtcggtctcaggaagagctcgaagctcacgtggtgaatgaccatgataacgacgccaatatccacacacagtcaaaggcacagcagtgtgttagcccatcctcctccctgtgtcggaaaactaccgagaggaacgagacaattcccgacattcctgtgagcgtcgataacctgcagacacacacggtgcagacagcttctgtggcagagatgggtaggcgcaaatggtacgcctatgaacagtatggtatgtacaggtgcctcttctgttcctatacttgcgggcagcagcgcatgctcaaaacacacgcatggaaacacgccggcgaagtggattgttcgtacccaatttttgagaatgaaaacgaacccttgggactcctggactctagcgctgcagcagcccctggcggcgtcgatgccgtcgtaattgcaatcggagaaagcgagctctccatccataatggcccgtctgttcaagtgcaaatttgttctagcgagcaactatcctcctcatcacctctcgaacagtccgccgagaggggggtccacctctcgcagagcgtgaccctggatcctaatgaagaggagatgctcgaggtgatcagtgacgccgaagaaaacctgatccccgactccctgctgactagcgcgcagaaaattatttccagctcaccaaataaaaagggccatgtcaatgttattgtggaaaggttgcccagtgcagaggagaccctatctcagaagagattcctaatgaatactgagatggaggagggaaaagacctatcactgactgaagcccaaatagggcgagagggcatggacgacgtgtaccgcgccgataagtgcactgtggatatcggagggttgattattggatggtcgagcagtgaaaagaaagatgaattaatgaacaagggccttgccactgacgagaatgccccccctggcagacggcgcaccaatagcgaatctctgcggcttcattctttggccgccgaggcgctggtcaccatgcccataagggctgctgagctgacaagggcgaacctgggacactacggcgatattaacctgctggaccctgatacgtcccagagacaggttgattccacactggcggcctattccaaaatgatgtcaccactcaaaaatagtagtgacggtcttacctctcttaaccagagcaatagcactctcgtggctctaccagagggaagacaagagctcagcgacgggcaggtgaagactggaatctccatgagtctgttgactgtaattgagaaactaagagaacgaacagaccaaaacgcttccgatgacgacatcctgaaggaattgcaggataacgcccagtgtcagccaaattccgatacttctttgtctggcaacaacgtggtggagtacatccctaatgctgaaaggccctaccgctgcaggttgtgccattatacctccgggaacaagggttatatcaagcagcatctgcgggttcaccgacaacggcagccttatcaatgccctatatgtgaacacattgccgataattctaaggatcttgaaagccacatgattcatcactgcaaaacaagaatctatcagtgcaagcaatgcgaggagtccttccattataagagccagctccggaatcatgaaagggagcagcactcgctgcccgacactttgagcattgcaaccagcaacgaaccccgaatttcttctgacaccgccgatggaaagtgcgttcaagaggggaacaaatcttctgtgcagaaacagtaccggtgtgatgtgtgcgattacaccagtactacatacgtgggggtgcgaaatcaccgaagaattcataacagcgataaaccctaccggtgctcattgtgcggctacgtttgtagtcacccaccctcactgaagagtcacatgtggaaacatgcttctgatcagaattacaattacgagcaggtgaacaaggctatcaacgacgcgattagtcagtctggacgagtccttggtaaatcacccggcaagactcaactgaaatcgtccgaggagagcgccgatcccgtgacaggctcttcagaaaacgctgtcagttcatcagagctgatgagccagacccctagtgaggtgctgggaaccaatgagaatgaaaagctttctccgacaagcaataccagctattctctcgaaaaaatctcgtctctagccccaccttccatggaatattgcgtgctgttgttctgttgttgtatttgcggatttgagtccacatccaaggaaaatctgttagaccatatgaaggagcacgagggggagattgtgaacatcatcctgaataaagaccacaacacagctctgaacaccaattag

SEQ ID NO: 21707 - DNA, 2862 bp, Artificial Sequence
  Description of Artificial Sequence: Synthetic coding sequence
atggaggagagcagcagcgtggccatgctggtgcccgacatcggcgagcaggaggcgattctgaccgcagagtccatcatcagtccttcgctggagatcgatgaacagcggaagacaaaacctgacccactgatccacgtaatccaaaagttatccaaaatagtggaaaacgagaaatctcagaagtgccttctgatcggaaagaagcgaccacgtagcagtgccgcaacccacagtctggaaacccaagagctttgtgaaattccagctaaggttatccagagcccggcagctgacactcggcgcgcggagatgagccaaaccaacttcacacccgacacactagctcagaacgagggcaaagccatgtcctatcagtgcagtctgtgtaaatttcttagtagcagcttttcagtgctaaaggaccatatcaagcagcacggccagcagaatgaagtcatactgatgtgctcagagtgtcatattacttctaggtcccaggaggagcttgaagcacacgtggtcaatgatcatgataacgatgccaatatacacactcagtccaaagcccagcagtgtgtcagtcctagctcatccttgtgtaggaaaactaccgaaagaaacgagaccatcccggacattccagtgtctgtggacaatctgcaaacccataccgtccaaactgcctcagtggccgagatgggacgaagaaagtggtacgcgtatgagcagtacgggatgtaccgctgtctcttctgttcatacacctgcggacagcagcggatgctgaagactcatgcctggaaacatgcaggagaggtggattgcagctatcctatattcgaaaatgagaacgagccactgggccttctagattcaagtgccgcagcggcacctggaggagtagatgccgtcgtgatcgcaatcggggagtccgagttgagtattcacaacggtccttctgttcaggttcagatttgttcctcagaacagctatcatcaagttctcccctggagcaaagtgccgagaggggcgtccatctctcgcaatctgtgaccctggaccctaacgaggaggagatgcttgaagtgatcagcgatgctgaggaaaacctcatccccgactccctgctcacttcagcccagaagatcatcagcagttcgcccaacaagaaaggacacgttaacgtgatagtggagagactcccttcagccgaagaaacattaagccagaaaagatttttgatgaacactgagatggaagaggggaaggatctttcacttacagaggctcagatcggcagggaaggcatggacgatgtgtaccgagccgacaaatgtactgtcgacattggtggcctcatcattgggtggtccagtagtgaaaagaaggacgaactgatgaacaaaggcctggctacagatgagaacgctccccccgggaggagacgcacaaactccgaatctctccgactgcatagcctcgccgcagaagccctcgtaacaatgcctatcagggcggcagaattaacacgggccaacctggggcattacggggacatcaacctgcttgatcccgacacgagtcagcgccaggtggacagtaccctcgctgcctatagtaagatgatgagcccgctcaagaactcctcagatggactaacatccttaaaccagtctaattcgacactggtagcactacccgagggccgtcaggagctgagcgatggacaggtgaaaaccggaatctcgatgtccttactgaccgtgatcgagaagctgcgcgaacgaaccgaccagaatgcctcagatgacgatatcttaaaggagctgcaggacaacgctcagtgccagcccaactctgacacatctctctcaggcaataacgttgttgaatatatccccaatgccgagcgaccctaccgctgtagactgtgtcattatacaagcggcaacaagggctacatcaaacagcatcttagggttcaccgtcagcgccagccgtaccagtgccccatatgcgagcatatcgccgacaatagcaaagacctagagtcccacatgatccaccactgcaagacaaggatctaccagtgtaagcagtgtgaggagtcctttcactataagagtcagctgaggaatcacgagcgcgagcagcatagcctcccagacaccttgagtattgccacctccaatgagcctcggatttcaagcgatactgcggacggcaagtgtgtgcaagaagggaataagagctccgttcagaagcagtatcggtgcgacgtgtgtgattatacaagcactacctatgtgggagttagaaatcatagaaggattcataatagcgacaagccttatagatgtagcctatgcgggtacgtctgcagccatcccccaagtctcaagagtcacatgtggaaacatgcctccgaccagaattataactatgagcaggttaacaaggccataaacgacgctatatctcagtcagggagagtcctgggcaagtctcctggaaagacacagcttaagtcttccgaggagagtgctgacccagttacaggctcctccgagaatgctgtgtcctctagcgaattgatgagtcagaccccgagtgaggtcttaggtaccaatgaaaacgaaaagctcagcccaacgagtaacacaagctactccctcgaaaagatcagctctctggccccaccaagcatggagtactgcgtactgctgttctgttgttgtatatgtggattcgagagtacaagcaaagagaacctgctcgaccatatgaaggaacacgagggagaaattgttaatataattcttaacaaggatcataataccgcactcaacaccaactag

SEQ ID NO: 21708 - DNA, 2874 bp, Artificial Sequence
  Description of Artificial Sequence: Synthetic coding sequence
atggaggagagcagcagcgtggccatgctggtgcccgacatcggcgagcaagaagcaattttaacagctgagagcataatctcaccatccctcgagattgatgagcagcggaagacgaaacctgaccccctgatccatgtaattcagaagctatccaagattgttgaaaatgagaagtcacaaaagtgcctgcttattgggaagaaaagaccacgctccagcgcggctacacactctctggagacacaggaattatgcgaaatcccggcaaaagtcatccaatcccctgccgcagacacccggagagcagagatgtcccagactaacttcacacctgacacactggcccagaatgagggcaaggccatgagttatcaatgctcactgtgcaagtttttgagctcatcatttagtgtactcaaggaccacattaagcagcatggacagcaaaatgaagtaattctgatgtgctctgagtgccatataacttctaggtcacaggaagaactggaggcacatgttgtcaatgatcacgataacgacgcaaacattcatacacaaagcaaggctcagcagtgcgtgtcacctagttcctccctttgtagaaagacaaccgaaagaaatgagacgattcccgacattccagtgtctgtggataatttacaaacacataccgttcagacagcctcagtggctgaaatgggaaggcgtaaatggtacgcctatgaacaatacggaatgtacaggtgcttattctgttcctacacatgcggccagcagcggatgctgaaaacccacgcttggaagcatgccggcgaggtggattgctcgtaccctatcttcgagaatgaaaacgagcctctgggattgctggacagtagcgccgcggctgctccaggtggagtggacgctgtcgtgattgcaattggagagtctgagctctccattcataatgggccctccgtccaggtgcagatctgctcttctgagcaactcagctcttcgtctcccctggagcagtccgccgagcggggcgtccatcttagtcaaagtgtcaccctggaccctaatgaagaggagatgttggaggttatcagcgacgccgaggagaacctgattcctgactcccttctcacaagtgcacagaagataatttcctcaagcccaaacaagaagggccatgtgaacgtgattgtggagcggctgccctccgctgaagagactctaagccagaagcggttcctgatgaatacagagatggaagagggtaaggacctgtctctgacagaagcacaaatcggacgggagggaatggatgacgtctaccgggcagacaagtgcactgtggacatcggtggactgatcatagggtggtctagctcggagaaaaaagatgagttgatgaacaagggcctggcaaccgacgaaaatgccccaccaggacgccgcagaacaaatagcgagtccctccgtctccactctctagccgcagaagccctggtgactatgccaatccgcgccgctgaattgaccagagctaacctgggacactacggagacattaacctgttggatcccgatacatcccaaagacaggtcgacagcaccctggcagcttactccaaaatgatgagccctcttaagaactctagtgatggactaacttcactcaatcagagcaactcgactctggttgcacttccagaaggaagacaggagctgagcgacggccaagtgaaaactggcatctctatgagcctcctgactgtgatcgagaaacttcgcgaacgcacagatcagaatgccagtgacgacgacatcctgaaggagctacaagataacgctcagtgccagccaaactctgacaccagtctaagtgggaacaacgttgttgagtacattcctaacgccgaacggccctatcgatgtaggctctgccactacacgagcgggaacaagggctatatcaagcagcacctgcgcgtgcaccgacaacggcagccatatcagtgtcccatttgtgaacatattgcggacaattctaaagacctggagagccacatgattcaccattgtaaaacccgcatctaccaatgcaaacagtgcgaagaatccttccattataagtcgcagctgcgaaaccacgaacgcgaacagcattccttacccgataccttatctattgctacaagcaatgagccacggatttcaagcgataccgcagatggcaagtgcgtccaggagggtaataagtcttcagttcagaagcagtacaggtgcgatgtctgcgattatacatcaacaacatatgtgggcgtacggaaccatagacggatccacaatagcgacaaaccctaccgcaaggaatttcgttgtagtctgtgtggatatgtatgtagtcatccaccttccctgaaatcccatatgtggaagcatgcctctgaccagaactacaattacgaacaggtcaataaagcaatcaacgacgccatctcacagtccggcagggtgttaggcaaatccccgggaaagactcagctcaaaagctcagaagaaagtgcagaccccgttacaggctcttcggagaatgccgtgtcttcatccgaactgatgagtcagaccccgagcgaggtcctgggcaccaatgagaatgagaagctctcccccacctcaaacacgtcatattcattggaaaaaatctcttcactggcccccccctctatggaatactgcgtgcttttgttctgttgttgtatatgcggtttcgagtcaacttctaaagagaatctgctggaccatatgaaggaacacgaaggcgagatcgtgaatattatcttgaacaaggatcataatacagcacttaacaccaactag

SEQ ID NO: 21709 - DNA, 1689 bp, Artificial Sequence
  Description of Artificial Sequence: Synthetic coding sequence
atgagccggagcctgctgctgtggttcctgctgttcctgctgctgttacctcccctccctgtcctgcttgccgaccccggcgctcccactccagtgaatccatgttgctactacccttgtcagcaccagggtatttgcgtcaggttcgggttagatcgctaccagtgcgattgcaccagaactggatactcaggcccaaactgcacgattcccggactgtggacctggttgcgcaactcattaagaccaagtccctcttttacgcacttcttgttaactcacggcagatggttctgggagttcgtgaacgcaacgtttattcgggaaatgcttatgaggctagtgctcaccgtgcgatctaacctgattccctccccaccaacttataatagcgctcacgactatatctcatgggagtcatttagcaatgtctcttattacacgcgtatcctgccatccgtgcccaaggactgtccaacccccatgggtactaaagggaagaaacagctgcccgatgctcagttgctcgcaaggagattcttactgaggcggaagtttattcccgaccctcagggaactaacctcatgtttgcgttcttcgcccagcacttcacgcaccagtttttcaaaacttctggtaagatggggcctggcttcaccaaagccttggggcatggtgtggatctggggcatatttacggagataacctcgaacggcaataccaattaagactgttcaaagatggcaagcttaaatatcaggtgctcgacggggagatgtatcccccttcagtggaagaagcacccgtgttaatgcactacccacggggaatccccccacagtcacagatggctgtgggccaggaggttttcggtttactccccgggctgatgctctatgccaccctgtggctgagggaacataatagggtgtgtgacctcctgaaagccgaacatccgacctggggggatgaacagttgttccaaacgacccgcctgatccttatcggggagacaatcaaaatcgtgatagaggaatatgtgcagcagctgtcagggtatttcctccagctcaagtttgaccccgaacttctctttggagtccagttccagtaccgtaaccggatcgccatggagtttaatcatttgtaccactggcaccccctcatgcctgactcctttaaaataggaggtggacgtaatatggaccatcacattcttcatgttgccgtcgacgtgatccgtgaaagtagagagatgcgtctgcagccgttcaacgaataccggaaaaggtttgggatgaaaccctatacaagctttcaggagctcgttggggaaaaagagatggccgcggagctagaggagttgtacggagacatcgacgcactggaattttatcccggcctgctactcgaaaaatgccaccccaacagcatatttggagaatcgatgatagaaattggtgcaccttttagcctgaagggcctcctgggtaaccccatttgttcacccgagtactggaaaccaagcacctttggcggtgaggtgggcttcaatattgtaaagacagcaacgctcaaaaagctcgtgtgcctgaacaccaagacctgcccttatgtgtcttttagagtccccgacgcttctcaggatgatggccccgccgtcgagagaccttctactgagctgtag

SEQ ID NO: 21710 - DNA, 405 bp, Artificial Sequence
  Description of Artificial Sequence: Synthetic coding sequence
atgagcccccaccccgaggccatcaccgactgcgtgaccctgaacactgtcggtcagttggctgaaggcggctatccactcaggttttcaacacttttccaggagcaacagaagatgaatatcagccaagcttctgtgtcgttcaaagacgtaaccattgagttcactcaggaggagtggcagcaaatggcccctgtgcagaagaatctgtaccgagacgtcatgcttgaaaactatagcaatctggtttccgtcggctactgttgttttaaaccggaggtgatctttaagttggaacaaggcgaagaaccttggttttctgaggaggaattttccaatcagtcgcatcctagtgagctgctatccagctcacgccataatagcgccggagtagtcagactctag

SEQ ID NO: 21711 - DNA, 2052 bp, Artificial Sequence
  Description of Artificial Sequence: Synthetic coding sequence
atgagcccccaccccgaggccatcaccgactgcgtgaccctgaacacggtgggccagctggctgaaggcgggtatcctcttcgattttctactcttttccaggaacaacagaagatgaacatatctcaggcctctgtgtctttcaaggacgttacgatcgagttcactcaggaagaatggcagcagatggctcccgtgcagaagaatctttatcgggacgttatgctggaaaattactcgaacctggtgagcgtgggttactgctgttttaagcctgaagtgatattcaagctggagcagggcgaggagccctggttctccgaggaggagttcagtaaccagtcccaccctaaggactaccggggcgacgatctgatcaaacagaacaaaaaaataaaagacaaacacctggaacaagccatttgcatcaataacaagacgctcaccactgaagaggaaaaagtccttggaaagccttttacgctgcacgtagcagccgtagccagcactaagatgagctgcaagtgtaactcttgggaagtgaacttgcagagcattagcgaatttataataaataatcgcaattactcgactaagaagattggctgcggcaacgtctgtgagaattccccttttaagattaacttcgaaaagactcagactggtgagaagttttacgaacacaacaaaaacatgaaagctttaaactataatgagaatttgcctaaacatcctaaattccagactcttgaacaagcatttgagtgtaataagatcggcaaagcctttaacgacaaagccaactgtgtcaaacacaactctagccacaccggggaaacaagcagcaaggacgatgagttcagaaaaaactgcgataaaaagactctgttcgaccataggcgtaccggcaccgggaagaagcacctccatctgaatcagtgcgggaagtcgttcgagaagtctacagtggaggaatacaataagctgaacatggggatcaaacattacgagctgaacccgagcgggaataatttcaaccgcaaagcgcatctaactgatccccagacggccgtgattgaagagaacccgcttgtctctaacgataggacccagacatgggtgaagtcctctgaataccatgagaataagaagtcctaccagacttccgtgcaccgcgtccgacggcggagccactcaatgatgaagccgtacaaatgcaacgaatgcggcaaatctttttgtcagaaagggcatctgattcaacatcagcggacccataccggcgaaaagcctttcgagtgctcagagtgtggaaaaaccttttcacagaagtctcatctgtcaactcatcagagaattcacacggcagaaaaaccctacaaatgcaacgagtgcggcaaaacatttgtgcaaaaatccaccctcagaggtcaccagcgaatacacaccggtgagaaaccatatgagtgtagtgaatgcggaaaaacttttgtccaaaaaagtaccctccgggatcaccaccgcattcataccggtgagaagtccttccagtgtaaccagtgcggaaagacgttcggacaaaagagtaatctcaggatccatcaaaggacacataccggagaaaagacctatcagtgtaacgaatgtgagaaatccttctggcggaaggaccatctcattcagcatcagaagacacacaccggcgaaaagccattcaaatgtaatgaatgcggaaagacatttgcacggacgagtacactgcgggtgcaccaaagaatccataccggtgaaaaaccttttaaatgcaacgagtgcggtaaaaagtttgtcagaaaagcaatactgagtgaccaccagcgtattcacacaggggaaaagccctttcagtgcaataagtgcggcaagacatttggtcagaagtctaatcttcgcatccatcaaagaacccattcaggcgagaaaagctacgaatgcaatgaatatggcaagctctgcaagaaaagtaccttgagtctgtatcagaagattcagggagagggtaatccttattag

SEQ ID NO: 21712 - DNA, 789 bp, Artificial Sequence
  Description of Artificial Sequence: Synthetic coding sequence
atgcagctgccccccgccctgtgcgcccggctggccgccggccccggcgcagccgagccattacccgtggagagggatcccgcagcaggagcggcaccatttaggtttgtggctcgacctgtgagattccctcgggagcaccagttcttcgaggacggcgatgtgcagagacatctctacctgcaggacgtgatcatgcaggtggccgatgttcccgaaaaacctagagtcccagcattcgcatgtcaagtcgcaggctgctgccaggtcttcgacgctctggacgattacgaacaccactatcataccctccacggaaatgtgtgcagcttctgtaagcgtgccttcccatccggccatcttttagacgcacatattctcgaatggcatgatagcctgttccagattctatctgaaagacaggacatgtatcaatgtctggtggagggatgcaccgaaaagtttaagacatccagagataggaaggaccacatggttcgcatgcatctgtacccagcagatttccggttcgacaaaccaaaaaagagtcgctctcctgcctctgctgaggccccaggcgattccggagagaggagcgaaggggaggccatggagatatgctccgaaccggtcgccgctagcccagcccccgcgggggagaggaggatctaccgacaccggagcgtgtccgagcttttcctgaagccagtactgaatatgtgcagtgtgcttaggatattgggatgcacatgggctgccgcccttctgatcctgaacagcgagcgttag

SEQ ID NO: 21713 - DNA, 759 bp, Artificial Sequence
  Description of Artificial Sequence: Synthetic coding sequence
atgcagctgccccccgccctgtgcgcccggctggccgccggccccggggctgccgaaccgctgcctgttgagcgtgatccagcggcgggcgccgccccattcaggttcgtagcacggcctgtgagattccccagagagcaccagttcttcgaggatggggatgtgcagcggcacctgtacctgcaggatgtgattatgcaggtggcggacgttcctgagaagcctagagtgcccgcctttgcctgccaggtcgctggctgctgtcaggtctttgacgctctggatgactatgagcaccactaccatacattgcacgggaatgtttgcagtttctgtaaaagggcctttccctcgggccacctgctggacgcacatatcctcgaatggcacgattcattatttcagatccttagcgagagacaggacatgtaccagtgccttgtcgaagggtgtactgagaagttcaagaccagtcgggacaggaaagaccatatggtcaggatgcatctgtacccagcagattttcggttcgataagccaaaaaaatcccgcagccctgcatctgcagaggcccccggcgacagtggcgaacgcagtgaaggcgaagcgatggaaatttgtagcgagcctgtcgccgctagtcccgcacctgccggggaacgaagaatctaccgccaccggatcccttcaaccatctgctttggtcagggcgccgcacgaggctttaagagtaataagaagaaaaccaagcagtgttag

SEQ ID NO: 21714 - DNA, 933 bp, Artificial Sequence
  Description of Artificial Sequence: Synthetic coding sequence
atgcaggtggccgacgtgcccgagaagccccgggtgcccgccttcgcttgccaggtggcaggatgctgccaggtgttcgacgcgctggacgattacgagcatcattatcacaccctgcatggcaatgtgtgtagcttctgtaaacgggcgttcccgtctggccatctgctcgatgctcacatcctcgaatggcacgactcgctcttccagatcctgtcagagcgtcaggatatgtatcaatgtctagtcgagggatgcaccgagaaatttaagacgtcgcgcgaccgaaaggaccatatggtgcgcatgcacctctatccggcagattttcgctttgataaacccaagaagagccggagtcccgcttctgcagaggcccctggagatagcggcgaaaggtctgaaggcgaagcgatggagatctgcagcgagccagttgcagcaagtccagccccagctggagagcgaagaatatataggcaccggttgctcttggtgacctctctggtggtggtactcttatgggaagccggcgccgtgccagctccaaaggtgcccattaaaatgcaggttaaacactggcccagcgagcaggaccccgagaaggcttggggcgctcgcgtcgtagagcctccagagaaagacgaccagctggtggttctcttccccgtgcagaaacctaagctgttgactactgaagagaaaccaagaggacagggacggggacccatcttgcctgggacgaaggcctggatggagacagaggacacgctggggcacgtcttatccccagagcccgatcacgactccctgtatcatcctccccccgaggaagaccagggggaggagcggccacggctctgggtgatgccaaaccatcaagttctgcttggtccagaggaggaccaagatcacatttatcatccccagtag

SEQ ID NO: 21715 - DNA, 1704 bp, Artificial Sequence
  Description of Artificial Sequence: Synthetic coding sequence
atgagcagccggctgggcgccgtgcccgccaccagcggccccaccaccttcaaacagcaacgctccacaaggattgttggagcgaaaaacagcagaactcagtgcagtatcaaagataactccttccaatatacaatcccgcacgatgacagcctatcaggatcaagcagtgccagttcctgtgagcccgtatcagatttcccggcatcttttcgcaagagcacatactggatgaagatgcggaggataaagcctgcagccacctcacacgtcgaagggtcaggtggagtgtccgcgaagggaaaacgaaaaccgaggcaggaggaggacgaagactatagagaattccctcagaagaaacacaagctgtacggaaggaagcagaggccaaagacccagcctaatcctaaatctcaggcgcgaaggatccggaaggagccccccgtttacgcagcagggtctttagaggagcagtggtacctagaaattgtcgacaaaggaagtgtcagctgtcccacttgtcaggccgtgggccgaaagaccatcgaaggactcaagaagcacatggagaactgcaaacaggagatgttcacttgtcatcattgtggcaagcagctgagaagtctggcaggtatgaaatatcacgtaatggccaaccataactcactcccaattttgaaggccggcgatgaaattgacgagccctccgaacgggaaaggttgcggaccgttctaaaacgcctcggcaagctgcggtgtatgagggagtcatgtagctcttcctttaccagcatcatgggctatctttaccatgtgcgtaagtgcggcaaaggagctgccgagctcgaaaaaatgaccctcaagtgtcaccattgtgggaagccatataggagtaaggccggacttgcttaccacctccgctccgaacatgggccaataagtttttttcctgaatcagggcagcctgagtgcctcaaagagatgaaccttgagagcaagtctggcgggagagtacagcgcagaagcgctaagatcgcagtataccacctgcaggaactcgccagcgcagaactggcaaaagaatggcccaagcggaaagtcctgcaggacctggtgccagacgatcggaaattaaaatatactcgtcctggtttacccactttcagtcaagaagtgctccataagtggaagaccgacattaaaaagtaccaccgtatacagtgtcctaaccagggatgcgaagcagtctattcgtccgtctcgggactgaaggcgcacttgggttcatgtactctagggaacttcgtggcgggaaagtacaagtgtctcttatgtcagaaggaattcgtcagcgagtccggcgtgaagtatcacatcaacagcgtgcacgccgaagattggtttgttgttaatccaacgaccacaaagtccttcgagaagttgatgaaaatcaaacagcggcagcaagaggaagagaagagacgccagcaacaccggtctagacgctccctgcgccggcgccaacagcctgggattgagctgcctgagacagagctttcacttcgggttgggaaagaccagaggaggaacaacgaggaattggtggtctcagccagttgcaaagagcctgaacaagaacccgttcccgcccagtttcagaaagtgaaaccacccaaaaccaaccacaagaggggcagaaagtag

SEQ ID NO: 21716 - DNA, 1701 bp, Artificial Sequence
  Description of Artificial Sequence: Synthetic coding sequence
atgagcagccggctgggcgccgtgcccgccaccagcggccccaccacgtttaagcagcagagaagtacaagaatcgttggcgcaaagaatagaacccagtgttcaattaaggataacagctttcaatacacaatcccccatgatgatagcctctccggatccagctccgcaagcagctgcgaaccagtgtctgacttccccgcgtctttcaggaaaagtacatactggatgaagatgcgcagaatcaagccagccgcgaccagccacgtagaaggcagtgggggagtctcagcaaaaggtaaaagaaaacccaggcaggaggaggacgaagattaccgggaattcccccagaaaaagcacaagctttacggaagaaagcagaggcccaagactcagcccaaccctaagagccaggcccggcgcattcgcaaggagcccccagtgtacgctgccggatctctggaagaacagtggtacctggaaatcgtggataagggcagcgtttcctgtcccacttgtcaggcagtgggacgcaaaacaatcgagggtctgaaaaaacatatggaaaactgcaagcaggaaatgttcacctgtcatcactgcgggaagcagctgcggtcactggcaggcatgaagtatcacgtgatggctaaccacaacagcttaccaattttgaaggcaggggacgagatagacgagccatccgagcgcgaaaggctaagaactgttctaaaaaggcttggtaaactgcggtgtatgcgtgaatcctgtagttccagctttacatctataatgggatacttgtaccatgtgagaaaatgtggaaagggagctgcagagctcgagaaaatgactctgaagtgtcatcactgtgggaagccctacaggtcaaaagccggcctagcctaccatctgcggagcgaacacggtcccatctctttttttcctgaatcaggacagccggagtgcctcaaggagatgaaccttgagtcaaagtccgggggccgcgtgcagagaaggtccgccaagattgccgtgtaccatcttcaggagctcgcttccgccgaactcgccaaagaatggcccaaaagaaaggtccttcaggatctggtgcccgatgataggaaattaaaatatacaagacctggcctcccgacattttcccaagaggtgctgcataagtggaagaccgacattaaaaagtatcacaggatccagtgtcccaaccaaggttgtgaagcagtgtatagctccgtttcaggactgaaagctcatctcggcagctgcacactagggaacttcgtggcaggtaaatataagtgcttactgtgtcagaaggaatttgtgagtgaatctggcgttaaataccacatcaatagcgtgcacgctgaggattggttcgtggtgaaccccacaaccacgaaatcctttgagaaactgatgaagattaaacagcgacaacaggaggaagagaagcgccgccagcagcacaggagcagacggagcctgagacggaggcaacagccgggcatcgagttgccagaaaccgagcttagcctgagggtaggaaaggaccagcgaaggaataatgaagagctggttgtttccgcatcgtgcaaggaaccggagcaggaacctgtcccagctcagttccagaaagtcaagcccccaaaaaccaaccataagcggggccgcaaatag

SEQ ID NO: 21717 - DNA, 1473 bp, Artificial Sequence
  Description of Artificial Sequence: Synthetic coding sequence
atgaagatgcggcggatcaagcccgccgccaccagccacgtggaggggtctggaggagtgtccgctaagggaaaaaggaagcccaggcaggaagaggacgaggattacagagaatttccccagaagaagcataagctgtatggcagaaagcaaagaccgaaaacccaacccaaccctaagagtcaagcgaggagaattcgaaaggaaccaccggtatatgccgctgggtcactggaggaacagtggtacctggaaattgtcgataaaggctcggtgtcctgtcctacctgccaggctgtgggacggaagaccatagaaggcttgaagaagcacatggagaactgcaagcaagaaatgtttacttgccaccattgcggcaagcagctgagaagcttagccggcatgaaataccacgtgatggcaaatcataattcactaccaatactaaaagccggtgacgaaatcgatgagccttcagaacgggagaggcttcgaacggtcctcaagcgccttgggaagctccggtgtatgagggaatcatgttcaagcagtttcacttctatcatgggctatctgtatcacgtccgcaagtgcggtaaaggagcggctgagctagagaagatgacactgaaatgtcaccactgcggcaagccctatcgaagcaaggctggtctggcatatcacttaagaagtgagcacggccctattagcttctttccggagagcgggcaacccgagtgtcttaaagagatgaacttggagtctaagagtggaggcagagtacagaggcgcagcgccaagatcgccgtgtaccatcttcaggaattggcttctgcagaattagccaaagagtggcccaaacggaaggtcctgcaggatttggtgcccgatgacaggaagctgaagtatactcgcccgggcctgcctaccttttcacaggaagtgctccacaagtggaagacggatatcaagaagtaccacaggatacagtgcccaaaccaaggatgcgaggctgtctactcttccgtatctggactgaaggcccatctgggttcctgtacccttgggaactttgtagccggtaagtataaatgcctgctgtgccaaaaggagtttgtctcagagtctggggtgaagtaccatatcaactctgtgcacgctgaggattggtttgtggtgaaccccaccactaccaagtcttttgagaagcttatgaagatcaaacagcggcagcaggaagaagaaaaaaggcggcagcaacaccggtctcggagatctctgcgccggcgacaacagcctggtatcgagctgcctgagactgagctgagtcttcgagtcggcaaagatcaaagaagaaataacgaggaacttgttgtgagcgccagctgcaaggaacccgagcaggagcccgtcccagcgcagtttcagaaggtcaaacctcccaagacaaaccacaagcgggggaggaagtag

SEQ ID NO: 21718 - DNA, 1617 bp, Artificial Sequence
  Description of Artificial Sequence: Synthetic coding sequence
atgagcagccggctgggcgccgtgcccgccaccagcggccccaccactttcaagcagcaacgcagcacacgcatcgtaggtgctaaaaaccgaacacagtgctcaattaaagataatagctttcaatacaccattccgcatgatgactctttgagcgggtcctcctctgcttcttcctgtgagcccgtttcggactttccagcatcattccgaaaaagtacttactggatgaaaatgaggaggattaagcctgccgccacttcgcacgtggagggtagtggaggcgtgtctgcaaaaggcaaacgcaagccaaggcaagaggaagatgaggattatagagagttcccacagaaaaagcacaagctgtatggcagtctggaagagcagtggtacctcgaaatcgtggataaaggtagtgtctcatgtcccacgtgccaagccgtcgggcgcaagacaattgaggggctgaaaaagcacatggaaaattgcaagcaggaaatgtttacctgtcaccactgtggaaagcagctacgaagcctggcaggaatgaaataccacgttatggcaaaccataatagtctgcccattctgaaggccggggatgaaatcgacgagcccagcgagcgggagaggctgagaaccgtgttaaagcgactggggaaactaaggtgcatgagggaatcgtgttcatctagttttacctctatcatgggatacttataccacgtgagaaagtgtggtaagggggccgctgaattggagaaaatgactctgaagtgccaccactgtggtaagccgtatagatccaaggcagggctggcctaccacctaagatctgagcatgggcctattagcttctttcctgaatctggccagcccgagtgtctgaaggagatgaacctagagagcaagagtggaggtcgcgttcagcgccgctctgcaaaaatagctgtgtatcacctgcaggagctggcgagcgcagagctggccaaagaatggcctaagcggaaggtacttcaggacctagtccccgatgacaggaagctcaaatacacaagacctggtctgcctacctttagtcaagaagtattgcacaaatggaagaccgacatcaaaaaataccaccggattcaatgcccaaaccaggggtgcgaggccgtctactccagcgtcagtggtctgaaagcccatttgggaagctgcactttgggtaactttgtcgccggtaagtacaagtgtctgctgtgccagaaggaattcgtatcagaatctggagtgaagtaccatataaacagcgtgcatgctgaggactggtttgtggtgaacccaacaacgaccaagtcctttgagaagctaatgaagatcaagcagagacagcaggaggaagaaaagcggcggcagcagcataggagtcgccgtagcttgagacgacggcaacagccaggcatcgagttaccagaaaccgagttatctctccgcgtaggaaaggatcagagaagaaataatgaggagctggtggtttccgcctcatgtaaagagcccgaacaggagccagtgcccgcacagttccagaaagttaagcccccaaaaaccaatcacaagcgtggacggaaatag

SEQ ID NO: 21719 - DNA, 1158 bp, Artificial Sequence
  Description of Artificial Sequence: Synthetic coding sequence
atgagcaagggccaggtggagtaccagccccggggcaagggcaacccagggagaaaaaaaatgaagaccatagagaattttcttcgccggagtatttcatttatggggggaagtaacgggttgaaactgtcaccaataccaaaccccagacctgtagtgtttggaagaaaccaccaattcatgcagcaggagatgttcacatgtcatcattgcggcaaacagctgagaagtttagcaggaatgaaatatcatgtgatggctaatcacaattcgctgccgatcctcaaagccggggacgaaattgatgagccctctgagcgggagcgtttaagaaccgtgttaaaacgccttggcaagctccggtgcatgagggagtcttgcagttcaagctttactagtataatggggtatctgtaccacgttagaaagtgcggaaaaggggctgcagaactggagaaaatgacgctcaaatgtcaccattgcggcaaaccctaccgatccaaggcaggcctggcctatcatctccgctccgaacacgggcccataagtttctttccagaaagcggacagccagaatgtctgaaggagatgaatctcgagtctaagagtggcggcagagtgcagaggcgctctgccaaaattgccgtttaccaccttcaagaacttgcctcagctgagttggccaaggagtggccaaaaaggaaggtcctccaagacctggtgcctgatgaccggaaactgaaatatactcgccccggcttgcccaccttctcacaagaggttctgcacaagtggaagactgacatcaaaaagtaccacagaatccaatgccctaaccagggttgcgaagctgtgtatagcagcgtgtccggccttaaggcccacctgggatcttgcactctggggaacttcgttgccggaaagtataagtgcttactctgtcagaaggagttcgtgtctgaatcaggggtgaagtatcacattaatagtgtacatgctgaggattggttcgtagtcaaccctacaacgactaaatcgttcgaaaaactgatgaaaatcaagcagcgacaacaggaagaagaaaaaaggcgccagcagcaccgcagtagaagaggatctcaggacacatgtatgcccaaggccttgcatcggatgtag

SEQ ID NO: 21720 - DNA, 690 bp, Artificial Sequence
  Description of Artificial Sequence: Synthetic coding sequence
atggacagcgccggccaggacatcaacctgaacagccccaacaagggattgctttccgattcaatgactgatgtacccgtggacacaggagtggcagctcggacgccggcagtggaaggtttgactgaggccgaagaggaggagctccgggccgaactgactaaggtcgaggaggaaatcgtgacactacggcaggtgttggcagcgaaagagcggcactgcggcgagctgaagcgacgcctgggcttgtcaactttgggagagctaaagcagaatctgtctcgctcttggcacgacgtgcaagtcagttccgcatacgtgaagacatctgagaaactcggtgagtggaatgagaaggtgacccagtccgacctctataagaagacccaggagaccctgagtcaggctggccaaaaaacctccgccgcgttgtcgaccgtcggatcagcgatcagtcggaagctgggtgacatgagagcacaccccttcagccactctttcagtagctatagtattagacatagcatttccatgccagccatgcgcaactctgccacctttaagagtttcgaggacagagtcgggactatcaaatccaaagtcgtcggggatagagaaaatggcagcgacaatttgcccagcagtgccggtagtggagacaagcccctaagtgacccggcacctttttag

SEQ ID NO: 21721 - DNA, 2679 bp, Artificial Sequence
  Description of Artificial Sequence: Synthetic coding sequence
atgaccgaccccttctgcgtgggcggccggcggctgcccggcagcagcaagagtggacccggaaaagacggaagcagaaaggaagtgcgcctgccaatgcttcacgatccacccaagatgggaatgcctgtagtgcgcggtgggcagactgtgccagggcaagcaccactgtgctttgacccaggttctccagcatccgacaagactgaaggcaaaaagaaagggcggcccaaggctgagaaccaggccttgcgtgacatcccgctgtccctcatgaacgattggaaggatgaattcaaagctcattctcgcgtgaagtgcccgaattccgggtgctggctcgaattcccctctatttatggcctcaagtaccactaccagcgatgtcagggcggagcgatctccgacaggctggccttcccatgcccgttttgtgaggccgcgttcacctcgaagacgcaattggagaaacataggatttggaaccatatggatcggccactccctgcaagtaagcctggccccatctcgcggccggtaaccattagccgtccagtgggcgtgagtaagccgatcggggtctcgaagcctgtcactatcgggaagcctgtgggcgtgagcaaacctatcggaattagcaagcctgtgagcgtgggccgtcctatgccagtcaccaaggcaatccccgtcacacgccccgtaccagtaactaaacctgtaacagtgtcgcgcccaatgcccgtgacaaaggccatgccggtaacaaagccaatcaccgtgacaaaatccgtgccagtgactaagcctgtgcccgtcacaaaacccataacggttaccaaactggttactgtcactaagcctgtgcctgtcacaaaacccgtcacagtgtcccgacctattgtggtgtccaagcccgtgactgtctcccgcccgatagccatatccagacacacacccccatgtaagatggttctgctcacccgctctgagaataaggctccccgcgcaactggtagaaactctgggaaaaagcgagccgccgatagcttggacacctgcccaattcctcctaaacaggctcgcccggagaacggcgagtacgggccctccagtatgggacaatctagcgcattccagctgtccgccgatacatcgtccgggtccctgtccccaggctcccgtcctagcgggggcatggaagccttgaaagcggccggccctgcatctccacccgaggaggatccagagaggactaagcaccgaagaaaacagaaaaccccaaagaaattcaccggagagcagccctccatatcaggaacctttggactgaagggactggttaaagctgaagacaaggcccgcgtgcatcgctctaagaagcaggagggcccaggacccgaggacgcgcggaagaaagtgcccgccgcaccaatcaccgtgtccaaagaggcgccagctccagtagcccaccccgccccaggaggcccagaagagcaatggcaacgggctatccatgaacgaggcgaagcagtgtgccctacatgcaacgtggtgacaagaaagactctagtcgggttaaagaagcatatggaggtatgtcagaaactccaagacgcgttaaagtgccagcattgcagaaagcagttcaagagtaaggccggactcaactatcacacaatggcagagcattcagccaagccgtccgatgccgaagcctccgagggcggggagcaggaggagcgcgaaagactaagaaaggtcctgaagcagatgggaagactgagatgtccacaggaagggtgtggtgctgccttctcgtcattgatgggctaccagtaccaccagcgacggtgtggcaaaccgccttgcgaggtggattctcctagctttccttgtactcactgcggcaaaacatatcgctcgaaagccggccacgattaccacgtcaggtcagagcacaccgcccctccaccagaggaacctaccgacaagagccccgaggccgaagacccactcggagttgaaaggaccccctctggccgggtccgaaggacctccgctcaggtggctgtgtttcatctgcaagagattgcagaggacgaactggcacgggactggactaaacgccgaatgaaggatgatttagtgcctgaaaccgcccggctgaattatacccgtccagggttgccgacacttaacccccaactcttggaagcctggaaaaacgaagtgaaagagaaaggacatgtcaattgccctaatgactgctgcgaggccatttattcctccgtgtcaggcctgaaggcccatctggcaagttgtagcaagggtgctcaccttgccggtaagtacagatgtctactgtgcccgaaggaattcagctccgaatcgggtgtgaagtatcacatcctgaagacccacgctgagaactggtttcgaacatccgccgatccaccaccgaagcaccgcagtcaggattccctagtcccgaagaaagaaaagaaaaagaacttagcagggggaaaaaagcgcggcaggaaacctaaagagagaactcccgaagaacccgtggctaagctgcctccacggcgggatgattggccacctgggtgcagggacaagggggccaggggttcaacaggacggaaggtgggagtcagcaaagctcctgagaagtag

SEQ ID NO: 21722 - DNA, 2679 bp, Artificial Sequence
  Description of Artificial Sequence: Synthetic coding sequence
atgaccgaccccttctgcgtgggcggccggcggctgcccggcagcagtaagtcagggcctggaaaggatgggtcacggaaggaggtgcggttgccaatgcttcacgatccccccaaaatgggtatgcctgtggttagggggggccaaacagtcccggggcaggccccgctctgcttcgaccctggctcacccgcttccgataagaccgagggaaagaagaagggacgacctaaagccgagaatcaggccttacgggacattccactctccctgatgaacgactggaaggacgagtttaaagcacactcgcgggtgaaatgccccaattctggatgttggctagagttcccgtctatatatggcttgaaatatcattaccagcggtgtcagggaggggcgatatcagaccggctcgcttttccatgtcctttttgtgaagctgcttttacaagcaaaacccagctggaaaagcaccggatttggaatcacatggaccggcctctcccagccagcaaacctggcccgatctcacgccccgtcactatttctcgaccggttggggtaagtaagcctatcggagtttccaaacctgttaccattggcaagcctgtcggcgtgtcaaagcccatcggcatctctaaaccagtgtcagttggtcgtcccatgcctgttaccaaagccatccctgttacccgacctgtgccagtgaccaagcctgtgacagtttcccgaccgatgcccgtgactaaggcgatgcccgtgaccaaacctattactgtgaccaaatccgtcccagtgacaaaacctgtgcccgtcaccaagcccataacagtaaccaagctggtgactgtcactaaacccgtgcccgttactaagccggtcactgtttctagacccatcgttgtgagtaagcctgtgaccgtttccagacccattgcaataagcaggcacactccaccatgtaaaatggtcttgcttactaggtccgaaaacaaggcacccagagcaaccggccgtaacagcgggaaaaagcgtgctgccgactcgttggatacatgccctatcccacctaagcaggcccgtcctgagaacggagagtatggcccctcatctatgggccagtcatcagccttccagctgagcgctgacaccagcagtggctccttgagtcccgggtctagaccctcaggaggaatggaagctctgaaagcagccggcccagccagtccacctgaggaagaccctgagaggactaagcacaggagaaaacagaagacccccaaaaaatttactggcgaacagccatctattagcggcacttttggcttgaagggcttagtcaaagcggaggataaagcaagagtgcaccggagcaagaagcaagaagggccgggccctgaagacgctcgaaaaaaagtccccgctgcacccattaccgtgagcaaggaagcccctgcacctgttgcccatccagctcccggaggacccgaggagcagtggcaacgagccatccatgaacggggcgaggctgtgtgtcctacctgtaacgtagtgacaaggaaaactttagtaggattgaagaagcacatggaagtgtgccagaagcttcaggacgccctgaagtgccagcattgccgtaaacagtttaagtctaaagctggtctgaactatcatacgatggccgaacatagtgccaagcctagtgacgcggaggccagcgaaggcggagaacaggaggaaagggagcgcctgcggaaagtgctcaagcagatggggagactgcgctgcccccaagagggatgcggcgcagctttttccagcctcatggggtatcagtaccatcagcggcgctgcggaaagccgccatgcgaggtcgattccccatcctttccatgtacacactgcgggaagacttaccggtccaaggcggggcatgattaccacgtccgcagcgagcacaccgcccctccacccgaagagcccacggataagagccccgaggcagaagaccctttgggtgtagaacggacaccttctggtagggttaggcggacatcggcccaggtggctgtgttccacctgcaggaaatcgctgaagatgagctggctcgtgactggaccaaacggcggatgaaagacgaccttgtccccgagaccgctaggctgaactatactcgtcctgggctccccacgctgaacccacagctgctggaggcatggaagaatgaagtcaaagaaaaagggcacgtgaactgtcccaacgactgttgtgaggcaatctactctagtgttagcggactgaaagcccacctcgctagttgttctaagggagctcatctggctggcaaataccgctgcctcctgtgcccgaaggaattttcttctgaaagcggggtaaagtaccacatcctcaagacccatgctgagaattggtttcgcacatctgccgacccacctcccaagcatagaagccaggacagcctcgtgcccaagaaggaaaagaagaaaaatctggccggaggcaagaagcgcgggagaaaaccaaaagagaggacacctgaggaacctgtggctaagcttccaccccgaagagatgactggccaccaggctgccgggacaagggagccaggggaagcaccggtcgaaaggtcggggtatccaaagcaccggagaaatag

SEQ ID NO: 21723 - DNA, 1203 bp, Artificial Sequence
  Description of Artificial Sequence: Synthetic coding sequence
atgaccttcgaggacgtggccgtggagttcagccagtgggagtggggccagttaaatccagctcaaaaggatttataccgggaggtgatgctcgaaaacttccggaatctagccattcttggtctgctggtctctaaaccgtacgtgatttgccagctcgaagagggaggggagccgtttatggtagagagagaaatcagtacaggcgctcactcagattggaagagacggagtaaatcgaaggagagtatgccctcatggggcattagtaaagaagaactgttccaggttgtctctgtggagaaacatattcaggacgtcctgcagttttccaaactgaaggctgcctgcggatgcgacggtcagctggagatgcaacaaattaaacaagaacgacacttaaagcagatgagcacaatacataaatccgcaactaccctgtctcgcgactataaatggaacggcttcggtcgaagcctggggctccgctctgtcctagtgaaccagcacagtatactgatgggggaaggaagttataagtgtgatacagaatttaggcagacgctcggaggcaataactcacaacggactcatcctgagaaaaagtcctgtaagtgtaatgagtgtggcaagtccttccacttccagtccgagctgcgcagacatcaacggtgtcacactggtgagaagccgtatgaatgctctgactgtggaagagcctttggccatatatcttcactcatcaagcaccagcgaacccacaccggtgagaagccctacgaatgcagcgagtgtggtagggcattttctcagagttcctctctggtgctgcactataggtttcataccggagaaaagccttataagtgcaacgagtgcggtagggcgtttggacacacttcttctctgatcaagcaccaacggacacatacaggtgagaaaccttatgagtgccgtgaatgcggcagaacattctcccaaagcagtagcttaatcgttcattaccgctttcacactggtgagaagccttacaaatgtaacaaatgtggacgagctttctcccaaagctcttcactgacccagcactaccgtttccatactggggagaaaccgtataaatgtaatgaatgtggcagggccttcgcccacacggcgagtctgatcaagcaccagagaagtcatgcgggcaagaaaaccctgtag

SEQ ID NO: 21724 - DNA, 1203 bp, Artificial Sequence
  Description of Artificial Sequence: Synthetic coding sequence
atgaccttcgaggacgtggccgtggagttcagccagtgggagtggggacaactgaatcccgctcaaaaagacctttatagggaggtgatgttagagaacttccgtaaccttgctatattgggactcctggttagcaaaccttacgttatttgtcagctggaggagggcggagagcccttcatggtggagagggaaatttctacaggcgcacactcggattggaaacgccggagtaagtctaaagaatcaatgccctcatggggaatttcaaaggaagaactgttccaggtggtgagtgtcgagaagcatatacaggatgtcttacaattcagtaagctcaaggccgcatgcggctgcgacggccaacttgagatgcagcagatcaaacaggaacgacacctgaagcagatgtcaaccattcataaatcagccacgacgttgtcccgtgattataagtggaacggcttcggccgaagcctgggcttaagaagtgtgctggtcaaccagcactccatcctgatgggggagggatcctataaatgcgataccgagttcagacagaccctgggtgggaataactcacagagaacacaccccgagaagaagtcatgtaaatgtaatgagtgtgggaagtcttttcattttcagagtgagctacgtcgccatcaacgatgtcacactggggagaagccctatgagtgttccgattgcggacgggcatttggacatatcagctccctgattaaacatcagcgcacacacacgggagagaagccctatgaatgctctgagtgtggaagggcattttctcagtccagttctctggtcctgcattacaggttccatacaggcgagaagccctacaagtgtaacgaatgcggaagggctttcggccacaccagttcacttattaaacatcagcgcactcatacaggcgagaaaccttatgagtgtcgcgaatgcggccggacattctctcaaagtagcagtttgatcgtgcactacagatttcataccggcgagaagccatataagtgcaacaagtgcggtagagcattttctcagtcatcctcgttgacacagcactatcggtttcacaccggggagaaaccttacaagtgtaatgaatgtggacgcgcctttgctcacacagctagcctgatcaagcatcagaggagccacgccgggaaaaagacgctttag

SEQ ID NO: 21725 - DNA, 162 bp, Artificial Sequence
  Description of Artificial Sequence: Synthetic coding sequence
cagagcgagctgcggcggcaccagcggtgccacaccggcgagaagccgtatgagtgctctgactgtggtcgcgcattcggacacatttcgtccttgatcaagcatcagttgatactcgagaaaagtccaatgaacgccgttaacgtgggggaaccgtcatag

SEQ ID NO: 21726 - DNA, 3492 bp, Artificial Sequence
  Description of Artificial Sequence: Synthetic coding sequence
atggaccggaaccgggaggccgagatggagctgcggcggggccccagtcccactagagctggaagggggcacgaagtggacggagataaggcaacatgtcatacatgttgcatatgtgggaaatctttcccattccagagtagcctatctcagcacatgcgaaaacatactggcgagaaaccgtataaatgtccctattgtgaccatagagcgagccagaagggaaacctgaagattcatataaggagtcacaggacaggtaccctcattcaggggcacgagcctgaggcaggagaagctccccttggagagatgcgcgcatctgaggggctcgacgcgtgcgccagccctaccaaatctgcctcagcttgtaacagacttctgaatggcgctagtcaagcggatggagcacgggtgctgaatggagcctcccaggccgacagcgggagggttctgctgagatcctccaaaaaaggcgcagaaggatctgcttgcgcacctggggaggccaaggcagccgtgcagtgtagtttctgcaagtcgcagttcgaacgaaagaaagacttggaactacacgttcaccaggctcacaagcccttcaaatgtcggctgtgtagctatgccacacttagagaggagagcttgctgtctcatatagagcgggaccacatcaccgctcaaggtccagggtcaggagaagcctgtgtagagaatggcaaaccggaactgagccccggcgaatttccttgcgaggtttgtggccaggcattctctcagacctggtttctaaaggctcacatgaagaagcatagaggttcattcgaccacgggtgtcatatttgcggccgtaggtttaaggaaccatggttcctcaagaaccacatgaaggcccacggacccaaaaccgggagcaagaatagacccaagtcggaacttgacccaattgctactataaataatgtcgtacaggaggaggtcatcgtggcaggcctctctttgtacgaggtgtgtgcgaaatgtgggaacctgttcaccaatcttgattccctgaacgcccataatgctatacacagaagggtggaggcttcaagaacccgcgcccccgctgaggagggggctgagggaccgtctgacactaaacagttcttcttgcagtgcctgaacctcagacccagcgctgccggggactcctgccccggaactcaggccggccggagggtggctgagttggacccggtaaacagctaccaggcctggcaacttgccacacggggaaaagtggccgagccagccgagtatttgaaatacggcgcttgggatgaggccctagctggggacgtggcctttgacaaggaccggagagagtatgtgctggtgagccaggaaaaacggaagagggagcaagacgctcccgccgcccagggtcccccccgcaagcgcgcaagtgggcctggtgaccccgcccccgcaggccacttggatccaaggtccgccgcccgcccgaatcgacgcgccgctgccacaacagggcaagggaaaagttctgagtgctttgaatgtggaaagatctttcgcacctatcaccagatggtcttacactcgcgggttcatcgaagagcccggcgggagcgggattctgatggagatcgcgccgcacgtgcaaggtgtggttcactgtccgaaggcgatagcgccagtcagcctagtagtcccggtagcgcatgcgcggccgcagacagccctgggtcgggtctggctgacgaggctgctgaagactctggagaggagggcgctccggaaccagctccaggtggccagcctagaagatgctgtttttccgaagaggtgacttcaacagagctttccagcggtgaccaatcccacaagatgggtgacaacgcctccgagcgcgataccggcgaatccaaagctggcattgcggcgtccgtcagtattctggagaattcctcaagggaaacctcacggagacaagagcagcataggttctcaatggatttgaagatgcctgcttttcaccccaaacaggaggtgcccgtgcccggcgatggagtggaattcccctccagcacaggagcggaggggcagaccggacaccctgcggaaaagctgagtgatctgcacaacaaagagcacagtggcggcggaaagcgagccctggcacccgacctgatgcctctcgacctctctgctaggagtactagagatgacccctcaaataaagaaaccgcctcctcactgcaggcagccctggtcgtgcatccgtgcccttattgctcccacaaaacttattaccctgaggtactgtggatgcataaaagaatttggcacagggtaagctgtaattccgtcgcaccgccctggatccagccaaacgggtacaagtcaattaggtctaacctagtgttcctctcaaggtccggcagaaccggaccccctcccgccctcggcggcaaagagtgtcagcctttgctcctggccagatttacgcgcactcaggtcccaggaggaatgccagggtctaaatctggcagcagcccattgggcgtggtgacaaaggcggcatccatgcctaagaataaagaatcccatagcggcggcccctgcgcactctgggcccctggccccgacggttacaggcaaaccaagccatgtcatggccaggaacctcatggggctgctacccagggccctcttgctaaacctcggcaggaggctagctccaagcctgtgcctgcccctgggggcggcggtttctcacgctctgcaactcccacacccactgtgatcgcccgggcgggtgcccaaccttctgctaacagtaaacccgtggagaagttcggggtccccccagctggagcagggtttgcaccaaccaataagcattctgctcccgacagtctgaaggccaagtttagtgctcagccacaaggacctcctcctgcaaagggtgagggcggcgcgccaccgctccccccgagggagcctccctcaaaggcggcccaagaactgcgcactttggcaacatgcgccgctgggtcacggggagacgcggccctacaggcccagcctggtgtagctggtgctccacccgttttgcactcaattaagcaggaaccagtggccgagggtcacgagaagagactcgacatccttaatatcttcaagacctatattccgaaggacttcgccacattataccagggctggggggtgtcgggtcccgggctggagcacagaggcacactacgtacacaggctaggccgggcgaattcgtgtgcatagaatgcggaaaatcctttcatcagcctgggcatctccgggcccacatgcgggcacacagcgtcgttttcgagagtgatggcccccgtggaagcgaagtgcataccacgtctgctgatgcaccgaagcaaggcagggaccactccaatacaggtaccgtccagaccgtgcccttgcgcaagggcacatag

SEQ ID NO: 21727 - DNA, 228 bp, Artificial Sequence
  Description of Artificial Sequence: Synthetic coding sequence
atggaccggaaccgggaggccgagatggagctgcggcggggcccctcgcctactagagccggccggggccacgaagtggatggcgataaggcgacctgccatacctgttgcatctgcggtaagagttttccatttcagagctccctctcccagcatatgcgcaaacacaccggtgaaaagccttacaagtgtccatattgtgaccacagagccagccagaaaggatag

SEQ ID NO: 21728 - DNA, 1479 bp, Artificial Sequence
  Description of Artificial Sequence: Synthetic coding sequence
atggccatggccctgcccatgcccggcccccaggaggccgtggtgttcgaggatgtcgccgtgtatttcacgagaattgagtggtcatgccttgcccctgaccagcaggccctctatcgggatgttatgctggagaactacggcaaccttgccagcctggggttcttggttgctaagccagccctgattagtttgttggaacagggggaggaacctggggctttgatcctgcaggtcgctgaacagagcgttgccaaggctagcctgtgcacagactctagaatggaagccgggatcatggagagtcccctccagaggaaactgagccgtcaggctggcctccccggaacagtgtggggatgtctgccttgggggcatcctgtgggcgggcatcctgctccgccacacccccacgggggccctgaagacgggtccgataaacccacccatcccagggcccgcgagcatagtgcctcaccaagagttctgcaggaagatctcggacgtccagtcggctcttccgctcctaggtacaggtgcgtctgcggaaaggcctttcggtacaactccctgctcctaaggcaccagatcattcatactggtgccaaaccattccaatgcacggagtgtggaaaggctttcaaacagtccagcatcctactgcggcaccaactgattcatacggaagagaaaccatttcaatgtggagaatgcggcaaagcttttcgtcagagcacccagttagctgcgcaccatcgggtgcatactcgagaacgcccctatgcctgtggggagtgtgggaaagccttctctaggtcctcgagacttctgcaacatcaaaagtttcataccggagagaagccgttcgcttgcactgagtgtgggaaagccttctgcagacggttcaccctgaatgagcacggaaggattcatagtggagagaggccttacagatgtctaaggtgcggacagagatttattcgggggtcgtctctgctcaagcatcacagactgcacgctcaggagggggctcaggatggaggtgtcgggcagggtgccctgctaggcgctgctcaaaggccgcaggccggagaccctccacacgagtgccccgtgtgtggcaggccctttaggcacaatagcttgttgctcctgcaccttagactgcacaccggcgagaagcccttcgaatgcgcagaatgcgggaaggcctttggtcgcaaatccaatcttactctgcatcagaaaatccataccaaggagaaaccatttgcttgtaccgagtgtggcaaggccttccgtcggtcgtacaccttgaatgaacattatcgcctgcactcaggcgagagaccttaccgctgcagggcatgcggacgtgcttgtagcaggctatctactctgatccagcaccaaaaggttcatgggcgcgaacccggcgaagatacagagggaagacgtgccccttgctgggctagttag

SEQ ID NO: 21729 - DNA, 1479 bp, Artificial Sequence
  Description of Artificial Sequence: Synthetic coding sequence
atggccatggccctgcccatgcccggcccccaggaggccgtggtgtttgaagacgtagccgtgtatttcacacgcattgaatggagctgtctggcaccggaccagcaggcactgtacagggatgtgatgttggagaattatggcaatctggctagtttggggtttcttgtggctaaaccagccctcatctctctcttggaacagggtgaggagcccggggctctcatcctccaggtggctgaacagtccgttgctaaggcatcactgtgcacagacagtcgtatggaggcaggaattatggagagtcctctccagcggaaactgtccagacaggcgggattgcccggtacagtgtgggggtgtctgccctggggtcatcccgtgggaggccatcccgcccccccgcatcctcacgggggcccagaggacggaagcgacaagcccacccatccgagggcccgcgaacattccgcatctcctcgggtgttacaggaagacttggggaggcccgttggtagcagtgctccacgatacagatgcgtatgcgggaaggcctttagatataactccctgttgctcaggcatcagatcatacatacaggcgccaagccattccagtgcactgagtgcggcaaggctttcaagcagagtagtatcctgctccgtcaccagcttatacataccgaggagaagccgttccaatgtggcgaatgcggcaaggctttcaggcagagcacgcagttggccgcccaccatcgggttcatacgagagaacggccttatgcatgtggggaatgcgggaaagcattctcccgttctagccgactcctccagcaccaaaaatttcacaccggagagaagcccttcgcctgtaccgagtgtggcaaggccttctgccggcggtttaccctgaacgaacacgggcgtatccattcaggtgagcgaccctatcggtgtttacggtgtggacagcggttcattcggggcagttcacttctgaaacatcaccgtttacatgctcaggagggagcccaggatggaggtgtagggcaaggcgcattgctgggggccgcccagcggccccaggcgggcgaccccccgcatgaatgtcccgtctgtgggcggccgttccgacacaacagccttttactgctgcatctgaggctgcacacaggagagaaaccgtttgagtgcgctgagtgcgggaaggctttcgggcggaagagcaacctgactttgcatcaaaagatccataccaaagagaaaccatttgcatgcacagaatgtggtaaggccttcaggagatcatatactctcaatgagcactatcggcttcattcaggagagcgcccctatcgttgtcgcgcttgcggcagggcttgttccagactgagcacgctgatccagcatcagaaagtccatggtcgagagcccggagaagatacagaaggtcggcgagcaccttgttgggcatcttag

SEQ ID NO: 21730 - DNA, 1479 bp, Artificial Sequence
  Description of Artificial Sequence: Synthetic coding sequence
atggccatggccctgcccatgcccggcccccaggaggccgtggtgtttgaggatgtggccgtctacttcacccggattgagtggtcttgtttagctcctgatcagcaggctctctaccgagatgtcatgctggagaactacggcaacttagccagtctcggtttcctggtcgccaaacctgccttgatcagcttactggagcagggcgaggagccaggcgctctgattctccaggttgccgaacaatctgtcgccaaggcctccttgtgcacagactcaaggatggaggcaggcatcatggaatctccactacagagaaagctgtcccggcaggctgggctgcccggtacagtttgggggtgcctcccttggggtcaccccgttggcggccaccctgcaccccctcatcctcatggtgggcctgaagatggcagcgacaagcccactcatccaagggcccgtgaacacagtgcttccccccgcgttctgcaggaggaccttgggcgtcccgtggggagctctgcaccacggtataggtgcgtgtgtgggaaagcgttccggtacaactccttgcttcttcggcaccaaatcatccatacaggcgcaaagccattccaatgtaccgagtgtggtaaggcctttaaacagagcagcattttgcttcggcaccaactcattcataccgaagaaaagcctttccaatgcggggaatgcgggaaggcatttcgccagtccactcagttggctgcccaccatcgcgtgcatacacgagagaggccatatgcctgcggggagtgtggcaaggccttctcacgaagttcccgcctcttgcagcatcagaaattccatacaggggagaagccttttgcttgtactgagtgcgggaaagccttctgtagaaggtttactctcaacgagcacggcaggatacactcaggggagcggccttaccgctgcctcaggtgtggccagaggttcatccgcggtagctcactgctgaagcatcacaggctgcacgcccaagagggcgcccaggatggcggcgtgggacagggcgcgctgctcggagcagcccagaggccccaagctggagaccctccgcacgaatgccccgtttgtggtcgaccgtttcggcacaactcactcttgctgctacatctgagactccatactggcgagaagcctttcgaatgcgcagagtgcggtaaagccttcgggcgcaaatctaacctcacccttcatcaaaaaatccatactaaagagaagccattcgcctgcactgagtgtgggaaggcattccgacggtcttacaccctgaacgagcactaccgcctccactccggcgagaggccttatcgttgcagagcctgtggacgagcatgttcaaggctgagcacactgatccagcaccaaaaggtgcacgggagagaacccggggaagacaccgaagggcggcgcgccccatgctgggccagctag

SEQ ID NO: 21731 - DNA, 3225 bp, Artificial Sequence
  Description of Artificial Sequence: Synthetic coding sequence
atgaaggacatcggccagcagctgtacaccacccacctgaacggcggccataactcactgacaatgagcccaaagcagccggacgccaatggcgcaccgaggcctaatcggcaggaagcacagacgctgctgtaccagggctcagaagctgaggcagcgatgatgactatcgcgacatgcgcaaagtgtaagtccgtgcacaagattagtctccaggatttacagaaggggaccgggaaggatggcatgtatgtgtgctttcagtgtagccttggggccgcaccccccaacttccatttcgtatccaacaattcctccgctacacatgtggggaacaagaccgaaaacttttcaagttctgtcaattcgaaattcaaagttcgcaactttaagccaggaaaatactactgcgacaaatgcagattctccaccaaggatcccctccaatataaaaagcataccctgcaacatgaggaaatcaagttcatatgcagtcattgctcttacatctcatacaccaagggtgaatttcagcgccacctggtcaaacacactggtatatttccgtatcaatgtgaatactgcgactacggagctatcagaaacgattacatcgtgaagcatacaaaacgcgtccacgaacgggcaggggccaaaaggccagtgaaagcagttgcaaagctggaaccaaaacgcaccggcacctccaagcagaaccctgagttgcttaaagcatcaaatcccaggactaccttccagaacaaatggtctgatcaattatccggcttctctcttcatgccaataaggacaagatgcataacataatgctccttcccgagccaaaagagtaccagaaggacgtggtgtgcatcccaaataaaatgacactctcagaaccaaatgaggtgaatttgttcgagaacaagaacgtagaggttgaggtcctctctcccgccaaagaacctgtccagcctgggatgccactgactgtggtcgcacccgccgagttagtggtgcccgctaactgcttggcgcagctgattgatgtcaaagtggtaaacggcacccagcaactggtgctgaagctatttcctctggaggagaataactgcttagaggccggtcgagataatggcggcaattccgagaggatggtcaaggagaaagggtctaatgaacaggaaaaagttctaagcgccgaaaagacgaaaagcctgacggttgacggcaatgtaggaaaactcgtggggatcgactcttttcagcctagtgtgcaaaaacaacttaaaaacgtgaaatgggtgcgttcgtacgactttatcatgcctaattcttctgttcacaacaacggcaaaagcttcattaattcagagacaattgaggatttccagaaaaagaataatctgtatcctcataggactgccttcccaagcgtggccttaaagggacacagcctggcttctgtctttaaaaactcagtccttcgatccctgggtgctgcctcaaaccctttcccctacaaagcagctgtctgcttcgccgagtcaggtcggaatctgcacagttccagccagcagctcctgccctttgcagcaagccctgctacttgttccttctccggggagaaaggcttgctccccgtatcagaaaacgatctggagtctacctctaaggtcaacattccagtcaaagtggtaagttctaaccggaagcaggaagacaaccagactgaagaacataaagcagtgtctactgtgggtcagatcagcagtcaacataagtccgagtacctccacataaacattaccggggaggacagatcccagcagcctggcgacaagccactggaattaaaaaattctgaacggaccaacaacaccaatgatggtccagtgattagttccgtgttctctctctctagcggaagcgagaatgtgcctgaagggatcaagtggaattcaagtaccagtaagattaagtccatcgagctactgcggcgcaaaatcgcgcagctgatcgaaagctgtggtaagcctagttcgctcgcatctaactccgcccacaggcgttccgtgggacaggcctcgaagggcaccagtaaagcaacaagcgagggtatccaggagattaacgtgagtcttaccggactgggacattctacaggcaccctgcagaagcctcctaacgacggagggatcacaggtaaccggcagctgacccatcaacagatctatccacacttcgcagacggtagtaatcgaaagaccaagtcccgcgtcgctagaaaagctcacgtggctacgcccgtgctcattccaaaaggtgctgttctgagggtactcaattcttcagaaaacgcacacattatcgaggctacctgcgaggcccctgtgtcgatcccttgcagcgagcgccagctaattaaaccggttcctttttgtcctgttagacaggctgacagtgaccttcagccactgcgaagcgagcggggcccaatcgacatgagccccaacattgaaacacccctcaggccgaaactacgcaaagaatctgcggtttgctcaacaattcatcgcaaaacagggttactgtacggtcagcaaggaagcagcgaactgaataaacagggtcgcctcctgtctaggtcgctatccatttccagaaataagacaaaacaggtccacctttccagaaagaaaaacaaaattcaagccgaaccatctcgatgcctgaaagacccctctattttccaggtcgcccgtcagctgcgcctcatagccgctaaaccagaccagttgataaagtgtccacggcgcaatcagcccgtgatcgtactcaaccatcccgatgttgattctcccgaagtgacaaatgtgatgaaagtaataaacaagtacaaggggaatgtgttgaaagtggtgctctcagagaggacccgctgccagctgggcatacggaggcaccatgttcgcctgacctaccagaacgcagaggaagcctctcagataaaacggcagatgatgctgaaaatgaagctcaagaaagtacacaagaacaattatcaggtagtggatagcctaccagacgattcttcgcaatgcgtgttcaaatgctggttctgcggtcgcctctacgaggaccaggaagaatggatgtctcacggacagcgacatttaatagaagctacccgtgattgggatgttttgtcttcaaaagggaagtag

SEQ ID NO: 21732 - DNA, 228 bp, Artificial Sequence
  Description of Artificial Sequence: Synthetic coding sequence
atgaaggacatcggccagcagctgtacaccacccacctgaacggcggccacaattccctaacaatgagccccaaacagcccgacgccaatggcgctcctagaccaaatcgccaggaagctcagaccctgttgtaccagggatccgaggccgaagccgctatgatgaccattgctacctgtgcaaagtgcaagagtgttcataagatttccctgcaggatcttcaatag

SEQ ID NO: 21733 - DNA, 1623 bp, Artificial Sequence
  Description of Artificial Sequence: Synthetic coding sequence
atggagctgctgaccttccgggacgtggccatcgagttcagccccgaagaatggaaatgcctcgatcctgcacagcaaaacctttacagggacgtgatgctcgagaactatcgaaatctggtcagcctggccgtttactcatattacaatcaggggattctcccggagcagggaatccaagacagttttaaaaaggccacactgggcaggtatggctcatgcggcttggaaaacatctgcctgtggaagaactgggagtctataggcgaaggggaggggcaaaaggagtgttataacctctgctcccaatacctgactacatcccataacaaacacctgaccgttaaaggagacaaagagtatagaattttccaaaaaaagccccagtttttaagcgccgcccccactgagccctgtatccctatgaacaaatatcagcacaagtttctgaaatctgtattttgcaataaaaaccaaatcaacttcaaccatgacagcaacatctcaaaacatcatagcacgcacttcttggaaaattactataactgtaatgaatgcgaaaaagtgttctatcaatctagcaaactgatattcccagagaacatccatatccagaaaaaaccttacaactcaaatgaatgcggagaaactagtgaccccttcagtaagttaacccagcaccagcgaatttatattggagaatcatcgcagcgctgtaacaaaaagtgcattattgtcttcagtcagtctcacctcaaaggtcacaaaatcataaataccggcgaaaagagcgtcaagtacaaggaaaggggaaaggcttttaccagggggctgcatctgggacaccagaaaatccacacaggggaaaagccctacaagtgtaagaagtgcgacaaggccttcaataaatcctctcatttggcccagcatcagaggatccacaccggggagaaaccctttaaatgcaaggagtgcggcaaagccttcaataggggctcctacctgacacagcatcaaaggatccacacaggggagagagcctttaaatgcgaagagtgcgggaaagctttcaacagggggagctaccttacccaacaccagaggattcataccggtgaaaagccctttaggtgcaaagagtgtggaaaggcatttaatagaagtagctatgtgacccagcatcagcgcatgcataccggtgagaaaccttttaagtgcaaagagtgcggtaaggcattcaacagggcttcccatttgactcagcatcaacgcatacataccggcgagaagcacttcaagtgcaaggagtgcggcaaagcatttaatagggggagccatctgacacggcaccagcgcatccacacaggggagaaatcgtttaaatgtgaggaatgtgggaaggcttttatctggggctcccatctgactcagcaccaacgcgtccacaccggagagaagttcttcaaatgcaaagagtgtgggaaggccttcacgcgatcaagtcatcttacccagcatcagaggatacacaccggagagaaacccttcaaatgcaaagaatgcggaaaagcattcaaccggcgctcaacattaacccagcaccagattatccacacgcgctag

SEQ ID NO: 21734 - DNA, 1623 bp, Artificial Sequence
  Description of Artificial Sequence: Synthetic coding sequence
atggagctgctgaccttccgggacgtggccatcgagttcagccccgaagaatggaaatgcttggacccagcgcagcaaaacctttatcgtgacgtaatgctggagaattacagaaatcttgtttccttagccgtgtacagctactacaaccagggaatcctgcctgagcaagggatccaagacagcttcaaaaaggcgacactcggaagatatggctcctgcggcctggaaaatatctgtctgtggaaaaattgggagtctataggcgagggcgaaggacaaaaagaatgctataacctgtgttcgcaatacctgaccaccagccataataagcacctcaccgtcaagggcgataaagagtacaggatcttccagaagaagccccagtttctcagcgcagctcccacggaaccctgtataccgatgaataaataccagcacaaatttctgaaatcagttttctgtaataagaatcaaatcaattttaaccacgactctaacatctccaagcatcattctacccattttcttgagaattattataactgtaacgagtgcgaaaaagttttctatcagtcatccaaactcatatttcctgagaacatccatatccagaagaagccttataatagcaatgaatgcggggaaacctctgaccccttcagcaagcttacccagcatcagcgaatttatatcggtgagagtagtcaaaggtgcaacaaaaagtgcataattgtgtttagtcagtcacaccttaaaggacacaaaatcatcaatactggagagaaatccgtaaagtataaggagcgaggaaaggcctttaccagggggctgcacttaggacatcagaagatacatacgggagagaaaccctataagtgcaaaaaatgtgacaaagccttcaacaagtctagtcacctggcacaacatcagaggattcatacgggtgagaagccctttaagtgcaaggaatgcggcaaagcattcaatcgcggaagttatctgacccagcatcagcggattcacactggcgagcgcgcttttaagtgcgaggagtgcggcaaagcatttaatagaggatcgtatctcacccagcatcagcgcattcacactggggagaaaccattccgctgtaaggagtgcgggaaagcctttaatcgatctagctacgttactcagcatcagagaatgcataccggtgagaagccattcaaatgcaaagagtgcgggaaggcgtttaaccgggcttcacatctgacacagcaccagcgaattcataccggtgaaaaacatttcaagtgcaaagagtgcggcaaagcctttaacagaggttcgcatctcactcgacaccagcggatccataccggtgagaagtcctttaagtgcgaagaatgcggcaaggcatttatctggggaagccatttaacccaacaccagcgcgtccatactggcgagaagttcttcaagtgcaaggagtgcggtaaggcatttactcgatcatcacacctgacccagcatcaacggatccacaccggtgagaagccttttaagtgtaaggaatgcggaaaggcctttaacaggcggtccaccctgacgcaacaccaaattattcacacaagatag

SEQ ID NO: 21735 - DNA, 795 bp, Artificial Sequence
  Description of Artificial Sequence: Synthetic coding sequence
atggacacccccagccccgaccccctgcccagccccctgcccggcgaggaagaaaagcccctggcactatcacctcccgtgccaagaggaaggaggggacgacggccaggtggtgctacctcatccaacagaaccttaaaggcttcacttccacggaagagaggtagaccacctaaatctgggcaggaacctccactggtgcaggtgcagggtgtgaccgctcccgttggatccagtggaggctccgatctgcttctaatagatgaccagggcgtcccgtacactgtaagtgaggggtcggcggccggccctgaggggtccggccctagaaaagccccccacttctgcccggtctgcctgcgagccttcccttacctgtcagacctggaacggcattctattagtcatagtgaacttaagccacaccaatgtaaggtgtgtggcaagacgttcaagcggtcttcccacctgagaagacattgcaatattcacgcagggctgcgcccttttagatgcccactgtgtccgagaagattcagagaagcaggcgaactggcccaccaccatcgcgtccactcgggtgagaggccctaccagtgtccaatttgccggctgagattcactgaggcaaatacactgaggcgccatgccaaacggaagcatccggaggccatgggggtacctctgtgtgctcctgaccccggttccgaacccccatgggatgaggaggggatcccagccacggccggcgctgaagaggaagaggagacggaaggcaagggcgagcctgcctag

SEQ ID NO: 21736 - DNA, 594 bp, Artificial Sequence
  Description of Artificial Sequence: Synthetic coding sequence
atgagcagcctgacctaccaccaccggctgcacaccggcgagaagccgtacaagtgcgaggagtgtgacaaggcttttcggcacaactccgcactgcagcgccatagaagaattcacaccggggagaaaccccacaaatgtaacgagtgcggcaagactttttcccagaagagctatctggcctgccacagatctatccatactggtaaaaagccttacgagtgtgaggagtgtgacaaggcgttttcttttaagtcaaatctggaaagccatcggattactcatacaggggaaaagccttataagtgcaatgactgcggaaagactttctcacacatgtctaccctgacatgccaccgtcgcttgcacaccggcgagaaaccctacaagtgcgaggagtgcgacgaggcatttcgctttaaatcttccctggagagacaccggaggattcacaacggagagaaattgtataaatgtaacgaatgtggcaagacgttcagccaagaactctccctgacctgccactgtaggctccactccggagaaaaaccctgcaaatgcggggagtgtgataaggcatactccttcaagtag

SEQ ID NO: 21737 - DNA, 1332 bp, Artificial Sequence
  Description of Artificial Sequence: Synthetic coding sequence
atgctggagaactaccggaacctggtgagcctgggcatcagcagcaaatgcacaatgaaagagttttcctccacggctcaggggaacaccgaagttatccatacagggaccctgcagcgtcacgaacgtcaccatattggagacttttctttccaggagatagagaaggacatccataatttcgaatttcagtggcaggaagatgagcggaacggacatgaggcacccatgactaagatcaaaaaactgatgggctctacagaacaatatgaccacaggcacgccggcaacaagcctattaaataccaactaggctcaagtttccactctcacttaagtgagctacatatcttccagccaaaagggaagataaacaaccaggtggaaaaatccattaatgatgcctcctccgtgtcaacggctcagcggatctcttgcaggcccaaaactcacataagcaacaactacggtgacaattttcttaattattctctgctgactcagcgtcaagaagttcggatgcgcgaaaagtcctttcagtgtatcgagagcggcaaggcatttaattacagcagtctgcttagaaagcatcagatcatacatctgggcgagaaacagtacaagtgcgacgtgtgcgacaaggtattcattcgcaaaagatatctggccaggcacagacggtgccacactggcgagaagccatacaagtgcaacgaatgtggcaagagtttcagccagatgtcctccttgacttaccatcaccggttgcacactggagagaaaccctacaaatgcgaggagtgcgacaaggcctttcgccacaactcagctttacagcgccaccggcgcatccataccggagagaaaccccataaatgcaatgaatgcgggaagacgttcagtcaaaaaagctacctggcttgccacaggagtatccacacgggaaaaaagccttacgaatgtgaagagtgcgacaaggcatttagcttcaagtccaatctggagtcccaccggatcacacacacaggggagaaaccatataagtgcaacgactgtggaaagaccttcagtcacatgtcaaccctgacatgccaccgacgactgcacacgggcgagaagccatacaaatgtgaggagtgcgacgaagctttccgcttcaaaagtagcctcgaaagacaccgtcgcatccataatggcgagaagttgtataaatgtaacgaatgcggcaagacattttcacaggagctttccctcacctgtcactgccgactgcatagcggcgaaaaaccatgcaaatgtggggaatgcgacaaggcctacagcttcaaatag

SEQ ID NO: 21738 - DNA, 1440 bp, Artificial Sequence
  Description of Artificial Sequence: Synthetic coding sequence
atggccctgccccagggcctgctgaccttccgggacgtggccatcgagttttcccaagaggaatggaaatgcctcgaccccgcgcagcgtactctctatcgagacgtgatgcttgagaactatcgcaatctggtcagcctggggatttcctccaagtgtaccatgaaggaattcagctcgactgcccagggtaataccgaggtgattcacaccggaactctccagcgtcatgagaggcaccacattggcgatttcagttttcaggagattgagaaagacatccataattttgaattccaatggcaggaggacgagcgcaacgggcacgaagcgcctatgacgaagattaagaagttgatgggcagtactgagcaatatgatcataggcatgccggaaacaagcctatcaagtatcagcttggctcttcctttcattcccacctgtccgaattgcacattttccaacccaaagggaagatcaacaaccaggtggagaaatctataaatgacgcctcaagtgtttccacagcgcagcgaatctcctgccggccgaagactcatatcagcaacaactacggagacaacttcctgaactactccttgctgacccagcggcaggaggtgcggatgcgggaaaagagtttccagtgtatcgagtcagggaaggcattcaattacagttcattgctgagaaagcaccaaatcatccatttgggtgaaaagcagtataagtgtgatgtatgtgacaaagttttcatccggaaacgatacctggccaggcatcgccgatgtcacactggagagaaaccttataaatgtaacgagtgtggtaagagcttctcccagatgagctcgctcacttaccatcacaggctccacactggcgagaagccttataagtgcgaggagtgcgataaggcttttagacacaattccgccctgcaacgacaccgcaggatccacactggggaaaaaccccacaagtgcaacgagtgtgggaaaacgttttcgcagaaatcctacctcgcttgccaccggtccatccacacggggaaaaagccatatgaatgtgaagagtgtgacaaagctttcagctttaaatcaaacctggaatcacatagaattacccataccggcgaaaaaccttacaaatgcaacgattgcggaaagacgtttagccatatgagtacacttacgtgccatcgacgccttcatacgggtgaaaagccatataaatgcgaagaatgcgatgaagcctttcggttcaagtcatctctggagaggcacagacgaatccacaacggcgagaagctttataagtgtaatgagtgtggtaaaactttctctcaagagttgtcacttacatgccattgtaggctacactctggtgagaagccttgtaaatgcggggagtgcgataaagcctacagcttcaagtag

SEQ ID NO: 21739 - DNA, 153 bp, Artificial Sequence
  Description of Artificial Sequence: Synthetic coding sequence
atggccctgccccagggcctgctgaccttccgggacgtggccatcgaattctctcaagaggaatggaaatgtctggatcccgcccagcgtacactctatcgagatgtgatgctagagaactacaggaatttggtaagcctgggttttttgtag

SEQ ID NO: 21740 - DNA, 1887 bp, Artificial Sequence
  Description of Artificial Sequence: Synthetic coding sequence
atggccctgacccagggccccctgaagttcatggacgtggccatcgagttcagccaagaagagtggaaatgcttggatcccgcccagcgcacactatatcgtgacgttatgctggaaaactacagaaatctggtgtccttgggtatttgtctgccagacctgagcgtgaccagcatgctcgaacagaaacgggacccttggactttacagagtgaggaaaagattgcgaacgatccagacgggcgggaatgtatcaaaggcgtgaataccgagagatcatccaaactcggctccaatgcaggaaacaagccctgcaagaatcaactgggctttacgtttcagcttcatttgtccgaccttcagctgttccaggcggagagaaagatctctggctgtaagcactttgaaaaacccgtctccgacaattcatcagtatctccccttgagaaaatctcctcaagcgtcaagtctcacctgctaaataaatacagaaataatttcgatcacgctccgttactgccgcaggagcaaaaggcccatattcgtgaaaaggcctataagtgtaatgagcacgggcaggttttccgtgctagcgcttcactcacgaaccaagtcatacataacgctgacaatccctacaagtgctcagagtgcgggaaagttttcagctgctcatcaaaacttgtaatccataggagaatgcataccggcgagaagccttataaatgccacgagtgtggtaagctctttagttcaaattctaacctatcgcagcatcagcgaattcatacaggagaaaaaccttacaagtgccatgaatgtgataaagtgttccgctcttctagcaaactggcccaacaccaacgaattcatacaggagaaaaaccctataaatgtcacgaatgcgataaggtgttcaatcaaattgcacatctggtgagacaccagaagatccacactggcgagaagccttacagttgtaacaagtgcggcaaggttttttccaggcactcttacctggctgaacatcagacggtgcacactggtgaaaaaccctataaatgcgaggaatgcggaaaggccttcagcgttaggtccagtctcattacccaccagttgatccatacagggaggaagccatataaatgcaaggagtgtgataaagtgtttgggcgaaagtgtttcttgacttcccaccagaggatccacacacgtgagaggccgtatggatgctcacaatgcggcaagattttttcccagaagtcggacctgatcaggcaccgaaaaacacatacagatgagaagccctataaatgtaacaagtgcggaaccgcatttcgagagttttctgatttgacagctcactttttgatccattccggggagaaaccgtatgagtgcaaggaatgtggaaaagttttcagatacaaatcttcactcaccagccatcaccgcattcataccggcgagaagccatacaaatgcaacagatgtggcaaggtttttagccggagctccaatttggtctgtcatcaaaagatccataccggagagaagccatataaatgcaatcagtgcggcaaggtgtttaaccaagcatcatacctgacgaggcatcagattatccacaccggcgagcgcccttatcgctgttccaaatgcgggaaggcatttagagggtgcagtgggcttaccgctcacctcgctattcacacggaaaaaaaatcacacgagtgtaaagagtgcggcaagatatttacacagaagagctctctcactaaccatcatagaatccatatcggagaaaagccctacaagtgtaccctgtgctcaaaggtgttctcccataattcggatctcgcgcaacatcagcgggttcactcgtag

SEQ ID NO: 21741 - DNA, 246 bp, Artificial Sequence
  Description of Artificial Sequence: Synthetic coding sequence
atggccctgacccagggccccctgaagttcatggacgtggccatcgaattttcacaggaggagtggaagtgtctagaccctgcccagaggaccctttatcgagacgtgatgttggagaactatcggaacctggtgtctctcggtatatgcttacccgatctctcagtcacctccatgttggagcaaaagcgggatccatggacactgcaaagcgaagagaagatcgcaaatgatcccgatggttag

SEQ ID NO: 21742 - DNA, 45 bp, Artificial Sequence; identical to SEQ ID NO: 10636
  Description of Artificial Sequence: Synthetic coding sequence

SEQ ID NO: 21743 - DNA, 1800 bp, Artificial Sequence
  Description of Artificial Sequence: Synthetic coding sequence
atggccgccgccctgcgggcccccacccagcaggtgttcgtggccttcgaggacgtggccatttacttctcccaggaggagtgggaactcctagacgagatgcagcgtctgctttatagagacgtgatgctcgaaaactttgccgtaatggctagcctggggtgctggtgcggagcggttgacgaagggactcctagcgccgaaagcgtgtctgtggaggagctttcacagggacggacccctaaggccgacacaagcacggataaaagtcacccatgtgagatctgtacacctgtattgagagacattctgcagatgattgaactgcacgcaagtccttgcggacagaaactttatctaggaggagcaagcagggacttttggatgtctagcaacctacaccagctccagaaactggacaacggcgagaagttatttaaagtggatggtgatcaggcctcatttatgatgaactgcagatttcacgtgtcgggaaagcccttcactttcggggaagtggggcgcgacttctcagctacctcagggttactacagcaccaagtgacccccactatcgagaggccgcattctagaataaggcacctccgagtaccgactggaagaaaaccccttaagtatactgaaagtcgcaagagtttcagggagaaatccgtgttcattcagcaccagagggctgactcaggcgagaggccttataagtgctctgaatgtggcaaatccttctcccagtcctccgggtttttgagacaccgtaaggcccatggcaggacaaggacgcacgaatgcagtgagtgtggcaaatctttcagccgcaagacacacctcacccagcatcaacgggtgcatacaggggagcgcccatacgactgctctgagtgtggtaagagctttagacaggtctctgtgcttattcaacatcagcgagtccacacgggagaaagaccctatgagtgttccgaatgcgggaagtcatttagccactctaccaacctctatagacatagaagtgcacacacaagcacaagaccttacgagtgttctgagtgtggcaaatcattcagtcactctaccaaccttttccggcattggcgggtccacacaggcgtacgaccctatgagtgctctgagtgcgggaaggccttcagctgtaatatataccttattcatcaccagcgcttccacaccggggagcggccgtatgtgtgttcagagtgcggcaagtccttcggccagaaatctgtcctcatccagcatcagcgtgtccatactggcgagagaccatacgagtgttctgaatgtgggaaggtcttctcacagtcgtccggactattccgccatagaagggcgcatactaaaactaagccctatgagtgctccgaatgcgaaaagagtttctcttgcaagaccgatctgattagacaccagaccgttcacaccggggagcgcccatacgaatgctctgtttgtggaaaaagttttattaggaagactcaccttattaggcatcagacggtacatacaaacgaaagaccttacgagtgtgacgagtgtggaaagtcgtattcccagtctagcgctctgctgcagcatcgaagagtccatactggcgagaggccgtacgagtgtagagagtgtggcaagagtttcactaggaagaaccacctgattcagcataagactgtgcatactggggagcgaccctacgaatgctccgagtgtgggaagagcttctcccagagtagtgggttacttaggcaccggcgtgtgcatgtccagtag

SEQ ID NO: 21744 - DNA, 3906 bp, Artificial Sequence
  Description of Artificial Sequence: Synthetic coding sequence
atgaccatgggcgacatgaagacccccgacttcgacgacctgctggccgcgttcgatattcccgatatggtcgaccctaaggctgctattgagagtggccacgacgatcatgaatcacacatgaagcagaatgctcatggagaagacgactcacacgctcccagctctagcgatgtaggagtatctgtcatcgtcaaaaatgtaaggaacatcgactcctccgaaggtggagaaaaggacggacacaacccaactggaaatggcttgcataacggtttcctgacggcgtcatctctggatagctactccaaggatggtgcaaaatctctcaaaggtgacgtgcccgccagtgaggttacattaaaggattccactttctcgcagttttctcccatcagcagcgctgaggagtttgatgatgacgaaaagattgaagtagacgacccgcccgacaaagaagatatgaggtcaagttttagaagtaatgtgctcaccggatccgctccacaacaagattatgacaagctgaaagcgctggggggtgagaatagcagtaagactggactctcaacatcaggtaacgtcgagaaaaataaggcggtcaaacgtgagactgaggcatctagtattaatctaagcgtatacgaaccattcaaggtgcggaaagctgaagacaagttgaaggagtctagcgacaaagtactggaaaatagagttctcgatggtaagctgagtagtgagaaaaacgacacctctctcccaagcgttgctccctcaaaaactaaaagctcttcaaagctaagttcttgcatagccgcaatcgccgctcttagcgcaaagaaagccgcgagcgattcctgtaaggagcccgtggcaaactcccgggagtcgagcccactgcccaaagaggttaacgatagtcctcgggccgcagataaatccccagagtctcagaacctaattgacggcaccaaaaaacctagcttgaagcagcctgatagtccacgtagcatctcaagtgagaacagctccaaaggatcaccttcaagccctgctggcagcacccccgccatacccaaggttagaattaaaacaattaagacttcgtctggggaaattaaacggaccgtaacccgggtcctgcctgaagtggacctggattctggtaaaaagccttcggaacagaccgcttccgtcatggcatccgtgaccagtctgttaagcagccctgccagcgcagcagtgttgtcatcaccccctcgtgctcccctgcagtctgcagtggtcaccaatgctgtaagtccagctgaactgacaccaaagcaggtgactattaaaccagtggcaacggcatttctgcctgtgtctgctgtgaagactgccggttcacaggtgataaacctgaagctggctaacaataccaccgtgaaagccacagtgatatcagctgcctctgttcagtcagcctcatcagctattattaaggctgcaaatgcaattcagcaacagacagtggtcgtcccagcctcctccctggctaacgccaagctggtccctaagactgtccatctggccaatttaaatttgcttcctcagggtgctcaggcaaccagtgagctgaggcaagtcctgaccaagcctcagcagcaaataaagcaggctatcatcaacgccgccgcttctcagccacccaagaaggtgtcgcgggtgcaggttgtgtcgtccctgcagtcgtctgtggtggaggcatttaataaggtgctgtcctcagtgaatcccgtgccggtttacattcccaatctgagcccccccgccaacgccgggatcacgctgcccacaagaggctacaagtgtctcgaatgcggcgattctttcgctctcgagaaatccctcactcaacattatgaccgtaggagcgtgaggatcgaggtgacgtgcaaccactgtacaaagaacctagtgttctacaataaatgctcactgctgagtcacgcaagaggacacaaggaaaagggcgtagtaatgcagtgcagtcatttgattctcaagccagtgcccgcagaccaaatgatcgtgtctccatcctcaaacaccagtacctccacaagtacactgcagtctccagtcggtgctgggacacatactgtgacaaagattcagagtggcattacgggcaccgtcatttccgccccttcaagtacccccatcacaccagccatgcccctggatgaggatccttcaaaactctgccggcactctctgaagtgtctcgagtgtaacgaagtgttccaggacgagacaagccttgcaacccacttccagcaagccgctgacacatctggtcaaaagacctgtacaatctgccagatgctgctgcccaaccaatgctcttacgccagccaccagcggatccaccagcataagagcccttatacatgccctgaatgtggggctatctgcaggtccgtgcatttccagactcacgtcaccaaaaattgcctgcactacacacggcgcgtgggattcaggtgcgtacattgcaacgttgtgtacagcgatgtggcggccctgaagtcgcacatacaaggttcccattgcgaggtgttttataagtgcccaatctgccccatggcatttaaatctgctccttcgacccattcccacgcctacactcaacacccggggattaagattggagagcctaagattatttataagtgcagcatgtgtgacaccgttttcacacttcagacactattgtatcgccatttcgatcagcacatcgagaaccagaaggttagcgtcttcaaatgtcccgattgctcactcctctatgcacagaagcagttaatgatggaccacatcaaatcaatgcacgggaccttaaagtccattgaggggccaccaaatctcggtataaacctgccattgagtatcaaacccgccacgcagaattccgctaatcagaataaggaagataccaagagcatgaatggaaaggagaagctggagaagaaaagtcccagtccggtgaagaaaagtatggaaactaagaaggtcgcctccccaggttggacctgctgggaatgtgactgtttgttcatgcaaagggatgtgtatatcagtcacgtgcggaaggagcacggcaagcagatgaagaagcatccctgtcgccaatgtgacaagtcttttagttccagccactccttatgcagacataaccggattaaacacaaggggattcggaaagtctatgcctgcagtcactgtccagactctaggcgcacctttacaaaaaggctcatgctggaaaaacatgtgcagctgatgcacggaatcaaggatcccgacttgaaggagatgaccgatgccaccaacgaagaggaaactgagattaaagaggataccaaggtgccatcccctaagcggaaactggaggagccagtgcttgagtttcgtccacctaggggcgccattacgcaacccctgaaaaagctaaaaatcaacgtctttaaggtgcacaaatgcgccgtatgtggatttaccaccgaaaatcttttgcaatttcacgagcatataccccagcacaaatctgacggcagtagctaccaatgcagagaatgcgggctgtgttacacatcacacgtgagcttaagcagacacctgttcatcgttcacaagctcaaagaaccacagccagtgtccaagcagaatggtgccggggaggacaatcaacaagagaacaaaccctcccacgaggacgaaagccccgatggtgctgtcagcgatcggaagtgcaaggtgtgtgccaaaacatttgaaaccgaagccgcgctcaatacacatatgagaactcacggcatggccttcataaagtctaaacggatgagcagcgcagagaaatag

SEQ ID NO: 21745 - DNA, 582 bp, Artificial Sequence
  Description of Artificial Sequence: Synthetic coding sequence
atggccctgacccagggccagctgagcttcagcgacgtggccatcgagttcagccaggaagaatggaaatgcctggatcccgggcagaaagccctgtaccgagacgtgatgttggagaattaccggaacctagtgtctctggggatttgcctgcccgatctgagtgtgacttcgatgctcgagcagaaacgtgatccctggaccctgcagtcagaagtcaaaattataaataatccagacggacgagagtgcattaaaggagtgaatacggactttagcctgctggcatgggacgcccgcgttttccgtgtagaggcctggagggcttcaggaggcgccgaagagcccacaggcccaaacttcgtgggaaatgatagtccgctgccatcccctctggccctactccccttcccctcagtgagcgcctccctgggcgatgcaaaaagggccaggctgacagctgaagggagaggacacggtaccctaagggcagggcctgcccctcgtcccaggtcagcagccccacatgctcctgatgcagtccaacgatggccacccgaacaaaggttgcccaggagttag

SEQ ID NO: 21746 - DNA, 2025 bp, Artificial Sequence
  Description of Artificial Sequence: Synthetic coding sequence
atggccctgacccagggccagctgagcttcagcgacgtggccatcgagttttcgcaggaagaatggaaatgcttggaccccggacagaaggcattgtatagggacgtcatgcttgagaactacagaaatttagtaagcctcggggaggataatgtgcggcctgaggcctgcatatgtagtggtatctgcctcccagacctctccgtgacctccatgcttgagcagaaacgcgatccctggaccctgcagagtgaagtcaagatcattaataatcctgacgggagagaatgcataaagggcgtgaatactgaaaaaagctctaagttaggttcttcagctggcaataagtccctcaaaaatcagcacggcctgacactgcagttacatctgacagaatggcagccttttcaggccgttcggaatatttacgggtgtaaacatgtcgagaaatctataagcgacaactcaagcgtgtctcctgtgcaaatttcctttttctcggtgaagactcatattttcaacaattatcggaatgattttctgttttccactctactgcctcaggagcaaaaggtgcatatccgagaaaaaccttacggctgcaatgagcacggtaaggtgttcagagtaagctcctccctcactaaccggcaggtgatccacatcgctgacaagacttataaatgctctgactgcggtgagatcttttcttccaactctaacttcgcccagcaccagcggattcatacaggagagaagccatacaagtacaacgagtgcggcaaggtgtttaaccagaattcccatctcgcacagcaccagaagattcacacaggacagaagccctacaataacaaggaatgtggcaaagtattttcccaccacgcttatctcgcacagcatcggaagatccacactggagaaaaaccctataaatgctccgaatgcggcaaagctttctcagtatgctcttcactgacagcccacctggttatccacaccggtgagaaaccatacgactgcaaagagtgcggcaaagtgtttcgccacaaatcttccttgaccacacaccagactgtgcacacaggagaacgaccctacaaatgcaacgagtgcggaaaaggtttctccagaatcgccttcctggcaaggcaccgaaaagtacataccggggaaaagccatacaagtgtaacgagtgcgggaaagttttcataggaaactcacgccttgcgagacataggaagatccacacaggtggaaggcgatacaagtgtaacgagtgcggcaaagctttcagaacttgttcagaccttaccgcacatctcctgatccatactggggagaagccctacgaatgtattgactgtggtaaggtcttcaggcacaagtcttccctgacttaccattgtcgaattcacacgggtgaaaagccttataagtgcaacgagtgcggaaaggtattctcccagaattcaaaccttcaacggcaccgaaaaatccacactggggaaaagctgtataagtgtaacgagtgcgggaaagtgtttcggcagaactcgcatctggcccagcaccgcgatattcacaccggtgaaaagccctactcttgtaatgagtgtggtaaggtcttccggcgtaattctcacctcgtacgacatcgcaatgttcatacaggcgaaaaaccctatagctgcaacgaatgtggtaaggttttctcgaggaattcccaccttgcacgccatcgtaacattcatactggggagaagccgcactcttgtaacgagtgtggtaaggtgttttctcgcaattcccacctggctcggcaccgtaaaatccacactggcgagaaactctacaaatgtaatgagtgtagcaaagttttcagccgcaactccaggttagctcagcatagaaatatccatacaggggtgaaaccatattcctgcaatgaatgtggaaaagttttttcaaagaactcaatcctggttcaacactgcagtattcacaccagagagaagccatag

SEQ ID NO: 21747 - DNA, 2022 bp, Artificial Sequence
  Description of Artificial Sequence: Synthetic coding sequence
gtgctgaccaccggccagctgagcttcagcgacgtggccatcgagttctctcaggaggagtggaagtgtctggatccagggcagaaagcattgtacagagacgtgatgctggagaactatagaaatctcgtaagtctgggagaagataacgtccgccctgaggcttgcatctgtagcggaatttgcttgcccgacttatccgtgacctcaatgcttgagcagaagagagacccctggaccctgcagagcgaagttaaaattataaataatccggacggccgcgaatgtattaagggcgtgaacaccgagaagtccagtaagctcgggagctctgccggcaataaatcgttaaagaaccagcacggattgacattacagctgcacctgacggaatggcaaccattccaggccgtgagaaacatttatggttgcaagcatgtcgagaagagcatttcagataactctagcgtgtctcccgtgcagatcagcttcttctccgtcaagacgcacattttcaacaactaccgcaatgattttttattctccaccttgctgccacaagagcagaaagtgcacatcagggaaaaaccttacggctgcaatgagcacggaaaagttttccgagtgagcagcagtttgacaaatcgtcaggtcatccatatcgctgacaaaacctataaatgttctgattgtggtgaaattttctcttcgaacagcaattttgctcaacaccagagaatccacaccggagaaaagccctacaagtacaatgaatgcgggaaagtcttcaatcagaacagccatctggcgcagcaccagaaaattcacactgggcagaagccatataataacaaggaatgcgggaaagtcttcagccaccacgcttatctggcccagcatcgaaagattcataccggtgagaagccatacaaatgcagcgagtgtggtaaggccttttcagtgtgtagtagcctgacagctcaccttgtcattcatacaggcgaaaagccctatgattgcaaagaatgcggcaaggtgttcaggcacaagagttcccttacgacgcatcagacggtgcataccggagagagaccttacaagtgcaatgaatgtgggaaaggattttcccgaattgcctttctggctcgccaccgcaaggttcacacgggggagaagccctataagtgtaacgagtgcggcaaggtgtttatcgggaattcgaggctggcaagacataggaaaattcatacggggggacgccggtacaaatgtaatgaatgtggtaaagcattcagaacatgttccgacttaacagcccatctactgattcacaccggcgaaaaaccatacgaatgtattgattgcggcaaggttttcagacacaagagtagcctgacctaccattgtcgtatccataccggggaaaaaccgtacaagtgtaacgaatgtggcaaggttttctcacaaaatagcaacctgcagcggcacaggaaaatccacaccggggagaaactgtacaaatgcaatgagtgcgggaaggtcttccggcaaaattcccatttggcccaacaccgagacatacatacgggcgagaagccgtactcttgcaacgaatgtggcaaagtgttcaggcgaaattctcacctcgtcaggcacagaaatgtgcacactggcgagaaaccatactcttgcaacgaatgcgggaaggtcttctctcgcaattctcatctggcgaggcacaggaatatacatacgggagaaaagccacattcctgcaatgaatgtgggaaggtgttcagcagaaatagccacctggcccgacatcggaaaatccacacaggcgagaagctttataagtgcaacgagtgttccaaagtgttctccagaaattcacgtcttgcacaacaccggaacattcataccggggtcaaaccttattcgtgtaacgagtgtgggaaggtattctccaagaactcaattctcgtccagcattgcagtattcacacacgagagaagccatag

SEQ ID NO: 21748 - DNA, 453 bp, Artificial Sequence
  Description of Artificial Sequence: Synthetic coding sequence
atggccctgacccagggccagctgagcttcagcgacgtggccatcgaattctctcaagaagagtggaagtgtttggatccaggacagaaagccttgtaccgggacgtgatgctcgagaattatcgcaacctcgtgagtctggacttctccctactggcgtgggatgctagagttttccgcgtggaagcatggcgggcgtcaggtggcgctgaggaacccaccggccccaactttgtggggaacgactcccctcttccatctccccttgccctcctccccttcccatccgtttctgcctcactcggagacgccaaacgcgcccggctaacagctgagggccgcggacatggtactttgcgggcaggccccgctccacggccacgcagcgcggcacctcacgctccggacgccgtgcagcgttggcctcctgaacagcgtctgccccggtcatag

SEQ ID NO: 21749 - DNA, 1986 bp, Artificial Sequence
  Description of Artificial Sequence: Synthetic coding sequence
atggccctgacccagggccagctgagcttcagcgacgtggccatcgaattcagtcaggaggagtggaaatgcctcgacccagggcaaaaggcgctatacagggatgtgatgctagaaaactacaggaatctcgtctctctggggatttgtctgcccgatctgtcagttacaagtatgctcgagcagaaacgagacccttggactctacagtcagaggtcaagatcatcaataatcctgacgggcgggaatgcatcaagggcgtaaataccgagaagagcagtaagctcggatcatctgccgggaacaaaagtttgaaaaatcagcacggactgaccctgcagctgcacttgacagagtggcagcctttccaagcagttaggaacatttacggttgtaagcacgtggagaaaagtatttccgacaattctagcgtcagcccagtgcagatctcatttttttccgtaaagacccatattttcaacaactacagaaatgattttctcttctcaaccctgctgccacaggaacagaaagttcacatccgagaaaagccatatggctgtaatgagcacggtaaggtgttcagggtgagctcatcgctgacaaatcggcaagtcattcacatagccgataaaacctacaaatgctccgattgtggggaaatttttagttctaattctaacttcgcgcagcaccagcgtatccatactggcgagaagccttataagtacaacgaatgtggtaaggtattcaaccagaattctcacctcgctcagcatcaaaaaatccacacaggccagaaaccctataataataaagagtgtggcaaggtattttcacatcatgcttacctggcccagcacagaaagattcatacgggcgagaagccttataagtgtagcgagtgcgggaaggccttttcagtgtgcagctctctgaccgctcatcttgtgatccataccggggagaagccttacgactgcaaagagtgcggcaaagtcttccgccacaagtcaagcctaacgacccatcagaccgtgcacactggcgaaaggccctataaatgtaacgaatgtggaaagggctttagtaggatagccttcctcgcgagacaccgtaaggtgcatacaggcgagaaaccgtataaatgcaacgagtgcggtaaagtcttcatcggtaatagccggctggcccgccacagaaaaatccacacaggaggtcgccggtacaaatgcaatgaatgtggtaaggcgtttagaacttgctctgacctgacagcacatctcctgattcacaccggggagaagccatacgaatgcatcgactgcggcaaagtgttccggcacaagtcttcccttacgtaccattgcagaatccacacaggcgagaaaccatataaatgtaacgagtgcggaaaagttttttcccagaactccaacttgcaacggcaccgcaaaatccatactggagagaagctctacaaatgtaatgagtgtggcaaggtcttccggcagaactctcacttggcccagcaccgcgacattcacaccggtgagaagccctattcttgtaacgagtgtgggaaggtattcaggaggaatagtcacttagtgcgtcatcggaatgtacacactggcgagaaaccctactcttgcaatgagtgtggtaaggtattctctcgtaattctcacttggcccgacaccgaaatattcacaccggtgagaaaccacactcttgcaatgaatgcggaaaagtgttctcccgtaactcccatcttgcgcggcatcgcaagatccacacaggagagaagctgtataagtgtaatgagtgctctaaagttttctctcgtaattctcgcctggcccagcatcggaatatacacaccggtgtgaagccttacagttgtaacgagtgcgggaaagtctttagcaagaactccatcttggtgcagcattgctcgatccatacacgggagaaaccctag

SEQ ID NO: 21750 - DNA, 3903 bp, Artificial Sequence
  Description of Artificial Sequence: Synthetic coding sequence
atggaggaggccagcctgtgcctgggcgtgagcagcgccgagcccgaggcggaaccccacctcagcggccccgttctgaacgggcaatacgcaatgtcacagaagctgcaccaaatcacctcccagctgtctcacgcgttccccgaactgcaccccaggcctaatcccgaagaaaagcccccagccagcctggaagaaaaggcacacgtgcctatgagcgggcagccaatgggctctcagatggccttactcgccaatcagctgggaagggaagtggacacttcattaaatggtagagtcgacctccagcagttcctgaatggccagaatctgggtatcatgtcacagatgagcgatattgaggacgacgctcgtaagaatagaaagtacccatgccctttatgcggaaaacggttcagattcaattcaattctctcactgcatatgcggacacatacaggagaaaagccatttaagtgcccctattgtgaccacagggccgctcagaagggtaacctcaagatacacctgcgcacgcataagctaggcaatctcggaaaagggaggggaagggtgcgggaggaaaaccgcctgctgcatgaactggaggagagagccatactgagggacaagcaactcaaaggatccctcctccaaccccgacctgacctcaagccgcctccacacgcccagcaagcccctttagccgcctgcactctcgcactacaggcaaaccattctgtacctgacgttgcccacccagtcccatcacctaaaccagcctccgtgcaagaggatgctgtggcacccgctgcggggttcagatgtactttttgcaaggggaaattcaaaaaacgtgaggagctggaccggcatatccgaatcttgcacaagccttataaatgtacgctctgtgatttcgctgccagtcaggaggaagagctgatctcccatgtggagaaggcacacattacagctgagagtgctcagggtcaggggccgaatggtggcggcgaacaaagcgctaatgagtttcggtgtgaagtgtgtggacaagtcttcagtcaggcctggttcttgaaaggtcacatgagaaagcacaaagatagtttcgagcattgttgccagatttgcgggcgacgctttaaagagccatggtttctgaagaaccatatgaaggtccacctgaataagctgtcagttaaaaataaatcacccagcgatccagaagtgcccgtgccgatggggggtatgtcacaggaggcccatgcaaatctatattctaggtacctcagctgtctccaaagtggatttatgacacccgataaggcagggctttccgagccctcccagctttatggcaaaggagagctgcctatgaaggagaaagaagctctgggaaaactccttagtccaatctcaagcatggcccacggcgttcccgaaggcgataaacacagcctgttgggttgcctcaacctcgtcccccctctgaagtcttcatgtatcgagcgtctccaggctgccgccaaagccgctgaaatggacccagtgaattcttatcaagcctggcagctcatggcccgtggaatggccatggaacacgggtttctgtcaaaggagcatcccctccaaaggaatcatgaggacaccctggcgaacgccggcgtactattcgacaaggagaagagggagtacgtgctggtcggtgctgacggtagcaaacagaagatgcctgccgacctcgtacatagtaccaaggtgggaagtcagagggacctcccaagcaagcttgacccactggagagcagtagagacttcttaagtcacgggctgaaccagaccctggaatacaatctccaaggcccaggcaacatgaaagagaaaccaaccgagtgccctgactgcggcagggtgttccggacataccatcaggtcgtagtgcattccagagtgcacaagagggaccgtaaaggcgaggaagacggcctgcatgttggtttggacgaaaggagaggctcgggttctgatcaggagagccagtccgtgtccagatccactacccctggctcttcaaacgttaccgaagaatcaggcgttggtggtgggctgtctcagaccggttccgctcaggaggatagcccccatccctctagccccagctcttccgacataggggaggaggcaggccgatccgccggggtccagcaaccggcccttctcagggataggagtttaggctccgctatgaaagattgcccttactgtggcaaaacattcaggacgagtcatcacttgaaggtgcacctaagaattcacaccggggagaagccctacaaatgcccccactgtgattatgcaggtacccagtcggctagccttaagtatcatttagagaggcatcatagggagaggcagaacggagctggacccctaagtggacagccacccaatcaagaccacaaagatgaaatgtcatctaaggcctccctttttataaggcccgacattctacgcggcgccttcaagggcctgccgggcattgatttcagaggcggacctgcatctcagcagtggacgagtggagtgctgtcaagtggcgatcacagcggccaggctactgggatgtcgagcgaggtgccctctgacgcactgaagggtaccgatctccccagcaagtccacacacttcagcgaaatcggccgtgcataccagtcaattgtctccaacggcgtcaatttccaaggttctctccaagccttcatggatagcttcgtgctctcgtctttgaagaaagagaaagatatgaaggacaaggcgctggcggacccacccagcatgaaagttcatggggtggacgggggcgaggagaaaccctccggcaaatcatcccagcgcaagtctgagaaatctcagtacgaacctcttgacctctccgtccgtccggacgccgcatcgctgccaggcagttctgtgaccgttcaggactccatcgcttggcacggttgcctgttctgcgccttcaccacatcctcaatggagcttatggcactgcatctccaagctaatcacctaggaaaggcaaagcggaaagacaataccattggtgtcacggtcaattgcaaggatcaggcacgcgaggcctcgaaaatggccctcctaccgtcactgcagtccaacaaggatctgggacttagcaatatgatctcctctcttgattcagcatccgaaaagatggcccaaggccagctgaaagagactctgggggagcaaaaatcaggtgcttggaccgggcacgtggatccagcattttgcaacttcccgtccgacttctataagcagttcggggtgtacccaggcatggttggatcgggggccagctcatcttgtccgaataaggaacctgatggaaaagctcattccgaggaggacgtcccaatccttatccccgaaaccacctctaagaatacaactgatgacttgtcagacattgcatcttccgaggacatggattcatcgaagggcgagaacaatgatgaagaagatgtggagactgagcccgagatgatgaccaagcctctctctgccctttccaaagactctagctccgatgggggcgatagcctgcagcccactggcacctcccagcccgtgcaagggctggtctcgcccttgagccaggctcctgaaaagcagtggcattctcaggggttgctccaggcacaagacccactggcggggttgccaaagccagaaaggggtccccagtcactggataaaccaatgaatatgctgtcagtgctcagagcttactcctcagacgggttagcggcattcaacggcctggcttcatcaacggcgaatagcggctgcattaagaggccggacctctgtgggaaatag

SEQ ID NO: 21751 - DNA, 4098 bp, Artificial Sequence
  Description of Artificial Sequence: Synthetic coding sequence
atggaccagtacagcctgggcgacgagggcgccctgcccagcgagatgcaccttccttcgttttcagaaagccaaggtctaaattgtagtgacacattgaatagagaccttggtcccaatacccgggggtttctgtacgcgggactctccggtctggatcccgatccaagcctccctacccccgacatgtctagcgaggtgctggaagacaatcttgacaccttaagcctgtattcaggcaaggattctgattcggtgaaactcctcgaagagtacgctgattctgagagtcaagctagtctccaagacctggggcttggagtactgaaggcgaaggaagctgatgagggaggcagggccacctcgggctctgcgcgcaaaggaaaacgccagcatagttcaccccagaaccccctgctagattgttctctgtgcggaaaagtattttccagtgcgagttcactgtccaagcactacctgactcatagccaggaacggaaacacgtttgcaagatttgtagtaaagcatttaagcgacaggatcacctgacaggacatatgctcacacatcagaaaactaagccctttgtgtgtattgagcaggggtgcagtaaatcctattgtgattacagatccctgaggcgtcattacgaagtgcaccacgggctgtgcattctaaaggaggctcctcctgaggaggaggcctgcggtgactcccctcacgcccacgaaagcgcaggccagcctcccccctcgagcttacgctccctggtgcctcccgaagcccgtagccctggctctctcctcccacacagagacttgttaaggagaatcgtaagcagtattgtccaccagaaaactccatcccccgggcccgcacccgctggggcctctgacagcgagggtcggaatacagcatgcccttgcccagcctcaagtgggagctcttcgtgcacccccgccggtccgcacgctgcacctgctgccctcgataccgagttgcccgaagagccctgtctcccccagaaagagccggccactgacgtcttcacagcacccaactcaagagctgctgaaaacggagcgcctgaccctccagagcctgagccagacactgcactgctccaggccaggtcaaccgctgagtgttggccagagggtggctcagtgcccgcatgtctgcccctgtttcgaggccaaacagtgcctgccagtagccagccctcttcacattcctttcagtggttgaggaatttgcctggttgccccaagtcgaaaggaaataatgtttttgtagtccacaagccaagtgcagtcccctcaagagaagggagcgagtcagggccaggcccctcttctggcagcccgtcagaagaatctccacctggccctgggggcggcctggaagatgcactcccctttcccgcagccctgctgcgggtgcctgcagaagccccaagtgaccctagaagcgcttccggggaagacgatccttgcgcacctaagaaagtcaaggtcgattgcgactcatttctctgccaaaatccgggggaacccggactgcaagaggcccaaaaggctggcggcctccctgctgatgctagccctctgttcaggcaactttttctgaaatcacaggaacccttggttagccatgagcagatgcaggtgtttcaaatgatcactaagagtcagcggattttctcccacgctcaggttgccgctgtgtctagtcagttacctgcacccgaaggtaaaccagctgccttgcggcctctgcaggggccttggcctcaacagccgccacccctcgccccagccgtagatagtctccatgctggacccggcaaccccgaagctgagggatcaccagccagaaggaggaaaaccacccccggagttccccgtgaggcatcaccaggctctacaagaagagatgcaaagggcggcctgaaagttgctgccgtgcccacccctctggcggcaccttctctggacccctcacggaacccggatatctcctctttagctaagcagctgaggtcaagcaaaggtaccttagatctagaggacatcttccccagcaccggacaacgtcagactcaattgggtggggaggaaccccccggcgcgtcccttcccgggaaacaggcccccgctgaaaacggggcagctagccgcatcaccaaaggggagaagggcccagcatgcagtcgcggaggcggatataggctgctgggaaatccccgagctccccgctttagtggcttccgaaaagagaaggccaagatggatatgtgttgtgctgcatctccgagtcaggtggcgatggccagcttcagctctgcaggcccaccagcagacccatcaaagtctaagctgactatttttagtaggatccaggggggtaatatatatagattacctcatcccgtaaaagaagagaacgttgcaggacgcggcaaccaacagaacgggagccccacagactggacaaagccgcgctctacgttcgtctgcaagaattgctcccagatgttctacacagagaaagggctttccagccatatgtgttttcattctgatcagtggccatctccacgggggaagcaggaaccacaggtcttcgggacggagttctgcaagcctctgagacaggtgctacgccccgaaggcgatcgtcactcccctccaggcacaaagaaaccactggatcccacagctgccgctccactggtggttccccagagtattcctgtggtacccgtaactcgccacattgggagcatggccatgatggaatggtgcagcaggtggttgcaggctaccacttgtggtagcaagctcctacaaggacaggagaaggacggagaggagagagatagtaaagagtccagtcagcagaggaagcggaaaaaacgacccccccctagcaccgccggagaacctgggccagccggttgccatcaatctcgcctcaggagtcccatgttccttgtagattgtttattaaagggactgtttcagtgcagcccttacacaccccccccaatgctgtccccaatccgtgagggttcgggggtgtattttaacacactgtgcagcactagtacccaggcatcccctgaccagctcatatcctccatgctcgaccaggtggatggctcctttggaatatgtgtggtaaaggacgatacgaaaatctcaatcgagccgcatattaatatcgggtctcgtttccaggcggaaatccctgagctgcaagagcgctcccttgctgggactgacgaacatgtagccagtctggtgtggaagccctggggcgatatgatgatttcatcagagacacaggatagagtcaccgaattgtgcaatgtggcttgtagtagcgtgatgcctggcgggggtactaacctggaactcgccctacattgcttgcatgaggcgcaaggaaacgtgcaggtcgccctagagacactcttgctgagaggtcctcacaagcctcgcacgcacttactcgccgactaccggtacactgggagcgacgtgtggacaccaattgagaagcgccttttcaagaaagccttttatgcccacaagaaggatttctacttgatccacaagatgattcaaaccaagacggtggcccagtgtgtcgagtattactatatctggaagaaaatgatcaaattcgattgcggcagagctccaggactcgagaagcgtgtgaagagggaacctgaggaagtagaacgcaccgaagagaaagtaccatgctctccccgtgagagaccttcccatcaccccacgcccaaactcaagactaaatcttaccgacgggaatctatcctgagtagctcccccaacgcaggctcaaagagaacacctgaacttcttggctctgcagaatcccaggggatcttcccctgtagagagtgcgaacgggtgttcgataagatcaaatcccgaaatgcacacatgaaacgccatcggctgcaggatcacgtcgaacccatcattagggttaaatggcccgttaagccatttcaattaaaagaagaggagctgggcgccgacatcggaccacttcagtggtag

SEQ ID NO: 21752 - DNA, 3267 bp, Artificial Sequence
  Description of Artificial Sequence: Synthetic coding sequence
atggaccagtacagcctgggcgacgagggcgccctgcccagcgagatgcaccttcccagcttcagtgaatctcaggggctgaactgcagcgatacgttgaatagagacctggggccaaacacgagggggttcctttatgctggactctctggtctcgaccctgaccccagtttacccacaccagacatgtctagcgaagttctcgaggacaacctggatacattgagcttgtactccggaaaggatagcgactccgtaaagctgctggaagaatacgccgatagcgaatcccaggccagcctccaggacttagggctgggagtgttgaaggccaaggaggcggacgagggagggagagctacatcaggcagcgcacgaaagggcaagagacaacactcctctccgcagaacccgctactggattgttccctgtgcgggaaagtgttcagttccgcttcctcattgagtaagcattatctgacacacagccaggagaggaagcacgtttgtaaaatttgtagtaaggcctttaaacgtcaggaccatctcacaggacacatgctgactcatcagaaaacaaagccttttgtgtgtatcgagcagggctgctccaagtcatattgtgactacagaagtttaaggcgtcattacgaagtccatcatggcctatgcattctcaaggaggcgccaccagaggaggaggcctgcggtgacagccctcatgcccacgagagtgcaggccagcctcccccatcctctttgcgttccctcgtccctcccgaggccaggtcaccagggtcactactaccccatagggacctgctccgtcggatcgtatccagtattgttcatcaaaaaactcccagccctgggcccgcccccgctggagccagtgacagcgaaggacgcaacaccgcatgtccatgtcctgcttctagtggatcctcttcttgtacccccgctggaccacacgcagcgcctgccgcacttgatacagaactgcctgaggaaccctgcctgccccaaaaggagccagcaaccgatgtgttcacggctccaaattcacgtgcggccgagaacggagctccggatccaccggagcctgagccagatactgccttattgcaggctaggagcactgccgagtgctggcccgaaggtggctctgttcctgcatgtctccctctgttccgagggcagactgtcccagctagtagccaaccatccagccattcttttcaatggctccgcaacctcccgggatgcccaaagtctaagggcaacaacgtcttcgtagtgcacaaaccttctgcggtacctagccgtgaaggcagtgagtccggacctggtcccagtagtggtagcccatcagaagagtcccctccgggccccggtggaggactcgaggacgcattaccatttcccgcagccctgctgcgggtgcctgcggaggcaccctccgacccccgctcagcatccggggaagacgatccttgcgcaccaaaaaaagtgaaagttgactgtgactctttcctctgccagaacccgggggaacctggattgcaggaggctcagaaagcgggtggtctgccggccgacgcttcacctctgtttcggcagctatttctgaaaagtcaggagcccctcgtgagccatgaacagatgcaagtgtttcagatgattaccaaaagccaacgaattttttctcatgcccaggtcgccgcagtcagcagtcagctgcccgcgcccgagggtaagccagccgccctgcggccattgcaagggccctggccacaacagccccctcccctggcccccgcagtcgacagcctgcatgctggccccggaaaccccgaagcggaggggtccccggcacgcaggcggaaaacaacaccaggggtccctagagaagcatctccaggaagcactaggcgcgacgccaagggaggcttaaaggtagccgccgtgccgacccctctcgcggccccatccctcgacccgagtaggaacccagatatcagctctctcgctaagcagcttcggtcatctaaggggaccctggatctggaggatatcttcccaagcaccggtcagcgccaaacccagttgggcggggaggagcctccgggggcctctctgcccgggaagcaggcccctgccgagaacggcgctgcatcccgaatcaccaagggggaaaaaggccctgcttgttcacgcggtggaggctatagattacttggaaaccctcgtgcccccaggttctcagggttcaggaaagagaaggctaaaatggacatgtgctgtgctgcatccccaagtcaagtggctatggcctctttcagctcagctggcccaccggccgatcctagcaaatctaagttgaccattttcagcaggattcaaggcggcaatatttacagactaccccaccctgtgaaggaagaaaacgtagcgggcagaggcaaccagcaaaatggctcacccaccgattggaccaagcctcgttctacgtttgtgtgtaagaactgtagccaaatgttttacacggagaagggactgtcaagtcacatgtgtttccatagcgatcaatggccttcccctcgtgggaaacaggaaccacaggtctttggaactgagttctgcaagcccttacgacaagtactgaggccggaaggtgaccgtcacagtccccctgggaccaaaaagcccctggatcccacagccgctgcccctcttgtcgtcccccagagcattcccgtggtacccgtgactcggcacatcggttctatggcgatgattcaaactaagacagtcgcccaatgtgtagagtattactacatatggaagaaaatgataaaattcgactgtggaagagcccctggcctggagaagcgagtcaaacgcgaaccagaggaagtggaacgtacagaggagaaagtcccatgcagcccgagagagaggccttctcaccaccccacgcccaaactcaaaacgaagagctatagacgtgagtccatcttgagttccagtccaaatgccggctcaaaacgtaccccggagcttttggggtcagcggagtcacagggaattttcccatgtagagaatgcgagagagtcttcgacaagatcaagagccgtaacgcccacatgaaaaggcacagactgcaggaccacgtagagcctattatacgggtaaagtggcctgtaaaaccctttcagctcaaggaggaagagctgggcgccgacatcggaccgctgcagtggtag

SEQ ID NO: 21753 - DNA, 1803 bp, Artificial Sequence
  Description of Artificial Sequence: Synthetic coding sequence
atggccgccagcgcccaggtgagcgtgaccttcgaggacgtggccgtcactttcactcaagaggagtgggggcagctggacgccgcccaaaggactctgtaccaggaggttatgctggaaacttgcggactcctcatgtctttgggatgtccacttttcaaacccgagcttatctaccagctggatcacagacaggagctatggatggcgactaaagacctgtcccagtcatcttatccgggtgataacactaagccgaagaccaccgaacctaccttttctcatctggccctccctgaggaagtgttgttgcaggagcagctcacacagggcgcatccaaaaattcgcaactcggacagagcaaggatcaggacggtcccagtgagatgcaggaagtacacctcaagatcggcataggtccccagcggggtaaactcctagagaaaatgagtagcgagagggatggcctcgggagcgacgatggagtgtgtaccaaaatcacccaaaaacaggtgtctacggaaggagatttatacgaatgtgacagccatggtcctgtaacagacgcactgatcagggaggagaaaaattcatacaaatgcgaagaatgcggaaaagtcttcaaaaaaaatgctctacttgtgcagcacgaacgaattcacacccaggtaaaaccatatgagtgtacagaatgcgggaaaacattctccaaaagcactcacctgctgcagcacctcataatccatacgggtgaaaagccctataaatgcatggaatgcgggaaggcattcaatcgccgttcacacctcacacgacaccagcggatccactcgggcgagaaaccttataaatgctcagagtgcggcaaggcttttactcatcgttctaccttcgtcctgcaccacaggagtcacacgggggagaaacctttcgtttgcaaggaatgtggaaaagctttccgtgaccggcctggattcattcggcactacatcattcacaccggagaaaagccttacgaatgcatcgaatgcggcaaggcctttaatcgccgctcttatctaacgtggcatcagcaaatacatacgggtgtaaaaccttttgaatgcaacgaatgtggtaaagcattctgtgagtccgccgacctcattcaacactacattatccatacgggtgaaaagccatacaaatgtatggagtgcggtaaggccttcaataggaggagtcatcttaaacagcaccaacgtatccatacaggagagaaaccttacgaatgttctgaatgtggcaaggctttcacccattgcagtacgttcgtgctacacaaaagaactcatactggcgagaagccttacgaatgcaaagaatgtggcaaagcttttagtgatcgagctgatcttattcgccacttcagtattcacaccggggagaaaccttatgagtgcgttgaatgcgggaaagcttttaatagatcttctcacctgacgcgccatcaacagatccacacaggagagaaaccttacgaatgcatacagtgcggaaaggcgttttgcaggtctgccaacttgattcgtcacagcataatccatacaggtgaaaaaccatatgagtgctctgagtgtggtaaagcttttaaccgtggatcaagtcttacccatcaccagcggattcataccggccggaacccaacaatcgtgaccgatgtgggccggccttttatgaccgctcagacatctgtgaatatacaggagcttctccttggcaaggagttcttgaatattaccaccgaagagaatctttggtag

SEQ ID NO: 21754 - DNA, 2148 bp, Artificial Sequence
  Description of Artificial Sequence: Synthetic coding sequence
atggaggcccggagcatgctggtgcccccccaggccagcgtgtgcttcgaagacgtcgcaatggccttcactcaggaagagtgggagcagctagatctggcccagcgcaccctataccgtgaggtcacactggaaacatgggaacacatcgtttctctgggattgtttctgtcaaagtctgatgttatctcacaattggaacaggaggaggatctttgccgcgccgaacaggaagcccctcgcgactggaaggctaccctcgaggagaacaggctgaacagcgaaaaggaccgtgcacgcgaggagctttctcatcatgttgaggtgtatcgctcgggacctgaagaaccgccttctctcgtcttgggaaaagtccaggaccagtcaaaccagctgcgcgaacaccaggaaaactccctgcggtttatggtcctgaccagtgaacggctcttcgcccaaagagaacactgtgagctcgaactgggtggaggttactccttaccaagcactctgagtctgctcccaaccacactgccgacctccaccggctttccaaagcctaatagccaggtaaaggagctcaagcagaactcagctttcatcaatcatgagaaaaacggagccgatggtaaacattgcgaatcccaccagtgtgcgcgcgccttctgccagagcatctatctttccaagctgggaaacgtggaaactggcaaaaaaaatccctacgagtatatcgtgtctggtgactcgcttaattacggaagcagtttgtgctttcacgggcggacattctctgtcaagaaatccgacgattgcaaagattacggcaatctgttctctcatagcgtgtccctaaacgagcaaaaaccagtccactttggaaaaagtcagtatgagtgtgacgaatgtagagagacctgtagcgaaagtctgtgcctcgtgcagacagagcggagcggaccaggggagactccctttcgatgtgaggagaggtgcgccgcttttcctatggcctcttcatttagtgactgcaacatcatacaaaccaccgagaaaccatcggtgtgcaaccagtgcgggaagtctttcagctgctgcaagctcatccatcaacgcactcacaccggtgagaagcctttcgaatgtacacagtgtggaaagagctttagccagtcttacgacctggtcatccatcaaagaacacatacaggcgagaagccgtatgagtgcgacctttgcggtaaaagcttcacgcagagaagtaaattaattacacatcagcgaatccacacaggggagaaaccataccaatgcatcgaatgtaggaagagttttagatggaatagcaacttgattgtgcaccaacgaattcataccggagaaaagccatatgaatgcacccattgcggaaagtctttcagccaaagctacgaactggttacacataagcgcacacacactggtgagaagccgtttaagtgtacacagtgcggcaagtcatttagccagaagtacgaccttgtcgtgcaccagcgcacacacactggcgaaaagccctacgaatgtaacttgtgtggaaaatctttctcacaaagctctaaactgatcacacaccaaaggattcacaccggggagaagccctaccagtgtattgagtgcggcaagtcattcaggtggaattccaatctcgttattcaccaacggatacacacaggagaaaagccttatgattgtacccattgcggaaaaagtttttctcagtcctatcagctggtggctcacaaacgaacacacaccggagagaagccatatgagtgtaacgaatgtggcaaggcattcaaccggagcacccagctgatacggcacctgcagatccatacaggagaaaagccttacaaatgtaaccagtgtaacaaagcctttgcacgaagtagctacctggttatgcaccagcgcacccatacaggggagaaaccttttgagtgcagccagtgcgggaaggcctttagcggttcctcgaatcttctctcccaccaccggattcactcaggagaaaaaccatacgaatgttctgactgcggcaaatcatttagacaacagagccagctcgtggtgcacagacgcacccatacaggggaaaagccttag

SEQ ID NO: 21755 - DNA, 321 bp, Artificial Sequence
  Description of Artificial Sequence: Synthetic coding sequence
atggaggcccggagcatgctggtgcccccccaggccagcgtgtgctttgaggacgtcgccatggccttcacccaagaggaatgggaacagttggatctggctcagcgcaccctctacagagaagtaacactggagacctgggagcacattgttagtttaggactctttctttcaaagagtgacgtaattagccagctggagcaagaagaagacttgtgccgagcggagcaggaggccccccgcggcaccagcggactcagccaggtgacgggagtggtggccgatggatccttccggttccctgtatgggatttcacgtag

SEQ ID NO: 21756 - DNA, 2064 bp, Artificial Sequence
  Description of Artificial Sequence: Synthetic coding sequence
atggaggcccggagcatgctggtgcccccccaggccagcgtgtgcttcgaggatgtcgctatggcattcacacaagaagaatgggaacagctggacttagcgcagcggactttgtaccgggaagtaacccttgagacttgggaacacatcgtgagcctggactggaaggcaaccctcgaggaaaatagattgaacagcgaaaaagatagagccagagaagagctttcccaccacgtcgaagtctatcgatccggacccgaagaacctccatcactcgtgctggggaaggtccaggatcagtccaatcagctcagagagcaccaggaaaactccctgcggtttatggtgctcacctcagagagattgtttgcgcagcgggaacactgtgagctcgagctggggggggggtactccctgccctcaaccctgtctctcttacctaccactctgccaacatccaccggcttcccaaagcccaattcccaggtaaaggagctgaagcagaactctgctttcattaaccacgaaaagaacggggctgacggtaagcattgtgagtcccaccagtgcgcaagagccttctgccaatctatttatctgtctaaacttgggaatgtggagactgggaaaaagaacccttatgagtacattgtcagtggggattccctgaactacggttcatccctatgcttccacgggaggactttctccgtcaaaaaatctgatgattgtaaggattacgggaatcttttttcccattctgttagcttgaacgaacagaagcctgtgcatttcggaaagtcccagtatgagtgtgatgagtgcagagagacatgctccgaaagtctgtgtctggtacagacggagcggtcgggacctggcgagacccccttccgttgtgaggaaagatgcgccgcgttccccatggcttcaagcttcagcgactgcaacatcatccagaccacggaaaagccgagtgtgtgcaatcagtgtggaaaaagtttcagctgctgtaaactaattcaccagagaactcacaccggagaaaagccctttgaatgcacgcagtgcggaaaatccttttcccagtcatacgacctcgtcatccatcagaggactcacaccggtgagaagccgtacgaatgtgacttgtgcggcaaaagcttcacccagagatccaagctgataacgcaccagcgcatccacacgggtgaaaaaccttaccagtgcattgaatgcaggaaaagcttccgctggaatagcaacctcatcgtccatcagcgaatccacacaggagagaaaccttatgagtgcacgcactgcggaaagagcttctcccaaagctatgagctcgtcactcataagcgcactcacacgggcgaaaaacccttcaagtgtacccagtgcggaaagtcctttagccagaagtacgatctggtagtacaccagcgtacacacaccggagaaaaaccctacgaatgcaacctgtgtgggaagtctttctcccagtcttcgaagcttatcacccatcaacggatacacacaggggaaaagccctaccaatgcatcgaatgcggaaaatcctttaggtggaattcgaacctcgtgattcatcaacgtatccatacaggagaaaaaccctatgactgcacacactgcggaaaaagtttctctcagagctatcagctggtcgcacataaacgaacgcatacgggagaaaagccatatgaatgtaacgaatgcgggaaggcatttaataggtccactcagctgatccggcacctgcagatccacacaggtgagaagccatacaagtgtaaccagtgcaacaaggccttcgctcgaagtagttatctggttatgcaccagcgtactcataccggggaaaaaccattcgagtgctcacagtgcggaaaggcttttagcggctcttcaaacctcttgtcccaccatcgaattcattcaggagaaaaaccttatgagtgttctgactgcggcaaaagttttagacaacagtcgcagctggtggtgcaccgtcgtacacacacgggggaaaagccttag

SEQ ID NO: 21757 - DNA, 804 bp, Artificial Sequence
  Description of Artificial Sequence: Synthetic coding sequence
atggccagcagcttcagcgactgcaacatcatccagaccaccgagaaacccagtgtttgtaatcagtgcggcaagagcttttcgtgctgcaagctgatccaccaaagaactcacaccggcgaaaaaccctttgagtgcactcagtgtggcaagagcttctcacagtcctacgatctcgtgattcatcagcggactcatactggagaaaagccctacgagtgtgatctgtgcgggaagagcttcacacagaggtcaaagctgatcacacatcagaggatccacaccggggaaaagccataccagtgcattgagtgtcgcaagtccttcagatggaactcaaatctgatcgtgcatcaaaggatccacaccggagaaaagccttatgagtgtactcactgtggaaagagcttctcgcaaagctacgaactcgtcgcgcataaacgcacccacactggagagaagccttacgagtgtaacgaatgcggtaaggctttcaaccggagcacacagctaatcagacatctccagatccatactggcgagaagccatacaaatgtaatcaatgcaataaagctttcgcccggagctcatatctcgttatgcaccagaggactcacacaggagagaaaccctttgaatgtagtcagtgtggaaaggccttttccggcagttcaaatctgttgagccaccatcgaatccactctggcgaaaagccctatgaatgcagcgattgcggcaagagcttccgacagcagtcgcagctggtggtgcataggcggactcacacgggagagaagccctag

SEQ ID NO: 21758 - DNA, 2511 bp, Artificial Sequence
  Description of Artificial Sequence: Synthetic coding sequence
atgcaggtggacccccccctgcacggcccccccaacgacttcctgatatttcaaatcatcccactgcattcactgtctattatgcctagatttctgtggatcttgtgtttctctatggaagaaacacagggggaactgacaagctcttgcggcagcaagacaatggctaatgtgtccttagctttccgtgacgtctcgatcgacctttcacaggaggagtgggagtgtttagacgccgtgcaaagagacttgtataaggacgtgatgctggagaattattccaacctcgtgtccttgggctatactattcctaaacctgacgtgattactctgctggagcaagagaaagaaccatggattgtgatgcgtgaaggcactcggaactggtttaccgatttggagtacaagtacattacgaaaaacctgctgagcgagaagaacgtgtgcaagatatatctgtctcagctccagaccggggagaagtcaaagaataccattcatgaagatactatcttccggaacggtctgcagtgcaagcacgagttcgagaggcaggagaggcatcagatgggttgcgtctctcagatgctcattcagaagcaaataagccatcctctacaccctaaaattcacgcccgcgagaaatcatatgaatgcaaggagtgtcgcaaagcattccgacagcagagttacttgattcagcaccttagaatacacacaggagaaagaccatacaaatgtatggagtgcggcaaggctttctgtcgggttggcgatctgagagtgcatcataccatacatgccggtgagcgcccatacgaatgcaaggaatgcggcaaggctttcaggctccactaccatctgacagaacatcaacggattcacagtggagttaaaccctacgagtgcaaagaatgcggcaaggcattctcaagggttcgggacttacgcgtgcaccagacgatccacgctggagagcgtccatacgaatgtaaagaatgtggcaaggcttttagactccattatcagcttaccgaacaccaacgcatccacaccggggagagaccctacgaatgtaaggtgtgtggaaaaacattccgtgtccagaggcacatcagccagcatcaaaagatacataccggtgtaaaaccatataaatgcaatgaatgtggcaaagccttctcccacggcagttacctggtccagcaccagaaaatacacaccggggaaaagccttatgaatgcaaggaatgcggcaaaagtttcagctttcacgctgaactcgcaaggcacaggaggatacatacaggggagaagccatacgaatgtcgcgagtgcggtaaagcattccgcctgcaaactgaattaacacgccaccatcggacacacaccggtgagaaaccttacgagtgtaaagagtgcgggaaggctttcatatgtgggtatcagttgacactacatctgcggactcatacaggcgagattccatacgaatgcaaagagtgcggaaagacgttttcatcaagatatcacctcacccagcactataggatacacactggcgagaagccttacatttgtaatgaatgcggcaaagccttccgcttacaaggtgagttgacgcgtcaccaccggattcatacgtgcgaaaaaccctacgaatgtaaggagtgtggtaaggcatttattcactccaaccaattcatttcacaccagcggatacatacctcagagagtacgtatatctgcaaagaatgcggtaagatatttagccgtcggtacaatctaactcagcacttcaaaatccacacgggggaaaaaccatacatctgtaatgaatgtggaaaagcatttcgcttccagactgaactgacgcagcatcatagaatccacacaggcgagaaaccatacaaatgcaccgagtgtggcaaagccttcattagaagcacacacctcacgcagcaccacaggatccacacaggcgaaaagccctacgaatgtacagagtgcggcaagactttttcccgccattaccacttgacgcagcatcaccgtggtcatacaggcgaaaagccttacatttgtaatgaatgtggcaacgcgttcatatgctcctatcggctcaccctccaccaaagaattcacacaggcgaactcccatatgagtgtaaggagtgtggaaagaccttttctagaagataccacctcactcaacattttcggctccacaccggggagaagccttactcttgtaaggagtgcggcaacgcattccggcttcaggcggaactgactcggcaccacatcgttcataccggcgagaagccatataaatgtaaagagtgtggaaaggctttttctgttaatagcgagctgacgcgacatcatagaattcacacgggggaaaagccatatcaatgcaaggaatgcgggaaagcctttattcgaagtgaccaacttaccctgcatcaacggaaccacatttctgaggaagttctctgtatcatgtag

SEQ ID NO: 21759 - DNA, 1344 bp, Artificial Sequence
  Description of Artificial Sequence: Synthetic coding sequence
aagaccttccgggtgcagcggcacatcagccagcaccagaagatccatacaggtgttaaaccctacaaatgtaacgaatgtggcaaagctttcagccacgggtcctacctagtccaacaccagaagatccacactggggagaaaccatacgagtgtaaggagtgcggtaagtccttctccttccacgccgagcttgcacgccaccgacggatccacactggggagaaaccgtacgaatgccgggagtgcggcaaagctttcagattgcagaccgagttaactaggcaccatagaacgcacaccggcgagaagccctacgaatgcaaagagtgcggtaaggcatttatctgtgggtatcagctgaccctccacctgcggacacacactggggagatcccatatgagtgcaaagaatgtggcaagactttttcatcgcgctaccacctcactcaacactaccgcatccatacaggcgagaaaccttacgagtgcaaggaatgcggaaaggcattcatccatagtaatcagttcataagtcatcaacggatccacacttctgaatcaacctacatttgcaaagagtgtggaaagatattttctaggaggtataatctgacgcaacacttcaaaatccacaccggtgagaagccctacatctgcaacgaatgcgggaaggccttcaggttccagacagagctgactcagcaccacaggatccacacaggagaaaaaccctacaagtgtacagaatgtggaaaagcattcatacggtccacacacctcactcaacaccacagaatacacactggtgaaaagccctatgaatgtaccgaatgtggcaagacttttagccggcactaccatctgacccagcaccacagggggcataccggcgaaaaaccctacatttgtaatgagtgtgggaacgcctttatctgctcctacagactgaccctgcaccagcgaatacacaccggggagctgccctacgagtgtaaggagtgtggtaaaacatttagcagacgctaccacttgacacagcattttcggctgcatacaggagagaagccctactcctgcaaggagtgcgggaatgcatttagactccaggcagagctaacaaggcatcacatcgtgcacactggggagaaaccctacaagtgcaaagagtgcggcaaagccttttctgtcaacagcgagctgacccgacaccatagaattcacacaggcgagaagccatatcaatgcaaagagtgcggcaaggccttcatcagatctgatcagctcacgctgcaccaaagaaatcacatctccgaccgtgagttcgtaatttgtaaggaatag

SEQ ID NO: 21760 - DNA, 1209 bp, Artificial Sequence
  Description of Artificial Sequence: Synthetic coding sequence
atggccgagatgaaccccgcccagggccacgtggtgttcgaggacgtcgccatctacttctctcaggaagagtggggccatctggatgaggcgcaacgtctcctgtacagggatgtgatgttggaaaacctcgcattgctgagcagtctgggatgttgtcacggggcagaagatgaagaggcacccttggagcccggcgtgagtgtgggggtgagtcaggtaatggctcctaaaccatgtctgtcaacccagaacactcaaccatgtgagacgtgctcctccctgctcaaggatatccttcgtttggccgagcacgatggcacacaccctgaacaaggactctatacctgccccgcgcatctccaccagcatcaaaaggagcaaatccgtgaaaagttgtccaggggagacggaggtcggcccacttttgtgaagaaccacagggtgcacatggctggcaaaacgtttctgtgcagtgagtgcggtaaggcctttagtcacaagcataagctatctgaccatcagaaaattcatacgggcgaacggacatacaaatgttcgaagtgtggcattttgtttatggaaaggagtacccttaatcggcaccagcggacccacaccggtgaaaggccttatgaatgtaacgaatgcggcaaggcttttctttgcaagagccacctcgtgcggcaccagactatccacagcggtgagagaccctacgagtgtagtgagtgcggaaagttgtttatgtggtcctctaccttgatcactcatcagagggtgcacactgggaaaagaccctatggttgttctgagtgcggtaaattcttcaaatgtaatagcaatctgttccgccactacaggattcacacaggcaagaggagctacggatgcagcgagtgtgggaagttttttatggagcgctcaactttatctaggcaccagcgagtacacactggagagagaccatatgagtgcaatgagtgtggaaaattcttcagtctgaagtccgtgctgatccagcaccagagagttcataccggtgagcggccctatgaatgtagcgaatgtggaaaggccttccttaccaaatctcacttaatctgtcatcaaactgtccatacggccgcaaaacagtgcagtgagtgcggaaaatttttcaggtataacagtactctgctgaggcaccaaaaagtacacactggctag

SEQ ID NO: 21761 - DNA, 1065 bp, Artificial Sequence
  Description of Artificial Sequence: Synthetic coding sequence
atggccgagatgaaccccgcccagggccacgtggtgttcgaggacgtcgcaatctactttagccaggaggaatggggacacttggacgaagcccaaagactcctgtatagagacgttatgctcgaaaatctggcactcttatcctcccttggatgctgccacggggcagaagacgaggaggctccccttgaacctggagtgtccgtgggggttagccaggtgatggcgcccaagccctgtctgagcacccagaatactcagccttgcgagacatgtagcagcctgctcaaggacatcttgcgtcttgcagagcatgatggcacacatccagaacagggtctgtacacctgccctgcgcatctgcatcagcaccagaaggagcagattagggagaagctaagccgtggcgacggcggtcggcctacgttcgtcaagaaccaccgcgtccatatggcggggaagacatttctgtgttccgagtgcggaaaagctttttcacataagcacaagttgtccgaccatcagaaaattcataccggagaacgtacctacaaatgcagcaagtgtggcatcctttttatggaacggagcactctcaatagacaccagcggacacatacgggtgagcgcccttacgagtgcaacgagtgtggcaaggctttcctctgcaagagtcacctcgtccgacaccagaccatccatagtggggagcgaccttacgagtgcagtgaatgtgggaaactcttcatgtggtcttcaactttaattacccaccagcgggtgcatacggggaagaggccgtatggttgctcagagtgcggcaaatttttcaagtgtaattcaaacctgtttaggcattacaggatacacactggcaaaagatcttacggatgcagcgaatgcgggaagtttttcatggaacgaagcaccttatcccggcaccagagggtccacactggagagcggccctatgagtgcaatgagtgtggaaagttcttcagcttgaagtctgtactgatccagcaccagcggagggtctacacagaggaagaaagcttccagtag

SEQ ID NO: 21762 - DNA, 1638 bp, Artificial Sequence
  Description of Artificial Sequence: Synthetic coding sequence
atgaacctgaccgagggccccctggccatggccgagatggaccccactcaaggcagagtcgttttcgaagacgttgcaatatacttcagtcaggaagagtggggccatctcgacgaggctcagcggctgttataccgcgacgtcatgctggagaacctcgctttactatccagtctcggaagttggcatggagcagaggatgaggaagcacctagccaacaaggcttcagcgtcggcgtgtcggaggtcacggcatccaagccatgtctaagctcacagaaagttcaccctagcgaaacctgcggtccccctctgaaggatattctatgtctggttgaacataatggtatccacccagaacagcacatctacatttgtgaggccgagcttttccagcatcctaaacagcagatcggcgaaaaccttagtcgcggcgacgattggatcccatctttcggcaaaaaccaccgtgtgcacatggcagaggagatcttcacctgtatggagggttggaaagacttacctgccacatcttgtcttctgcagcatcagggcccccagtctgagtggaaaccttatcgcgatacggaagatagggaagcctttcagacaggacagaatgactacaagtgttccgagtgtggaaaaaccttcacttgctcttactcctttgtggagcatcagaaaatccataccggagaaagatcctatgaatgtaacaagtgtggaaaatttttcaagtattctgctaactttatgaagcaccagacagtgcacacctccgagcgaacatatgagtgccgggagtgcggcaaaagttttatgtataattaccgacttatgcggcacaagcgggtgcacaccggggagcgcccttacgagtgcaacacatgcggaaaattttttcggtacagtagcaccttcgtgcgccaccagagagtgcacacgggcgagaggccatacgagtgccgggagtgtggtaagttcttcatggactccagtactctgattaagcatcagagagtgcacactggcgaacggccatacaaatgtaacgactgtgggaaattttttagatatattagcactctaatccgccaccaacggatccataccggcgagaggccctacgaatgttccgtgtgtggcgaactctttcggtataatagctccctggttaagcattggaggaatcacacaggcgagaggccatataaatgttccgagtgcggaaagtcattccggtatcattgtcgcctcatccggcatcagcgggtccacacgggggaaagaccttacgagtgctcagagtgtggaaaatttttccgttataacagcaatctgattaagcattggcgaaatcacacaggagaaaggccctatgagtgcagagagtgtggaaaggctttttcacataagcacatccttgtggaacatcagaagatccactccggcgagcggccatacgaatgctctgagtgtcagaaagccttcatccggaaatctcacctcgtacatcatcagaaaattcactccgaggaacgcctggtttgcagtatgaatgtgggcaacagcctggcgaagactccaacgagtttaaacatcagggactttaccatggaaaaagtttatcactag

SEQ ID NO: 21763 - DNA, 1602 bp, Artificial Sequence
  Description of Artificial Sequence: Synthetic coding sequence
atgaacctgaccgagggccgggtggtgttcgaggacgtggccatctatttcagccaggaggagtgggggcatctggatgaggcacagcggctgctgtacagggacgttatgctggaaaatctagcactgctgtctagtctcgggagctggcacggcgcagaggacgaagaggccccttctcagcagggtttctccgtcggcgtgagcgaagtgaccgccagcaaaccatgccttagttcccaaaaggtgcatccatccgagacctgtggtccaccactgaaagatatactgtgtctcgtggagcacaacgggattcatccagagcaacacatctatatctgcgaggcagaactatttcaacatcctaaacagcagatcggagagaacctgagtcggggcgatgattggattccttcttttgggaaaaaccaccgcgtccacatggctgaggagattttcacatgtatggagggttggaaggacctgccggccacatcttgtctgctacaacatcagggcccgcaaagtgagtggaagccataccgcgacactgaagaccgggaagctttccaaactggccaaaatgattataagtgtagcgaatgtggaaagaccttcacttgcagctattcatttgtggaacaccagaaaattcacactggcgaaagaagctacgaatgcaataagtgtgggaagttttttaagtactctgcaaacttcatgaaacaccagacagtccacacaagcgaaaggacttatgagtgccgggaatgcgggaaatcctttatgtacaactaccggctgatgcgccataagcgagtgcacactggagaacgcccatacgagtgtaacacatgcggaaaatttttcagatacagtagcactttcgtgagacaccaaagagtacatactggcgagcgcccgtacgaatgccgggagtgtggaaaattctttatggatagcagcacattaatcaagcatcagagagtccatacaggtgagcgcccttacaaatgcaatgattgcggtaaatttttcagatacatcagtactcttattcgccaccaaagaatccacacaggcgaaagaccctatgaatgctcagtatgcggtgagctttttagatacaattcaagtttggtgaagcactggcgcaaccatacgggtgaaagaccttataaatgcagcgaatgtggcaaatcattcaggtatcactgccgcctgattagacaccaacgggttcacactggcgaacgcccatatgagtgctctgaatgtggtaaattcttcaggtacaatagtaatttgataaaacactggaggaatcacacaggggagaggccctacgaatgccgcgagtgcggcaaagccttttcgcacaaacacattctggttgagcaccagaagatccacagtggagagcgtccgtacgaatgttccgaatgccagaaggccttcatcaggaaatcccacctggtgcaccaccagaaaatccactctgaggaaaggctggtgtgttccatgaatgttggaaattcattggccaagaccccaaccagtttgaatatcagagattttacaatggaaaaagtgtatcactag

SEQ ID NO: 21764 - DNA, 1884 bp, Artificial Sequence
  Description of Artificial Sequence: Synthetic coding sequence
atggccgaggccgccctggtgatcaccccccagggccacgtgaccttcgaagatattgcagtgtatttcagtcaggaagaatggggtttgctggatgaggctcaacggtgtctgtaccacgacgtcatgttggagaatttcagcctcatggcttctgtaggctgtttgcacgggatcgaggccgaggaggcgcccagcgaacagactctatctgcccagggtgtcagccaggcccggactcctaagctgggcccgtctattcctaacgctcattcctgtgagatgtgcattcttgtcatgaaagatattctctatctgagcgagcaccagggtactctcccatggcaaaaaccctacacttcagtcgctagcggcaagtggttttccttcggcagtaatctacagcagcaccagaaccaggactccggggagaagcacataagaaaggaagagtcctccgcccttcttctgaactcctgcaaaatacccctgtccgataacctgttcccctgtaaggacgttgaaaaagactttcccacaatcctggggttgctacagcatcagaccacacactctaggcaggaatacgcccaccggagccgggaaacctttcagcaacgcagatataagtgtgaacaggtgttcaatgaaaaggttcacgtcactgaacaccagcgggtccataccggagagaaagcatacaagcggagagagtacggcaaatccttaaactcgaaatatctgtttgtggaacaccaacgtactcacaacgctgaaaagccctatgtgtgcaacatctgtgggaaatcgttcctgcacaagcagacactggttgggcaccagcagagaatacatactcgagaacggtcctatgtttgcatagaatgtggaaaaagcctctcatcaaaatattctctggtcgaacaccagcggactcataatggagaaaagccctacgtgtgtaatgtgtgcggtaagtcttttagacacaaacaaacatttgttggacaccagcagaggatccacaccggggaaagaccctatgtttgcatggagtgtggcaagtcgtttatccactcatatgatcggatccgtcatcagcgtgttcatacaggcgagggagcgtaccagtgttctgagtgcggaaaaagcttcatatacaagcagtcactcctggatcatcacagaattcacactggcgagagaccctatgaatgtaaggaatgcgggaaagctttcatccacaaaaaacgcctgctggaacaccaacgcatccacactggtgaaaaaccatacgtgtgtattatctgcggaaagagttttatccgcagtagtgattatatgcgccaccagaggatccatacaggagagagggcctatgagtgctcagactgcgggaaggcattcatcagtaagcagaccctgctgaaacaccataagattcacaccagagagaggccctacgaatgcagtgagtgcggaaagggtttttacctggaagtgaaactgcttcagcatcagcggattcacacccgcgagcaactatgtgagtgtaacgaatgtggaaaagtgttttctcaccagaagagactgctcgagcatcaaaaagtgcacacgggtgagaagccttgcgagtgttccgaatgcggtaaatgtttccgccacaggacatcacttattcagcaccagaaagtccacagtggtgagcgcccatataactgcacggcatgcgagaaagccttcatttataagaacaagctagtcgaacatcagcgaatccataccggagagaagccttacgagtgtggcaagtgtggcaaagccttcaacaagcggtactcactcgttaggcaccagaaggtccatatcaccgaggaaccctag

SEQ ID NO: 21765 - DNA, 1923 bp, Artificial Sequence
  Description of Artificial Sequence: Synthetic coding sequence
atggccgaggccgccctggtgatcaccccccagatccccatggtgactgaggaattcgtcaaacctagccagggccacgtcaccttcgaagacatcgccgtgtacttctctcaagaggagtgggggctgctggacgaggcacagcggtgtctctatcatgacgtgatgctcgagaacttttcgctgatggcctctgttggttgcttacacggaattgaggcagaggaagcaccctccgaacaaaccctatctgcacaaggggtgtctcaggcaagaacgcccaagctaggcccttctatccccaacgctcacagttgcgagatgtgcatcctcgtcatgaaagacattctgtatctgtcagaacaccagggcactctgccttggcagaaaccatacacaagtgttgcttccggaaaatggttcagttttggctcaaacctgcagcagcatcagaatcaagactccggggaaaaacatatccgcaaagaggaaagctcagcactactgctgaactcttgtaaaattcctctgtcggacaatctgtttccatgtaaggatgtggaaaaggatttcccaaccatcctaggcttactgcagcaccagaccacccacagccgacaagaatacgctcatcggtccagggaaacattccaacaacgacggtataaatgcgaacaggtatttaatgaaaaggtgcacgtcacggagcaccaaagagtacataccggagaaaaagcatataaaaggcgcgaatatgggaagagccttaactctaagtacctatttgtggagcatcaaagaacgcacaacgctgagaaaccttacgtttgtaatatttgtgggaagtcctttttgcataagcagacgttggttggacaccagcagcgcattcacacgagagagaggtcttatgtgtgtatcgagtgcggcaagtcgctgtcttcaaagtattccctcgtggagcatcagagaactcacaacggggaaaagccctacgtgtgtaatgtttgcggcaagagtttccgtcacaagcaaactttcgtagggcatcaacagaggattcatacaggtgagcgaccatacgtatgcatggagtgtgggaagagtttcatccattcttacgatcgaattcgccatcagcgggtgcacaccggggaaggcgcctaccagtgctctgagtgtgggaaatccttcatctacaagcagtccctgctcgatcatcatcggatccatacgggtgaaagaccctatgagtgcaaggaatgtggtaaggccttcattcataaaaagcggctcctggaacaccagcggatccacaccggcgaaaagccatacgtgtgcattatctgcggcaaatcctttatccgttcgtcggactacatgaggcaccagcgcatccacacaggggaaagagcatatgagtgctcagactgcgggaaggcatttatttccaaacagaccttgctgaagcaccataagatccatacgagagagaggccatatgaatgcagcgagtgcgggaaaggcttctacctcgaagtgaagttgctccagcaccagcggatacacacacgcgaacagctttgcgagtgcaacgaatgcgggaaagtgttctcacatcagaaaaggctgctcgagcatcagaaagtccacaccggtgagaagccgtgcgagtgctcagaatgcgggaaatgtttccgacaccgtacttcgcttattcagcatcaaaaggtgcatagtggggaacggccttacaattgcacagcctgtgaaaaggcttttatctataaaaacaaactggtagaacaccagcggattcacacaggtgaaaagccctatgagtgcggcaagtgcggtaaagccttcaataaacgttatagcctcgttaggcaccagaaggtccacatcaccgaagagccttag

SEQ ID NO: 21766 - DNA, 1173 bp, Artificial Sequence
  Description of Artificial Sequence: Synthetic coding sequence
atggccgagaccaaggacgccgcccagatgctggtgaccttcaaggatgttgcagtcacgttcacacgcgaagagtggaggcagctggatctagcacagcgtacactgtaccgtgaggtgatgctggagacttgcggcctgctggtgagcctaggggatagagcccaggtgcacactagagaacctactacctacccccctgtgctgagcgaaagggcttttcttcgcggcagcctcaccctggagagcagtacatcaagcgattcccgcctgggacgagctcgggatgaagaaggtttgctagagatgcaaaaaggaaaagtgactcctgagactgacctccacaaagaaacccacctcggcaaggtctccctggagggcgaaggcctgggtaccgacgatggactccactctcgggccctgcaggagtggttatccgccgatgtgttacacgagtgtgactcccagcagccagggaaagatgccttgatccacgcgggaacaaatccttacaaatgtaaacaatgtgggaagggttttaataggaagtggtatctcgtgcgccatcagagggtgcatactggcatgaagccctacgaatgtaacgcatgtggaaaggcctttagtcagtcttcgactctcatcagacattatcttattcacacaggcgagaaaccttacaagtgccttgagtgcggtaaagcctttaaacggcggtcctatttaatgcagcaccacccaattcacaccggcgagaagccctacgagtgcagtcagtgccgcaaagccttcactcatcgttccacattcatcaggcacaacaggacacacaccggcgaaaagccgtttgaatgcaaagaatgcgagaaggcgttctccaaccgggcccatttaattcagcactacatcattcatacaggagaaaaaccttatgattgtatggcctgcgggaaagcttttcggtgctcttcggagctgattcagcatcaaaggatccatacaggggaaaagccatacgagtgtactcagtgtgggaaggcgttccacaggagtacatatctcattcagcattccgtcattcatacaggcgagatgccatacaaatgtatcgagtgtgggaaagcgttcaaacgtcgatcccatcttctgcaacaccagagagttcacacctag

SEQ ID NO: 21767 - DNA, 1269 bp, Artificial Sequence
  Description of Artificial Sequence: Synthetic coding sequence
atggccgagaccaaggacgccgcccagatgctggtgaccttcaaggatgtagccgtgacatttactcgtgaagaatggagacaattggatctcgcacagaggacactgtatcgcgaggtgatgctggaaacttgcgggctactggttagcctggggcatcgagttccgaaacccgaactggtccatctgctcgaacatgggcaggagctgtggattgttaagaggggcctgtcccatgccacttgtgccggagatcgggcccaggttcacacacgagagccgacaacctacccacccgtcctctctgaaagagcattcttgcgagggagcttgactcttgagtccagcaccagcagcgattctagactgggccgggctcgggatgaagaaggactgctcgagatgcagaaagggaaggtgactcctgaaaccgatttgcacaaggaaacccacttaggtaaagtgtccctcgagggtgaagggttggggaccgatgacggcttacattcgcgggctcttcaggaatggctgtctgctgatgttctccacgaatgtgactcacaacaacccgggaaggacgcactgattcacgcgggtacaaatccatacaaatgcaagcagtgtggcaaaggctttaaccggaaatggtatctggttaggcatcagcgggttcacacaggaatgaagccctatgaatgcaatgcatgcgggaaggccttctcccagagcagtacactcataagacattatctgatccataccggtgagaagccatataagtgcctggaatgcgggaaggcctttaaacgccgctcctaccttatgcagcaccatcctattcatacgggggagaaaccttatgaatgtagtcagtgccgaaaggcctttacccacaggtcaacattcatacgacacaaccggactcacactggtgagaagccattcgagtgtaaagagtgcgagaaagctttctctaatcgggcgcatctgatacaacactacatcatccacaccggggaaaagccatatgattgtatggcctgtgggaaggcttttagatgcagttcagaactgattcagcaccagaggatccacactggggagaagccatacgagtgcacacagtgcgggaaggcatttcacagatctacttatttaatccaacactcggtgattcacaccggagagatgccctataagtgcattgagtgcgggaaagcctttaagcgcagaagccatctactgcagcaccagagggtgcacacctag

SEQ ID NO: 21768 - DNA, 1146 bp, Artificial Sequence
  Description of Artificial Sequence: Synthetic coding sequence
atgctggtgaccttcaaggacgtggccgtgaccttcacccgggaggagtggcggcagctcgatctagcccagcgcacactttacagggaggttatgttagaaacatgcgggctactcgtatcgctgggtgatcgggcccaagtgcacacccgagagccgactacttatccacccgtcctgtcggagcgggccttccttcggggctcactgaccctggagtcgtctacctcttcggactcccgattggggagagcccgggatgaggaaggcctgctggagatgcagaagggtaaggtcacacccgagaccgaccttcacaaagagacccacctaggcaaagtatcattggagggcgaaggtctgggaaccgatgatggcttacatagtcgggccctgcaggaatggctgtctgcagatgtcctccacgaatgtgatagccagcagcctggaaaggatgccctgattcacgcagggaccaatccatataaatgcaagcagtgcggaaaaggttttaataggaagtggtatctggtccgccatcagcgcgttcatactggaatgaagccatacgaatgtaatgcgtgtggtaaagcttttagccaaagctccactttaatccgacattatcttatccacacaggagaaaaaccttacaagtgtttggagtgcggaaaagctttcaaacgcaggtcctacctgatgcagcatcatcctattcacactggagagaaaccgtacgagtgcagtcagtgtcgcaaggcctttacgcaccgaagcactttcataagacataaccgcacgcacactggagagaagcctttcgagtgcaaagaatgtgagaaggcattttccaaccgcgcccatctgatccagcattacattatccataccggcgaaaagccgtacgactgtatggcatgtggaaaggctttccgctgtagtagcgaactgatccagcaccagcgaatccatacgggagaaaagccatacgagtgcactcagtgcggcaaagccttccaccgctcaacgtacctcatccaacacagtgtgatacatacaggtgaaatgccatacaagtgtatcgaatgtggtaaagcctttaagagaagaagtcacctgctgcagcaccagagggtgcacacctag

SEQ ID NO: 21769 - DNA, 1965 bp, Artificial Sequence
  Description of Artificial Sequence: Synthetic coding sequence
atggccgccgtggccctgcgggacagcgcccagggcatgaccttcgaagacgtggctatctactttagccaagaggagtgggagctgctggatgagtcccagcgcttcttgtattgcgatgttatgttagagaatttcgcccacgtgacctctttggggtactgccatggaatggagaatgaagccatagcttcagaacagagtgtttctattcaggttagaacttctaaggggaacacgcctactcagaaaacccacctcagcgaaatcaagatgtgtgttcctgtgctgaaagatattttacccgctgcggagcaccagacaacctcacccgtacaaaaatcttatttgggcagcacgtccatgagggggttttgcttttctgctgaccttcaccagcaccaaaaacactataatgaagaggagccgtggaagcgaaaagtggatgaagccacgtttgtaaccgggtgccgttttcatgtcttgaactactttacatgtggagaggcatttccagctcctacggaccttttgcagcacgaggccacgccctccggtgaagaacctcactctagctcctctaagcacatacaggccttttttaatgcaaaatcatattataagtggggagaataccgtaaagcgtcatcccataaacacaccctggtacagcaccagagtgtttgctctgagggcgggctgtatgaatgttcaaagtgcgagaaggccttcacttgcaaaaacacactcgtacaacaccagcaaatacataccggacaaaaaatgttcgagtgttcagagtgtgaggagtccttttcaaagaagtgtcatttaatccttcataaaattatacatacaggcgaacgtccctatgagtgtagtgaccgagagaaggctttcatccacaagtccgaattcatccaccatcagcgccggcacactgggggggtgcggcacgagtgtggcgagtgccgcaagactttcagctacaagtcaaatctaattgaacaccagcgagtccatactggtgaaaggccgtatgagtgcggcgaatgcggtaaaagtttccgtcagtcatcaagcttgtttcggcaccagcgagttcactctggcgagcggccttaccaatgctgtgagtgtggaaagagcttccgacagatttttaacttgatcagacaccgccgagttcacactggtgagatgccttaccagtgttctgactgcgggaaatcttttagttgcaaatcagaactgatccagcaccagcggattcattctggggaaaggccttatgagtgtcgggaatgtggcaagagtttccgccaattttcaaacctaatcagacaccggtcaatccatactggggaccgcccgtacgagtgttcagaatgcgagaagtcctttagtaggaaattcattctcattcagcaccagagagtccataccggcgaacgaccgtatgaatgctccgagtgtggaaagagcttcacccgtaaaagcgaccttatccaacatcggagaattcatactggtactcgaccttatgaatgctcagagtgcggaaaaagtttcaggcaacgcagtggcctgattcagcacaggaggctgcacaccggggaacgcccatacgaatgctcagagtgtgggaagtcctttagccagtccgcttcgctcatacaacatcaacgggtgcacacaggtgaaagaccatatgaatgcagcgaatgtgggaagagtttttctcagtcctcctcactgattcagcatcagcgaggacacaccggagagaggccgtacgagtgtagtcagtgtggaaagccgtttacacataaaagcgacctcatacagcaccaaagggtccacaccggtgagcggccgtatgagtgctctgaatgcggtaagtcattttcaaggaaatccaacttaatccgccaccgcagggtccatacagaggagaggccctag

SEQ ID NO: 21770 - DNA, 2013 bp, Artificial Sequence
  Description of Artificial Sequence: Synthetic coding sequence
atgcccgcccccgtgggccggcggagcccccccagcccccggagctccatggcagctgtagccttgcgggatagtgcccagggtatgactttcgaggatgttgctatctatttcagccaggaggaatgggagcttcttgacgaatcgcagagattcttgtactgcgatgtgatgctggaaaactttgctcatgttaccagcttaggatattgtcacgggatggaaaatgaagccatcgcctccgagcagtccgtcagcatacaggtacgaacgagcaagggcaacactccaacgcaaaagacccacctgagtgagataaagatgtgtgtgcctgttctgaaggatatcctgccagccgccgaacatcagaccacatcccccgtgcaaaagagctatctgggttctacaagcatgagaggcttctgtttcagtgctgacctccaccagcaccagaaacactacaatgaggaagagccctggaaaaggaaagtcgatgaagccacgtttgtaactgggtgccgttttcacgtccttaattatttcacgtgcggagaggctttccctgcgcccacagatctgctccaacacgaggctacaccttcaggggaggaacctcatagttccagttccaagcacatccaggcttttttcaatgctaaaagctactacaaatggggtgaatataggaaggctagctcccataagcatactctggtccaacatcagagcgtctgctccgagggtggcctgtacgagtgcagcaagtgtgagaaggcattcacctgcaaaaataccctggtccaacatcaacagatccatactggtcaaaagatgtttgaatgcagcgagtgcgaggaaagtttctctaaaaaatgccaccttattctgcacaagatcatccacacgggcgaacgtccctatgagtgctctgaccgtgaaaaggcctttatacataaatcagagtttatccatcatcagaggcgacatacaggaggcgttcgccatgagtgtggcgagtgtcggaagacattttcctataaatccaaccttattgagcatcagcgggttcatacaggggagcgaccttatgaatgtggtgaatgtggtaaatcattcagacaaagttcttccctcttccgccaccagagagtgcactccggcgagagaccttaccaatgttgtgagtgtggcaagtcatttcggcaaatcttcaatttaatccgccacaggcgggtccacaccggagaaatgccttaccagtgcagcgactgtggaaaatctttcagctgcaaatctgagcttattcaacatcagaggattcacagcggagaacggccttatgaatgtcgcgaatgcggaaaatcttttaggcagttcagcaacctgattcgccatcggagcatccacactggcgaccggccttacgagtgttctgaatgcgagaagtctttttcacgaaaattcatattaatacagcaccagcgggtccataccggtgaaagaccctatgaatgctctgaatgtggcaagtcattcacacggaaatccgatctaatccagcaccgacgcattcacactggaactcggccctacgagtgttcagagtgcggcaagagcttccgccagcggtctggtctcatacaacatcgcagactacacacaggcgaacggccgtatgagtgcagcgagtgcggcaagagtttcagccaatccgccagcttgattcaacatcagcgcgttcacaccggtgagcggccctacgagtgcagtgagtgcgggaagtcctttagccaaagcagcagtctgattcagcaccagcggggacacaccggagaacgcccctacgaatgtagccagtgtggcaagccgttcactcacaagagcgacctcatccagcaccagagggttcacactggtgagagaccatatgaatgctctgagtgtggcaaaagttttagccgcaagagcaatttaatacgccaccgcagagtccacaccgaggagcgaccttag

SEQ ID NO: 21771 - DNA, 1269 bp, Artificial Sequence
  Description of Artificial Sequence: Synthetic coding sequence
atgaccttcgaggacgtggccatctacttcagccaggaggagtgggagttgctggatgagagccagaggttcctctattgtgatgtcatgctggagaattttgcacacgtaacaagtctggtcacctcgcaccagaagcattataatgaagaagagccgtggaagcggaaagtggatgaggctacgttcgtgaccgggtgcaggttccatgttttgaattacttcacatgcggggaggcttttccagcaccaactgatctactccagcatgaagccaccccgtccggtgaggagccacattcctcctcttcaaagcacatccaagcattcttcaacgcaaagagctattacaagtggggcgaatatcgaaaggcctccagtcacaaacataccctggtacagcaccagtcaagagtacatactggggaaaggccttatgagtgtggtgaatgtggcaagtcctttcggcagagcagttccctctttcggcatcagagggtgcatagcggggaaagaccatatcaatgttgcgaatgtgggaaatcatttcggcaaatcttcaatctcatccggcatcgcagagtgcacactggcgagatgccttatcagtgttctgactgcggcaagagcttttcgtgtaaaagtgagcttattcagcatcagcgcatccactctggcgagagaccttatgaatgtagagaatgcggaaagagcttcaggcaattctcaaacctcattcggcacaggtccatacacacgggagaccggccgtatgagtgcagcgagtgtgagaaaagtttttcccgcaagtttatccttatccagcatcagagagtgcatacaggagagaggccctacgaatgcagtgagtgtggaaagtcatttactagaaaatctgacctaatccagcataggaggatccacaccggcacaagaccctacgagtgctcagagtgcgggaagagtttcagacagcgaagcggcctgatccagcaccgccggctgcatacaggcgagcgcccgtacgaatgtagtgagtgtggaaaatcgtttagccagtccgccagcctgatccagcaccaaagagttcacaccggcgagagaccttacgagtgttcagaatgtggcaagtccttctcccaatcctcatccttgatccagcaccaacggggccatacgggggagcgtccttatgaatgcagccagtgtggaaaacctttcacccacaagtctgatctaattcaacatcagagagtgcacaccggctag

SEQ ID NO: 21772 - DNA, 1224 bp, Artificial Sequence
  Description of Artificial Sequence: Synthetic coding sequence
atggccgccgccgccctgcggttccccgtgcagggcaccgtgacctttgaagacgtggcggtcaaattcactcaggaggagtggaatcttctgtctgaagcccagcggtgtctgtatcgcgacgtcaccctggagaacctcgcactgatgagtagccttggatgttggtgcggagtggaagacgaggccgcaccaagcaaacagtcaatttacatccaaagagagacgcaggtgcgaacaccaatggcaggtgtgtctccaaagaaagcccacccctgtgaaatgtgcggccctatattaggagatatccttcacgttgccgatcaccaaggcacacaccacaagcagaagctacacaggtgtgaggcatggggaaacaaattgtacgactctggaaacttccaccagcaccagaacgaacacatcggcgagaaaccttaccggggctcagtcgaggaggctctctttgctaagcgctgtaaactgcacgtctccggcgaaagcagtgtgttcagcgagtccggaaaagacttcctgctaaggtctgggttactacaacaggaggctacccacaccggcaagtccaacagcaagaccgagtgcgtttctttatttcacgggggcaagagccactattcctgtggcggttgcatgaaacatttctcgacgaaagatattctctcacagcacgagaggctgctgccaaccgaagagccctctgtatggtgcgagtgcggcaaatcctcctcaaaatacgattccttctcaaaccaccagggggtgcacacccgagaaaaaccctatacgtgtgggatttgtggcaaactcttcaactctaagagtcacttactggtgcaccagcggatccacaccggagaaaaaccgtatgagtgcgaggtttgccagaagttttttaggcataagtaccatcttatcgctcaccaaagagttcacacaggggagcgcccttatgaatgctctgattgtgggaagagttttacgcacagctctactttccgtgtgcacaagcgcgttcatacagggcagaaaccctatgaatgctccgagtgtgggaagtcgttcgctgagtcgtctagcttgacaaagcacagacgcgtgcatacaggggagaaaccctacggatgcagtgaatgcgaaaagaaattccgccagatctcctccctcagacatcaccaaagggtgcacaaacgcaaagggctgtag

SEQ ID NO: 21773 - DNA, 1617 bp, Artificial Sequence
  Description of Artificial Sequence: Synthetic coding sequence
atggtgacctgcgcccacctgggccggcgggcccggctgcccgccgcccagccctccgcgtgcccaggtacgtgcttttcacaagaggaacgcatggccgccgggtatctgccccggtggagccaagagctggtgactttcgaggacgtgagcatggatttcagtcaggaggagtgggaactgcttgagcctgctcagaagaacctgtaccgcgaggttatgttggaaaattacagaaatgtagtgtccctggaggccctgaaaaatcagtgcaccgatgtcggcatcaaggaaggccccctgtcgcccgcccagacctctcaggtcacatctctctcttcatggactggctatttgctgtttcaacccgtggcgtcctcccatctcgagcagagggaggccctatggatcgaggagaaaggcactccgcaggccagctgttccgactggatgactgttctccgtaaccaagacagcacatacaaaaaggttgccctacaggaagaacctgcctcgggcattaacatgattaagctgattagagaggatggggggtggaaacaactggaggattcacatgaagacccacaaggtttgctgtcccaaaaggccagcctccatgtggtggcagtccctcaggaaaaggctacagcttggcacgggtttggcgaaaatgggaatttgtcaccggcactggtactctcgcagggctcctctaaagggaaccacctttgcggcagcgagcttgatattaccagtctcgcgtctgatagcgttcttaaccaccatcagcttggttatgcagaccggaggccctgcgagagcaatgagtgtggcaacgccattagacagaactcacactttatccaacatggggggaagatgtttgtctacttggaaaatggccaaagtctgaaccatgggatggctttgactattcacaataagatcaatacagccgagaagccattcgagtgtcaccagtgtggcaaggtgttcaaccgaagacatagcctttccgagcaccaaaggatccatacaggagagaagccgtacgaatgccaggaatgcggcagggcctttacacatagcagcacacttacccggcatttaagaactcatactggagaaaaaccatacggatgcggagaatgtggcaaggcttttaacagaatctctagcctgacccagcaccagcggatccacaccggcgagaaaccatataaatgcgaagactgcggaaagagtttctgccagtcgagctacctgatccttcacaagcgcactcacacaggggaaaagccttatgagtgctcagagtgtgggaaagccttctccgacaggtccagtctgaatcagcatgagagaacgcacaccggcgagaatccctacgagtgtaaacaatgcggcagggcctttagtcagaggagtagtctcgttcggcatgaacggacccatacgggtgagaagccttaccggtgccaggaatgtggaaaagcgttctcacagtcttccagtttggttactcatcagaaaacgcacagctcccagaagacctataaaatcatcgactgtggaaaagccttctatcagaaccgccacctgattggctactag

SEQ ID NO: 21774 - DNA, 1887 bp, Artificial Sequence
  Description of Artificial Sequence: Synthetic coding sequence
atggacagcgtggtgttcgaggacgtggccgtggacttcaccctggaggaatgggcattactcgattccgctcagcgagatctgtatagggatgtcatgctggagaccttccaaaatctggcctccgttgacgatgagacgcaatttaaggcatccgggtccgtgagtcagcaagacatttacggagaaaaaatccccaaggagagtaaaatcgccaccttcacaagaaacgttagctgggctagtgtgttaggtaaaatttgggacagcctcagtatagaggatcaaacaacaaatcagggacgcaacctgtctcgaaaccatggcctggagcggctctgcgagagcaatgaccagtgtggagaggctctgtctcagatcccccatttgaacctgtacaagaagattcccccaggtgtcaagcagtacgagtacaacacatacggaaaagtgttcatgcacagacgtaccagcctcaaatctccaattacggtgcatactggccataaaccgtatcagtgtcaggagtgtgggcaggcctattcatgccgtagccacctcagaatgcatgtgcggactcacaacggggagaggccatacgtctgcaaactatgcggcaaaacatttccgcggacatcaagtttgaatagacacgtgcggattcacaccgccgagaagacctatgaatgtaagcagtgcggcaaggcatttatcgatttctcatctcttacttcgcacttacgctcccatacaggcgagaaaccctacaaatgtaaagaatgtgggaaagcgttcagttactcctccacatttaggaggcacacgataactcacacaggtgaaaagccctacaagtgcaaggagtgcgcagaggctttcagctactcatctactttccgccgtcacatgatctcacacacaggagagaaaccacataaatgcaaagagtgtggcgaggcttttagctattctagcgcatttcgcaggcatatgatcactcatacaggggaaaaaccatatgagtgtaagcagtgcggaaaaaccttcatatatctacaaagcttccggagacacgaacgtatacatactggagaaaagccctatgagtgcaagcagtgcggaaaaacttttatttatccccagagcttcagacgacacgaacgcacgcacggtggggagaagccctacgaatgcaaccagtgcggtaaagccttctcccacccctccagttttaggggtcacatgcgcgtccatacaggcgagaagccctacgagtgcaaacagtgtggtaagacctttaattggccgattagccttagaaagcatatgcggacacacactcgggaaaagccctatgaatgtaagcaatgtggaaaggcattctctttaagcgcctgctttcgggagcatgtccggatgcaccctgaggacaaatcttacgaatgtaagctgtgtggtaaggcattttattgtcacatatcgctccagaagcacatgcgccgtcacactgcggagaagttgtataagtgcaagcagtgtggaaaagcgttttcttggcccgagctgctgcagcagcatgtgaggactcatactgtcgagaagccgtacgaatgcaaggagtgcgggaaggtgttcaaatggccctcttcgctgcctatccatatgagattacatacaggggaaaaaccttaccagtgcaagcactgcggtaaagcttttaattgcagcagctctctgcggcgtcacgtgcgcatccatactaccgaaaaacaatacaaatgcaatgtggggcatccgccagcgaacgaatttatgtgcagcgcttctgagaaatcacaccaggagagagacctgatcaaggtagtgaacatggtccttccactgtag

SEQ ID NO: 21775 - DNA, 1632 bp, Artificial Sequence
  Description of Artificial Sequence: Synthetic coding sequence
atggacagcgtggtgttcgaggacgtggccgtggacttcaccctggaagagtgggctcttctggattctgcacaacgcgacctgtaccgcgacgttatgctggagacattccaaaacctagcctctgttgatgacgagacacaatttaaggcgtctggttctgtctcacagcaggatatctatggagaaaaaatacctaaagagtccaagattgctacctttacccggaacgtgtcctgggcatccgtgctgggaaagatctgggattctctcagtatcgaagatcaaacgacgaatcaaggacgtaatttgcggaaccatgggttagaacggctctgcgaaagtaatgatcagtgtggcgaagcgctgagccaaattcctcatctcaacctgtataaaaaaatacctccgggagtcaagcagtatgagtataacacatatggaaaagtgttcatgcaccgcagaacctccctgaaatcccctattaccgtgcacactggtcataagccttatcagtgtcaggaatgcggccaagcctacagctgtagatcacacctccggatgcatgtgcgtacacataatggcgagcgcccctatgtgtgtaagctgtgtggcaaaaccttccctaggaccagcagcctgaaccgtcacgtccggatccatacggcagaaaagacctacgagtgcaagcagtgtggtaaagcatttattgacttttccagcttgaccagtcatttgaggtcgcataccggtgaaaaaccatacaaatgcaaggagtgtgggaaggctttttcatattcgtctacatttaggaggcataccatcacacacacaggggagaagccctacaagtgcaaggaatgtgccgaagcgttcagctacagttcaacttttagaaggcacatgatcagtcacaccggcgaaaaacctcataagtgtaaggaatgtggtgaggcattttcttactcatccgcattccgtcgtcatatgatcacccacacaggggagaagccttatgaatgcaaacaatgcggtaagaccttcatttacctgcaatcattcaggaggcacgagagaatccataccggagagaagccatacgagtgcaaacagtgtggaaagacctttatttatccgcagagttttaggcgccatgagcgcacacatggcggcgagaagccatacgagtgtaaccagtgtggaaaggccttttctcacccttcaagctttaggggtcacatgcgggtccatacgggcgagaaaccatatgaatgtaagcagtgtgggaagactttcaattggccgatatcgctccgaaaacacatgcgcactcacacacgcgagaagccctacgagtgcaaggaatgtggcaaagtcttcaagtggccatcatccctccccatacacatgcgactgcacaccggtgagaaaccatatcagtgtaaacattgtggaaaggcttttaactgtagctccagtctgcgcagacatgtccggattcacacgactgagaaacaatataaatgtaacgtcggtcacccaccagccaacgagtttatgtgttccgcatcagagaaatcccatcaagaaagagacctgattaaagtcgttaacatggtgctgccactgtag

SEQ ID NO: 21776 - DNA, 1371 bp, Artificial Sequence
  Description of Artificial Sequence: Synthetic coding sequence
atggacaccgtggtgttcgaggacgtggtggtggacttcaccctggaggagtgggcccttcttaatccagcccaacggaaactgtaccgggacgtaatgttagaaacattcaaacatctcgcctccgtggacaatgaggcgcagcttaaggccagtggctctattagccagcaggacacatccggggagaaactatccttgaaacagaaaattgagaagttcacccggaagaacatatgggcttctctgttgggtaaaaactgggaagaacattcagtcaaggacaagcacaatacaaaagagcggcacttgtcgagaaatcctagggtggaacgtccctgcaagagttccaagggtaacaagcgcggtaggacatttaggaagacacgtaattgcaatagacacctgcgcaagaactgttgtacaagcgtgaggcggtatgaatgctcccagtgcgggaaattgttcacgcattcaagttcattgatcaggcataagagggctcattccggacagaagctgtataagtgtaaggagtgcggtaaggctttttcccggcccagctatctgcagactcatgagaagacccactccggcgaaaaaccatatgcttgccaatcatgtggaaaaaccttccttcgctctcattcgctgacagaacatgtgagaactcacactggcgaaaaaccctacgagtgcgggcagtgcgggaaggggttcagctgtcctaagagttttagagcacatgtcatgatgcacgctggaggaagaccctatgaatgtaagcattgtggaaaggcgtttcgttgccaaaagagctttcgggttcacatgatcatgcatgccggaggacgcccttatgagtgtaagcagtgtggtaaagcctattgctgggctacgtcattccaaagacatgtgcgtattcacaatggcgaaaagccttataagtgtggaaagtgtggaaaggctttcggctggccttcatcgcttcataagcacgctcgtacccacgccaaaaagaagccagtctctggagggtctgtgggcaagagcagcgcgcgcccccgcccgagcacggatgtgaaatcgcagactagggagaaagtgtacaaatgtgaaacttgcggtaaaacatacggctggtcaagctcgctgcacaaacatgaacgtaagcatacaggcgagaaacccgtaaacgctgcctccgtgggtaagccgtccggggggctgtgttctagcaagaacgttcgaacacagattggccagaagccttctaagtgtgagaaatgcggcaaggcatttagttgcccaaaggcctttcagggtcatgttcgctcccacacagggaagaaatcatgtacttccaaatag

SEQ ID NO: 21777 - DNA, 1293 bp, Artificial Sequence
  Description of Artificial Sequence: Synthetic coding sequence
atggccgccgtggtgctgccccccaccgccgccctgagcagcctgtttccagcaagccaacgcgaagggcatacagaggggggagaactggttaacgagctgctgaagagttggctcaaaggcctcgttacctttgaggacgtggccgtggagttcactcaagaggagtgggcgctgctcgatccagctcagcggaccctctaccgagacgtgatgttggaaaattgcagaaacctcgccagcctggggaatcaggtggataagcccagactgatcagtcagttggaacaggaagacaaagtcatgaccgaggagcggggcatcctgtccggaacttgtcctgatgtggaaaatccatttaaggctaaagggctgaccccgaaactccacgtattccgtaaagagcaatcacggaatatgaagatggagcgtaaccatctgggtgccacattgaatgaatgtaatcaatgctttaaggtgtttagtacgaaaagctctctgacaaggcaccgaaagatccataccggcgagcgaccctacgggtgctcagaatgtggcaagtcatatagctccaggtcatatctggcagtacacaaacggattcataatggtgaaaagccttacgaatgcaacgattgtggcaaaacctttagctctcggtcatacttaacagtgcacaaacgaatccataacggggagaagccttatgagtgctccgattgcggcaagactttcagtaattctagctatcttcgtccacatctcagaatccataccggcgaaaaaccctacaagtgtaaccagtgttttagggagtttagaactcaaagtatttttacacggcacaagcgagtgcacactggggagggacactatgtttgcaaccaatgcggcaaggcgtttggcacgaggtcaagcctcagttcccattacagtattcatacaggcgaatacccttacgaatgccacgactgcggtcgtacctttcggagacgaagcaacctgactcagcacataaggacacatactggagaaaaaccatatacttgcaacgaatgcggtaagtcattcactaacagtttctcactgaccatacatcgccgcatccataacggagagaagtcatatgagtgttccgactgcggaaagagctttaatgtactgtcaagcgtgaagaagcatatgagaacacatactgggaaaaagccctacgagtgcaattattgtggaaaatctttcaccagcaattcctacttgtcagtgcacaccaggatgcacaacaggcagatgtag

SEQ ID NO: 21778 - DNA, 1293 bp, Artificial Sequence
  Description of Artificial Sequence: Synthetic coding sequence
atggccgccgtggtgctgccccccaccgccgccctgagcagcctgtttccggcttcccaaagggaaggacacacggaaggaggcgagctggtgaacgagttactcaaatcatggctgaaagggttagtcacatttgaagacgtggctgtggagttcacacaggaagaatgggcgcttctggatcctgcccagagaactctctaccgcgatgttatgttggagaattgtagaaatctggcaagtcttggcaaccaagtagataaacccagactcatttcccagcttgaacaggaagataaggtaatgactgaagaaagagggattttgagtggaacctgtcccgatgtcgaaaacccctttaaagctaaggggctcactcccaaactccatgtcttcaggaaagaacagtccaggaatatgaaaatggaacgaaatcatctgggggctactttgaatgaatgtaatcagtgctttaaggtgttttccacaaaaagttccctgacacgacatcgaaaaattcacaccggcgaacgtccatacgggtgttctgaatgcggtaaatcctattcatctcggagttacctagccgtgcataagagaatccataacggcgagaagccatacgaatgcaacgactgtggaaaaacctttagttcaagaagctacctgacagtccacaaacgaatccataatggcgagaagccctacgaatgtagtgactgtggaaagacattctccaactcttcttacttgcgccctcatctcaggattcacactggcgagaagccgtacaagtgcaaccagtgtttcagggaatttaggacacagtccatctttacccgccataaacgggtacatacgggggaggggcattacgtttgtaaccagtgtggcaaggccttcggcaccaggtcaagcctgtcctctcactattcaatccatacgggcgaatacccctacgagtgtcacgactgtggtcgaaccttcaggagacgaagtaatttgacccaacacatcagaactcacacaggggagaagccttacacgtgtaacgaatgtgggaagagctttaccaactccttctctttgactattcacaggcgcattcacaacggcgagaaatcctatgagtgcagcgattgtgggaaaagtttcaatgtactgagttcggtgaagaagcacatgaggacacacaccggaaaaaagccgtatgagtgcaactattgcggaaagtcattcacctctaacagttacctgtccgtacacaccagaatgcacaaccgccagatgtag

SEQ ID NO: 21779 - DNA, 1272 bp, Artificial Sequence
  Description of Artificial Sequence: Synthetic coding sequence
atggccgccgtggtgctgccccccaccgccgccagccagcgggagggacatacagaggggggcgagctggtgaatgagctcctcaagagttggcttaagggcttggtcacctttgaggatgttgccgttgaattcacgcaggaagagtgggctctgctcgatccggctcagcgcaccctctatagagacgtgatgctggagaattgcaggaatctggcttcgcttggaaaccaagtcgacaaaccacggctgatcagtcagctggaacaggaagataaggttatgacagaggaacgtgggatcctctcaggaacatgtcccgacgtcgaaaacccctttaaagctaagggcctaacacccaagctccacgtgtttcgcaaggagcagtcccgcaacatgaaaatggagaggaaccacttaggcgctacactgaacgaatgcaaccagtgctttaaggttttctctactaagtctagcctcacacggcatcgcaagattcacaccggagagcggccgtacggttgctcagagtgcgggaaatcatattcaagtagatcatacttagctgttcataaacggatccataatggggaaaagccgtatgaatgcaatgactgcggaaagacgttttcatctagatcttacctgacggtacacaagagaattcacaacggggagaaaccgtatgagtgctctgattgcggcaaaacctttagcaattcttcatatctgagacctcacctacgcattcacactggcgagaagccctacaagtgcaaccagtgctttcgtgagttccggacccagagcatattcaccaggcataaacgcgtccacaccggcgagggacattacgtttgtaatcagtgtgggaaggcatttggcacccggagctctctgtccagccactacagtatccacacgggtgagtacccctatgaatgtcatgattgtggtcggaccttccggcgccgcagcaacctgactcagcatattaggacacatactggcgagaagccgtatacttgcaacgaatgcggtaaatccttcacaaacagcttctccctgactatacacaggcggattcataatggggagaagtcttatgaatgcagcgactgtggaaagagctttaacgtgctctcaagcgtaaagaaacatatgaggactcacacgggaaagaagccctacgaatgcaactactgcgggaagtcttttacaagtaatagttatctctcagtgcacacacggatgcacaacagacagatgtag

SEQ ID NO: 21780 - DNA, 1209 bp, Artificial Sequence
  Description of Artificial Sequence: Synthetic coding sequence
atggccgccgtgatcctgcccagcaccgccgcccccagcagcctgtttcctgcctctcagcagaaagggcacacccaggggggcgaactggtgaacgagctgttgaccagttggctgcgcgggctggttacctttgaggatgtcgccgtcgagtttacccaggaggaatgggccctacttgacccagctcagcgcaccctgtacagggatgtcatgctggaaaactgccggaatctggccagtctcgggtgtagggtaaataaaccaagtcttatatcccagctggaacaggataaaaaggtggtcacagaagagcgtggtattctgccttctacttgcccagatctcgagacactgctgaaggccaagtggttaacgcctaagaagaatgtgtttcgaaaggagcagtccaaaggagtcaagactgaaagatcccaccgtggagtgaaattaaatgaatgcaatcagtgtttcaaggtatttagtacaaagagtaacctcacgcagcacaagaggattcataccggagaaaaaccctatgattgctcacagtgcggaaaatccttctctagcagatcttatttgactatccataagcgcatccataacggagaaaagccttatgagtgcaaccactgtgggaaggctttcagcgatccttccagcctgcggttgcatctccgcattcacacgggcgagaaaccatatgagtgcaaccagtgttttcacgtttttagaacttcttgcaatcttaagtcgcataagcggattcatacaggggagaatcaccatgagtgcaatcagtgtggaaaggccttttctacgagaagttccctgacagggcataattcaattcacaccggcgaaaaaccatacgagtgccatgactgtggtaagacttttcgcaaaagcagctatctcactcaacatgtccggacacatactggagagaaaccttatgagtgcaacgagtgcggcaagagctttagtagctcattttcactgacagtgcataagcgcatccatacaggggagaagccttacgagtgctccgattgtggcaaggcattcaacaatctgtccgccgttaagaaacacctgaggacacacaccggggagaagccctatgaatgcaaccactgtggcaaaagtttcacctccaatagttacctgtccgtgcataagagaatccacaacaggtggatatag

SEQ ID NO: 21781 - DNA, 996 bp, Artificial Sequence
  Description of Artificial Sequence: Synthetic coding sequence
atgctggagaactgccggaacctggccagcctgggctgccgggtgaacaagcctagtctgatcagtcagctggagcaggataaaaaggtggtgacagaggaaagaggcatcctccccagcacctgccctgatctggagactttgttaaaggcaaaatggttaactcctaagaaaaacgtgtttaggaaggaacagtccaaaggtgtaaaaacagaacggtcccacaggggggtgaagctgaatgagtgtaaccaatgcttcaaagtgttttcaaccaagtctaatctcacacagcacaaaaggatccacacaggcgagaaaccttacgactgctcccagtgcggtaagagcttcagctctagaagttatctcactatccacaagcgtatccataatggcgagaagccctatgagtgcaaccattgtggaaaggcctttagcgacccaagcagcttacggctccatctgcgaattcacacaggcgagaagccttacgagtgtaaccagtgttttcacgtttttcgcacgtcctgcaatttaaagtcacacaaaaggattcacacgggggagaaccatcacgaatgcaaccagtgcggcaaagcattctccacacgctcaagtcttacgggccataattcaatccacacgggggagaagccttatgaatgtcatgactgtggaaaaacattcaggaagagttcctatctaactcagcacgtgaggacccataccggggagaaaccctatgaatgtaacgaatgtggcaagagtttctcatcttccttttcgctgacagtgcataaacgtattcacaccggagaaaagccctatgagtgcagcgactgcggtaaagccttcaacaatctgagtgcagtcaaaaagcatttgcgcactcataccggggagaaaccatatgaatgtaaccactgtggaaagagctttacatcgaactcatacctgagtgtacacaagaggatccataataggtggatctag

SEQ ID NO: 21782 - DNA, 1617 bp, Artificial Sequence
  Description of Artificial Sequence: Synthetic coding sequence
atggtggccggctggctgaccaactacagccaggacagcgtgaccttcgaggatgttgccgtggatttcacccaggaagagtggaccttgctcgatcaaacacaacgaaacttgtatcgagatgtaatgcttgagaactataaaaaccttgttgcggttgattgggaatctcacatcaataccaaatggagcgcccctcagcagaactttctgcagggaaagacgagttcagtagtggaaatggaacgaaatcacttcggtgaggagctgttcgactttaaccaatgcgaaaaggctctctccgaacacagctgcttgaagactcatcgcagaacgtacttcaggaaaaaaacatgtgagtgcaaccagtgcgaaaaggctttccggaaaccctcgatttttacacttcataagaaaaccgacatcggcgaagaactgcctaactgcaatcagtgcgaaactgccttcagtcagcatctgcatttggtctgtaaaaagactagccagaatctgcacctagtatgtaaaaaaacacatactcaggaaaaaccttacaagtgttctgattgcgaaaaaggcctgcccagctcttcccatttacgcgaatgcgtgcggatctacggaggcgaacggccatacactcacaaagagtatgtcgagacgtttagtcatagcacagccctgttcgtgcacatgcagacccaggacggagaaaaattctatgagtgcaaagcctgcggtaagcccttcacagaaagttcctacctcacacagcatctgaggactcactccagggtgttaccgatcgaacataagaagtttgggaaggctttcgccttcagccctgacctcgcaaagcatatacggcttaggacccggggaaagcactatgtctgcaatgaatgcggcaaagaattcacctgtttcagtaagctgaatatccacattcgcgtccacacgggcgaaaagccatacgaatgcaacaaatgcggaaaggccttcacagactccagtggcctcattaagcatcggcggacacacactggagagaaaccttacgagtgtaaggagtgtggaaaggccttcgcaaattcaagccacctgacagttcacatgcggacacacactggcgagaagccttaccagtgtaaggaatgtggcaaggcgttcattaacagctcctccttcaagagtcatatgcagacacatcccggtgttaagccctatgattgccagcagtgtggcaaggcctttattaggtcatcttttttgataaggcatctacgctcccactcagcagagcggccattcgagtgtgaggaatgtggcaaagcctttcgttacagctcacatctgagccagcacaagcggatccacacgggagagcggccctataagtgccagaagtgcgggcaagcattctccatttcgtctggactgactgtccacatgcggacccataccggagagagaccttttgagtgccaggaatgcggcaaagcttttaccaggtcaacatacctgattaggcacctgaggagccacagcgtcgaaaagccttacaaggaatgtgggcagaccttctcaaattcatcttgtctcactgaatgtgtctag

SEQ ID NO: 21783 - DNA, 1617 bp, Artificial Sequence
  Description of Artificial Sequence: Synthetic coding sequence
atggtggccggctggctgaccaactacagccaggacagcgtgaccttcgaagacgtggccgtggacttcactcaggaagagtggacactgctggatcagacgcagcggaatctgtaccgggacgtaatgctcgagaattataagaaccttgtggccgtcgattgggaaagccatattaataccaaatggtcagccccgcagcagaactttctccaaggcaaaacaagctcagtcgttgaaatggaaagaaaccatttcggcgaggagctctttgacttcaaccagtgtgagaaggctctctcggagcacagttgcctgaaaacacaccggcggacctacttcaggaaaaaaacttgcgaatgtaatcagtgcgaaaaggcattcaggaagcccagtatatttacactgcacaaaaagacggatattggagaagagctacctaattgcaaccagtgtgaaaccgctttttcgcaacatcttcatctcgtgtgcaagaagacttctcagaacctgcacctcgtttgtaagaagacccatactcaagaaaaaccctataaatgctccgactgcgaaaaggggcttccttcctcctcacacttgagagagtgcgtcaggatctacgggggggaacggccgtatacccataaggagtatgtcgaaacattttctcactctacagccctgttcgtccacatgcaaactcaggacggcgaaaaattctacgagtgcaaggcatgcggcaagcctttcactgaaagtagctacctcacccagcacctgcgaacacattcacgggtcctccccatcgaacacaaaaaatttggtaaagccttcgctttttccccagatctagctaagcatatacgacttaggaccaggggaaagcattatgtgtgtaacgaatgcggcaaggaatttacctgctttagtaaactgaatattcacattcgggtccacacaggcgagaagccgtatgagtgtaacaaatgcggtaaagctttcacagacagttccggccttatcaagcaccggcggactcataccggagagaagccgtacgagtgtaaggaatgcggcaaggccttcgctaatagttcacatctcactgttcacatgcgcactcacacaggcgagaagccataccagtgtaaggagtgtgggaaagcctttattaactcttcctctttcaagtcccatatgcaaacccatcctggcgttaaaccgtacgactgccagcagtgtggcaaagcatttatcagaagctcttttctgattcgacacctgcgaagccattcagccgagcgtccttttgagtgtgaagagtgcggaaaggcatttaggtactctagtcacctgtcccagcacaaacgcatccacactggcgaacggccatataagtgtcagaaatgtgggcaagccttctcaatttcctccggtctgaccgttcatatgcggactcatactggcgagaggccttttgagtgccaagaatgcggcaaggcttttacccgaagtacctacctgatacgccacctccgatcccactcagtggagaaaccttataaagaatgtggccagacattcagcaactcatcctgcttaacagaatgcgtgtag

SEQ ID NO: 21784 - DNA, 1377 bp, Artificial Sequence
  Description of Artificial Sequence: Synthetic coding sequence
atggagcggaaccacttcggcgaggagctgttcgacttcaaccagtgcgagaaagccttgtccgagcactcctgtctgaagacccatcgcaggacttattttcgaaaaaagacttgcgagtgcaaccagtgtgagaaggcattcagaaagccctccatcttcacactccataagaagactgatattggggaggagctaccaaactgtaaccagtgtgagacagctttttcccagcatttgcacctcgtgtgcaaaaagacaagccagaacctgcatctagtctgcaaaaagacccacacccaggagaaaccttacaagtgttccgattgcgagaagggcctacctagctccagccacctgagagagtgtgtgcggatctacggcggggagagaccttacacccacaaggagtatgtagagaccttctcccattcaacggctctatttgttcatatgcagacacaggacggagagaaattttacgaatgcaaggcttgtggtaaaccttttactgaatcttcttaccttactcagcacttacggacccacagtagagtcctcccgattgagcataagaagtttggtaaggcatttgccttctccccagacctggcgaagcatatccgcctccgtacccgtggcaagcactacgtgtgtaacgagtgtggaaaagagttcacatgtttctcgaaattgaacatccacatccgcgttcacacaggggaaaagccgtatgagtgcaacaagtgtggtaaagcattcaccgattcctcaggattgatcaagcacaggcgcacgcacaccggcgagaaaccctatgagtgcaaagagtgtggcaaggccttcgcaaattcctcacacttgaccgtccacatgcgcacccatactggcgaaaaaccatatcaatgtaaggagtgtggaaaagccttcattaatagtagcagttttaagtcgcacatgcaaactcatcccggcgtcaaaccctatgactgtcagcagtgtggcaaagcgtttatccgatcaagttttttgatcagacacctccgaagccattctgctgaacggcccttcgagtgcgaggaatgcggcaaggcttttcgctacagcagccatttgtcacagcataaaaggatccacactggggagaggccatacaagtgtcagaagtgcggccaggccttcagtatttcatcgggtcttacagtacacatgaggacccataccggggaacggccctttgagtgccaggaatgcggtaaggcattcacacgctcgacctacctgatccgacatctccggagccattctgtcgagaagccatataaagagtgcgggcagacgttctccaatagctcctgtttgacggagtgcgtttag

SEQ ID NO: 21785 - DNA, 1617 bp, Artificial Sequence
  Description of Artificial Sequence: Synthetic coding sequence
atggtggccggctggctgaccaactacagccaggacagcgtgaccttcgaagatgtggcagttgacttcactcaggaggaatggactctgctcgaccagacgcagcggaatctgtaccgggacgtgatgctggaaaactacaagaacctcgtggccgtggattgggaatcccacatcaatactaagtggagcgcaccccagcagaactttcttcagggcaaaacctcatccgtagtagaaatggaaagaaatcatttcggggaggaactgttcgatttcaatcagtgcgagaaggctctgtccgaacatagctgcctcaaaacccataggaggacatacttccggaaaaaaacatgtgaatgcaaccagtgtgaaaaggccttccgaaagccttctatcttcactctccacaagaagactgatatcggtgaagagttgccaaactgcaatcagtgtgagactgccttcagtcagcatctgcacctggtttgcaagaagacatcacagaatcttcatcttgtgtgcaaaaaaacacatacacaggaaaaaccttataaatgctctgactgcgagaaaggactgccgagcagtagtcacctgagagagtgcgtaaggatttacggtggggagcgcccatatactcacaaagaatatgtcgagactttcagccattctactgcactatttgtgcacatgcaaacccaggacggggaaaaattttatgagtgtaaggcctgcgggaagccctttaccgaaagcagttatctgacccagcatctccggactcactcacgcgtattgcctattgagcataagaagttcggcaaggccttcgccttttcccctgatctggcgaagcatatacgcttacgcactagagggaagcattacgtatgtaatgagtgcgggaaagagttcacctgcttcagcaagttaaatatccacattcgggtccacacaggcgaaaagccttatgaatgcaacaaatgtggcaaggccttcactgattcctctggattaatcaagcaccggcgtacgcacacgggggagaagccttacgagtgcaaggagtgcggtaaggcgtttgccaacagttctcacctgactgtccatatgcggactcacaccggcgaaaaaccgtaccagtgtaaggagtgtggaaaggctttcataaactcaagctctttcaagtcccacatgcagactcatcctggagtcaaaccttatgactgccagcaatgcggcaaggctttcatcagatctagtttcctgattagacacctccggtctcacagcgctgaacgaccctttgaatgcgaagagtgtggtaaagctttccgatattcgtcccatttgtctcagcacaagcgaatacacacaggcgaaaggccttataagtgtcagaagtgcgggcaagctttttccatcagttctgggctcacagtgcacatgcgcactcacaccggcgagagaccctttgaatgccaggagtgcgggaaggccttcaccagaagtacgtaccttatcaggcacctgagaagccactctgtggagaagccatacaaggagtgcggccagacattcagcaactcctcctgcctgacagaatgcgtatag

SEQ ID NO: 21786 - DNA, 2373 bp, Artificial Sequence
  Description of Artificial Sequence: Synthetic coding sequence
atggcctactgcctgaccaactgctaccagtacagcgtgaccttcgaggatactgccgtcgattttacacaggaggaatggatccttctcgaccccgtgcagcgtaatctgtacagggacgtgatgttggagaactatgagaatgttgctaaggtcggatttcagctgtttaagccctcagtaatcagttggttagaggaggaagaactgcggacattacagcagggtgtgctccaggattgggcaattaagcatcagaccagcgtgagcgctttacagcaagagttttggaagatccagacgtctaacggtatccaaatggaccttgtgacgtttgattctgtcgccgtggagtttacgcaggaggaatggacactgttagatccagcgcaaagaaatctgtactccgacgtcatgctggaaaattataagaaccttagctcagtggggtatcagcttttcaagccctccctgatctcatggctggaggaggaggaagaactctccaccttgccccgagtgctgcaggagtggaagatgtgcctgaagacaaagggccctgccctctggcaggataatttttgcctgaagactctcaatgggattcaactggccaggaaccaaaacggagaggagctctatgattgtaagcagtgcgaggatgtgttctgcaagcacccatgtcttaagactaacatgagcacccaaaaccgcggaaatacaagtgaatgcattcagtatgcaaaagatctgctgtccttatataacaaaacaagcaccattcggaaagttagcgtattttcaaaacacggcaaatcttttagacttattctaaacgtgcaagtccaacgcaagtgtactcaagacaagtcattcgaaggtacagattacggcaaagcgttcatttaccagtcttatctggaggctcaccgaaaaactcagtctggggagaaactgaacgaatggaagcagtgtggggaggccttcacccactccacttcgcacgctgtcaacgtcgaaacgcacattattaagaacccctacgaatgtaaagagtgcggaaaggattttagataccccactcacttgaataatcatatgcaaacacatattggtattaaaccttacaagtgtaaacactgtggtaaaaccttcacagtgccttccgggtttctagaacacgtgcggacgcacacaggtgagaagccctacgggtgcaaggagtgtggtaaggcttttgggacctccgccggactgatcgagcacattcggtgccacgctcgcgaaaagaccttcaagtgcgaccattgcggaaaggcttttattagttacccctcactttttggccacctgcgtgtgcataatggagagaagccctatgaacataaagagtacggcaaagcattcggtaccagctccggagtcattgaagatcgcaggagtaacactggccagaagcgcttcgactgtgaccagtgtgggaaggtgttcgtctcgttttcctccctgttcgctcatctgcgtacccacactggagaaaagcccttcaagtgttataagtgcggaaagccatttacctcctccgcctgtcttagaatccacatgcgcacccacaccgaggaaagattgtatcagtgtaaaaagtgtggcaaggcattcactaagtgcagctatttaacaaagcacctaaggacacacgctggggagaagccgtatgagtgtatgaaatgcgggaaggccttcacggagagatcatacttgacaaaacacctgagaagacactcaggggagaaaccctacgagtgcaagaagtgcggtaaagcttttactgagagatccgacttgaccaagcacctcaggcgtcacactggtgataagccttacgagtataaagattgtggaaaagcgttcgttgtctcctccagtcttgtcgatcacctccgaacccacaccggctataagccttacaaatgcaacgcatgtgagaaggcgtattccagaagctgtgtgctcacccagcacctgaagactcacgctgccgaaaaaacatctgaatgtaatgcttgcggaaatagcttcagaaattctatgtgcttccacgacagactgaagacactgacaaagataaagccctacaagtgtaaggactgcggcaaggcttttacatgtcacagtgacttgacgaatcacgtgcggatccacacaggagagaagccatataagtgcaaagagtgtggaaaggccttccgcacatcatcaggcaggatccagcacctccggacccacatgggcgagaagccgttcgagtgtgatcagtgcgggaaagcctttgcttccttttcagccaggatagcacacttgaaaactcattag

SEQ ID NO: 21787 - DNA, 1461 bp, Artificial Sequence
  Description of Artificial Sequence: Synthetic coding sequence
atggccgccatctacctgagccggggcttcttcagccgggagcccatctgcccttttgaagaaaagactaaggtcgaaaggatggtggaagactacctcgccagtgggtatcaggattctgtgacattcgacgacgttgctgtagatttcactcctgaagaatgggccctcctcgacactaccgaaaaatatctgtatcgggacgttatgcttgagaactacatgaatctcgcctccgtagaatgggagatccagccacgtaccaaaagatcttctcttcagcagggcttcctgaaaaaccaaatcttcagcggcattcagatgactaggggctactctggatggaaactttgcgattgcaagaactgcggggaagtgttccgcgaacagttctgtctgaagacccacatgagggtgcagaatggcgggaacacaagtgagggcaactgttacggcaaggacacgctctcggtccacaaggaagcctcgaccggacaggaactaagcaagttcaacccatgtggcaaggtgttcacactaactcccggtctggcagtgcacctcgaggtgcttaatgccagacagccatacaaatgtaaggagtgcggcaagggttttaagtacttcgcttctcttgataaccacatgggaattcatacagacgagaaactgtgtgagttccaggagtatggcagagccgtgaccgcaagttcacacctgaaacaatgtgtggctgtgcataccggtaagaagagcaaaaagacaaaaaagtgcggcaagtccttcaccaattttagccagctctatgcaccagtcaagacccacaaaggcgaaaagtccttcgagtgcaaagagtgtggtcgttcctttaggaacagcagctgcctgaatgatcacatccaaattcatactggaatcaaacctcacaagtgtacctactgcggaaaggccttcaccagaagtacccaactgacagaacacgttcgcacgcacactggcattaaaccctacgagtgcaaggagtgtgggcaggcattcgcacagtatagtggcctgtctattcatatccgatcacactctggcaaaaagccttaccagtgtaaggaatgtggtaaggccttcacgacttcaacctctctgatccagcacaccaggattcatacgggtgagaagccttatgaatgtgtggagtgcgggaagacttttattacttcttcaaggcgcagcaagcaccttaaaacacattcaggtgaaaagccttttgtctgcaagatctgtggcaaagccttcctatacagctctcgcttaaatgttcacctgagaacacataccggagagaagccctttgtttgcaaagagtgcggaaaggcatttgctgtctcttcaaggctgagtcgacacgaaaggatccacaccggggaaaagccctatgagtgcaaggacatgagtgtaacaatctag

SEQ ID NO: 21788 - DNA, 1053 bp, Artificial Sequence
  Description of Artificial Sequence: Synthetic coding sequence
atgcgggtgcagaacggcggcaacaccagcgagggcaactgctacggcaaggataccctgagcgtgcacaaggaggccagcaccggtcaggagctgtctaaattcaacccctgtggtaaggtgtttaccctgactccagggctagcagttcacctggaagtattaaacgcacggcaaccatacaagtgtaaggagtgtggtaaggggtttaagtatttcgcctctctcgataaccacatgggaattcatacagacgagaagctatgtgaatttcaggaatatgggagagccgtgactgcctctagccatctgaagcagtgtgtggcagtccacacaggcaagaagtcgaagaaaacgaagaaatgcggcaagtccttcactaacttctctcaactctatgcccccgtgaaaactcacaaaggagaaaagagcttcgagtgtaaggaatgtgggcgctcgtttaggaacagctcctgcttaaacgatcacatccagatccacaccggcattaagcctcataagtgcacatattgcgggaaggctttcactcgaagcacccagcttaccgagcatgtacgaacacataccgggattaagccgtatgagtgtaaggagtgtggacaggcttttgcgcaatactcaggactctcaatacacatccgttcacattcaggtaagaaaccttaccagtgcaaagagtgcggaaaagccttcactacctcgaccagtctcatccagcatacaaggatccatactggagaaaaaccgtacgagtgcgtagagtgcggtaagacctttatcacttcatctcgacgcagtaagcacctgaaaacccactcaggtgagaaacccttcgtttgtaaaatctgtggaaaggctttcctttatagtagccgccttaatgtgcacctccgaactcatacgggagagaaaccttttgtgtgcaaggagtgcggcaaggcttttgccgtctccagtagactgtcgaggcacgagcgaattcataccggggagaagccgtacgagtgtaaggatatgagcgtgacgatatag

SEQ ID NO: 21789 - DNA, 231 bp, Artificial Sequence
  Description of Artificial Sequence: Synthetic coding sequence
atggccgccatctacctgagccggggcttcttcagccgggagcccatctgtccatttgaggagaagactaaggtggaaaggatggtggaagactacctcgcttctggttaccaggacagtgtgacctttgacgacgtagcagtcgactttacgccagaagagtgggctctgctcgatacaaccgaaaagtacctttacagagacgttatgttggagaattacatgaattag

SEQ ID NO: 21790 - DNA, 1254 bp, Artificial Sequence
  Description of Artificial Sequence: Synthetic coding sequence
atgctggagaactacatgaacctggccagcgtggagtgggagatccagccacggacaaagcggtccagtcttcagcaagggttcttgaagaatcaaattttctctggcatccaaatgacacgggggtacagtggatggaagctgtgtgactgcaaaaactgcggggaagtattccgagagcagttttgcctgaaaacgcacatgagggtgcagaatggtggtaacacttcagaaggcaactgctacgggaaagacaccctgtcagtgcataaggaagctagtacaggtcaggaactgagtaagtttaatccctgtggaaaggtcttcacccttacccccgggctggcagtgcatctcgaagttcttaatgcccgccagccgtataagtgtaaagagtgtggcaagggcttcaaatacttcgcgtccctcgacaaccacatgggtatacacacagatgaaaagttatgcgagttccaggagtatggacgcgctgtgacagcctcaagtcatctgaaacaatgcgtcgctgtgcataccgggaaaaagagcaagaagacaaagaaatgcggtaagtcctttactaatttctcgcaattatatgccccggtgaagacacataagggagagaagagtttcgagtgtaaagaatgtggtaggagtttcaggaattcatcctgtcttaacgaccatatccaaattcacactggcattaagccccacaagtgcacatactgcggcaaggcctttaccaggagtacgcagcttaccgaacatgtcaggacccataccgggattaagccctatgagtgtaaggagtgcggccaagccttcgcccagtattctggcttgtctatccacataagaagtcactcaggaaagaaaccctaccaatgtaaggaatgtggaaaagcctttaccacatcaacgtcattgattcagcatacccggattcatactggggaaaagccttatgagtgtgtggagtgtggcaagactttcatcacctcttccagaaggtctaaacacttgaaaactcatagcggagaaaagcccttcgtctgtaagatctgcggaaaagcgtttctttacagttcaaggctcaatgtacacctgcgcacgcacacgggtgagaaacccttcgtgtgtaaagaatgtgggaaagcctttgcagtatcctcacgattaagtcgccacgaaaggatccacactggtgaaaaaccctacgaatgcaaggatatgtccgttactatctag

SEQ ID NO: 21791 - DNA, 126 bp, Artificial Sequence
  Description of Artificial Sequence: Synthetic coding sequence
atggccgccatctacctgagccggggcttcttcagccgggagcccatttgcccgtttgaggagaaaaccaaggtggaacgaatggttgaagattacctcgcaagcggttatcaagactctgtgtag

SEQ ID NO: 21792 - DNA, 1065 bp, Artificial Sequence
  Description of Artificial Sequence: Synthetic coding sequence
atgagcgccttcgacatgagccacgacttcttcttctgcctgaccagcgaatgggagattcagccacgcacaaagaggagctcactgcagcaggggttcctaaagaatcagatattcaccggcattcaaatgcaaacacgctcatattcaggctggaagctgtgtgagaactgtggagaggttttctccgagcaattctgtctgaagactcacatgcgggctcaaaatggcggcaatacatttgaaggcaattgttatgggaaagatagcatctcagtacacaaagaagcctctatcgggcaggaattgtcaaagtttaacccctgcggtaaggtgtttaccttaactcccggcctggccgtgcacctcgagatcctgaatggcagacagccctataaatgcaaggagtgtggcaagggctttaaatattttgcctccctggacaatcatatggggatacacattggagaaaagctctgtgagttccaagaatgtgagcgggcgattaccacctcgtcccaccttaagcagtgtgtggcagtccataccggaaaaaagtccgagaagactaaaaactgcggcaagtccttcaccaacttctctcagctgtctgcccacgccaagacgcataaaggggagaaatcttttgagtgtaaggagtgcggacggagctttagaaatagctcatcttttaatgtgcatatccaaatccacactgggattaagccccacaaatgcaccgagtgtggcaaggctttcactcgctcaactcacctgacccagcacgtgcggacccatacggggattaagccttacgagtgtaaagaatgtgggcaagctttcacccagtacactggcctagctattcacattcggaaccatactggggagaagccgtaccaatgtaaggagtgtgggaaggctttcaacagaagctccactcttacccagcataggaggattcacaccggggagaagccctacgagtgcgtggagtgtggcaaaacattcataacttcctcccacagatccaagcatctaaagacccattctggagagcggtag

SEQ ID NO: 21793 - DNA, 1281 bp, Artificial Sequence
  Description of Artificial Sequence: Synthetic coding sequence
atgagcgccttcgacatgagccacggcttcttcccccgggagcccatttgcccctttgaagaaaaaaccaagatcgggaccatggtcgaagaccatcgaagcaattcttatcaggattcagttacttttgacgatgtcgccgtcgagtttactcctgaagaatgggccctgctggacaccactcagaagtatctctaccgcgacgtgatgcttgagaactatatgaatctggctagcgttgatttcttcttttgcttaacaagtgagtgggagatccaaccccgaacaaagaggtcctctctacaacaaggatttctaaaaaatcagatcttcaccggtatccaaatgcaaactcgatcttattctggatggaaactctgcgaaaattgcggggaggtgtttagcgaacagttctgcttaaagacacacatgcgtgctcaaaacggcggcaatacattcgaaggtaattgctatggaaaggattccatttctgtacataaagaggcatctatcggccaggagctgtcaaaatttaatccttgcggcaaggtctttaccctcacgcccggcctcgcggtgcacttagagattctcaacgggagacagccttacaaatgcaaagagtgtggaaagggtttcaaatatttcgcctcccttgacaaccatatgggcattcatatcggtgaaaaattgtgcgaatttcaggagtgtgagagggcaatcacaacaagttcacatctgaagcaatgtgtagccgtgcacaccggaaagaaaagcgaaaagacgaaaaattgcggtaaatccttcacgaacttctcacagctctcagctcatgccaaaactcacaagggtgagaagtcattcgaatgcaaggagtgcggccggtcttttcggaacagctcctcttttaacgttcatatacaaatccacactggtataaaaccgcacaaatgcactgagtgtggcaaggcctttactaggagcactcacttgacccagcacgttcgaacgcacactggtatcaaaccgtacgagtgtaaggagtgcggccaggcgttcacgcagtatactgggctcgcaatacatatcaggaaccatactggagaaaaaccttaccagtgtaaggagtgcgggaaggcttttaatcgcagctcaacactcacccagcacaggaggattcacacaggcgagaagccttacgaatgcgtggagtgcggcaagaccttcattacatcatcccacaggtccaagcacctgaagactcattcgggggaaaggtag

SEQ ID NO: 21794 - DNA, 1281 bp, Artificial Sequence
  Description of Artificial Sequence: Synthetic coding sequence
atgagcgccttcgacatgagccacggcttcttcccccgggagcccatatgccccttcgaggaaaagacaaagatcggaaccatggtggaagaccaccgatctaattcataccaagattccgtgaccttcgatgacgttgctgtcgaattcacacccgaggaatgggccttactagatacaacacaaaaatatctctaccgtgacgtgatgctcgagaactatatgaacctggcaagcgtcgattttttcttctgtctgacatcggaatgggagattcagcctcgcaccaagcgaagtagcctgcagcaagggttcctgaagaaccaaatctttacgggcatccagatgcaaactagaagttatagcggctggaaattgtgcgaaaactgcggagaggtgttctccgagcagttttgtctcaagactcatatgagggctcagaatggggggaacaccttcgaagggaactgttatggcaaagattccatctctgttcacaaggaagcttctatcggtcaggagctgtctaagttcaatccctgcggcaaggtgttcacactgaccccagggctagccgtacatctggaaattctcaacggaagacaaccatataagtgtaaggaatgtggaaagggatttaaatatttcgcgtctctggacaatcacatggggatccatataggggaaaagctgtgcgagttccaggagtgtgagcgggctatcactacaagttctcacctgaaacagtgcgtagccgtccataccggcaagaaatcggagaaaaccaaaaattgtgggaaaagctttacaaactttagccaactgtctgcccatgcgaaaacgcacaagggcgaaaaatcttttgaatgtaaggagtgcgggcggagttttcgcaatagttcctcctttaacgtgcacatacagattcacacagggattaaacctcacaaatgcaccgagtgtggcaaggccttcacccggagcacacacctgacccagcacgtgcgaacccatacagggataaaaccttacgagtgtaaagagtgcgggcaagcgttcacccagtacaccggacttgcgatccatatcaggaatcataccggggagaaaccataccaatgcaaggagtgtgggaaagcctttaatcgctcctccactttgacccagcaccggcgaattcacaccggtgagaaaccatatgaatgcgtagaatgtggcaaaaccttcatcacgagtagccatagatctaaacacctgaagacgcactcaggagagcgttag

SEQ ID NO: 21795 - DNA, 1074 bp, Artificial Sequence
  Description of Artificial Sequence: Synthetic coding sequence
atgctggagaactacatgaacctggccagcgtggacttcttcttctgcctgaccagcgagtgggagatccagcctcgcaccaaacggtctagcctacagcaggggttcttgaagaaccagatttttacaggcatccagatgcagaccaggagctattcaggttggaaactgtgtgaaaactgtggagaagtttttagcgagcagttttgtctgaagacacatatgcgtgcccagaatggagggaatactttcgaaggaaattgctacggcaaagacagcattagcgtacacaaagaagcgtcaatcggacaagaacttagcaagttcaatccttgcggaaaagtattcaccctgaccccaggcctggccgtgcatctggagattctgaacggccggcaaccctataaatgcaaagaatgcggaaagggattcaagtactttgctagcctggacaaccacatgggcatccacattggagagaaattgtgcgaatttcaagagtgcgagcgagccataactacatcgtctcacctgaagcaatgtgttgcggtccacaccgggaaaaaaagcgaaaaaacaaaaaactgcggaaaatctttcaccaatttctcacaactgtcagcacatgccaagacacacaagggcgagaagtcttttgaatgcaaagagtgcggcaggtctttccggaactctagctccttcaacgtgcacatccagatccacaccggtataaagccccacaaatgcaccgaatgcggaaaagcgttcacccgctcaactcacctcacccagcatgtgcgaacacacacaggcattaaaccttatgaatgtaaggagtgtgggcaagcctttactcagtacaccggcctggcgattcacatcagaaaccacaccggcgaaaaaccttaccagtgcaaggagtgcgggaaagcgttcaaccgctcatcgaccctgactcaacacaggcgcattcacacaggggagaagccatatgagtgtgtggagtgtggaaagacctttattacatctagccatcgctcaaagcacctgaagacccattcaggcgaaagatag

SEQ ID NO: 21796 - DNA, 933 bp, Artificial Sequence
  Description of Artificial Sequence: Synthetic coding sequence
atgacccggagctacagcggctggaagctgtgcgagaactgcggcgaggtctttagcgagcagttctgcctcaaaacacatatgcgggcacaaaacggaggcaataccttcgaggggaactgctatggcaaggactcgatttctgtacataaggaagccagcataggtcaagaactgtccaaatttaatccctgcgggaaggtattcactcttactccaggccttgctgttcacctggagattctaaacgggcggcagccatacaaatgcaaggagtgcggcaaggggtttaaatattttgctagtctcgataaccacatgggcatccatattggcgaaaagctgtgtgagttccaggagtgcgagcgcgcgattacgacgtcaagccatctcaagcaatgtgtggcagtgcataccggcaaaaaatctgaaaagactaaaaactgcggcaagtccttcacgaacttcagtcaactgagcgctcacgcaaaaacccacaagggagagaagtcctttgagtgcaaggagtgcggtaggtccttccggaacagctcatccttcaacgtgcacatccagatacacaccggcataaagccccacaaatgtactgagtgtggcaaggcgttcactaggagcactcacctgacccagcacgttcggacccacactggcatcaagccatacgagtgcaaagaatgcggtcaggcattcacccaatacaccggacttgcaatccacattagaaatcacacaggagaaaagccctaccaatgcaaggagtgtggcaaagcgtttaatcgatcttccaccctgacacagcatcggaggatccataccggggaaaagccctacgaatgcgtggaatgtggtaagacatttattactagcagccaccgatcaaagcacctgaaaactcacagcggtgaacgatag

SEQ ID NO: 21797 - DNA, 1170 bp, Artificial Sequence
  Description of Artificial Sequence: Synthetic coding sequence
atggacagcgtgaccttcgacgacgtggccgtggagttcacccccgaggaatgggcgcttctcgacacaacacagaaatatctgtacagggacgtaatgctcgaaaactatatgaacctggcgagtgtggactttttcttttgccttaccagtgaatgggaaatccaaccccggaccaagaggagcagtctccagcagggatttctgaagaaccagatttttaccgggattcagatgcagacgcgctcctacagcggatggaagctgtgtgagaattgtggtgaggtgttttctgaacagttttgccttaaaactcacatgcgggcccaaaatggcgggaataccttcgaaggaaattgttatggcaaagacagcatttccgtacataaggaagcctctattggtcaggagttatctaaatttaatccatgtggaaaagttttcacccttacacccggcttagctgtgcatctggagatcttgaatggaagacaaccttacaagtgtaaggaatgcggtaaaggttttaagtacttcgcttctctggataaccacatgggcatccatattggcgagaaactgtgtgaatttcaggagtgcgagcgcgcaatcacaactagcagccatcttaaacagtgtgtggccgtccacactggcaagaaatcagagaagactaagaattgtggcaagagctttacgaacttctcacagttaagcgcacacgcaaagactcataagggtgagaaatctttcgagtgcaaagaatgcggaaggtcgttcagaaattcctctagctttaacgtacatatccaaatacataccggcattaagccccacaaatgcactgagtgcggaaaagccttcaccaggtcaacccatctgacccagcatgtgcgaactcacacagggatcaagccctacgaatgcaaagagtgcgggcaggcttttactcaatacacaggcctggctatccacattcgcaaccatacaggggagaagccatatcaatgtaaagaatgtggcaaagcatttaatagatcttctacccttacccagcatcgaagaattcacactggcgagaagccatacgagtgtgtggagtgtggaaagaccttcattacctcctcacatcgatccaaacatctgaaaacccatagtggcgagcgttag

SEQ ID NO: 21798 - DNA, 1431 bp, Artificial Sequence
  Description of Artificial Sequence: Synthetic coding sequence
atggacgccgtggccttcgaggacgtggccgtgaacttcacccaggaagagtgggccctgctgggcccttcacagaagaatctgtatcggtacgtgatgcaggaaacaataagaaacctggactgcatccgcatgatctgggaggaacagaacactgaggatcagtataagaaccccagaagaaaccttcgatgccacatggtcgaacgcttttccgagagcaaggacagcagtcaatgcggggaaacattctccctgattagggactctatagtgaataacagtatatgccctggagaggacccctgccaaagcgccgagtgtgaagaagtgataatgggacatctgtcattaaattcccacatcagggtggattctggacataaaccccacgagtatcaggagtacggggagaagccccacacccataaacagcgtggaaaggccttctcgtatcaccacagcttccaaagccggggacgtccacacactggtaagaaacgatatgagtgtaaggagtgtggcaagacctttagctctcggcgcaacctgaggcggcatatggttgttcagggtggtaacaggccctacaagtgtaagctctgcggtaaagcttttttttggcccagtctgctaagaatgcacgaacggacccatacaggggagaagccttatgagtgtaagcagtgcagtaaagcgttccctttctactcatcctatcggcgccacgaaagaatgcacactggggaaaaaccatacgagtgcaaacagtgctccaaggccctcccagatagcagtagttacatccgacatgagcgaacccatacgggcgaaaaaccttacacgtgtaagcagtgtggaaaggccttcagcgtctccagcagcctccgtcggcacgaaactacccacagcgcagaaaagccatacgaatgcaaacagtgcgggaaaacatttcatcatttgggcagctttcaaatccacatgaagagacacaccggcgaccgcccccacaaatgcaaaatctgcggcaaaggattcgatcgtccctcgctcgtgcggtaccacgaacggatccacacgggggaaaagccatatgaatgcaagcagtgcgggaaaacgctctctcactcttcaagcttcaggaggcacatgatcatgcatactggaggtgggccccataagtgcaagatctgcggcaaagcgttcgtctatccatccgtgtgccagcgccacgagaagagccatagcggagaaaagccttacgagtgcaagcagtgtggcaaagccctctctcacagctcaagtttccgacggcacatggtgatgcacactggagacggccctaataagtgcaaggtttgtggaaaagcttttgtgtacccatccgtgtgccaaaggcacgagaagacgcactggcgggagacaatatag

SEQ ID NO: 21799 - DNA, 690 bp, Artificial Sequence
  Description of Artificial Sequence: Synthetic coding sequence
atggacgccgtggccttcgaggacgtggccgtgaacttcacccaggaggaatgggcccttctcggaccttcgcagaagaatctctaccgttatgttatgcaggaaaccatccgcaatctagactgtatacgtatgatatgggaagagcagaacaccgaagaccagtataagaacccccgcagaaatctcagatgtcatatggtggagcggtttagcgagagcaaagattcatcacagtgtggtgaaacattctcccttatcagggactctatagtcaataattctatttgtcctggagaagatccctgccagagcgctgagtgtgaggaggtcataatgggccatctgagtctcaactctcacattcgcgtggatagcggtcacaaaccccacgagtaccaggaatatggtgagaagccgcatacacataaacagagaggaaaggccttctcctaccatcattcgttccagtcgcggggtcgacctcatactggcaagaaaaggtatgagtgcaaggagtgtggtaagaccttttcgagccgtcggaacctgcgcaggcacatggtggttcagggggggaatagaccctataagtttccaatagaagacatgagagagtgcacacttggacgcaaccggatgaacgtgtcctctgttctcaaaccttgcctgattccggtgccgatctag

SEQ ID NO: 21800 - DNA, 1662 bp, Artificial Sequence
  Description of Artificial Sequence: Synthetic coding sequence
atggacagcgtggccagcgaggacgtggccgtgaacttcaccctggaggagtgggccttgcttgatcctagccagaagaaactatatcgcgatgttatgcgggaaactttcagaaatctcgcgtgtgtgggaaagaaatgggaggatcagagtatcgaggattggtacaaaaaccagggccgcattctgaggaatcacatggaagagggtctatctgaatccaaagaatatgatcagtgtggggaggctttcagtcagatcctgaatctaaatttgaataagaagattcccacgattgtaagaccctgtgagtgcagtctgtgtgggaaggtgtttatgcaccactccagcttatcccggcatatcaggtcccatttagggcacaagccgtatgattaccaggaatacggtgagaagccctataagtgcaaacagtgtggaaaagctttctcttcctgtcagagttttcgccggcacgaacggactcacaccggcgaaaagccttacgcatgtccagaatgcggcaaggcatttatatctctcccatccgtacgaaggcacatgattaaacacactggggacggcccttataagtgccaggagtgcggcaaggctttcgaccggccttcgcttttccaaatccacgaaagaacccacacgggggaaaagccttatgagtgtcaggagtgcgctaaggccttcatttccttgccctctttccagagacacatgattagacatacaggagacggaccttacaagtgccaggagtgcgggaaagccttcgataggccaagcctgttcagaattcacgagagaactcatacaggcgagaagccccacgagtgtaagcagtgtggcaaggcatttataagcttcactaactttcagagtcatatgatccgccataccggggacggcccctataaatgcaaagtgtgtggccgtgcgtttattttcccctcttatgtgcggaaacatgaacgaacccacaccggcgagaagccatatgaatgcaataaatgcggcaagacattctcgagcagttccaatgtgcgcacccacgagagaacgcatacaggagagaaaccctatgaatgcaaagagtgtggaaaagccttcatcagtctgccaagtgtcagacgacacatgatcaagcacactggtgatgggccctacaagtgtcaggtctgtggccgggcctttgactgccctagttcatttcagattcacgagcggacccatactggagaaaagccatacgaatgtcaggtgtgtggtaaagccttcattagtcttaaacgcatccggaaacacatgatccttcacactggagatggtccctataagtgtcaagtctgtggcaaagcattcgattgtccctccagcgtgaggacgcacgaaaggacacataccggcgagaaaccgtatgaatgcaaagagtgtggtaaggcattcaattatgcctcctcaattagaatccacgagagaacccacaccggggagaagccttacgaatgcaaacagtgcggaaaaacttttagctatagcagttcttttcagcgtcatgaaagggcccataatggtgataaaccctatgtcaaaaatgttgggaaactgagctttatcacacagccttctaatacgtgcgaaaacgagtag

SEQ ID NO: 21801 - DNA, 1260 bp, Artificial Sequence
  Description of Artificial Sequence: Synthetic coding sequence
atggcccaggagagcgtgatgttcagcgacgtgagcgtggacttctcccaggaggagtgggagtgcctaaacgacgatcaacgagatctctaccgcgatgtgatgctggaaaattactctaatctggtgagcatggctggccacagcatcagcaaacccaatgtgatctcatacctggagcagggaaaagagccctggctggcagacagggagcttactagagggcagtggccagtcctggaaagccgctgcgagacaaaaaaactttttctcaagaaagaaatctacgaaatcgaatccacacagtgggagatcatggagaaactgacacgacgtgatttccaatgttcctcattcagagacgattgggagtgtaatagacagttcaagaaggaactggggagccagggcggacactttaatcaacttgttttcactcatgaagacctgcccactctgtcccaccacccttctttcacattacagcaaatcataaattcgaagaagaagttctgcgccagtaaagagtaccggaaaacattccgacacggatcccagtttgccacgcacgaaattatacatacaattgaaaaaccttacgaatgcaaagagtgtggaaaaagcttccgccacccttcacggctcacccaccaccagaaaatccacacaggcaaaaagcctttcgagtgtaaagaatgtggaaagactttcatttgtggatcagaccttactaggcatcatagaattcatacaggggaaaaaccctacgagtgcaaagagtgcggtaaagctttcagttctggctcaaacttcacgcgacatcagcgcatccatacaggtgaaaagccgtacgagtgcaaggagtgtggcaaagctttttcttccgggtcaaacttcactcaacaccaaaggatccacaccggcgaaaagccctacgagtgcaaagagtgtggcaatgccttttctcagtcctcacagctcataaagcaccagcgtatccacacaggagaaaaaccctacgaatgcaaggaatgtgagaaagccttcagaagcggctctgatttgacacgacatcagagaattcataccggagaaaagccttacgaatgcaagatatgtggcaaggcctattcccaaagcagccagttaatctcacaccatagaatccatacatctgagaagccatatgagtatcgcgaatgtgggaagaatttcaattatgatccgcagctgattcagcaccagaatctgtattggtag

SEQ ID NO: 21802 - DNA, 1257 bp, Artificial Sequence
  Description of Artificial Sequence: Synthetic coding sequence
atggcccaggagagcgtgatgttcagcgacgtgagcgtggacttctcacaagaagagtgggagtgtctgaatgatgaccagagggacctgtatagggatgtgatgctagagaactactccaacctggtgtctatggggcacagcatctccaagccaaacgtgatctcttatctggagcaaggcaaggagccatggctggcagatagggaactgaccaggggacagtggccagtcttggagagtcgctgcgagaccaagaagctgtttctcaaaaaggagatttacgaaatcgagtcaacccagtgggagatcatggagaagctcacacgccgggatttccaatgtagcagtttcagagacgactgggaatgtaaccgacagtttaagaaagaactgggtagtcaaggcggacatttcaaccagctggtgttcacacacgaagacctccctaccttgtcccaccatccctcattcactctgcaacagattatcaactctaaaaagaaattctgcgcgagtaaagaatataggaagacctttagacacggctctcaattcgccacacatgagattatacacacaattgaaaagccatacgaatgtaaggagtgtggaaaatccttcaggcatccatctcgactgactcaccaccagaagatacacactggtaagaagcctttcgagtgcaaggagtgcggaaaaacctttatatgcggcagcgacctgacaagacaccaccggatccatactggcgaaaagccctacgagtgcaaggagtgcggaaaagcattctccagcggatccaactttacccggcatcagcgaatccacacaggcgagaaaccatacgagtgcaaagaatgcggtaaagcattttcctcaggaagcaattttacccaacatcaaagaatccatacaggagagaagccctatgagtgtaaggaatgcggcaacgccttctcccaatcttcccagctgatcaagcaccagaggattcatactggcgaaaaaccttatgagtgtaaagagtgcgaaaaagcttttagatctgggagcgatctcacacggcatcagagaatacacactggtgaaaagccttatgagtgcaaaatatgtggaaaagcttattcccaatcatctcaactgatatctcaccacaggattcacacaagtgaaaagccatatgaatacagagagtgtggcaaaaatttcaattacgacccacaattaatccagcatcagaatttatactggtag

SEQ ID NO: 21803 - DNA, 477 bp, Artificial Sequence
  Description of Artificial Sequence: Synthetic coding sequence
atggcccaggagagcgtgatgttcagcgacgtgagcgtggacttctctcaggaagaatgggagtgtctcaacgatgaccagagggacttgtatagggatgtgatgctcgagaattacagcaacctggtgagcatggccggccattccatttccaaaccaaatgtgattagctacctagagcaggggaaggagccctggcttgctgatcgcgaactaactcgcgggcagtggccagtactggaatcacggtgtgaaaccaagaagctgtttctgaagaaagaaatatacgagatcgaaagcacacagtgggagattatggagaaattaactagacgagacttccagtgtagttcctttagagacgattgggaatgtaataggcagtttaagaaggaacttggttctcagggtggccacttcaatcaactagtgtttacgcatgaggatctgcccacactgagccaccatcctagttag

SEQ ID NO: 21804 - DNA, 1257 bp, Artificial Sequence
  Description of Artificial Sequence: Synthetic coding sequence
atggcccaggagagcgtgatgttcagcgacgtgagcgtggacttctctcaagaggagtgggaatgcctgaacgacgaccagcgcgacctgtacagggatgtgatgctcgaaaactactccaacctcgtaagtatgggccactccattagtaaacctaacgtaatctcatacttggaacaggggaaggaaccatggttggctgaccgagagcttaccagagggcagtggccagtgctcgagtctagatgcgaaaccaagaaattatttcttaaaaaggagatctacgagatcgagtctacacagtgggagataatggagaaactgactcgccgggattttcagtgcagttcatttagagatgactgggaatgcaaccgccaatttaagaaagagctggggagccagggaggccactttaatcagctagtgtttacccacgaagacctccctaccctctcccatcaccccagctttacgcttcagcagataattaatagcaagaagaaattctgtgccagcaaagaataccggaaaactttccgccatgggagccagtttgcaactcatgaaattatacatactatcgagaaaccttacgagtgcaaagaatgcggcaagagctttagacacccctccagactcacccaccaccagaagattcacacaggaaagaaaccgttcgagtgtaaagaatgcggaaaaacgtttatctgcgggagtgatcttactagacatcacagaattcatacaggcgagaagccctatgagtgtaaggagtgtgggaaggccttcagctcaggtagcaactttactcggcatcagcggattcacaccggcgagaaaccatacgagtgtaaagagtgcgggaaagcgttctcctctggcagcaactttacgcagcaccagagaattcataccggtgagaaaccctatgaatgtaaagagtgtggcaatgcattctcccagtcaagccagctgattaagcaccagcgtatacatactggcgagaaaccatacgagtgcaaagagtgtgaaaaagccttcagaagcgggtcggatctaaccagacaccaacggattcacaccggagagaaaccttatgaatgcaagatctgtgggaaagcctactcccagtcgagccagctcatcagccatcatagaatccacacctctgaaaaaccctacgaatacagggagtgtgggaaaaatttcaattacgatccccaactcattcaacatcagaacctttattggtag

SEQ ID NO: 21805 - DNA, 1260 bp, Artificial Sequence
  Description of Artificial Sequence: Synthetic coding sequence
atggcccaggagagcgtgatgttcagcgacgtgagcgtggacttcagtcaagaggagtgggagtgtctcaacgacgatcaaagagacttgtatagagacgtcatgctagaaaactacagtaatctcgtgtcaatggccggccactcaatatctaagccgaatgtgataagttacctagagcaggggaaggaaccatggttggccgacagagagttaactcggggccagtggcctgttctcgaatcaagatgtgagacaaagaagctattcctcaaaaaggagatatacgagatcgaatcaacccagtgggagatcatggagaagctgacacggcgagacttccagtgttcatccttccgggatgattgggaatgcaacaggcagtttaagaaggaacttgggagtcagggcggacacttcaatcagctcgtgtttacccatgaagacctgccaacactcagtcaccatccatctttcaccctgcagcagatcattaatagtaaaaaaaaattttgcgcatccaaggaatacaggaagaccttccggcatggctcccagtttgcgacacacgaaatcatccacacgatcgaaaagccctacgagtgcaaggagtgtggaaaatctttcagacatccaagccggctcactcatcaccagaaaatacacaccgggaaaaagcccttcgagtgcaaggagtgtgggaagacctttatttgtggctctgacctcactcgccaccatcgcattcacacaggggagaaaccttacgagtgtaaagagtgcggcaaagctttttctagtggaagtaacttcacccgccatcagcggatccataccggagagaagccctatgaatgtaaggaatgtggtaaggcattttcaagtggcagcaattttactcagcatcagaggattcacacaggcgaaaagccctatgaatgtaaggaatgtggcaatgctttctctcagtctagtcagcttatcaagcatcagcggatccacaccggagaaaaaccctatgagtgcaaagagtgtgaaaaggcttttcggtctgggtccgaccttacacgtcaccagcggatccataccggggagaaaccttacgaatgcaagatttgcgggaaagcttacagtcagtcttcccagcttataagccaccatcgaattcacacctccgagaagccgtacgaatatagagaatgcgggaagaactttaattacgacccacagctgatccagcaccaaaacctgtactggtag

SEQ ID NO: 21806 - DNA, 1935 bp, Artificial Sequence
  Description of Artificial Sequence: Synthetic coding sequence
atgaccagccagagcagcgtgatcagcaacagctgcgtgaccatggagcggctgagtcacatgatggagagaaaggcatggtgctctcaggaatcagccctatccgaggaggaagaagatacaactcgaccgcttgaaacggtcacgtttaaggatgttgcggtggatttaacccaggaggagtgggaacaaatgaagcccgcccaacgaaacctctatcgtgacgtcatgttagagaattactccaacctggtgacagtaggctgccaagtaaccaaacccgacgtgatctttaagcttgagcaagaggaggagccatgggttatggaagaagagatgtttggccgccactgcccggaagtgtgggaagttgacgagcagataaagaagcagcaggagaccctggttcgaaaagtgacgtctatctccaagaagatactgattaaggagaaggtgatcgagtgcaagaaagtggcaaagattttcccactgtcctcagatattgtgacctctcgccaatctttctacgactgtgactccttagacaaagggctggagcataacctggacctgctgcggtatgagaaaggctgtgtgcgggagaaacaatcgaatgagttcgggaagcccttctatcactgtgcatcttacgtggtcaccccatttaaatgcaatcagtgcggtcaggatttcagtcacaaattcgacttaatccgtcacgaaagaatccatgccggtgagaaaccttacgaatgtaaagagtgcggtaaggccttcagcagaaaggagaatttaatcacccatcagaaaatacacaccggagagaagccctacaagtgtaatgaatgcggcaaagcctttatacaaatgtctaacctgatacggcatcaccgcattcatacaggagagaagccctatgcctgcaaggactgctggaaagccttttctcagaaatccaacctcatcgagcacgagaggatacatacaggcgaaaaaccatacgagtgtaaggagtgtggcaagtccttttcacagaagcagaacctgatcgagcacgagaagatccatacaggagaaaaaccctatgcgtgcaatgaatgtggaagagccttttccaggatgagctctgttacattacatatgcggagtcacactggagagaagccctataagtgcaataaatgcggaaaggccttttcgcagtgcagcgtgtttattatccatatgagaagccatacaggcgagaaaccttacgtatgctccgaatgcgggaaagcttttagccaatcctcaagcttgacagtacatatgagaaatcacaccgcggagaagccatatgagtgcaaagaatgcggaaaagcgtttagcagaaaagaaaatttgatcactcaccaaaaaattcatacgggggaaaaaccctacgaatgtagcgagtgtggaaaagctttcattcagatgtccaatctaattcgacaccagcgaattcacacaggggagaagccgtatgcctgcacggtgtgtggcaaagcttttagtcagaagtccaatctgactgagcacgagaaaattcatacaggggaaaaaccgtatcactgcaaccaatgcggcaaagcctttagtcagcgccagaatctgctggaacacgagaagatccacacgggcgagaagccctttaaatgtaacgagtgtggtaaggccttcagtagaattagctctctaactctgcatgtacgatctcacactggcgagaaaccctatgaatgtaataagtgcggcaaagctttttcacagtgctcactactcattattcacatgcgttctcacacaggagagaagccattcgagtgtaacgagtgcgggaaggccttttctcagagggcttccctgagtatccataagcgcggccatacaggggaacgacaccaggtgtactag

SEQ ID NO: 21807 - DNA, 1743 bp, Artificial Sequence
  Description of Artificial Sequence: Synthetic coding sequence
atgaagcccgcccagcggaacctgtaccgggacgtgatgctggagaattattctaacctggtgaccgtggggtgccaggtgacaaaacctgatgtgatttttaaactggagcaagaagaggagccatgggtgatggaggaggagatgtttggccgtcattgccctgaggtttgggaggtcgacgagcagataaaaaagcaacaagagacactggtgagaaaagtgacttctataagcaagaagatattaatcaaggaaaaagtgattgaatgtaaaaaagtcgcaaaaatattccctctcagcagtgacatagtgacatcccggcagagcttctacgactgcgattcactggataagggactagagcacaatctggatttgctgcgatacgaaaaaggctgtgttcgggaaaaacagtcgaacgaatttggtaaacccttctaccactgcgcatcctatgtggtgacaccctttaagtgtaatcagtgtgggcaggacttttctcacaaatttgacttaatcaggcatgaacgaatccatgccggggagaagccatacgagtgcaaggagtgcggcaaagcgttttctcggaaggagaatctgatcactcaccaaaagatccacaccggtgaaaaaccatataagtgcaacgaatgcgggaaagcattcatccaaatgtctaacctgatcaggcaccatcgcatacatactggagaaaaaccttacgcctgcaaggattgctggaaagcctttagtcagaagtctaatctgatcgagcatgagaggatccacacaggcgagaaaccatacgagtgtaaggaatgtgggaaaagcttttcccagaagcagaatctgatagagcatgagaaaattcacacaggtgaaaagccctatgcatgcaatgagtgcggccgggctttcagtcgaatgagcagcgtcacgcttcatatgagatcgcataccggagagaaaccatacaaatgtaacaaatgcggcaaggcattttcacagtgttctgtgttcatcatacacatgcgatcccatacaggtgagaagccctatgtttgttctgagtgtggcaaggccttctcacaaagctccagcctgactgtgcacatgcgcaaccacacagccgagaagccatatgaatgtaaggagtgcggtaaggcttttagtcgcaaggagaatttgataacgcaccagaaaatccatacgggagaaaagccctacgagtgttccgaatgcggaaaggccttcatccaaatgagcaatctcatcagacaccagcggattcatactggtgagaagccctatgcctgcaccgtgtgcgggaaggcgtttagccaaaagagcaatctgactgaacatgagaaaatccacaccggtgagaagccctatcactgcaatcagtgtggaaaggccttcagccagcgccagaacctgctcgagcacgagaaaatccacaccggtgagaaaccattcaaatgcaacgaatgcggtaaggcttttagccgaattagttctttgactctgcacgtccgaagccatacaggtgagaagccatacgagtgtaacaaatgcggcaaagcttttagccagtgtagcctgctgataatccatatgagatcacacacgggagagaaacccttcgagtgcaatgagtgtgggaaggccttcagtcaacgggccagcctgtccattcataaaaggggccacacaggtgagagacaccaggtgtattag

SEQ ID NO: 21808 - DNA, 1716 bp, Artificial Sequence
  Description of Artificial Sequence: Synthetic coding sequence
atgaagcccgcccagcggaacctgtaccgggacgtgatgctggagaattactctaacctagtgacggtgggctgccaggtgacaaaacctgatgtaatctttaaactggagcaggaagaggaaccctgggtaatggaagaggaaatgttcggtcggcactgtcctgagccacgacgtggcgagaactgttgtgccagcgaagtgatggccgagggccttaagttcaaggacgttgtgatttacttctcccagaaggaatgggagtgtctccacagcgctcaaaaggacctgtacagagacgtgatgttggagaattacggaaatctggtgttgctcggtctgagtgataccaagcccaacgtgatctctctcctggagcagaagaaggaaccctggatggtcaaacgcaaagaaactaaggagtggtgtcccgattgggagtttggaagggagacgaaaaacctcagtcccaaggagaatatatatgagatacggtctcctcagcaggaaaaggctcgggtaatccgggaaattagatgtcaagtggaacgacagcaagggcatcaggagggccattttcgccccgcagttattcccttcaccagcatgcagtgcactgcccacagggaataccagtggctgcatacgggagaaaaaagctgcgagtgccgtaaatgtaaaaacgcctttcggtatcagtcatgtccaatccagcatgagattatccacaataaagagaaagaaccagagtgcggggagtgccggaaaattttcaactctggcagcgatctgatcaagcatcaaaccttgcatgagagcaagaagcattctgaaaacaataagtgcgcctttaatcatgacagcggaataacacagcctcaatcaatcaatactggtgagaaacctcataaatgcaaagagtgtggtaaggcctttaggagctcatcacaaattagccagcaccagaggatgcacctgggcgaaaagccttataaatgtcgggaatgtggcaaagctttccctagcacggcacagctcaacctgcatcagcgtatccatacagacgagaaatattatgaatcaaaggcgtgtggaaaggcgtttacacggcccagccacttattcaggcaccagaggatacacaccggcgaaaaacctcacaagtgtaaagaatgcggtaaagcctttagatacgatacgcaactcagtcttcatcagatcattcacaccggcgaaagacgctacgagtgtagagaatgcggcaaggtgtattcatgcgctagccagctgtcgctgcatcaaaggatacacaccggggagaagccacacgagtgcaaggagtgtggcaaggccttcatttccgattcgcatttaattagacaccaatctgtacatacaggtgaaaagccctgtaagtgcaaggaatgtggaaagtcattccgtcggggctctgaactgacccggcaccagcgcgcccacactggggagaagccttatgagtgcaaggagtgcgaaaaagcatttacctgcagtaccgagttggtgagacaccagaaagtgcacaccggggagcgtccacataagtgcaaagaatgtgggaaagctttcatacgccgcagtgaactaacccaccacgagcggagtcacactggagaaaagccttatgagtgcaaggagtgtgggaagcccttcggcggggggagtgagctgagttag

SEQ ID NO: 21809 - DNA, 1752 bp, Artificial Sequence
  Description of Artificial Sequence: Synthetic coding sequence
atgaccagccagagcagcgtgatcagcaacagctgcgtgaccatggaacgtctctcacatatgatggagcggaaggcttggtgctcccaggagtcggctctcagtgaggaagaggaagacacgaccaggccactagagactgtcactttcaaggatgtggccgtggatcttacccaggaagagtgggagcagatgaaacctgcccagcgcaatctttaccgcgatgtcatgcttgagaattattcaaatctcgtgactgtaggttgtcaggttactaagcccgacgttatctttaaattggagcaggaggaagaaccttgggtgatggaggaggagatgttcgggcgccactgtccagagccaagacggggagagaattgttgtgctagtgaggttatggccgaaggattgaaattcaaagatgtcgtcatctacttctcccaaaaggagtgggaatgccttcattctgctcagaaagatctgtacagggatgtcatgcttgagaactatggcaacctggtgttactgggccttagcgacacaaaaccaaacgtcataagtcttctggaacaaaaaaaagagccctggatggtgaagcggaaagaaactaaagagtggtgcccagactgggaatttggccgagagacgaaaaacctgagtccgaaagaaaacatctatgagatcaggtccccacagcaggaaaaggctcgcgtaattcgcgagattcgatgccaagtcgagcgacagcagggccatcaggaggggcacttcaggccggcagtgatacccttcacatcgatgcaatgtaccgcacaccgggaataccagtggctgcatacaggagaaaaatcctgtgagtgccgcaaatgcaaaaacgccttccgctaccagagctgtcccatccagcacgagatcatacacaataaagaaaaggaacccgaatgtggagaatgcagaaaaatcttcaacagcggcagcgatttgattaaacatcagaccttgcatgagagcaaaaaacactccgagaacaacaaatgcgcattcaatcatgactctgggataacccagccgcagtcaattaatacgggcgaaaagcctcacaaatgcaaagagtgtggaaaggcgttcaggtctagcagccagatatcgcagcaccagaggatgcacctgggcgaaaagccttataaatgcagagagtgcggtaaggcttttccatctacagcccaactcaatttgcatcagcggatccacaccgatgagaagtactacgagtcgaaggcctgtggcaaggcattcacccgtccctcgcatcttttcagacaccagcgtatccatactggcgagaaaccacacaagtgcaaagagtgtggcaaggctttcagatatgatacacagttgagtctgcatcagattatccataccggcgagaggaggtatgaatgccgcgaatgtggaaaagtgtactcctgtgctagtcaactgtcactgcatcaaaggatccatacgggagagaaacctcatgaatgcaaagagtgtgggaaagcgttcattagcgatagtcatctcatccggcaccagagtgtgcacactggagaaaagccatgcaagtgcaaggagtgcggtaagagctttagacgcgggtcagagctgacgcggcaccaaagggcccacactggggaaaaaccctatgagtgcaaggagtgcgagaaagccttcacttgctccaccgagctagtgaggcaccagaaatag

SEQ ID NO: 21810 - DNA, 1668 bp, Artificial Sequence
  Description of Artificial Sequence: Synthetic coding sequence
atggacagcgtggtgttcgaggacgtggccgtggacttcaccctggaggagtgggcactactggactcagctcagagggacctctaccgggatgtgatgcttgaaacatttcgaaatctggcatcggttgacgatggaacgcagtttaaagcgaatgggagcgtgagcttgcaagacatgtatggtcaggagaaaagtaaggaacagacgattccgaatttcaccgggaacaactcatgcgcctacacactcgagaaaaactgtgaggggtatggcaccgaggaccaccataagaacctccgaaatcatatggtggacagattttgcactcacaacgagggcaatcagtatggtgaagcgatacatcagatgcctgacctaacactgcataaaaaggtgagcgccggggagaaaccatacgaatgcacaaaatgtcgcaccgtctttacccatctgagctccctgaaaagacacgtgaaatctcactgtggaaggaaggcacctccaggcgaggaatgcaagcaggcttgcatttgccctagccaccttcattcgcacggacggactgataccgaggagaagccgtacaagtgtcaggcctgcggccaaacttttcaacacccccgttacctgtctcaccatgtcaaaacccacactgccgaaaaaacatataagtgcgaacagtgtcgcatggccttcaacggtttcgcctcctttacacgccatgtgcggacgcacaccaaggacagaccctacaagtgccaggagtgtgggcgagcattcatctaccctagcacatttcaacggcacatgacgacccacaccggcgaaaaaccatataaatgccagcactgcggcaaagcgttcacctacccacaggctttccagcggcacgaaaagacacataccggcgaaaaaccctatgaatgtaaacagtgtggcaagaccttcagctggagcgagactctcagagtccacatgagaattcatacgggtgataaactgtacaaatgtgaacattgtggcaaggcatttactagcagccgaagttttcagggtcatctgcgtactcacacaggtgagaaaccttatgagtgtaaacagtgtggcaaggcctttacctggagttccacctttcgggagcatgtcaggattcacacccaggaacaactgtacaagtgcgaacagtgcggaaaagccttcacctcatccagatcatttcggggccaccttcgcacacacactggcgaaaaaccgtatgaatgcaagcagtgcgggaagactttcacctggagttcaacatttcgggaacatgttagaatacacacccaggagcagctgcataagtgtgagcactgtggcaaggcttttacatcatcaagggcctttcaggggcatttacgcatgcacacgggcgagaaaccctacgagtgcaaacagtgcggcaagacattcacctggtcgtctacactgcacaatcatgtcagaatgcacacaggggaaaagccccacaaatgtaagcaatgcgggatgagtttcaagtggcattccagctttcgcaaccatctacgaatgcatacaggtcaaaaatctcacgaatgtcaaagttactcaaaagctttctcctgtcaagtgattctgtccaaaacctctgagagtacacactag

SEQ ID NO: 21811 - DNA, 1674 bp, Artificial Sequence
  Description of Artificial Sequence: Synthetic coding sequence
atggacagcgtggtgttcgaggacgtggccgtggacttcaccctggaggaatgggccctattggacagtgcccagcgagacctgtatcgcgacgtcatgctcgagacctttaggaatctcgcctctgtcggctgcgagatgtgggagaggaccaacggaagtgtatccctgcaagatatgtacgggcaggagaagtccaaggagcaaacaatacctaacttcacaggcaataacagctgtgcatacaccctggagaagaagaggatcactcggagcggggaccaaagccaactccctgttcgacgaaggaaccatatggtcgatagattctgcactcataatgaggggaatcagtacggggaagccatccaccagatgccagatcttaccctgcacaagaaagtgtccgccggagagaagccttatgaatgcacaaaatgcaggaccgtttttacacacctctcatcactcaaaagacatgtgaagtcccactgcggacgcaaagcccctcctggcgaggaatgcaaacaagcatgtatttgccccagccacttgcatagtcatggtcgaacagatacagaggagaagccatacaagtgtcaggcttgcggccaaacatttcaacatccacgttacctaagccatcacgtcaaaactcacactgccgaaaaaacttataagtgcgagcagtgtcgcatggccttcaacggattcgcttcctttacacggcacgtgcgcacccataccaaggaccggccgtacaaatgtcaggaatgtggacgggcctttatttatcccagcacatttcaacggcacatgactacacatactggtgaaaagccttacaagtgccagcactgtggtaaggcattcacctatccacaggcctttcagcggcacgaaaaaactcacactggagaaaagccatacgaatgcaaacagtgtggaaagactttttcatggagtgaaacactaagagtgcacatgcgaatccatactggcgacaaactgtataagtgtgaacactgcggcaaagccttcacctctagccgctccttccaaggtcaccttaggactcatacaggcgagaaaccctacgaatgtaagcagtgtggcaaagcatttacctggagcagcacatttcgtgaacatgtcaggattcacacgcaggagcagctgtacaagtgcgagcagtgtggtaaggccttcaccagctccagatctttcagagggcacctcagaacccatacgggcgaaaagccttatgaatgcaagcagtgcggtaagacatttacctggtcctctacgttcagggagcacgttaggatacatactcaggaacagctgcataaatgcgagcattgtggcaaagcttttaccagtagcagagcttttcagggccaccttcgcatgcacacaggagaaaaaccttacgagtgcaaacaatgcggcaagactttcacttggtcctccacactgcacaaccacgttaggatgcacactggggagaagccccataagtgtaaacagtgcggtatgtcctttaagtggcacagcagcttccgcaatcatctgcgtatgcatactggccagaaaagtcacgaatgccagtcttatagtaaggcattctcgtgccaggtgattctgtccaaaacatcagagtccactcactag

SEQ ID NO: 21812 - DNA, 1611 bp, Artificial Sequence
  Description of Artificial Sequence: Synthetic coding sequence
atggccgtgggcctgctgaaggccatgtaccaggagctggtgaccttccgcgacgtagccgtggatttctctcaggaagaatgggactgcctggactcaagtcagcgacacctgtacagtaacgtaatgctggagaattatcgaattctggtgtcactcggactgtgtttctcgaaaccaagcgttatcctcctgttggaacagggcaaggcgccatggatggtgaagagagaactaaccaaggggctttgttccggttgggagcccatatgtgaaacggaggagctcacgcctaagcaggacttctacgaggagcatcaaagccaaaagatcatcgaaaccttgacatcttacaatttggagtatagctcactaagggaagagtggaaatgtgaaggttacttcgaacggcagcccggaaatcagaaggcatgcttcaaggaagaaattatcacacacgaggagccactgtttgatgaacgggagcaggagtacaagtcctggggctcttttcatcagaatccgcttctctgcactcagaagattataccaaaggaggaaaaggttcacaagcacgacacccagaaaaggtcatttaaaaagaatctaatggcgattaagcctaagtccgtttgtgctgagaaaaagctgcttaaatgcaatgactgcgagaaagttttctctcagtccagctctctgacgcttcaccagcgtatacatactggagagaagccttacaagtgcatagagtgcgggaaagctttcagtcagcgatctaacctagttcagcatcagagaattcacactggggaaaagccttacgaatgtaaagagtgccgcaaggcattctcccagaacgcgcacctggtgcagcatttacgagtgcacacaggtgagaagccttacgagtgtaaggtgtgtcgtaaagctttcagccagttcgcatacctggcccagcatcagagggtccatactggggaaaaaccttacgaatgtattgagtgcggtaaggctttctctaatcggtcctctatagcccagcatcagcgagttcacactggagagaaaccctacgagtgtaacgtgtgcgggaaagccttcagcctgagagcgtatctcaccgttcaccagcgaatccacaccggggagaggccctatgagtgtaaggaatgtggcaaggcctttagtcaaaactctcacctggctcagcatcagaggatccacaccggggaaaaaccctacaaatgccaggagtgtcgcaaagcattcagtcaaattgcttaccttgctcaacaccaacgcgtccacacgggggagaagccatacgagtgcattgaatgcggcaaagccttcagcaatgattcttctcttacacagcatcaaagggtgcacacgggcgagaagccttatgagtgcactgtctgcggcaaggctttctcttactgtggctccctagctcaacaccagcgtattcatacaggagagcgaccttatgagtgcaaggagtgcaagaaaaccttcagacaacatgctcaccttgctcatcaccagaggatccatattggagagagcctgagtcctcctaatcccgtgaatcaccaggttctctag

SEQ ID NO: 21813 - DNA, 1002 bp, Artificial Sequence
  Description of Artificial Sequence: Synthetic coding sequence
atggccatcaagcccaagagcgtgtgcgccgagaagaagctgctgaagtgcaacgattgtgagaaagtgttttctcagtccagtagcctcaccttacatcagaggatccacacgggggaaaagccctataagtgcatcgagtgtggaaaagccttctcccagcgcagtaatctagtgcaacaccagcgcattcacaccggggaaaagccgtatgagtgtaaggagtgccgcaaggccttttcccaaaatgcccacctggtgcaacatctcagagtccacaccggcgagaagccttacgaatgcaaggtatgtaggaaggccttctcacagtttgcgtacttggcgcaacaccagagagttcacacaggggagaagccctacgagtgcatcgagtgcggcaaagctttcagtaataggtcgagcatcgcccagcatcaaagagtgcatactggtgaaaagccctacgaatgtaacgtgtgtggcaaggcctttagccttcgggcctacttgactgtgcaccagcggattcacacaggagaaaggccttacgagtgtaaggaatgtggcaaggccttttcacaaaactcccaccttgcccagcatcaaagaatccacactggtgagaagccatacaaatgtcaagaatgtagaaaagcattctcccagattgcctatctggcccagcaccagcgcgtgcacaccggggagaagccatatgagtgtattgagtgcgggaaggctttttcaaacgattcttccttgacgcagcatcagagggtgcatacaggcgaaaaaccctacgagtgcaccgtgtgcgggaaagccttcagttactgtggatcactggcccagcaccagcgtatacatacaggcgagagaccgtacgagtgcaaagagtgtaaaaagactttcaggcagcacgcccatttagcacatcatcagcgtattcacattggcgagagtttgtctccccccaatcccgtcaatcaccaggtgctgtag

SEQ ID NO: 21814 - DNA, 1830 bp, Artificial Sequence
  Description of Artificial Sequence: Synthetic coding sequence
atgccccacctgctggtgaccttccgggacgtggccatcgacttctcacaggaggagtgggaatgtctggaccctgctcagcgcgacctttatcgagatgtgatgctcgaaaactatagtaacctgatcagcttggacctggagtcttcttgtgtaaccaaaaagctgtcccctgaaaaggagatttacgaaatggaatcccttcagtgggaaaatatggggaagaggattaatcaccaccttcagtacaacgggctcggggacaatatggagtgcaagggtaaccttgagggccaggaggctagtcaggaggggctgtatatgtgtgtgaagatcacatgcgaagaaaaggccacagagagccactctacgtcgagtacgttccatcgaattatcccgactaaggagaagttgtacaagtgcaaggagtgtcgtcagggcttcagctacttgtcctgtttgatccaacatgaagagaaccataatatcgaaaaatgttccgaggttaaaaaacacaggaacactttttcaaagaaaccttcctatatccaacaccagagaattcaaacgggcgaaaagccttatgagtgcatggagtgcgggaaggcctttggtcgaacatctgatctgattcagcaccagaagattcataccaatgagaaaccttaccagtgtaatgcttgtggaaaagccttcatccggggcagtcagctgacggagcaccagagagtccacactggggagaagccttacgagtgcaagaaatgcggtaaggcctttagttactgtagccagtacaccctccatcagcggatccacagtggggagaagccctacgagtgtaaggactgcggaaaggcctttattttgggatcacagcttacctaccaccagaggattcactccggagaaaagccatacgaatgcaaggaatgtgggaaagcgttcatcttggggtctcacctcacttatcaccaacgcgtgcacaccggcgaaaaaccatatatttgtaaggaatgtgggaaagcctttctgtgtgccagtcaacttaatgaacaccagcggatacataccggcgaaaagccctatgagtgcaaagaatgcgggaagacgttcttcagggggagccagttgacttatcacctgagggtgcattcaggcgaaaggccctataagtgtaaagagtgcgggaaggcatttattagtaacagcaacctgattcagcaccagaggattcataccggcgaaaaaccttacaaatgcaaagagtgcggaaaggcttttatttgcgggaaacaactaagcgaacaccagagaattcacacaggggaaaagccgttcgagtgcaaagaatgcggaaaagcatttatacgggtcgcataccttacacagcacgaaaagattcatggcgaaaagcactacgagtgtaaggagtgcggaaaaacatttgtcagagctacccagctgacatatcaccagagaatacatacaggggaaaaaccatataagtgcaaggagtgcgacaaagcttttatttacggaagccagttgtctgagcaccagagaatacaccggggagaaaaaccttacgaatgcaaacaatgtggaaaggcttttatccgcggcagccacctcaccgagcatctgcgcacacacactggggaaaagccctatgagtgcaaagagtgtggacgagcttttagccggggaagcgagctgactctgcatcagcggattcatacaggagaaaagccatacacatgcgtgcagtgtggcaaggattttcgctgccctagccaactgactcagcatacacgcctgcacaattag

SEQ ID NO: 21815 - DNA, 1830 bp, Artificial Sequence
  Description of Artificial Sequence: Synthetic coding sequence
atgccccacctgctggtgaccttccgggacgtggccatcgacttcagccaagaagagtgggagtgcctggaccccgctcagcgcgatttgtacagagatgttatgcttgagaactattcgaatttgatttccctggacctagagagcagctgtgtaaccaaaaaactgagtcccgagaaggaaatatacgaaatggagtctctccagtgggagaacatgggcaagcgcatcaaccatcatctgcagtataacggccttggggacaatatggaatgcaaggggaatttagaagggcaggaggcttcacaagaaggcctgtatatgtgtgtcaaaatcacctgcgaagagaaagcaacagagtcacactccacatctagtacatttcaccgcattatccctaccaaggagaagttatataaatgtaaagagtgccgccagggcttcagctatttaagttgcttgatccagcacgaagagaaccacaatatcgaaaagtgttctgaagtcaaaaaacatcgaaacactttttctaaaaaacccagctatatacagcatcagcgcattcaaactggggaaaagccctacgaatgtatggaatgtggtaaagcatttggaagaacaagtgatctgatccagcaccagaagatccatacaaatgagaaaccctatcaatgcaatgcctgcggcaaagccttcatcagaggatcacagctgaccgaacaccagagagtgcacacgggggaaaagccatacgagtgcaagaaatgcggaaaagctttcagttactgcagccagtacactctccaccagcgaatccacagcggcgaaaaaccctatgaatgtaaagattgcggaaaggccttcatcctcgggtcccagttgacgtaccatcaacgaatacacagcggtgagaaaccttacgagtgcaaggaatgcggcaaggcgttcatccttgggtcccaccttacctaccatcagagagttcataccggggagaaaccctatatttgcaaggagtgcggcaaagcatttctctgcgcaagccaactgaacgaacatcagcggatacacaccggagagaagccctacgagtgcaaggagtgtggcaagaccttttttaggggatcccagctgacttaccatctccgagttcactctggggagaggccttacaagtgtaaagagtgcggcaaagctttcatttcaaactcgaatctaattcagcaccagcggatccataccggagagaagccatacaaatgcaaggaatgtgggaaggcttttatctgcggaaaacagctgtcagaacaccagcgcatccatacaggtgaaaagcccttcgagtgcaaggaatgtggtaaggcatttataagagtagcctacctcactcagcatgaaaagatacacggggagaagcactacgagtgcaaggagtgcggaaaaacgtttgtccgggccacccagctcacctaccatcagcggatccataccggggagaaaccatataagtgcaaagagtgcgataaggcatttatatacggcagccagctgagtgagcaccagcggatccacaggggtgaaaagccctacgagtgtaagcagtgcggcaaagcctttatcagaggcagccatctcacagaacatctgcgcacgcacacgggcgagaaaccatacgagtgcaaggagtgtggcagagccttcagccggggaagtgagctgacattgcaccaacgcatacacaccggtgagaaaccgtacacgtgtgtccaatgcggaaaagattttcgctgcccatcccagctgacccagcacacaaggcttcacaactag

SEQ ID NO: 21816 - DNA, 1830 bp, Artificial Sequence
  Description of Artificial Sequence: Synthetic coding sequence
atgccccacctgctggtgaccttccgggacgtggccatcgacttctctcaggaagaatgggagtgtctggatcctgctcagagagatttataccgcgatgtgatgttggagaactatagtaacttaatttcccttgatctcgaatcctcctgtgtgaccaagaagctcagtccagagaaagagatttatgaaatggaatccctacagtgggagaatatggggaagcggattaaccaccacctgcagtataatgggctgggcgataatatggaatgtaaggggaatttggaaggccaggaggcttcccaggaaggcctgtatatgtgtgtgaagattacatgtgaggagaaggccactgaatcccacagcacaagtagcacattccatagaatcatccctaccaaagaaaagctatacaaatgcaaggaatgtaggcaggggttcagctacttgtcttgcctgattcagcatgaagaaaaccacaacatcgagaagtgctcggaagtgaaaaaacaccgcaatacattcagcaaaaagccatcctatattcagcaccagagaattcagaccggggagaagccttatgaatgtatggaatgtggtaaagcctttggcaggacatcagacctcatacagcatcagaaaatccatactaacgagaagccttaccagtgtaacgcctgtgggaaagcctttataagaggtagtcagctgaccgaacaccaacgcgtgcacactggagaaaagccatacgagtgcaaaaaatgcggaaaggccttctcgtactgcagccagtacaccctccatcagcggatacacagcggcgagaagccgtatgagtgcaaggattgtgggaaggcctttatactgggctctcagctgacctaccaccagcgcatccatagtggcgaaaagccatatgagtgtaaagagtgtggcaaggccttcattctggggagccatcttacttaccatcagagggtccacaccggcgagaagccgtacatctgcaaggagtgtggtaaggcatttctgtgtgcctcacagctgaacgaacaccaaaggatccatactggtgagaagccatatgagtgtaaagaatgcggaaagacattctttagagggtctcagcttacttatcacctgagggtgcactccggtgaacgaccctataagtgtaaagagtgcgggaaagcttttatatcaaattctaatcttatacagcaccagagaattcacaccggcgagaagccatacaagtgcaaggagtgcggtaaagcattcatctgtggaaagcagctctccgaacaccagcgcatccacactggggaaaagcctttcgagtgcaaggaatgcggcaaggcattcatccgggtcgcctatctcacccagcatgagaagatccatggtgagaagcattacgaatgtaaagaatgtggaaagactttcgtgcgagctactcaattaacataccaccaaagaattcatacaggcgaaaaaccctacaaatgtaaggagtgcgataaggcatttatttatggctcccagctctcagaacaccagagaatccacagaggggagaagccatatgagtgtaaacagtgtgggaaagcttttatcaggggcagccacctcactgagcatctgcggacgcatacgggggagaagccctacgaatgtaaagagtgtggcagggccttctcccgtggctctgagttgacactccaccaaaggattcacaccggagagaaaccatacacctgcgtgcagtgcggaaaggattttcgttgcccctctcagttaacacagcatactcgtctacacaactag

SEQ ID NO: 21817 - DNA, 1590 bp, Artificial Sequence
  Description of Artificial Sequence: Synthetic coding sequence
atggagcaggagaagaagctgctggtgagcgacagcaacagcttcatggagcgggagtctttaaagagtcccttcaccggtgatactagcatgaacaacctggagaccgtccaccacaataattcaaaagcagataagctgaaggagaagccttccgagtggagtaagcggcacaggccacagcactataagcacgaggatgccaaggagatgccactgacatgggtgcaggatgaaatctggtgccacgactcctacgaaagcgatggaaagtccgaaaactggggaaattttatcgctaaagaggaggaaaaacctaatcaccaggagtgggacagcggggagcacactaacgcatgtgtgcaacagaattcttcattcgtcgaccggccgtataaatgctccgaatgttggaagtcgttctctaactcttcccacctgcggacccatcagagaacacactctggcgaaaagccctacaaatgttctgaatgcgctaaatgcttttgtaattctagccatctcattcaacatctgagaatgcatacaggagaaaagccttaccagtgtggcgagtgcggcaagtctttctctaatacgagtcatctcatcatccacgaacgcacacacaccggtgaaaaaccttataaatgtcccgagtgcgggaaacggtttagctcctccagtcatctcattcagcaccacaggagtcacacgggagagaagccctatgagtgctcagtgtgcgggaagggtttctcgcattcctacgtgctgatcgagcaccagcggacacacaccggcgagaagccttataagtgccctgattgcggaaaatccttctcccaaagttcctcgctcatcaggcaccagaggactcacaccggcgaaaagccctataaatgtctcgagtgtgagaaatcgttcggatgcaatagcaccctaatcaaacaccagcggatacatactggcgaaaagccatatcagtgtccggagtgtgggaagaacttctcccgaagctccaatcttattacccaccaaaagatgcataccggagaaaagtcctacgaatccagtgagtacgaggaatcccttggccagaactgcaatgtgattgaagagtgtagaattcaactgggcgaaaagccctatcgctgctgcgagtgcggcaagagttttggtctcagtagtcaccttatccggcaccaacgcacgcacacaggcgagaaaccatatcgatgctcggaatgttggaagacttttagccagtcgagcaccctggtaatccaccagagaactcataccggggagaaaccctacaaatgtcccgattgtggagagagcttttctcagagttttaatctgattcgccacagaagaacacatattggtgaaaagccttacaagtgcaccagctgcgaaaaatgcttcagtaggtccgcctacctctctcagcacagaaaaatacacgtcgagaaaccttttgagtctcccgatgttggtgattttcctcatgaatggacctggaaaaactgcagcggggagatgccgtttatctcttctttctctgtctccaactcttctagttag

SEQ ID NO: 21818 - DNA, 1824 bp, Artificial Sequence
  Description of Artificial Sequence: Synthetic coding sequence
atggagagctgcagcgtggcccaggccggcgtgcagtggcccgacctcagcagcctgcaacctccaccaccccgtttcaaacagtttagctgccactctttgcaagtggctggcatcactgacctggaccttcaatgtgagataatctcctacatcgaagtcccaacgtacgagacagacatctcatccactcagctacagtctatttacaaaagagagaaactgtatgaatgcaagaaatgccagaagaaattttcctccgggtatcagctgattctacaccataggttccacgtgattgaaagaccttatgagtgtaaggagtgtggcaagaattttaggtccggctatcagctgaccctgcatcaaaggttccacacaggagagaaaccctacgagtgcaccgagtgtggaaaaaattttaggtcaggctatcaactcacggtgcatcagcgctttcacacaggagaaaagacgtacgagtgtagacagtgcggcaaagcctttatttacgcatcgcacatagtacagcacgaacgtattcacacaggcggcaagccttacgaatgccaggagtgtggtagagcctttagccaaggtggacacctcaggatccaccagcgggtgcacactggcgagaagccctacaagtgtaaggagtgtggcaaaaccttctctcggagaagtaacctggtggagcatggacaatttcacactgacgaaaaaccttatatatgtgagaaatgtggaaaggcattccgcagaggacaccagctgacagtgcatcagagagtgcatacgggcaaaaaaccttatgagtgcaaggagtgcgggaaaggatatacaaccgcaagctactttttactgcaccaaaggatacacaaaggtgggaagccctacgaatgcaaagagtgtaagaaaacctttacgctttataggaaccttacccgccaccaaaacatacatactggagagaaactgtttgagtgtaagcagtgcggcaagacatacacaaccggcagtaaattgtttcaacaccagaagacacacaccggagaaaagccatatgagtgtaaagagtgcgggaaggccttttccctatacgggtatctaaaacagcatcagaagatccatacgggtatgaaacatttcgaatgcaaagagtgtaagaaaacctttaccttgtataggaacctaacccgccatcagaatatccacaccggaaagaaattgttcgaatgccaagagtgcggcaaggcctactcaaccggatctaacctaatccagcatagaaaaactcatacaggggaaaagccctataagtgcaaagagtgcggtaagaccttcagcctgcatgggtacctgaaccagcatcagaagattcacacgggaatgaaaccttatgagtgtaaagtttgtagaaaaaccttcacattctataggaatctgaccctgcaccagagcattcatactgacgaaaagcctttcgaatgcaaggagtgtggcaagacatttagaagatctagccatctcaccgcacaccagtccatccacgccgacaaaaaaccctacgaatgtaaggaatgtgggaaggcattcaagatgtacggttatttaacccaacatcaaaaaattcacaccggaggcaaaccatacgaatgcaaggagtgcggcaaggcatttagccgcgccagcaatctggtccagcacgagcggatacatactggcgagaaaccttatgtgtgtaagcagtgcggcaagaccttccggtacgggagcgccctcaaggcccaccagagaattcacaggtcaatcaaagtgtag

SEQ ID NO: 21819 - DNA, 1734 bp, Artificial Sequence
  Description of Artificial Sequence: Synthetic coding sequence
atgatcctgcgggaggagacccagttcaccgacctggacctgcagtgtgagatcatcagctacatcgaagtccccacatatgagacagacatatccagcacccagctgcagagcatctacaagagggagaaactttacgaatgcaagaaatgccaaaaaaaattttcgtccggataccagttaatccttcaccaccggttccatgtcattgagcggccatacgaatgtaaggaatgtgggaaaaattttcgctctgggtaccaactgaccctgcatcaacgcttccacactggagagaaaccatacgagtgtacagagtgcggcaaaaacttccgttccggatatcagttgaccgtgcatcagaggttccacaccggcgaaaagacctatgagtgtcgacagtgtggtaaggcatttatttatgctagccacattgtgcagcacgaaaggatccatacgggcgggaagccttacgagtgccaggaatgcggtagggcctttagccaggggggacatctgcggatccaccagcgtgtgcatacaggggagaagccatataaatgcaaggagtgtggcaaaactttttcacgtcgtagcaatctcgtggaacacggacagttccatacggacgaaaagccttatatttgtgaaaagtgcggtaaagcttttcgaaggggccaccagctcactgtgcaccagagagtgcatactgggaagaagccttacgagtgtaaagagtgtgggaaggggtacacaacagcatcttacttcctgcttcaccagagaatacacaaggggggaaaaccttacgagtgtaaagagtgcaaaaagacattcacactgtaccgcaatctcaccagacatcaaaatatacacaccggagagaagctgtttgagtgcaagcagtgtggtaagacatacacgacgggatccaagttgtttcagcaccagaaaactcataccggcgagaaaccgtacgaatgtaaggaatgtggaaaagcctttagcctttacggctacctgaagcagcatcagaaaatacacaccggcatgaagcatttcgaatgtaaagaatgcaagaagacatttactctgtatagaaatctgacccgccaccagaacattcataccggaaagaagttatttgagtgccaggagtgcgggaaggcatactctacagggtctaatctaatccagcatcggaagactcatacaggtgagaagccatacaagtgcaaagaatgcgggaaaaccttctctctgcatggctacttaaatcagcaccagaagattcatacgggcatgaagccgtatgaatgcaaggtttgccggaaaacctttactttttatcgaaatcttactcttcatcagtctattcataccgatgagaagcccttcgaatgcaaggagtgcggcaaaacgttccgtcgcagctctcacctcactgctcaccagtccatccacgctgacaaaaagccctacgaatgtaaagagtgcgggaaggctttcaaaatgtacggatacctaacccaacatcagaagatacatactggtggcaagccctacgaatgcaaagagtgcggcaaagccttctccagggcctccaacctggtgcagcatgagagaattcacaccggagagaagccatatgtgtgcaagcagtgcggcaaaactttccgctacggttcagctttgaaagcccatcagaggattcacaggagcattaaggtttag

SEQ ID NO: 21820 - DNA, 129 bp, Artificial Sequence
  Description of Artificial Sequence: Synthetic coding sequence
atgctggagaactaccggaacctggtgagcctgggcggccacagcatctccaagccagttgtggtggatctcctggagcgcgggaaggagccctggatgatcctgcgggaagagactcaattcacatag

SEQ ID NO: 21821 - DNA, 1737 bp, Artificial Sequence
  Description of Artificial Sequence: Synthetic coding sequence
atgctggagaactaccggaacctggtgagcctggacctggacctgcagtgcgagatcatctcttacatagaggtgccaacatacgaaactgatattagcagtacacaattacagagtatttacaagcgcgagaagctgtacgagtgtaaaaaatgccagaagaagttttcctcagggtatcagctcattctccatcacagatttcatgtcattgaaagaccatatgaatgcaaggaatgtggtaagaattttagatccgggtatcaacttaccctccatcagaggttccacacaggggaaaagccgtatgagtgtacagagtgcggtaagaactttaggagtggttaccagttaactgtgcaccagcggtttcacactggcgaaaagacgtatgaatgcagacagtgcgggaaagctttcatctatgcttcccacattgtccagcacgagcgcattcatacgggtgggaagccctacgagtgtcaggaatgtggaagagcattctctcagggaggacacctgaggatacaccaacgtgtgcacacaggcgagaaaccctacaagtgcaaggagtgcggaaagacgtttagtaggcgctccaatttggtggagcacggccagtttcatacggacgagaaaccgtacatctgtgaaaagtgtggtaaagcttttagacgtggccatcagttgaccgtccatcagagggtccacactgggaaaaaaccctatgaatgcaaagagtgcggaaagggctacactactgcctcctatttcttgctgcatcaacggattcataagggaggaaaaccatacgaatgcaaggaatgcaagaaaacctttacattatatcgcaaccttaccaggcatcagaacatccacactggcgagaagctcttcgaatgcaaacaatgtggcaagacttatactacaggctccaaactgttccagcatcaaaagacacacacaggggagaagccctacgagtgcaaagagtgcggaaaagcttttagcctctacgggtacctcaagcagcaccagaagatccatacagggatgaaacactttgaatgcaaggaatgtaagaagactttcactctttacaggaatctgacaagacaccagaatatccatacaggtaaaaagcttttcgaatgtcaggagtgtggcaaggcctatagtacaggatctaatctgatccagcatcgtaagacccacacaggggagaagccctataagtgcaaggaatgcggaaaaaccttctcccttcacggctatctaaaccagcatcagaagattcacacgggaatgaagccctatgagtgcaaagtgtgccgaaaaacatttacattttaccgcaacctgaccttgcatcagtctatccatactgacgagaagccatttgagtgtaaggaatgtgggaaaacattccgacggagtagccacctgaccgcccaccagagtatccacgcagataagaagccttacgaatgcaaggaatgcggaaaagccttcaagatgtacgggtatttgactcagcatcagaagatccataccggaggcaagccttacgagtgcaaagagtgtggcaaggcttttagcagagcaagcaacttagtgcagcatgaaagaattcacactggcgaaaaaccctatgtttgtaaacagtgcggtaaaacattcaggtacgggtccgccctgaaagcacaccagcggatacatcggtccattaaggtgtag

SEQ ID NO: 21822 - DNA, 1734 bp, Artificial Sequence
  Description of Artificial Sequence: Synthetic coding sequence
ttcatcctgcggaccagcagcttcgtgagcgacctggacctgcagtgcgaaatcatttcttacatagaggtgcctacttatgaaacagacatctctagcacccagctccagtctatctataagcgagaaaagctgtatgaatgtaaaaagtgccagaagaaattttcttctggatatcagttgattctgcaccacagattccacgttatcgagcggccctatgagtgcaaggagtgtggcaaaaacttcagatccgggtatcaattgacattgcatcagcggtttcacactggcgagaaaccatatgaatgtaccgagtgtggaaagaacttcaggagcggctaccagctaacggtgcatcagcgcttccacacaggcgaaaaaacatatgagtgtcgacagtgtggtaaggcctttatttatgcttctcatatagtccagcatgagcgcattcacaccgggggcaaaccttatgaatgtcaggaatgcggtagagctttctcacagggcggacacctccgcatccaccagcgggttcacactggggagaagccttacaaatgtaaagagtgcggcaaaacgttttccaggcgctcaaacctcgtggaacatggtcaatttcacactgatgagaagccatacatttgtgagaaatgtggtaaggccttcagaagaggacatcaactgaccgtccaccagcgggtgcatactggcaaaaagccgtacgaatgcaaggaatgcggaaagggctatactacagcctcatatttcttgctgcaccagcgtatacataagggcgggaagccttacgagtgtaaggaatgcaagaagaccttcacactttacaggaatctcacgaggcatcagaatatacataccggcgaaaagctgtttgagtgcaagcagtgcggcaagacatatacaactggaagcaagctgttccagcaccagaaaacgcacaccggggaaaagccctacgagtgtaaggagtgtggaaaggctttcagcctctacggttacctcaaacagcaccagaagatccatacaggaatgaaacactttgagtgcaaggagtgcaagaagacatttactctctatcgcaacctgaccagacaccaaaacatacacacagggaaaaaactgtttgaatgccaggagtgcgggaaggcatattcaaccggatcaaaccttatccagcaccggaagacccatactggcgagaagccctataagtgtaaggagtgtggcaagaccttttccttgcatggttatctaaaccagcatcagaagatccatactggtatgaaaccttatgagtgcaaggtgtgccggaagacctttacattctaccggaacctgacactccaccagagcattcacactgacgaaaagccatttgagtgcaaggagtgcggtaaaacttttcggagaagtagccacctaactgcccatcagtcaatccatgcagataagaagccttacgaatgtaaggaatgcgggaaggccttcaagatgtacgggtacctgactcagcaccaaaagatccacacaggaggcaaaccctacgagtgcaaggagtgcggtaaggccttttcacgggcgtctaatctggtgcagcatgaacgcattcataccggagagaagccttatgtgtgcaagcagtgcggaaagacttttagatacggcagcgctttgaaggcgcatcagcgcatccatagaagcattaaggtatag

SEQ ID NO: 21823 - DNA, 1734 bp, Artificial Sequence
  Description of Artificial Sequence: Synthetic coding sequence
atgatcctgcgggaggagacccagttcaccgacctggacctgcagtgcgagataatctcctacatcgaggtcccaacttatgagacagatattagtagcacgcaactgcaaagtatctacaagcgggagaaactttatgagtgcaagaagtgccagaaaaagttctcctctgggtaccagctgatcctgcaccacagattccatgtcatcgaaaggccttacgagtgcaaagagtgcgggaagaactttcgcagcggataccagctcactctccaccagagatttcacaccggtgaaaagccatacgaatgcaccgagtgcggtaagaattttcggtctggctaccaactgactgtgcaccagcgcttccacaccggagaaaagacatatgagtgccgacagtgcgggaaagctttcatttatgcgagtcatatcgtacagcatgaaagaattcacacaggcggcaagccttatgagtgtcaggagtgcggtcgggcatttagtcagggaggccatctgcgtatacatcagagggtccacacgggtgagaaaccatacaagtgtaaagagtgtggaaagactttcagccgacgttccaatctggtggagcacgggcagttccacacagatgaaaagccctatatttgtgaaaaatgtggcaaggcgttccggcgaggtcaccagctgactgttcaccagagggtgcatacaggaaaaaaaccctatgaatgtaaagagtgcgggaagggatacactacagcttcatatttcctccttcatcagaggattcacaaaggaggaaagccgtacgagtgcaaagaatgtaagaaaacatttacactctaccggaatctaactcgacatcaaaatattcacacgggggagaaactgttcgagtgcaagcagtgtggaaaaacttacaccacaggcagtaaactttttcagcatcaaaaaacacatacaggcgagaagccatacgaatgcaaagaatgcggtaaagccttttctctctacggatatttgaaacagcaccagaagatccataccggaatgaaacacttcgaatgcaaggagtgtaagaagaccttcacactgtatagaaatcttacgagacaccagaatatacacaccggaaaaaaactcttcgaatgccaggaatgtgggaaggcctactccaccgggagtaacctgatccaacaccggaaaactcacaccggggaaaagccttacaaatgcaaggagtgcggaaagacattctctctgcacggctacctaaaccagcaccaaaagattcatacaggcatgaaaccatatgagtgcaaagtatgcaggaagacattcaccttttaccggaacctgaccttgcaccagtctatccacacagatgagaaacccttcgaatgcaaggagtgcgggaagacatttaggcgcagctctcacttaaccgcacaccagtctatccatgctgacaaaaagccttacgaatgcaaggaatgcggcaaagccttcaaaatgtacgggtacttgacccaacatcagaaaatccataccggcggcaaaccctacgagtgcaaggaatgcggcaaggctttttcacgggcctcaaatctcgtgcaacacgaacgcatccatactggcgagaaaccgtatgtgtgtaagcagtgtgggaagactttcaggtacgggagtgccctgaaagcccaccagcggatacaccggtcaatcaaggtctag

SEQ ID NO: 21824 - DNA, 1998 bp, Artificial Sequence
  Description of Artificial Sequence: Synthetic coding sequence
atgttccccgtgctggagccccaccaggtgggcctgatccggagctacaatagcaaaactatgacttgctttcaggaactggtgaccttcagagatgtcgccatcgactttagcaggcaagaatgggaatacctggaccccaaccaaagggacctctatcgagacgtgatgctcgaaaactaccgaaacctggtaagtttgggcggtcattctatctctaaaccggtcgtggtggacctgttagaacggggaaaggaaccttggatgattctccgcgaggagacacagtttacagatttagatctgcaatgtgagataattagttacatcgaagtgcccacttatgagactgacattagctctacccaactacagtccatctacaagagggagaaactctatgaatgcaaaaaatgtcaaaaaaagttcagctccggatatcagctgatcttacaccatcgcttccacgtcatcgagagaccctatgagtgtaaagagtgcggtaagaatttcaggtccggctatcagttgacactgcaccaaaggttccacaccggggagaagccgtacgagtgcaccgaatgtggtaagaatttcagatccgggtaccagctgactgtgcatcaacggttccacactggggagaagacatatgagtgcagacagtgcggaaaggccttcatttatgcctcccacattgtgcaacacgaacgtatccatacgggggggaaaccatacgagtgtcaagagtgtgggcgggctttcagccagggcgggcaccttcggatccaccagagagtgcataccggcgagaaaccctacaaatgtaaggagtgcgggaaaaccttttctaggcggtccaatttagtggagcatggccagttccacaccgatgagaaaccttacatctgtgagaagtgcggtaaagccttccgacggggccaccagttaacggtgcatcagagagttcacactggtaagaagccgtacgagtgtaaagaatgtggcaagggctataccactgcctcatattttctcctgcatcagcggatacataaaggcggaaagccctatgaatgtaaggagtgcaagaagactttcaccttgtataggaatttgacacgccaccagaacatccacacaggagagaaactctttgagtgtaaacagtgtgggaaaacctataccaccggatcgaagctgttccaacaccaaaaaactcacacaggggagaagccctacgaatgcaaggagtgcggtaaggctttcagcctctatgggtatctgaagcagcatcagaaaatacacactgggatgaagcactttgaatgcaaagaatgcaagaagacctttacactttacagaaatctgacaagacatcagaacatacacaccggaaagaaactctttgagtgtcaagaatgtgggaaagcctactcaactgggtcaaacttgatccagcacaggaaaacgcacacaggtgaaaagccctacaaatgtaaagaatgcgggaagactttctccctgcacggatacttgaatcagcatcagaaaattcacacgggaatgaaaccatacgagtgtaaggtgtgtaggaagaccttcacgttctaccgaaatctgactttgcatcagagcatccatacagacgaaaagccattcgaatgtaaggagtgcgggaagacgttcaggcgctcgtcccacctcactgcccatcagtcaattcatgctgataagaaaccatacgagtgcaaagagtgtgggaaggcttttaagatgtacggatacctgacacaacaccagaagatacatacgggggggaagccctacgagtgcaaggagtgtggcaaagcattctcccgcgcttccaatcttgtgcagcacgaacggatccatacaggcgagaagccatatgtctgcaagcagtgtggtaagacctttcgctacggatccgctctcaaggctcatcaaagaatacatcgctccataaaagtctag

SEQ ID NO: 21825 - DNA, 1452 bp, Artificial Sequence
  Description of Artificial Sequence: Synthetic coding sequence
atgagcggcggcggccccagcggcggcggccccggcggcagcggccgagccagaacatcctctttcgccgagcccgggggcgggggcggcggagggggcggcgggcctggaggttctgcgtccggtcccggaggcaccggaggcggcaaagccagcgtgggggccatggggggaggcgtgggcgcctcctcctctgggggaggtcctggcggttctgggggcgggggcagtggcggccctggagccggaaccagtttcccaccgcctggcgtaaagctaggaagggacagtggcaaggtgactactgtagttgcgaccctaggccagggccccgagcggagtcaggaggtcgcctatacagacatcaaggtaataggtaacggatctttcggcgtcgtatatcaggcgcgactggcagagactcgggaattggtagctattaaaaaggtgttgcaggataagcgatttaagaaccgtgaacttcaaatcatgcggaaactggaccattgtaatatcgtccggttgaggtactttttttatagctccggggagaagaaggatgaactgtacttgaatttggtgttagaatacgtacctgagactgtctaccgagtggccaggcactttacgaaggctaagttaaccattcccattctgtacgtcaaagtctacatgtatcagttattccgatctctcgcatatattcatagtcagggggtgtgccacagagatattaaacctcagaacctgcttgtcgatcctgacacagcagtgctcaaactgtgcgatttcgggagcgcaaagcagctggtgcggggggaacctaacgtgtcctacatttgctccaggtattatagagctccggaactaatctttggcgcaactgactacacttcctccatcgacgtgtggtctgcgggctgcgtgctggccgagctcctactggggcagcccattttccccggtgatagtggggtggatcagttagttgaaattatcaaggtgctgggaacccccacaagagaacagattagggagatgaatccgaattatacagaattcaaattcccacagattaaggcccatccatggaccaaagtttttaagagccgtacaccaccagaagcgattgctctatgttcttcccttctcgagtacacacctagtagtaggttgtcacccctggaagcgtgtgcccacagcttctttgacgaattacggtgcttagggactcaattgccaaataatcgccctctgcctccactcttcaattttagtgcaggcgagctgtctattcaaccatcgctgaacgcgatcctgattccccctcaccttaggtctcccgcaggcaccacaactctgactccttcctctcaggcccttacagaaacccctacgtctagtgattggcagtctacagatgcaactcccacgctcacaaattccagctag

SEQ ID NO: 21826 - DNA, 2691 bp, Artificial Sequence
  Description of Artificial Sequence: Synthetic coding sequence
atgaccgaggagagcgaggagaccgtgctgtacatcgagcaccggtacgtgtgctcagagtgtaaccagctgtatgggagtcttgaggaggttctgatgcaccagaatagccacgtaccgcagcagcacttcgaactggtgggcgtcgcagatcccggagtaactgttgcaaccgacacggcgtccggaacagggctctaccagaccttagtgcaagaaagccagtatcaatgtctggagtgtggccagttgttgatgtccccatcacagctgctagaacaccaggaactgcaccttaaaatgatggctccacaggaggccgttcctgctgaaccctcacccaaagccccccctctctcttcctcaactattcactatgagtgtgtcgactgtaaagccctgtttgcctctcaagagctgtggttaaaccacagacaaacgcacttgagagctactcccacaaaggcacccgctccggtagtccttggatctcccgtcgtgctgggaccacctgtgggccaagccagagttgccgtggagcactcctatcggaaggctgaagagggaggggaaggtgccactgttccatccgctgcggccacaaccacggaagtagtgaccgaggtggagcttctgctgtataagtgctcagagtgttctcaactgtttcaattgcctgcagacttccttgagcaccaggcaacgcattttcctgcaccggttccggagagccaggaacctgcactacagcaggaggtccaggctagtagccctgccgaggtgcccgtgagtcagcctgatcctctgcccgcatccgaccattcatatgaattgagaaacggcgaggccatcggaagggataggagaggacgacgggctcgacgtaacaattcaggagaggcggggggcgctgccacccaggaattgttctgtagtgcatgcgatcagttgtttctgtccccccaccagttacagcagcacctgcggtcgcatagggaaggggtgttcaagtgtccattgtgtagccgtgtgtttcccagtccctcatcgcttgatcagcatttgggtgatcactcttctgaaagccacttcctctgcgtggattgtggactggcatttggtacggaggctctgctccttgcacatagaagggcacacacacccaaccctctccattcttgcccatgcggcaagacattcgtgaatctcaccaaatttttgtaccaccgacgcacccatggagtgggaggagtgccgctgccaacaacaccagtcccacctgaggaaccagtgatcggcttccctgaaccagctccagctgagacaggggagccagaagcacctgaaccaccagtaagtgaggaaacctccgcgggccccgctgctcctggcacataccggtgtctgctgtgttcccgcgaatttgggaaagcattacagctcacccggcaccagcgctttgtccaccgattagagaggcgtcataagtgcagcatctgcggaaagatgtttaaaaaaaagtcccacgtgcggaatcaccttagaactcacacaggggagaggccattcccgtgtcctgactgtagtaagcccttcaactcaccagctaacttagcacgacacagactgactcatacgggcgagcgcccatatcggtgcggagattgcggaaaggcctttacgcaatcttccacgctgaggcagcatcgcttggtccatgcacagcattttccctatcgttgtcaggagtgtggcgtcagattccaccgaccgtatcgactgctcatgcatcggtaccaccacacaggagagtacccctacaaatgcagagaatgtcccaggtctttcctcttgcggcggttactggaggtccaccagctagtcgtgcatgccggccgtcagccacacaggtgtccatcatgtggggccgcattcccctctagccttcggttacgggagcacaggtgtgctgctgcagcagcccaggccccaagaagattcgagtgcggaacatgtgggaagaaggtagggtcagccgcacggttgcaggcccacgaggccgctcacgctgcggcgggaccaggggaggtgctggccaaagaaccacctgctcctagggctccacgggccactagagctcctgtggcatcccccgctgcgctgggctctaccgcgacagcctcacctgccgcccccgcgagacggcgaggtctcgaatgttcggagtgtaaaaagctcttctctactgagacgtctctgcaggtccaccggcggatacacaccggggagcggccatatccttgcccagactgcggcaaggcgtttcgccagtcaacccacttgaaggatcacaggcggctacatactggcgagcgccccttcgcatgtgaggtttgcggcaaagctttcgctatctccatgagattggcagagcacagacggatccatacgggggaaaggccttactcctgtcctgactgtggcaagtcatataggagcttcagtaacctttggaagcaccgtaaaactcaccaacaacagcaccaggctgcagttaggcaacaacttgcggaagctgaagccgctgtgggcctggcagttatggaaactgcagtcgaagccctgccacttgtggaggccattgagatctatcctttagccgaagccgaaggcgtacagatatcgggatag

SEQ ID NO: 21827 - DNA, 1635 bp, Artificial Sequence
  Description of Artificial Sequence: Synthetic coding sequence
atgagcatgtgggaggacctgtgccagccctaccaggtgcccctgtcacccgcctacagctggggcaggggatgtccccttcctactacacccgtcccacccgaagaacccgtgattggctttcctgagccggcaccggccgaaacaggggaacccgaagctcccgaaccacctgtgtcagaggagaccagcgcgggccccgccgcccctggtacataccggtgcctgttgtgctctcgcgagtttggaaaggccttacaactgacaagacaccagaggttcgtccacaggttggaaagacgacataaatgttccatctgcggtaagatgtttaagaaaaagagccacgtacgtaatcacctgaggactcatactggggagcgaccatttccttgccctgactgctcaaagccgttcaactctcccgccaacctggccagacatcgcctcacacacacaggggaaagaccttatcgctgcggggactgtggaaaggcttttacccagagctctactctgaggcagcaccgtttggtccacgcgcagcatttcccatacagatgtcaggaatgcggggttcgttttcaccgcccctacagacttctcatgcacaggtaccaccacaccggcgagtacccctacaagtgccgggaatgccctcgatcctttttgctgagaaggctccttgaggtgcatcagcttgtcgtacacgccggtaggcagcctcaccgatgccctagctgtggtgctgctttcccatcctccttaagattaagagagcataggtgtgccgccgccgcagcacaggctccccggagattcgagtgcggcacttgcggaaaaaaggttgggtctgctgcccgccttcaggcacacgaagctgcccatgcggccgccggacccggggaggtcctcgcgaaggagccccccgcacctagagccccaagggccacgagggccccggtggcctctcccgctgccctgggatcgaccgccaccgccagccctgcagcgcccgccagacggcggggattggaatgttccgaatgtaaaaaacttttctcgaccgagacatccttgcaggtccatcggcgcattcataccggcgagcggccatacccatgtcctgattgcggaaaagcctttagacagagtacccatctgaaagatacaggcgcctgcacccaagtctccggtccgctgcccgtgaagtgcgtcgcaaggcctctgccatctccctgtgcctggcagaatatcgctgctagcacccaagcgaatgacccgaccccagcgctgactgtggcaagagcaacggcccctagccccacttctggttctactgcgaggcctatcagttccagcattaggcagctatgtggcagcagttggcaaaggagaaggctacccctcgcgtggccatcttggcgcttgctctggaggaggtacccctggtggaagcccctccgttcgactctgtggccaaggctccgcgggtcccgttcggtcgcagacagcgcccgacttccgctgtggcacctgcactctcttctgcttaaggccctgcaacacccactgaagcatctctatatcctgtgtccattcctcttcccgtcaccccctccatgtaaattttag

SEQ ID NO: 21828 - DNA, 2691 bp, Artificial Sequence
  Description of Artificial Sequence: Synthetic coding sequence
atgaccgaggagagcgaggagaccgtgctgtacatcgagcaccggtacgtgtgctccgaatgcaatcagttgtacggatcactcgaggaggtgctcatgcatcagaatagccatgtgcctcaacagcattttgaattggtgggcgtggcagaccccggcgtaaccgtcgcaactgatacagctagtggaaccggcctctaccagacactcgttcaggaatcgcagtaccagtgcttggagtgcgggcagcttttaatgtccccctcccaacttctcgaacatcaggagcttcaccttaaaatgatggctcctcaggaagccgtccctgcagagcctagccctaaagcccctccattgagctcctccacaatccattacgaatgtgttgattgtaaggcattgttcgcatctcaggaactatggctcaatcatcgtcagactcacctgcgcgccaccccaactaaggcgcctgcacctgtcgtactgggcagccccgtggtgctgggaccccctgtgggtcaggcccgggttgcggtcgaacactcttacagaaaagcagaggaaggcggggagggggctactgtacccagcgccgctgcgacgaccactgaggtcgtcacagaagtagaactccttctatacaagtgcagcgaatgcagccagttgtttcagttgcctgctgatttcttggagcaccaggccacccactttcccgcacctgtgcccgagtcccaagaacctgcgctgcagcaggaagttcaagcctcgtcacccgcggaggtccccgtgagccagcctgacccgctgcctgcctcggaccatagctacgaactccgcaatggagaagccattggtagggaccggcgtggtcggcgagccagacggaacaattctggagaggcgggaggcgcagcgacacaggaactattctgcagtgcctgcgaccagttgttcctgtcaccacaccagctgcagcagcacctgcgctctcatcgagagggggtgttcaagtgtcctttgtgctcccgcgtgttcccctcaccttcgagcctggatcaacaccttggcgaccactctagtgagagtcacttcctttgcgtggattgcggtttggctttcggaactgaagctttgctcctcgcccaccgacgggctcatacgccaaaccccttgcacagctgcccctgtgggaagacatttgtgaatctgacaaaatttctgtaccaccgcaggacacacggggttggtggggtacccctcccgacaacacccgttccgcctgaggagcctgtgataggattccccgagcctgcccctgctgaaacaggcgagcctgaagcacccgaaccaccagtcagtgaggaaacgagtgctggccccgccgccccaggaacatatagatgcctgctatgctcgcgggagtttggaaaggccctgcaactgacaaggcatcagagattcgtccacagactggaaagaaggcacaaatgttcgatatgtggtaagatgttcaaaaaaaaatcccatgttcggaaccaccttcgaacacacactggggagcgaccctttccttgccccgattgcagcaagccattcaactctcctgcaaacttagctcgtcataggctgacccatactggcgaaagaccttatcgctgcggggattgcggaaaggctttcactcagtccagcacccttcgccagcacagactcgttcatgcgcagcactttccataccgatgtcaggaatgcggcgtccggtttcataggccttatagattgctgatgcaccgctaccaccacactggcgagtatccatacaagtgtcgcgagtgtcccaggtcctttctgctgcggcgactactcgaggtgcatcagcttgtggtccacgctggtcgtcagccccaccgctgcccatcctgcggagccgcttttccaagttcccttagacttcgggagcacagatgtgctgctgccgcagctcaggcccctcgcaggttcgaatgtgggacctgcgggaagaaggtgggctccgcagcccgcctgcaggctcacgaagctgcccatgccgcagcgggtccgggcgaggttctggctaaggaacccccagcccccagggccccgcgggcaacacgcgcgcccgtagcttccccagctgcactgggctcaaccgccactgcgtccccagctgcgcctgcaagacgacgagggctcgagtgttctgagtgcaaaaagttgttctcgacagaaactagtctccaggtgcatcggcgtatacacacaggcgagcggccgtatccctgcccagattgtggcaaggcctttaggcagtctactcatttgaaggaccatcgaagactgcatactggggagcgcccgtttgcctgcgaagtgtgcggaaaagcattcgcaatctcaatgcggctggcagaacatcgaaggatccatacaggtgaaaggccttattcctgccctgactgtgggaaatcctacagaagcttttctaatctatggaagcatagaaaaacacaccaacagcagcaccaggctgccgtgcgccagcagctggccgaggctgaagctgctgtcggcctggctgttatggagaccgccgttgaagcgctgccgcttgtcgaagccatcgaaatataccctctggccgaggctgaaggcgttcagattagtggctag

SEQ ID NO: 21829 - DNA, 738 bp, Artificial Sequence
  Description of Artificial Sequence: Synthetic coding sequence
atgctggagcggggcgccgagagcgccgccggcgccaccgacccctctcccaccggcaaagagccagtgacaaaagaagccccacaccaggggcctccccaaaagccttcccagtctgctcccggccccactgccagcgcagggagccctcctcgcccaaggcgacgccccccgcctcagagaccccatcgctgtcccgactgcgataaagcctttagctaccctagcaagctcgctacccacaggttggcccacggaggggctaggccccacccctgtccagattgccctaaggccttctcttaccccagtaaattggctgctcatcgcctaacccatagcggcgcgaggccacatccctgtccacactgccccaagtccttcggtcatcgaagtaaacttgccgcccacctgtggacccacgcccccacaaggccgtacccgtgccctgattgcccgaagtccttctgttaccccagcaaactggccgctcaccgacatactcaccacgcaaccgatgcccgcccatacccctgcccccactgcccaaaagctttcagctttccttccaagttggctgcccacaggttatgtcacgatccaccgaccgcacccgggtcccaagcaacagcatggcaccgttgtagctcctgtggacaagcattcggacagagacgactcttgctgctgcaccaaagatcacaccaccaggtggagcataagggagaacgcgattag

SEQ ID NO: 21830 - DNA, 1035 bp, Artificial Sequence
  Description of Artificial Sequence: Synthetic coding sequence
atgagcctggtgcccggcctgaccagcatcgagcagccccagccccagttattggaccagctgggcattcccaggagatgctttcaagactgggtcgatcaaaatgggttgcccggccttagcgttacacagcaaattagggggattacgctgctccgccgcctcgagtgctccaatacaatcattgcccattgcagacatgagcttctcggaccacctaccctgtccccttccgcctggtcctcaccagcctcaccccctcccagagcccttcctctgggtagttgtgctagcaagatgcttgagcgcggcgctgaatccgcagccggtgctaccgatccgagtccaacaggcaaagaacccgtgaccaaggaggcaccgcaccaaggtccccctcagaaaccctcacagagtgcccctggcccaactgcatccgcagggtctccccctcggccccgacgacggccccccccccaacgcccacacaggtgccctgattgtgataaagccttttcttatccaagtaagctcgcaactcacaggctcgcgcatggtggcgcgaggccccacccatgtccagactgtcctaaggcctttagttatccctcaaaactggccgctcaccggctcactcactctggagcccgacctcatccttgcccgcattgcccaaagtcttttgggcaccgcagcaaactagcggctcatctttggacacacgcaccaacccgtccttatccctgcccagattgtcccaaaagcttctgctaccccagcaaactggctgctcacaggcacactcaccacgctaccgacgcgaggccctacccatgcccccactgcccgaaagccttctcatttcctagtaagcttgccgctcacagattgtgccacgacccacccacagccccaggatcgcaggctacagcatggcataggtgctcatcctgtggtcaggctttcgggcaacgcagacttttacttcttcatcagcgcagtcaccaccaggtcgaacacaagggtgagcgcgattag

SEQ ID NO: 21831 - DNA, 513 bp, Artificial Sequence
  Description of Artificial Sequence: Synthetic coding sequence
atggaggaccccaaccccgaggagaacatgaagcagcaggacagccctaaggaaaggtccccgcaatccccagggggaaatatctgccatttgggcgctcccaaatgcacccgctgcctaataacattcgccgattcgaagttccaggaacggcacatgaagagagagcaccctgccgactttgttgcccagaagttacaaggagtactctttatctgcttcacgtgcgccagatcattccctagttcaaaagcacttattactcatcagcggtcacacggaccagctgcaaagccaacactgccagtggccacaacaaccgcccagccaacatttccttgccctgattgtgggaagactttcgggcaggccgtgtcgctgagacggcatcggcaaatgcacgaagtaagggccccacctggcacatttgcatgcactgaatgcggccaagatttcgctcaagaagccggccttcatcaacactacatcagacacgcccgtggtgaactgtag

SEQ ID NO: 21832 - DNA, 513 bp, Artificial Sequence
  Description of Artificial Sequence: Synthetic coding sequence
atggaggaccccaaccccgaggagaacatgaagcagcaggacagccccaaagaaagatctcctcagagccctggaggcaacatttgccatctgggtgctcctaagtgtacccggtgtctgatcacatttgcagactccaaattccaggaaagacacatgaagcgggagcaccctgctgattttgtggcccaaaagctgcaaggagttttattcatctgctttacatgtgctaggtccttcccttcctcaaaggcactcatcacccaccagaggtctcatggccccgctgccaaacctactttacccgtggccaccaccactgcccagccgaccttcccttgtcccgactgcggcaagacgtttggacaagcagtttcccttcgcaggcatcgacagatgcatgaggtccgggcgccgccgggtacttttgcctgcacggagtgcggtcaggatttcgcccaggaggctggtctgcaccaacattatatccgccacgctcgcggtgaactgtag

SEQ ID NO: 21833 - DNA, 513 bp, Artificial Sequence
  Description of Artificial Sequence: Synthetic coding sequence
atggaggaccccaaccccgaggagaacatgaagcagcaggacagccccaaggagaggtccccccaaagccctgggggcaatatatgtcatctcggagctcctaaatgcactagatgtcttataacgtttgcagacagtaagttccaggaacgccatatgaagagagagcacccggcagacttcgtggctcagaagttgcagggggtgctctttatctgcttcacatgcgctagatcattccccagctcaaaggccctcattacacatcagcgcagtcacggtcctgcagccaagccgactctccctgtggccaccacaaccgcccaaccaacctttccttgccccgattgtgggaagacttttggccaggccgtcagccttaggcggcaccgtcagatgcacgaagtgcgagcaccccccggaacctttgcctgtactgaatgcggccaagatttcgctcaggaagcggggctgcaccagcactacatccgccacgccaggggtgagctgtag

SEQ ID NO: 21834 - DNA, 513 bp, Artificial Sequence
  Description of Artificial Sequence: Synthetic coding sequence
atggaggaccccaaccccgaggagaacatgaagcagcaggacagccccaaggagagaagcccacagtctccaggaggaaacatctgccacctgggagcaccgaagtgtacaaggtgcttaatcacttttgctgacagcaagttccaggaaagacacatgaagagagaacacccggccgattttgtcgcacagaagctgcaaggtgtcctgtttatttgttttacttgcgcccgcagttttccctctagcaaagccctaattacccatcagagaagccatgggccagccgccaagccaacactgcccgtcgccaccaccaccgcgcaaccaacgtttccatgtccggactgcggaaagacattcggccaggcggtttctctaaggcgacataggcagatgcatgaggtgagggcgcctcccgggaccttcgcctgcaccgagtgtggacaggatttcgctcaggaggccggactgcaccaacactatatcagacacgctcggggcgaactctag

SEQ ID NO: 21835 - DNA, 513 bp, Artificial Sequence
  Description of Artificial Sequence: Synthetic coding sequence
atggaggaccccaaccccgaggagaacatgaagcagcaggacagcccgaaagaacggtcgcctcagtcaccaggcggtaatatatgccacttgggggccccaaagtgcactcggtgcctgatcacatttgctgacagcaagtttcaagaacgacacatgaaacgcgaacatcctgccgactttgtggcccagaaacttcagggcgtcctcttcatatgcttcacctgtgccaggtcctttcccagcagtaaggctttgattacccaccaacgcagccatggacccgccgcaaagccaacattgcccgtggcaaccaccacagcccagccaacctttccttgtcctgactgcgggaagacatttggtcaggccgtgtctcttagaagacatcgacaaatgcacgaagtacgcgctcctcccgggaccttcgcgtgcaccgagtgtgggcaggattttgcccaggaggctggcctgcatcagcactatatacgacatgctcgtggcgagctgtag

SEQ ID NO: 21836 - DNA, 513 bp, Artificial Sequence
  Description of Artificial Sequence: Synthetic coding sequence
atggaggaccccaaccccgaggagaacatgaagcagcaggacagcccaaaggagaggtcgccccaaagcccgggcgggaatatttgccatttaggggccccaaagtgcactcgctgcctaataactttcgcagactctaaatttcaggaacgacacatgaagcgggaacaccctgcggacttcgtagcacagaagctccaaggggtgcttttcatctgcttcacctgtgccaggtcctttccatcatcaaaggctctcatcacccaccagcgttctcatggccctgcagcgaaaccaacactccctgtggctactactactgcccagcccactttcccatgtcctgactgtggaaaaacgtttgggcaggccgtatctctgaggagacaccgtcaaatgcatgaggtccgcgcccccccaggcaccttcgcctgtactgagtgcgggcaagattttgcgcaggaggcaggtctgcaccagcattatatccggcatgcgaggggagaactctag

SEQ ID NO: 21837 - DNA, 1458 bp, Artificial Sequence
  Description of Artificial Sequence: Synthetic coding sequence
atgaagaacgccaccatcgtgatgagcgtgcggcgggagcagggctcaagctccggtgagggaagtctgagttttgaagacgttgcggtgggatttacccgcgaggagtggcagttcctcgaccagtcccagaaagtgctgtataaagaagtaatgcttgagaactatatcaacctggtgtctattgggtaccgcggcacgaaaccagacagccttttcaaattggagcagggcgaaccccccgggatcgcagagggcgctgcccattcccagatctgtccaggcttcgtgatccagtcccgccggtacgccgggaaagacagtgacgcatttggcggctacgggcgcagttgtctgcatattaaaagggataagaccctgaccggggttaaatatcaccgctgtgttaagcccagtagccctaagtcccagctcaatgacttacaaaaaatatgcgcgggaggcaagccccatgagtgtagcgtgtgcggcagagccttcagccgaaaggcgcagttgatacagcaccagagaactgaacgcggggaaaaaccgcacgggtgtggcgaatgcggcaagactttcatgagaaagatacagctgacagaacatcagaggacccataccggggaaaaaccgcacgagtgttccgagtgcgggaaagctttcagcagaaaatctcagttaatggtgcatcaacggacacacaccggtgaaaaaccctatcgatgctctaaatgcggtaaagcgtttagtaggaaatgtcggctcaatcgacatcagcggtctcacactggcgaaaagttgtacggttgttccgtctgtggcaaggctttcagccagaaagcctaccttacagcccatcaacgacttcataccggggataaaccatacaagtgttctgactgcggtaggacgttttactttaagagcgatctgaccagacatcagcgaatccatacgggggaaaagccctacgagtgctctgaatgtgaaaaagccttccggagcaagagcaaactgattcagcaccaacggactcatacgggagagaggccttattcttgcagggaatgcgggaaggcctttgcccatatgagtgtgctcatcaaacatgagaagacccacatccgagagacagcaatcaattcgctcaccgtggaaaagccttcctcaaggagtcacacctccctgtatatgagtgagctgatccaggaacagaagacagtaaatacagtgcctatcgagatgcccagctcggggactccccctctacttaacaagagtgagcgcctagtgggcaggaacgtcgtgatagtagaacaaccatttcccaggaatcaggcctttgtggtgaatcaggaatttgaacagcgcattagccttaccaacgaagtgaacgttgctccttccgtcatcaactacatcctgtacttgaccgacatagtttctgaatag

SEQ ID NO: 21838 - DNA, 135 bp, Artificial Sequence
  Description of Artificial Sequence: Synthetic coding sequence
atgaagaacgccaccatcgtgatgagcgtgcggcgggagcagggctcgagctctggcgagggaagcctttcattcgaagatgtggcagtgggctttacaagggaggagtggcagtttctggaccaatctcagtag

SEQ ID NO: 21839 - DNA, 177 bp, Artificial Sequence
  Description of Artificial Sequence: Synthetic coding sequence
atgaagaacgccaccatcgtgatgagcgtgcggcgggagcagggcagcagttcaggcgaagggagcctctccttcgaagatgtggcggtggggtttacacgggaggaatggcagtttcttgaccagtcccaaaaggtgttgtataaggaggtgatgctggagaactatataaattag

SEQ ID NO: 21840 - DNA, 189 bp, Artificial Sequence
  Description of Artificial Sequence: Synthetic coding sequence
atgaagaacgccaccatcgtgatgagcgtgcggcgggagcagggctcatcctccggcgaaggctctctatctttcgaggatgtggccgtcggtttcactagggaagagtggcagttcttggatcagtcccagaaagtcctctacaaagaggtcatgctcgaaaattatatcaacctggtgagcatttag

SEQ ID NO: 21841 - DNA, 1443 bp, Artificial Sequence
  Description of Artificial Sequence: Synthetic coding sequence
atgaagaacgccaccatcgtgatgagcgtgcggcgggagcagggctcgagctccggggaaggcagtttatcatttgaggatgttgctgttggctttacacgcgaggaatggcagtttctggaccagagccagaaagttctctataaagaagtgatgcttgaaaactacatcaaccttgtctctatagggtatagggggacgaagcccgatagcttattcaagttggagcagggagaacccccgggtatcgctgagggcgctgcccacagtcagatctgccccggattcgtcattcaatcgaggcgatacgccggaaaggactccgacgcatttggcggatatgggaggagctgcctacacattaagcgggacaaaacactcacaggagtgaagtatcaccgatgtgtcaagccatcatcccccaaaagccagttaaacgatctgcagaagatttgtgctggtggcaagcctcatgaatgctcggtgtgcggacgcgcattcagccgcaaagcgcagctgattcagcaccagcggactgaacgtggggagaaaccacacgggtgcggagagtgtgggaagacattcatgaggaagattcagctgaccgagcaccagagaacccacactggcgaaaaaccccatgagtgcagcgaatgcggaaaagcattctcccgcaagagtcagttgatggtgcaccagcgcacacacactggagagaagccgtatcgttgtagcaagtgtgggaaagctttttccaggaagtgccggttgaatcgacatcagcgctctcatacaggcgaaaaactgtacggttgtagtgtgtgcggcaaagccttcagccagaaggcttacctgaccgcacaccagcgactgcacactggcgacaagccctacaagtgtagcgactgtggacgcacattttactttaagagtgacctgacaaggcatcagcggatccacaccggggagaaaccctacgagtgctcagagtgcgagaaggctttccggtctaagagcaagctgatccaacaccagcgaacgcacaccggagaaagaccatactcatgccgggagtgtggcaaagcctttgcccacatgtctgtgttgatcaaacatgagaaaacacacattagagagaccgccatcaacagtcttactgttgagaagccatctagtagatcccacactagtctgtacatgagcgaattaatacaagagcagaaaaccgtaaataccgtacctatcgaaatgcctagtagcggcacccctccactgctgaacaagtccgaaaggcttgtgggccgaaacgttgtgatcgttgagcaaccctttccccggaatcaggcattcgttgtgaaccaagaattcgaacagagaatctccttgaccaatgaggtcaacgtcgccccatcagttattaactacatactctacctcacctag

SEQ ID NO: 21842 - DNA, 1689 bp, Artificial Sequence
  Description of Artificial Sequence: Synthetic coding sequence
atggacccccagccccccccccccgcccagggcagccccccccacagaggacgcggacgagggcgcgggcgcggacgtggcagaggccgcgggcgtggtcgtgggggtgcgggtgcaccccgggctcctctgccctgtccaacttgcggccggctgtttcggttcccttattacctgtccaggcaccggctctcacattctggcctcagaccgcacgcatgcccactctgccctaaggcctttaggaggccggcacacctgtctcgacacctacgcggccatggccctcaaccgccactgaggtgcgcagcctgcccccgcactttcccagagccagcacagctgcgtaggcaccttgcccaggaacacgcggggggtgaggtcgaattagcaatcgaaagggtggctaaagagacagctgaacctagttgggggccccaggatgaaggcagcgaaccaccaacaacagcggcagcgggcgccaccgaggaagaggcagtggccgcttggcccgagacatggcctgctggggaacctagtactctcgccgcccccacttccgcagcggagccccgagaaagcgagagcgaggaagccgaagccggagccgctgaactccgagcagagcttgcactggcagccggacgtcaagaggagaagcaggttctgctgcaggccgattggacgttgctatgtctcaggtgtagagaggcatttgctaccaaaggtgagctgaaggcacacccatgtctgcgtcccgagggcgagcaagagggtgaggggggtcctcctccgcggcccaagaggcatcaatgtagcatctgcttgaaggcctttgctcgaccatggtccctctcccggcaccgattggtacactccaccgacagaccatttgtctgccccgactgtggcctcgcattccgcttggctagctatctgagacaacaccgccgcgtgcacggaccactttcgctgctggcgccgctgcccgctgccggcaaaaaggatgataaggccagtggagctcgcaacagcgctaaaggccccgagggcggggagggcgcagaatgcgggggggcttctgaaggcggtgaggggcagaacggcggtgacgctgcccccgctcgccctcccgcgggcgaacctcggttctggtgccccgagtgtggcaaagggttcagaagaagggcccatctccgccaacacggcgtgacccactcaggagcaaggcccttccaatgcgtgcgctgtcagcgggaattcaagcggctggccgacctagctcgccatgctcaggtgcacgccggtggccccgccccacacccctgtcccaggtgtccccggagattcagtcgggcttactctctcctgcgccatcagcgatgtcatagagctgagctggaacgcgcggccgcattgcaggcactacaggcgcaggcaccgaccagtccccccccccccccccccccactcaaggcagaacaggaggaggaaggcctacccctgcctttagccaacatcaaagaagagcctcccagcccaggcactcctccccagagcccaccggctcctccagtgtttctgtctgcttcctgtttcgatagccaggaccactccgctttcgaaatggaagaagaagaagtggacagcaaagcacacctgaggggtctgggtggactggcttcctag

SEQ ID NO: 21843 - DNA, 519 bp, Artificial Sequence
  Description of Artificial Sequence: Synthetic coding sequence
atgctgctgctgcccccccggcccccccacccccggagcagcagccccgaagccatggatcctcctcctcctaaagcgccaccttttccaaaggctgagggtccaagttcaactcctagtagtgctgccggacctcggccaccacgtctggggcgacatctcctgatcgacgctaacggcgtaccctacacttacaccgtgcagttagaggaagagccacgcgggccccctcagcgtgaggcaccccctggcgagcctggcccacgcaaaggctactcgtgtcctgagtgtgctagagtgttcgcttcaccattgcgcctgcagagtcaccgtgttagccactctgatttaaagccttttacatgtggcgcctgtgggaaggccttcaagcgaagctcgcatctttccagacaccgagccacccatcgcgctagagctgggccccctcacacctgccccctctgcccaaggcgcttccaagacgcggccgaacttgcccagcacgtgagactgcattag

SEQ ID NO: 21844 - DNA, 519 bp, Artificial Sequence
  Description of Artificial Sequence: Synthetic coding sequence
atgctgctgctgcccccccggcccccccacccccggagcagcagccctgaagccatggatccaccccctccaaaggcacctcccttcccaaaggctgaggggccctcttctacgccatcttccgctgccggcccccgccccccgcgtctgggaaggcatttgctgatagatgctaacggggtgccttacacctatacggtgcaactcgaggaggagccacggggaccgccccaaagagaggcaccacccggagaaccagggcccagaaaaggctactcatgcccagagtgcgctcgtgtcttcgcatcccctttgagactgcagtcccacagggttagtcactcagatttaaagcccttcacttgcggtgcttgcggaaaggctttcaagaggagctcccatctcagcagacatagggcaacgcaccgcgctagggccggaccccctcacacatgtccactttgtccccgcaggttccaggacgctgccgaattggctcagcatgtacgtttacattag

SEQ ID NO: 21845 - DNA, 519 bp, Artificial Sequence
  Description of Artificial Sequence: Synthetic coding sequence
atgctgctgctgcccccccggcccccccacccccggagcagcagcccagaagcaatggaccccccccctccaaaggcaccacccttcccaaaggccgagggccctagcagcacaccctccagcgccgcagggcccagaccaccacgacttggacgccatctgctcattgacgcaaacggagtgccttatacctataccgtgcagctggaggaggaaccacgggggccccctcagcgcgaggcgcctcccggtgagcccggtccccgcaaaggctactcctgtccggagtgtgcacgtgtttttgcctctccactcaggcttcagtctcaccgcgtatcacattccgacttaaagcctttcacctgcggcgcgtgcggcaaagcctttaaacggtcatcacatctgagtaggcacagggccacccaccgggcgcgcgcggggcctccccacacatgcccactgtgtccgagacggtttcaagacgctgcagagctggcacaacacgtgaggctccactag

SEQ ID NO: 21846 - DNA, 594 bp, Artificial Sequence
  Description of Artificial Sequence: Synthetic coding sequence
atgctggtgctgcccagcccctgcccccagcccctggccttcagcagcgtggaaacaatggaggggccgcctagaagaacgtgtcgctcgccggaacctggcccttcctctagcatcgggagcccacaggcctcatcaccacctcgaccaaaccactacctgctaattgacacccaaggcgtgccgtacaccgtcctggttgacgaggagtcacagcgcgagcccggggcgagcggcgctccgggtcaaaaaaaatgctacagttgtccggtctgtagccgagtgttcgaatacatgtcctatctacagagacactccataacgcacagtgaggtgaaacctttcgaatgcgacatttgcggtaaggcattcaaacgtgccagccatctggcccggcaccatagcattcacctagctggcggcggtcggcctcacggctgccccctgtgtcctaggcgatttcgtgatgcaggggaactggcgcagcacagcagggtacactccggagagcgtcctttccagtgcccgcattgcccccgacggtttatggagcaaaatacactgcagaaacacaccaggtggaagcatccgtag

SEQ ID NO: 21847 - DNA, 1554 bp, Artificial Sequence
  Description of Artificial Sequence: Synthetic coding sequence
atgagcctgggcagcgagctgttccgggacgtggccatcgtgttctcacaggaagaatggcagtggcttgcccccgcccagagggacctctacagggatgtcatgctcgagacttacagcaacctagtctccctgggactcgctgtctccaaacccgacgtaatttcatttctagaacagggaaaggagccatggatggtggaacgcgtggtaagtggcgggctgtgtccagtgctggaaagccgatatgacacgaaagaactgttcccgaagcagcacgtctacgaagtcgaatcaccccagtgggaaattatggaaagcctgacttcatacggcctggagtgtagctcttttcaggacgactgggagtgtcggaatcaatttgatcgtcagcagggcaatccagaccgccatttccaccagatgatcattaggcatgaagagatgccaacgtttgatcagcacgccagcttgactttctatcaaaagatacacacccgcgaaaagcctttcggctacaacaagtgcaggaaagacttttggcaaaaggaattgttgatcaaccaccagggcatttatacaaacgaaaaaccctacaagtgcaaggagtgcgggaaagccttcaagtatgggtcgagactgatccagcacgaaaacatccacagcggcaaaaagccttatgaatgcaaggagtgcggaaaagcttttaattccggatcgaattttattcagcaccagcgggtgcatactggagaaaagccctacgaatgtaaagattgcgagaaggctttcagtaggagttcccaacttatcgagcaccaaaggacccacaccggagagaagccttaccaatgtaaggagtgcgggaaggctttcaaccgcatcagtcacctaaaagtccactacagaattcatacgggagagaaaccttatgcttgcaaagagtgcggcaaaactttttctcatcgtagtcagctgattcaacatcaaacagtacacacggggagaaagttgtacgagtgtaaagaatgcggcaaagccttcaaccagggttctaccctgatccgacatcagagaatccacaccggagaaaagccttatgaatgtaaggtatgcggcaaggcgtttagggtaagctcccagctcaaacagcaccagcggatacacacaggcgagaagccttaccagtgcaaagtttgcggaagggcctttaagcgcgttagtcatctgacagtgcactacagaattcacacaggggagaaaccttatgagtgcaaagagtgtggcaaggcgttttcgcactgttcccagctgattcaccatcaggtgatccacactgaaaagaaaccatacgagtacaaagagtgcgaaaaaaccctgtcccatgacagcacaaccgtacagccgcagcggatgcataatcgcgaaactcacgttaatattattaatgtggagaagcctagcatatcgtcttatcccctgctgattattagagagttcatgctggcttccaaccacatgaatggaagcaatggcgagtccccactcgcctag

SEQ ID NO: 21848 - DNA, 1710 bp, Artificial Sequence
  Description of Artificial Sequence: Synthetic coding sequence
atgagcaaggacctggtgaccttcggcgacgtggccgtgaacttctcccaggaggaatgggagtggctcaaccccgcgcaaagaaacctatacagaaaagtgatgctggaaaattatcggtctctggtgtccctgggggtatctgtttcgaagccggacgtcataagcctactggaacaggggaaagagccatggatggtgaaaaaagaaggaacccgagggccttgcccagattgggaatatgtgttcaagaacagtgagttctcatccaagcaagagacctacgaggaaagcagcaaggtggtaactgtgggcgccaggcaccttagttactctctggattatccttcgctacgcgaggattgtcagtccgaggattggtacaaaaaccaattaggatcacaggaggtccatctctcccagttaataattactcacaaagagatcctgccagaggtgcaaaacaaagagtataacaaatcttggcagacttttcatcaggacaccatctttgatattcagcaaagcttccccaccaaagaaaaggcccacaagcacgagccacagaaaaaatcctaccggaagaaaagtgtggagatgaagcatcggaaggtgtacgtagaaaaaaagctgctcaaatgcaacgattgtgagaaagtattcaaccagagctcaagtcttaccctccaccaacgcattcacaccggagaaaaaccgtacgcctgtgtggagtgtggcaaaaccttctcacagtccgcgaacctggctcagcataagcgcattcataccggagagaaaccatacgagtgtaaggaatgccgaaaagccttttctcagaatgcccatctcgctcagcatcaaagagttcacacaggcgaaaagccctatcagtgtaaagagtgcaaaaaggcattttctcagatcgcccacttgacgcagcatcagcgcgtgcacactggcgagagacctttcgagtgtatcgagtgtgggaaagccttttctaacgggagcttcctcgctcaacatcagagaatacatacaggggagaagccatacgtttgtaacgtctgtggcaaagccttctcacacaggggctatctcattgtccaccaacgaatccacacaggcgaacgcccttacgagtgtaaggaatgtcggaaggccttttctcagtatgcccacttagcccagcaccagagggtgcacaccggcgaaaagccatacgagtgtaaagtctgtcggaaggccttttcccagattgcctacttagatcagcaccagcgggtgcacaccggggaaaagccttatgagtgtatcgagtgtggcaaggccttctcaaactcatctagcctcgctcagcaccaacgcagccatacaggggagaagccttacatgtgcaaagagtgcaggaaaactttttcacagaatgctggtctggctcagcaccagcgaatccacaccggagaaaaaccctatgagtgcaatgtgtgcggtaaggccttctcttactctggctctcttaccttacatcagaggatccacaccggcgagcgcccttacgagtgcaaagattgtaggaagagctttcgacaacgagcccacctggcgcatcatgaaaggattcataccatggaatcctttctgaccctatcctcccccagcccaagcacgagcaaccagctcccaagacctgtgggcttcatctcatag

SEQ ID NO: 21849 - DNA, 1710 bp, Artificial Sequence
  Description of Artificial Sequence: Synthetic coding sequence
atgagcaaggacctggtgaccttcggcgacgtggccgtgaacttcagccaagaagagtgggaatggctcaatccagcccaacgtaatctctacagaaaagtcatgctggaaaactataggtcactggtcagtttgggggtgtccgtctcaaaaccggatgtgatctctctgcttgagcaggggaaagagccatggatggtcaaaaaggaggggacccgggggccctgtccagattgggagtacgtcttcaagaacagtgagttctcctctaagcaggaaacatacgaggaatccagtaaggtagttacagttggagccagacacctctcctattccttggattatccctcactacgggaggattgtcagtccgaagattggtacaaaaaccagctgggctcccaggaggtgcacctttctcagttaatcatcacccacaaggagatcctccctgaggtgcaaaataaagagtacaataaatcttggcagacatttcaccaggacactatcttcgacatacagcagagtttccccactaaagagaaagcccacaagcacgagcctcaaaaaaagtcgtatagaaagaagagtgttgagatgaagcacagaaaagtgtatgttgagaagaaactccttaagtgtaacgactgtgaaaaggttttcaaccaatcatcttcactcaccctgcatcagaggattcacacaggcgaaaagccttatgcatgtgtggaatgcgggaagaccttcagtcaatcagccaatcttgcacaacataaacggatacatacaggagagaagccctatgaatgcaaggaatgtagaaaggccttttcccaaaacgcccacctggcccaacatcagagagttcacacgggagaaaagccctaccagtgcaaggagtgcaagaaagctttttcacagattgcacatctgacacaacaccagcgagttcatacaggggaacgtccatttgagtgcatcgagtgtggcaaggctttcagcaatgggtctttcctagctcaacaccagagaatccatacaggcgagaaaccgtacgtgtgtaatgtgtgtggaaaagccttcagtcaccggggatatctaattgtgcaccagagaatccataccggggagcgcccctacgaatgcaaggagtgtcggaaggctttcagccaatacgcccatctcgcacagcaccaaagggtacatactggtgagaaaccatatgagtgcaaggtgtgtaggaaggccttctcccagatcgcctacttagaccaacatcagcgcgtgcacaccggggagaaaccctatgagtgcatcgagtgcggcaaggcttttagtaatagtagcagcctagcacagcatcagagatctcatacgggtgaaaaaccttacatgtgtaaggaatgccgcaaaacattctcacaaaacgcgggtctcgcccaacaccagagaatccacacgggagagaaaccctacgaatgcaacgtgtgcggtaaggccttttcatatagtggttctctgacgttgcatcagagaatacataccggagaacgcccttacgaatgcaaagattgccggaaatccttcagacagcgagcgcatcttgcgcaccatgaacgcattcatacgatggagagtttcctcactttgagttctccctcaccttcaacctctaaccaactccctaggcccgtcggtttcatctcctag

SEQ ID NO: 21850 - DNA, 414 bp, Artificial Sequence
  Description of Artificial Sequence: Synthetic coding sequence
atgagcaaggacctggtgaccttcggcgacgtggccgtgaacttcagccaagaggaatgggagtggctgaatcccgctcagaggaatctctacagaaaggtcatgctggagaactatagatctctcgtgagtttaggagtttccgtgtctaaacctgatgttatctcactgcttgaacaggggaaagaaccttggatggtaaaaaaggaagggacccgcggaccctgtcctgattgggagtacgtgttcaaaaatagcgaattttcgtcaaaacaggaaacatacgaagaatcttccaaggtagtgactgtgggcgccaggcatttgtcatatagcttggactacccatctctccgggaggattgccaaagcgaggactggtacaagaaccagctcggctcacaagaagtatag

SEQ ID NO: 21851 - DNA, 390 bp, Artificial Sequence
  Description of Artificial Sequence: Synthetic coding sequence
atgagcaaggacctggtgaccttcggcgacgtggccgtgaacttctcccaagaggaatgggagtggcttaatccagcacagaggaacctttacaggaaggtgatgctagagaactaccgtagcctggtctccctgggcgtgtcagtgagcaagcccgatgtgatttccctgcttgagcaaggaaaagaaccatggatggtgaagaaagagggaactagagggccctgccctgattgggaatatgtctttaaaaattccgaattcagcagtaaacaggagacctatgaggaaagcagcaaggtggtaaccgtcggggctagacatctatcctatagcctcgattaccccagcctacgggaggattgccagtctgaagactggtacaaatag

SEQ ID NO: 21852 - DNA, 1266 bp, Artificial Sequence
  Description of Artificial Sequence: Synthetic coding sequence
atggccggcgaggccgaggcccagctggaccccagcctgcagggcctcgtgatgtttgaggatgtcactgtttattttagtcgagaggaatgggggctgcttaatgtcacccaaaaggggttgtatcgcgacgtaatgttggagaatttcgccctggtctcaagtctgggcctcgctccttcgcgatctcccgttttcactcagcttgaggatgatgagcagtcatgggtcccgagctgggtcgatgtgacccctgtgtcccgtgctgaggcccgaagaggcttcggactggatggactttgccgagtggaggatgagcgagcccatcccgagcatttaaaatcctaccgtgtgattcagcatcaggacactcactccgaagggaagcctcggagacacacggagcacggtgccgctttcccccccgggagctcgtgcgggcagcagcaggaagtccacgtggcagagaaactgttcaagtgtagcgactgtggcaaggtttttcttaaagcctttgctctcctggatcacctcatcacccactcagaggagcgaccatttcgttgcccaacaggtcgctcagcctttaagaagtctgcccacattaacccccgcaagattcacactggagaaacagcccacgtatgcaacgagtgcggcaaggctttctcttacccttcaaagcttcgaaaacatcagaaggtgcacacaggcataaagcccttcaagtgctctgattgtggaaaaacttttaaccggaaagacgcattagtactgcatcagcggattcataccggagagcgcccatatgagtgctcgaagtgtgggaagaccttctctgtgctctcgacccttattagacacaggaaggttcacatcggagaaagaccctacgaatgcaccgagtgcggaaaattttttaagtacaataactctttcatcctgcaccaaagggtccatacaggggaacgaccttttgagtgtaaacagtgcggcaaaggctatgtcaccagaagtggtctctaccaacactggaaggtgcacacaggggagcgaccctacgagtgctctctgtgcggaaaaaccttcacgacacgatcctataggaacaggcatcagcagtttcacacagaggagagaagctacgagtgcaccgagtgcggaaaggccttcaaacacagttccactctccttcagcacaagaaagtccataccccagagcgccggcaggaagatagggcccatggaaaggtggttagctgttag

SEQ ID NO: 21853 - DNA, 438 bp, Artificial Sequence
  Description of Artificial Sequence: Synthetic coding sequence
atggccggcgaggccgagggcctggtgatgttcgaggacgtgaccgtatacttttcacgggaggaatgggggctactaaacgtgacacagaagggattgtacagggacgtgatgctggaaaactttgccttggtgagttccttaggactcgccccaagccgctcccctgtcttcacacagcttgaggacgacgagcagtcatgggtgccttcttgggtggatgttactccggtgtcacgcgcagaagccagaagaggttttggccttggaccagcttgctcgtgtctgtccggcctgaggctgttgatcgcactgttatgtatctgtgccgaattgagcaccgtgggtgacagcgtgcgcgtgctgaagtgtgcacacatccttaagcaaatggtgtgcgtggagtggagaatgagagaacctattcttagcatctag

SEQ ID NO: 21854 - DNA, 924 bp, Artificial Sequence
  Description of Artificial Sequence: Synthetic coding sequence
cccggcagcagctgcggccagcagcaggaggtgcacgtggccgagaagctttttaaatgtagcgattgtggaaaagtgttccttaaggcctttgcactgctggatcacttaattacccactccgaagagagaccgttcaggtgtcccaccggcaggtctgccttcaaaaagtctgcacacattaatcctcgcaaaattcacactggggagacagcacatgtatgtaatgagtgtggtaaagccttcagttatccgtccaaactgcgcaagcaccagaaggttcataccggtatcaagccgttcaagtgctccgactgtggcaaaacgttcaataggaaagatgctcttgttcttcatcagagaattcacaccggtgaacgtccgtatgaatgttctaaatgtgggaagactttctccgtcctttccactctcattcgccataggaaagtccatatcggggagcgcccctatgagtgtaccgagtgcggaaagttctttaaatacaacaatagctttatcctacatcaaagagtgcacacaggtgagcgccctttcgagtgtaagcagtgtggaaagggatacgtcactagaagcgggctgtaccagcattggaaggtgcacaccggcgaacgtccgtacgaatgttctctttgcgggaaaacttttacaaccagaagctacagaaaccgccatcaacagttccacaccgaggaaaggagctatgaatgcactgagtgcgggaaagcttttaagcatagcagtaccctgctgcagcacaagaaggtccacactcctgagcggccatttatttgctttaattgtggcaagaacttcaatatgtcatcttgtctggcttggcaccagaagctgcaccctggcgaaaaaccttttgactattctaagtgccgtaaggttttcacatag

SEQ ID NO: 21855 - DNA, 2145 bp, Artificial Sequence
  Description of Artificial Sequence: Synthetic coding sequence
atgctggagacctacagccacctgctgagcgtgggctaccaggtgcctgaggcagaagttgtgatgcttgaacagggcaaagaaccatgggccctccagggtgagaggccacgacagtcttgtcccggagaaaagctatgggaccataaccagtgtagaaaaatactgtcctataagcaggtgtcctcccagccgcaaaagatgtatccaggggaaaaagcatatgagtgcgccaagttcgaaaagatatttacgcagaagtcacaactgaaggtgcatctcaaggtgctggccggagaaaagctgtacgtctgtattgaatgtggaaaagccttcgtgcagaaacctgaattcatcatccatcagaagacgcacatgcgagagaagcccttcaaatgtaacgaatgtggaaaaagcttcttccaggtaagtagtctcttccgccaccagcgaatccacacgggggagaagctatacgagtgttctcaatgtggcaaagggttcagctacaactccgatctctctattcacgagaaaattcatacaggtgagcgtcaccatgagtgtaccgattgtggtaaagctttcacccagaaatctaccttaaaaatgcaccaaaagattcacactggcgaacgctcttacatctgcatcgagtgtggtcaagcgttcatccagaaaacacacttgatagctcaccgccggatccataccggtgagaagccatacgaatgctctaattgcggaaagagttttatttctaagtctcagctccaggtccatcagagagttcataccagggtgaaaccctacatatgcaccgaatacggcaaagtgttttccaacaactcaaatcttgtgactcacaagaaggtgcagtcaagggaaaaaagttccatttgtaccgagtgcggaaaggcattcacatataggagtgaactcatcatccaccaacgaatccacactggcgagaaaccgtatgagtgctctgattgtggcaaagctttcactcagaaatccgctctgacagttcatcagcggatccatacaggcgaaaagtcctacatttgcatgaagtgcggcctagcctttattcaaaaggcacacctaattgcccaccagatcatccatacgggagagaagccccataagtgtggtcactgtgggaaactctttacttcaaagagtcagcttcatgtccataaacggattcacactggcgagaaaccgtacatgtgtaacaaatgtgggaaggcgtttacaaaccgctcaaaccttatcactcaccagaagacgcacaccggggaaaaatcatatatctgcagcaagtgtggaaaagcatttacacagcggagcgatctcatcacacatcaacgaatacacaccggggagaaaccatatgaatgtaacacttgcggcaaagcctttactcagaagagtcacctaaatatccaccagaagatacataccggtgaacgacagtatgaatgccacgagtgcgggaaagccttcaaccagaagtccatcctcattgtgcatcagaaaatccacacaggggagaaaccttacgtctgcaccgaatgcggacgtgccttcattaggaaatccaacttcatcacccaccagagaatccataccggcgagaagccctacgagtgcagtgattgtggaaagagcttcacctcgaaatcacagctgttggtccatcagcccgttcacaccggcgaaaagccctacgtatgtgcagaatgtggaaaggccttttcaggccggtccaatctgtccaaacaccagaagacccacactggggagaaaccttacatctgctctgaatgcggtaaaaccttccggcaaaaaagtgaacttataactcaccacagaatccacactggagagaaaccgtacgaatgctctgactgtggtaaaagcttcaccaagaaaagccagctgcaggtccatcagaggattcacacaggcgaaaaaccctatgtctgtgctgaatgcggaaaagccttcaccgataggtcaaatctgaataaacaccagactactcacactggtgacaagccttataagtgtggcatttgcggcaaaggcttcgtccagaaatcggtgttttcggtacaccagtcttcacacgcatag

SEQ ID NO: 21856 - DNA, 1221 bp, Artificial Sequence
  Description of Artificial Sequence: Synthetic coding sequence
atgctggagacctacagccacctgctgagcgtgggctaccaggtgccagaagctgaagtggtgatgcttgaacaggggaaggagccatgggccctacaaggcgaacgccccagacagtcctgccccggcgaaaaactgtgggatcacaatcagtgcagaaaaatcctgagttataagcaggtgtcgtcccagccacagaaaatgtatcccggcgagaaagcctacgagtgtgctaagtttgaaaagatcttcacacagaagtctcagctcaaagtgcacctcaaagttctcgcgggggagaagctgtacgtttgtattgagtgcggtaaagccttcgtgcagaagcctgagtttatcatccatcagaaaacacacatgcgggaaaaaccctttaaatgtaatgagtgcgggaagagcttcttccaggtgagctcactgttcaggcaccagcgcatccacactggcgaaaagctttatgagtgctctcaatgcggtaaaggattcagctataactcggatctctccatacatgagaaaatacacaccggcgagagacatcatgagtgtactgactgtggtaaggcattcactcagaagagcactctgaaaatgcaccaaaaaatccatacaggcgaaagatcgtacatctgtatagaatgtggccaggctttcatccagaagacccatctcattgcccataggagaatccacacaggtgagaagccctacgagtgctcaaactgcgggaagtcgtttatcagcaaatcccaactgcaggtgcatcagagggtgcatacaagagtgaagccctatatatgcaccgagtatggtaaagtgttctcaaataactctaaccttgtgacacacaaaaaagtgcagtccagggaaaagagctcaatatgcacagagtgcgggaaggcatttacctaccgaagcgacctgattacacatcatcggatccacacaggagagaagccatacgaatgttcagactgcggaaagagctttacaaagaagagccagctccaagtgcatcaacggatccatactggagaaaaaccttacgtgtgtgccgaatgtggcaaggcttttacagaccgctccaaccttaataagcaccagacgacccacacaggcgacaaaccatacaagtgtgggatttgcgggaagggtttcgtacagaagagtgtattttccgtgcaccagtcttcgcatgcctag

SEQ ID NO: 21857 - DNA, 2310 bp, Artificial Sequence
  Description of Artificial Sequence: Synthetic coding sequence
atgcccgccaactggaccagcccccagaagagcagcgccctggcccccgaagatcacggatctagctatgagggctctgtgtccttcagggatgttgccattgatttttccagagaggagtggaggcaccttgatccttcccaaagaaacctttatcgggacgtcatgctcgagacgtatagtcacctgttgagcgtggggtatcaggtgcccgaggcagaagtagtcatgctcgagcaaggcaaggagccatgggccctgcagggcgaacggcctagacaaagttgtcctggggagaaactgtgggaccataatcaatgccggaagatcttgtcttacaagcaggtcagctcgcagcctcaaaaaatgtatcctggagagaaagcctacgagtgtgctaaatttgagaagatatttacacagaagtcacagctgaaggttcacttaaaagtattagcaggtgaaaagctatatgtgtgtatcgagtgcgggaaagcctttgtgcaaaaacccgagttcataatccatcagaagactcatatgcgcgagaagccctttaagtgcaatgagtgcgggaagagtttttttcaggtttctagcctttttcggcaccagaggattcacaccggggagaaactatatgaatgttctcagtgcggtaaaggttttagctataactctgatctgtccattcacgagaagatccacacaggggagcgtcatcacgagtgtacagactgtggcaaggcatttacacaaaaaagcacacttaagatgcaccagaaaatccataccggcgaacggagctacatctgtatcgagtgcggacaggcatttattcagaaaactcaccttatagcacaccggaggattcatacaggggaaaagccttacgagtgttctaactgcggcaaatctttcatctccaagtctcagcttcaggttcaccagcgggttcacacccgcgtgaaaccgtatatatgcaccgagtacggaaaggtgttctcaaataatagcaacctcgttacccacaagaaggtgcagagccgcgaaaaatcctctatctgtaccgaatgtgggaaagcattcacataccgctccgagctgatcatccatcagcggatacacaccggcgaaaagccctacgaatgctcagactgtggcaaggcatttacacaaaagagcgccttaactgtgcaccagaggattcataccggcgaaaagtcgtacatctgtatgaaatgtggcctggcatttattcaaaaagctcacctgatcgcacaccagatcattcacactggcgagaagccacataagtgcggacattgcggcaagttgtttaccagcaagagtcagctccacgtgcacaagaggatccatacgggcgagaagccctacatgtgcaataagtgcgggaaagcattcaccaaccggagtaaccttatcacccaccagaagacccacacaggcgaaaagagttatatttgctctaagtgcgggaaggccttcacccagcgcagcgaccttataacccaccagaggattcataccggggagaagccctacgagtgtaacacttgcggcaaggcctttacccagaaaagtcatttaaatatccaccagaagattcataccggcgagcgccagtacgagtgtcatgagtgtggcaaggcattcaaccagaagtccatccttattgtccaccaaaaaatccacacaggcgaaaaaccatacgtatgcaccgaatgtggacgggctttcattcgcaagtctaattttatcactcaccagcggattcacaccggggagaagccttatgaatgtagcgactgtgggaagagcttcacttcgaaatcccaacttctcgttcatcaaccagtgcataccggcgagaaaccttatgtctgcgctgagtgtgggaaagccttcagcggccggagcaatctgtctaagcatcagaaaacacacactggggaaaaaccctacatctgctcagagtgtggcaaaaccttcagacagaagagcgagttgattacacatcataggatacacacgggtgagaagccatacgaatgtagcgattgcggaaagtctttcaccaagaagagccaactccaagtgcatcagcggatccacaccggcgaaaaaccatacgtttgtgccgaatgtggtaaagcttttacagacaggtccaacctgaacaagcatcagaccacccataccggcgataaaccctataagtgcggaatctgtggaaaaggattcgtccaaaaatccgtattcagcgtgcaccagagctcacacgcctag

SEQ ID NO: 21858 - DNA, 2145 bp, Artificial Sequence
  Description of Artificial Sequence: Synthetic coding sequence
atgctggagacctacagccacctgctgagcgtgggctaccaggtgccagaggcagaggtcgtgatgctcgagcagggtaaagagccatgggctctccaaggggagcgaccgcgtcagtcctgccctggggagaagctgtgggatcacaaccagtgccgcaagatcctctcttataagcaggtcagctcccagcctcagaaaatgtatcctggagaaaaggcctacgaatgcgccaaattcgagaagatctttacacagaagagccagctgaaggtgcatctcaaggttctcgctggggagaagctctatgtctgtattgaatgtggcaaagcgttcgttcaaaagcctgagtttataattcatcaaaagacccatatgagggaaaaacctttcaaatgcaacgagtgtggcaaatctttttttcaggtttcctccctatttcgccaccagcgaatccacaccggcgagaagctatacgagtgtagccagtgcgggaaaggcttcagttataactcagatttgagcattcatgaaaaaattcacacaggcgagcggcatcacgagtgcacagattgtggtaaagcttttactcagaagtctacactgaagatgcatcagaaaatacataccggcgagcggtcgtacatttgcattgagtgcggccaggcgtttatacagaaaacacatctcatcgcgcatcgaaggattcatacgggcgaaaagccctacgagtgctctaattgtgggaaatcatttatctctaaaagtcagctccaggtacatcaacgggttcacacgagggtcaaaccctatatatgcacggagtacgggaaagtgtttagtaacaacagtaacctggtgacacacaagaaggtgcagtctcgtgaaaagagcagcatttgcaccgagtgtggcaaggctttcacataccgctccgagttgattattcatcagaggatccataccggggaaaagccctacgagtgttctgactgtggaaaggcttttacacagaagtccgcactgacagtacaccaaaggatccacactggcgaaaaatcatatatctgtatgaagtgtggcctggcctttattcaaaaggcccacttgatagcccaccaaattattcacaccggcgagaaaccacacaaatgcggccattgcgggaaactgttcaccagcaagagccagctgcacgttcataaaaggatacacactggtgagaagccgtacatgtgtaataagtgtgggaaggcctttaccaatcggtcgaatctaattacacaccagaagacccatacaggtgaaaagtcatatatatgttccaagtgcggtaaagcattcacccagaggtcagatctgatcacgcaccagaggatccatacaggggagaaaccctacgaatgcaacacctgtgggaaagcattcacccagaagtctcacctgaacatccaccagaagatccatactggggaacggcaatatgagtgtcacgagtgtggtaaagcatttaaccagaagtcaattctgattgtacaccagaaaatacacaccggcgagaagccatatgtgtgcaccgagtgcggacgcgctttcattcgtaaatcaaattttatcactcatcagcgcattcacacgggcgaaaagccttacgagtgctccgattgcggtaaatcttttacctcgaaatcacagctcttggtacatcagcctgtgcatacaggcgagaagccttacgtgtgtgcagaatgtggcaaagcatttagcggacggagtaatctgtccaagcaccagaagacacatacaggggagaaaccctacatttgttctgaatgcggcaagacctttagacaaaagtcagagctcatcacccaccacagaattcacacaggagaaaagccctacgaatgttctgattgcgggaaaagtttcactaaaaagtcgcagcttcaggtgcaccaacggatacacacgggggagaagccatatgtgtgtgccgagtgcggcaaagccttcacggaccgatctaacttgaataagcatcaaaccacccacactggagacaagccttacaagtgtggcatttgtggtaaaggtttcgtgcagaagtcagtgttctcagttcatcagagcagccacgcatag

SEQ ID NO: 21859 - DNA, 1074 bp, Artificial Sequence
  Description of Artificial Sequence: Synthetic coding sequence
atgaagtgcggcctggccttcatccggaaggcccacctgatcacccaccagatcattcacacaggagaaaaaccttataagtgcggtcactgcgggaagctgtttaccagcaaaagtcaattacatgtacataaaagaattcacactggcgagaaaccctacgtgtgtaataaatgcggtaaggcttttactaatcgaagcaatctgatcactcaccagaaaacccacacaggcgaaaagagctacatttgttccaagtgcgggaaggctttcacccagcggtctgacttaatcactcaccaacggatccatactggtgagaagccatacgagtgtaatacctgtggaaaggctttcacgcagaagtccaatctgaatatccatcagaaaattcacactggtgagcgccagtacgaatgccacgagtgtgggaaagcctttaatcagaaatccattttgatagtgcatcagaagatccacactggtgaaaaaccgtacgtgtgcactgagtgtggcagagcattcatcaggaagtcaaactttatcactcatcagcgcatccatacaggcgagaagccatatgagtgctcggattgtgggaaatcatttacctccaagtcacagctgctggtccaccagcctgttcacaccggcgagaagccttacgtgtgcgctgaatgtggtaaagcctttagcggtagaagcaacctttcaaagcaccagaagactcatacaggagaaaagccctatatctgttcagagtgcggaaagacttttcggcagaaaagcgagctaataactcaccatagaatccatacgggtgagaagccctatgaatgctcagactgtgggaaaagttttaccaagaagtcccaactccaagtgcaccagcgaatacacactggcgagaagccctacgtgtgcgccgaatgtggcaaagcattctcgaacaggtctaacttaaacaaacaccagaccacacacaccggcgataaaccttataaatgtggaatctgtggtaaaggctttgttcaaaaaagcgtgttctcagtgcaccaaagtagtcatgcatag

SEQ ID NO: 21860 - DNA, 2145 bp, Artificial Sequence
  Description of Artificial Sequence: Synthetic coding sequence
atgctggagacctacagccacctgctgagcgtgggctaccaggtgcccaagcccgaggttgtgatgctggaacagggcaaagagccatgggccttgcagggagagaggccccgccattcctgtcccggtgaaaagctgtgggaccataatcagcacagaaaaataatcgggtacaaacctgcatcatctcaggatcagaaaatctattccggggagaaaagctacgagtgtgctgaatttggtaaatcttttacttggaagtcacaatttaaggtacatctaaaagtgcccacgggcgagaagctgtatgtttgcatcgagtgcggtcgcgcttttgttcaaaaaccggaatttatcacccaccagaagactcatatgagagagaagccttataagtgcaatgaatgcggaaagtcattttttcaggtctccagcctgttccggcatcacaggattcacacaggcgagaagctctatgaatgttctgagtgcggaaaaggattcccttataattccgatctgagtattcacgagaagatccatacgggggagcggcatcacgaatgtactgactgcgggaaggcctttacacagaaatcaactctgaaaatacaccagaagatccatacgggtgaaagatcttacatttgtatcgaatgcgggcaggcctttattcaaaaaacccagttaatagctcatcggcgtattcactccggcgagaaaccatacgaatgtaacaactgcgggaaaagctttataagtaaatcccaactgcaagtgcatcagcgcgttcacaccagggtcaagccgtacatctgcactgaatacggcaaagtcttcagcaacaacagcaatctcataacacacgagaagattcagagcagggagaagtcttctatatgtactgagtgtgggaaggcgttcacctatcgaagtgagttgatcatccatcagcgcatacatacaggcgagaaaccttatgaatgctctgattgcggtcgcgccttcacacaaaagtcggctctcactgttcaccagcgcatccacacaggagaaaagagctatatttgtatgaaatgcgggttggcctttattcgaaaggcccatctcatcacacatcagattatccatacaggcgaaaagccctataaatgtggtcactgcggcaaactatttacgagtaagagtcaactccacgtgcacaaacgcatacacaccggcgaaaagccttatgtgtgcaacaaatgcggaaaggcctttaccaataggtccaatttaattactcaccaaaagacccatactggcgagaagtcatatatttgttctaaatgtgggaaagctttcacacagcggagcgatttgataacacaccagcgaatccacactggtgaaaaaccatatgagtgcaacacatgcggcaaggcgtttacgcagaagagcaaccttaacatccaccagaagatccacactggagagcgacagtacgagtgccatgagtgcggaaaggccttcaatcaaaagtcaatcctcatcgtgcatcagaagatccataccggagaaaagccttacgtatgtacagaatgcggcagagctttcatccgtaagagtaacttcatcacccatcagcgcatacatacaggcgagaagccttacgagtgctctgattgcgggaagtcctttacatcgaagtcccaattgcttgtgcatcaacctgtgcacacaggggaaaagccttatgtttgcgctgaatgtggcaaggcctttagcggtcggagtaacctgagcaagcaccaaaaaacccataccggagagaagccctatatctgctctgaatgcggtaagaccttccggcagaagtcggagctcataacccatcatcggatccataccggggaaaagccgtatgaatgtagcgactgtggaaagagctttacaaagaaaagccagcttcaggtccaccagcgcatccatacaggtgagaaaccgtatgtgtgtgcggaatgtgggaaggcattctccaacaggtctaacctgaacaaacatcaaacgacacatactggggacaaaccatacaagtgcggcatatgtggcaaaggcttcgtccagaaatccgtgttctctgtgcaccagtccagtcatgcatag

SEQ ID NO: 21861 - DNA, 2310 bp, Artificial Sequence
  Description of Artificial Sequence: Synthetic coding sequence
atgcccgccagctggaccagcccccagaagagcagcgccctggccccagaggatcatggcagtagctacgaaggatcagtatcatttcgagacgtggccattgactttagtcgtgaggagtggcgccacctggacctgagtcaaaggaatttatatcgcgacgtaatgctggagacctactcccatctgctgtccgtgggataccaggtgccaaagccggaggttgtgatgcttgaacagggcaaggagccctgggcactgcaaggcgaaagaccacggcacagttgccccggtgagaagttgtgggatcacaatcagcatcggaagatcataggttacaaacccgcgtcaagtcaggaccagaaaatctactcaggtgagaaatcatacgagtgtgccgagttcggcaagagcttcacttggaaatctcaatttaaagtccacttgaaggtccctacaggtgaaaagctgtacgtgtgcattgaatgcgggagagctttcgtccagaagcccgagttcattacccaccagaaaactcatatgcgggaaaaaccatacaagtgtaacgagtgcggcaaatcctttttccaggtaagcagcttgtttcggcatcatcgcatacatacgggggaaaagctttacgaatgttctgagtgcggtaaggggttcccatacaactcagacttgagtattcatgaaaaaatacacacaggggagaggcatcacgaatgtaccgactgtggaaaagcctttactcaaaagagtaccctgaagatacatcaaaagatacataccggcgaaaggagctacatctgcatagagtgcggacaggctttcattcagaaaacgcagctcattgcccatagaagaatccactctggtgaaaaaccgtacgaatgtaacaattgcggcaagagcttcatcagtaaaagccaactccaggtccatcagagggtacacacacgcgtaaaaccatacatctgcacagagtatgggaaggttttttctaacaactccaacctgattacacacgaaaagattcagtcacgggagaagtcatcaatttgcacagagtgcggaaaagcttttacataccgctccgagcttataatccatcagagaatccacaccggcgagaaaccatatgagtgcagtgactgcgggcgggcgtttacccagaagagcgcattgaccgtgcaccagcggatacacaccggggagaaaagctatatctgcatgaaatgcggtctggcattcatcagaaaggcacatctgatcactcaccaaatcatccatacaggagaaaagccatacaaatgtggacactgtggaaagttgttcacttctaaatcgcagctgcacgtacataagcgaatccataccggggagaaaccatatgtgtgcaataaatgcgggaaagcatttaccaacaggtctaatctgatcacccatcagaaaacacacaccggagagaagtcttatatttgtagtaaatgtgggaaagcctttactcaacgttcagatcttatcacccaccagcgcatccacaccggcgagaagccctatgaatgtaacacctgtggaaaggccttcacacagaaaagcaatctaaatatacatcagaaaatacacacaggagagagacagtacgagtgccacgaatgcggcaaggcctttaaccagaagagtatactgatagttcaccagaaaattcacacaggagagaagccatatgtctgtaccgagtgcggaagggctttcattaggaagagtaactttatcactcatcagcggatccacacaggcgaaaagccgtacgaatgcagcgattgcggcaaaagttttaccagtaaatcccaacttctggtgcaccaacctgtgcacaccggcgagaaaccctacgtgtgcgcggagtgcggaaaagcctttagcggccgctccaacctgagcaaacaccaaaaaactcatacaggggaaaaaccttacatctgctccgagtgcggcaagaccttcaggcaaaaatccgagctcatcacacaccaccgaatccacactggagagaaaccctacgagtgtagtgactgcggtaaatcattcaccaagaaatcacagctgcaggtacaccagcgcatccacacaggggagaagccctacgtgtgcgctgagtgcggcaaggccttcagcaaccgctcaaacctgaacaagcaccagactacccacacgggagataaaccttataagtgtggtatctgcgggaaggggttcgttcagaagtctgtgttcagcgtgcatcaaagcagtcatgcttag

SEQ ID NO: 21862 - DNA, 195 bp, Artificial Sequence
  Description of Artificial Sequence: Synthetic coding sequence
atggccgccgccgccgccctgcgggcccccgcccagagcagcgtgacctttgaagacgttgctgttaacttctcactggaggaatggagcctgctgaatgaggcccaaggatgcctctatcacgacgtgatgcttgagaccctgacgctcattagctctcttgggtgctggttgcaggttgaagacggtgcttag

SEQ ID NO: 21863 - DNA, 1080 bp, Artificial Sequence
  Description of Artificial Sequence: Synthetic coding sequence
atgctggagaccctgaccctgatcagcagcctgggctgctggcacggtggagaggacgaggcggctccaagtaagcagtccacgtgcattcacatctacaaggaccagggcgggcattctggggagagaccctatgaatgtggcgagtacagaaaactgttcaaaaacaagtcctgccttacagagccccggcgagaccacaagcatcggaatgtgcgtactggcgaacgtccctatgagtgttcaaagtatggcaaacttttccatcagaagccaacccttcatattcatgaacgttttcatactggccagaaaacatatgaatgcagcgagtgcgggaaatcctttcaccagtcatcgtcccttctccagcggcagactctgcacaccagagagcgcccatatgagtgcatcgaatgcggtaaggcctttgctgagaagtctagtttaatcaatcatcggaaagtgcatagtggagccaagaggtatgaatgtaatgagtgcggcaaaagtttcgcttatacctccagtctcatcaaacatcgtcgaattcatacaggggagcgcccatacgagtgcagcgagtgtggcaggtctttcgctgagaacagttccctcatcaaacatctgcgtgttcataccggagagcgcccctatgaatgcgttgaatgtggaaagagtttccgaagatctagttcccttctgcaacaccagcgggtccataccagggagcgaccgtacgagtgttctgagtgcggaaagagttttagcctcagatccaatctcatccatcaccagcgcgtgcatacaggcgaaaggcatgagtgcggccaatgcggtaagtctttctcccgcaagtcttccctgattatccacctgagggtccataccggagaacgcccttatgagtgtagtgactgtggtaaatcgtttgctgaaaacagctctctgataaaacacctccgggtccacacaggtgagaggccgtacgagtgcattgattgcggcaagtcattccggcacagttcatccttccgccgtcatcagcgtgtgcacacaggcatgcgcccctataaatag

SEQ ID NO: 21864 - DNA, 633 bp, Artificial Sequence
  Description of Artificial Sequence: Synthetic coding sequence
atggccgccgccgccgccctgcgggcccccgcccaggtggtgggcatggagggcaaaatgagacagcaccttttgagccgagcccgcgtttatatctatactaagactagagaagtcatcgttgagaagggattgatgagtgtgggcaacattggtaattacttacggacatctccagcctccctgaatccggaggaaataacaaacacaggcatgtttgcgctggagaaaggccttatgtcggcagcgaatatgggcaattactttaccaagagcctccactccattttcatgcgcgattttatactcgggaaaaggccgatgagcgcagtcagtgttgagaatcatttcaccaaggcactgcactcatgttctgtgcggcactttacgctcgaaaaaggcctcatgtctgtcttgaacgtgggaaagcctctacttaaatcccccgtaagcctcactacgggcaagttcaccctcgaacagtcggtgatgaatgccatgaatgttggcagcccgctgcttatccacctcgtgtccctgaatacagggggcttcacactcgagcgaggtttgatgtccgctgtgaacgtcggggaccctctgctcaagacgcccgtgctcttgaatacgtag

SEQ ID NO: 21865 - DNA, 1209 bp, Artificial Sequence
  Description of Artificial Sequence: Synthetic coding sequence
atggccgccgccgccgccctgcgggcccccgcccagagcagcgtgaccttcgaagatgtagcagtgaacttctcactcgaggaatggtccttgttgaatgaggctcagcgttgcctttaccgcgacgtcatgctcgagaccctgacactgattagctctctgggatgctggcacggtggcgaggatgaggcagctccaagcaaacagtccacctgtatccatatatacaaagaccagggcggccactcaggagaacggccctatgagtgtggggaatacagaaagttattcaagaataaaagttgcctgactgaacctcgaagagaccataagcacaggaatgtcaggaccggggaacgcccatatgaatgctctaagtacggtaagctttttcatcagaagcccactctgcatattcatgaacggttccataccggccagaaaacctacgaatgttctgaatgtggaaagagttttcatcagtcctcctctctgctgcagcgacagactctgcacacccgcgagagaccatacgagtgcattgaatgtgggaaggcctttgcagagaagagcagtctaattaatcaccgtaaggtgcactctggcgccaagagatatgagtgcaacgaatgtggcaagtcttttgcctatactagctccctgatcaaacaccgcagaatccacaccggagaaagaccatatgaatgctccgagtgcggccggtcctttgctgagaactcatccctaatcaagcacttgagagtgcatacgggcgaacgtccttatgagtgtgtagagtgtggcaagagcttccggcggagtagcagccttctgcaacaccagcgcgtgcacacgcgcgaacggccctacgagtgctctgaatgcggaaaaagctttagcttacgctccaacctaatacaccaccagcgggttcataccggggaacgccacgagtgcgggcaatgtgggaagtcattttcgcggaaatctagtctgatcattcatctgagggtgcacactggagaaaggccttacgagtgcagtgattgcggcaaatcttttgcagaaaattccagtttgatcaagcacctccgagtgcacacaggtgagcgcccctatgagtgcattgactgcggtaaaagctttcgccactcttcttccttcagacgtcaccagagagtccatacaggcatgcgaccttacaagtag

SEQ ID NO: 21866 - DNA, 300 bp, Artificial Sequence
  Description of Artificial Sequence: Synthetic coding sequence
atggccgccgccgccgccctgcgggcccccgcccagagcagcgtgactttcgaagacgtcgcagtgaatttctcgctcgaggagtggtctctgttgaacgaagcccagggttgtttgtatcatgacgtgatgctggagacactgaccctgatcagcagcctcaagggttgtactagacagcagttttgtaaccgttctactctgaataaagaagaccgggttatatataacctgcgccgcagccctagctgtcgcttcccactccctggcacagggccccacatactgtacgtgtcttag

SEQ ID NO: 21867 - DNA, 1209 bp, Artificial Sequence
  Description of Artificial Sequence: Synthetic coding sequence
atggccgccgccgccgccctgcgggcccccgcccagagcagcgtgacatttgaggacgttgccgtcaactttagtcttgaagagtggtcattgctgaatgaagcgcagaggtgcttgtatcgtgacgtaatgctcgagactctgacgttaatttctagcttgggttgctggcacggcggggaggatgaggccgccccctccaaacagagcacatgtattcacatctacaaggaccaaggtggtcatagtggcgagcggccatacgaatgcggggagtacagaaagctgtttaagaacaagagttgtttaaccgagcctagacgggatcacaagcacaggaatgtcaggaccggagagcgtccttacgagtgttctaagtacggaaaactttttcatcagaagcctacactccacattcacgagaggttccatacgggccagaaaacatatgagtgcagcgagtgtggcaagtcattccaccagtcttcttctctgcttcagcggcagaccttgcatacgcgggaaagaccttacgagtgcatcgaatgcgggaaggcatttgccgaaaagtcttcactgataaatcatcgcaaagtgcactcaggagctaaaaggtacgaatgcaatgagtgcggcaaaagtttcgcctatacaagctcacttataaaacatagacggattcataccggggagaggccttacgagtgtagcgagtgtggacgcagcttcgccgaaaattcttcccttatcaagcatctcagggttcacactggtgaaagaccttacgagtgtgtggagtgtggaaaatctttcagaaggagtagcagtctcctgcaacaccagcgggtgcacacaagggagcgcccctacgagtgcagtgaatgcggaaaaagcttctcactcagatccaacttgatccaccatcagagggtgcacaccggcgaaagacatgagtgtgggcagtgtggaaagtcgttctcacgcaagagttcactgattattcatttgagggtgcataccggagaacgtccatatgaatgtagtgactgtggaaagtctttcgccgagaatagcagcctgattaagcacctgagagtacacacaggtgaaaggccatacgagtgcatcgattgcgggaaatccttccgccactccagttcttttcggcggcatcagagggtgcatacagggatgaggccgtacaagtag

SEQ ID NO: 21868 - DNA, 498 bp, Artificial Sequence
  Description of Artificial Sequence: Synthetic coding sequence
atggccgccgccgccccccggcggcccacccagggcaccgtgacctttgaggacgtagcagtcaagttcactcaggaagaatggaacctcctgtccgaagctcagaggtgtttgtacagggacgtcaccctagagaatctcgccctgatgagtagtcttggatgttggtgtggagttgaagatgaagcagctccatccaagcagagcatctacattcagcgcgaaactcaggtgcgcacgccagttacaggcgtgtctcccaagaaggcacatccatgcgagatgtgcggtcctattctgggcgatatacttcatgtcgcagaccatcaaggaacccaccacaaacagaaactgcatcggtgtgaggcatggggcaacaagctctacgactcaggcaattttcatcagcaccagaacgagcacataggcgaaaagccatatcggggatccgtggaggaggcactgttcgtcaaacggagcggccattgcgacctctag

SEQ ID NO: 21869 - DNA, 1728 bp, Artificial Sequence
  Description of Artificial Sequence: Synthetic coding sequence
atggccgccgccgtgccccggcggcccacccagcagggcaccgtgacattcgaggacgtggccgtaaacttttcacaggaagaatggtgcctgttgtcagaagcccaacggtgtttgtacagggacgtgatgctcgagaaccttgcactgatttcatccctgggttgctggtgcggtagtaaggacgaagaggccccttgtaagcagcggatctcagttcagagggaaagccagtctcggacgcccagggccggggtcagtcctaaaaaggcacatccatgcgaaatgtgtggtctgatcctcgaagatgtgttccactttgcggatcaccaagaaacccaccacaaacagaaattgaacagaagcggagcgtgtggcaagaacctggacgatacagcgtacctgcaccagcaccaaaagcagcatattggagagaaattctacaggaaatcagtccgcgaggcgagctttgtgaaaaagaggaaattgcgtgtgagccaggaaccttttgtattcagggagttcggaaaggacgttttgcctagctccggcctctgtcaagaagaggcagctgtcgagaagactgattcagagactatgcacggacctccctttcaggaaggcaagacaaactactcgtgcggcaagagaactaaagctttttcaaccaagcattcggtgatcccccaccagaaactgttcactagagacggttgttatgtctgtagcgactgtggcaaatcattctccagatatgtctcgttcagcaaccaccagcgagatcacaccgccaaaggaccatatgactgtggtgagtgtggcaagtcctactccaggaaaagttcccttatccagcaccagcgagtgcacacaggtcagactgcatatccgtgtgaagagtgcggaaagtcatttagccagaaggggtcgctgatttctcatcagctcgtgcacaccggcgaaggaccctacgagtgtagggagtgcgggaagtcatttggccaaaagggaaacttgatacaacaccagcagggccacacaggcgagagggcgtaccactgcggcgagtgtgggaagagttttcgccagaagttctgttttatcaatcaccagcgggtgcacacaggtgagcggccttataaatgcggtgaatgcggcaagtcatttgggcagaagggcaatcttgtccatcatcagcgggggcatactggggaaaggccctatgaatgtaaggagtgtgggaagtcgttccgctatcgatcccacctgacggaacatcaaaggttgcatacgggggaaaggccatacaactgcagagagtgcggcaaactcttcaatagaaagtatcacctactagtgcatgagcgtgtgcacacaggcgagcggccttacgcttgcgaggtatgcggaaagctgtttggaaataagcactctgtgacaatacaccaacgaatccatacaggcgagcgtccatacgagtgcagtgaatgcggaaagtcattcctgagtagttcagccttgcacgtccataagcgagttcactccggccagaagccatacaaatgttccgaatgcgggaagtcgttttccgagtgctctagcctgatcaaacatcgtcgtattcataccggggagcgcccctatgagtgtacaaaatgtggcaagacgttccagcgaagctccactctactgcaccaccagtcctcgcaccgccgcaaggccctgtag

SEQ ID NO: 21870 - DNA, 1599 bp, Artificial Sequence
  Description of Artificial Sequence: Synthetic coding sequence
atgctggagaacctggccctgatcagcagcctgggctgctggtgcggctctaaggatgaggaggcaccgtgcaaacagagaatttccgtgcagcgagaaagccagtcccggactcctcgggcaggagtgtctcccaagaaggcccacccatgcgaaatgtgcggcctgatcctggaggatgtgttccatttcgctgaccaccaggaaacacaccacaaacagaaactcaaccggtctggcgcctgtgggaagaacctggacgataccgcttacctgcaccagcaccaaaagcaacacatcggagagaaattctaccggaagagcgttcgtgaggcatcttttgttaagaaacggaaactgcgggtcagtcaggagcccttcgtttttcgcgagttcggaaaggacgtcttaccctctagcggactgtgccaggaggaagcggcggtggaaaagacagattcggaaactatgcatggcccccccttccaagaagggaagacaaattactcttgcggaaagagaacaaaagctttttctactaaacactccgttatacctcaccaaaagctgttcaccagggatggttgttatgtatgttcagattgcgggaaatctttctctcgttatgtctccttttccaaccatcagcgcgatcacaccgctaagggcccttatgactgcggcgaatgcggcaaatcatatagtaggaagtcctcactcattcagcatcagagggtccacaccggccagactgcttacccttgtgaggaatgtggaaaaagtttctcccaaaaagggtctctgatcagccaccagttagtgcacacaggagagggcccctatgagtgcagggaatgtgggaaatcatttggtcagaaagggaacctgatccagcatcagcaggggcatactggagagagggcttaccactgcggcgagtgtggaaagagttttcgtcagaagttctgcttcattaaccaccagcgagttcatacaggagaacgcccctataagtgcggagagtgtgggaagtcgttcggacagaaaggcaacctggtgcatcatcaaaggggacacaccggggagagaccttacgaatgtaaggaatgtggcaaatccttcagataccgcagccacctgaccgaacatcaaaggctacacacaggagaacgcccatataattgccgggaatgtggcaaactctttaatagaaaatatcatctgctcgtgcacgaacgtgtacacacgggagaaagaccatacgcttgtgaggtgtgtgggaaactatttggtaacaagcacagcgtgacaattcaccagcggatccacacaggcgagaggccttacgagtgtagtgagtgtggaaaatccttcctcagttcctctgcactgcatgttcacaaaagagtacattcagggcagaaaccatacaagtgctcagaatgcggcaagagtttttccgaatgttcctccctgatcaagcatcggagaattcacacaggcgagcggccttacgaatgcactaaatgcggaaaaacgtttcaacggtcctcaacgctgcttcaccatcaatctagccatagaagaaaggccctttag

SEQ ID NO: 21871 - DNA, 1209 bp, Artificial Sequence
  Description of Artificial Sequence: Synthetic coding sequence
atggccgtggtggccaccctgcggctgagcgcccagggcaccgtgacttttgaagatgtggcggtgaaatttacccaggaggagtggaatctgttgtccgaagcacagcggtgcttatatcgcgacgtgaccctcgaaaacttggctcttatgtccagtcttggttgctggtgtggcgtcgaggacgaagcagcaccgagtaagcaaagcatatacatacagcgggagactcaggtcaggacacccgtgacaggagtgagtccaaagaaagcccacccctgtgagatgtgcggaccaattctgggggatatcctgcacgtggctgatcaccaggggacccatcacaagcagaagctacaccgttgcgaggcctggggcaacaagttatacgactctgggaattttcaccagcaccagaatgagcatattggcgaaaagccctacagagggtccgtggaagaggccctattcgttaagaggtgtaaactacacgtctccggagagtccagcgtgttttctgagtccgggaaggatttcctgcctaggtctggcctcctgcaacaggaagcgagccatacaggagagaaaagcaatagcaaaaccgagtgtgtttctcctttccagtgcggaggcgctcactacagtcacggagattccatgaagcatttttccacaaagcatatcctctctcaacaccagagactgctccctagagaagagtgttatgtctgttgtgagtgtggcaagtcttttagcaaatatgtgtccttctctaaccatcagagggtgcattcaggcaaaaggccgtacgagtgtggagagtgtgaaaagtcctttagccagaaatcgtcactgatacagcaccagcagttccacaccggcgggaagccatatggatgtgaggagtgtggtaaatacttctccctcgagggctacctgcggagacaccagaaggttcacgctggaaagggtccttacgaatgtggggagtgcgggaaatctttttcgtcaaacgtgaatttgaaaagccatcagcgtatccatactggcgagaggccgtacaagtgtggggaatgtgagaagtcctttagcaggaaaccctctctgtcctatcaccaacgctttggccggcctcgatgggtcgaccataaggatcggaaggagttcaaaacttctcttgggaatatcgtcaagtcttgtctgttttag

SEQ ID NO: 21872 - DNA, 1860 bp, Artificial Sequence
  Description of Artificial Sequence: Synthetic coding sequence
atggccgccgccgtgccccggcggcccacccagcagggcaccgtgacttttgaagacgtggccgttaatttcagccaggaggagtggtgcttgttgtctgaggctcagcgatgtctgtacagggacgtgatgttggagaatcttgccctcatttcttccctgggttgctggtgcgggtccaaggatgaggaggccccgtgcaagcagagaatttccgtgcagagggagagtcaatcgcgcacgcccagggcgggagtgagccccaaaaaggcacacccctgtgagatgtgtggattgattctcgaagatgtctttcacttcgctgatcaccaagagacccatcacaaacagaaattgaaccggtcaggggcgtgcggtaagaatctggacgataccgcctatctacatcagcaccagaagcagcacatcggggaaaagttttacagaaaatcagtccgggaagcatcattcgtgaagaaacgaaagctgcgcgtgagccaagaacccttcgtgttccgcgagtttggtaaggatgttcttccaagcagcgggttgtgccaggaggaagcagcggtagaaaaaaccgatagcgagacaatgcacggacctccctttcaagagggtaagacgaactattcttgcggcaagagaacaaaggctttttccacaaaacattccgttattccacatcagaaactcttcactcgcgacggatgctacgtgtgttcagactgcggtaaatcgttcagtcgctacgtttctttctccaaccatcagcgtgatcataccgctaaaggcccctacgattgcggcgaatgtggcaaatcttacagcagaaagtcctcgttaatacaacatcagagagtgcacacagggcagacagcctatccctgcgaggaatgcggtaaatctttttctcagaagggcagcctgatctcccaccagctggtgcataccggcgagggaccgtacgagtgcagggaatgcgggaaatctttcggccagaaggggaacctgatccaacatcagcaaggacatactggtgaaagggcctaccattgcggcgaatgcggtaagagctttaggcaaaagttttgttttatcaaccaccaacgcgtgcacacgggcgagcgtccgtataagtgtggggaatgtgggaaatccttcggtcagaaggggaatcttgtacatcaccagaggggacacaccggagaaaggccctatgagtgcaaggaatgtggcaaatcatttagatacagatcccacctgaccgagcaccaacggctgcataccggggaaaggccatacaactgccgcgagtgcgggaaactgtttaacaggaaataccatctgctggtacacgaaagggtccatactggcgaaaggccatatgcttgcgaagtatgcggaaaactgttcggtaataagcacagcgttactatccaccagagaatccatacaggcgagcggccttacgagtgttcagagtgcggaaaaagctttttatcttcctcagcgctgcatgttcataagagggtgcattctggccaaaaaccatataaatgcagtgaatgcgggaagtccttttccgaatgtagcagcctcataaaacacaggcgcatccataccggcgaacgcccctacgaatgcaccaagtgcgggaagactttccagcgtagttctactctgttgcatcaccgagtgcatacaggagagcgcccttatgagtgtagtgaatacggtaaaagctttgcagaagctagccgactggtgaaacatcggcgcgttcacactggcgaaaggccatatgagtgctgtcagtgcggaaagcaccagaatgtgtgctgtccccgcagctag

SEQ ID NO: 21873 - DNA, 1269 bp, Artificial Sequence
  Description of Artificial Sequence: Synthetic coding sequence
atgatcgacttccagatgctgaaccagctgtgccggaccatcatcaacccaagtgtgataccctgcctgaaatattgtggtgatcagatcggtcccgtgacgttcgaagatgtcgctgttctgtttacagaggccgagtggaagcggctgagccttgagcagcgaaatctgtacaaagaagttatgctggaaaatctgcggaacctagtgtctcttgagagtaagccagaagttcacacttgtccgagctgtcccttagcattcggctcccaacagtttctctcacaggatgagctccacaatcatcccatcccagggtttcacgctggcaaccagctgcaccctggaaacccctgtcccgaagaccagccacagtctcagcacccgtccgacaagaaccaccggggggccgaagccgaggaccagcgcgtcgagggaggcgtgcgtccgctattttggtccacgaatgagcgcggcgccttggtaggatttagcagcttgtttcagcggccacccatcagtagctggggcggtaaccgtattctcgagatacagttatcacctgcccaaaacgcaagttccgaagaggtcgacaggatctccaagcgcgccgagactcctggatttggagctgttactttcggcgagtgcgcgctggcctttaatcagaagtcgaacctgttccgccagaaggctgtaacagcggaaaagtcttctgacaaacggcaatcacaagtttgtcgcgagtgcggtcgcggtttctcccgcaaatcgcagctgatcatccaccagaggacgcacacaggggagaagccatatgtgtgcggagagtgtggccgtggtttcatcgtggagtccgtcttgcgcaatcatttgtctacacacagcggagaaaaaccatatgtatgctcacactgcgggcggggatttagttgtaaaccatatctgatccgccatcaaagaacgcatactcgcgagaaatcattcatgtgtacggtgtgcggacggggcttccgggaaaagagcgagctaattaagcaccagcagaggtgccaagtgaccgtgccacttgaggagtggtcacttcacttgacaacctctttttgtaattgcgtcttgcctttggcctctatgaccttgagctgcttcatctttttctatatctcttctctctgttgcttcctcagttatccaaccttcagattttactcagaattttcattgcagccttacaacctccgcgacacgtttacccgcagcccaagctag

SEQ ID NO: 21874 - DNA, 1095 bp, Artificial Sequence
  Description of Artificial Sequence: Synthetic coding sequence
atgtgggccccccgggagcagctgctgggctggaccgccgaggccctgccagctaaagattcagcctggccctgggaggagaagcccaggtacctaggacccgtgaccttcgaagacgtcgctgtgctcttcactgaggccgagtggaagcgcctgtctctcgaacagagaaatctttacaaggaagtgatgctcgagaatcttagaaatctcgttagcctagctgagtctaagcctgaagtccacacctgccctagctgccccttggccttcgggagccagcaattcctcagtcaagatgagctgcacaaccatcctatccctggatttcacgccggtaaccaattgcaccccggtaatccatgccccgaggatcaaccccaaagtcagcatccctcggataagaatcaccggggagctgaggctgaggatcaacgggtggaggggggggtccgacctcttttttggagtaccaatgagcgaggagccctggtcggtttttccagcctcttccagcgtccacctatatcttcttgggggggtaacagaatacttgaaatccagctgtcgcctgcccagaacgccagcagcgaggaggtggaccggatcagtaagcgagctgagacacctgggttcggcgccgtcacctttggcgaatgtgccctagccttcaatcagaagtctaacctgtttcgccagaaggcagttaccgcagaaaaatcatccgacaagagacagagccaggtctgcagagagtgtggtagagggttcagccggaagagccagcttattatccaccagcgaacccacaccggtgaaaagccctacgtgtgcggagagtgcggcagggggttcatcgtggagagcgttttaagaaatcacttgtccacccattccggtgaaaagccctatgtctgcagccactgcgggcgaggattcagctgtaaaccgtatcttattcgacaccaaagaactcacaccagagagaagtccttcatgtgcactgtctgcggccgcggcttccgagaaaagtctgagctgatcaagcatcaacggatccacacaggggacaaaccctatgtgtgtcgggattag

SEQ ID NO: 21875 - DNA, 534 bp, Artificial Sequence
  Description of Artificial Sequence: Synthetic coding sequence
atgtgggccccccgggagcagctgctgggctggaccgccgaggccctgcccgccaaggattctgcatggccgtgggaggagaagccccgctacctgggtccggtcacgttcgaggacgtcgccgtgctcttcacggaggcggagtggaagcgtctttcactcgagcagaggaatttgtacaaggaggtcatgctcgagaatcttcggaacctcgttagcctggagagtaagcctgaggtgcacacctgcccttcttgtcccctcgctttcggaagtcagcagtttctgtctcaggacgaactgcacaaccatcccattcccggcttccacgctggcaatcaactgcaccctgggaatccctgtcctgaagaccaaccccagtctcagcaccctagtgacaagaaccatcggggcgccgaagcagaagaccagagggtagagggcggagtccgcccactgttctggatattagagttgggcagtccgagaagtggtctgctgcccttggatctgaacctagacctttggctgtag

SEQ ID NO: 21876 - DNA, 1095 bp, Artificial Sequence
  Description of Artificial Sequence: Synthetic coding sequence
atgtgggccccccgggagcagctgctgggctggaccgccgaggccctcccagccaaggactcagcttggccctgggaggaaaagccgcggtacctcggcccagtaacctttgaggatgttgccgtgcttttcacggaagccgagtggaagcggctctcactggagcaacgcaacctgtacaaggaggtgatgcttgagaacctgcgcaacctggttagtcttgccgagagcaagcccgaagtccatacttgcccgagctgtcctctcgcttttggttctcagcagtttctgtcgcaagatgagctgcacaaccaccctattccggggtttcatgccgggaatcagcttcatcccggcaacccatgtccggaggatcaaccgcagagccagcatccatccgacaaaaatcaccggggcgccgaagctgaggaccagagagttgagggcggcgtgcgcccactgttttggtcgaccaacgaacgcggcgcgctggtgggcttttccagcttgtttcagcgcccccccatctcttcttggggaggtaacagaattcttgaaatccaactgtctcccgcccaaaatgcctcctccgaggaagtggacaggatttccaagcgggcagagacccccggtttcggggccgtgaccttcggggaatgtgcactggcctttaatcaaaaatccaacctgtttagacaaaaggccgtcactgctgagaagagcagtgacaaaagacagagccaggtgtgcagagagtgcgggcgtgggttctcacgaaagtcccaactgatcatccaccaaaggacgcacaccggcgagaagccctacgtgtgcggcgagtgtggacggggcttcatcgtggagagcgtcctaagaaaccaccttagtactcacagcggagagaaaccatatgtctgcagccactgcggcagagggttctcctgcaagccatatctgattcgtcaccaacgcacacatactagagagaaaagcttcatgtgcaccgtgtgtgggaggggctttcgggaaaaaagtgagctcattaagcatcagaggatccataccggagataagccttatgtctgccgagactag

SEQ ID NO: 21877 - DNA, 471 bp, Artificial Sequence
  Description of Artificial Sequence: Synthetic coding sequence
atgggccggagccggcggaccggcgcccaccgggcccacagcctggcccgtcagatgaaggcaaaaagacgccggcctgatctggacgaaatccaccgagagctcaggccgcaaggctccgcccggccacagcccgaccctaatgctgagttcgaccctgacctaccaggcggggggctgcaccggtgtctagcctgcgcacgctacttcatcgactctaccaaccttaagacccacttccggtctaaggatcacaaaaagcgctacgagggagtgcgacgggggctgatggacgggtgcagcgccgaccgtgctttgacatggtcggcacccaatagctgctttagtttcagccaggctgaggccgcagagagaagagcactgcagagtggcaggggcggtgagggatccggatacggaattctgtgcgcgcctcaggctgctggatccgcccacggcagcgtgcattag

SEQ ID NO: 21878 - DNA, 405 bp, Artificial Sequence
  Description of Artificial Sequence: Synthetic coding sequence
atgggccggagccggcggaccggcgcccaccgggcccacagcctggccagacagatgaaggcgaaaaggcggagaccagacctggacgagattcaccgcgaattaagaccccagggtagcgccaggcctcagcccgatcctaacgccgagttcgatcccgatttacctggtggaggcttacacagatgcctagcctgcgctcgctactttatcgattccacaaatcttaagacacatttcagaagtaaggaccacaagaagcgcttgaagcagctcagcgtggagccctattctcaggaggaagctgaacgagccgcaggaatgggcagctatgtgccgccacgtaggctagccgtccctacggaagtttccactgaggtgccagaaatggacaccagcacatag

SEQ ID NO: 21879 - DNA, 996 bp, Artificial Sequence
  Description of Artificial Sequence: Synthetic coding sequence
atgaacgtgaagaacgtgggcaagctgaaccagagcagcgacctgcttcgacatcaccgtattcactcgggtgaaaagccttatgtgtgcaacaaatgtggcgagtcttttagatcatcatctgatctcattaagcaccaccgggttcatacaggggaaaaaccacacgagtgcagtgaatgcggcaaggtctttagtcagcgtagccaccttgtgacccatcagaagatccatactggagagaagccgtatcagtgtacagaatgcgaaaaagcctttagacggcgaagtctgctgatccagcgcagaaggatacattccggcgagaagccatatgaatgcaaggagtgtgggaaactgttcatgtggcacacagcattccttaagcaccagagactgcatgcaggcgagaaactcgaagagagagaaaaaactttctctaaggacgaggaactgcggggggaacagaaaatccaccaggaggagaaagcgtattggtgcaatcagtgcggtcgtgcattccagggatcctcagatctgatcggacatcaagtgacgcacactggcgagaagccatacgagtgcaaggagtgtggcaagacgttcaaccagagctcagatttgctcaggcaccacagaatccatagtggcgagaagccctatgtttgcaacaagtgcggcaaatccttccgcgggtcctcggacctgataaggcatcaccgagttcatactggagagaagccctatgaatgccctgaatgttggaaagccttttcacagaatagccatctggtttcccaccagcggattcatacaagagagaagcccttcgaatgtagtaactgcggaaaggcattttcaggttggactgctttccttaagcaccagaaactccacatcggcaaagaatttgaggattgcaagtccctgcagacaggtccaatccttataggctcacgcaatttgatgaacgctgtgaaactcgggaaggtttag

SEQ ID NO: 21880 - DNA, 918 bp, Artificial Sequence
  Description of Artificial Sequence: Synthetic coding sequence
atgaacgtgaagaacgtgggcaagaaccagagcagcgacctgctgaggcaccatagaatccactctggcgagaagccttgtgtttgttcgaaatgcggaaaaagctttcgcgggagcagtgacttaattcggcatcacagagtgcacacgggcgagaaaccctatgaatgttccgaatgcggcaaggctttctcccaaagatcccacttggtgacgcaccagaagatccataccggagaaaagccttatcagtgcacagaatgcggtaaagcgttcagaagacgaagcttgctcatacagcatcggcggatccattctggcgaaaagccctacgagtgcaaagagtgtgggaagctcttcatttggagaaccgctttcctcaagcatcagagcttacatacaggggaaaagctggaatgtgagaagacattctcccaagatgaggagctgcgtggcgagcagaaaatccaccaagaagcaaaggcatactggtgtaaccagtgcggcagggccttccagggctcttctgaccttatcagacatcaagtcacacatacccgcgaaaagccatatgaatgcaaagaatgcggaaaaaccttcaatcagtcttcggacctcctccgccaccaccggatccactccggcgagaagccgtacgtgtgcaataagtgtgggaagagtttcagaggaagcagtgatctgattaaacaccatcgaatacacacaggtgaaaagccatatgagtgtagcgagtgcggaaaggcattttctcagcgcagtcacctggcgacacaccaaaaaatacatactggagaaaaaccctaccaatgcatggagtgcggcaagctttttatgtggcacactgcatttctgaaacaccagagactacatgccggcgaaaaattagaagaatgttag

SEQ ID NO: 21881 - DNA, 2424 bp, Artificial Sequence
  Description of Artificial Sequence: Synthetic coding sequence
atgaaggagtggaagagcaagatggagatcagcgaggagaagaagtccgcacgcgcggcctcggagaagctccagcgacagattactcaggagtgcgaactagtggagactagtaactccgaagataggcttctgaaacactgggtctcaccattgaaagacgcaatgcgccacctgcctagtcaggagtccgggatcagagagatgcatattatcccccagaaggccatcgtcggagaaatagggcacgggtgcaacgaaggagaaaagattctcagcgctggggagagtagccatcgctatgaagtcagcggccaaaattttaaacagaagtcaggattgactgagcaccagaagattcacaacatcaataagacttatgagtgtaaagaatgcgaaaagactttcaatcggagcagcaacctgattattcatcagcgcatacatacaggcaacaaaccgtacgtgtgcaatgagtgtggcaaggacagcaatcagtctagcaatctgataatacaccagcggatccataccggcaagaaaccatatatttgtcacgaatgtggcaaggactttaatcagagctcaaatctggtgaggcataaacaaatccattctggaggcaacccttacgagtgtaaagagtgtggaaaggcctttaagggatcaagcaaccttgtactccatcagcggatccactcaaggggaaagccatatttgtgtaacaagtgcggcaaagcctttagtcagagtaccgacctgattatccaccaccgaattcacaccggagagaaaccatacgaatgctatgattgcggtcaaatgttctcccaatccagccatctcgtgccccatcaaagaattcatacaggcgagaagccactgaagtgcaatgaatgtgaaaaggcgttcaggcagcacagccaccttaccgagcaccagaggctgcactcaggagaaaaaccatatgaatgtcaccgctgtgggaagacattcagcggcaggaccgcttttctgaaacatcaaagactccacgcgggagaaaagatcgaagaatgcgagaaaacatttagcaaggacgaagaacttagggaggagcagagaatacatcaggaagagaaggcttattggtgtaaccagtgtgggaggaattttcaagggacgtccgacctgatccgacatcaggttacccatacaggtgagaaaccctacgaatgtaaagagtgtgggaagacattcaatcagagctccgacctgctccggcatcaccggattcattctggagaaaagccttgcgtgtgctctaagtgcggaaaaagcttccggggctcctcagaccttattcggcatcacagagtgcatacgggggaaaaaccctacgaatgcagtgagtgtgggaaagccttctctcagcgaagccacctggtcacccaccagaaaatccataccggagaaaaaccatatcagtgtaccgagtgtggcaaagccttccgccggcggagtcttttaattcagcaccggaggatacactctggcgaaaaaccgtatgagtgcaaggaatgcggtaaattgttcatttggcggactgcgtttctgaagcatcagtcgctccacaccggtgagaaactggaatgcgagaagacgttctcccaggatgaggaattacgaggcgagcagaaaatccatcaagaagccaaggcttattggtgcaatcaatgtgggagagcttttcagggcagctccgatctgatccggcaccaagtgacgcacacacgcgagaaaccatatgagtgcaaagagtgcggcaaaacattcaaccagtcctcagacctgttaaggcaccacagaatccactccggcgaaaaaccctacgtgtgcaacaagtgtggtaagtcttttaggggatcatctgatctgataaaacaccaccgaattcacacgggggagaaaccttacgagtgttccgaatgtgggaaggcatttagccagagaagtcatttagccacgcatcagaagattcatacaggcgaaaaaccttatcagtgtagcgagtgcggcaacgcgttcaggcggaggagcctgcttattcagcaccggcggctgcacagcggagagaaaccttacgaatgtaaggagtgtgggaaactgttcatgtggcataccgcattcttgaagcaccagagactgcatgcgggagaaaaactcgaagagtgcgaaaaaactttcagtaaggatgaagaactgcgaaaagaacagcggacccatcaggaaaagaaggtttactggtgcaatcagtgctcgaggacgtttcaaggctcgtctgacttaatcagacatcaagtgacccatacgagagagaaaccttacgagtgcaaagaatgcggaaagacacaatctgaactgcgcccttctgaaacttcctag

SEQ ID NO: 21882 - DNA, 1515 bp, Artificial Sequence
  Description of Artificial Sequence: Synthetic coding sequence
atgcccagccccgacagcatgaccttcgaggacatcatcgtggacttcacccaggaagaatgggccctactagataccagccagagaaaacttttccaagacgtgatgctggaaaacatctcccatttagtatcaatcgggaaacagttgtgcaagtcggtcgtcctcagtcagcttgaacaggttgaaaagctgtccacacagcgcatcagtctcctgcagggcagggaggtaggaattaaacaccaggagattccttttatccaacacatctatcaaaaagggacttccacaatatctacaatgaggtctcacacgcaggaggatccattcctgtgtaatgacttgggagaggactttacacagcacatcgcactgacacagaacgtgatcacttacatgagaaccaaacattttgtgtctaaaaagttcggaaaaatctttagcgactggctaagctttaaccagcataaggaaattcacacgaagtgtaagtcatacggctctcacctgtttgattacgcgttcattcagaatagcgccctgcgaccccattctgttactcataccagagaaatcaccctcgaatgcagggtttgcggcaaaaccttctctaaaaatagcaacctgaggagacacgaaatgatccacaccggagagaaaccacacggatgccatctatgcggcaaagccttcactcattgcagtgacttgagaaagcatgaacgcacccacaccggagaaaagccttacggctgccatctgtgcgggaaggcattttcaaagtcttcaaacctaagacgccatgaaatgattcacacccgagagaaggcacagatctgtcatctttgcggtaaagcctttacccattgctccgacttgcggaagcatgagcggacacacctgggggataaaccctacggttgtctgctgtgcgggaaagccttctcaaaatgtagctacttgagacagcatgagaggacgcacaacggggaaaaaccctatgaatgccacctctgtggtaaggccttttctcattgttctcatttgcggcagcacgagagaagccataacggggaaaagccacacggctgtcacctgtgcggcaaagccttcaccgaatcctccgtcctgaagaggcatgaaagaatacacactggagaaaagccttatgagtgtcacgtgtgtggaaaggcttttacggaatcaagtgatttacgcaggcatgagcgcacacatactggggagaaaccttacgagtgccacctgtgtggaaaggctttcaaccactcatctgtcctcaggcgccacgaaaggacacacaccggggaaaaaccttacgagtgcaacatctgtggcaaagcttttaacaggagctataactttcgcttacacagacgggtgcacaccggagaaaaaccttacgtgtgtccgctgtgtgggaaagcattcagcaagttcttcaacttaaggcagcacgagcgcactcacaccaaaaaggccatgaacatgtag

SEQ ID NO: 21883 - DNA, 1305 bp, Artificial Sequence
  Description of Artificial Sequence: Synthetic coding sequence
atgcccagccccgacagcatgaccttcgaggacatcatcgtggacttcactcaggaggagtgggctctcctggatacctcacagaggaagttgttccaggacgtgatgcttgagaatatctctcaccttgtgtctatcggcgaagacttcacacagcacatcgcacttacccagaatgtgatcacctatatgagaactaagcacttcgtctccaagaagtttgggaagatcttctcagactggctgagctttaatcagcacaaggagattcacaccaagtgtaagagttacgggtcccacttgtttgactatgctttcatccagaattcggcactgcggccccacagtgtcacccatactagagagattacacttgagtgtcgcgtgtgcggtaaaacgtttagcaagaattccaatttgcgtcggcatgagatgatacatacaggcgaaaagccccacgggtgccacctttgtggaaaggccttcactcactgctcagacctccgaaaacacgaacgcactcatacaggggaaaaaccctatggctgccatctttgcggcaaagctttttccaaatccagcaacctgagaagacacgaaatgatccacactagggaaaaagcgcagatatgtcatttatgtggtaaggccttcacgcattgctcagatctgcggaaacatgaacggacacatcttggggataagccttacggttgtctgctgtgcggtaaagctttctctaagtgctcatatcttagacagcacgagagaacgcataatggcgaaaagccgtatgagtgccacctctgtggcaaggctttcagccattgttcacatctcaggcaacatgagcggtcacataacggcgaaaagccacacggctgtcatttgtgcgggaaggcctttacagaatctagtgtcctgaaacgccatgaacgaattcacacaggcgagaaaccctacgagtgccatgtgtgtggcaaggcatttacagagtctagcgatctgcgtcgccatgaacgcacacacacaggtgagaagccgtacgaatgccacctttgcggaaaagcattcaatcacagttctgtcctgcgccgccatgagcgaacacacactggagagaaaccgtacgagtgtaacatctgtgggaaggctttcaatcggtcgtacaatttccggctacataggagggtccacactggggaaaaaccctacgtgtgcccgctatgtggtaaagcgtttagcaaatttttcaatcttaggcagcatgagaggacacatacgaaaaaagccatgaacatgtag

SEQ ID NO: 21884 - DNA, 1515 bp, Artificial Sequence
  Description of Artificial Sequence: Synthetic coding sequence
atgcccagccccgacagcatgaccttcgaggacatcatcgtggactttacccaggaagaatgggcattgcttgacaccagccagcgcaagctgtttcaagatgtcatgttagaaaatataagtcatcttgtgagcatcgggaagcagctttgcaaaagcgtggtcctatcccagttagaacaggtggagaagttgtccacccagcgtattagcctgctgcaggggagagaggtcgggattaagcatcaggagattccatttatccagcacatttaccagaaaggaacgtccacaatatccacaatgagaagccatacacaggaagatccctttttgtgcaacgaccttggagaagacttcacacagcatattgccctgacccaaaacgtcataacatatatgcggactaaacattttgtctcaaaaaaattcgggaaaatctttagtgattggctcagctttaaccaacacaaggagattcacaccaagtgcaagtcatacggctcacacctcttcgactacgccttcatccaaaactccgctctgagaccccattcggttacccacacaagagaaataaccctagaatgtagagtgtgtgggaagacattcagcaaaaatagcaacttgcgacgacacgagatgatacacaccggtgagaagccacacggctgtcatctctgtgggaaagcattcacccactgctccgacctgcgtaaacatgaaagaactcatacaggggaaaaaccctacgggtgtcatctctgtggaaaagctttctccaagtcgagcaatctccggagacatgaaatgatacatactagagaaaaagcccagatttgccacctgtgtgggaaggcgtttacacattgttcggatctgagaaaacatgagcgcactcacttgggcgacaaaccttacggatgtctactctgcggtaaggccttctccaaatgttcctacctgcgtcagcacgagcggacccataacggagaaaaaccttacgagtgtcatctttgtgggaaagcattcagccattgctcacacctcagacagcatgagaggtcacacaatggcgaaaagccacatggttgtcacctgtgtgggaaggcatttaccgagtcctcagttttaaagcgccatgagcgaatccacaccggggagaaaccttatgagtgtcacgtttgcggaaaggccttcacagagtcatccgacttacgcagacatgagcggacccacacaggcgaaaagccctacgagtgtcatctgtgcgggaaggccttcaatcattccagtgttctgagaagacatgaacggacacacacaggcgagaagccctacgagtgcaatatctgcgggaaggcctttaaccgatcctacaatttccgactgcatcgccgggtccatacgggtgagaagccctatgtttgccctctttgtggcaaggccttctctaagttcttcaacttgaggcaacatgagcggacacataccaaaaaggccatgaatatgtag

SEQ ID NO: 21885 - DNA, 1275 bp, Artificial Sequence
  Description of Artificial Sequence: Synthetic coding sequence
atggccagcatgccccccacccccgaggcccagggccccatcctgtttgaggatctggccgtctatttctcacaagaagagtgcgtcactctgcatcccgcccagcgcagcctgtcaaaagatgggactaaggagagtctggaggacgccgccctaatgggtgaagaaggtaaacctgagataaatcagcagctgtccctggagtcaatggagcttgatgaactggcccttgaaaaataccctatagctgccccactggttccgtaccccgaaaagtcctccgaagatggcgtgggtaacccggaagccaaaatactttctggtacccctacctacaagcggagggtcatctctctcctggtcacaattgaaaaccacacacctctggtagagctgtcagagtacctggggacgaataccctatccgagatactggacagtccatgggagggcgctaagaatgtctataagtgcccagagtgtgaccagaatttttcagatcactcctacctcgtcctgcaccagaagatccacagcggagaaaaaaaacacaagtgtggcgattgtggaaaaattttcaaccacagggccaatctacgaacccaccggcgtatccatactggcgagaaaccatacaaatgcgccaaatgctcagcgagtttcagacaacactcccatttgagccggcacatgaacagccacgtgaaagaaaagccatatacgtgctctatatgtggaagaggttttatgtggcttcctggcttggcacagcaccagaagtcacactcagctgagaatacttacgagtcaactaattgcgataagcatttcaacgagaagcccaacctggccctgcccgaagaaactttcgtctccgggccacaatatcagcacaccaaatgcatgaagagctttcggcaaagtctgtatcctgctcttagcgaaaaatctcatgacgaagactctgagcgctgctccgatgatggggataacttcttttcattctccaagttcaagcctctgcagtgccctgattgtgacatgacctttccctgtttttcagagctgatttctcaccagaacattcacaccgaagagcggccacacaagtgcaagacatgtgaggagagttttgccctggatagcgagttggcctgtcatcagaagagtcatatgctcgccgagcccttcaagtgtacagtgtgtggcaagacattcaagagcaacctgcacctcataacgcataagcgcacccatattaaaaacacaacttag

SEQ ID NO: 21886 - DNA, 1767 bp, Artificial Sequence
  Description of Artificial Sequence: Synthetic coding sequence
atggccgcccccgccctggccctggtgagcttcgaggacgtggtggttaccttcacaggtgaagagtggggtcacctggatctcgcccagcggacactgtaccaggaggttatgctcgagacatgccgactgctcgtgtcattaggacacccggtgcctaaaccagagctaatttatctacttgaacatgggcaggagttgtggacagtcaaaagggggctttctcagagtacatgtgcaggcgagaaagcaaaacctaagatcacagaaccgacggcctctcagctagcctttagtgaggagtctagttttcaggaactgctggcccaacgcagttctcgtgacagcaggttgggacaggcccgagatgaggaaaagcttataaaaatccaggaagggaatcttaggcctggtaccaacccccataaggaaatctgccctgaaaaattaagttataagcatgacgatctcgagccagacgactccctaggccttagggtgttgcaagagcgcgttactcctcaggacgctctgcacgaatgtgatagtcaggggcctgggaaggatccaatgaccgacgctagaaacaatccctacacctgcaccgaatgtggcaagggtttctctaaaaaatgggccttagttcgccatcagcagattcacgccggcgtgaagccgtatgaatgcaacgagtgtgggaaagcctgtcgctatatggccgatgtcatacgccacatgcgcttgcacaccggcgagaaaccctataaatgtatcgaatgtgggaaagcttttaagagacgcttccacctgactgagcatcaacgaattcataccggagataaaccttacgagtgtaaagaatgcggaaaagcgtttacacataggagtagctttatccagcacaacatgactcatacccgcgagaagccttttctgtgtaaagagtgtggcaaagccttttattatagctcttcgttcgcccagcacatgcgaatccacactggaaagaagctctacgagtgtggcgagtgtgggaaggctttcactcaccgcagtactttcatccagcacaatgtgacccacacaggtgagaaacctttcctgtgtaaggaatgtggaaagaccttttgcctcaattccagtttcacacagcatatgcggatacatacaggcgaaaagccatatgagtgtggcgaatgtggcaaggcatttacccaccgttctacatttattaggcacaagcggactcatacaggcgaaaaaccatttgagtgcaaggaatgcggcaaggcattttgtgactcttcctccctaatccagcacatgcggattcatacaggagagaaaccctatgagtgcagcgaatgcggaaaagccttcacacatcatagtgtctttattcgccacaacagaacgcacagcggacaaaaacccttggaatgcaaagaatgtgcaaaggccttctactacagtagctcctttactcgccacatgaggatacacactggtgagaaaccatatgtctgcagagaatgcggtaaagcattcacccaaccggccaattttgtgagacacaataggattcacaccggagagaaaccttttgaatgtaaagagtgcgaaaaggctttctgcgacaactttgccctaacccagcacatgaggactcacacgggtgaaaagccctttgagtgcaatgagtgtggcaagacattctcccactcatcctcctttacacaccaccggaagatccacacacgggtgtag

SEQ ID NO: 21887 - DNA, 270 bp, Artificial Sequence
  Description of Artificial Sequence: Synthetic coding sequence
gccctggtgagcttcgaggacgtggtggtgaccttcaccggcgaggaatggggacatctggatctcgcccagcggaccctttaccaagaggttatgttggagacatgcaggctgttggtgtcactggggcaccccgtccccaagcctgaactcatttacctcttggagcacgggcaagaattgtggaccgtgaagcggggcttaagtcagtcgacctgtgcagcgagtttctcactcctgtggaaaagttaccatccaggtcacggatag

SEQ ID NO: 21888 - DNA, 927 bp, Artificial Sequence
  Description of Artificial Sequence: Synthetic coding sequence
tacacctgcaccgagtgcggcaagggcttcagcaagaagtgggccctggtacgccaccagcaaattcacgcgggtgttaaaccttatgagtgtaacgagtgtggcaaggcgtgcaggtacatggctgacgtgatcagacacatgcgactgcacactggtgagaaaccatataagtgcattgaatgtggaaaagccttcaaaaggcggttccacctcactgaacaccagcgcatccacactggcgataagccgtacgagtgcaaggagtgcggcaaagcgttcacgcatcggagctcttttgcccagcatatgaggattcatacaggcaagaaattgtatgaatgcggggaatgtggaaaggcctttacccacagatctactttcatccaacacaatgtgacccacactggtgaaaaacccttcttgtgtaaggaatgcggtaagacattttgtcttaactccagttttactcaacacatgcgaatccatacaggagagaaaccgtacgagtgtggagagtgtggaaaggcatttactcaccgttcgactttcatccgtcacaagcgtacgcacacaggcgagaaacccttcgaatgtaaagaatgcggtaaggccttttgcgactctagtagcctgattcaacacatgcgcattcacactggtgagaaaccatacgagtgcagcgaatgcggtaaggccttcacacaccattcagtgttcattcgtcataaccgcacccactctgggcaaaaacccctcgagtgcaaagaatgcgcaaaagccttttattatagttctagtttcacgcggcatatgaggatccatacgggggagaaaccatatgtatgtcgggagtgcggtaaagctttcacccagcccgccaacttcgtgaggcacaaccgaatccatacgggcgagaaaccctag

SEQ ID NO: 21889 - DNA, 1764 bp, Artificial Sequence
  Description of Artificial Sequence: Synthetic coding sequence
aaggcccccgccagcgccctggtgagcttcgaggacgtggtggtgacgtttaccggagaggagtggggacacctggacttggcacagaggactctctaccaggaggtgatgttggagacatgtcgcctgttagtctcactggggcacccagtcccgaaacctgaactgatttatcttctggagcacggccaagaactttggaccgtcaagagagggctgtcacagagcacctgcgctggggaaaaggcgaagcccaaaatcactgagcccacagcgagccagctggcattcagtgaggagtcctcatttcaggagcttctcgcgcagcgctcgtcccgcgattcacggttgggccaggccagagatgaggaaaaactgatcaagatccaggagggaaaccttcgaccgggtacgaacccacataaggaaatctgcccagaaaaactgtcttataagcacgatgatcttgaacccgacgattccttgggtttgagggtcttgcaggagagagtgacaccccaggacgctctgcatgagtgtgactctcagggccctggaaaagatcctatgacggacgcgcgcaataatccgtatacgtgcaccgagtgcggaaagggcttctctaaaaagtgggcgttggttaggcatcaacaaattcacgccggagttaaaccctacgagtgtaatgaatgcggcaaggcctgccgctatatggctgacgtgatccggcacatgcgtctccataccggcgagaagccctacaagtgtatcgagtgcgggaaggcctttaagcggcgatttcaccttacagagcatcagaggatccataccggcgataagccatacgaatgtaaggagtgtgggaaggctttcacgcaccgttcaagttttatccagcataatatgactcatactcgcgagaaacccttcctgtgcaaagagtgcggaaaagccttctattatagctctagtttcgctcaacacatgaggatccataccggcaagaagctgtacgaatgcggcgagtgcggcaaagcattcactcacagatcaacattcattcagcataatgtcacccataccggggagaaaccgtttctgtgcaaggagtgcgggaagactttctgcctgaattccagctttacccagcacatgcgtattcacaccggtgaaaagccctacgaatgcggggaatgtggcaaggccttcacccacagatccaccttcataagacacaaacgcacacatactggggagaagcccttcgagtgcaaggagtgtggtaaagcattctgcgacagcagctccttgattcagcacatgcggatccacacaggggaaaaaccctacgaatgctccgagtgcggcaaggcgtttacacaccactctgtgttcatcagacataatcgcactcactctggacagaagcccctcgaatgtaaggaatgtgccaaagcgttttactacagttccagcttcacccgtcatatgcggatccacaccggcgagaaaccttacgtatgccgagaatgcggaaaagcgttcactcagcccgctaactttgtccgccacaatcggatacatacgggtgaaaagccttttgaatgcaaggagtgcgagaaggccttttgcgataatttcgctctgacccagcacatgaggacacacacgggggaaaaaccattcgaatgtaacgagtgcggcaaaacgtttagccattctagtagcttcacacatcacaggaagattcatacgcgagtctag

SEQ ID NO: 21890 - DNA, 2169 bp, Artificial Sequence
  Description of Artificial Sequence: Synthetic coding sequence
atgatgaaggaggtgctgagcaccggccagggcaacaccgaggtgatccacactgggaccctgcagaggtaccagagttaccatattggcgacttctgctttcaggagatcgagaaggagatccacgacatagaatttcagtgccaggaagacgagagaaatggacacgaggctcctatgactaaaataaagaaacttacagggtcgacagatcagcatgatcacaggcacgctggaaacaagccgatcaaggaccagctgggatcatccttctattcccacctgcccgaattgcatatcattcagatcaaaggcaagattggtaatcaatttgagaaatctactagcgatgcaccatctgtaagcactagccaacggatctctccgagaccacagattcatatttcgaataactacggaaataattctcctaattcctcattgcttcctcagaagcaggaagtctatatgcgcgagaagagctttcaatgcaacgagtccggcaaggcttttaactgctccagcctcctgcgcaaacaccagataccccacctgggcgacaagcagtacaaatgcgatgtgtgtggaaagttgtttaatcacaagcaatacctaacctgccactgtagatgtcataccggcgagaagccctacaaatgcaatgagtgtggaaaatccttctcgcaggtttccagcttgacatgccatcgacgattacacactgctgtcaaaagtcataagtgcaatgagtgtggtaagatttttgggcaaaactccgcactggtcatacataaggccattcacaccggtgagaagccctataagtgcaatgagtgtgataaagcttttaatcagcagtccaacctcgctcgccacagaagaatccacacaggggaaaaaccctataagtgcgaggaatgcgataaggtcttcagccgtaagagtaccctagaaagtcacaagagaattcatactggggagaagccatacaagtgtaaagtgtgtgacaccgccttcacttggaatagccaattagccagacacaagaggattcataccggcgaaaaaacatataagtgcaacgagtgcggaaagacattctcccacaagtcaagccttgtgtgtcatcaccgcctccatggcggcgagaagtcctacaaatgcaaggtatgcgataaggcctttgcttggaactcacatctggtgcgtcacacccgcatacacagcggagggaaaccatacaagtgtaacgagtgtgggaagacgtttgggcagaacagtgatctgctcatacataagtctattcacaccggagagcagccatacaagtatgaagaatgcgaaaaggtcttctcctgcggctcaacattggaaacccacaagatcatccatactggtgagaaaccctataaatgcaaagtttgtgacaaagctttcgcatgtcatagctatctggcaaagcatacacgtatccactccggagaaaaaccctacaaatgtaacgagtgctccaaaacattcaggcttaggtcctatttggcttcccacagaagggtgcatagtggggagaaaccgtacaagtgtaatgagtgttccaagactttcagtcagcggagctacctgcactgtcaccggcggctccactctggagagaaaccatacaagtgtaatgaatgtggtaagaccttctcacacaagcctagtctggtgcaccatcgcaggctccatactggagagaagagttataagtgcacagtgtgtgataaggcttttgtgagaaactcttatttagcccgccacacaagaatacacactgctgagaagccgtataaatgtaatgagtgtggcaaggcctttaaccagcagtcccagctgagcctacatcacagaatccatgccggcgagaagctctataagtgtgaaacatgcgacaaggtcttctccaggaagtcccacctgaagcggcatcggcgaatccatcccggcaagaagccatacaagtgcaaagtgtgcgataagactttcggcagcgattcccacctgaaacagcacaccgggttacacaccggagagaagccgtacaaatgcaacgaatgcggcaaagccttttctaagcagtctacactgattcaccaccaggcggttcatggagtcggtaaacttgactag

SEQ ID NO: 21891 - DNA, 1926 bp, Artificial Sequence
  Description of Artificial Sequence: Synthetic coding sequence
atgatccagagccagatcagcttcgaggacgtggccgtggacttcacacttgaggagtggcaactcttgaaccccacccagaaaaatctgtatcgggacgtgatgctcgagaattactccaatctggtcttcttagaggtctggttggataatccaaagatgtggctccgggataatcaggataacctgaagtcgatggagcgggggcacaagtacgacgttttcggaaaaatttttaatagctctattaacatcgtgcatgtgggactacgcagtcacaagtgtggaaccggggagaaatctctaaagtgcccatttgatttgcttatccctaagaataactgcgaacgcaagaagatcgatgagcttaacaaaaagctgctgttttgcatcaagccagggcggacccacgggggaatcaagtactgtgactgtagtacctgcagaaagtcttccaatgaggagccttggctcacagctaaccacatcacacatacgggtgtgtacctgtgcatggaatgcggcagatttttcaataagaaaagccagcttgtgatccatcagagaacccacaccggggagaaaccataccagtgtagcgaatgcggtaaggcgttctcccaaaagtctctcttaaccgtccaccaaagaacccactccggtgaaaaaccgcatgggtgcagtgagtgccagaaagccttcagcaggaagtcgcttctgattctacatcaacggattcatacgggggaaaaaccctacggttgttctgagtgcgggaaggccttctcaagaaaatctcagctgaaaagacaccaaatcacccacaccatcgaaaagccatattcttgttccgagtgcggaaaagcattttcacagaagctgaagttgattacacatcagcgcgcccatacaggggagaagccgtatccatgcagtcattgtgggaaggctttcttctggaagtcccagctgataacccatcagagaacccacacaggtaaaaaaccctatggatgcggagagtgtcagaaagccttcagtagaaactcactgcttatccggcatcagcggatccataccggagagaaaccatatgaatgcaatgagtgcggtgaggcattcattagaaaaccacagctcattaaacatcagatcacccatacgggtgagaaaaattatagatgcagcgattgcgaggaggctttctttaagaagtccgagctgattcggcatcagaagatccacctcggggaaaaaccatacggctgtatccagtgtgggaagactttcttcggcaagtcccagttattaactcaccaccgcacacatacgggtgaaaagccatatgaatgcagtgagtgtggcaaggcctttacacagaaaagcagtctaattagtcaccagcgcactcacactggagagaagccgtacgagtgtagcgagtgccggaagacttttagcgagaagagctccttaatacaccaccagagaactcacacaggcgagaagccatttgaatgctccgagtgccgtaaagcattcgcatggaagcctcagctgttgagacaccagagaatccacacgggggaaaaaccttatgagtgctcagagtgcggtaaagcttttgtccagaaggtccagctgatcaaacaccaacgcaatcatacaggagagaagacctacgggtgttccgattgtgccaaggctttttttgaaaaagcacagttaatcatccaccagcgtatccatacgggagagagaccatacaagtgtggcgagtgtggtaagtcattcacccgtaaaagccatctcatgaggcatcaaaggattcataccggtgataaatactatggctgcaacgagtgcggcacaactttcaataggaaaagtcagctcatgatccatcagaggaatcacattatttag

SEQ ID NO: 21892 - DNA, 2019 bp, Artificial Sequence
  Description of Artificial Sequence: Synthetic coding sequence
atgatccagagccagatcagcttcgaggacgtggccgtggacttcactctggaagaatggcagctcctcaaccctacgcagaagaacctttatagggacgtaatgctcgagaactacagtaacttggtgtttctcggcttccagatcctaaaaccagacgctatgttcaaactcgagcagcaagatccttggattatcgggcaggagatactgaaccagaatttctcagaggtttggctcgacaatcccaagatgtggctcagggacaatcaagacaacctgaagtccatggaaagggggcacaagtatgacgttttcggcaaaatatttaacagcagcatcaatatcgtacatgtgggactgcgcagccacaaatgtggcactggtgagaaatcacttaaatgcccctttgacctactcatccccaagaacaattgcgaaagaaaaaagatcgacgagctgaataagaagcttctgttttgcattaaacccggtaggacacacggcggcattaaatattgcgattgtagcacttgcagaaagtcatctaatgaggagccctggctgaccgccaatcatatcactcatacaggcgtatatttatgcatggagtgtgggagatttttcaacaagaagtcccagctcgttattcaccagcggactcacacaggtgaaaagccctatcagtgttcagagtgtgggaaagcattctctcagaaatctttgctcactgtgcaccagcgaactcactccggagagaagccccacggatgtagtgagtgccagaaagcctttagccggaaatcactgctgattctccatcaacggattcacactggcgagaagccatacggatgctctgagtgcggaaaggcattttcacgcaagagccaacttaagcggcatcaaatcactcacactatcgaaaaaccgtacagctgttccgagtgcggcaaggcattcagccagaagttgaaactgatcactcatcaacgtgctcacactggagagaagccctacccgtgcagccactgcgggaaggcgtttttctggaaaagtcagctcatcacacaccagcgcactcacactggcaagaagccctacggatgcggggaatgtcaaaaagcattttcaagaaactctctgctgattcggcaccaaagaatccacacaggagagaaaccatatgagtgcaatgagtgcggggaagcattcatccggaagccacagttgatcaagcaccagattacccacactggagaaaagaattatagatgtagcgactgcgaggaggccttttttaagaagagcgaactgatccggcaccaaaagattcatctcggggaaaaaccgtacggatgcattcaatgcggtaaaactttttttggcaaatctcagctgctcactcaccacaggacccacactggtgaaaagccctacgaatgcagtgagtgcggcaaggcctttactcagaagtcctccctaattagccatcagcggacccatactggtgagaagccatatgagtgttccgagtgtaggaagacattttccgagaaaagcagcttaatacaccaccagcggacacacacgggtgagaaacccttcgaatgctctgaatgtagaaaagcgttcgcttggaagccccagttgctaagacatcagcgtatccacaccggagaaaagccatatgagtgctcagagtgcggaaaagctttcgtgcagaaggtgcagctgataaaacatcagaggaatcacactggcgagaagacttacggctgttccgactgcgcaaaagccttcttcgagaaagcacaattgatcatccaccagcggattcataccggcgaaagaccgtacaagtgcggcgaatgcggcaagtccttcacccgaaagtcccatcttatgcgccatcaaaggattcacactggagataaatactacgggtgcaacgagtgtggcaccacctttaacaggaagtcacagttaatgattcaccagcggaaccacattatttag

SEQ ID NO: 21893 - DNA, 2091 bp, Artificial Sequence
  Description of Artificial Sequence: Synthetic coding sequence
atgagctacggcagcatcaccttcggcgacgtggccatcgacttctctcaccaagagtgggagtacctgagccttgtgcaaaaaacactgtatcaagaagtcatgatggaaaactatgacaacctggttagcttagccggacactctgtttctaagcctgacttgatcaccctgcttgaacagggaaaagaaccctggatgattgttagagaagagacacgcggggaatgtacggatctggattcaaggtgcgagattatcagcgatgggaaaatgcagctgtatcggaagcacagttgcgtgactctgcatcagcgaattcacaacggccagaagccttacgagtgcaagcagtgtcaaaaatctttttcgcacctgactgaactgatggtccatcagaccatccatacctcagaggaacctgatcagtgtgagaagttccggaaagcgttctcacatctgacagatctccgcaagcatcaaaaaatcaatgcgagagagaagccgtacgaatgtgaggaatgcgggaaggttttctcttacccggccaacctggcacaacacggcaaggttcacgtggaaaagccatacgaatgcaaagagtgtggcgaagcattccgcactagcagacagttgactgtccaccatagattccattacggcgaaaagccttatgaatgcaaggaatgcggcaaagcattcagcgtgtacggaaggctgagccgccaccagtccattcatactggcgagaaaccattcgaatgtaacaagtgtggaaagagctttagactaaaggccggcctgaaggttcaccagagcatacacactggagaaaagccccacgagtgtaaagagtgtggcaaagctttccgccagttcagtcacctggtgggccataaacgcatccacaccggcgaaaaaccatacgaatgcaaagagtgtggtaaagggttcacttgtcgctaccagctgaccatgcaccagaggatctatagcggcgaaaaacactacgaatgtaaggagaatggtgaggcttttagctcaggacaccagttgacggcaccacatacctttgaaagtgttgagaaaccctacaagtgcgaggaatgcggaaaagcgttctctgttcatggcagactcactagacaccagggtatacatagtggcaaaaagccttacgagtgcaacaaatgtggtaagtcatttcggctgaactcctcgctcaaaattcaccaaaatatccacacgggggaaaaaccttacaaatgcaaggaatgcggaaaagccttctcccaaagggcccacctggcacatcataaccggatccatacaggttacaagccctttgaatgcaaagaatgcggtaagtctttccgttgtgcaagctaccttgtgatccacgagcggattcataccggtgaaaagccatacgtatgccaagaatgtggcaaggggttttcctattcgcacaaactcaccattcaccggcgggtgcacacgggtgagaagccatatgaatgtaaagaatgcggcaaagccttcagtgtctccgggcagctgactcagcacttatccatacactccggcaagaaaccttttgaatgtaacaagtgtggaaagtctttccggttcatctccgtgctcaaagcacatcagaacatccatagcgctgagaagccctacgagtgcaaggagtgtggcaaggctttcaggcacgcaacatcgctgatttaccacgacaggacacatgctggggagaaatcttacgagtgcaaagagtgtggcgaaaccttttctcacgcttcacacctgatcatccacgaaaggatccacactagcgacaaaccttatgaatgcaaacgatgtgggaaagcatttcattgcgcctcctatctcgttcgccatgaaagtgtgcacgctgatggaaatccatatatgtgcgaggaatgtggcaaagcctttaacagttcccacgagctatccattcatcacagggtgcacacaggtgagaaaccattcaaatgtaataaatgccggcggagcttccgcctacggtccatccttgaagtgcatcaaagaatccacatatag

SEQ ID NO: 21894 - DNA, 2088 bp, Artificial Sequence
  Description of Artificial Sequence: Synthetic coding sequence
atgagctacggcagcatcaccttcggcgacgtggccatcgacttcagtcaccaggagtgggaatacctctcgttagtgcagaagaccctgtatcaggaggtgatgatggagaattatgataacttggtgtccctcggccactcagtaagcaagcctgacctcatcacccttctggaacagggaaaggaaccgtggatgatcgtgcgtgaggaaacacgaggagaatgtaccgacctagacagtcgatgcgaaatcatctccgatggtaagatgcagttataccggaaacatagctgtgtaaccttgcaccaaagaatccataacggccagaagccttatgagtgtaagcagtgtcagaaatccttttctcatttaactgagttgatggtgcaccagaccattcacacttcagaggagcccgaccaatgtgagaagttccgcaaagcttttagtcaccttactgacctcagaaaacaccaaaagattaacgcacgggaaaagccttatgagtgtgaggaatgtggcaaagtgttttcttatcctgcaaacttggcgcagcatggcaaggtgcatgtggagaagccctacgagtgcaaggaatgcggtgaagcttttcgaacatcacgccaactcacagtgcaccataggtttcactacggggagaagccctacgagtgcaaggaatgcggtaaagcattttccgtgtatgggcggctgtcacgccatcagagcattcacacgggggagaaaccttttgaatgtaataagtgcggaaaaagtttcaggcttaaggctggtctgaaagtgcaccagtctatccacacaggtgaaaaaccgcacgagtgcaaggagtgtggcaaggccttcagacagttttcacacctcgtgggacataagcgtatccacacgggcgaaaagccttacgagtgcaaggagtgcggcaaagggtttacctgccgctatcagctgaccatgcatcagcggatctattcaggcgagaagcattacgaatgcaaggaaaacggtgaggcattcagtagtggccaccagctaaccgcacctcacacctttgagtccgtggaaaagccttacaaatgcgaggaatgtggcaaggctttctccgttcatgggcgcttgactcggcaccagggtatacactctgggaagaagccatatgaatgcaataaatgcgggaagtcatttagacttaactcttcgttgaagattcaccaaaatatccatacaggcgaaaagccgtataaatgtaaggaatgcggcaaggcctttagtcagagggcccacttggctcaccataatagaattcataccggatacaaacccttcgaatgtaaggagtgcgggaagagcttccgctgtgccagttatttagtgatccacgaaagaatccataccggggagaagccttatgtttgccaagagtgcggaaagggcttcagctactcccataaacttacgatccaccgcagagtgcataccggggaaaagccatacgagtgcaaggagtgcgggaaagccttcagcgtgagcggccaactgactcagcatctctccatccacagtggaaagaagccattcgaatgtaataagtgtggcaagagctttaggttcatttccgtgctgaaggcacaccagaatatccattccgctgagaagccctatgaatgcaaggagtgtgggaaggcttttcggcacgccacatcacttatttaccacgatcggacccacgctggagagaagtcctatgagtgcaaggaatgtggtgaaactttcagtcatgctagccacctgattatacacgagcggattcacacatccgataaaccatatgagtgcaaacggtgcgggaaggcctttcattgtgcatcatacctggttcgtcacgagtctgtgcatgcggacggcaacccttacatgtgcgaagaatgcggcaaggcattcaactcctcccacgagctctcaatccaccatcgggtgcacaccggcgagaaaccttttaagtgtaacaagtgtagacgaagtttccggctgagaagtatactggaagtgcaccagcggatacacatctag

SEQ ID NO: 21895 - DNA, 4236 bp, Artificial Sequence
  Description of Artificial Sequence: Synthetic coding sequence
atgagcctgagcagcggcgccagcggcggcaagggcgtggacgccaaccccgtggagacatacgatagcggagacgaatgggacatcggagtggggaacctcataattgaccttgatgcggacttggaaaaagatcagcaaaaacttgagatgagtggatccaaggaggtaggcatcccagcccctaacgctgtggctacattgccggataacattaaatttgttacccccgtcccgggccctcaagggaaggagggtaaaagcaagtccaagcggtcaaagagcggcaaggatacctcaaagcctacccctggaacatccctttttacgccctctgagggagccgcctccaagaaagaggttcagggtaggtccggagatggggctaacgcgggaggcctggtcgcagccattgctcctaaggggagcgagaaagctgcgaaagctagcagatccgtggccggctccaagaaggagaaggaaaattctagtagcaaatcaaaaaaggagaggagtgaaggtgtcgggacctgcagtgagaaagatcccggagttctccagccagtgcctcttggcggtcgcggcgggcaatacgacggaagtgccggggtcgacaccggggcagtggaacctctgggctctattgccatcgaaccgggagctgccttgaatcctctgggtacgaagcccgagcccgaggagggagaaaatgagtgcaggttgctaaagaaggtgaaatccgaaaagatggagtctcctgtgtctacacccgccgtgctgcccattcatctcctcgtgcctgtggtcaacaatgacatcagtagtccttgcgagcagataatggtcaggaccagatctgttggagtgaatacatgtgatgtggcactggctactgagcctgagtgcctgggcccttgcgagcctgggacttctgtcaacctcgaagggattgtgtggcaggaaaccgaagacgggatgttggtggtgaacgtcacctggcggaacaaaacctacgtagggactctacttgactgtacccggcatgactgggcccctcctaggttctgtgactcgccgacatcggatctggaaatgcgaaacggccgtggccgcggtaagcgcatgcggcctaattctaacacaccggtcaatgagacagccacagcatcagatagtaaggggactagcaattcttcaaagacacgcgcgggggcaaattctaagggaaggcgtgggtcgcaaaacagctctgaacacagaccacctgcgtcatctacgagcgaggacgtgaaagcttcccctagcagtgccaataagcgcaaaaataagcctctgagcgatatggagctgaactcctccagcgaggattcgaagggaagcaaacgggtgcgtaccaatagcatgggaagcgcaaccggtccgctgccaggcacaaaggtggaacctaccgtgcttgatcgtaactgcccctctcccgtgctcatcgactgtcctcatcctaattgtaataaaaaatacaagcatataaacggactcaagtaccatcaggcgcacgcccatactgatgacgacagtaagcctgaagccgacggagattccgagtacggagaggaacctatcctgcatgccgatctaggctcatgcaacggcgctagtgtttctcaaaagggctctctgagccctgctagatccgccaccccaaaagtcaggctcgtcgagccacactccccgtccccaagctctaagtttagcactaaaggcctgtgcaagaaaaagctgagtggagaaggcgacacagatctcggggctctttctaacgatggcagtgatgatgggcccagcgtgatggatgaaaccagcaatgacgcttttgattcattagagcgaaaatgcatggagaaggagaagtgcaagaaaccaagtagcttgaagcctgagaaaatcccttccaagtccttaaagtccgcccggccgatcgccccggctatccctcctcagcagatttatacctttcagactgctacattcaccgcagccagccctggctcttcaagtggcttgacggccacggtggcccaggctatgccaaatagcccgcagttgaagcccattcaaccaaagcctactgttatgggggaacctttcacagttaaccctgccctgacgcctgctaaggataagaaaaaaaaggacaagaaaaagaaggagtctagcaaagagttagaatcaccactcacccctggaaaagtgtgccgcgccgaggagggaaagagcccctttcgagagtcctcaggagacggcatgaagatggagggcctgctgaatggaagctctgatccccaccagtcccggcttgcatcaatcaaggccgaagctgacaaaatttattcatttaccgacaacgccccaagcccatccattggcggaagctcacgcttggagaacacaactcccacacaacctctcacacccctacacgtagtaacccagaatggggccgaagcctccagcgttaagactaattcccctgcctactccgatatcagtgatgcgggggaagatggggaaggaaaagtggatagtgtgaagagcaaagacgctgagcagctcgttaaggagggggccaagaaaacacttttcccaccccagccccaatcgaaagattctccctattaccaaggctttgagtcttattactctccttcatacgctcagtcctcccctggcgcattgaacccatcctcacaggcaggagtcgagagccaagccctgaagaccaaacgcgacgaggagcctgaatccatagaaggtaaagtgaagaatgatatctgcgaagaaaagaagcccgagctgtcttcctcaagccagcagccatctgttattcagcaaagacccaacatgtatatgcagtctctgtactacaatcagtatgcctacgtacccccctatggttatagcgaccaatcttaccacactcacttgctgtcaaccaacaccgcatataggcagcaatacgaggaacagcagaaaaggcagagcctggagcagcagcaacgcggagtagataagaaggccgaaatgggccttaaagaacgagaagccgcgctgaaggaagaatggaagcagaagccaagcataccccccactctaacaaaggcccccagcctgactgatctggtcaaatcaggtcccggaaaggccaaggagcctggagcagatcctgcaaaatccgtcatcatcccaaagctcgatgacagcagtaaactccctggccaggctccagaaggcctcaaagtaaaactatctgacgctagccacctgtcgaaggaagcgtcagaagccaagaccggtgccgagtgcggacgacaagctgagatggaccctatcctatggtaccggcaggaagcagaaccgaggatgtggacctacgtgtaccccgctaagtattctgacattaagtctgaggacgagcggtggaaagaggaacgagacaggaaattgaaagaagagagatctaggtctaaagactcggtgcctaaggaagacggcaaggagagtacttccagcgactgcaagctcccaactagcgaagaaagcagattgggatcaaaagaaccaaggcccagcgtgcacgtgccagttagttcaccccttacccagcaccagtcgtatattccttacatgcacgggtactcctattcccagtcttacgatccaaatcacccctcctaccggtcaatgccagcagttatgatgcagaactaccctggatcctatctccccagctcctacagcttctcaccgtacgggtccaaagtctcaggaggcgaggatgctgacaaagccagagcctcgccgtccgtgacctgcaaatcaagcagcgagtccaaggcccttgatatccttcaacaacatgccagtcactataagtccaaaagccccaccatttcagacaagacctctcaagaaagagaccgtggtggttgcggcgtcgtagggggaggcggaagctgtagtagtgtgggaggcgcctcaggaggggagcgaagcgtggaccggccgcgtacttcaccttcccaaaggctgatgtctacccaccatcaccatcaccacctggggtacagcctcctgccggcacagtacaacctaccttatgctgcgggactttcatccacagctattgtcgcgagccagcaaggaagtacgccaagtctctatccgccccccaggcggtag

SEQ ID NO: 21896 - DNA, 1260 bp, Artificial Sequence
  Description of Artificial Sequence: Synthetic coding sequence
atgctgtgcgacgaggaggcccagaagcggaaggccaaggagagcggcatggcgttaccacaagggaggctcacctttatggacgtggccatcgagtttagtcaggaagaatggaagtccttagatccagggcagagggctctgtaccgtgatgttatgctggaaaattaccggaacctcgttttccttgggagatcttgcgtgctggggagcaacgctgagaataaaccaatcaagaaccagcttggcctgacattggaggcccacctgtccgaattgcagctttttcaggcagggagaaaaatctaccggagcaatcaagttgaaaagtttactaaccaccgttcttccgtgtccccgctgcagaagatatctagctctttcactacccatatctttaacaaatatagaaacgacttgatcgatttccctttattgccgcaggaggagaaggcatacataagaggaaagtcctacgagtacgagtgctccgaggacggtgaggtcttccgcgtgagggcgtcactaactaaccaccaggtgattcatactgcagagaaaccttacaagtgtactgagtgtggaaaggtgttttcaagaaattcccaccttgttgagcactggcgtatacatacaggccagaagccatacaaatgcagcgagtgcgacaaggtgtttaatcggaacagcaatctcgctcgccatcagcgaatccacaccggggaaaagccgcataagtgtaacgagtgtggcaaggcttttagggaatgttctggattgacaacccatctggtgatccatactggcgaaaagccatacaagtgtaatgagtgcggcaaaaatttccggcacaagttctcattgacaaaccatcagcgctcacacaccgcagagaagccatataaatgcaacgaatgtggaaaggtcttctccctccttagttacctcgctagacatcagatcattcattccactgaaaaaccgtataagtgtaatgagtgcggccgtgctttccacaaaaggccaggattaatggcacatctcctcatccacacaggggagaagccatataaatgcaacgaatgtgacaaagtctttggcagaaagctgtatctgacgaaccatcagcgaattcacaccggcgaacgcccttacaaatgtaatgcctgtgggaaggtgttcaatcagaatccccatcttagtcgacaccgcaaaattcatgccggcgaaaacagtttacggaccctgcaaatggagtag

SEQ ID NO: 21897 - DNA, 1389 bp, Artificial Sequence
  Description of Artificial Sequence: Synthetic coding sequence
atgctgtgcgacgaggaggcccagaagcggaaggccaaggagagcggcatggcactgcctcaaggcaggcttactttcatggacgttgctatcgaattctcccaggaagagtggaaaagcctggatcctggacaacgggccttatacagagacgtgatgttggaaaactaccgcaatttggtgtttctggggatttgcctgcctgacctcagcatcatctctatgcttaaacagaggcgagaaccactaatcttgcagagtcaagttaaaatcgttaagaacactgatgggcgtgaatgcgtgcgttccgtgaacactggcagaagttgtgtgctgggctcaaatgccgagaacaagccaattaaaaatcagttgggattgacactcgaggctcatttatcagagctccagcttttccaggctgggaggaagatctaccgatccaaccaggtcgagaagtttactaaccataggagttcagttagcccactacagaagattagtagctctttcacgactcacatattcaacaaataccggaacgaccttattgacttccccctgttaccccaagaggagaaggcctacatccgggggaagtcatacgagtatgagtgctcagaagatggcgaggtgtttcgcgtccgcgctagcttgaccaaccaccaagtcattcacacagctgaaaagccctataaatgcacagaatgcggtaaggttttcagtcgtaattcccatcttgtggagcactggcgtattcatacaggccagaaaccttacaaatgtagtgaatgcgataaggtattcaataggaattccaatctggcgcgccaccagcggatccacacgggcgagaagccacataagtgtaacgagtgtgggaaagcctttagggaatgctcgggcctaacaacccacctcgtgattcacaccggcgaaaagccctacaagtgcaacgaatgcgggaaaaattttcgacacaagttttccctgaccaatcaccagcgaagccatacagctgaaaagccatacaagtgcaacgaatgcggaaaagtgtttagtttgctgagctacctagcaagacatcaaattatccattctaccgagaagccgtacaaatgcaatgagtgtggacgagcttttcacaagcgaccaggtctaatggctcacctgttaatacatactggagagaaaccctataaatgcaatgaatgtgataaggtgtttggtagaaagctgtatctgacaaaccatcagcggatccacacgggcgaacgcccctacaagtgcaacgcctgcggaaaagtgttcaaccagaatcctcatttaagccgccatcgcaaaatccacgctggcgaaaatagtcttaggaccctgcagatggagtag

SEQ ID NO: 21898 - DNA, 1389 bp, Artificial Sequence
  Description of Artificial Sequence: Synthetic coding sequence
atgctgtgcgacgaggaggcccagaagcggaaggccaaggagagcggtatggctttacctcagggcaggttaacctttatggacgtggcgatagagttctcccaagaagaatggaagtcgttggatcccggccagcgtgccctgtacagagatgtcatgctggagaactatcgaaatctggtgtttctcggcatctgcctgccggatttgtccattatttccatgctcaaacagcggcgcgagccattgatcctacagtcccaggtgaaaatcgtaaagaatacagacggtcgtgaatgcgttcgatccgttaacactggccgatcctgcgtcctgggatcaaacgctgagaacaaaccaattaagaatcagctgggccttaccctggaggctcatctgtccgagctccaactcttccaagcgggtcggaaaatctatcggagtaaccaggtggaaaaatttacgaatcacagatcaagcgtgtctcccctccagaagatttcttcttcgtttacaactcacatttttaataaatatcggaacgacctgattgatttccctttgctacctcaggaggagaaagcttacatccggggaaagagctacgagtacgagtgctctgaagacggagaagttttccgggttagggcatcactgactaaccatcaggttatccatactgccgagaaaccttacaagtgcactgaatgtggcaaggtgttttcgaggaacagccacctcgtcgaacactggagaattcatacaggccagaaaccgtacaagtgcagcgagtgcgacaaggtattcaaccgcaacagcaatttagctcggcatcagagaatccacaccggagagaaaccacacaaatgtaacgagtgcggaaaggctttccgggagtgctcagggttgacaacacatctggtcattcacaccggagaaaaaccctacaaatgtaatgaatgcgggaaaaattttcgccataagttttccctgacaaatcaccagcgcagtcatacagctgagaagccttacaagtgcaacgaatgcgggaaggtattctcactgctgagttatctagcgcggcatcagatcatccacagcactgagaaaccatacaagtgcaatgagtgcgggcgggccttccataaaagaccaggtctgatggcgcacctgctaatacacacaggcgaaaagccttacaagtgtaatgagtgcgataaggttttcggtaggaagctgtacctgacaaatcaccagcgaatacatactggcgaaagaccgtataagtgtaacgcctgtgggaaagtgtttaatcaaaacccgcacttgtcacgacacaggaagattcacgccggcgagaatagtctgcgcactttacagatggagtag

SEQ ID NO: 21899 - DNA, 1260 bp, Artificial Sequence
  Description of Artificial Sequence: Synthetic coding sequence
atgctgtgcgacgaggaggcccagaagcggaaggccaaggagagcggcatggccctgccacagggccgactcacctttatggatgttgctattgagttcagccaagaggagtggaaaagcctggacccgggccagagagcactatatagagacgtcatgttagaaaactaccgtaatctggtgtttctggggcgctcctgtgtgctcgggagcaacgctgagaacaaacccattaagaaccagctgggacttacacttgaggcccacctgagtgaactccaactatttcaagccggtagaaagatttatcggtccaatcaagtggaaaaatttaccaatcatagaagcagtgtaagccccctccagaagatcagttctagtttcaccacccacatcttcaacaagtatagaaatgacttgatcgatttcccactgctcccgcaggaagaaaaagcatacatccgggggaagagctacgagtatgagtgcagtgaagatggggaggtattcagggttcgagcatctctcacaaaccaccaggttatccacacagctgagaaaccttacaaatgtaccgagtgcggaaaggtcttctcaaggaacagccatctcgtcgaacattggcggatacacactggacagaagccctacaagtgctcagagtgcgacaaagtgtttaaccgcaattctaacctggctaggcaccaacggattcacacaggggaaaagccgcataagtgtaacgaatgcgggaaggccttcagagagtgttcaggcttaacaacacacttggttatacacaccggcgagaagccctacaaatgtaatgagtgcggcaagaattttcggcacaagttctcccttacaaatcaccagcggagccacaccgcagaaaaaccttacaagtgtaatgaatgcgggaaagtcttctcactactcagttacctcgcccgccaccagattattcattcaactgagaagccgtataagtgcaatgaatgcggaagggcctttcacaaaaggccaggactgatggcccatctgctgattcacaccggggagaagccttataaatgtaatgagtgcgacaaagtcttcggacgaaaactctatctgacgaaccaccagcggattcacaccggagagagaccctacaaatgtaacgcgtgtgggaaagtttttaatcagaacccacacctgtctcgtcaccgcaaaatccacgcaggggaaaatagcctgagaaccttacagatggagtag

SEQ ID NO: 21900 - DNA, 2118 bp, Artificial Sequence
  Description of Artificial Sequence: Synthetic coding sequence
atgctgcgggaggaggccgcccagaagcggaagggcaaggagcccggcatggctttgccacaaggcagacttacattcagagatgtggccatcgagtttagcctcgctgagtggaagtgcctgaacccatctcagcgcgccttgtaccgggaagtcatgctagagaattaccgcaacctggaggccgtcgatatcagctcgaaatgtatgatgaaagaagtgctgtcgacaggtcagggcaatacggaggtcatacatactggaacgctccagcgacatgaatcccaccacattggagacttttgcttccaagaaattgaaaaagaaatacacgatatcgagtttcagtgccaggaggatgagcggaacggacttgaagcccctatgactaagatcaagaagttgaccgggtccacagatcagcacgaccaccggcatgcggggaataaacctatcaaggatcagctgggaagctcattttattcccacctgcccgaactgcacatctttcagatcaagggggagattgggaaccagctagagaaatccactaatgacgctcctagtgtctccacattccagcggatcagctgtcggccccaaacccaaataagcaataactatggcaataatcctttaaatagctcactgcttcctcagaaacaagaggttcacatgagggaaaagtccttccagtgcaataaatccgggaaagccttcaattgcagctctctgctgcgcaaacaccagattccccacctgggagacaaacagtacaaatgtgacgtctgtgggaagctgtttaatcacgaacagtatctcgcatgtcatgatcgatgtcacaccgtggagaagccatataagtgtaaagaatgcggaaaaaccttctcccaggagagcagcctgacatgtcatagaagactacacaccggtgtcaagcggtataactgtaacgagtgcggcaaaatttttgggcaaaattcggccctgctcatcgacaaagccatagacacaggcgagaacccctataaatgcaatgagtgcgataaggctttcaaccagcagtctcagctgtcacaccaccgaatccatacgggcgagaagccatataaatgcgaagaatgtgacaaggtctttagcagaaagtctaccattgagactcacaagaggatccacacaggcgagaagccctatcggtgcaaagtttgcgatacagctttcacatggcatagccaactggccagacaccggaggatccacaccgccaagaagacatataagtgcaacgaatgcgggaaaacattctcacataagtcctccctcgtctgccatcaccggttgcacggcggtgagaaatcctacaagtgtaaagtttgcgacaaggcctttgtgtggtccagtcagctcgctaagcatacacggatcgactgcggtgagaagccatacaagtgtaatgagtgcggtaaaactttcggccagaacagcgacttactgatacataaatcgatccacacaggcgagcagccttacaaatgcgacgaatgtgagaaagtcttcagtaggaaatctagcctggagacccacaagataggccacactggcgagaagccttacaagtgcaaagtctgtgacaaggcattcgcctgccactcttatctggctaaacacactcggatccattcaggcgaaaagccatacaaatgcaacgaatgcagtaagacctttagtcatcgatcctacctggtgtgtcaccaccgcgtccacagcggcgagaaaccatacaaatgtaacgagtgctcaaaaaccttttcccggcggtcaagtctccactgccacaggcgtctgcattctggggaaaagccctacaagtgtaatgagtgcgggaatactttccgccactgtagctcactgatttaccatcgccgcctacacacaggagaaaagagttacaagtgcaccatctgtgacaaagcatttgtccgaaattcattactctccagacatacccggatccacactgccgagaagccttataagtgtaacgaatgcggtaaggcctttaaccagcaatcacacctcagccgacaccatcggatccacaccggtgaaaaaccttag

SEQ ID NO: 21901 - DNA, 1911 bp, Artificial Sequence
  Description of Artificial Sequence: Synthetic coding sequence
atgatgaaggaggtgctgagcaccggccagggcaacaccgaggtgatccacaccggcacactgcagcgccatgagagccaccatattggcgatttttgctttcaggagattgagaaggaaattcacgatatagaattccagtgccaggaagatgagcgcaacggcctggaggccccgatgaccaagatcaaaaagctcaccggcagcacggaccagcatgatcatagacatgctgggaataagccaatcaaggatcagttggggtccagcttttacagccacctcccggaacttcacatattccagatcaaaggggaaattgggaatcagctggaaaaaagtactaacgacgcgccctcagttagcacgtttcagaggattagttgcaggccacagacacagatatctaataactatggaaataacccgctgaactcctctctgttgccgcagaaacaggaggtgcacatgcgagagaaatcatttcagtgcaacaaatctggaaaagcatttaactgctcttcactgctgcgcaaacatcagatacctcacttgggcgacaaacagtataaatgcgatgtatgcggcaagttgttcaaccacgaacaatacctggcttgccatgataggtgccacactgtggaaaagccctacaagtgcaaagaatgcggaaagacgttcagccaggagtctagtctcacttgccaccgcagacttcacaccggagtcaaacggtacaactgtaacgaatgtggtaaaatcttcgggcaaaactccgccctgttgatcgacaaggccattgatacaggggagaatccatataaatgtaacgagtgtgacaaggctttcaatcagcagtctcagctgtcccatcaccgcatacacacaggcgaaaagccttacaaatgcgaggagtgtgataaagtgttctcacgcaagtccacaattgaaacgcataagaggatccacaccggcgagaaaccctacaggtgtaaagtgtgcgataccgctttcacgtggcactcacagctcgcacgtcatcggcgcatccatacagccaaaaaaacctacaaatgcaatgagtgcggtaagaccttcagccataagtcctcattggtctgccaccacagattgcatggcggcgaaaaatcttataaatgcaaagtctgcgacaaggcctttgtgtggtcctctcagctcgccaaacacaccaggattgactgcggagagaagccttataagtgtaacgagtgcgggaagaccttcgggcaaaactccgacttactaatccacaagtcgatacacaccggggagcaaccctacaaatgtgacgagtgcgagaaagtgttctccagaaagtcgtctttggaaacgcacaaaatcggacatacaggcgagaaaccttacaagtgtaaagtgtgtgacaaggcttttgcttgtcatagttatctggctaagcatactcgaatccatagcggtgagaagccttacaaatgcaacgaatgtagtaaaaccttttctcaccgctcctatcttgtgtgccaccatagggtgcactctggtgagaagccttataaatgtaatgaatgctcgaaaacattttcccgcagatcctctctacactgccacaggcggctgcacagtggtgagaaaccttacaaatgcaacgaatgcggaaacacattccgacactgttcttctttaatctatcacagaaggctacatactggcgagaaatcctataagtgcactatttgtgataaggccttcgtgcgtaactctttgctgtcccgccacacccggatccacactgccgaaaagccttacaaatgtaatgaatgcggtaaggcctttaatcagcagtcccacctgagcaggcaccaccggattcacactggcgagaaaccctag

SEQ ID NO: 21902 - DNA, 2118 bp, Artificial Sequence
  Description of Artificial Sequence: Synthetic coding sequence
atgctgcgggaggaggccgcccagaagcggaagggcaaggagcccgggatggccctgccgcagggcagactcacttttcgtgatgtagccatcgagtttagcctggcagagtggaaatgtttgaatccttcacaacgagcactgtatagagaagttatgttggagaattaccgcaatcttgaagcagtggacatatcatctaaatgtatgatgaaggaggtgctgagtacagggcagggtaacaccgaggttattcatacagggacactccagaggcatgaaagccatcatattggtgacttttgcttccaagagatcgagaaggagatccatgatatcgagttccagtgtcaagaggatgagagaaatggtctcgaggccccaatgacaaaaattaagaagctgacaggctcaacagatcagcatgaccacaggcatgcggggaataagccgattaaagatcaactgggctcaagtttttactcacatctgcccgaactccatatctttcagattaagggggagatcggcaaccaactagaaaagtctaccaacgatgctccatcagtgagtaccttccagcgaatctcctgtagaccgcaaacgcagatctctaacaactatggcaataatcctctcaatagctcacttttgcctcagaaacaggaggtgcatatgagagagaaaagctttcaatgtaacaagagcggaaaagcattcaactgctcttccctgctcagaaaacaccaaatcccacacctgggtgacaagcagtataaatgtgatgtctgtgggaaactgtttaaccatgaacagtaccttgcctgccacgaccggtgtcacactgtcgaaaagccttataaatgcaaagaatgcggaaagacattttcgcaggagagcagtctgacatgtcacaggaggttgcacacaggagtcaagcgttataattgtaatgagtgcggcaaaatctttgggcagaactcagccttactcattgataaagccatcgataccggggagaacccctacaagtgtaatgagtgcgacaaagccttcaaccagcagagccagctgtcccaccacaggatacataccggcgaaaaaccatacaagtgtgaggaatgcgacaaagtgttctctcggaagtctacaattgagacacacaaaagaattcacactggagagaaaccataccgctgcaaggtgtgtgacaccgcgttcacatggcactctcagctcgcacggcatcgccggatccacactgccaaaaagacctataagtgcaacgaatgcggtaagactttttcgcacaaatcctctctcgtttgtcaccataggttgcatgggggagagaagtcttacaagtgtaaagtttgcgacaaagcctttgtctggtcaagtcagctggcgaagcacacacgaatagattgcggtgaaaaaccgtataagtgcaatgaatgtggcaagactttcggccaaaatagcgatctcctcatccataaatctatccataccggtgagcagccatataagtgcgacgaatgtgagaaggttttttcccgcaagtcgagcttagaaacgcacaaaatcggccatacaggggaaaagccgtacaaatgcaaggtgtgcgacaaggcattcgcatgtcattcctatctggctaaacatacacggatacactctggagaaaaaccctacaagtgtaacgaatgctctaaaactttctctcatcgcagctaccttgtttgtcatcacagagtccacagcggcgagaagccttataaatgcaacgaatgcagcaaaacatttagtaggagatcctccttgcactgtcatagacgcctgcacagtggggagaagccctataaatgtaatgagtgcgggaacacctttagacactgttccagcctcatttaccatagaaggttgcataccggagaaaaatcatataagtgtactatctgtgacaaagccttcgtgcgaaattcgctcctcagccgacacacccgaatccatacagccgagaaaccctacaagtgcaatgagtgtgggaaggctttcaaccagcagagtcacctgagccgccaccatcggatccataccggcgaaaaaccatag

SEQ ID NO: 21903 - DNA, 2118 bp, Artificial Sequence
  Description of Artificial Sequence: Synthetic coding sequence
atgctgcgggaggaggccgcccagaagcggaagggcaaggagcccggaatggcactgccccaaggaagattgacgttccgagatgtcgctatcgaatttagcctggccgaatggaagtgtctgaacccatcacagagagctttgtatagggaggtcatgctcgaaaactaccgcaatctcgaagctgtagacatcagtagcaagtgcatgatgaaagaagtgctgtccaccgggcagggcaatacggaggtgattcacactggaacattacagagacacgagagtcatcatataggagacttctgcttccaggaaatcgaaaaagagatccatgatattgagttccagtgtcaagaagacgaaagaaatggcctggaagcccccatgaccaaaataaaaaagctcactgggtccaccgatcagcacgaccatagacatgctggtaacaagcccattaaggatcaacttggcagtagtttttattcccacttgcctgaactgcacattttccagattaagggcgaaatcggtaaccagctggagaagtcaacaaacgatgcccctagtgtatcaaccttccagaggattagctgtcgaccacaaactcagattagcaacaattacggaaataaccccctgaattcttccctcctccctcaaaagcaggaggttcacatgcgggagaagagctttcagtgcaacaaatccgggaaagcgttcaactgcagcagtctgctgcggaaacatcaaattccacacttaggcgacaagcagtacaagtgcgatgtgtgtggcaagctcttcaaccacgaacagtatctggcttgtcatgaccgctgccataccgtcgaaaagccttataagtgtaaagagtgcggaaaaaccttttctcaggaaagctctctgacatgccatcgcagactgcacacaggagtgaaacggtacaactgtaatgaatgtggaaagattttcggacagaacagcgctctcctgatcgacaaagctatcgatacaggcgaaaatccttacaaatgtaatgaatgtgataaagctttcaatcagcagagccagctgtctcatcaccgaattcacacaggcgaaaaaccctacaaatgcgaagagtgcgacaaagttttttcgcggaagtcaaccattgaaactcacaagcggatacatactggcgagaaaccttacagatgtaaagtgtgtgacacagccttcacctggcatagccagcttgcgcgacacagacgaattcatactgcgaagaagacctataaatgcaatgagtgcgggaagacgttcagtcacaagagctccctagtctgccatcatagattgcacggcggagagaagtcttacaaatgtaaggtgtgcgacaaggcttttgtttggtcttctcaacttgcaaaacacacacgcatcgattgcggagaaaagccttacaagtgcaacgagtgcggtaagaccttcgggcagaattcagatctgttaattcacaagtccattcacacgggcgaacagccatacaagtgcgatgagtgcgaaaaggtgttttctaggaaaagctccttagagacccacaaaatcgggcacactggggagaagccctacaaatgcaaagtctgcgacaaagcctttgcatgtcactcatatttagcaaagcacactaggatccactccggcgagaagccttacaaatgcaatgaatgtagcaaaaccttctcccatagatcctacctcgtgtgccaccatcgggtgcattccggagaaaaaccctacaaatgcaacgagtgcagcaaaaccttcagccggagaagttccctgcattgtcatagacgtctacattctggggagaaaccatacaagtgcaacgaatgcggaaatacctttcgccattgttccagcctcatttatcacaggcgcctccatactggagaaaagagttataagtgcaccatatgcgacaaggccttcgttagaaactcgttactgagccggcatacaagaatccatacagcggaaaagccatacaaatgcaatgagtgcgggaaagcttttaatcaacaatcccatctgtccaggcatcataggattcatactggcgagaagccatag

SEQ ID NO: 21904 - DNA, 1854 bp, Artificial Sequence
  Description of Artificial Sequence: Synthetic coding sequence
atgatcaagagccaggagagcctgaccctggaggacgtggccgtggagtttacctgggaagaatggcagttgttgggacccgcacagaaggacctgtaccgggatgtgatgttagagaactattctaatttagtgtctgtaggatatcaagcttcaaaaccagacgcgctttttaagttggagcagggagagccctggaccgtagaaaatgagatccacagtcagatctgcccagaaattaaaaaagtggacaatcacctgcaaatgcatagtcagaaacagagatgcctgaaaagagttgagcagtgtcataaacataacgccttcggtaatataatccatcaaaggaagtctgacttccccttgcgccagaatcacgacacgtttgatctgcacggaaaaatcctgaaatctaatctcagcctggttaatcagaataaacggtatgagatcaagaactccgtcggagtgaatggtgacggtaaaagtttcctgcatgcaaagcacgaacaattccataatgagatgaattttccagagggcgggaattcagtgaacacaaacagccagtttatcaagcaccagcgcacccaaaacattgataaacctcatgtgtgtaccgagtgcggcaaagcttttttaaagaagtcgcggctgatctaccatcaacgtgtgcataccggcgagaagcctcacggttgttcaatttgcgggaaagcctttagtcgcaaaagcggtctgacagagcaccagagaaaccatacgggagagaaaccctacgaatgtacagagtgcgacaaggctttcaggtggaaaagccagctgaatgcccaccagaaaattcacactggcgagaagagctacatatgctccgactgcggcaaaggattcattaagaaatccagactcattaaccaccagcgcgtgcataccggcgagaaaccccatggctgcagtctctgtggtaaagcgttttcaaagagatcacgcctcacggagcaccaacgaacacacacgggggagaagccctatgagtgtacggagtgtgacaaagccttccgatggaagtctcaactaaacgcccaccagaaggcacacacaggggagaagagttacatttgtagagattgcggcaaaggattcatccagaagggaaatcttattgtccaccagagaatacacacaggagaaaagccatacatctgcaatgagtgtggaaaggggttcatacagaagggtaacctgctaatccaccgccgtacccatactggtgaaaaaccctacgtgtgtaatgagtgtggcaaagggttctcgcagaaaacatgcttgatttcccatcaacggttccacacggggaagacacctttcgtctgcactgaatgtggcaagagttgttcgcataaaagtggcctcattaaccatcaacgcattcacactggtgaaaaaccatacacgtgtagtgattgtggtaaagctttccgtgacaagagttgcttaaatcgtcatcgcagaacccacactggggagcggccatacggctgctctgattgtggtaaggctttctcacacctcagttgcctggtctaccataagggaatgttacatgccagggagaagtgcgttgggtcggtgaaactcgagaacccctgttctgagagccacagcctatcccacaccagagatctgatccaggacaaggatagtgtgaatatggtgactttgcagatgccctccgtggctgcccagacgtccctcacaaacagcgcgtttcaggctgaatcgaaggtagctattgtatcacagcctgttgccagaagtagcgtgagtgctgatagcaggatctgcactgagtag

SEQ ID NO: 21905 - DNA, 1746 bp, Artificial Sequence
  Description of Artificial Sequence: Synthetic coding sequence
atgctggagaactacagcaacctggtgagcgtgggctaccaggcctccaagccagacgcattgttcaagctggagcaaggggagccgtggacagtagagaatgagatccactcccagatctgcccagaaattaagaaggtggataaccatctccagatgcactcacaaaagcagagatgtttaaaacgagtggagcagtgccataaacataacgcttttggaaatattattcatcaaaggaagtctgattttcccttgaggcaaaatcatgacaccttcgacctgcacgggaaaatcctcaagagcaacctatcactggttaatcaaaacaagcgttacgaaatcaagaattccgttggtgtaaacggtgatggaaagtctttccttcatgccaagcatgagcagttccacaacgaaatgaatttcccagagggcggcaactcagtgaatactaactcccagttcataaaacatcagcggacccagaatatagacaagccccatgtgtgcacagaatgcggtaaggcattcctgaagaaatccagactgatttaccaccagagagtgcacaccggtgagaaaccccacggatgtagtatttgcgggaaagctttctccaggaagagtgggcttacagaacatcagcggaaccatacaggtgagaagccttatgagtgcaccgagtgtgataaggctttcagatggaagtcacaactaaacgcccatcaaaagatccacaccggggaaaagtcttacatttgtagtgactgcggaaaagggtttattaagaaaagtagactgattaatcatcagagggtccatacaggagagaaaccccacgggtgctcactctgtggtaaagctttcagtaagcgtagccgactcactgagcatcaaaggacccacacaggtgagaaaccgtatgagtgtaccgaatgtgacaaagcattcagatggaagtcccagctgaacgcgcatcagaaagcacatacaggcgaaaaatcatatatatgtcgggattgcggtaaggggtttatccagaagggtaacctgattgtgcaccagcgtatccatactggcgagaagccgtatatatgtaacgaatgcggaaaaggattcattcagaagggaaatctcctgatacacaggagaacccatactggggagaagccctatgtgtgcaatgagtgcggcaaaggttttagtcagaaaacatgcttgatatcacatcagcgctttcataccggaaagaccccattcgtctgcacggagtgtggtaaatcctgctcccataaaagcggcctcatcaaccaccagaggatccacacgggcgagaagccttatacttgtagcgactgtggtaaagccttcagagataagtcatgtcttaaccgtcatcgccgtactcatacaggggaacgaccttacggctgtagcgattgcgggaaagctttcagtcacctgtcatgccttgtgtaccataaggggatgctacatgccagagagaagtgcgttggctccgtcaagctggagaatccttgttcagagtcccactccctgtcccacaccagggatctcattcaagacaaggactctgtgaacatggtgacccttcagatgccctctgtggccgcccaaacatcattgactaactccgccttccaggcagaatccaaagtcgctattgtcagccagccagttgcccgtagttcggtatctgcagactcccggatttgtaccgagtag

SEQ ID NO: 21906 - DNA, 933 bp, Artificial Sequence
  Description of Artificial Sequence: Synthetic coding sequence
aagcggagccggctgaccgagcaccagcggacccacaccggcgagaaaccctacgagtgcacagaatgtgacaaggcctttcgctggaagtctcaactgaacgcacatcagaaggcacacaccggggagaaatcttacatctgccgcgactgtggaaaagggttcatacaaaaaggtaatctcatagtgcatcagcggatacatacaggtgagaaaccctatatctgcaacgagtgtggaaaaggcttcatacagaagggtaacctcctaatccatcgcaggactcatactggtgaaaaaccttatgtgtgtaacgagtgtggtaagggttttagccagaaaacttgcctgattagccaccaacgcttccataccggtaagacgccattcgtgtgcacagagtgcggcaaatcctgttcacataaaagtggattaatcaatcatcaacggatccatacaggagaaaagccttatacatgctctgactgcgggaaggctttccgggataagtcctgcctaaatcggcaccggcggacacacaccggtgagcgcccttatgggtgcagcgactgcggaaaggctttttcacacctgagttgcttggtgtaccataaggggatgcttcatgccagggagaaatgcgtcggaagtgttaagctggaaaacccatgttcggaaagtcacagtttaagtcacactcgcgacttgattcaagacaaggattctgttaatatggtgaccctccagatgccttctgtcgctgcccagacatctctaacaaattccgcctttcaagccgaatctaaggtcgcgattgtgtctcagcctgtggcccggagcagtgtcagcgccgattctaggttcgcccaaaacaagaaccacatgaatgcagtgaatgtggtcgtgctatcagtaatcaactacattatatag

SEQ ID NO: 21907 - DNA, 1758 bp, Artificial Sequence
  Description of Artificial Sequence: Synthetic coding sequence
atgatcaagacccaggagagcctgaccctggaggacgtggccgtggaattctcttgggaagagtggcagttgttagacactgcacaaaagaacctgtatcgtgacgttatggtggagaattataatcatctcgtgtctttgggctatcagacatctaaacctgatgttctgtccaagctcgcgcacggtcaggaaccctggacaaccgacgccaaaattcagaacaagaactgtccaggaatcggaaaagtggattcccatctgcaagaacattcacctaaccagcggctgctcaagtctgtccagcaatgtaatggccagaatacattaagaaatatcgttcacctgagtaaaacacactttccgattgtacaaaatcacgatactttcgatctgtatcggaaaaatctgaaatcaagcctgtcactgataaatcagaaacggcgacacggtatcaataatcccgttgagttcataggaggcgagaaaactctgctgcacgggaagcacgagagaactcataccaagacgcgcttctcggaaaacgccaagtgcattcataccaaattccaggtttttaaacatcagagaacgcagaaaatcgaaaagcctcatgcatgcatcgaatgtgaacaaacattcctgcgcaagtcccaacttatttaccacgagaacatctgtattcaggagaaccccggatctggacagtgtgagaagctgagccgttcagtgctctttaccaaacatcttaagaccaataccaccgacaagatttgtatccctaatgaatacagaaaaggcagtactgtgaagtccagtctgattacgcaccagcagacccataccgaagagaagtcgtacatgtgctccgagtgcggcaagggtttcacgatgaagcgatatctcatcgcccaccaacggacccacagcggagaaaagccatacgtgtgtaaagagtgcggaaaaggttttaccgtcaagtcgaatctgattgttcatcagcgtacccatacaggagaaaagccatatatttgctctgaatgtggaaaggggttcacgatgaaacggtaccttgtcgtgcaccaacgcacccacacaggcgagaagccatacatgtgctccgaatgcggaaagggatttactgtgaaatcgaacctcatcgtgcaccaacgcagccatacgggggaaaaatcctatatttgttccgaatgtggcaaaggatttactgtaaaaagaacccttgtgatccaccaaaggacgcatactggggaaaaaagctacatatgcaacgagtgcggaaaagggttcaccacaaagcgcacactgatcatccatcaaagaacccacactggggaaaagccctatgagtgcaacgaatgtggaaaggccttttcacagaaaatttgtctgatccagcatgagagatgccacacaggcaaaactccctttgtatgtaccgagtgtggcaaaagctatagccacaagtacggactaatcacacaccagcgaatccataccggagagaaaccatatgagtgcaatgagtgcgggaaggcatttaccaccaaaagtgtactgaatgtgcatcagaggactcataccggagaaagaccctatggctgctctgattgtgagaaagcgttttctcatctctcgaatctggtgaaacataaaaaaatgcatacacgtgagatgggcagaatctcccaggttgaaaatagttgcaatggagagagtcaactcctgccatataaatag

SEQ ID NO: 21908 - DNA, 597 bp, Artificial Sequence
  Description of Artificial Sequence: Synthetic coding sequence
atgatcaagacccaggagagcctgaccctggaggacgtggccgtggaattctcttgggaggaatggcaattgcttgataccgcacaaaagaacctgtaccgagatgtgatggttgaaaattataatcacctcgtttctctgggttaccaaacctcaaaacccgacgtgttaagcaagctggcacacggccaggagccgtggacgacagatgccaaaatccagaacaaaaactgtcccggcatcggcaaagtagattcacatctgcaggaacattcaccaaaccagcgcctcctaaagagtgtgcaacagtgcaatgggcagaacacccttcggaacatcgttcatctgtcaaagacccatttcccaatcgtacagaaccacgacacctttgatctctaccgcaagaatctcaagagctctcttagcctgatcaatcaaaagagaagacacggaatcaacaatcctgtagagtttatcggcgaaacagggtcacttgaaagaccacggcaggccgatcacttacggtccgaggtacaagatcagccaggtcagaggggagagactctttgcttgcttaaaatacacaccaagaattag

SEQ ID NO: 21909 - DNA, 2226 bp, Artificial Sequence
  Description of Artificial Sequence: Synthetic coding sequence
atgaccgcccaggagagcctgaccctggaggacgtggccgtggactttacgtgggaagagtggcagtttctgagccctgctcaaaaggatttatacagagacgttatgctggaaaattacagcaacctggtcgctgtcgggtaccaggcctctaagcctgacgctctctccaagttagaacggggcgaagaaacttgtacaaccgaggatgagatctactctcggatctgttcagactccgggggcgccagcggcggggcttatgcagaaattagaaagatcgacgaccctttgcagcaccatctgcagaaccagtctattcagaagtctgtgaagcagtgccatgaacaaaatatgtttggaaatattgtcaaccagaataaagggcactttttacttaaacaggattgcgatacatttgatctgcatgaaaagcccctcaaaagcaatttgagctttgaaaaccaaaagaggagcagcggcttaaagaatagtgccgaatttaatcgcgatggcaagagtctgttccacgccaaccataaacagttctacacggagatgaaattccccgccattgcaaagcccatcaataaaagccagttcatcaagcagcagaggacccacaatatcgaaaacgcccatgtttgttcagaatgcggcaaggccttcttaaagctttcccaatttattgatcatcagcgcgtacacacaggtgagaagcctcatgtgtgtagtatgtgcggcaaagccttcagcagaaagagtcgactgatggaccaccagcgaactcatacggaattgaagcattacgagtgcaccgaatgcgataagaccttcctgaagaaatcacagctgaatattcaccagaagacccacatgggtggaaagccgtatacctgttctcaatgcgggaaggccttcattaagaagtgcaggcttatctaccaccaaagaacccacacaggagaaaagcctcatggctgctctgtgtgcggcaaggccttctctaccaagttcagtctcactactcaccaaaaaactcatactggcgagaagccatatatctgcagtgaatgcggcaaagggtttattgaaaagcgtcgtctcacagcacatcaccggacacatacaggggagaaacccttcatatgtaacaagtgtggaaagggatttacactgaagaactccctaataactcatcagcagacgcacaccggggagaagctttacacttgctcggagtgtggaaagggcttctccatgaaacattgcctgatggtacatcaacgaacccatacgggagaaaagccctacaagtgcaatgagtgcggcaaaggattcgctcttaagagcccattaatccgccatcagcggactcacacgggagaaaagccctatgtgtgcacagaatgccgcaaggggttcacaatgaagagcgacttgatagtgcaccaacgaacacatactgccgagaagccctacatctgtaatgactgcggaaaaggatttactgtcaagtcccggcttatcgtgcatcagagaacccacacgggagaaaaaccttacgtgtgtggcgaatgtggtaagggcttcccagcaaaaattagattaatgggacaccagcgaactcacactggcgagaagccctatatatgtaatgagtgcggaaaggggtttaccgaaaagagccatctgaatgtgcatcgcagaactcataccggcgaaaaaccatatgtgtgcagcgaatgcggtaagggactcacagggaaaagtatgttaatcgctcaccagagaactcacacaggggagaaaccctatatctgtaacgagtgtgggaaagggtttaccatgaagtcaacgctttccatccaccagcagacccacacgggtgaaaagccctacaagtgtaacgagtgcgacaaaactttccggaagaaaacttgtctgatccagcaccaaaggttccacaccggcaagacttcatttgcttgtacggagtgtgggaaattttccttgagaaagaatgatttgattactcaccagaggattcacaccggagagaagccttataaatgtagcgattgtggaaaggcgtttaccactaagtcggggttgaatgttcaccagagaaagcacactggcgaacggccgtacggctgttccgactgtggaaaggcctttgcccacctatccatcctcgttaaacacaggcgaattcatcggtag

SEQ ID NO: 21910 - DNA, 2196 bp, Artificial Sequence
  Description of Artificial Sequence: Synthetic coding sequence
atgatgcaggcccaggagagcctgaccctggaggacgtggccgtggattttacttgggaggaatggcaatttctcagtcccgctcagaaggacctatatagagatgtcatgcttgagaattattcgaacctggttgccgtgggataccaagcgtcaaagcctgatgcgctcagtaaactggagcggggcgaagagacctgtaccaccgaggacgaaatctactcacgaatatgttctgaaattcgtaagattgacgatcctttgcaacaccacctacagaatcagtccatccaaaagtccgtgaagcagtgtcacgaacagaatatgttcggtaacatcgtcaatcagaataaaggccatttcctgctgaaacaggattgtgataccttcgacctccacgagaagcctctcaagtccaatctgagtttcgagaaccagaagaggtcaagtggtctcaaaaactcagcagagtttaatagggatggaaaatcactgtttcatgcaaatcataagcaattctacactgagatgaaattccccgcaattgctaagcccatcaataagtcccagtttatcaaacaacaaaggacccacaacattgaaaacgcacacgtttgttccgagtgcggcaaggcctttctgaagctaagtcagtttattgaccaccagcgcgttcacacgggggagaagccccacgtctgctccatgtgtggtaaggccttttcccgcaagtctcggcttatggaccaccagcgcacacacaccgagttgaagcattacgagtgtaccgagtgcgacaaaacttttctcaagaaatcacagctgaatatacaccagaaaacacatatgggcggcaagccatatacatgttctcagtgcggaaaagctttcataaagaagtgcagactcatctaccatcagaggacacataccggagagaaaccccacggctgttcagtctgtggtaaagcctttagcaccaaattttcactgacgacacaccaaaaaacccatacgggtgaaaaaccatatatctgcagtgagtgtggcaaggggttcattgagaagcggagactgacagctcatcaccgcacacacaccggcgagaaaccttttatctgcaacaagtgtgggaaaggattcaccctcaaaaatagcctgatcacacaccagcagacacacacgggagagaaactatatacctgcagcgagtgcggtaaggggttttctatgaaacattgcctgatggtgcaccaacgaacacataccggggagaagccctataaatgcaacgaatgtggcaagggctttgcactgaagtccccactaattcgccaccaaaggacccacacaggagagaaaccctacgtctgcacagagtgtagaaagggttttaccatgaagtcggatctgatcgtgcaccagagaactcacacagcagagaagccctacatttgcaacgattgtggtaagggattcacagtaaagagtcgcctgattgtgcaccagcgtacgcacaccggagaaaagccctatgtatgcggtgagtgcggcaaagggttccctgcgaaaatccgcttaatgggacaccagaggacccatacaggtgaaaaaccctacatttgtaatgaatgtggcaaggggttcactgaaaagtctcacttgaacgtccacagacgaacgcacactggtgagaagccttatgtatgtagtgaatgtgggaaaggcctgaccggaaagagcatgctgattgcacatcagaggacccatacaggtgagaagccctatatttgtaacgagtgtggcaagggatttactatgaaatctaccctgagcatccaccagcagacacatactggggagaagccttataaatgcaacgagtgcgacaagacctttagaaaaaagacgtgcctcatccagcaccaacggttccatactggtaagacatctttcgcctgtacagaatgcggtaaattctccctcagaaaaaacgatctaattacgcatcagcgaattcacaccggtgagaaaccctataagtgttctgactgtgggaaggcctttaccactaaaagtggcctcaacgttcaccaaaggaagcacacaggagagcgaccatatggctgttccgattgcgggaaggcatttgcccatctgtccattttagtgaaacaccgccggatccacaggtag

SEQ ID NO: 21911 - DNA, 2058 bp, Artificial Sequence
  Description of Artificial Sequence: Synthetic coding sequence
atgaccgcccaggagagcctgaccctggaggacgtggccgtggactttacctgggaggagtggcaatttttgtcccctgctcaaaaagatctttaccgcgacgtaatgttggaaaactacagcaatctggtggcggttggctatcaggcaagtaaaccggatgccttgtctaagcttgagcgaggggaggagacttgcacaaccgaggatgagatttactcccggatctgtagcgacagtgggggcgccagtgggggcgcctacgcagaaatacgtaagatcgacgaccctcttcagcatcaccttcagaatcagtccatccagaagtccgtgaagcagtgtcatgaacagaacatgttcggtaacattgtaaaccagaacaaagggcactttcttttgaagcaggactgtgataccttcgacctgcacgaaaagcccctgaaatctaatcttagctttgagaatcaaaagaggagtagcggtctgaagaacagcgcggaattcaatcgagacggaaaaagcctgtttcacgcgaaccacaaacagttctacacggaaatgaagttcccagccattgctaagcctatcaacaaatcccagttcattaaacagcaaagaacacataacatcgaaaatgcacacgtatgtagtgagtgtggaaaggcctttcttaagctgagccagttcatcgatcaccagcgcgtacacacgggggaaaagccccatgtctgctcaatgtgtggtaaagcctttagtagaaaatctcgcctgatggaccatcagcgcacacacacggaactgaagcattacgaatgcactgagtgtgacaagacatttcttaagaaatctcagcttaatattcaccagaagacccacatgggcggcaagccgtacacctgttcccagtgcggcaaggccttcattaaaaagtgtcggctcatctaccatcagagaacccacaccggagaaaaaccccacggatgctcggtatgtgggaaagccttcagcacgaaattctctctgacaacccaccaaaaaactcatacaggtgagaagccctacatttgcagcgagtgcggcaaagggtttattgaaaagagaaggcttaccgctcaccaccgaacccataccggcgaaaaaccttttatatgcaataaatgcggcaagggattcaccctgaagaactccctaattactcatcagcagacccacacaggagaaaagctgtacacttgttccgagtgcggcaagggctttagtatgaagcattgccttatggtgcaccagaggacccacacaggcgagaagccctacaaatgcaacgagtgcggcaaaggcttcgccctcaagtctcctcttatccgccatcaacgtacccacacaggggagaaaccgtacgtgtgcactgagtgcaggaagggcttcacaatgaagtcagatctgatagtgcatcaacggacccacaccgcagaaaaaccctacatatgtaatgactgcggcaagggtttcacagtgaaatctaggctaatcgtgcatcagaggacgcataccggagaaaagccctacgtctgcggggagtgcggcaagggatttccagcaaagattcggcttatgggccaccagaggacccacactggggaaaagccctacatctgcaacgagtgcggaaagggttttacaatgaagagcaccctgtccatccatcagcaaacccacacaggagagaaaccctacaagtgtaatgagtgcgataaaacttttcgcaagaaaacgtgcctgatacaacaccagcggttccatacgggcaagacgagttttgcttgcaccgagtgtgggaagttttcacttcggaagaatgacctgataacacaccagagaatccatactggggaaaaaccatacaaatgctctgactgcggcaaggccttcaccactaagagcggactgaatgtgcaccagcggaaacacactggcgagagaccttacggatgcagtgactgcggcaaagcctttgcccatttgagcatcttggttaagcaccgccggattcatcggtag

SEQ ID NO: 21912 - DNA, 2211 bp, Artificial Sequence
  Description of Artificial Sequence: Synthetic coding sequence
atgcggcccgagcccaccaagttctgggaggagagcctgaccctggaggatgtggcagtggatttcacatgggaggagtggcaattcctgagcccagcgcagaaagatctatacagggacgtcatgcttgaaaactactccaatcttgtcgcagttgggtaccaggccagcaagccagatgctctgagtaaattagagcgaggcgaagagacatgcacaactgaagacgagatttacagtcggatatgctcagagatcaggaaaattgacgaccccctccagcatcacctgcagaaccagagcattcagaagagcgtcaagcaatgccatgagcaaaatatgttcgggaacattgtcaaccagaataagggtcactttcttctgaaacaagactgcgacacattcgatctacacgagaagcccttgaagtctaacttatcattcgagaatcaaaagaggtcatctggcctcaagaattcagctgagtttaacagggatggcaaaagcctcttccatgcaaaccacaagcagttctatacagagatgaagttccctgctatagctaagccaattaacaaatcccagtttatcaagcaacagagaacccataacatcgaaaatgcccatgtttgctcagaatgcggtaaagccttccttaagctttctcagttcatcgaccaccagcgcgttcacacaggagaaaaaccccacgtgtgctccatgtgtggaaaagctttctcgcggaagagtagattgatggaccaccagcggacccacacagagctgaaacattatgagtgcacagaatgcgacaagaccttcctgaaaaagtcgcaacttaacatccaccagaagacccatatgggcggtaagccctacacgtgcagtcagtgcggtaaagccttcattaagaaatgccgactgatctaccatcagcgaacccatacaggcgaaaagcctcatggatgtagtgtctgcggcaaagcttttagcactaagttttctctgacgacccaccagaaaactcacactggagagaagccgtatatttgtagtgagtgcggaaaaggattcatcgaaaaacgccggctgacggcgcaccaccggacacacactggcgaaaagccattcatttgcaataagtgcggcaaagggttcaccctgaagaactctctgataactcatcaacaaacccatacaggtgagaagttgtatacatgtagcgaatgtggcaagggattcagtatgaaacactgtcttatggtgcaccagcgcacccatactggggaaaaaccctataagtgtaatgagtgcgggaaagggttcgctttgaagagtcccctgatccgccaccaaagaacgcatactggggagaaaccttacgtctgcactgaatgccgaaaagggtttaccatgaaaagtgacctaatagtgcatcagaggacacataccgctgagaagccctacatttgcaatgactgcggcaaaggcttcaccgtgaagagcagattgattgtgcaccagcggacacacacaggggagaaaccttacgtttgtggggaatgcggaaaagggttccccgctaagatcagactgatgggccaccaacggacacacactggagagaaaccttatatctgcaacgagtgtggcaagggatttacagaaaagtctcaccttaacgtgcaccgtcggacacacacaggcgaaaaaccctacgtttgcagcgaatgtggtaaagggctgacggggaagtctatgcttatagcccaccagcgtacgcatactggagagaagccttacatttgtaatgagtgtggcaaaggatttactatgaaatccaccctatcgattcatcaacagactcacactggagagaagccctacaagtgcaacgaatgcgataagacctttcggaaaaagacatgcctgattcagcatcagaggtttcacaccggcaagacaagcttcgcttgtacggagtgcggtaagtttagcctgagaaaaaacgatttgatcacacatcaaagaatccacaccggagaaaaaccctataaatgctctgactgtggaaaagccttcacaacaaaatcaggcctcaatgtccaccagaggaaacacacaggcgagcggccatatggctgttctgattgtggtaaagcctttgcccacctgagcattttggtgaagcataggcgcatacaccggtag

SEQ ID NO: 21913 - DNA, 2229 bp, Artificial Sequence
  Description of Artificial Sequence: Synthetic coding sequence
atgatgcaggcccaggagagcctgaccctggaggacgtggccgtggattttacctgggaagaatggcagttcctttcccctgcacagaaagacctctaccgggatgtgatgctggagaactattccaacctggtggcagtgggatatcaggcatccaagccagacgccctttcaaagctggagaggggagaggagacctgcacaacagaagatgagatctatagccgcatttgttccgacagcggaggcgcctcaggcggtgcatatgccgaaattcggaagatcgatgatcctttgcagcatcacctccagaatcaatccatccaaaagagtgttaagcaatgccacgagcaaaatatgttcggcaacatcgtcaaccagaacaagggtcatttcttgcttaaacaggactgtgatacctttgacctgcatgagaaacccttgaaatctaatttgagcttcgaaaatcaaaagaggtccagcggactgaagaattctgctgaattcaacagggacgggaagagtcttttccatgccaatcataaacagttttacacggaaatgaagttccccgccattgcgaagcctatcaacaagagtcagtttatcaaacagcaacgaacacacaacatagaaaacgctcacgtttgttccgaatgtggtaaggcttttcttaagctgagccagtttattgaccatcagcgggtgcataccggcgaaaagcctcacgtgtgttccatgtgtgggaaagcattcagccggaaatcccgcttaatggaccaccagcgaacacatacagagctgaagcactatgaatgcaccgaatgcgacaagacctttttaaagaagtcccaactcaatatccatcaaaaaactcatatgggcggaaaaccgtatacatgttcccagtgtggcaaggcgttcatcaaaaagtgtagactgatctaccatcagagaactcataccggggaaaaaccccatgggtgtagtgtctgtgggaaggccttcagcaccaagttcagcctaaccacacaccagaaaactcatacgggcgagaagccgtacatttgcagcgagtgcggaaagggctttatcgagaagaggcgactgaccgcacaccatcggacacacacaggggagaaacctttcatttgtaacaaatgtggaaaaggttttacacttaagaactcgctgatcactcaccagcagacgcacacaggagaaaagctctatacttgcagtgagtgtggtaaagggttctccatgaaacactgcctcatggtccatcagagaacccacaccggggagaaaccctataaatgcaatgagtgtggtaaaggtttcgccttgaaatcgcctctcatcaggcatcagaggacacacaccggtgaaaagccgtatgtttgcacagaatgccgcaagggatttacaatgaagtcagatctaattgtgcaccagcggacacacacagccgaaaaaccatacatctgcaacgactgtgggaagggttttacggtgaaatctcggcttatcgtgcatcaacggacccacactggcgagaaaccctatgtgtgcggcgagtgcggaaagggcttcccagccaaaattcgtcttatgggacaccagcggacccacaccggagagaagccatatatttgcaatgagtgtggcaagggcttcaccgagaaatcacacctgaatgtacatcgccggacacacactggggagaagccctacgtgtgtagtgaatgtgggaagggattgacagggaagtctatgcttattgctcaccagcgcacccacactggggaaaagccctacatctgcaacgagtgcgggaagggatttaccatgaaaagcacactctcgattcaccaacagactcataccggcgagaagccttataagtgtaatgaatgcgataagacatttcgcaagaagacctgtttaatccaacatcagaggtttcacactggaaaaacttccttcgcatgcactgagtgcggaaagttcagtctccgaaagaacgatttaatcacccaccagcgaatccataccggggagaagccatacaaatgctctgattgtggcaaggcatttactactaagagtgggctgaatgtgcatcagcgcaagcacaccggagaacgcccatatggttgttctgactgtggaaaagcctttgctcatctgtccatcctggtcaagcatcggaggatccaccgttag

SEQ ID NO: 21914 - DNA, 2346 bp, Artificial Sequence
  Description of Artificial Sequence: Synthetic coding sequence
atggccacccagggccacctgaccttcaaggacgtggccatcgagttttctcaggaggagtggaagtgcctggaaccagtgcaaaaagccctgtataaggatgtgatgctggagaattatcgaaacctggtcttcctaggaatatcacctaagtgcgtaatcaaggaacttcccccgaccgagaatagcaatactggcgaaaggttccaaaccgtggctttagaaagacaccagagctatgacatcgagaatctgtattttagagaaattcaaaagcatctgcatgacctggagttccagtggaaggacggggagaccaacgataaagaagtccctgttccgcacgagaacaacctgacaggcaagcgcgaccagcattcccagggcgacgtggagaacaaccatatcgagaatcaactgacgtctaattttgagagtcgtctggccgagctgcagaaggtgcagacagaaggcagactgtatgagtgtaatgaaacggagaaaacaggaaataacggctgcttggtctctcctcatattcgggaaaagacgtatgtgtgtaacgagtgtggcaaggcttttaaggcttcaagcagcctgataaatcaccagcggatccatactacagaaaaaccctataaatgtaacgagtgcggaaaagctttccaccgtgcgagcttgctgaccgtacataaagtggtgcatacacgcggtaagtcataccagtgcgatgtgtgtggcaaaatcttcagaaagaattcgtacttcgtcaggcaccagcggtcccacaccgggcagaaaccttatatctgcaatgagtgtggcaaatctttttccaaaagcagtcacctggctgtgcaccagcgcatccatacgggggaaaagccatacaagtgtaacctgtgtgggaagagcttctcacagagagtgcacctaaggctgcatcaaaccgtacataccggtgagcgcccgtttaagtgtaatgaatgcgggaagacctttaaacggtcctccaatcttaccgttcatcaggtcatccatgctggaaagaaaccgtataagtgcgacgtatgtggcaaggcctttcgccatcgctctaatctggtctgccatcgcaggatccatagcggggaaaaacagtacaaatgtaatgagtgtggcaaggtcttttccaagcgtagctcattggctgtacaccggcggatccacacggtcgaaaagccctgtaagtgcaacgaatgcggtaaggttttctcaaaaagatcgagtcttgccgtgcaccagcgcatacacacgggacagaaaacctacaagtgtaataagtgcgggaaggtgtattctaaacacagccatctggcagtgcactggcggattcacacgggcgagaaagcttataaatgtaacgaatgcgggaaagtgttttctatccatagccggctagctgctcatcagagaatccacacaggagagaagccttataaatgtaatgagtgtggtaaagtgttcagtcagcactctcgtcttgcagtccaccggcgcattcacacaggagagaagccatacaaatgcaaagagtgcgggaaggtgttcagcgatcgctctgcattcgccaggcacaggaggatccataccggggaaaagccttacaaatgcaaggagtgtggaaaggttttcagccagtgttctagattgactgtgcataggaggattcatagcggcgagaagccatataaatgcaacgagtgcggtaaggtgtattcacaatatagtcacctggtgggccaccgtagggtacacaccggcgagaaaccatataaatgtcatgagtgtggaaaggccttcaatcaagggagcaccctgaatagacaccagagaattcatacaggcgaaaaaccctataagtgcaaccaatgcggaaactctttctcgcagagggttcacctccgcttacatcaaaccgtgcacactggggatagaccgtacaagtgtaatgaatgcggcaagactttcaaacgtagcagtaacttgaccgctcaccagatcatacatgccgggaagaagccttataagtgcgacgagtgcggaaaagtcttccggcacagtagtcacttggttagtcaccagcggatccacactggcgagaagaggtacaagtgcatcgagtgcggtaaagctttcggtcggctgttcagcctatccaagcaccagcgcatccactccggcaaaaaaccctacaaatgtaacgagtgcggcaagtcttttatatgtcggtctggcctcactaaacacagaattcggcacacgggagagagtttaaccaccaaacttaatgtcacaaggccatag

SEQ ID NO: 21915 - DNA, 2346 bp, Artificial Sequence
  Description of Artificial Sequence: Synthetic coding sequence
atggccacccagggccacctgaccttcaaggacgtggccatcgagttttctcaggaagagtggaaatgtctggaaccagttcaaaaagccctatataaggatgtgatgctcgaaaactatcggaatctcgtgttcctaggcatctcacccaaatgtgtcattaaagagctgccaccaaccgagaatagtaacacgggcgagagattccagacggtcgcactagagaggcatcaaagttacgacatcgagaacctgtattttagggaaatccaaaaacatctccacgacttagagtttcaatggaaagatggagaaacaaatgacaaggaggtcccagttccgcatgagaataacctcaccggcaaaagggaccagcactcccagggagatgtcgagaacaaccacatcgagaaccagcttacctctaactttgaaagtaggctggcagaactccaaaaagtgcagacggaggggcgcctctatgagtgtaacgaaaccgagaaaaccggcaacaatgggtgcttagtgagtcctcacattcgagagaagacttatgtttgcaacgaatgcggcaaagcgtttaaggctagctcaagcctcatcaatcatcagaggatccacacaaccgagaaaccttacaaatgtaatgagtgcggcaaggcctttcacagagccagtctgctaacagtgcacaaagtcgttcacaccagaggaaagtcttatcagtgcgacgtgtgtggcaaaattttcaggaaaaactcctattttgtgagacatcagaggagtcatactggtcagaaaccttatatctgcaacgaatgcgggaaaagcttttccaaatcttcccatcttgcagtgcaccagcggattcacaccggcgaaaaaccgtataaatgtaatctttgcggaaagtcctttagccagcgggtgcatctgcgccttcatcagaccgtgcacactggtgaacgacccttcaagtgcaatgagtgtggaaaaactttcaaaaggtcttcaaacctcactgttcatcaggtgatccacgccgggaagaaaccatataagtgtgatgtgtgtgggaaagcttttaggcataggtcaaatctggtctgtcatagacgcattcactccggtgagaagcagtataaatgcaacgagtgcgggaaagtctttagtaagcggtcaagtctcgcggtgcatcgtcggattcacactgtggaaaagccatgtaaatgcaacgagtgcggaaaggttttctccaagagatcatctcttgccgtccatcagagaattcacactgggcagaagacttacaaatgtaataaatgtgggaaagtttatagtaaacactctcacctggccgttcactggcggatccacaccggtgagaaagcctataagtgtaacgagtgtggcaaggtttttagcattcacagtagactcgcggcccatcagcgcatccatacgggtgagaagccttataaatgcaacgagtgtggcaaggtattttcacagcacagcagactggcagtgcaccggcgtatccacaccggcgagaaaccctataagtgcaaggaatgcggcaaggtctttagcgatagatctgccttcgcccgacataggagaatccacaccggagaaaagccttataaatgcaaggaatgtgggaaagttttcagtcaatgttctagactcacagtacatagacgtatacattccggcgagaagccctataagtgcaatgaatgcgggaaagtgtacagccaatacagtcatctagtagggcaccgccgcgtgcacactggcgagaagccttacaagtgccatgagtgcggcaaagcattcaaccagggctctaccctgaatcggcaccagagaatccacacaggcgagaaaccctataaatgcaatcagtgcgggaactccttttcgcagagggttcacttgaggctgcatcaaacagtccacactggcgatcgcccatataagtgtaatgagtgtgggaagaccttcaaacgttctagtaacctgactgctcaccaaattatccacgccgggaagaaaccgtataaatgcgacgagtgtggcaaagttttccgccacagttcccaccttgtcagtcaccagagaatccacacaggtgaaaagcggtacaaatgcatcgagtgcggcaaagcatttgggcgtctgtttagcctgagcaagcaccagcggatccacagcggcaaaaaaccttacaaatgcaacgagtgcggaaaaagtttcatttgccgatcagggctcactaaacatagaatccgacacaccggagagagtctcaccacaaagttaaacgttacaagaccatag

SEQ ID NO: 21916 - DNA, 2586 bp, Artificial Sequence
  Description of Artificial Sequence: Synthetic coding sequence
atgaaccagcccggcggcgccgccgccccccaggccgacggcgcctctgctgctggacggaaatctacggctagtcgcgagcgactgaaaagaagccaaaagtctacaaaagtggagggccccgagcctgttcctgccgaagcaagtctctcagcagagcaaggtactatgaccgaggtgaaggtaaagacagagctacccgatgactacattcaggaagtcatctggcagggcgaggctaaggaagaaaaaaaggcagtcagtaaggatggaacaagcgatgtgccagcggaaatttgcgtcgtcatcgggggggtcaggaaccagcagacattgggatcctacgagtgcggcatatgcggtaaaaaatacaagtactataattgttttcagacacatgtccgcgcacacagggatacagaggccacttcaggagagggagcctctcagtccaacaactttaggtatacatgcgacatatgcggaaaaaagtataaatattatagctgcttccaggagcatcgcgatttgcacgccgttgacgtgttctcagtcgagggcgcacccgaaaatcgggccgacccatttgaccagggggtcgtggcaacggatgaggtgaaagaagaaccaccggagccattccagaagatcggacccatgaacaacattacatctgatattttcaaaaaaaaggaggtccggcagtgccagaagcgggagaccggcaattatacatgcgagttctgtgggaagcagtacaaatattatacaccataccaggaacatgtggccctgcatgctcccattaagtccgcattcagtcgccgagttgagggcaaagctcagaatcatttcgaggagacgaattccagtagccagaacagttccgagccctacacgtgtggcgcctgtggcatacagttccaattttacaataacttattagagcatatgcagtcacatgcagccgacaatgaaaacaacattgcatctaatcaatctagaagtcccccggccgtcgttgaagagaaatggaagcctcaggcacagcggaattctgctaacaacaccactacctctggtctgactcccaatagcatgatccccgaaaaggaaagacaaaacatcgcggaaaggctcctgcgcgttatgtgcgccgatctgggagcgctcagcgtggtgtccggtaaagagttccttaaactggcacaaactctggtagatagcggggcacgttatggcgcgttcagtgttaccgagatccttggcaacttcaacacattggctctgaagcatttacctaggatgtacaaccaggtaaaagtgaaagtcacctgtgccctcggcagtaatgcctgtttgggcatcggtgtaacttgccactcccagtccgttggtcccgacagttgctacattctcacagcctatcaggccgagggcaaccatattaagtcctatgtgctgggcgtgaagggggccgatatcagagactccggtgacctggtccaccattgggttcagaatgtgttgtccgaatttgttatgtctgaaattcgaaccgtctacgttaccgactgccgcgtgtcaacctcagcctttagtaaggcaggtatgtgcttgcgctgcagtgcttgtgcattgaactccgtggtccagagtgttctctccaagcgaacactgcaagcccggtccatgcacgaggtgatcgagttattgaacgtatgtgaagatctcgcagggagcaccggactggctaaagagaccttcggcagcctggaagagaccagtccacccccgtgttggaacagcgtgactgactcccttctactcgtccacgagaggtacgagcaaatctgcgaattctactcacgggctaagaaaatgaatttaatccagtctctgaataaacacctgctgagcaatctggccgccattcttaccccagttaaacaggctgtcattgagctgagtaatgaatcacaaccaaccctccagttggtgctccctacctatgtgcggttggagaaactcttcaccgcaaaagcaaacgacgcgggcaccgtgagcaaattgtgccatctgtttcttgaagcccttaaggaaaactttaaggtgcatcccgcacataaagtcgcaatgatcctggatcctcagcagaaactgcgaccagtgcccccttatcagcacgaggaaattattggaaaggtgtgtgagctcatcaatgaagtgaaggagtcttgggcagaggaggccgacttcgagcccgccgctaagaagcctcggtccgctgccgtagaaaaccctgccgcccaggaggatgaccgcctgggtaagaatgaggtgtacgattatctgcaagagcccctctttcaggctactccagacctgttccagtattggtcttgtgtgacccagaaacatactaagttagcaaagttggccttttggctcctggcagtccccgcagtcggcgcccgttccggctgcgtaaacatgtgcgaacaggccctcttgatcaagcgtcgcagactactgtctccggaggatatgaataagcttatgtttctgaaaagtaacatgttatag

SEQ ID NO: 21917 - DNA, 1128 bp, Artificial Sequence
  Description of Artificial Sequence: Synthetic coding sequence
atgaaccagcccggcggcgccgccgccccccaggccgacggcgcctctgccgctggccggaaatctacagcctcgcgcgagcggttgaaaagatctcagaaatctaccaaagttgagggacctgagcccgtacccgccgaagccagcttgagtgccgagcagggaactatgacagaagttaaagtgaagaccgaattgcccgacgactacatccaggaggtgatttggcagggcgaggccaaggaggagaagaaggctgtctctaaggatgggacatcagatgtgcctgccgagatatgcgtcgtgatcggtggtgtacgcaaccagcagacgctgggctcttacgagtgtggtatttgtggcaagaaatataagtactataattgcttccagactcatgttcgggcccacagagatacagaggcaaccagcggagaaggggccagccaatccaataactttcgttacacctgtgatatttgcggtaagaaatataaatattactcctgctttcaggaacaccgtgatctccacgcagtggatgtcttcagtgtggaaggcgcaccggaaaaccgcgctgaccccttcgaccagggcgtggttgccaccgatgaggtgaaagaagaacctcccgagccttttcaaaagattggcccaatgaacaacatcacctccgacatcttcaagaaaaaggaggtcagacagtgtcagaagagggaaacaggcaactacacctgtgagttctgtgggaagcagtacaaatactatacaccttatcaggagcacgttgcccttcatgccccaatttccacagcccccggatgggaaccacccgacgatcccgatactggctccgaatgctcacaccccgaggttagccccagcccacgcttcgtagccgccaaaactcaaactaatcagagcgggaagaaggccccagcctcagtggttagatgtgccacattgctccaccgaaccccaccggccactcagacacaaacatttagaactccaaactccggttcaccagcatcgaaagcaactgcagaatcggcattttccagacgggttgaagggaaggcacagaaccatttcgaggaaaccaattcctcttctcaaaactcttag

SEQ ID NO: 21918 - DNA, 2865 bp, Artificial Sequence
  Description of Artificial Sequence: Synthetic coding sequence
atgaaccagcccggcggcgccgccgccccccaggccgacggcgcctccgccgctggccggaagagcactgcctccagggagagactcaagaggagtcagaaatccacaaaagtggagggtccagagcccgtcccggccgaagcttctttatccgcagagcagggaacaatgacagaggtgaaggtgaagactgaactgccggatgattacatccaggaggtgatttggcagggcgaggcaaaggaagagaagaaagccgtgagtaaagatggcacttccgatgttcctgcggagatctgcgtggtgattggcggtgtaagaaatcagcaaaccctagacggcaaggcacccgaaggatctccccacggtggctctgtacgttcacggtattccgggacgtggattttcgaccaagctctcaggtacgccagcggctcgtacgaatgcggaatctgcggtaagaagtacaaatactataattgttttcaaacacatgtccgtgcccatcgcgacaccgaagccacaagtggcgaaggcgcgtcgcagagcaataacttcaggtacacatgcgacatctgcggcaaaaaatacaagtactactcatgtttccaggagcacagagatctccacgcagtcgacgttttttctgtcgaaggagctcccgagaaccgagcagacccgttcgatcagggggtcgtcgccaccgatgaggttaaggaggaaccgcctgagcccttccaaaagatcggccccaagacgggtaactatacatgcgaattctgcggaaaacagtacaaatactacacgccataccaggaacacgtggcgctgcacgctccaattagcacagccccaggctgggagccccctgacgacccagatacaggtagcgagtgcagtcatcctgaggtctcaccttctccacggttcgtggcagccaaaacccagacaaatcaaagcggtaagaaagcacctgcttccgtcgttaggtgtgccacgttgttacaccgcactccgcccgcaacccagactcagaccttcaggactccaaattcaggttccccggcatcaaaggcgactgcagcagaaagtgcgttttccaggagggttgagggcaaggcacagaaccatttcgaagagacaaacagcagctcacagaactctagtgagccatacacttgcggtgcctgtggtatacaatttcagttctataacaacctcctggagcacatgcagtcacacgccgccgacaacgaaaataatatcgcctctaatcagagtaggagcccgcccgcagtggtcgaggagaagtggaagcctcaggcccaaagaaattctgcaaacaacacaaccacatcaggtttgactcccaacagcatgattcccgaaaaggagagacaaaatatcgcagaacggttgctccgcgttatgtgcgccgacctgggtgccctcagcgtcgtctcaggaaaagagtttctgaagctggcgcaaacgctggtggattccggagcacgctacggcgctttctctgtcaccgaaatactaggcaacttcaacactctggcgctgaaacacctgccacggatgtataatcaggtcaaggtcaaggtgacatgcgcattaggatctaatgcatgcttggggattggagtaacgtgccactcccagtccgtgggacccgactcatgctatatcctgactgcttatcaggctgagggaaaccatattaagagttatgtcttaggcgtgaagggagccgacattcgggattccggtgacctggtacaccattgggttcagaatgtcctaagcgagttcgtgatgtccgagattcgcacagtgtatgtcactgactgccgggtctcaacatccgctttcagtaaggccggcatgtgcctcaggtgctccgcctgcgccctgaacagcgtggtccagagcgtcctgagcaagaggacactgcaggctaggagcatgcacgaagtcatcgaactcctaaacgtctgcgaggacttagcagggtccaccgggttggctaaggagacctttgggtcactggaggagacctcacctcctccctgctggaatagtgtgacagacagcctcttactggtacatgaacgctacgaacagatctgtgagttttattcccgagcaaagaaaatgaacctcatccagtcactgaacaagcatcttcttagcaatttggccgcgatcctgacacccgttaaacaggccgtaattgagctgagcaacgagtcccagccaactctgcaactggtgctgcccacatatgtgcgcctggagaagctctttaccgctaaggccaacgacgctggaaccgtaagcaaactgtgccacctgtttcttgaagcccttaaggaaaatttcaaggtacaccctgcccataaagtggcgatgatcctcgatccacagcagaaattgaggcctgtgcccccttaccagcacgaggaaatcatcggcaaggtgtgtgagctgatcaacgaggtaaaggaaagctgggctgaggaggctgatttcgagcccgctgctaaaaaacccagaagcgcagcagtggagaaccccgccgcgcaggaagacgatcgtttgggaaagaatgaggtgtacgattatctgcaggaaccactgttccaggccactcccgacctgttccagtactggtcgtgcgtgactcagaaacacactaagctggcgaaactggccttttggctgctcgccgttcccgctgtaggggcccgatctgggtgtgtcaatatgtgcgaacaggccctcctcatcaaaagacgcagactgttgagccctgaggatatgaacaaactgatgtttcttaagtctaacatgctgtag

SEQ ID NO: 21919 - DNA, 915 bp, Artificial Sequence
  Description of Artificial Sequence: Synthetic coding sequence
atgaaccagcccggcggcgccgccgccccccaggccgacggcgccagtgcagccggaagaaagagtactgccagcagagagaggctgaaaagatcccagaagagcacaaaggttgaggggcccgaaccagttccagctgaagcgagcctgagcgccgagcagggaaccatgaccgaagtaaaggtcaaaaccgaactgcctgatgactatatacaggaagtgatctggcagggcgaagctaaagaggaaaaaaaagccgtgagtaaggatgggacatcagatgttcccgcagagatctgtgtggtgatcggaggtgtacgcaatcagcaaacgctgggttcatacgagtgtggaatttgtgggaaaaaatataaatattacaattgcttccaaacccacgtccgcgcacaccgcgatacagaagccaccagcggtgaaggggccagccaatctaataattttcgctacacctgcgatatatgtggaaagaagtacaaatattactcttgcttccaggagcaccgtgatcttcacgctgttgacgacccattcgaccagggtgttgtcgccacagacgaagtgaaagaagagccacctgaaccgtttcaaaagatagggcccatgaataacattacctctgacatcttcaaaaagaaggaggtccgccagtgccagaagagggaaacaggcaactatacgtgtgagttctgtggaaagcaatataagtattacactccatatcaagagcacgtcgctttgcacgcgcccattaccactcaaacgcagactttcaggacacccaattccggaagcccggcaagtaaagcgacagctgaatccgctttttcaagacgggtcgagggcaaggctcagaaccactttgaagaaaccaactccagttcgcagaactcctag

SEQ ID NO: 21920 - DNA, 1683 bp, Artificial Sequence
  Description of Artificial Sequence: Synthetic coding sequence
atgggccagcccgccccctacgccgagggccccatccagggcggcgacgctggtgaattgtgcaagtgcgatttcctagtctctatttcaattccccagaccagatcagatatccctgccggagctcgccgctcgtctatgggccctcgaagtctggatacttgttggggaaggggaccagaaagacacgtacacaggctcgagtgtaatggggtgatcttcactcatagaaatctgtgcctgcctggcggaaaaacaaagaccgaaaacgaagaaaagactgcccagctgaacattagtaaggagagtgaatctcatagacttatcgtggaagggctgcttatggacgtaccgcagcaccctgatttcaaggaccgcctagagaaatcacagctacacgatactggcaataagaccaaaatcggggattgcacagacttaacagtgcaggatcacgaaagtagcaccactgagcgggaggaaatcgcgaggaagctggaggaatcttcggtgtccactcacctgattaccaaacaaggctttgcgaaagaacaggtgttctacaaatgtggggagtgcggcagttattataacccacacagcgatttccacctccaccaacgggttcatactaatgagaaaccatatacgtgtaaggaatgtggaaagacgttcaggtacaacagtaaactctcccggcaccagaagatccacaccggagaaaagccctattcttgtgaggaatgcggacaagccttctctcagaactcacacctgctccaacaccagaagctgcatggcgggcaaagaccctacgagtgcacggattgtggaaagaccttttcctataatagtaaattaattaggcaccagcgaatacatactggcgagaagccattcaagtgcaaggaatgtggaaaggcttttagctgtagctatgattgcatcatccatgagcgaatacataatggtgagaaaccctatgaatgtaaggagtgcggaaagtctctgtcttcaaactcggtgctgatccagcaccaaaggatccacaccggagaaaaaccctacgagtgcaaagagtgtggtaaggcttttcatcggtcttcagttttcttgcagcaccaaaggtttcatactggggagcagctgtacaagtgtaacgagtgctggaagacattttcctgctcctctcgcttcattgtgcatcaacgaattcacaatggcgagaagccctatgagtgccaggagtgtggcaagaccttttcgcagaaaatcaccttagtccagcatcagagggtccataccggtgagaaaccctacgagtgtaaagaatgtggcaaggctttccggtggaacgcatcttttattcaacatcagaagtggcacacccgtaagaaactgatcaatgggacaggactctcggcagttaagccatactgcccatgtgccattttgagccctctgccgccacaacacacttgtagcgcgctggcaccaccgggcccacctctgtcatctagtcatgcagtggtgttgccaccatctgtacctttcttcttattgctgccatcatccgagaaggcgaacccctcacccgtccaaatagcccatttcttccaggatctagcgtttcctggaaaaagctcacttcaaagtccaaaccctttgagccattcactgtag

SEQ ID NO: 21921 - DNA, 1731 bp, Artificial Sequence
  Description of Artificial Sequence: Synthetic coding sequence
atgctgcagaccgtgtggttccagggcctgggccggaacctgctgttccaggagccagtcacctttgaagatgtggccgtgtattttacacaaaacgagtgggcatctctgcaccctacacagcgggctctgtaccgggaagtcatgctcgagaattatgccaatgtgacctctcttagcgcctttccctttcctaaacctgacctcatatttcagctggagcagggtgaggccgcctggggcccagatccctggacgttagccggcggagaagctctgcggggcatgtgtacaggaggaaaaacgaagaccgagaatgaagagaagacagctcaattaaacatttctaaagagagtgagtcgcacaggctcattgttgaaggactgctgatggatgtgcctcagcacccggattttaaggaccgcctagagaagtcacagctgcacgacaccggtaataagacaaaaatcggggactgcacggatctgacggtgcaagaccacgagtccagtacaactgaacgtgaagagatcgctcggaagctggaggaaagcagcgtcagcacacatctgatcacaaagcagggcttcgctaaagaacaggtcttttataaatgtggtgagtgtgggtcctattacaatccacattcagactttcatcttcatcagagggttcacaccaatgagaagccatacacatgcaaggagtgcggaaaaacattccgatataactcaaaactgagccggcaccagaagatacacaccggtgagaaaccgtacagttgcgaggagtgtgggcaggctttcagtcaaaattcccatctgctgcagcatcagaagttacacggcggtcaacgaccttacgagtgcactgattgcggaaaaacattttcctacaactcgaaactaatccggcatcagcgcattcacacgggagaaaagccctttaaatgcaaggaatgtgggaaggcattttcttgttcgtatgactgtatcatccacgagaggattcacaatggcgagaagccctacgagtgtaaggagtgcggaaaaagcctttcctcgaactccgtgctcattcaacatcagcgtattcacacaggagaaaagccttatgagtgcaaagagtgcggtaaggcattccataggagtagcgtcttcttacaacatcaaaggttccatacaggcgagcagctgtacaaatgcaacgagtgctggaaaacattttcatgtagcagtcgtttcatcgtccatcagaggatccacaatggcgaaaagccttacgaatgccaggagtgtggaaagaccttcagtcagaaaattacattggttcagcaccagcgcgtgcatactggagagaagccatacgagtgtaaggagtgcgggaaggcattccgttggaatgcatctttcattcaacaccaaaagtggcacacacgtaagaaactgatcaatggcacagggttgtccgctgtgaaaccttactgcccctgcgcaatcctcagccccctgcctcctcagcacacttgctcagctctggctccaccaggcccaccactcagcagtagccacgccgttgtgctgcctccctccgtgcccttcttcctactgctccccagctccgagaaagccaatcccagccctgtccagatcgctcacttctttcaggatctagcattccccggcaagtcctccctgcagtcacccaacccgctctcccactccttatag

SEQ ID NO: 21922 - DNA, 1731 bp, Artificial Sequence
  Description of Artificial Sequence: Synthetic coding sequence
atgctgcagaccgtgtggttccagggcctgggccggaacctgctgttccaggagcctgtgacctttgaggacgtagccgtctactttactcagaatgaatgggcgtccttacatcctacccaacgggctctgtaccgtgaggtaatgctggagaattacgccaatgtaacaagtctgtcagcattcccattcccgaaacctgacttgatcttccagctggagcagggcgaagccgcctgggggccagacccctggaccttagccgggggcgaagccctccgcgggatgtgcacgggaggaaagaccaagactgaaaacgaggaaaagactgctcagctgaacatcagcaaggagagtgaatcccaccggttaatcgtagaaggtcttctgatggatgtgccccagcatcctgactttaaggaccggctcgaaaagtcccagctccatgacaccggaaataagactaaaattggtgactgcacagaccttaccgttcaggaccatgaaagctctactaccgagcgtgaggaaatcgcccggaagcttgaggaatcaagcgtttcaacccatctaattacaaagcagggctttgctaaagaacaggtgttttataagtgcggagagtgtggatcatattataatcctcattccgactttcaccttcaccagcgtgttcacactaacgagaagccatacacctgcaaagaatgcggaaagacatttaggtataattccaagctaagccgtcaccaaaagatccatacaggggagaagccctactcatgcgaggaatgtggccaggcttttagtcagaactcccatctgctgcaacatcagaagctccatggcggacaacggccttacgagtgcacagattgcggtaagactttcagctacaattcgaagctgatccgtcatcagagaattcacacaggagagaaaccattcaagtgtaaggagtgcggcaaagccttcagctgcagttacgattgcattatccacgagagaattcacaacggagagaagccgtatgagtgcaaagaatgtggaaaatccctgtctagcaattctgtgctgattcaacaccaaagaatccatacgggagagaagccttacgagtgcaaagagtgtgggaaagcatttcatcggagctccgtctttctccagcatcagcggtttcacacgggagagcagctatacaagtgcaacgagtgttggaagacattctcgtgtagctcacggtttatcgtccaccagaggattcataatggggagaaaccctacgagtgtcaggagtgcggaaaaactttttcgcaaaagattacccttgttcaacaccagagggtgcacaccggagaaaaaccttatgagtgtaaagagtgtggaaaggcatttaggtggaatgcctccttcattcagcatcagaaatggcacacacggaagaagctcattaatggcactgggttatcggccgtaaaaccttattgcccttgtgccatactttctcctctgccccctcagcatacgtgctcagctctggcacccccaggaccacctctaagctcttctcacgcggttgtgctgcccccctctgtacccttcttcctgctgttgccatctagtgagaaagctaatcccagccctgtccagattgctcatttcttccaggatctggcatttccaggtaaatcgagccttcagtccccgaatcctttatctcactcactgtag

SEQ ID NO: 21923 - DNA, 594 bp, Artificial Sequence
  Description of Artificial Sequence: Synthetic coding sequence
atgggccagcccgccccctacgccgagggccccatccagggcggcgacgcgggcgaattgtgtaagtgcaacgaatgctggaaaactttttcctgttcatcccggtttattgtccatcagagaattcacaacggagaaaagccgtacgaatgccaggaatgtggtaagacatttagccagaagattacactggtgcaacaccagagggtgcatacaggtgaaaaaccatatgaatgcaaggagtgtgggaaagctttcaggtggaacgctagtttcattcagcatcagaagtggcacaccaggaaaaagctgataaacggcaccggcctcagcgctgtaaaaccatattgcccctgcgccattctgtcccccctgcccccgcaacatacctgttccgctttagcaccaccaggcccacccttgagcagctcgcatgccgtagttctgcctcctagcgtgcctttctttttgctgctgccgagctctgagaaggcgaacccgagccccgtgcagattgctcacttttttcaggacttggcctttcctggaaagagttcccttcagagcccaaaccccctgtctcacagcctgtag

SEQ ID NO: 21924 - DNA, 1851 bp, Artificial Sequence
  Description of Artificial Sequence: Synthetic coding sequence
atgctgcagaccgtgtggttccagggcctgggccggaacctgctgttccaggagccggtcacctttgaggatgttgctgtctactttacccagaacgaatgggccagcttgcaccctacccaacgcgctttgtacagggaggtcatgcttgaaaactatgccaacgtgacgtccctgtatcccacggctggtggctttccacttgacacagaacggaccgagaaggtccctggtgctttgtcctcattcctgccatctagtagtagtttagaactaattttggctctgctgcccatgtcagcctttcctttccctaaacctgacctgattttccagctcgagcagggggaagcagcatggggcccggatccctggacactagccggaggcgaggcacttcgcgggatgtgtaccggcggaaagacgaagacggaaaatgaagaaaaaacagcgcagttgaatatttcaaaggaaagtgagtcacacaggttgatcgtcgaaggtttactgatggacgtgccacagcaccctgatttcaaagatcgtctcgagaaaagtcagctgcacgacaccggcaataagacgaagatcggcgactgtacagacctgaccgtgcaggatcacgaaagcagtactacagaaagagaagaaattgctcgaaaactggaagagtctagcgtctcaacccacttaatcacaaagcaaggattcgcaaaggagcaggtattttataagtgtggcgagtgcgggagctattacaatccccacagtgattttcatcttcatcaaagagtgcacactaatgagaagccctatacctgtaaagagtgtggtaagacgttccggtataattccaagctcagccggcaccagaaaatccataccggtgagaagccgtacagctgcgaggaatgtggccaggcgttcagtcagaactcgcatctactccagcaccagaagcttcacggaggacagcggccctacgaatgtacggactgtggaaagacgttcagttacaacagcaaacttatccgtcaccagcgcatccacacaggggaaaaaccgtttaagtgtaaagagtgtggaaaggcttttagctgtagttatgactgtatcattcatgagagaatccacaatggagagaagccctacgagtgtaaagaatgtggtaaatctttgtcctccaatagcgtcctcatccagcatcaaaggattcacactggcgaaaaaccctatgaatgtaaagagtgcggaaaggcctttcacaggtcctctgtgtttctgcagcaccagcggttccatacaggagagcagctgtataagtgtaatgagtgctggaagacgttttcatgctcgtcaagatttatagtgcatcaacgcattcataacggggagaagccctatgaatgccaggaatgcggcaaaacctttagccaaaaaattactctggtgcagcaccagcgcgtccatacaggtgagaagccgtacgaatgcaaagagtgcggcaaggcctttaggtggaatgcatcattcatccagcaccaaaagtggcacacaagaaaaaaactgatcaatggcaccggcctctccgccgtgaagccatattgtccatgtgcaattctgtccccgctacctcctcagcacacatgttccgctttggccccgccaggacccccactgagttctagtcacgctgtagtgctcccgccatctgtcccattcttcttgctcttaccttcttcagaaaaggctaacccgtcgcccgtccagatcgcacactttttccaggatctagccttcccaggtaagtctagcctgcagtctccgaatcccctaagtcactctctgtag

SEQ ID NO: 21925 - DNA, 1599 bp, Artificial Sequence
  Description of Artificial Sequence: Synthetic coding sequence
atgaagcccggcgtgatcagccacgcccccgacagcgtggtgcccgcagcattccccttccccaagcctgacctgatcttccaacttgaacagggagaggctgcctggggcccagacccttggacactcgctggaggagaggcgttgcgggggatgtgcaccgggggcaagacaaagactgagaacgaggaaaaaaccgcacaactcaatatcagcaaggagtcagagtcccaccggttgatagtggaaggactgctcatggatgtaccccagcaccccgacttcaaggatcggcttgagaaaagtcagctacatgacaccggtaacaaaacaaagatcggggactgtaccgaccttacagtccaagatcatgagagcagcacaactgagcgggaagagattgctaggaagcttgaagagagcagcgtctccactcacctgattacaaagcagggatttgcgaaagagcaggtattctacaagtgtggtgagtgcggctcatattacaatccccacagtgattttcacctgcaccagcgcgtgcatacaaatgagaagccttatacatgtaaagagtgcggcaaaacctttcgctacaatagcaagctgtctcggcatcagaaaattcacacgggagagaaaccctactcctgtgaggagtgtggccaagcattctctcagaacagccacctgctgcagcaccagaagctacacgggggccagagaccgtatgaatgcaccgattgcggcaaaacattttcttataatagcaagttgatccgccatcaaaggattcacacaggcgaaaagcctttcaagtgtaaggaatgtgggaaggcgttttcctgtagctacgattgtatcatacacgaacgcatccataacggggagaaaccttacgagtgtaaagagtgcggaaagtctctgtcttccaatagcgtgctgatccagcatcaacgcatacacacgggtgaaaagccctatgagtgtaaagagtgtgggaaggctttccaccggtcctcagttttcctgcagcaccaacgctttcacactggagagcagctgtacaagtgcaatgagtgttggaagacgtttagctgtagctcaagattcattgttcatcagagaattcacaatggcgagaagccttacgagtgtcaggaatgtggcaaaaccttctcacagaagattaccttggtccagcatcaaagggtacatactggtgagaaaccatacgagtgtaaagagtgtggtaaagcgtttaggtggaacgccagcttcattcagcaccaaaaatggcacaccaggaagaagctcatcaacggtactggcctctctgctgtcaagccttattgcccatgtgccatcctttctcctttacccccacagcacacctgttccgccctggccccacctggaccccccttgtcatcttctcatgccgtggtactgccgcccagtgttcctttctttcttctactgccgagttcggagaaagcaaaccccagtccagtgcagatcgcacacttcttccaggatttagcattccccgggaaaagttctctccagtctccaaatccattgagtcactccctgtag

SEQ ID NO: 21926 - DNA, 1851 bp, Artificial Sequence
  Description of Artificial Sequence: Synthetic coding sequence
atgctgcagaccgtgtggttccagggcctgggccggaacctgctgttccaggagcccgtaacctttgaggatgttgccgtgtactttacacagaatgagtgggccagcctccaccccacccagcgagccctgtaccgcgaggtgatgcttgagaactacgccaatgtgacaagcctctaccctactgccggggggttccccctggacactgagcggaccgagaaggtgcctggcgccctgtcctctttcctgcccagttcctcttcgctggagctcatcttggccctactcccgatgtccgccttccctttcccaaaacctgacctcatattccaactggaacagggtgaggcagcctgggggcctgatccctggaccttggctggaggagaggcactgcggggtatgtgcactggcgggaagaccaaaacagaaaatgaagaaaaaaccgcacagctgaacattagcaaagagagcgagagccatcgcctgattgtggaaggattgctgatggatgtaccccagcaccctgacttcaaggataggctggaaaaaagccagctacatgacactgggaacaagacaaaaatcggtgattgtaccgatttgactgtgcaggaccacgagtcctccacaacagagcgagaggagattgccaggaagctggaggaatcgtctgtctcaactcacctcatcaccaagcaaggcttcgccaaggaacaggtgttctacaagtgcggagagtgcggaagttactacaatccacactctgactttcatttacatcagcgtgtccacacaaatgaaaaaccctacacctgcaaagaatgtggaaaaaccttccgctataactctaagttatcgaggcaccagaagatccatactggagagaaaccttattcctgcgaggagtgtgggcaagccttcagccagaattcccacctgcttcagcatcagaagctgcacgggggacaacgtccttatgaatgtactgactgcggtaagacgttctcctacaatagcaaactcattaggcaccagcggattcataccggagagaaaccttttaaatgcaaggaatgtgggaaggcttttagctgttcctacgactgcattatacacgagagaatccacaacggcgaaaagccctatgagtgtaaagagtgcgggaaaagcctcagctcaaattctgtgttgatccagcaccaaaggatacatacaggcgagaaaccatacgagtgtaaggagtgcggtaaagcctttcatcgatcatcagtcttccttcaacaccagcgctttcataccggagagcagttatataagtgcaacgagtgctggaagacctttagctgttccagtagattcatagttcaccagcgaattcataacggggagaaaccctatgaatgccaagagtgcggtaaaacattctctcagaagattacactcgttcaacatcaaagggtccacactggggagaaaccttacgagtgcaaggagtgcgggaaggcttttaggtggaatgcgtcgtttatccagcaccaaaagtggcacactaggaaaaagttgatcaatgggaccggtctgtctgctgtgaagccttactgtccttgcgcaatcttgtcgcctctaccacctcagcacacgtgttccgccctggcgccccccgggccaccactgagtagtagccacgccgtagtgttaccaccctctgtgcctttcttcttactgctgcccagctcggagaaagctaacccaagccctgtacagatcgcccactttttccaggatttggccttcccgggcaagtccagcctgcaatcccccaatccactctcacactccctctag

SEQ ID NO: 21927 - DNA, 1704 bp, Artificial Sequence
  Description of Artificial Sequence: Synthetic coding sequence
atgggccagcccgccccctacgccgagggccccatccagggcggcgatgccggggaactctgcaaatgtgacttccttgtctcgatttctattccacagacccggtctgacattcctgcgggcgcccggcggtcatcaatgggcccccggtctctagatacttgttggggccgaggtccagagaggcatgtacacagagtgagtctgctgttgccccgcctggagtgcaatggggtgatcttcactcacaggaatctgtgcttaccaggaggcaaaaccaagacggagaacgaggagaagaccgcacagctgaacatctccaaggaaagcgagagtcaccgactgatcgtggaggggttgttgatggatgtacctcagcaccctgacttcaaagacagattggagaaatctcaattacacgacacaggcaacaaaactaagatcggggattgtacagatcttaccgtccaagatcacgaaagcagcacaaccgagagggaagaaattgcgagaaagctcgaggagagcagtgtttcaactcacctgataaccaaacaaggcttcgccaaagaacaggtgttttataaatgcggagaatgtgggtcttactacaacccacactcggacttccatttgcaccagcgcgtccatacaaacgaaaaaccatacacctgcaaggaatgtggtaaaacctttaggtataattcaaagctgtctagacaccagaagatccacacaggggagaagccgtactcatgcgaggagtgcggacaagctttttcccaaaattcccacctcctgcagcatcagaaattacatggtggacagcgcccctacgaatgcaccgattgtggcaagaccttctcttataacagtaaactgattcgtcatcagcggattcacacaggcgaaaaaccctttaaatgtaaggagtgtggtaaagcgttcagttgtagctatgattgtattattcacgaaagaatccataatggtgagaagccctatgaatgcaaagaatgcggaaagtcactttccagcaatagcgtcctaattcaacaccagaggatccacaccggagagaaaccgtatgaatgcaaagaatgtggtaaagcatttcaccgatctagcgtcttcctgcagcatcagagattccacaccggagaacagctctacaaatgtaacgagtgttggaagaccttttcctgctcatcacggttcatcgtgcaccaaagaattcacaacggcgaaaaaccttatgagtgccaggaatgcggcaagacctttagccagaaaataactctggtgcagcaccagcgggttcacacaggtgaaaaaccctatgaatgcaaggagtgtgggaaggctttcaggtggaatgcttcattcatccagcaccagaaatggcataccaggaaaaagctgatcaacgggacaggtttaagcgccgtcaagccctactgtccgtgcgccattctatctcccttgccgccccagcatacttgttcggccttggcgccaccaggacctccactgtcttcatctcacgctgtggttctgcctccctccgtcccattttttctgttgcttccaagttctgaaaaggctaatccatcccccgtccagatcgctcatttcttccaggatctcgctttcccaggcaagtcttcattgcagtcacccaaccccctgtctcatagtctctag

SEQ ID NO: 21928 - DNA, 474 bp, Artificial Sequence
  Description of Artificial Sequence: Synthetic coding sequence
atgctgcagaccacctggccccaggagagcgtgaccttcgaggacgtggccgtttacttcacccagaaccaatgggcttcactggaccccgcccagcgcgcactgtacggtgaggtaatgctagagaactatgccaacgtggcctctctcgtagcgttcccctttcccaaaccagcgctaatttcacacttggagaggggagaagctccatgggggccagacccctgggacaccgagatcttgagggggatctctcagggcggcgagagttggatcaaaaatgaagggctcgtgatcaagcaggaggcctcagaggagaccgagctgcatagaatgcctgtgggtgggcttctccgtaatgtaagccagcactttgattttaagagaaaagctctcaagcagacttttaacctgaaccccaacctgatcctgagaggaggctctgtggaggtcagatctctgcggccagcctag

SEQ ID NO: 21929 - DNA, 1320 bp, Artificial Sequence
  Description of Artificial Sequence: Synthetic coding sequence
atgctgcagaccacctggccccaggagagcgtgaccttcgaggacgtcgccgtgtattttactcaaaatcagtgggcttccctcgacccggcacagcgggccctctatggagaagtcatgctcgaaaattacgccaatgtggctagtctagtggcatttccattccctaagccggccctgatctctcatctggaaagaggcgaggccccttggggcccagatccatgggacactgagatcctgagggggattagtcagggcggggaatcctggatcaagaacgaaggactagtcatcaaacaggaggcctccgaggaaactgagttgcaccgcatgccagtaggagggcttctgagaaacgtttcacaacacttcgacttcaaacgcaaggccttaaaacagacatttaacctaaatcccaatctgatcctacgaggcggtatgaaattttacgagtgtaaagagtgcggtaaaatcttcaggtataattctaagctgatccgtcatcagatgagccatacaggagaaaagcccttcaagtgcaaggaatgtgggaaggcttttaaaagcagttatgactgcattgttcacgaaaaaaaccacattggagaaggtccatacgagtgcaaggagtgcggcaagggcctgtctagcaatactgccctgacccagcatcagaggatccacacaggagagaaaccttatgaatgcaaggagtgcggaaaagccttccgccgatccgctgcgtacctgcaacatcaacgcctgcataccggcgaaaagctgtacaagtgcaaagagtgctggaaggctttcggttgtaggagcctgttcattgttcaccagaggatacacaccggggagaaaccctaccaatgtaaggaatgcgggaaagcttttacacagaaaattgcctctatacagcaccagcgggtccacacaggagaaaaaccatatgaatgcaaagtctgcggcaaagcgttcaagtggtatggtagtttcgtgcagcatcagaagctccaccccgttgagaagaagcccgtgaaggtgcttggaccatcacttgtgtccccacagtgttcttcaccagcgatccctccagttctgcttcaaggaagctgcagcgcttctgcagtggcagtgccttcgctgacttttccccatgctgtactgattccaacaagtggcaactttttcatgttgctccctacttccgggataccatcttcatctgctcagattgtccgggtcttccagggattgacgcccactgtcaagccttctccggtcatcctgaccccaagcagccattcctcgtag

SEQ ID NO: 21930 - DNA, 1320 bp, Artificial Sequence
  Description of Artificial Sequence: Synthetic coding sequence
atgctgcagaccacctggccccaggagagcgtgaccttcgaggacgtggccgtgtacttcacccagaaccagtgggcgagcttagaccccgcacagcgggccctgtacggcgaggtgatgctcgagaactacgccaacgtcgctagtctggtggcgtttccgtttcctaagcccgctctgatctcacaccttgaaagaggtgaggccccatggggtccagacccatgggacacagagatcttaagaggaattagccaggggggcgaaagctggatcaagaatgagggcctggtcatcaaacaagaagcgtctgaagagactgagctccaccggatgcccgtaggcggcttgctgcgaaacgtttcccagcactttgatttcaagaggaaagccctgaagcaaacctttaatcttaaccccaacttgatcctccgcggaggaatgaaattttacgaatgtaaggaatgtggcaagatatttaggtacaactccaagctgatcagacaccagatgtctcatactggggaaaagccctttaaatgtaaggagtgcggcaaagcctttaaatcttcttacgattgtatcgtgcatgaaaagaaccatatcggcgagggcccatacgagtgtaaagagtgtgggaaaggactaagtagcaacaccgctctgacccagcatcaacggatccacaccggcgaaaaaccttatgagtgcaaagaatgtgggaaagcattccggcgatctgccgcttatctccagcatcagagattgcataccggcgagaagctttacaaatgcaaagaatgttggaaagcttttgggtgcagaagtttatttattgtgcatcagcggattcacaccggtgaaaagccctatcaatgcaaggagtgtggcaaggcattcacacagaaaatcgcgtcgatccagcaccagcgcgtccacacgggggaaaagccctacgaatgcaaggtgtgtgggaaagctttcaaatggtacggctcatttgtccaacatcagaaactccatcctgtggagaaaaagccggtgaaagtgctgggcccttccctggtgtccccacagtgtagtagccctgcaataccgccggttctgttacagggatcgtgttctgccagtgcggtggccgtgccaagccttacattcccccacgccgtactaattcccacgagcgggaacttcttcatgctcctgcctaccagtggtatcccctccagctctgcgcagatagtcagagtgttccaagggctgacacccaccgtaaaaccttctcctgtcatcctcacaccttcatctcattcctcttag

SEQ ID NO: 21931 - DNA, 459 bp, Artificial Sequence
  Description of Artificial Sequence: Synthetic coding sequence
atgctgcagaccacctggccccaggagagcgtgaccttcgaggacgtagcggtgtacttcacgcaaaaccagtgggcatcactggatccggctcagagggctctgtacggtgaggtgatgctggaaaactatgccaacgtggcatctttagttgcatttccctttcccaaacccgcactgatcagtcatttggaacggggggaagctccatggggtccagatccatgggatactgagattctgaggggcataagccagggaggagagagttggataaagaatgagggcctcgttatcaaacaggaggcgagtgaggagacagagctgcatagaatgcctgtgggcggtttgctaagaaacgtgtcacagcacttcgactttaaacgcaaagcccttaagcagacatttaatctgaatcctaacctcatcctgaggggcgggatgaaattctacgaatag

SEQ ID NO: 21932 - DNA, 1425 bp, Artificial Sequence
  Description of Artificial Sequence: Synthetic coding sequence
atggagctgcccagccccgagagcgaggaggtgcacgagccccggctgggggaactactggggaatcctgagggacaatcactaggatccagcccttcacaggacagaggctgtaaacaggtcacagtgacacactggaagattcagaccggtgaaacagcgcaggtgtgcacaaagagtgggcgcaaccatatccttaattccgatctcctgctgctgcagcgcgagctgatcgaaggcgaggccaacccttgcaacatctgcggaaagacattcactttcaatagcgaccttgtcagacatagaatctctcatgctggcgagaagccctacacctgtgaccagtgcggaaaaggatttggacagtcttctcacctgatggaacaccagcgtattcacaccggcgagcgcctatacgtctgtaatgtgtgtggaaaagatttcatccattattctggattgatcgaacatcagagagtccattccggggagaagcctttcaagtgcgcacagtgtggtaaagcattctgtcactcaagcgatctgatccggcaccagcgagtgcatacacgcgaaagaccgttcgagtgcaaggaatgtgggaagggattctcccagagttccctcctgattagacatcagagaattcacaccggtgagcgtccgtacgagtgcaatgagtgcggcaagtcatttatacgttccagctctctgatacggcattaccagattcacaccgaagttaagcagtacgagtgcaaagaatgtggtaaggcttttcgtcacagaagtgaccttatagaacatcagcgcatccataccggcgagcgaccatttgagtgtaatgaatgtggaaaagccttcatcagatcatcgaaattgatccagcaccagaggatccacaccggtgagcggccatacgtgtgcaacgaatgtggaaagaggttctcacaaaccagtaattttacacagcaccagagaattcatacgggagaaaagctgtacgagtgcaatgagtgtggaaaggcctttttcctttccagctacctaatacgccaccagaaaattcatactggcgaaagggtgtacgaatgcaaggaatgcggtaaggcatttctgcagaaggcacacctgactgaacaccagaaaattcattcgggcgaccggccttttgagtgcaaagattgtggtaaagcatttatccagtcatctaaattgctgcttcaccaaataatccataccggcgaaaagccttatgtctgctcttattgtggcaaggcactctttcgggggcagacctcctttaacactaggaagtttatcctgaaaaggtcatcgatgaatgtagtaagcatgggagagatcctgacgcagttacaaactctcaagattatcaagggattcaccaagagggatagcccttag

SEQ ID NO: 21933 - DNA, 1491 bp, Artificial Sequence
  Description of Artificial Sequence: Synthetic coding sequence
atggagctgcccagccccgagagcgaggaggtgcacgagccccggctgggcgaactcctggggaatccggaaggacaaagtctgggcagctcaccctctcaggaccgaggttgcaaacaagtcaccgtaacccattggaaaattcaaacgggcgagaccgcgcaggtttgtacaaaatccgggagaaaccatatcctgaacagcgacctgctgctgctccagcgggagcttattgagggtgaggctaatccatgtaatatttgtggcaaaaccttcacctttaacagtgatctcgtgcggcaccgcataagtcatgcgggagaaaagccttacacctgtgaccaatgcggcaaaggttttggacagagctcacatctcatggagcatcagagaatccacactggagaaagactatatgtttgcaatgtctgcggtaaagatttcatccactattccggtctaatcgagcatcagagagtccactcaggggagaaaccttttaagtgcgcacaatgtggtaaagcattctgccattcttcagacctcatccgacaccagcgcgtgcacactagagagagaccctttgagtgcaaggagtgcggtaaaggtttctctcagtcctccctactgatccgacatcagcgtatacacaccggagagagaccctacgaatgcaatgaatgcgggaaatccttcatccggagttcttcgctgatccgccactaccagattcatactgaggtcaagcaatatgagtgtaaagaatgcgggaaggcctttaggcatcggagtgatcttatcgaacaccaaagaattcacactggtgaacgcccattcgagtgcaacgaatgcggcaaagcatttatccgtagcagtaaactgatccagcaccagcgtatacacaccggcgagcgaccatatgtgtgcaacgaatgtggtaaacgcttttcacaaacaagcaatttcactcagcaccagcgcattcataccggtgaaaagctctacgaatgcaacgaatgcggaaaggctttctttctgtcaagctatctcatacggcaccaaaagattcacactggggaacgcgtgtacgagtgcaaagagtgcggaaaggccttcttgcagaaggctcacttaaccgaacaccagaaaattcactctggcgatagaccattcgagtgtaaggattgtggtaaagccttcatacagtctagcaaacttctgcttcatcagataatccataccggggagaagccgtacgtgtgtagttactgtggaaagggattcatccagcgatccaactttctgcagcatcagaaaatacataccgaagagaaactttacgagtgttcccaatatggccgggacttcaactcaacaacaaacgtcaaaaataatcagcgagtgcaccaggagggcttgtcactctctaaagcacccatacacttaggggaacgctctgtggacaagggcgagcatactgggaacctttag

SEQ ID NO: 21934 - DNA, 1611 bp, Artificial Sequence
  Description of Artificial Sequence: Synthetic coding sequence
atgatcctgctgagcttcgtgagcgacagcaacgtgggcaccggcgaaaagaaggtgacagaagcttggatcagtgaagacgagaacagtcatcgcaccacctccgataggctgaccgtcatggagctgccctctccagagtccgaagaagtgcacgaacctcggctgggtgagctgctaggaaaccccgagggacagtctcttggttcttctccctcccaggacaggggatgtaaacaggtgactgtgacgcattggaaaatccagactggagagacggcacaggtctgcaccaaatctggccgcaatcacattcttaattccgaccttttgcttcttcagagagaactcattgaaggcgaggccaacccctgtaacatttgcgggaaaactttcacttttaattccgatctggtacgccatcggataagccatgccggcgagaaaccctacacgtgcgatcaatgcggcaaagggttcggccagagtagtcaccttatggaacaccaaaggattcacaccggggagagactctacgtgtgcaatgtatgtgggaaggatttcatacactacagcggtctgatcgagcaccaaagagtgcattcaggcgaaaagccattcaagtgcgcacagtgtggaaaagcattttgtcattctagcgatctcattaggcaccagagagtgcacaccagagagaggccctttgaatgtaaagagtgtggtaaaggttttagtcagtcatccctcctgattcgtcatcagcgcatccacactggggaaagaccctatgagtgcaatgaatgtggcaaaagtttcatacgcagctcctctctgattcgacactaccagatacacacggaggttaaacaatacgaatgtaaggagtgtggaaaggcattccggcacagatccgatctgattgaacatcagagaatacacactggcgagcgaccctttgagtgtaacgagtgcggtaaggccttcataaggagcagcaaacttatccaacaccagagaattcataccggcgaaagaccatatgtctgtaacgaatgtgggaagaggttcagtcagacatctaattttacccagcatcaacgaatccataccggcgagaagctatatgagtgcaacgagtgcggaaaggcttttttccttagctcatatttaattagacaccagaagatacacacgggcgagcgagtctacgaatgcaaggagtgcggcaaggctttcttacaaaaagcccacctcacagagcaccagaaaatccacagcggggaccgtccttttgaatgtaaagactgcggaaaggcctttattcaatcttccaagctgctacttcaccagataattcacacgggcgaaaagccgtatgtgtgcagctactgcggcaaaggctttatccagcggtcaaactttctccagcatcagaagattcacactgaagaaaaactatacgaatgcagtcaatacggacgagacttcaatagcaccacaaacgtgaaaaataatcagcgcgtgcaccaggaaggattgagcctctcaaaagccccaattcacttgggagagcgaagcgttgataaaggagaacacactggcaatctctag

SEQ ID NO: 21935 - DNA, 1491 bp, Artificial Sequence
  Description of Artificial Sequence: Synthetic coding sequence
atggagctgcccagccccgagagcgaggaggtgcacgagccccggctgggagaactgctcgggaacccagagggtcagtctctcggcagttcacctagccaggatcgtgggtgtaagcaggtgacagtgacacactggaaaatccaaactggcgagactgcccaggtgtgtactaagtccgggagaaatcatatacttaacagtgacctccttctgctgcagagggaacttatcgagggcgaagcaaatccctgcaatatctgcggcaagacatttaccttcaactctgacttagtgcgtcaccggatcagtcatgcaggggaaaagccctatacatgtgatcagtgcggaaaagggttcggccaatcatctcacctgatggagcatcagagaattcacactggagagcgattgtacgtgtgcaatgtgtgcggcaaggactttattcactactctggcctgattgagcaccagagagtccactcaggcgaaaagccatttaagtgtgcacagtgtggcaaggccttttgccacagcagcgaccttattcggcaccagagagtgcatacgcgggaacgccctttcgagtgcaaagagtgtggcaaaggtttcagccagtcttccttgctcatccggcatcagcggatccatactggggagcgaccgtacgagtgcaacgaatgcgggaaaagtttcattaggtcctctagtcttattaggcattaccagattcacacagaggtaaagcagtatgagtgcaaggagtgtggcaaggccttccggcatagatctgatcttatcgaacatcaacgcatccataccggtgagagaccattcgagtgcaacgaatgcggaaaggcgttcattcgcagttccaagctcattcagcaccaacgaatccataccggggagcggccctacgtgtgtaacgagtgcggcaagcggttttctcaaacgtctaattttacacagcatcagcgaatccatacaggggaaaagctttacgaatgcaacgagtgcggcaaagctttttttctgagctcgtatctaattaggcatcagaaaattcacacaggagagcgagtctacgagtgtaaggagtgcggtaaggccttcctgcagaaagcccatctcaccgaacaccagaaaattcattcaggggaccgaccttttgaatgtaaagactgcggtaaagcgtttatacaatccagcaaacttctcctgcatcagattatacacaccggcgagaaaccgtatgtttgttcatattgcggcaagggtttcattcagcgcagcaactttctgcagcatcaaaagatacacactgaagagaaactctatgagtgcagccagtacggacgggatttcaactctactacgaacgtaaaaaacaatcagagagtgcaccaagagggactgagtctatcaaaggcgccaatacacctgggagagagatctgtagataagggcgagcacactggcaacctgtag

SEQ ID NO: 21936 - DNA, 1611 bp, Artificial Sequence
  Description of Artificial Sequence: Synthetic coding sequence
atgatcctgctgagcttcgtgagcgacagcaacgtgggcaccggcgaaaaaaaagtgacagaggcctggatatcggaagacgagaattctcatcgcacaactagcgaccgattgaccgtcatggagctgccaagcccagagtccgaggaagtccacgaaccaagactgggagaattgctgggaaaccccgaggggcagtccctaggtagctccccctcacaggaccggggctgtaaacaggttacagtgacacactggaaaattcagaccggggaaaccgcgcaggtctgcacgaagtcaggaaggaatcatattctgaactccgatctgctgctactccagcgtgagcttatcgagggtgaagccaacccttgcaatatctgtggtaagactttcacgtttaacagcgacttggtgagacaccggatctcccacgccggagagaaaccttacacttgtgatcagtgcggtaaagggtttggccagtctagccacctgatggaacatcagcggattcacacgggggaacgcttgtatgtctgcaacgtgtgtggaaaggacttcatccactactccggcttgatcgagcatcagcgggtgcattccggggagaagccctttaagtgtgctcagtgtggaaaggctttctgccattccagtgacctaattcgccaccagagagttcataccagagaaaggcctttcgaatgcaaagagtgtgggaaagggttctcacaaagttctctcctcattagacatcagcgaatacacactggggaacggccgtacgaatgtaacgaatgtgggaagtcattcatcaggtcaagctcattgataagacattatcaaattcatacagaggtgaaacagtatgaatgcaaggagtgtggcaaggccttccggcaccggtctgacttgatcgaacatcagcggattcatacgggtgaacggcctttcgagtgtaatgagtgcggcaaggcattcatccggtcatctaagttaatccagcaccaacgcatacacactggcgagcgcccttatgtctgtaacgagtgcggaaagcggttttcccaaacaagtaatttcacacagcaccagcgaatacacactggggaaaaactctatgagtgtaacgaatgcggcaaggctttttttttgtccagctacctcatcagacatcagaaaatccacacaggcgaacgtgtttacgagtgtaaggagtgcggcaaagcatttctgcagaaggctcacctcaccgagcatcagaagattcactctggcgatcggccctttgagtgcaaagactgtggtaaggcctttatccagtccagtaaattgctgctgcatcagataatccataccggtgaaaagccctatgtttgctcctactgcggaaaggggttcatacagcggagcaatttcctgcagcatcaaaaaatacatacggaggagaagctttacgaatgctcacaatacggtcgggattttaactccacaaccaacgttaagaacaatcagagagtgcatcaggagggtctgagtctgtccaaggccccaatccacctgggtgaacgctcggttgataaaggcgagcacaccggaaatctttag

SEQ ID NO: 21937 - DNA, 2598 bp, Artificial Sequence
  Description of Artificial Sequence: Synthetic coding sequence
atgagcctgcaggacagcaccctgagccgggagggcaagcccgagggcgaaatcatggcggcagtatttttttctgttggacggctgtctccggaggtgacccaaccagacgaggacctacacctccaagcagaggagacccaactggtcaaagagagtgttacgtttaaagatgttgccatcgactttactctcgaagagtggaggctgatggaccccacacagcggaacctgcacaaagatgtgatgctggagaattataggaacctcgtctcactcggactggctgtcagtaaacccgatatgatctctcacttagagaatggcaagggcccgtgggtgacggtgcgcgaaatcagtcggatcccataccctgacatggagcccaagcctgccacaaaaaaggctaccagaaccaaggccatcagtgaggacttaagccaggaagccatccttgagaaactaaccgaaaatggactctgggacagccggatggagggactctggaagtggaatgacagaatcctgcgtctgcagaataaccaggagaaccatctttcacagcgaatcattcctcttaaaaagacgcccactagccagcgaggcttcagattcgaaagtatcctgataccagaacctggaatagccaccgaggaacttcactccaggtgccaaacccaagaggagaactttaccgagaatctcaatctgattacggatacacatttgggcaagatcatttgtaaggagatgaaaggctctaaagcaatacgtcagactagcgagctcacactcggaaagaagtctaacaataaagagaaaccatataaatgctccacctgtgagaaagcattccactaccggtctctcttaatccaacatcagcggacccatacgaaagagaagccctatgaatgcaatgaatgtggaaaaaccttttcgcagccaagctatctgtcacagcacaagaagatacataccggcgagaaaccgtacaagtgcaatgagtgcggaaaggcttttatcgccagctcctccctcatggttcatcagcgaatacatacgaaggaaaaaccctatcagtgtaacgtatgcgggaagagtttctcacagtgtgctcggctcaaccagcaccagaggattcagacgggagaaaagccctataagtgtagcgagtgcggcaaagccttcagtgacaagagtaaattggccagacaccaggagactcacaacggtgaaaagccatataaatgcgatgactgtgggaaggcgttcaggaacaaaagctatctgtccgttcaccagaagacacacaccgaggaaaagccttatcagtgtaacgagtgcgggaaatctttcaagaacactactatttttaacgtgcaccaacgcattcacaccggggagaagccgtttagatgcaatgaatgtggtaaagcatacagaagcaattcatcactgatcgtgcacatccgcacacacacaggagagaagccctatgaatgcaacgagtgtggcaaggcgtttaatcggattgctaactttacagaacatcagcgcatacacacaggggaaaagccgtacaaatgtaatgaatgtggaaaagctttcatcaactactcttgcctcactgttcaccatcgtatgcatacaggtgagaagccatacaagtgcacagagtgtggcaaggccttcatgaggtcttccagtctgatcatccatcagcggatccataccgaggagaagccttacctgtgcaacgagtgcggagagagttttagaataaagagccatcttactgtgcatcagcgtattcacaccggcgaaaagccatataaatgtactgactgtgagagagcctttaccaaaatggttaatttaaaggagcaccaaaagattcacaccggtgttaagccatataagtgttatgactgtggcaagagcttccgaacgaaatcctatctcattgtgcaccagcggactcatacaggggaaaaaccgtacaagtgtaatgagtgcgaaaaggccttcactaacaccagtcagctgacagttcatcagcggaggcacaccggcgagaaaccgtacaaatgtaatgagtgcggcaaggtgttcacctccaattctggtttcaatacacaccagaggacgcacacgggcgagaaaccttttaagtgtaatgattgtggcaaagcattctcccagatggtccacgttacagaacatcaaaagatacatagcggtgagaaaccctacaaatgcgacgtgtgtggtaaagccttccggagagggtcctatctgacagttcattggcgtacccatactggtgagaagccgtatacctgtaaagagtgtggcaaggggtgtatcacattatctcagcttactctgcatcaaagaattcataccggggaacgcccctataaatgtgaggaatgcggaaaagcctttcggaccaacagcgactttactgtccatcttcgtatgcataccggggagaagccgtataaatgcaacgagtgtggcaaggcatttaggtcaagctcttcacttaccgtgcatcaaagaattcaccaacgtgaaacccagctcatctag

SEQ ID NO: 21938 - DNA, 336 bp, Artificial Sequence
  Description of Artificial Sequence: Synthetic coding sequence
atgagcctgcaggacagcaccctgagccgggagggcaagcccgagggcgagataatggctgctgtgtttttcagcgttgggaggttgagccccgaggtgacccagcctgacgaagacctgcatctgcaggccgaagaaacacaattggttaaggagagcgttaccttcaaagacgtagctatcgactttacactggaggaatggcggctgatggatccaactcaaaggaatctccacaaagacgtgatgctcgaaaattatcgcaaccttgtttcgttgggcttagccgtgtccaagcccgacatgatttcacatctggaaaatggaaagggctag

SEQ ID NO: 21939 - DNA, 921 bp, Artificial Sequence
  Description of Artificial Sequence: Synthetic coding sequence
atgggcgagcggctgctggagagcaagaaggaccaccagcacggcgaaatcctgactcaggtacctgacgacatgctgaaaaaaaagactccgcgcgttaagagttgcggcgaagtgagtgtagggcatgcttcccttaatcgccatcatcgcgccgacacgggtcacaaaccttatgagtaccaagaatacggccagaaaccctacaagtgcacgtattgcaaaaaagcatttagtgatctcccgtattttagaacgcatgaatgggcccataccggtggaaagccatatgattgtgaggaatgtggcaaaagtttcatttctcgatctagtatccgcaggcaccgaataatgcattccggagacggtccgtacaaatgtaacttttgtggcaaggccctaatgtgtcttagcctttacctcatacacaagcggacacacactggtgaaaaaccctacgaatgtaagcaatgcgggaaagctttctcacactcaggctcattgagaattcacgaacgcactcatactggtgagaagccttacgagtgtagtgagtgtggcaaggccttccactctagtacatgcctgcatgcccacaaaatcacacatacaggggaaaagccatatgagtgcaagcaatgtgggaaagctttcgtgagcttcaattctgtgcgttatcacgagcgtactcacacgggagaaaaaccgtacgaatgtaagcagtgcgggaaggcgtttcggtcagcaagccacttgcgaacccacggaaggacgcatactggggagaaaccgtacgagtgtaaacagtgcggtaaggcctttgggtgcgcaagctctgtcaagatccacgagcgcacacacaccggtgagaagccgtgcagcagcaacacttcaaaagggcagggggaaaaaatcgcatag

SEQ ID NO: 21940 - DNA, 1119 bp, Artificial Sequence
  Description of Artificial Sequence: Synthetic coding sequence
atggacagcgtggtgttcgaggacgtggacgtgaacttcacccaggaagagtgggctctgctcgatccctcccagaaaaacctgtaccgtgatgtaatgcaggaaacgttccgcaatctggcttccgtaggtaagaagtggaaagaccagaagattgaggacgagtacaagaaccctcgacgcaatttacggggtctgatgggggagcggctgctggaaagcaagaaggatcaccagcacggtgaaatcctgacacaggtgcctgatgacatgcttaaaaagaaaaccccgcgcgtgaaaagctgtggggaagtgtctgtcggtcacgccagcctcaatcgacaccacagggcagataccggacacaaaccctatgaatatcaggaatacgggcagaaaccctataaatgtacttattgcaagaaagccttctctgacttaccctactttagaacacatgagtgggcacatactggcggcaagccttatgactgcgaggaatgcggaaaaagtttcatatcacggagcagtattagaagacatcggatcatgcactcgggggatggcccgtacaagtgtaacttctgcgggaaagcgcttatgtgccttagtctttacctaatccacaagagaacccatacaggcgaaaagccctatgaatgcaaacagtgcggaaaagcatttagtcactcgggtagccttagaatccacgagcgcacacacactggagaaaaaccgtacgagtgctcagagtgtggaaaggcatttcactcgtctacctgtttgcacgcccacaaaataacacatactggggaaaagccatacgagtgcaagcaatgcggaaaggccttcgtgagctttaacagcgttcgctaccacgaaagaacacacacaggcgagaaaccttatgagtgcaagcagtgcggcaaggccttcagatccgcctctcacctcagaacccatgggcgaacccacaccggagaaaaaccctacgaatgtaaacagtgcggcaaagcgtttggatgtgcatcctcagtgaagatccacgagcgtacccacactggggaaaagccttgttcttctaatacttcgaaaggacaaggagagaaaatagcctag

SEQ ID NO: 21941 - DNA, 921 bp, Artificial Sequence
  Description of Artificial Sequence: Synthetic coding sequence
atgggcgagcggctgctggagagcaagaaggaccaccagcacggcgagatcctgacccaagtccccgatgacatgctcaaaaagaaaacacccagagttaaatcttgcggggaggtgtccgtaggtcacgcatccctgaacaggcaccaccgagccgacaccggtcataaaccgtatgagtaccaggaatacggacagaaaccttataaatgcacatactgtaagaaggcgttttccgatcttccctactttaggacccacgaatgggctcataccgggggcaaaccctatgactgcgaggaatgcggaaaaagttttataagccggtcttctatcaggcggcaccgcattatgcactctggcgacgggccttataaatgtaacttttgcggcaaggccctgatgtgcctgtccttgtatctgatacacaagagaacgcacacaggcgaaaagccatatgaatgcaaacagtgtgggaaagccttttcacatagtgggtccctccggatccacgagcgaactcacactggtgaaaagccttacgaatgcagtgaatgcggcaaggcttttcactcatcaacatgcctccatgcccacaagataacgcacaccggcgagaaaccatatgagtgtaagcagtgcgggaaggctttcgtgtcatttaacagcgtgcggtatcatgaacggactcacactggcgagaaaccctacgaatgcaaacaatgcggaaaagcatttcgctctgcgagccacctgcgcacccacggtagaacacacacaggagaaaaaccttacgaatgcaaacagtgcggcaaagccttcggatgtgccagctcagtcaagatccacgagcggacccacacaggagaaaagccatgtagcagcaatacctcaaaaggccagggcgaaaagatcgcttag

SEQ ID NO: 21942 - DNA, 279 bp, Artificial Sequence
  Description of Artificial Sequence: Synthetic coding sequence
atgggccccctgcagttccgggacgtggccatcgagttcagcctggaagaatggcactgtctggacactgctcaacgaaatctgtaccggaatgtgatgcttgaaaattactccaatttggtgttcttgggtattaccgtttccaagcccgacctaattacatgcttggagcaaggccgaaagccacttaccatgaagcggaacgaaatgattgctaaacctagcgtgtcctttctacaggtccactctgaaagccagagtcccctccacgacatatag

SEQ ID NO: 21943 - DNA, 1623 bp, Artificial Sequence
  Description of Artificial Sequence: Synthetic coding sequence
atgggccccctgcagttccgggacgtggccatcgagttcagcctggaggaatggcactgtctagataccgcccagcgaaatttataccgcaacgtaatgctggagaactactcaaatctcgtgtttcttggaatcacagtgtcaaagccggacctgatcacgtgcctggaacaggggcgcaaaccgcttactatgaagcgaaacgaaatgatcgccaaaccaagcgtgatgtgtagccactttgcccaggacttatggccggagcagtccatgaaggactcgttccagaaggttgttctgcgacgctatgaaaagtgcgagcacgataacttgcagctcaagaagggttgcataagtgtggacgagtgtaaggttcacaaagaggggtacaatgagttgaaccagtgcttgaccaccacaccacgaaagatttgccagtgcgataaatacgtcaaggtgctccaccagtttcctaactcgaatggccagaagcggggacataccgggaagaaacccttcaagtacatcgagtgtggaaaggctttcaaacagttcagcacactgacaacccataaaaagattcacacgggcggaaagccgtacaaatgtgaggagtgcggtaaggcttttaatcattcctgttctttgacaaggcataaaaagattcacactggtgagaagccctacaaatgcgaagagtgtggcaaagcattcaagcactcatcaaccctaactacgcacaagcgaaatcacaccggggagaagccttacaaatgtgataagtgtgggaaggcttttatgagttctagcacactgtcgaaacacgagatcatccatacagaaaagaaaccctacaagtgtgaagagtgcggtaaagccttcaacaggagcagcaccttgactacccacaagattatccatacgggagaaaagccctataagtgcgaagaatgtgacaaggccttcaagtactcatacactttaacaactcataaacgcatacataccgaggacaagccttacaagtgtgaggaatgcgggaaagcctttaagtactcatcaaccctcacaacgcataagcgtattcacaccggcgagaagccgtacaagtgcgaagaatgtgggaaagcatttaagcggtcatcagacttaacaacacacaaaatcatccacactggcgagaagccctacaaatgtgaggaatgcggaaaggcttttaagtatagctctaacttgaccactcataaaaagatccacacaggagagcggccctacaaatgtgaggagtgcgggaaagcctttaaccaaagctctattcttacaacacaccgtagaattcatacgggtgaaaaattctacaagtgtgaagagtgtgggaaagcatttaagaggtcctcccatctgactacccataagatcatccacacaggtgaaaaattttacaagtgcgaggagtgcgacaaagccttcaaacactttagtaaccttacaacacacaagaaaatccacaccggcaagaaaccttacagatgcgaagagtgtgggaaggcatttaagcacagcagtaagctcactactcacaaacgattccacaccggtgagaagccttaccgttgcgagtag

SEQ ID NO: 21944 - DNA, 1587 bp, Artificial Sequence
  Description of Artificial Sequence: Synthetic coding sequence
atgggccccctgcagttccgggacgtggccatcgagttcagcctggaggaatggcactgcttggacactgcccagcggaacctttaccgcaatgtgatgcttgagaattatagcaacctggtttttcttgggattaccgtttccaagccagacctgatcacctgtttggaacagggacgaaagcccctgactatgaagcgaaatgaaatgattgccaaaccaagtgtcatgtgttcccacttcgcccaggatctttggccggagcaatccatgaaggactcatttcagaaggtggttttgcgacgctatgagaagtgtgaacatgacaacctgcagttaaaaaaagggtgcattagtgtcgatgagtgcaaagttcataaagaaggctacaatgagctcaaccaatgtttgaccacaacaccacggaagatatgccagtgcgataaatatgtgaaagtcttacatcagttccctaattcaaacggacagaagcgcgggcacaccggaaaaaagcctttcaagtacatagaatgcggaaaggcttttaaacagttcagtaccttgaccactcacaaaaaaatccatactggcggcaaaccctataagtgtgaggagtgcgggaaagccttcaatcactcctgttccttaactcggcacaagaagattcacaccggtgaaaaaccctacaaatgcgaggaatgtggcaaagcgtttaagcattccagcaccttgactacccataagcggaatcatacgggagagaagccatacaagtgtgataaatgcggaaaagccttcatgagctcttccactctgtccaaacatgaaatcatccatactgaaaagaagccgtacaaatgtgaggagtgtggaaaagccttcaacaggtcctctaccctcaccacacataagattatacacaccggagaaaaaccctacaaatgcgaggaatgcgataaggctttcaagtatagctacacccttacaacacacaagagaatacacacagaagataaaccatacaagtgcgaggaatgcgggaaagcctttaagtactcctcgacccttacaacccataagagaatccatacaggcgagaaaccctataagtgtgaagagtgcgggaaagctttcaaacggtcctccgaccttacaactcacaaaataatacatacgggcgagaagccctacaaatgcgaggaatgcggcaaggctttcaaatatagtagcaatctgaccactcataagaaaattcacactggggaaaggccctataagtgtgaggaatgtggtaaggcctttaatcaatcttcaattttgaccactcatcgccggatacacacaggggagaagttctataaatgtgaggaatgcgggaaagctttcaaatgcagcagcaacctgacaacccataaaaagatccacactggagagcggccttataagtgtgaggagtgtggaaaagcctttaaccaatcttccatcctgaccacccacgagaggattattttagaacggaacagcaccaacgtgaaaaatgttgccaagccttcttccgggccacacactctactccatattagatag

SEQ ID NO: 21945 - DNA, 1359 bp, Artificial Sequence
  Description of Artificial Sequence: Synthetic coding sequence
atgtgcagccacttcgcccaggacctgtggcccgagcagagcatgaaggacagcttccagaaagtggttttgcgtcgatacgaaaagtgtgagcatgacaatctgcagctgaaaaaagggtgtatcagtgtagacgaatgcaaggtgcacaaggagggctacaatgagctgaatcaatgtctgactacaacccctcggaaaatttgccagtgtgataagtacgtgaaagtgctgcaccagtttcccaacagcaatggacagaaacggggccacacggggaagaaaccctttaaatatattgagtgcggcaaagcgttcaagcagttttccacactgaccactcacaagaagattcataccggcgggaagccttacaagtgtgaggaatgcggtaaggcatttaatcattcctgcagcttaactagacataaaaaaatccacactggagaaaaaccatataaatgtgaagagtgcggtaaagccttcaaacattcctctaccctgactacccacaaacggaaccacaccggcgaaaaaccctacaaatgcgataaatgcggaaaagctttcatgagctcaagcaccctttctaaacacgagattatccatactgagaaaaagccttataagtgcgaggaatgtggtaaggcgtttaatagatctagcaccttgaccacacacaagattatccataccggcgagaaaccgtacaaatgtgaagagtgcgacaaggctttcaaatacagttatactctcaccacacataaacggatacacacagaagataaaccctataagtgtgaggagtgcgggaaagcctttaagtactcaagcactctgaccacccataagcgcattcataccggggaaaaaccctacaagtgtgaagagtgtggcaaagcctttaaaaggtcctcagatttgaccacgcataagattattcataccggcgagaagccatataagtgtgaggagtgtggcaaggcttttaaatactcctccaatttgaccacccataaaaaaattcacaccggagagcggccctataaatgtgaggaatgtgggaaagcgttcaaccagtcctccattttgaccacccatcgcaggatacatactggcgagaagttctacaagtgcgaggagtgcggcaaagcgtttaaatgttcttcgaacctcaccacccacaagaagatccacaccggagagaggccttacaaatgtgaggaatgtgggaaagcattcaaccagagctctattctgacaacccatgagcggattattctcgagcgcaattctacaaacgtaaaaaatgtcgcaaaacctagcagtgggccccataccttacttcatattcggtag

SEQ ID NO: 21946 - DNA, 1587 bp, Artificial Sequence
  Description of Artificial Sequence: Synthetic coding sequence
atgggccccctgcagttccgggacgtggccatcgagttcagcctggaggaatggcactgtctggatactgcccagcggaacctgtacagaaacgtcatgctcgagaattactcgaacctggtttttctgggcattacagtgtcaaagccagacctgatcacctgcctcgagcagggaaggaagccgttgaccatgaaacgcaacgagatgatagccaagccatcggttatgtgttcccatttcgcgcaggacctatggcctgaacagagtatgaaagactctttccagaaagttgtgcttcgtaggtacgaaaaatgcgagcatgataatttacagctgaaaaaggggtgtatatcagtggacgagtgcaaggtccataaagagggttataatgagctgaatcagtgcttaacaaccacacctcgaaaaatctgccagtgcgataagtatgtaaaggtgctccatcagtttcccaattccaacggtcagaagagggggcacacgggcaagaagccgttcaaatacatcgagtgcgggaaggcctttaagcagttttcaacactcaccacccacaagaagattcatactggtggcaagccttacaagtgcgaggaatgtggcaaggcctttaaccacagttgttcactcacacgtcataaaaaaatacacacgggagaaaagccatataagtgtgaggaatgcggtaaggctttcaaacattcgagcactctgacgactcataagaggaaccataccggcgaaaaaccatataagtgcgataaatgtggaaaagcttttatgtcttcaagcaccctctcaaagcacgagatcattcatacggaaaagaagccctacaagtgtgaagagtgtggtaaggcattcaaccgctcctccaccttaaccacccataaaattatacacaccggtgagaagccctataagtgcgaagaatgtgacaaagcctttaagtacagctatacgcttacaacccacaagcggatccatacagaagataagccgtacaagtgtgaggaatgcgggaaagctttcaagtacagctccacgctcacaacacataagcggattcacactggcgagaagccatacaagtgcgaggagtgtgggaaagcattcaagcggagttctgacttaacaactcacaaaatcattcataccggagaaaaaccgtataagtgcgaggagtgtggaaaggcattcaaatacagtagtaatctgactactcataaaaaaatccacaccggggagagaccttacaagtgcgaagaatgcgggaaggcctttaaccagagctccattcttactacacatcgcagaatccacaccggagagaaattctataagtgcgaagagtgcggcaaagcctttaagtgttcatctaatcttacgacccacaaaaaaatccatacaggtgagcgaccctacaagtgtgaagaatgcggtaaagctttcaatcaaagtagcatactgacaacccacgaacgcattatcctggaaaggaacagtacaaacgttaaaaatgtagcaaaaccttcaagcggcccccatactcttcttcatattcggtag

SEQ ID NO: 21947 - DNA, 2610 bp, Artificial Sequence
  Description of Artificial Sequence: Synthetic coding sequence
atggagcccgagaccgccctgtggggccccgacctgcagggccccgagcagagccctaatgacgcacacagaggggccgagtccgaaaatgaagaggaatcgccccgccaggagagctctggcgaagagatcattatgggggatccagcacagtcccctgagtccaaggactctactgaaatgtcactggaaagatctagccaagacccttctgttccgcagaacccacccacgccgttgggacacagcaatccattagaccatcaaattcccctggatccccctgccccagaagttgtgcccactccatctgattggaccaaagcctgtgaagcctcatggcagtggggagctctgaccacatggaactccccacctgtggtgccagccaatgagcctagtctgcgagaactggttcaagggcgccccgcgggggccgagaaaccatacatctgtaatgagtgtgggaagagtttctcccagtggtcaaaattgcttaggcatcagcgcatccacactggtgagaggccgaatacgtgtagtgagtgtggcaaatcattcacgcagagctcccaccttgtccaacaccagagaacacataccggcgaaaagccttacaagtgcccggactgtggtaaatgtttttcttggtcttctaatttggtgcagcaccagaggacacacacaggcgaaaaaccctataaatgcaccgagtgcgagaaggccttcacacaatcaaccaatttgattaaacatcagcggtcccacacaggtgaaaagccttacaagtgtggcgagtgtcgccgcgccttctataggtcatctgacttgatccagcatcaggccacacacactggggagaagccctataagtgccctgagtgtggaaaacggttcggtcaaaatcataacctcctaaaacaccaaaagattcatgccggggagaagccttaccggtgtaccgagtgcggcaagtcattcatccagtcttccgagctaacgcaacatcagcgaacacataccggtgagaagccctatgagtgcctcgaatgcggtaaaagttttgggcacagcagcacgctaattaaacatcaacgaactcacctgcgcgaagaccccttcaagtgcccagtttgcggcaagactttcactctgtccgctacactactccgacaccagcgcacccatacaggtgaacggccatacaaatgccccgagtgcggtaaatcctttagcgtgtcttcaaacctgatcaaccaccagcgaattcaccgcggagagcgcccatacatttgcgcggattgtggaaagtccttcataatgagttctactctaatacgccatcagagaatccacaccggagaaaagccctacaaatgctctgactgcggcaaatcctttatccgctctagccaccttattcagcacagaaggacccacacaggagagaaaccctacaaatgcccagaatgtggcaagagttttagccaatccagcaacctgatcacccacgtgcgaacacatatggacgaaaacttgttcgtctgttctgactgcgggaaagcctttctggaagcccatgagttagagcaacatcgcgttattcatgagagaggaaagactccagcgaggagagctcaaggcgatagcttgctcgggctgggggatccctccttgctgaccccaccaccaggagccaagccccataagtgtttggtgtgcggcaaaggctttaacgatgaaggcatcttcatgcagcaccagcggattcatatcggcgaaaacccctataaaaacgccgatggcctcatcgctcacgcagctcccaagccacctcagctgcggtcccctaggctaccttttcgggggaattcctatcccggggccgcggaaggccgcgctgaagctccgggccagccactgaaaccgccggagggacaagaggggttctctcagcgacggggccttctgagcagtaaaacatacatatgtagtcactgtggagaatcatttctcgatcgcagtgtgctactgcagcatcagttgactcatggaaatgaaaagccatttctgtttcctgattacaggatcggcctcggagaaggcgcaggtccaagcccattcttgagcggaaaaccgttcaaatgccctgaatgcaaacaatcattcgggctcagttccgagctgctgttacatcagaaggttcatgccggtgggaaatccagccagaaatcacccgagcttggtaaatcatccagcgtccttctggaacacttgcgctcacccctgggagcccgaccctatcggtgtagcgattgtcgagcctcctttctggacagggtcgcgctcaccaggcaccaggaaactcacactcaggagaaaccccctaaccctgaagacccgcctcccgaagccgtgactttgtctaccgaccaggaaggagagggggaaacaccaacaccaactgagtctagctcccacggggaaggccaaaaccccaaaactctggtggaggagaagccgtatctgtgtccggagtgcggcgcaggatttacagaggtggccgcactcctattgcaccgcagctgccatccaggcgtgagtctgtag

SEQ ID NO: 21948 - DNA, 1458 bp, Artificial Sequence
  Description of Artificial Sequence: Synthetic coding sequence
atgaacgagtaccccaagaagcggaagcggaagaccctgcacccctcccggtactccgatagttccggaattagccgcattgccgatggttttaacggtattttttcggaccactgttattccgtgtgctccatgcgccagcccgatctgaagtacttcgacaataaggatgacgacagcgacacagagacttccaacgatttaccaaagtttgccgacggtatcaaggcccgaaaccgcaatcaaaattacctcgtgccgagccctgttctgagaatattggaccacacggctttctctacagaaaagagcgccgacatcgtgatttgcgacgaggagtgcgattcacccgaatcagtaaaccaacagacacaggaagaaagcccaattgaagtgcacacagccgaggacgtccccattgccgtggaggtacatgctatttctgaagactatgatatagagacggagaacaatagctctgagtccctgcaggatcagacagacgaggagcctcccgccaaactgtgcaagatactcgataaatcccaggccttgaatgtaaccgctcagcagaagtggcccctcctgagagccaattccagcggcctgtacaaatgtgagctctgtgagttcaattctaagtacttttccgatctgaagcaacacatgatcctgaaacataaacgtaccgactcgaacgtctgcagagtctgcaaagaatccttttccacgaatatgctcctgattgaacatgcaaaactgcatgaggaagacccttacatttgcaaatattgtgactacaagacggttattttcgagaatctatcacaacatattgccgacacccacttttccgaccacttgtactggtgtgaacaatgtgatgtccagttttcttccagtagcgagctgtacctgcactttcaggagcattcatgcgatgaacagtacctttgccagttttgcgagcacgagacaaatgatcccgaagacctgcacagccacgtggttaacgagcatgcctgtaaactgattgaactttctgataaatataataacggcgaacatggtcagtactccctcctcagcaaaattaccttcgacaagtgcaagaacttcttcgtgtgccaggtgtgtggcttcagatctcgattacacacaaatgtcaacaggcatgtggccatcgaacataccaagattttcccccatgtttgcgacgattgtggcaagggatttagttccatgctggagtattgtaaacatttgaatagccacctgtcagagggaatttacttatgccagtactgtgaatactccacaggacagatagaggatctaaagattcatctggactttaaacactcagcggatctgcctcacaagtgttcagactgtctgatgagattcggcaacgaaagagagctgatctctcacctgcctgtccacgagaccacatag

SEQ ID NO: 21949 - DNA, 867 bp, Artificial Sequence
  Description of Artificial Sequence: Synthetic coding sequence
atgaacgagtaccccaagaagcggaagcggaagaccctgcacccctcccggtactctgactctagcgggatctcaagaatcgccgatgggttcaatggtattttctctgaccattgttacagcgtctgctctatgcgccagcccgacctaaagtacttcgacaacaaggatgacgactctgacactgagacatccaacgacctgcccaagttcgccgatggcatcaaggcgagaaatcggaatcaaaattacctcgttcctagcccagtactgagaatcctggatcacacggcctttagtactgagaaatcagctgacattgtgatttgcgatgaagaatgcgattcaccggaaagcgtcaaccagcagacgcaagaagagtctcccatcgaggtgcatacagcagaagacgtgcccattgcagtggaggtccacgcaatatcagaagattatgatatcgagaccgaaaataactcgagtgagtctcttcaagaccaaaccgacgaagaacctcccgctaagctctgcaaaatcctggacaaatcccaggccttgaacgtgactgctcagcaaaaatggccgttactgcgtgccaattcatcaggactgtacaaatgtgagctgtgcgaattcaactccaaatactttagcgaccttaaacagcacatgatcctaaagcacaaacggacagactccaacgtgtgccgagtttgcaaagaatccttctcgacaaatatgttactaatcgaacatgccaaactgcacgaggaagatccctacatctgcaagtactgtgattataagaccgtcattttcgagaacttaagtcagcacatcgccgatacacacttcagcgaccacttgtag

SEQ ID NO: 21950 - DNA, 414 bp, Artificial Sequence
  Description of Artificial Sequence: Synthetic coding sequence
atgaacgagtaccccaagaagcggaagcggaagaccctgcaccccagtagatatagcgactctagcgggatctcacgcatcgccgacggatttaatggcatctttagtgaccattgttacagcgtttgcagcatgcggcagcccgatcttaagtattttgacaacaaggatgatgattcagacaccgaaaccagtaacgacctgccaaaatttgccgacggtattaaggctcgcaatcggaatcagaattatctggtaccttctcccgtccttcgcatacttgaccacacggccttcagcaccgagaaaagtgccgatatagttatatgcgacgaggaatgtgattctcccgagtccgtgaaccagcagacccaggaagaatctcccatcgaggtgcacaccgccgaggattag

SEQ ID NO: 21951 - DNA, 1458 bp, Artificial Sequence
  Description of Artificial Sequence: Synthetic coding sequence
atgaacgagtaccccaagaagcggaagcggaagaccctgcaccccagtagatactccgactcatccgggatttcgcggatagcagatgggtttaacggaatattctcagatcattgttactccgtgtgctccatgaggcagcctgatttaaaatacttcgataacaaagatgacgatagtgatacagaaacctctaatgacctgccaaaatttgcagacgggattaaagctcggaacagaaaccaaaattacttggttcctagccctgtgttaaggatcttggaccacaccgccttctcgaccgaaaagagcgcagatattgtgatttgcgatgaggagtgtgattctcctgaaagcgtaaatcagcagacccaggaagagagtcccatcgaggtccacaccgccgaagatgtaccaatcgcagtggaagttcacgctattagtgaagattacgacatcgaaactgagaacaactcctcagaatctctacaggatcagaccgacgaggaaccaccagctaaactatgcaagatcttagacaaatcacaggctctaaacgtgaccgcgcagcagaaatggcccctacttagagccaactcatcaggtctgtacaagtgcgagctgtgcgagttcaatagtaaatacttctctgacttaaaacaacatatgattcttaaacataagcgtactgactccaacgtgtgccgcgtgtgcaaagagagcttcagcactaacatgcttcttatcgagcacgctaagttgcatgaggaagacccatacatttgcaaatactgtgactacaagaccgtcatctttgaaaatctctcccagcacatagcagacacacactttagcgaccacctctattggtgcgaacagtgtgacgtgcagtttagctctagctcagagttgtacctacacttccaggagcattcttgcgacgagcaatacctgtgtcagttctgtgagcatgaaacaaatgatccagaggaccttcactcgcacgtggtaaacgagcacgcctgtaagctcatcgagctgtctgacaaatacaacaacggcgaacatggccagtactctctgctgtctaagatcacttttgacaaatgtaagaatttctttgtctgccaggtctgtggatttcggtccagactccacactaacgtaaacaggcatgttgcgatagagcacaccaaaattttccctcacgtgtgcgacgactgtggtaagggatttagtagcatgttggaatactgcaagcacctgaattcacacctgagtgaggggatttacctttgccaatattgcgaatactccaccgggcagatcgaagacctcaagattcacctggatttcaagcattctgccgaccttccacataaatgttctgattgcttaatgagatttggtaatgaacgcgagctgataagccatctgcctgtccacgagaccacttag

SEQ ID NO: 21952 - DNA, 651 bp, Artificial Sequence
  Description of Artificial Sequence: Synthetic coding sequence
atgaacgagtaccccaagaagcggaagcggaagaccctgcacccctcccggtattcagacagttctgggatatcccggatcgctgatggattcaacgggattttctctgaccactgctactctgtttgcagcatgagacagcccgatctaaagtactttgataataaggatgacgacagtgacacagaaacgtcaaacgaccttcccaaattcgctgacggcattaaagcccgtaatcgcaaccaaaattacttggttccaagccccgtactccgaatactggatcatacagctttttctactgagaaatccgccgacatagtgatatgcgatgaagaatgcgatagccccgagtcagtgaaccagcagacacaggaagagtcccccatagaggttcacacagccgaggatgtcccaattgccgtagaagttcatgctatctctgaggactatgatattgagacagagaataattccagcgagtcgctccaggaccagaccgacgaggagcctcccgccaagctttgcaaaatcctggataagtcccaagcgctaaacgtgacagcccaacaaaagtggccattactgagagccaactcctctgggttatataagtgcgagctttgcgaatttaactctaagtacttctag

SEQ ID NO: 21953 - DNA, 393 bp, Artificial Sequence
  Description of Artificial Sequence: Synthetic coding sequence
atgaacgagtaccccaagaagcggaagcggaagaccctgcaccccagccggtattcagatagctcagggatctccagaatagcggatggcttcaacggaatcttcagtgaccattgctattcggtgtgctcgatgcgccaacccgatttaaaatactttgataataaggatgatgattcagatactgaaacatccaacgatctgccgaaattcgcagacggcattaaggctagaaatcgaaaccagaactacctggttcccagtcccgtgttgaggatcctcgatcatacagctttcagtaccgaaaagagcgccgatatcgtgatatgcgacgaggaatgcgatagtcctgagtcagtgaatcagcagacacaggaggaaagtcccatctag

SEQ ID NO: 21954 - DNA, 1458 bp, Artificial Sequence
  Description of Artificial Sequence: Synthetic coding sequence
atgaacgagtaccccaagaagcggaagcggaagaccctgcaccccagcaggtacagcgattcctctggcatttctcggattgccgacgggtttaacgggattttttcagatcattgttatagcgtgtgttccatgcggcaacctgacctgaagtatttcgataacaaagatgatgactctgacacggaaacctctaacgacttgcccaaatttgcagacgggataaaggcacgaaaccggaatcagaactatttggtgccttcccccgttctaagaatcctggatcataccgctttctctaccgagaaaagcgccgatatagtaatttgtgacgaagagtgtgattctccagagagtgtgaatcagcagacgcaagaggaatctccaatcgaggttcacacggccgaggatgttccaatcgccgtcgaggtccatgcgatctctgaagattacgacatcgagaccgaaaacaactccagtgagagcctgcaggaccagactgatgaggagccccccgcaaaactgtgcaagattctggataagagtcaggcactgaatgtcaccgcacaacagaagtggcctctcctgcgggctaatagtagcggtttgtacaagtgtgagctatgcgaattcaattctaaatattttagcgacctaaaacagcatatgattctgaagcataagcgcacagatagcaatgtgtgtagggtttgcaaagaatccttctcgactaatatgctcttaatcgagcacgctaaattgcacgaagaagacccctatatttgcaagtattgcgattataagactgtcatcttcgagaacctatcacagcatatcgctgatacacactttagcgatcacctttattggtgcgaacagtgcgacgtacagtttagtagctcgagcgaactgtacctccacttccaagaacatagctgcgacgaacaatatctctgccagttctgtgagcacgaaacgaatgaccctgaggacttgcacagccacgtggtgaatgagcacgcctgtaagctgatcgagttgagtgacaagtacaacaacggagaacacggccaatattctctgctgtccaagattaccttcgataagtgcaagaattttttcgtgtgtcaggtctgcggtttcagaagtcgcctacatactaacgtcaaccgtcacgttgctatcgagcacacaaagattttcccacatgtgtgcgacgactgcggtaagggcttcagctctatgttggaatactgcaaacacctgaacagccacctgtcggagggcatttatctgtgtcagtactgtgaatacagcacaggccagatagaggatcttaagatccacctcgattttaagcattccgcggatctaccccataaatgctcggactgcctcatgcgcttcgggaacgagcgggagctgatttcccacttgcctgtgcatgagactacttag

SEQ ID NO: 21955 - DNA, 1113 bp, Artificial Sequence
  Description of Artificial Sequence: Synthetic coding sequence
atggccgccgagcggcaggaggccctgcgggagttcgtggccgtgaccggggcagaggaggaccgggcccgattttttttagagtccgccggctgggatctgcagatagccctggcctccttttatgaagacggcggggacgaagacatcgtaactatttctcaggcaaccccctccagcgtgagcagaggcaccgctccgtctgacaacagggtgacatcctttagagatttgattcatgatcaggacgaggatgaggaggaagaagaagggcagcgattctatgctggtggcagcgagaggagtggacaacagattgtcggtcctcctcgaaagaagagccctaacgagttggtggacgacttattcaaaggcgcaaaggaacacggtgctgtcgcagtggagagggtgacgaagagtcctggtgaaacctctaaacctcgcccttttgccgggggaggctacaggctgggtgccgctcccgaggaggagagcgcatatgtagccggtgagaaacgtcaacattcaagccaggatgttcatgtggtgttaaagctttggaaatctggattctccttggacaatggagaattgcgctcctaccaagacccaagcaacgctcagttcctggagtcaataagaagaggtgaggttcccgcggagctacggcgtctggctcacggcggtcaggtgaatctcgatatggaggaccatagggacgaggattttgtgaaacccaaaggcgcgtttaaggcattcaccggggaaggacagaaactgggttcaactgcacctcaagttctcagtacgtccagtcccgcccagcaggccgagaatgaagcgaaggcgtcctcatccattctgatcgatgaaagcgaacccacaaccaatatccagatacgcttagctgacggtggccgacttgttcaaaagtttaatcattcacacagaattagtgacattaggctcttcatcgttgatgctcgcccagccatggctgctacttcctttatcttaatgacaaccttccccaacaaagagctagccgacgagagccagacactcaaagaggcgaacctgctgaacgccgtgatagtgcagcggctaacttag

SEQ ID NO: 21956 - DNA, 1884 bp, Artificial Sequence
  Description of Artificial Sequence: Synthetic coding sequence
atgaacgccagcagcgagggcgagagcttcgccggcagcgtgcagatacctgggggcactaccgtgctggtggaactgactccagatatccacatctgcgggatctgtaagcagcagttcaataatctggacgccttcgtagctcataaacagtctggctgtcaactgactggcaccagtgccgcagccccttccacggtgcaattcgtatccgaggagactgttccagcaacacaaactcagaccacaacaagaactattacctcagagactcaaaccatcactgggtgccagttcaagacagcttacgggatgaaagacatggagcgccaccttaaaatacacacaggggataagccccacaagtgtgaggtttgtggcaagtgtttttcccgaaaagacaagctgaaaactcacatgcggtgtcatacgggagtgaaaccttacaaatgcaagacatgcgactacgccgccgctgactctagtagcttaaacaaacacctcaggatccacagtgacgagcggccattcaagtgtcagatttgcccttacgcttctcgtaacagctctcaactcaccgtacatttgaggagccacactggcgatgctccttttcaatgctggctctgttctgccaaattcaagatctcctccgacctcaaaaggcacatgcgagtgcattccggcgagaaacccttcaaatgcgaattctgcaatgtgcgctgtacaatgaagggcaatcttaaaagtcacatccggatcaaacactccggcaacaacttcaagtgtccccactgtgatttcctgggcgatagtaaggctacccttcggaaacattcacgggtccaccaatctgaacaccccgaaaaatgcagcgaatgctcatactcctgttcttcgaaggctgcgctgcggattcatgagcgcattcactgtacagataggccctttaagtgtaactattgttcattcgacaccaagcagccatccaatctgagtaaacatatgaagaaatttcatggggacatggtgaagaccgaggccctggaacggaaagacacaggacgccagagctcccgccaggttgctaagcttgatgccaaaaaaagcttccactgtgacatctgcgacgcttcattcatgagggaagactctttgagatcacacaaaagacaacacagcgagtactccgagtcgaaaaacagcgatgttactgtgctgcagttccaaatcgatccatcgaagcagccagctacacctctgactgtaggacacctccaggtccctctgcaacctagccaggtgccgcaattctcagagggaagagtgaagattatcgtgggacatcaggttccacaggcaaacacgattgtccaggcggcggccgccgctgtgaacattgtgccgccagctctcgtggcccagaatcccgaagagctgcccggaaactctcggctacaaatcttgcgccaggtgtccctcatcgcccctccacagtcttccagatgcccgagcgaggccggcgccatgacacagcctgcagtgcttttgaccactcacgagcagacggacggagcgaccctgcaccaaaccctcataccaaccgcatccgggggtccccaggagggctcaggaaaccagacattcattacaagttcaggcattacatgtaccgattttgagggtttgaatgccctgatccaggaggggacagctgaggtcactgttgttagtgacggaggacagaatatcgccgtggccaccacggcccctcctgtgttttcaagctctagccaacaggagcttcccaaacaaacgtattcaattattcagggtgcggcacaccccgctctcctatgtcctgccgatagtatccctgactag

SEQ ID NO: 21957 - DNA, 1938 bp, Artificial Sequence
  Description of Artificial Sequence: Synthetic coding sequence
atgaacgccagcagcgagggcgagagcttcgccggcagcgtgcagatccccggtggcaccacagttttagtggagctcaccccagacatccacatttgcggcatttgtaagcagcagtttaacaatttggatgcattcgtggctcacaagcagagtgggtgtcagctgactggaacgagcgctgcagctccctccaccgtccagtttgtgagtgaggagaccgtacccgctactcagactcagaccactacacggacaatcacatcggaaacgcagaccatcaccgtctccgctcctgagttcgtctttgagcacggatatcaaacatatctccccactgagagcaatgaaaatcagacggcaactgtgattagcttacccgccaagtcccgaacaaagaagccgacaactcctcctgcgcagaaacgcctcaattgttgttatcccgggtgccagtttaaaacagcttatggaatgaaggatatggaacggcacctcaagatccacactggtgataaaccccacaaatgtgaggtatgtggaaaatgcttctcacgtaaggataaactgaagacgcacatgaggtgtcacaccggcgtgaaaccatacaaatgtaagacctgcgattatgctgccgcagatagtagttctctgaacaaacacctgcgtattcactcagacgagaggcccttcaaatgtcaaatctgtccctacgctagtaggaacagcagccaactgacagttcatctcagaagtcacaccgcctccgagctagacgatgatgtgccaaaggccaactgtttaagtaccgaatccaccgatactcctaaggccccagtcataaccctgcccagcgaggccagagaacagatggccactcttggtgagcggaccttcaactgttgttatcccgggtgccattttaagacagtgcatggcatgaaggacctcgaccggcatctccggattcataccggcgacaaaccacataagtgtgagttttgtgataagtgtttctctcggaaggacaacctaactatgcacatgcgatgccacacatccgttaagccccacaaatgccatctatgcgactacgcggcagttgactctagttctctcaaaaagcatttacggattcactctgacgagcgaccttacaaatgccagctatgtccatacgcaagccgaaatagcagccagctcacggttcatctgaggagccatactggagacacaccattccaatgctggctttgttctgccaaattcaaaatctcgtccgatttaaaaaggcatatgatagtgcattcaggagagaagcccttcaagtgtgaattttgtgatgtgaggtgcaccatgaaagctaatcttaagagtcacattcgcattaaacatactttcaagtgtctgcattgcgcatttcagggcagagaccgcgcggatctgctcgaacacagtaggctccaccaggccgaccaccccgagaagtgccccgagtgttcttattcctgtagtagcgccgccgcattacgggtccattcaagagtgcattgtaaggatcgccccttcaagtgcgatttttgtagcttcgatactaagagacccagctctctggcaaagcatgttgataaggtgcaccgagatgaggccaaaactgagaatcgggcccctctggggaaggagggactgagggagggctcgagccaacacgttgcgaaaatcgttactcagcgagctttcagatgtgagacatgcggagcgagtttcgtcagagacgattctctaaggtgccataagaagcagcattctgaccaaagcgaaaataagaatagcgacctggtgacctttccacccgagagtggagcctctgggcagctgagtacattggtgagtgtggggcaactcgaggctccattggagccaagtcaggacctgtag

SEQ ID NO: 21958 - DNA, 2040 bp, Artificial Sequence
  Description of Artificial Sequence: Synthetic coding sequence
atgaacgccagcagcgagggcgagagcttcgccggcagcgtgcagtcaggaacgactgtcctagtagaactcactcccgacatccatatctgtggcatttgcaaacagcagttcaataacctggatgcctttgttgcccacaaacagagtgggtgccagttgaccggcacatccgcagcagccccttctacggtgcagtttgtgagcgaagaaactgtaccagcaactcagactcagaccacaacaagaactattacatccgaaacacaaaccattaccgtctcagctcctgagtttgtgtttgaacacgggtatcagacttacctccccaccgaaagtaatgaaaatcagacagctacagtgatctccctacccgccaagtctcgcaccaagaagccaaccacaccacccgcccagaaaaggcttaactgttgctaccccgggtgtcagttcaaaacagcatatgggatgaaggacatggagaggcacctgaaaatacacaccggagacaaacctcataagtgtgaggtctgtggcaaatgcttctccaggaaggataaattgaagacccatatgagatgccacacaggtgtcaaaccgtataagtgcaagacttgcgattatgctgccgctgatagctccagcctcaacaagcatctacgcatccattccgatgaacggccctttaagtgccagatctgcccctatgcaagccgcaactcttctcagctcaccgtgcacttgaggtcccacactggcgatgctccatttcagtgctggctttgctctgctaagtttaaaatatcatccgacttgaagcggcatatgagggtccattctggagagaagccattcaagtgcgagttttgcaacgtgcgttgtacaatgaagggcaatcttaagagccacattaggataaagcattcaggaaataactttaaatgcccacactgtgacttcctgggcgacagcaaagctacacttaggaaacattcccgcgtgcaccagtccgaacacccggaaaagtgcagcgaatgctcttatagttgctcttccaaggcagcgttacgcattcatgaacggatccattgtactgaccggcccttcaagtgcaactattgttcattcgacaccaaacagcctagcaatctgtccaaacatatgaagaagtttcatggggatatggttaagactgaagcccttgagaggaaggacacgggccgtcaatccagtcgtcaggtggctaaactggacgctaagaaaagcttccattgcgacatttgcgacgctagttttatgcgggaggatagcctccggtcacataaacggcagcatagcgaatatagcgagtcaaagaatagcgacgtaacagtcctccagttccaaattgacccctcgaaacaaccggcgactccgctgactgtagggcacctgcaggtcccactccagccatcacaggtgccacaattctctgaagggcgggttaagataatcgtggggcaccaggtgcctcaggccaacacaattgtccaggctgcagcagcggccgtgaatattgtcccacctgccctggtcgcacagaatccagaggagctgccaggaaattccaggctgcaaattctaagacaggtgtcactcatcgccccaccacagagcagccgctgtccctctgaagcaggagccatgacgcagccagcagttcttttgacgacccatgagcagacagatggagctaccctgcatcagacacttatacctaccgcttctggtggcccccaggaggggagcggcaaccaaacatttattacctctagcggcatcacgtgcaccgattttgaaggtctcaacgctcttatacaggaaggtacggctgaagtgactgtcgtatccgacggcgggcagaatatcgctgttgccacaacagcgcccccagttttctccagctccagccagcaggaactgccgaagcagacctatagcattatacagggcgccgctcatccagcactattgtgtcccgccgactccataccggattag

SEQ ID NO: 21959 - DNA, 1932 bp, Artificial Sequence
  Description of Artificial Sequence: Synthetic coding sequence
atgaacgccagcagcgagggcgagagcttcgccggcagcgtgcagattccaggtgggacaacagtgttggttgagctgactccagacattcacatttgtggcatctgcaaacaacaattcaataacctggatgccttcgtggcacataagcagtccggatgccagctcaccggtacctctgccgccgcacccagcactgtgcaattcgtctctgaagagactgtgcctgctacacaaacccagaccaccacaaggacaatcaccagcgagactcagacaatcacagtgtcagccccagagttcgttttcgaacatggatatcagacatacctcccaactgaatctaacgagaaccagaccgccaccgtcatctccctgccagcgaaatctcgtacaaaaaagcccactaccccaccagcacagaaaagattaaactgctgctatcctggtaaaggcagcatcatgtcttacctgtgccgcggcctgggccgatacccttccgagataatttcagacgttcaaaagtcctgcaagaattgcaccaagaagaatagccccaacgtcacaatcctcttatacctgctttgtcattctttgtacatctataaactcctccagtgcgttttcccgaaaaatcagaatatcctgttgaataaccatcggactattataaagtccgatttcgtcataaaatgtcacttcatgtcattcataagctccaatcaggaacagctgtccatatacttgtcctttcgattgtgctcttttggccggaaccataagatgacagtttgcttttctcggtctagccacatcttccctattacagttgtgctgacccttgtaacttggctgagaatgttcttaccagttttctccatgcttaagctgagtttcttcttcctcgggtgtcagtttaaaacagcatatgggatgaaagacatggagcggcatctgaagatccatactggagacaagcctcacaagtgcgaagtgtgtggaaagtgtttttctcgaaaagataagctgaaaacccatatgagatgccatactggggtgaagccctacaaatgcaagacctgtgactatgcagccgcagactcctcctctttgaacaaacacctcagaattcactctgacgaaagaccattcaagtgccagatttgcccgtacgcctcgaggaacagctcccaactgacagtgcaccttcggtcccacactggcgatgcgccctttcagtgttggttgtgtagcgccaagttcaagatctctagcgatctgaagagacatatgagggtgcacagcggcgaaaagcctttcaaatgcgagttttgcaacgttagatgtactatgaagggcaacctgaagtcgcacatccgtatcaaacattcaggcaacaatttcaagtgtccacactgcgacttcctcggcgattccaaggccactttgcgtaaacatagccgcgtgcatcaatcagaacatcccgaaaaatgtagcgagtgctcctacagctgctcctcaaaagcggcgctcagaatccacgagcggatccactgcacggaccgcccattcaagtgcaattattgtagcttcgacactaaacagccatccaatctctcaaagcatatgaaaaagtttcacggcgatatggtgaagacggaggctctcgagcggaaggacacaggtcggcagtcctctagacaagtggccaaactcgacgcaaaaaagtcttttcattgcgacatctgtgatgctagcttcatgcgggaggattccctgcgatcccacaagcggcaacacagcgaatacagtgagtctaagaactctgatgtgactgttctgcagttccagatagacccctcaaaacagcccgcaaccccactgaccgtaggtcatctgcaagtccctctgcagccttcccaggtgccctag

SEQ ID NO: 21960 - DNA, 1281 bp, Artificial Sequence
  Description of Artificial Sequence: Synthetic coding sequence
atgagccggcggaagcaggccaagccccagcacctgaacagcgaggagccgaggcccgcccgccgcgaatgcgccgaggtggcgccccaagtcgctggagaaccggcgtctgaactcgacgacgacgttccaaaggctaattgcctatccacagagtctacagatactccgaaggcacctgtcataaccctcccctccgaggcgcgggagcagatggctaccttaggggagcgtacgttcaattgctgttaccctggctgtcacttcaagacagttcacgggatgaaagacctggaccggcacctgagaattcacaccggggataagcctcataagtgcgagttctgtgataaatgtttttcaagaaaagataacctcacaatgcacatgagatgccatacctccgtcaaaccgcataaatgtcacctctgtgactacgccgctgttgactccagtagtctgaagaaacacctgagaattcactcagatgagaggccgtataagtgtcagctgtgtccctatgcttcccgcaattccagccaactcacagtccatttgcggagccacacgggggatacacctttccagtgctggctgtgttctgcaaagttcaagattagtagtgacttaaaaaggcatatgatcgttcattctggggagaaaccatttaagtgcgagttttgcgatgttcggtgcactatgaaggccaatttaaagagccatattagaattaagcatacattcaagtgtttgcactgtgcgtttcaagggcgggaccgagcagatctgcttgagcactcccggctccaccaggccgatcacccggaaaagtgtcccgaatgcagctattcatgctctagtgccgccgccctgagagtccattctagggtgcattgcaaagatcgacccttcaagtgcgacttttgcagcttcgacactaaacggccttctagcctggctaagcacgtagataaggtgcaccgcgacgaagccaagactgaaaatcgggctcccctaggaaaggaggggctaagggaagggagttctcaacacgtcgcaaagattgtgactcagagagccttccggtgtgagacatgtggagcctcctttgttagggatgattctcttagatgtcataagaagcagcatagtgaccaaagtgaaaataaaaactccgatcttgtcacttttcctcctgaatctggggcatctgggcagcttagcaccctggtgtcagtgggacagcttgaggctccattggaaccctctcaggatctctag

SEQ ID NO: 21961 - DNA, 396 bp, Artificial Sequence
  Description of Artificial Sequence: Synthetic coding sequence
atgcggggccaccccagcctgcggcccccctggcactgggccagcgctgcacgcctcgagggtggattcctgccgtggggctacgtctccaacgcccttagccgcgagggtctgaccgaagagagaaccttcgaacggagacctgaaggttgggagggggcatcttgcgctgctagtgagctcgacgacgacgtaccaaaagccaactgcttgtctacggaatctaccgataccccaaaggcaccagttattacgctgccttccgaggctcgcgagcagatggccacactaggagagcgcacttttaattgctgctaccccggctgccactttaagaccgtgcacggaatgaaagacctcgaccgccatcttaggatccacaccgcatcgtgttag

SEQ ID NO: 21962 - DNA, 666 bp, Artificial Sequence
  Description of Artificial Sequence: Synthetic coding sequence
atgcggggccaccccagcctgcggcccccctggcactgggccagcgccgcgcggctagaggggggcttccttccctggggctacgttagtaatgccctgagtcgggaaggccttaccgaggaaaggacctttgaacggagacccgagggctgggaaggcgctagctgcgccgcttctgaactggatgacgacgtccccaaggctaattgcttaagtactgagtctaccgataccccaaaggcccccgtgatcacactgccgtctgaagctcgagagcagatggccaccttgggtgaacgaacttttaactgctgctacccaggctgccattttaaaactgttcatggaatgaaagatctcgacaggcatttgaggattcatacaggagacaagccccacaaatgcgagttctgtgataaatgcttcagcagaaaggataacttgacaatgcatatgaggtgtcacacgagtgtgaaaccacacaagtgccatctctgcgattacgccgcagtcgattcttcgagtctgaaaaaacatttgcgaatccattccgacgagcggccctataagtgtcagctttgcccctacgcctccaggaactcatcgcaactgacagtccatctccgtagccatactggagacaccccgttccagtgctggctatag

SEQ ID NO: 21963 - DNA, 363 bp, Artificial Sequence
  Description of Artificial Sequence: Synthetic coding sequence
tgagagcggaccttcaactgctgctaccccggctgccacttcaagaccgtacacggaatgaaggatctggacaggcatctgcgcattcatacaggggataagccccacaagtgcgagttttgcgacaagtgtttcagccggaaggacaacctgaccatgcatatgagatgccacaccagtgtgaagcctcacaagtgtcatctgtgtgactacgccgctgtggactccagctcactgaagaagcacctcagaatccactctgatgaacggccctacaagtgccagctgtgcccttatgcttccaggaattcttcacagttgactgtgcacctgagaagtcatacagggccaggtccaggctag

SEQ ID NO: 21964 - DNA, 1572 bp, Artificial Sequence
  Description of Artificial Sequence: Synthetic coding sequence
atgaaggacatggagcggcacctgaagatccacaccggcgacaagccccataaatgtgaggtgtgcggaaagtgctttagtcgaaaggataagttgaagacacatatgcgttgtcacactggggtgaagccctacaagtgtaagacttgcgattatgcggccgcggattcctcctctctcaataaacacttgagaatccacagcgacgagcgtccatttaaatgtcaaatctgcccctacgcctccagaaacagctcccaactcacggtgcacctcaggtctcatactggcgacgctcctttccaatgttggctgtgctcagcaaagttcaaaatcagctccgatctgaagcggcatatgcgcgttcactctggggaaaagcccttcaaatgcgagttttgcaatgtgaggtgtacgatgaagggaaaccttaagagccacattcggattaagcattcaggcaacaactttaagtgccctcattgtgatttcctgggcgattccaaggctaccctgcgtaaacattcccgggtgcatcagtcagagcacccagagaagtgttcggaatgttcctattcttgctccagcaaggctgcgcttcggatacatgagagaatacactgcacagacaggcccttcaagtgtaactattgttccttcgacaccaaacagcccagcaacctgagcaagcatatgaagaaatttcacggcgatatggttaaaacagaggcactggaacgaaaagacacaggaaggcaatctagcaggcaggttgctaagctagacgccaagaaaagcttccactgcgacatttgcgatgcctcctttatgcgcgaggactccctcagaagccacaaacgacagcactctgagtactccgagtctaaaaacagcgatgttactgtactgcaattccagatagacccttctaagcagccggccactccattaactgttggacacctgcaagtaccactgcaaccctcacaggtgccccagtttagcgagggaagggttaaaattatcgtgggccatcaggttccccaggctaacactattgtccaggccgccgctgcagccgtcaacattgtcccgccggcgctggtggcacaaaacccagaagagcttcctggcaattcacggctgcagatactgaggcaagtgtccctgatagcacccccccagagttcacggtgtccgtctgaagccggtgctatgactcagcctgccgtgttgctgactactcatgagcagacagacggcgcaactctgcatcagacattaattcccacggcttccggcggaccgcaggaggggtccggcaatcagactttcattacctcttccggcatcacctgtaccgattttgaagggctaaacgcccttattcaggagggtactgcagaagtgacggtggtctccgatgggggtcaaaacatcgctgtcgctacaacagctccgcctgtgttctcctcctcctcccagcaagaactgcccaaacagacttacagcataattcagggggccgcacaccctgccctgctttgtcccgccgacagtattccggactag

SEQ ID NO: 21965 - DNA, 1581 bp, Artificial Sequence
  Description of Artificial Sequence: Synthetic coding sequence
atgccccagcagctgctgatcaccctgcccaccgaggccagcacctgggtaaaattacagcatccgaagaaagccgtggagggcgctccactctgggaagacgtgacaaagatgttcgaaggagaagcactgttgtctcaagatgccgaagacgtgaagacccaaagggaatccttagaagatgaggtcactccgggcttacccaccgcagagtctcaggaactgctaacgtttaaggatatttcgattgacttcacacaggaagagtggggacagctggccccggcacatcaaaatctgtatagggaagtcatgctggagaactactctaatctggtatcagttggttatcagctttccaagccctctgtgatcagccagcttgaaaagggggaggaaccatggatggccgaaaaggagggtcctggggatccctccagtgatctgaagtcaaaaattgaaaccatcgagtctactgccaagtccactattagccaagagcgcctatatcacgggatcatgatggaaagctttatgagagatgacataatctatagtacactgcgcaaggtgtccacatacgacgatgtgctcgagaggcatcaagagacctgcatgagggacgtgcgccaggccattcttacccacaagaagcgggtgcaggaaacaaacaaatttggagaaaatatcatcgtacattctaatgtgatcatcgagcaacggcaccacaagtatgatacacccaccaagaggaacacctacaaactcgacttaattaatcaccccacatcttatatccgcactaaaacgtacgaatgcaatatatgcgaaaaaattttcaaacagcctatccacctgaccgagcacatgagaatccatactggagagaaaccattcaggtgtaaggagtgcggaagagccttctctcagtctgcatcactcagcactcaccagaggatccatacgggggaaaaacctttcgaatgcgaagagtgtgggaaagcttttcggcatcggtctagtctgaatcagcatcatcgaacccacactggcgagaagccatatgtgtgtgataaatgccagaaggccttctcccaaaacatctccctagttcagcacctccgcacccactccggagagaaaccatttacttgtaacgagtgcgggaagacatttaggcagatccggcacctttctgaacacattcgcatccataccggggagaaaccttacgcatgtaccgcctgctgtaaaacattttcgcacagggcctacctgactcaccaccaaagaattcataccggcgagcgcccttacaagtgcaaagagtgtggaaaagcctttaggcagaggattcacctgagcaatcacaagaccgtccacacaggcgtgaaggcttatgagtgtaatcggtgcggcaaagcctatcggcacgacagcagctttaagaagcatcaacgacatcataccggagaaaaaccttatgaatgcaatgaatgtggcaaggccttctcttacaattcaagcctgtcaagacaccatgaaattcaccgccggaatgcatttcgcaataaagtgtag

SEQ ID NO: 21966 - DNA, 1581 bp, Artificial Sequence
  Description of Artificial Sequence: Synthetic coding sequence
atgccccagcagctgctgatcaccctgcccaccgaggccagcacctgggtcaagctccagcaccctaagaaagcagtggaaggcgcacctctgtgggaggacgtcaccaaaatgtttgaaggcgaggccctcctgtcgcaggatgccgaggacgtgaaaactcaaagagaaagcctggaggatgaggtgaccccgggcctccccacagcagaatcacaggaactgcttacattcaaagatatatctatcgatttcacacaggaagagtggggtcagctggctcctgcccatcagaacctgtaccgcgaggtcatgctggaaaattatagtaatctggtctctgttggctaccagctgtcaaaaccaagcgtcatctcgcagctcgagaaaggcgaagagccatggatggccgaaaaggaaggtcccggggatccttcttctgatcttaaatcaaagatcgaaactatcgagagcacggcaaaatctaccatctcacaggagagactctatcacgggatcatgatggagagttttatgagggatgacatcatttattccactttacggaaagtatcgacatacgacgacgtgttggagaggcaccaggaaacatgcatgagagacgtacgccaggccatattgacccacaaaaaaagggtgcaggaaactaacaaatttggagagaatatcatcgttcattcaaatgtgattattgagcagcggcatcataaatatgacactcctaccaaaaggaatacttacaagctggatttgattaatcatccaacatcctacatccggacaaaaacttacgagtgtaatatctgcgagaagatattcaaacagccgatccacctgacagaacatatgcgcatacacactggcgagaaaccctttaggtgtaaagagtgcggccgcgccttttcacagtccgcttcgctgtccactcaccaaaggatccacactggtgaaaagccttttgagtgcgaggagtgcgggaaagcatttaggcaccggtcaagtttgaatcaacaccaccggacacacactggagagaagccctatgtatgcgacaagtgtcagaaggcattcagtcaaaacatatcgctcgtgcaacatctgaggacccacagcggcgaaaagccattcacttgtaatgaatgtggaaagacatttagacagatcagacacctgagtgaacatatacggattcatactggcgagaaaccctatgcttgtaccgcctgttgcaagacattttcccatcgtgcgtacctgactcatcaccagcggatccacaccggagaacggccatataaatgcaaggagtgcgggaaagcattccgccaaaggatacatctgtccaaccataaaacggtgcatacgggggtgaaggcatacgaatgtaatcgctgcggcaaggcttatcggcacgattcctcattcaagaaacatcagaggcaccacaccggggagaagccatacgagtgtaatgagtgcgggaaggccttctcctacaacagctccttatctagacaccatgagattcacaggagaaatgctttccgcaataaagtgtag

SEQ ID NO: 21967 - DNA, 1299 bp, Artificial Sequence
  Description of Artificial Sequence: Synthetic coding sequence
atgctggagaactacggcaacctggtgagcgtgggctgccagctgtccaaacctggggtgatttcccagctggaaaaaggcgaggagccatggcttatggagcgggatatcagcggcgtacccagctctgaccttaagagcaagacaaaaactaaagaaagcgcactccagaatgacatcagttgggaggagctgcactgcggcctaatgatggagcgctttaccaagggctcctccatgtactccactttggggagaatttccaagtgtaacaagctcgagtctcagcaggaaaaccaacgcatgggtaagggacagattcccctgatgtgtaagaagacgttcacccaggagaggggacaggagtcaaaccggttcgagaaacgaatcaatgtgaagtctgaagtgatgccgggaccaattggtctaccgaggaagagagatcgaaagtacgacacgccaggcaagagaagcagatacaatatcgatctggtgaatcactctcgtagttacactaagatgaagacctttgagtgcaatatctgcgagaaaatctttaagcagcttatccatctgaccgaacatatgcgcatacacacaggcgaaaagccattcagatgcaaagaatgtggcaaggcattcagtcaatcttccagcttaatacctcaccagcggattcacacaggcgagaaaccatatgaatgcaaagaatgcgggaagaccttcagacatccctcctctctgacccagcatgttagaattcataccggagaaaaaccctacgaatgtcgggtgtgcgagaaggctttctcacaatccattggtctcattcagcaccttaggacgcatgtacgcgagaagcctttcacctgtaaggactgcggcaaagcatttttccagattagacatcttcgccagcatgaaatcattcataccggggtgaagccatacatttgcaatgtctgcagcaaaaccttctcacattctacctacctaactcaacatcagaggactcataccggcgaacggccctataagtgcaaagaatgtgggaaagcattctctcagcgcatccaccttagtatccaccagagggtacacaccggcgtcaaaccatatgaatgttctcactgcggtaaggccttccgacatgattccagttttgcgaagcatcagcgcatacatacaggcgaaaaaccttacgactgtaatgaatgcggcaaggcttttagctgtagttcatctttgatcaggcattgcaaaacccacctccgcaatactttttctaatgtcgtgtag

SEQ ID NO: 21968 - DNA, 1605 bp, Artificial Sequence
  Description of Artificial Sequence: Synthetic coding sequence
atgctgcagcagctgctgatcaccctgcccaccgaggccagcacctgggtgaagcttcgacatccaaaggctgccaccgaacgggtggctctatgggaggacgtgaccaaaatgttcaaggctgaggctttgctgtcgcaggatgcggatgagacccaaggagaaagtctggagtcccgtgtcacgctcggatccctaacagccgagtctcaggaactgctgacgtttaaagatgtgtcagttgacttcactcaagaggaatgggggcaactggcgcccgcacatcggaatctttaccgggaggtgatgctagagaattacggcaaccttgtgtcagtcggctgtcagctgtctaaacctggtgtaatttcccagttggagaagggtgaagagccatggttgatggaacgtgacatcagtggcgtaccttcctccgatctgaagtcgaaaacaaagacaaaggaaagcgcccttcagaacgacatctcctgggaggagctccattgtggcctgatgatggaaagatttacaaagggcagctctatgtatagcaccttgggccggatcagtaaatgcaacaagctcgagagtcagcaagaaaatcaacgcatggggaaggggcagattcctctgatgtgtaagaagaccttcactcaggaacgcgggcaggaaagtaataggtttgagaagcgcattaatgttaaaagtgaagttatgcctgggcccatcggacttccccgaaaaagagataggaaatatgataccccagggaagaggagccgatataatatcgaccttgtcaaccactcaaggtcttataccaaaatgaaaacctttgagtgtaatatctgcgagaaaattttcaagcaactgatccacctgactgagcacatgcggatacatactggcgaaaagccttttaggtgcaaggagtgcggcaaggctttcagccagtctagcagtcttattcctcatcagcgaattcataccggagaaaagccatacgagtgcaaagaatgtgggaagacatttcgtcacccctcttccttgacccagcacgttaggattcacactggggagaagccatacgaatgtagagtgtgtgaaaaagccttttcgcagagtattgggcttattcagcacctacgcacacacgtacgggagaagccatttacatgtaaagactgtggcaaggcgttttttcagatccgacacctgagacagcatgagattattcacacaggtgtgaaaccctacatctgcaatgtgtgttccaagacttttagtcattctacttatttaacgcagcatcagcgcactcacaccggtgagaggccatataagtgtaaagagtgtggaaaagcgttctcccaaaggattcacctcagtatccatcagcgcgtgcatacgggggtcaaaccctacgagtgctcccactgcggaaaggcttttcggcacgatagctctttcgccaagcaccaacgaattcatacaggcgaaaagccctatgattgcaacgagtgtggtaaggcattctcctgcagctccagtctcatcaggcattgtaagacccatcttagaaacacctttagcaacgtggtctag

SEQ ID NO: 21969 - DNA, 1398 bp, Artificial Sequence
  Description of Artificial Sequence: Synthetic coding sequence
atgctgttcagcgccctgttcttcctgctgtacagcgccttcttccgacgacctgagtatcagagaactatttttaagttcttaggttggttatgtgacctgagcatctacagtctctttttccctattagtaggatgtcagcattccagacctggcgcgattttcctgtgggtgagcgtaggcgaccgtggttaatggagagagatatctctggcgttccaagttccgacctcaagagtaagaccaagacgaaggagtccgccctgcagaatgacatcagctgggaagaactgcactgtggattaatgatggaaaggttcacaaaggggtctagtatgtattccactctcggcagaatttcaaaatgcaataagctggaatctcagcaggagaatcagaggatggggaaggggcagataccactgatgtgtaaaaaaacatttacacaggaacgcgggcaagagtcaaatcggttcgagaaacggattaatgtgaaatctgaagtcatgcccgggcctattggactgcctaggaagcgcgataggaagtatgacaccccaggaaagaggagccggtacaatattgatctggtgaatcatagcagaagctacacaaaaatgaagacatttgaatgcaacatttgcgagaagattttcaaacagctgatacacctgacagagcacatgagaattcataccggcgagaaaccgttcagatgcaaagaatgcgggaaagcgttctcacagagcagctcactgatccctcaccagcgcattcacacgggagaaaagccctatgagtgtaaggaatgcggcaagacgtttaggcacccttcaagcctcacccagcatgtccgtatccatactggtgaaaagccgtacgaatgtcgtgtctgtgagaaggcattctcgcagtccatcggactgattcaacaccttcggactcacgttcgcgagaagcccttcacttgcaaggattgcgggaaggccttttttcagataaggcatttacggcagcacgagatcatacatacaggcgtgaagccatatatatgtaatgtgtgttcaaaaacctttagtcacagcacatacttaactcaacaccagcggacccacaccggcgaacgaccatataagtgcaaagaatgtggcaaagcgttcagccaacgcattcacttaagcatccaccagagggtccacacaggggtcaagccgtatgaatgcagtcactgcggcaaagctttcaggcatgactcgagctttgcgaaacatcagcggatacatacaggtgagaaaccttacgactgtaatgagtgtggtaaggcatttagctgttcatcaagcctgatacgccattgcaaaactcatcttaggaatacattttcaaacgtggtgtag

SEQ ID NO: 21970 - DNA, 5499 bp, Artificial Sequence
  Description of Artificial Sequence: Synthetic coding sequence
atggaggacaccccccccagcctgagctgcagcgactgccagcggcacttccctagtctccctgaattatccaggcacagagagctgctacacccgtccccaaatcaggacagtgaagaggccgacagtattccgcgtccttatcgatgccagcagtgtgggcggggctatcgacacccgggaagccttgtgaaccataggcgcacgcatgaaaccggtctcttcccatgtacgacctgtggcaaggacttcagcaacccaatggccctgaaatcccatatgagaacacacgcacccgaaggccgacgtaggcatcgcccccccaggcctaaagaggccactccgcatcttcagggggagaccgtgagtaccgactcgtggggtcaacgattaggaagctctgaagggtgggagaatcagaccaaacacaccgaggagactccagactgtgagtccgtccctgacccgcgggcagcgtcaggcacatgggaggacctacctacacgtcagagagagggcttggccagtcatcccggtcctgaggacggtgcagatgggtggggaccaagcacaaacagcgcaagggcccccccattgccgatacctgccagcagtctcctgtcaaacctggaacagtacctcgccgaatctgtcgtcaattttaccggtgggcaagagcctacacagtccccccctgctgaggaggaacggaggtacaaatgtagccagtgtggtaagacttataaacacgcaggttcactgaccaaccacaggcaaagccacacactagggatttacccatgtgcgatctgtttcaaggagtttagcaacctaatggcactcaaaaaccattcaagactgcatgcgcagtacagaccctaccattgtcctcattgcccacgagtgttccgcctccctcgggagctgctggagcaccagcaatcccacgagggagagcgccaagaacctcgatgggaagagaaaggtatgcctaccaccaatggtcacaccgatgaatctagccaagaccagctgccaagcgctcagatgcttaacggctccgctgaactctcaacatcaggtgagctggaagacagtggcctggaggagtaccgccccttccgctgcggcgactgtggacgcacttaccgtcacgcaggctcattaataaaccatagaaagagccaccagactggggtgtatccttgttcactatgctcaaaacagttattcaatgctgcagccctcaaaaaccacgtgcgggcccatcaccgcccacggcagggcgtcggagagaacggacaaccctctgtccccccagctccgctcctcctagctgagactacccataaggaggaagaggacccaacaactaccctggaccacagaccctacaagtgctccgagtgcgggcgggcctatagacaccgggggagcctggtgaaccaccgccattcccaccggaccggcgagtaccaatgttccttgtgcccacggaagtatccaaacctgatggccctgcgaaaccatgtgagggtccattgtaaagccgccaggcggtctgccgatatcggagccgagggggcaccgagtcacctgaaggtggaactgccacccgatcccgtggaagcggaggccgccccccatacagaccaagaccacgtctgcaaacatgaggaggaggcaaccgacattacacccgctgctgacaagactgcggctcatatctgttctatttgtggtctgctgtttgaggacgctgagagcctcgagcgccatggcttgacccacggcgccggtgagaaggagaattcaaggacagaaactaccatgtcaccgccacgggctttcgcctgtagagattgtggcaagagctaccgtcactccggatctcttatcaatcatagacagacccaccaaacgggagatttttcttgtggagcctgcgcgaaacattttcacacgatggcggcaatgaagaatcacttgagacggcactcacgtcggaggtcgcggaggcaccgaaagcgcgcaggtggtgcttccggaggaagagaggctaagctacttgctgctgaaagttggaccagggaactggaggataatgaaggccttgagtccccacaggatccaagcggggagtctccgcacggcgcagagggtaatctcgagtccgacggggattgcctgcaggccgaatcggagggcgacaagtgtggactggagcgagacgagactcattttcagggtgacaaggagagtgggggcaccggggagggactggagagaaaggatgcatcactcttggacaatctcgacattcctggagaagagggggggggcactcacttctgcgattcccttaccggtgtggacgaagaccagaaaccagcaaccgggcaaccaaatagctccagtcacagtgccaatgctgttaccgggtggcaggccggagccgcgcacacatgtagcgactgtgggcactcattcccacacgccaccggcctgctgagtcatcgcccgtgtcatccccccggtatttaccagtgctcactgtgtccaaaagagtttgatagcttgcctgctcttcgcagccatttccagaaccaccggcccggcgaggccacgtctgctcaaccatttctgtgttgcctatgtggcatgatctttcctggacgggccggttacaggctacaccgaagacaggcacatagttccagcggcatgactgaaggctccgaagaggaaggggaggaagagggtgtggctgaggctgcccctgctcgctccccgccactccagttgtctgaggccgagctgctgaatcaactgcagcgggaagtagaggctctggactcggcaggctacgggcacatctgcggatgttgcggacaaacctatgacgacctggggagccttgaaaggcaccaccagtcacagagcagcggaactacggcagacaaggccccttctcctctcggtgtggccggggacgccatggagatggtggtcgattccgtcctggaagacattgtgaacagtgtctctggtgaggggggggacgctaagtctcaggagggcgctggaaccccacttggagactcactgtgcatccagggtggggagtccctgcttgaggcccagccacgacctttccgctgcaatcagtgcggtaagacatataggcacggaggaagtctcgtgaaccatcgaaaaatacatcagaccggggactttctgtgtcccgtatgctcgagatgctaccccaacttggcagcatacagaaaccatcttcggaatcaccctcgctgtaagggctctgaaccccaggtggggcctataccagaggccgcaggaagttctgaactgcaagtgggccctattcccgagggtggcagcaacaaacctcagcacatggcggaggagggtccaggccaggccgaggtagagaaacttcaagaggaactgaaggtggaacctttggaggaggtagcacgcgttaaagaggaggtctgggaagagactaccgtcaagggcgaggaaattgagcctcggttagagacagctgagaaaggctgccagaccgaggccagcagcgagcggcctttttcctgcgaggtgtgtgggaggtcatacaaacacgctgggtctctgatcaaccataggcagagccatcagacaggccactttggttgccaagcgtgctcgaaaggcttttcaaatctcatgagtctgaagaaccacagacgcatacatgctgatcccaggaggtttagatgttccgagtgcggtaaagcattcaggctccgaaagcagctggcttctcatcagcgggtgcacatggaaagaagaggtggcggtgggacacggaaagctactcgggaggatcgcccctttcgatgcggccaatgcgggcggacctaccgacacgcaggatcactgcttaaccaccggagaagccatgaaacgggtcagtactcctgtccgacgtgtccgaagacttattctaacaggatggcactcaaagaccaccagagactgcatagcgagaatcgaaggagacgcgcaggaagatcaaggcggacagccgtccgctgcgctctgtgtggccggtcattccccggtagggggagcctggaaaggcatctaagagagcatgaggagacagaacgggaacccgcgaacggacaaggaggattggatggtacagccgcatccgaagcaaacctaactggttcccaggggctggaaactcagctggggggtgccgaaccagtcccccatctggaggacggagtgccacgccctggagaacgctcccagagtccaatccgggccgctagctccgaagcacctgagcccctgagctggggtgccggaaaggccggtggctggcccgtcggtggaggactggggaaccactccggcgggtgggtgccccagtttctaactcggtctgaggaacccgaggatagcgtccaccggtctccttgtcatgctggtgattgtcagctaaatggacccacactttcgcatatggactcgtgggataatagggataattctagccagcttcaacctggctcgcacagcagctgttcgcagtgtggtaagacatactgccaatctggcagtttgctcaatcataacaccaataagactgacagacactattgtctgttgtgttcaaaagaatttctgaacccagttgctactaagtctcactcacacaaccacattgacgcccagacatttgcctgtcccgactgcggtaaggcctttgagtctcaccaggaattggcctcccaccttcaggcgcacgctcggggccactctcaggtccctgcccaaatggaggaggccagagatcccaaagccggaaccggagaggaccaggtagtgctgcctggacagggcaaagctcaggaggcaccctctgaaaccccgcggggccctggagagtcagtagagagagctcgcggtggccaggccgtgacctccatggccgccgaagacaaagaacggcccttccggtgcacgcaatgtggtcggagctaccgacacgcagggagccttcttaatcaccaaaaagcgcacacaaccggcctgtacccctgttctttatgtcccaagctgctacctaacctgctgtccctgaagaaccattcccgcacgcataccgatcctaagaggcactgttgtagcatctgcggcaaggcgtttcgcactgccgcacggctcgaggggcacggaagagtgcacgctcctcgcgagggaccctttacatgcccgcactgtcctcgacacttccgccgccggatctcattcgttcagcaccaacagcagcatcaggaggagtggacagttgctggttccggtgcacctgtggctcccgttaccggccggggggatctgcccctgccccccccaccaacacccaccacccctctgctcgatccgagtcctcagtggcctgcggatcttagctttagcctatag

SEQ ID NO: 21971 - DNA, 5490 bp, Artificial Sequence
  Description of Artificial Sequence: Synthetic coding sequence
atggaggacaccccccccagcctgagctgcagcgactgccagcggcattttccgtctcttcccgagctgagccggcaccgcgagctccttcacccaagccctaatcaagattctgaggaagcggatagtatccctagaccctaccggtgccagcagtgtggccggggatacagacatccagggtctttggtcaatcacaggaggacccacgaaactggactgttcccgtgtactacgtgcggtaaggacttcagcaacccaatggctttaaagtcgcatatgcgaactcatgctcctgagggccgccgaagacataggcctccacgacccaaagaagcgactcctcatctgcagggggaaacggtttccaccgattcctgggggcagagattaggaagtagcgaaggatgggagaaccagacgaaacataccgaagaaacccccgactgcgaaagcgtaccagaccctagggccgcaagcgggacctgggaggacctgccaacacgtcaacgtgagggattggcgagtcatcctggtccagaagacggtgcagacggttggggcccttcaaccaactccgcccgggccccacccctgcctattcctgctagttcactcttatccaatctagaacagtatctcgcagaatctgtggtcaatttcaccggaggccaggaacctactcagtcgccgccagccgaagaagagcgcagatacaaatgctctcagtgcggcaaaacatacaagcatgctggcagcttaacaaaccacaggcagtcccatactctgggtatttatccatgcgcaatctgtttcaaagagttctccaacctcatggccctgaaaaatcactctcgcctgcacgcccagtatcgaccataccattgtccccactgtcccagagtgtttcgcctgcctcgggaactgctggagcatcaacagtctcacgaaggtgagcgacaagagccgcgttgggaggaaaaaggtatgccaaccacaaacggccatactgatgaaagcagtcaggaccagttgcctagtgcccagatgctcaatggcagtgccgagctgtctacgagtggggagttagaggattccggtctggaggagtacagacccttcagatgcggggattgtggccgcacataccgccatgccggctcccttatcaatcataggaaatcccaccagactggcgtctatccctgctctctctgcagcaagcagctctttaatgccgccgcccttaagaaccatgttagagctcaccaccggcccaggcagggcgtgggagagaatggccaaccctctgtgcccccagctcctctcttgctggcagagacgacacataaggaagaggaggacccgaccactacactggatcaccgtccctacaagtgcagcgagtgtggccgagcatatagacatagaggctcactggtcaatcaccggcactcccacaggaccggcgaataccaatgctctttatgtcccagaaagtaccctaacctcatggccttgaggaatcacgtgcgggttcattgtaaggccgcccgacgaagcgctgacattggagcagaaggggccccctcccacctcaaggttgagctgcctcccgaccctgtcgaagcagaggcggccccacataccgaccaggatcatgtatgtaaacacgaagaggaagcaactgatattacccccgcggcggataaaacagccgcccacatatgttccatctgtggcttactgttcgaagatgccgaatcactggagagacatggtcttacacatggggccggagaaaaagaaaactcgcgcaccgagactaccatgagccccccccgggcctttgcctgtcgcgactgtgggaagtcctacagacattccgggtctttgattaaccatcgacagacccatcaaaccggagatttctcctgcggcgcttgtgctaaacattttcacaccatggccgctatgaaaaatcacttgcgccggcatagccggcgcagaagcaggagacacaggaaacgggctggtggagcaagcggcggtagagaggcgaagttactggctgcggagagttggacacgggagctagaggataacgagggcctggaaagcccccaggacccctccggcgagtcccctcacggcgctgagggcaatctggaatccgacggggactgtctgcaagccgaatccgaaggtgataagtgtggactagaacgggatgagacacactttcagggtgacaaagagtccggggggacaggagaggggctcgagcggaaggacgcaagcttactggataacctcgacataccaggggaggaaggcggcggcacccacttctgtgactccttgacaggggttgacgaagatcaaaagcctgccacaggacagcctaacagtagttcacattcggccaatgcggttactggatggcaagccggcgccgcacacacctgttcagattgtggccatagtttccctcacgctaccggactcttatcacaccgcccgtgtcatcctcccggaatctaccagtgctcactgtgccctaaagaatttgattctttgcctgccctaaggtcccatttccagaatcaccgccctggagaggcaacgagtgctcagccatttctgtgctgtttgtgcggcatgatcttcccaggccgcgctggataccggctgcacaggagacaggcccactcctcttccgggatgaccgagggcagcgaggaggaaggggaggaggagggagtagctgaagccgcaccagctcgatcccctccactgcagctctctgaagcagaactcctgaatcagcttcagcgtgaggtcgaggccctggacagcgccggctacggccacatttgtggctgttgcggtcagacctatgacgaccttggatcacttgagcgccaccatcagtctcagtcttctggcaccacagcagacaaagccccaagccctttaggggtagccggggacgcaatggaaatggttgttgattccgtgcttgaggatatagtgaattctgtgtctggcgagggtggggatgctaagtcccaggaaggcgctgggacaccactcggcgattccctctgcatccaaggaggcgagtcactgctggaagctcagccgcgtccctttagatgtaatcagtgcggtaagacataccggcacgggggcagcctagtgaaccataggaaaatccaccagacgggagacttcctgtgcccagtttgttctcgctgctatcctaacctggcagcttatagaaatcatctgcgcaatcaccccaggtgcaagggcagtgagccccaggtcggtcccattcccgaggccgccgggtccagtgaactacaggtcgggccgattcctgaaggaggcagcaacaagccacaacacatggccgaggagggcccgggtcaagcagaggtggaaaaactgcaggaggaacttaaggtggagccactggaggaggtggcccgggtaaaagaggaggtgtgggaagaaaccaccgtgaagggagaagaaattgaaccgagactggaaacggccgaaaaagggtgccaaacggaggcgagttctgaacggccattcagctgtgaggtctgtgggcggagttacaagcacgccggatccctgatcaaccacaggcagtcgcatcagactgggcacttcggatgtcaggcgtgctcgaagggattcagtaatcttatgtcactgaaaaaccatcggcgcattcacgctgacccccgacggttccgctgttccgaatgcggcaaagcatttcggttgcggaagcagctggcctcgcaccagcgcgtgcatatggaaaggagaggcggcggcgggacacgtaaggccactcgggaagaccggccctttaggtgtggccagtgtggacgtacatatcgacatgccggctctcttcttaatcatcgtagaagccacgaaaccggccagtatagctgccccacgtgcccgaagacatatagcaatagaatggctttgaaagatcatcagcgcttgcacagcgagaaccgacggcgccgagccggcaggtctaggcgcactgccgtgcgatgtgccctctgtggtagaagcttcccaggaaggggctccctagagagacatctgcgagagcatgaggagacggagagggaacctgctaatggtcaaggcggcctggacggtaccgccgcctctgaagcaaatctcacagggagccagggactggaaacacagctcggtggcgccgagcccgtgccccacctcgaagatggggtccccaggcccggggaacggagccagtctccaatccgggccgcttcctcagaggcgccggagccgctctcctggggcgctggcaaggcaggaggatggccagtcgggggtggcctggggaaccattccgggggctgggttccccagtttctgacccgctctgaggagccggaggacagtgtgcatcgatcaccatgccatgctggcgactgtcagctgaatggaccaactctttcccatatggactcctgggacaatcgcgataacagttctcagctccaacccggcagccatagctcctgtagtcagtgcggaaagacctattgtcaaagtggaagtttactcaaccataatacaaacaagaccgaccgccattattgtcttctgtgctcaaaagagtttttgaaccccgtggccaccaaatcccactcccacaaccatattgacgctcagacattcgcatgtccagactgcggaaaggcatttgaatcacaccaggaactggcgtctcacctccaggctcacgctcgcggacacagtcaggtgcccgcacagatggaagaggctcgcgatcctaaggccggtacaggcgaggaccaggtcgtgctacctggacagggtaaggcccaggaagccccttccgagacgccacgcggccccggtgaatctgttgaacgggctcgcggtggccaagcagtgaccagcatggcagctgaagataaagagcgcccttttagatgcactcagtgcggtcggtcgtacaggcacgcaggcagtttgttgaatcatcagaaggcccacaccaccggattgtatccctgttccctgtgccctaaattacttcctaatctgctttcacttaaaaatcatagcagaacacacacagacccaaaaagacactgctgctccatctgtgggaaagcgttccggaccgctgccaggctcgagggccacgggagagttcatgcgccaagagaaggaccctttacgtgccctcattgtcccaggcactttcggaggagaatctcgttcgtgcagcaccagcaacagcatcaggaggagtggacagtggctgggagtggacgcgggcatgaaggttctcaggaggaggttggaacccagtggcggggcaagagctctccaaaagtcggaggaggcgctcgatccgagcggcgcgagccgcgcggtttttag

SEQ ID NO: 21972 - DNA, 723 bp, Artificial Sequence
  Description of Artificial Sequence: Synthetic coding sequence
atggaggacaccccccccagcctgagctgcagcgactgccagcggcactttccttcactgcctgagttgtcaaggcatcgggagctgctgcatccctcccccaaccaagactccgaggaggccgatagtatcccacgcccgtataggtgccagcaatgcgggcggggataccgacatcctggctcactggtgaatcatcgtcgtacacatgaaacaggcctgttcccatgtaccacttgcggcaaagatttttctaacccaatggcactcaagtcacatatgagaacccacgctccagaagggcgccggaggcaccgtcctccacggccaaaggaggcgactcctcatttacagggcgagacagtgagtaccgacagctggggccagagactgggatcctctgaaggatgggaaaatcagaccaagcataccgaagaaaccccagactgtgaatccgtgcccgatccccgcgctgcaagcggcacgtgggaggatctgccaacaaggcaacgggagggactggcatcacaccctggtcctgaggatggagccgacggctggggaccttctactaatagcgcaagggccccaccactgcccattcccgcctcatccttgctcagcaacttggaacagtatctggccgaatctgtagtaaactttaccggaggtcaggagccaacccaatccccacccgccgaggaggaaagaagatacaagtag

SEQ ID NO: 21973 - DNA, 582 bp, Artificial Sequence
  Description of Artificial Sequence: Synthetic coding sequence
gagcggcggtacaagtgcagccagtgcggcaagacctacaagcacgcaggatccctcacaaaccacaggcagtcccacacccttggcatttatccctgtgccatctgtttcaaagaattcagcaatctgatggcgcttaaaaatcactctcggttgcatgctcagtacaggccctaccactgtccccattgccccagagtcttccgactgcctagagagcttttggaacaccagcagagccacgaggctgcacgcccgttttcctgcgaagtgtgcggccggtcgtacaagcacgcgggatccctgattaatcaccggcagtcccaccagacaggccactttggttgtcaagcgtgttccaaaggtttttctaacctgatgtcattaaaaaatcacaggcgcatccacgcggatccgcggagattccggtgcagcgagtgtgggaaagcctttcgtttgaggaaacagttggcctctcatcagcgggtacatatggaacggcatcgtcccttccgctgcgggcagtgcgggcgcacctaccgacacgctggcagccttttgaaccacaggcggagccactag

SEQ ID NO: 21974 - DNA, 1707 bp, Artificial Sequence
  Description of Artificial Sequence: Synthetic coding sequence
atggcccaggtggacagccaggaccggtggggcgaggccagccccctctcctccttgactgaggaagctcacgatacccaaatgctatccatgaacctggagtccgacgatgaggatggaggggaggcagagaaagagggaactgcagatcctgttgcctgcccccgaggctcgtcccccgtcacccatgaaaatcctgacttaccttggccacatcctttgggtaaggaagaagagaaatttagtgactcctctagtgccggtggcatgggtcagaagccagttgaaatgtctggtaaggctagttggtcccgtgatgttaccaagatcaatgagacacaaggatcccccggtgcctctcgggccctgggcagtttgccttcggggctcgctcacaaactgttgggtcaaatgcagccgctgggggatcgtcttcctgctggtgacgacggatactccggtgccaatcaggatgctgtgttagacgtcccgcctagcttcccaagcaacgggaaatacttgtgtgctcataagagcgtagatacctccgcgggcaactcttcactgctgtgtttcccaagaccagggtcaaattgggaccttccaacccaagaaactcatactcccgcccaggcctcggcaacccccgcttctcttgctgcagccgtcctggctaaggctaggaatagtcgtaaggtccagaaccaggccggccgccgtgaaggcggcgaggcagaagcccgcccttacaggtgtttgcgtgggggtcgcgcttttcagaagccctctaagccgttgagtccagcagagacacgaggaggggcagccaaacgctacgcatgcgaactgtgcggcaaggcgtattctcaccgcggcacactgcagcagcatcggaggctgcacactggcgagcggccatatcagtgttccttctgtgacaaggcctatacttggagctccgaccacaggaaacatatacggacccatactggggagaagccttacccctgtcccgactgcggcaaggcattcgtccgctctagtgaccttcgtaaacaccagagaaacatgcacagtaataataagccatttccttgctccgaatgcggacttacattcaataagccactgtctttgttacgtcaccaacgtacccacttaggcgccaagcccttcaggtgcccagcctgtgatagggagtttgccgtggcatctcggatggtggaacaccaacgcgtccattctggcgaacgcccctttccctgtcccacttgtggcaagtgtttcacaaagtcctccaatttgtctgaacatcagacactccataccgggcagaggccctttaaatgtgcagattgtggcgtagcctttgcccagccatcaaggctggttcgacaccagcgaattcataccggtgagagaccatttccgtgtacacagtgtggtcaggctttcgcccggtcaagtaccctgaaaagacatcaacagatccactcaggagaaaaaggtttcctgtgtgcagaatgcggccgggctttcagaatagcatccgagctggcccaacacattcgtatgcacaacggtgagcgcccgtaccaatgtgaagattgcggccaagcctttactcgcagcaaccatcttcagaggcatagagccaagcacggaacatgcaagaaggaaccaattcctagttcgagcgatgagtag

SEQ ID NO: 21975 - DNA, 1821 bp, Artificial Sequence
  Description of Artificial Sequence: Synthetic coding sequence
atgagccacaccgccagcagctgccaggagctggtggagaactgcgcagtgcacgttgccggcatggcccaggaggattcccgacgaggccaagtcccctctagcttttaccatggtgccaaccaggagctggacctatccaccaaagtatataaaagagagtctggctccccatactctgtcctggttgacaccaaaatgtcaaagccccacctccacgagaccgaagaacaaccctatttcagagagaccagggcagtctctgatgtgcatgcagtgaaggaagatcgcgaaaattccgacgatacagaggaggaagaggaggaggtaagctacaagagggaacagattatagtggaggtgaatctaaataaccagaccctcaacgtctcaaaaggagagaagggtgtttcatctcagtcaaaggagactccggtgctgaagactagcagcgaggaagaagaagaggagtctgaggaggaagcgacagatgacagcaatgattacggcgagaacgagaagcagaagaagaaggagaaaatcgtagagaaggtcagtgtgacgcaaaggaggacgcgcagggcagctagtgtagcagccgcaaccacttcgcctacacctcggaccaccaggggccgccgtaagtcagttgagccaccaaagaggaaaaaacgggcaaccaaagagcctaaggctcccgtgcagaaggcaaaatgcgaagagaaagaaaccctgacttgcgaaaagtgtcccagggtgtttaacactcgctggtacctggagaagcacatgaatgtcactcaccgtaggatgcagatctgcgacaaatgtgggaaaaaatttgttctggagtctgagctgagcctgcaccagcagaccgactgtgaaaaaaatattcaatgcgtctcttgtaacaagtcctttaaaaagctgtggagtctacacgagcatatcaagattgtgcacggttatgccgaaaagaagttttcctgtgagatctgcgagaaaaagttttacaccatggcccacgtcagaaagcatatggtcgcacacactaaagatatgccctttacgtgtgagacatgtggcaagagtttcaagaggagcatgtcgcttaaggtccattcgttgcagcacagcggggaaaaacctttccgctgcgagaattgtgacgagaggttccagtacaagtatcaactccgcagccatatgagtatacacattggacataagcagttcatgtgtcagtggtgcggaaaggactttaatatgaaacagtattttgatgagcatatgaaaactcacactggcgagaagccgtttatttgcgagatttgcgggaaatcttttacctcacgcccaaacatgaaacgacaccgaagaacccataccggggaaaaaccgtacccctgcgacgtgtgtggtcaaagatttcgattttccaatatgctgaaggcccataaggaaaagtgctttcgggtaacatctccagtgaacgttcctcccgccgtccaaattcccctgactacaagcccagcgacaccggttccatccgtggtcaatacggctactactcctaccccgcccattaatatgaaccccgtttccaccctgcccccaaggcctatcccacatccattttcacacttacacatacatcctcatccacaccaccctcaccatctaccgataccacctgtccctcaccttccccccccgcccgcactctttaaaagcgaaccactgaatcatagagggcaatccgaagacaatttcctgcgacacctggccgagaagaatagctctgcccagcatcactag

SEQ ID NO: 21976 - DNA, 1821 bp, Artificial Sequence
  Description of Artificial Sequence: Synthetic coding sequence
atgagccacaccgccagcagctgccaggagctggtggagaactgcgctgtgcacgtcgcgggcatggcacaagaggacagtaggcgcggccaggtgccatcttccttttaccacggagcgaaccaggagttggacctgtccaccaaagtgtacaagcgcgaatcaggatcaccatactccgtgctggtcgacacgaagatgtcaaaaccccatctgcatgagacagaggaacagccgtacttcagggagactagggcagtctccgatgtgcatgccgtcaaggaagaccgcgaaaatagcgacgataccgaagaggaagaggaggaggtgtcctacaagcgggaacaaattatcgtggaggtgaatctcaataatcagaccctgaacgtgtcaaaaggcgagaagggtgtgtcatcccagagcaaggagacccctgtgctgaaaacatcatcagaggaggaggaggaggagagcgaggaagaggcaactgacgactccaacgattatggggagaatgaaaaacagaagaaaaaggagaaaattgtggaaaaagtgagtgtgacacagcggcgaacaagaagagctgcatccgtggcagcagctaccactagcccaacacccaggaccactagaggccggcgtaaatcagtggagcctcccaaaaggaagaagcgcgccaccaaagaacctaaggcccctgtccagaaggctaagtgtgaggagaaggagactctgacatgcgagaaatgtccaagagtgttcaacactcggtggtacctggaaaagcacatgaacgtcacacataggaggatgcagatctgtgacaaatgcggcaagaaattcgtgcttgagtctgaactgtcacttcaccaacagaccgattgtgaaaagaacatccaatgtgtcagctgcaacaaatccttcaaaaaactgtggagcctgcacgaacacattaaaatcgtccacggttatgccgaaaagaagttttcatgcgaaatctgcgagaagaagttctatacgatggctcacgtcaggaaacacatggtcgctcacaccaaggacatgccgtttacctgtgaaacttgtggaaagtcttttaagcgatctatgtcccttaaagtgcacagcctccagcactccggagaaaaaccttttcgctgtgaaaattgcgacgagcggtttcagtataagtatcaactgcggagccacatgagcattcacataggtcacaaacagttcatgtgccaatggtgcggcaaagacttcaatatgaagcagtacttcgacgagcacatgaaaacacataccggggaaaaaccttttatctgcgaaatttgcggtaaatcatttacgtctaggccaaatatgaagaggcatcgtcggactcacacgggtgagaaaccctacccttgtgacgtatgcgggcagaggtttcggttttcaaatatgctgaaagcgcataaggagaagtgttttagagtgacaagccctgtcaatgtccccccggccgtccaaattccgctgactactagccctgctacccctgtgcccagtgtagtcaatacagcaacaactcccacacctcccattaacatgaaccccgtgtctacactcccgccgaggcccattccccatccctttagccatctccatatccacccccaccctcatcacccgcaccacctgccaataccccctgtgcctcacctgccccctccaccggcgctgtttaagagtgagcccctgaaccatcgaggccaaagtgaagataactttctccggcatctagcagaaaaaaacagctccgctcaacaccattag

SEQ ID NO: 21977 - DNA, 1281 bp, Artificial Sequence
  Description of Artificial Sequence: Synthetic coding sequence
atgagccacaccgccagcagctgccaggagctggtggagaactgcgctgttcatgtagctggtatggcgcaagaggacagtaggaggggacaggtgccttcatccttctatcacggcgctaaccaagagcttgatctcagtacaaaagtgtataaaagggaaagtggctctccctattccgtcctggttgacaccaaaatgtcaaagcctcatcttcacgagaccgaagagcaaccttatttcagagagacccgggcagtcagcgacgtgcatgccgtcaaggaggatagagagaatagcgatgacacagaagaggaggaagaagaggtcagctataagcgtgaacagattatagtagagtgcgttagttgtaacaagagcttcaagaagctttggagtctccacgagcacatcaagatagtacacggttatgccgagaaaaagttctcttgtgagatttgtgagaaaaagttttacaccatggcccacgtaagaaagcacatggttgcccacacaaaggatatgccattcacctgtgaaacttgtgggaaatcctttaagcgctccatgagtcttaaggtgcactccctccagcactctggggaaaaacctttccgatgtgaaaattgcgacgagcgatttcaatataagtatcagttgcgaagtcacatgtccattcatattggccacaagcagtttatgtgtcagtggtgtgggaaagacttcaacatgaaacagtattttgacgagcatatgaagactcatacaggggagaagccttttatttgtgagatctgtggcaagagctttactagtcgacctaatatgaaacgacaccggaggactcatacaggggaaaaaccctatccttgtgatgtttgcggacaaagatttcgctttagtaacatgttgaaagcccacaaggaaaaatgtttccgcgtgactagccccgttaacgtgccccctgcagtgcagattcctctcacgacctcccctgcgactcccgtcccaagtgtggtgaacaccgcaaccactcccacgccgcctatcaacatgaaccccgtgagcacactcccccctagacccatcccccacccattttctcacctgcatatccacccacacccacaccacccgcatcacctccctattccccctgtcccacatctgccgccacctccagctctctttaagtcggaacccctcaaccacagaggacagtccgaagataatttcctccgccacttagccgaaaaaaactccagtgcccagcaccattag

SEQ ID NO: 21978 - DNA, 1848 bp, Artificial Sequence
  Description of Artificial Sequence: Synthetic coding sequence
atggccgagcgggccctggagcccgaggccgaggccgaggccgaggccggggccggaggggaggcagccgctgaggaaggcgcagccggccgcaaagcccgtggaagacctagattaaccgagagcgacagggcacggcgaagactcgaaagtcggaagaagtatgatgttcgccgggtgtacctgggtgaggcacatgggccctgggttgaccttcgtaggcggtcaggatggagcgacgccaaacttgcagcttacttgatttctctagaaagaggacagcgctccggacggcacggcaaaccctgggagcaggtccctaaaaaacctaagcggaagaagcgccggcggcgcaatgtcaactgtctcaagaacgtcgttatctggtatgaggatcataaacatcggtgcccctacgaaccccacctggccgagctggatcctaccttcggcctctatacaacagcagtgtggcaatgtgaagcaggacaccgctatttccaggatttacatagtccccttaagcccctgtcagactccgaccctgattctgataaagttggcaatggcttggtcgctgggagcagcgacagcagttcatcaggctccgcttctgacagcgaggaatctcctgaggggcagcccgtgaaagcagctgctgccgcagcagccgctacccctaccagcccagtgggctcttctggactcataacccaggagggagtccacattccattcgacgtgcatcacgtagaatccttggccgagcagggcaccccactctgttctaatcccgcaggcaacggacctgaggccctcgagactgttgtctgcgtgcccgtgccagttcaagttggggcaggtccgagtgccctgttcgagaatgtccctcaagaggcactcggagaagtcgttgccagctgccccatgcctggaatggtccctggatcacaagtcattatcatcgccggcccaggatatgacgctctcacagccgagggcatccatttgaatatggccgccgggtctggcgttccggggagcggacttggtgaggaggtgccctgcgctatgatggaaggagtcgctgcatacactcagactgagcccgaaggctcccagccatcgaccatggacgccactgcagtggctggcattgagaccaagaaggagaaggaagatttgtgtcttttaaagaaagaggagaaggaagaaccagtggctccagagctcgcaaccacagtgccagagtccgcggagccagaggctgaggccgatggggaagagttggatggcagtgacatgtccgccattatctacgaaatccctaaagaacctgaaaagagacgaaggtcaaagcgcagtcgtgtgatggacgccgatgggctcctagagatgtttcactgcccatatgaaggatgcagccaggtttacgtggctctgtcatcttttcagaatcatgtcaatctggtgcatcggaagggtaagacaaaagtctgcccccatcctggctgcggaaagaaattttatctgtccaatcacctccggagacacatgattatacattccggtgttcgggagtttacttgcgaaacctgcgggaagagcttcaagcggaagaatcatttggaagtgcacagaagaacacacacaggtgagacaccgctccaatgtgaaatttgcgggtatcagtgtagacagcgtgcttcacttaactggcacatgaagaaacacaccgctgaagtgcagtataattttacgtgtgatcggtgcggtaagcggttcgagaaactagattccgtgaagtttcacactctcaaaagccaccctgaccacaagcccacctag

SEQ ID NO: 21979 - DNA, 1746 bp, Artificial Sequence
  Description of Artificial Sequence: Synthetic coding sequence
atgctgtgcaacaaggagttcctgggcggccacatcgtgcggcacgcccaggcccaccagaagaaaggctccttcgcctgcgttatatgcggcaggaagtttagaaatcggggcttgatgcagaaacacctaaaaaaccatgttaagaaaatacagagacagcagattgctgcagcccagcaggatgatcaggaggtgactgcgctagaagagatcaattgcagttcctcttccatttcctttgagaatggcaacagcgactcaaaggatttggaagtcgagacactcaccgcttcctccgaggggaacaaggaggttatcccagagcacgtggctgagtttattgaaattccgatttcagtgcctgaagacgttatagagaacgtaattgaaaacggctcaccgaacaatagcctaaacaacgtcttcaaaccactgacagagtgcggagatgattatgaagaggaagaagatgaagaaggcgactacgaggaagatgactacgacctaaaccaagaaacttccgtgatccacaagattaacgggaccgtatgtcacccaaaagacatttacgctaccgaccaggagggcaattttaagtgccccgcgttgggctgcgtgcggatctttaaaagaattggctttctgaacaaacatgccatgaccgttcacccaacagacctcaatgtgagacagaccgttatgaaatggtcaaagggcaaatgcaaattttgtcagcgccagttcgaggactcccaacattttattgatcacctgaataggcactcctatcccaatgtatatttctgcctgcatttcaactgtaacgaatccttcaagctaccatttcagcttgctcagcacactaaaagccatcggatatttcaggcccagtgcagctttcctgagtgccacgaattatttgaggatctccctcttctgtatgaacacgaggcccagcattacctatccaaaactccagagtcaagtgctcagcccagcgaaacgattttgtgggatgtgcagaccgacagcaacccaaaccaggaaaaagattcttcaagtaatgagaagcagaccatctcactgcctgtctccacttctaaatctaggaaagaaagcactgaaccaaagacttgcatcgagtcaatggaaaagaagactgattccctggtgcaaaatggcaatgagcgatccgatgataccgtgagcaatataagcctgattgaccagaagatgcctgacatcgaacctaattccgagaacaactgttcttcatcagacatcgtgaacggccatagcgagattgagcagactcctctggtgagttcggatccagccctgaaaattgacactaaccgaataaggactgagaacgggtccattctaccctcagttgtgccccaagaacataatactctcccagtatcccaggctcctagcaaacctaaccttacttcagagcacacaagttacggactgattttgactaaaccgtacgtccggccccttccaccgagctatctggacgaaagatacttgagtatgcccaaacgcagaaaattcctaactgaccgcgttgatgcctgtagtgatcaggacaatgtgtacaagaaatccgtgaagcggcttcgctgcggaaagtgtctcacgacttattgcaacgctgaggcactggaggcccatctcgcccagaagaaatgtcagaccctgtttgggtttgatagcgacgacgagtccgcttag

SEQ ID NO: 21980 - DNA, 3180 bp, Artificial Sequence
  Description of Artificial Sequence: Synthetic coding sequence
atgaacatgagccaggccagcgtgagcttccaggacgtgaccgtggagttcactcgcgaagaatggcagcaccttggaccagtggaacgaaccttatatagagatgtgatgctcgagaactacagccacctgatctctgtgggatactgcatcactaagcctaaggtgataagcaagctggaaaaaggtgaggaaccctggagcctcgaggacgagttcctgaaccagagatatcctggatactttaaggtggaccacattaaagggatcagagaaaagcaggaaaaaccgctgtggcaagagatctttatctcggatgccgacaaaaccctttcaaaggaaggccagaaagttctggaaaagccatttaatctggaaattgctcctgagctgtcagagaaaatctcttgtaagtgcgattctcatagaatgaacttacctgtggcaagccagctgatcatcagtgaaaggaagtacagccgcaaaaagaccgagtatatgaatgtttgcgagaaactgcagctcgatatcaaacatgaaaaggctcatgccgaggaaaagagttacgaacatggtgaaaatgccaaggccttttcatataagaaggaccagcactggaaattccaaactcttgaggaaagttttgagtgtgacggatcgggtcagggactctacgacaaaactatctgcatcactccacagtccttcctcacgggcgagaagagctgcaaggatgacgagttccggaaaaacttcgataaaatcaccctgtttaaccatatgaggactgacacccgaggaaagtgcagtgacctgaatgagtatggaacttcttgcgataagaccactgctgtggagtacaataaggtacatatggctatgacacattacgaatgtaatgagagaggaatcaattttagccgaaagtcgcccttaacacagtcacagaggactatcaccggatggtctgcattcgaatctaacaaatgtgaggagaactttagccagtcttctgcccatatcgtgcatcagaagacacaggcaggggataaatttggggagcataacgaatgtactgatgccctgtaccagaagcttgatttcacagcacatcagagaatccataccgaagacaagttctacttgtccgatgagcatggtaagtgtaggaaaagcttctaccgtaaggctcacctgattcagcaccagcggccccactccggggaaaaaacctatcagtatgaagaatgcgcaaaaagtttttgctcgtcctctcatcccattcagcaccctggcacatacgtgggctttaaattgtatgagtgcaatgaatgtggtaaggctttctgccagaacagcaatctcagtaagcacttgcgcattcatactaaggagaaaccgtgtgataataatggttgcggaaggtcatacaagtctccactgatcggacaccaaaagacagatgccgaaatggagctttgcggcgggtctgaatatggcaaaacatcccatctgaaggggcaccaacgcatactgatgggggaaaaaccctacgaatgtatcgagtgcggtaagactttctccaaaaccagtcatttacgcgcacaccaacggatccatactggcgagaagccctatgaatgcgtcgagtgtgaaaagacgttttcacataagacccacctctccgtccatcagagggtgcacaccggcgagaaaccctatgagtgcaatgactgcgggaaaagttttacttataattccgccctccgggcgcaccagaggatccacactggcgagaagccctacgaatgcagcgactgcgagaagacatttgcccataactcggctctccgagctcatcacagaattcacacaggagagaagccttatgaatgcaatgaatgcgggcgatcattcgctcacataagcgtcctcaaggcgcaccagaggatccacaccggcgagaagccctatgaatgtaacgaatgcggcagatcttttacttacaatagcgctctcagggctcatcagaggatccacaccggacgaaaaccctacgaatgttctgattgcgagaagactttcgctcacaattccgccctcaagatccaccaacggatccatactggtgagaagccctacgaatgcaacgagtgtgagaagaccttcgcccacaacagcgctctgcgggcccaccagaacatccacactggggagaaactctacgaatgtagtgagtgtggtaaaacgttcttccaaaagacaagactgtccacccacagaagaatccatactggcgagaagccctacgagtgcagtaaatgcggaaaaacgtttagtcagaagtcatatttgtccggacacgaacgcatacatacaggcgaaaagccgtatgagtgtaacgtttgcgggaagaccttcgtgtacaaagccgccttgattgtccatcaaaggattcacacgggcgagaagccatacgagtgtaaccagtgcggcaaaaccttcagccagagaactcacctgtgcgctcaccaaagaatccatacgggcgaaaagccgtacgagtgcaacgagtgcggaaaaacattcgccgacaacagtgccttgcgcgcacaccatcggatccacactggcgagaaaccatacgagtgcaacgactgtggcaaaacattctccaagacttctcatctcagagcccatctgcgaaccagaagtggagaaaagccttatgaatgttctgagtgcggtaagactttctctgaaaaaagctacgtgtccgcccaccagcgtgtacatacaggagaaaagccatatgaatgtaacgtctgtgggaaaccatttgcacacaacagtaccctaagagtgcatcaaagaatccacacaggagagaagagttatgagtgcaacgactgtgggaagaccttcagccaaaagagccacctgtcagcccatcaaagaatccacacaggcgagaagccctatgaatgtaatgagtgcgggaaggcatttgcacagaactcgacccttagggtacaccagagaatccacaccggtgagaaaccttacgaatgcgatgaatgcggtaaaacgtttgtgcgaaaagcagccctgcgcgtgcatcatacacgcatgcacacccgagaaaagaccttagcgtgcaatggattcggcaaatcatag

SEQ ID NO: 21981 - DNA, 1848 bp, Artificial Sequence
  Description of Artificial Sequence: Synthetic coding sequence
atgagccaggccagcgtgagcttccaggacgtgaccgtggagttcaccagagaggagtggcagcacctcggaccggtggagagaacgctgtaccgtgacgtgatgctggaaaattactcccacctgatatcagtgggatattgtatcaccaagccaaaggtgattagcaaactggagaaaggtgaagagccatggtccctggaggacgaatttctcaaccaaagataccctggctacttcaaagtggatcatatcaaaggaatccgggaaaagcaggagaagccattgtggcaggaaattttcatttccgatgcagataagactctctctaaggaggggcagaaggttctggagaagcccttcaatctggaaatcgcgcccgaactgtcagaaaaaatttcttgcaaatgcgatagccaccgaatgaatttacctgtagcctctcagcttatcatctccgagcgcaagtattctcgtaagaagacggagtatatgaatgtgtgcgagaagctccagttggatattaagcacgagaaggctcacgccgaagagaaatcctatgagcacggggaaaacgctaaagcattttcttataagaaagatcagcattggaaatttcaaacccttgaagagagtttcgagtgtgatggcagtggccaaggcctgtatgataaaacaatctgtatcacaccgcagtctttcttgacaggggagaagtcatgcaaagacgacgaatttcgaaaaaatttcgacaaaatcactctcttcaatcatatgcgaaccgacactagaggtaagtgttcagacctgaatgagtacgggactagctgcgacaaaaccacagccgttgagtacaacaaggtccacatggccatgacgcactacgagtgtaatgaacgtgggatcaatttctcacgtaaaagtccactaactcagtcgcagagaaccataactggctggagcgccttcgagtccaacaaatgcgaagagaacttctctcagtcatctgcacatatcgtgcaccagaagactcaggctggagataagtttggcgaacataatgagtgcacagatgccctgtaccagaagctcgacttcaccgcgcatcaaaggatacacaccgaggacaagttttacttatcggacgagcacggcaagtgtcgaaaaagtttttacaggaaggcgcatttgattcaacatcagcggccacatagcggggaaaaaacatatcaatacgaggaatgtgctaagagcttttgtagctcttctcacccaattcagcaccctgggacctatgtaggttttaagctctacgagtgcaatgaatgcggcaaagctttctgtcaaaattctaacctgagcaaacatcttcgtattcataccaaagagaagccgtgtgataataatgggtgcggaagatcctataagtcccccctcatcgggcatcagaaaacagacgccgaaatggaactctgtggcggatccgagtatgggaagaccagtcatctgaaaggacaccaacgcatactgatgggggaaaagccttatgagtgcatcgaatgcgggaagactttcagcaaaaccagtcaccttcgcgcccatcaaaggattcatactggcgagaagccctatgagtgcgtggagtgtgagaaaaccttttcgcacaagacacacttatcagtgcatcagcgggttcatactggtgaaaaaccatacgagtgtaatgattgcggaaaaagttttacatataactctgccctgagagcacaccagcgaattcatacaggcctcgccgtttgccacgtgggcatccttatggcaactaaaagtctgttccatcagtcctag

SEQ ID NO: 21982 - DNA, 996 bp, Artificial Sequence
  Description of Artificial Sequence: Synthetic coding sequence
atgcggcggaagacccggaacttcaagcacaagaccgtgaaggacaacaaggtgctgaccgagggaagtgatcaggaatcagagaaggataattctcagtgctgtgatcctgcaactaacgaacgagtgcaggctgagaagcgtcagtatgtgtgcacggagtgcgggaaagccttctcgcagtctgctaacttaaccgtgcatgagagaatccataccggggaaaagccatacaaatgcaaagagtgcgggaaagctttttcccacagcagtaatttggtggtccacaggcgcatccacacaggcctcaagccctatacttgtagtgagtgcgggaaaagcttcagcggcaaaagccatctaatcaggcaccaaggcatacacagcggcgagaagacctatgagtgtaaggaatgcgggaaagcctttagtaggtcgtccgggttgatctcacaccacagggtccatactggagaaaaaccatacagttgtatcgaatgtggtaaggccttcagtcgtagttctaatctcacacagcatcagaggatgcatcgaggcaagaaggtgtacaagtgcaaggagtgcgggaaaacctgtggcagcaataccaagatcatggaccaccaaaggatccacacaggggaaaagccgtatgagtgtgacgagtgtggtaaaactttcatacttcgcaagaccctcaacgagcatcagcggctgcaccggagagaaaaaccttacaaatgcaatgaatgcggcaaggcctttacatccaacaggaatttggtggatcaccaacgtgtgcacaccggtgagaagccttacaaatgcaacgagtgcggaaagacatttcgccagacatcacaagtgattctgcacttgcgcacccatactaaggagaagccttacaaatgcagtgagtgtggaaaagcctatcgctatagtagtcagctgattcaacaccagagaaagcataatgaggagaaggaaacctcttag

SEQ ID NO: 21983 - DNA, 120 bp, Artificial Sequence
  Description of Artificial Sequence: Synthetic coding sequence
atgcggcggaagacccggaacttcaagcacaagaccgtgaaggacaacaaggtcctgactgagggctccgatcaagaatctgaaaaggataatagccagtgttgtgacccagcgacatag

SEQ ID NO: 21984 - DNA, 105 bp, Artificial Sequence
  Description of Artificial Sequence: Synthetic coding sequence
atgcggcggaagacccggaacttcaagcacaagaccgtgaaggacaacaaggttctgaccgagggttccgatcaggagtctgaaaaggataactcccagtgttag

SEQ ID NO: 21985 - DNA, 1359 bp, Artificial Sequence
  Description of Artificial Sequence: Synthetic coding sequence
atggccgccgtggccctggccagcggcacccggctgggcctggtgcttgaactgctgcccgggcaaccagccctgcctagagccaggcgcgagagtgttacatttgaggatgtcgccgtttacttctcagaaaacgagtggattggactcgggccagctcaacgagctttataccgcgacgtgatgctagagaactatggtgctgttgcctccctggcgttcccgtttccaaaaccagcacttatctcccagttggaacgcggggagaccccatggtgttctgtaccccgcggggcactggatggcgaggcaccccggggaatttcctcagaaggcgttctcaagagaaaaaaagaggactttattcttaaagaagaaatcatagaggaggctcaggatcttatggttctgtctagcgggccacaatggtgcgggagccaggaactgtggttcgggaagacctgcgaagaaaagtcaaggctgggccggtggcccgggtacttgaacggggggcgcatggaatcttccaccaatgatattatagaagtgatcgtcaaagacgagatgatttcagtggaggagtcaagtggaaacaccgacgtgaataatctcctggggatccatcataaaatcctgaacgagcagattttctatatatgtgaggaatgtggcaaatgtttcgatcagaatgaagactttgatcaacatcagaagacacataatggggagaaagtgtacgggtgcaaggagtgcggtaaagccttttcatttagatcacattgcatcgcccatcagcgcattcactcaggggtcaagccatacgagtgtcaggaatgcgccaaggcctttgtttggaagagtaacctgattagacaccagaggatccacaccggtgaaaagccatttgaatgtaaggagtgcgggaagggatttagtcagaatacgtcactcactcagcaccagaggatccataccggcgaaaagccctatacatgcaaagagtgcggcaagtctttcacacgtaacccagccctgttgagacatcaacggatgcacacaggtgaaaagccttacgaatgtaaagattgtgggaagggattcatgtggaattctgacctgtcccaacaccagcgggttcacactggagacaagccccatgaatgcaccgattgtggtaaatcgtttttttgcaaagcccatctgattcggcaccagagaatccacactggcgagcgtccctacaagtgtaatgactgcgggaaggctttttcccagaattctgtccttataaaacatcaaaggaggcacgccagggataaaccctataactgccaaataagtcatctgctggagcactag

SEQ ID NO: 21986 - DNA, 1281 bp, Artificial Sequence
  Description of Artificial Sequence: Synthetic coding sequence
atgctggagaactacggcgccgtggccagcctggccgccttccccttccctaaacctgctctgatatcccaattagagcggggtgagaccccctggtgctcagttcctaggggggcacttgatggagaagctccgaggggcatttcctctgggtaccctttcctgaaacctgccggtatctcacatccagagcaagtcgaggagcctctgaatctcaagctacagggtgagggtcccagcctgatttgtccagagggggtcctgaaacgcaaaaaggaagattttatcctgaaggaagagatcattgaagaagctcaggacctgatggtgctgtccagtggaccccaatggtgtgggtcccaggagttgtggttcggtaagacgtgtgaggaaaagagcagactgggaaggtggcccggctatctcaacggagggcggatggaatccagtaccaacgatatcattgaagtgatcgtcaaggatgaaatgattagcgtcgaagaatcgtctgggaatactgatgtgaataacttactgggcatccaccacaagatacttaatgaacagattttttacatttgtgaagagtgtgggaaatgttttgatcagaatgaggatttcgatcagcaccagaaaacccataatggagaaaaggtttatggctgtaaagaatgcgggaaagctttctcatttcggagtcactgtatagcgcatcaacgcatccactcgggggtcaaaccttacgagtgccaggagtgcgcaaaggccttcgtgtggaaatccaaccttattagacaccaaaggatccatacgggggagaaaccctttgaatgcaaagaatgcgggaagggcttttcacagaatactagtcttacccagcaccaaagaattcatactggggagaagccttacacatgtaaggaatgcgggaagtcctttactcgcaatcccgcccttctgcggcatcaacgcatgcatacaggcgagaaaccttatgagtgtaaggattgcggtaaaggattcatgtggaacagtgaccttagccagcaccagagagtgcatacaggcgacaagccgcacgagtgtaccgattgcggcaaatccttcttttgcaaggctcatctgattcgtcaccaacgcatccataccggtgagagaccatataagtgcaacgactgcggcaaggccttctcacagaacagtgtcttaatcaaacatcagaggaggcacgctcgtgataaaccctacaactgccagatttcacacctgttagaacattag

SEQ ID NO: 21987 - DNA, 1281 bp, Artificial Sequence
  Description of Artificial Sequence: Synthetic coding sequence
atgctggagaactacggcgccgtggccagcctggccgccttcccctttcccaagccagctctcatctcacagctggaaaggggagaaactccttggtgcagcgtcccccggggcgcactcgatggcgaggctcccaggggcattagttcgggataccctttcttgaaaccagccggaatttcccaccctgagcaggtggaagagcccttaaacttaaaactgcaaggtgaaggaccatccttaatttgccccgagggcgtcttaaaacggaagaaggaggatttcattcttaaggaggaaatcattgaagaggcgcaagatttaatggtgctcagctctggccctcaatggtgcgggtcacaggaactgtggttcgggaagacgtgtgaggagaagtctagactcggtcgctggcctggatacctgaatggcgggcgcatggaatcaagcacaaacgatataatcgaggtcattgtcaaagatgagatgatcagcgttgaagagagcagcggcaatactgatgtgaataatctcctcggcatccaccacaaaatcctgaacgaacagatattctatatatgtgaagaatgtggcaaatgcttcgaccagaacgaagattttgaccaacaccagaagacgcataacggagagaaggtgtatgggtgtaaggagtgcggtaaagcattttctttccggtcacattgtattgctcaccagcggattcactccggtgtgaagccttatgagtgccaggagtgcgctaaggcctttgtgtggaagtccaacctgatcaggcaccagagaattcacacaggagagaagccgttcgaatgcaaagaatgtggcaaagggttcagccaaaacacttcgttaacccaacatcagcgcatccacacgggcgagaaaccgtacacttgtaaggagtgcggaaaaagtttcacaagaaacccagccttactccggcaccagaggatgcacactggcgaaaagccgtacgagtgcaaggattgtggcaagggctttatgtggaattctgacctatctcagcatcagcgggtgcacactggagacaaaccacatgaatgtaccgattgcggcaagagctttttttgtaaagcacacctaatcaggcatcagagaatccacactggcgaacgaccctacaagtgcaatgactgtggcaaggctttttctcagaattctgtgcttatcaagcatcagcggaggcacgcgagagataagccatataactgccaaatctcacatctactcgagcattag

SEQ ID NO: 21988 - DNA, 786 bp, Artificial Sequence
  Description of Artificial Sequence: Synthetic coding sequence
atgatctacaagtgccccatgtgccgggagttcttcagcgagcgggcagatctgttcatgcatcaaaaaatccatactgctgagaaacctcataagtgcgataagtgcgacaagggctttttccacattagtgaattacacattcactggcgagatcatactggcgagaaggtttacaaatgcgatgactgtggcaaggacttctcaacaaccacaaagctgaaccgccacaaaaagattcacaccgtcgagaaaccctataaatgctacgagtgcggcaaagcattcaattggagctcccatctacagatccacatgcgggtgcacactggggagaagccatatgtctgttccgagtgcggtaggggcttttcaaactcatcaaacctctgtatgcatcaacgtgtccatactggcgaaaaaccattcaagtgcgaggagtgcggcaaagcttttcggcatacctcaagtctctgcatgcatcagagagtgcataccggtgagaagccatataaatgctacgagtgcggaaaggcattttcccaatccagctccctgtgtattcaccagcgggttcacacaggcgagaagccatatagatgttgcggctgtgggaaagcctttagccagtcctcatccctgtgtatccaccagagggtccataccggagaaaagcccttcaagtgcgacgaatgcgggaaagcgttctctcagtctacgagtttgtgtatacaccaaagggttcacactaaagagaggaatcatcttaaaatctcagtgatctag

SEQ ID NO: 21989 - DNA, 786 bp, Artificial Sequence
  Description of Artificial Sequence: Synthetic coding sequence
atgatctacaagtgccccatgtgccgggagttcttcagcgagcgggccgatctctttatgcaccagaagatccataccgccgagaagccgcacaaatgtgacaagtgcgacaagggtttttttcacattagcgagcttcatatacattggagagatcacactggggagaaggtgtacaagtgcgacgactgcggcaaggacttctccacaactacaaagctcaaccgccataaaaaaatccacaccgtggagaaaccctacaaatgctatgaatgtgggaaagctttcaactggtcaagccacctccagatacatatgcgcgtgcacacgggtgagaagccatacgtgtgttccgagtgtgggagggggtttagcaacagcagcaacctgtgtatgcatcaacgcgtgcacaccggagagaaaccattcaaatgcgaagaatgcgggaaggctttcaggcatacctcctccctgtgcatgcaccagagggtacacactggtgagaagccgtataaatgctacgagtgtggaaaggcattttcgcagagcagctccctctgtatacaccagagagtgcatacgggggaaaagccttaccgatgttgcggttgcggcaaagcctttagtcaatcatcctccctctgcatccaccaacgcgtacatactggggaaaagccttttaaatgcgatgagtgcggcaaggccttttctcaaagtacatctctgtgcattcaccagcgcgtacatacaaaagagcgcaatcacctgaagatcagtgtgatttag

SEQ ID NO: 21990 - DNA, 600 bp, Artificial Sequence
  Description of Artificial Sequence: Synthetic coding sequence
atgatcgtggtgcggatcctggccctgcagcagaacctgatcgacatacgcaagtccactcagtggagaagtcccataaatgtgaccagtggcaaggccttcaattggtccagccaccttcagatccacatgcgggtacatacaggcgaaaaaccctacgtctgctccgagtgtggccgtggatttagcaacagctctaacctctgtatgcaccagcgcgtccatactggcgaaaaacctttcaagtgcgaggagtgtggcaaggcgttccgtcacacatcttcactctgcatgcatcagcgagtccacaccggggagaaaccctacaaatgctacgaatgcggcaaggctttctcccagagcagctctctgtgcatccatcagcgcgtgcacacgggagagaaaccctatagatgctgcggctgcgggaaggccttttctcaatcaagttctttatgtattcatcaacgcgttcacacaggcgaaaaaccctttaagtgcgatgagtgcggtaaagcatttagccagtctacatccctgtgtattcatcagcgcgtgcatacaaaggaacgcaaccatctaaaaatatccgtgatctag

SEQ ID NO: 21991 - DNA, 786 bp, Artificial Sequence
  Description of Artificial Sequence: Synthetic coding sequence
atgatctacaagtgccccatgtgccgggagttcttcagcgagcgggccgatctcttcatgcatcagaagatccacacagcagagaaaccccataagtgcgataaatgcgataagggattttttcacatttcggagctgcacatacactggagagaccacacgggagaaaaggtgtacaagtgcgatgattgtgggaaagacttcagtactaccacaaaacttaatcgacacaagaagatccacaccgttgaaaagccctacaagtgttacgaatgcggtaaggctttcaattggagcagccaccttcagattcatatgcgggtccatacaggtgaaaaaccttatgtctgctctgagtgcggccggggcttctccaactcctccaatctctgcatgcatcaacgagttcatacaggcgaaaagccattcaagtgcgaagagtgcgggaaggccttccgccatacctcaagcctctgcatgcaccaacgtgtacacacaggtgagaaaccatacaaatgttacgagtgcggtaaggcatttagccagagcagctcactgtgtatccaccaacgtgtgcatactggggagaagccataccggtgctgtggatgtgggaaagccttctctcagtcctcctcgttatgcatccatcaaagagttcatacaggcgagaaaccgttcaaatgtgacgaatgcggaaaggcctttagccagtcgactagcctctgcatccaccaaagagtacacactaaagagaggaaccatctgaaaattagtgtcatttag

SEQ ID NO: 21992 - DNA, 786 bp, Artificial Sequence
  Description of Artificial Sequence: Synthetic coding sequence
atgatctacaagtgccccatgtgccgggagttcttcagcgagcgggccgacctgttcatgcaccagaagatacacacagccgagaaaccacataagtgcgacaagtgcgacaaaggcttttttcacattagcgaattacatatccactggcgcgatcacaccggtgaaaaggtttacaaatgcgacgattgcggaaaagatttcagtactacaacaaagcttaaccggcacaagaaaatccacactgtagaaaagccttataaatgctacgaatgtggaaaagcatttaattggtccagtcacttgcagattcatatgcgggtgcacacaggggagaagccctatgtatgtagcgaatgcggtcggggatttagtaatagctcaaacctctgcatgcatcagagagtccacaccggggaaaagccctttaagtgcgaagagtgcgggaaagcatttcgccacacatcaagtctgtgtatgcatcagagagttcacacgggggaaaaaccttacaaatgctatgagtgtggtaaagcattcagccaatcttcatccctgtgtattcatcagagggttcacaccggcgaaaaaccttacaggtgttgcggttgtggcaaagctttcagtcagtcctctagtctatgtatccaccagcgagttcacacaggcgagaaaccgttcaagtgtgacgagtgtgggaaagcgtttagccaaagcacttctttatgcatccaccaacgcgtgcacacaaaagagcggaaccatttaaaaatctcggtgatctag

SEQ ID NO: 21993 - DNA, 2037 bp, Artificial Sequence
  Description of Artificial Sequence: Synthetic coding sequence
atggccctgccccagggccagctgaccttcaaggacgtggccatcgagttttctcaagaagagtggacgtgcctggacccggctcagaaaacactctatcgggatgtgatgctggagaactatcggaatctagtgtctcttgatatcagctgcaagtgtgtgaacaccgatttgccccctaaggggaagaataacatgggggaagctttctatacagtaaaactggagagactggagagctgcgataccgtcggcctgtctttccaggaggtgcagaagaacacttacgatttcgagtgccagtggaaggacgatgagggtaattataaaaccgtgctgatgctccagaaggaaaatctgcccgggagacgcgcacaaagggaccggagagcagccggcaataggcacattgaaaatcagctcggagtgtcattccagtctcacttacccgagctccagcagttccagcacgagggaaaaatttatgaatataatcaggtcgaaaaatcccccaataaccggggaaaacactataaatgcgacgagtgcggcaaggtgttcagtcagaatagccggctcaccagccataagaggatccacactggtgagaagccataccagtgtaataaatgtgggaaagccttcaccgtgagaagcaacctcacaatccatcaagtcatccatacgggcgaaaaaccctacaagtgtaacgaatgtggcaaagtttttagtcagccttcgaatcttgcaggccaccagcgtatccacaccggagaaaagccctataagtgcaatgagtgcgggaaagccttccgcgcgcattctaaactgacaactcatcaagtaattcatacaggcgagaagccttataaatgcaaggagtgtggaaaatgctttacgcaaaactcccacctggcgtcacacaggcggattcacaccggagaaaagccatacaagtgtaatgagtgtggaaaggccttctcggtgcgcagcagtcttacaactcatcagacaatacataccggagagaaaccctacaagtgcaatgagtgtggcaaagttttcaggcacaactcctatctggccaagcacaggaggattcacactggtgagaaaccatataagtgcaatgaatgcggaaaagctttttctatgcacagcaacctgacaaagcatcagattattcacacaggcgagaaacctttcaagtgcaacgagtgcgtcaaagttttcacgcagtactcacatctggctaaccatcggcgtattcacaccggtgagaaaccatatcgctgcgatgagtgtggcaaagccttctctgttcgctcatctctgactacgcatcaggccattcatactggtgaaaaaccctacaaatgcaacgattgcgggaaagtgttcacccagaactcacatttggcctcccaccggggcatccacagcggggaaaagccctacaagtgtgacgagtgcggaaaagcttttagtcaaacctctcagctagccagacactggagggtacacactggcgagaagccgtacaaatgtaacgagtgtggcaaggctttctcagtccattcatccctgacaattcatcagacgatccacactggacaaaaaccttataagtgcaatgactgcggaaaagttttcaggcataatagttatctcgcaatccatcagcgcatccataccggggagaaaccgtataagtgtaacgaatgtggcaaggcctttagcgttcattccaaccttgcaacccaccaggtcattcataccggagaaaagccctacaagtgtaatgagtgtgggaaggtgttcacacagaacagccaccttgccaaccatagaaggatacacacaggggaaaagccctataggtgcaacgagtgtggcaaagccttctccgtgaggtccaccctgaccactcatatggccgtgcataccggggacaagccctacaagtgtaatcagtgcggtaaggtgttcacacagaacagcaatctcgctaagcaccgtagaatacattccggttag

SEQ ID NO: 21994 - DNA, 1860 bp, Artificial Sequence
  Description of Artificial Sequence: Synthetic coding sequence
atggaggtggaggccgccgaggcccggagccccgcccccggctacaaaaggtccggacgcaggtataagtgcgtcagctgtacaaaaacattccccaacgccccacgcgccgcacgacatgcggcgacccacggtcctgccgattgtagcgaggaggtcgctgaggtgaagcccaaaccagagacagaggccaaggccgaggaggcgagcggcgaaaaagttagcggatccgcagccaaacctcggccttatgcttgccctctctgccccaaggcatacaagactgcacccgaactacgctcacatgggcgaagccacacaggggaaaaaccgttcccttgtcccgagtgcgggcggcgatttatgcagcccgtctgcttacgggtccatctggccagccatgctggcgagctaccttttcggtgtgctcattgccccaaggcctacggggccctctccaagcttaaaattcaccagaggggacataccggggagagaccttatgcctgcgctgattgtgggaaatcctttgctgacccgtccgtgtttcggaagcaccggaggactcatgctgggctcaggccttacagctgcgaaaggtgtggcaaagcctatgccgagctaaaggacctgaggaatcatgagagaagccacacaggagaaaggccattcttgtgttctgagtgcgggaagtcctttagtcgcagctcatccctcacctgtcaccagaggatacacgccgctcagaaaccttaccggtgccctgcctgcgggaaaggcttcacccagctgagctcctatcagagccacgaacgcacccactcgggggagaagccattcttatgtccccgctgtggtcggatgttctccgaccccagtagctttcgccggcatcaacgcgcgcacgaaggcgtaaagccataccattgcgaaaagtgcggcaaggactttaggcaacctgccgatctcgctatgcacagaagggtacacaccggtgaccgacctttcaaatgcctccaatgtgataaaactttcgtggcctcctgggacctgaaaagacacgccttagtccactctggtcagcggcccttcagatgcgaggagtgtggccgcgcattcgcagagagggcttccttaaccaaacactctagggtacacagcggggagagaccatttcactgtaatgcttgcggtaagtcttttgttgtttccagcagcctgagaaagcacgaaaggactcaccggagttcagaggcagctggcgtgccccctgcccaggagctggttgtgggcctcgcactgccagtaggggtggcaggcgaatcatctgcggcaccagccgctggagcagggttgggtgaccctccggctgggttgttaggcttgcccccggagagtggcggagtaatggctacccaatggcaggttgttgggatgacagtggagcatgtggagtgccaggacgctggtgtccgggaggcacccggccctttagagggtgctggcgaggccggcggcgaagaggccgatgaaaaaccaccacagttcgtctgtcgggaatgcaaggagaccttcagcacgatgacactgcttaggcggcatgaacgatcccacccagagctgcgcccatttccttgcacccaatgcggcaagagcttctccgatagggccggattgaggaagcactctcgcacacatagcagtgtgcgtccctacacatgtccacattgccccaaagcctttctttccgcgagcgacttgagaaagcatgaacggacccaccctgtgccaatgggcacccctactcctctcgagcctctagtcgccctgctgggtatgcctgaggaaggtccagcctag

SEQ ID NO: 21995 - DNA, 1860 bp, Artificial Sequence
  Description of Artificial Sequence: Synthetic coding sequence
atggaggtggaggccgccgaggcccggagccccgcccccggctacaagaggagcggtcggcggtataagtgcgtatcgtgtactaagaccttccctaatgcccctcgtgctgccaggcacgccgcaactcacggcccagccgactgcagcgaggaggttgcagaggtgaagcctaagcccgaaactgaggcaaaagcagaagaagcatcaggagagaaggtgtcgggctctgcagctaagccacgcccctacgcttgcccgctctgtccgaaggcatacaaaacggcccctgagcttagaagtcacgggcgatcccacactggtgaaaagcccttcccctgtccagaatgcggccgacgctttatgcagccagtgtgcttgcgcgtgcatctggcttctcacgctggagaattgccctttcggtgtgcccactgtcccaaagcttatggggccctgtccaagctgaagatccaccagagggggcacacaggcgagcggccttacgcctgcgcagactgtggaaagagcttcgccgatccatctgtgttcagaaagcacagaaggacacacgccggcctgcgcccatattcttgtgagagatgtggcaaagcctatgccgagcttaaggatctaaggaatcacgagaggagccatacaggggagcggcctttcctctgctccgaatgcggcaagtctttttcacgaagtagcagtctcacttgtcaccagaggatacatgcggcccaaaagccttaccgctgtccggcctgtggcaaaggcttcactcagctgtcgagctatcagagccatgagagaacgcactccggcgaaaaaccatttctctgtccccgctgcgggagaatgttttcagaccccagcagctttcgcaggcatcagcgggcccacgaaggggttaagccttaccactgtgaaaagtgtggcaaggacttcaggcaacctgctgatctggctatgcataggagggtgcataccggcgacaggccgttcaaatgcctgcagtgcgacaagacttttgtggcgtcctgggatctgaaaagacacgcattagtgcactccggacagaggccgtttaggtgtgaggagtgcgggcgggcattcgccgagcgcgcttctctcaccaagcattcacgcgttcattcgggagaaagaccattccattgtaacgcctgcggcaaatccttcgttgtgagttcatctctccgcaagcacgaacggacccacagatcaagcgaagctgctggcgttccacccgcccaggagctggtggtgggtcttgccctcccggttggggtggcaggcgagtcttcagccgctcctgctgcgggtgctggcctgggcgatccccccgccggactgctgggacttccccccgaaagtggcggagtaatggctacacagtggcaggtggtggggatgacagtggagcacgtggagtgccaggacgccggggtgcgcgaggctcccggtcccctggaaggggccggagaggcgggaggcgaagaggccgacgaaaagccacctcagttcgtttgtcgggaatgcaaagaaactttctcgaccatgacgctgctccgacgccatgaacggagtcatcccgaactccgccctttcccttgcacacagtgtggtaagtcgtttagtgaccgagcgggactgcgaaaacactccaggactcacagtagtgttaggccttatacctgtccccactgtccaaaggcatttctgtctgcttcggacttgcgcaaacacgagaggacccaccctgtgcctatgggaacaccaaccccactcgagcccctcgtcgcgctgctgggcatgcctgaagagggccccgcatag

SEQ ID NO: 21996 - DNA, 327 bp, Artificial Sequence
  Description of Artificial Sequence: Synthetic coding sequence
atggaggtggaggccgccgaggcccggagccccgcccccggctacaaaaggagtggtcgcagatacaaatgtgtttcctgtacgaagaccttcccgaacgcgccgcgggcagcacggcacgcggctacacatggacccgccgattgctccgaagaagtggccgaggtgccacaccgtagagccccgctccccctgctgagggtgcgggaagagctcctgcccttgatccttgcacatgttcccccagcccacccccgcggaacggaagcccttccgctgccgggcctgagacagggcctccatgccgcccaatttcttccagaatag

SEQ ID NO: 21997 - DNA, 279 bp, Artificial Sequence
  Description of Artificial Sequence: Synthetic coding sequence
atggaggtggaggccgccgaggcccggagccccgcccccggctacaagaggtctggacgcagatacaaatgtgtgtcttgtacaaaaacattcccgaatgctcctagggccgctcggcatgccgccacccacggtcccgccgattgttctgaagaagtagcagaagttaaacccaaacccgaaactgaggcaaaggccgaggaggcttcgggcgagaaggtgtccggctcagccgccaagccacggccttacgcctgtcctttgtgtccgaaagcatag

SEQ ID NO: 21998 - DNA, 231 bp, Artificial Sequence
  Description of Artificial Sequence: Synthetic coding sequence
atggaggtggaggccgccgaggcccggagccccgcccccggctacaagcgaagtggcagacgatacaaatgtgtttcctgcaccaagactttccccaacgcccccagagctgcaaggcacgcagcgactcacggcccagccgattgctccgaagaggtcgcagaagtcaagcccaagccagaaactgaggcaaaggcggaagaggcaagtggagaaaaagtgagcggctag

SEQ ID NO: 21999 - DNA, 312 bp, Artificial Sequence
  Description of Artificial Sequence: Synthetic coding sequence
atggaggtggaggccgccgaggcccggagccccgcccccggctacaagagaagtgggcggcgctataagtgcgtatcatgcacaaaaacatttcctaatgcgcctagggcagcccgccacgcagcaacacatggcccagcagactgctccgaagaggtggccgaagtgaaaccaaagcctgagaccgaagctaaagccgaagaagcctccggggagaaggtgtcgggctctgccgccaagcctcgaccttatgcatgtcccctctgtcctaaagcctacaagaccgctccagagcttcgttcacatggctag

SEQ ID NO: 22000 - DNA, 1860 bp, Artificial Sequence
  Description of Artificial Sequence: Synthetic coding sequence
atggaggtggaggccgccgaggcccggagccccgcccccggctacaaacggtcaggtcgcaggtataaatgtgtctcttgcaccaagaccttcccaaatgctccacgcgctgcccggcatgccgcaacccacggaccagcggattgttcagaagaggtcgcggaagttaagcccaaacccgagaccgaagcaaaggcagaggaggctagcggggagaaggtttcaggaagcgcagctaagcccaggccttatgcctgccccctgtgccccaaggcatataaaacagcaccagagctgaggtctcatggccgctctcacaccggcgaaaagccatttccatgcccagagtgtggaagacggttcatgcaacccgtatgtctcagagttcacctggcctcccatgccggcgagttaccttttcgctgcgcccactgccccaaagcttatggcgccctgtcaaaactgaagattcaccagcgcggacacaccggtgagcggccctacgcctgtgcagattgtggcaagtcgttcgcggacccgtccgtctttagaaaacacagaagaacccatgcaggccttcgaccctacagttgtgagcgatgcggaaaagcgtacgccgagctgaaagacctcagaaatcacgagcgcagccatacgggtgagcgccctttcctgtgttcagagtgcggaaaatcctttagcagatcgtcatccctcacctgccatcagaggatccatgcagcacagaaaccttataggtgtccagcctgtggcaaaggtttcacgcagctctcttcatatcagtcacatgagcggacccattccggcgagaagccattcctgtgtccacgttgcggacgcatgttcagcgatccctcctccttccgacgtcaccaacgggcccatgaaggggttaaaccataccattgtgaaaagtgcggcaaagactttaggcagcccgccgacctggcaatgcatcgtcgggtccatactggcgaccggccattcaaatgccttcagtgtgataagaccttcgtggctagctgggatctgaagcgacacgcgctggttcacagcggccagcgtccgttcaggtgcgaagagtgcggcagagcctttgccgagcgcgctagtttgacgaagcattctagagtgcactccggtgagcggccatttcactgcaacgcttgcgggaaatccttcgtggtctcttcaagcttgcgcaaacatgagcggacacacaggtcctcagaggccgccggcgtgcctccggcacaggaactcgtggtggggctggcactgccggtcggagtggcaggcgagtccagcgcggcacccgccgcaggggcaggcttgggagacccccccgcagggctactcggacttccgcccgagagcgggggtgtgatggctacacagtggcaggtggttggtatgactgtggaacacgtggaatgccaagatgcaggggtaagagaagctcctgggcccctggaaggggcaggcgaggccggcggcgaagaggccgatgaaaagcccccacagttcgtatgccgtgagtgtaaggagaccttctctacaatgactctgttaaggaggcacgaacggagccacccagagctgcgcccctttccctgcacccaatgtggtaagtcattctctgacagagctggcctccggaaacactctaggacccattcctcagtgcgcccgtacacttgtcctcactgcccgaaggcttttctgtccgcctcggacctgcgcaagcatgagcggacccacccggtgccgatggggacccccaccccactcgaacccctggtcgccctgctcggtatgccagaggaagggcccgcgtag

SEQ ID NO: 22001 - DNA, 1860 bp, Artificial Sequence
  Description of Artificial Sequence: Synthetic coding sequence
atggaggtggaggccgccgaggcccggagccccgcccccggctacaagagatccgggagacggtacaagtgtgttagttgcacaaaaaccttccctaatgcccctagagccgctcggcacgcggcaactcatggccccgccgattgctccgaagaggtcgctgaggtaaaacccaagcccgagactgaggcaaaagccgaagaggcgtcgggcgagaaggtatctggaagcgcagcgaaacctcggccatacgcatgccccctttgtccgaaagcatataaaactgcccccgaactgaggagccacgggagatcccacaccggggagaagccgtttccctgtccagagtgtggcagaagattcatgcagcctgtgtgcttgagagtgcatctagcttcccatgccggggaactccctttcagatgtgcccattgccctaaagcatacggcgccctgagcaagctgaaaatccatcagcgaggccatactggcgagcgcccttacgcttgcgccgactgcgggaagagtttcgccgaccctagcgttttcagaaagcacagaaggactcatgctgggctccgaccatatagctgtgagcggtgtggtaaagcatacgcagagttgaaggacctgaggaatcatgagagatctcacacaggtgaaaggccctttctgtgttccgagtgcggcaaaagctttagccggtcctcctccctgacctgtcatcagaggatacacgccgcacaaaaaccatacaggtgccccgcgtgtggcaaggggttcacacaactgtccagctaccagtcacatgaacggacccactccggcgagaagccatttctctgccccagatgtggtaggatgttctccgatcccagctctttccggagacaccagcgcgctcacgaaggcgtgaaaccgtatcattgcgaaaaatgcggcaaagatttccggcagccggcagatttagcaatgcaccgcagagtacacaccggagatcggccatttaaatgcctccaatgcgacaagaccttcgttgcctcatgggacctcaaaagacatgctctagtgcactccgggcagcgtccgtttcgctgcgaagagtgcgggagagcattcgctgagcgtgcctcgttgaccaagcattccagggtccactccggggagaggcccttccattgcaatgcctgtggtaagtctttcgtcgtttcgagtagtttgagaaagcatgagaggacgcaccgatcgtctgaggcagcaggcgtccctcctgcccaggaattggttgtgggcctcgccttacccgttggtgttgccggagagtcttctgcagcccctgccgcaggggctggccttggggatccgccagccgggctattaggactcccccctgaaagtggaggcgtaatggcaactcagtggcaggtcgttggcatgacagtggagcacgtagagtgccaggatgcaggggtgagagaggcaccaggccctttggagggggctggagaagccgggggtgaggaagctgatgagaagccacctcagtttgtttgccgggaatgtaaagaaactttctctaccatgacgctcctgcggcgccacgagcgcagccatcctgaactgcgcccattcccatgtacgcagtgtggtaagagtttttcagaccgagccggtctccgcaaacactccagaacccacagcagcgtgcggccatatacatgtccacattgcccaaaggcattcttgtcagcaagtgacctgagaaaacatgaacggacacaccccgtgccgatgggaacaccgactcccctggagccattagtggcgctacttgggatgcccgaagagggaccggcctag

SEQ ID NO: 22002 - DNA, 1929 bp, Artificial Sequence
  Description of Artificial Sequence: Synthetic coding sequence
atgagcgagcccggcatgctgggccggaaggacgtgtgggtgccccgggaaacgcctttcactaaagcaatggaagtggaggcggccgaggcgaggtcccccgcgcccgggtacaaaaggtcaggaaggcgttacaagtgcgtgtcttgcactaaaactttccccaatgctcccagagcggcaaggcacgccgcaacccacgggccagctgattgttcagaagaggtcgccgaagttaagcccaaacccgagacagaggcaaaagcggaagaggcatcgggcgagaaggtgtccggctcagccgccaaaccaaggccctatgcatgcccgttatgtcccaaagcctataaaaccgcgcctgaactgagatctcatggaagatctcacacaggcgaaaaaccatttccctgcccagagtgtgggcgccggtttatgcagcccgtctgcttaagagtgcatctggctagccacgccggagagcttcccttcaggtgtgcccattgtcccaaagcttacggggcgctgtctaagctgaaaatacaccagcgggggcatacgggagaaagaccgtatgcctgcgcggattgcggcaaatcattcgcagacccgtctgtcttcaggaaacacaggcgcacccacgcagggctgagaccttattcatgcgagcggtgtgggaaggcctatgccgaattgaaggatttacggaaccacgagagatcacacacaggggagcgcccgttcctgtgcagtgagtgtggaaagtctttcagtagatcatcaagcctgacttgccaccagcgcatccacgctgcacagaagccttaccggtgtcctgcctgtgggaaagggtttacccagcttagcagttatcagagtcacgagaggacacatagcggcgagaagccatttctgtgtcctcgttgcgggcggatgttttctgaccccagtagctttcgcagacatcagagggcccacgagggcgtcaaaccttaccattgcgagaagtgcggcaaagacttccggcaaccagcggacttggcaatgcatcgtcgcgtccacactggagacaggccctttaagtgtcttcagtgtgataaaactttcgtggcctcctgggacctgaaaagacacgctcttgtgcattccggccagagacctttccgctgcgaagaatgcggcagagcctttgctgagcgcgcctcattgactaaacacagccgtgtccactctggagagaggccttttcattgtaacgcgtgcggcaagtccttcgttgtttccagcagcttacgaaagcacgagcgtacccaccgttcatctgaagccgctggggtacctccagcacaagaactagttgtcgggttagctctgcctgtaggggtggccggcgaatcatcagccgctcccgccgccggagccggactgggagacccaccagccggactgctgggactgcctccagaatctggcggcgttatggcaactcaatggcaggtagtggggatgaccgttgagcatgtagagtgccaggatgccggggtgagggaggctccgggcccactggagggggctggcgaggctgggggcgaagaggcagacgagaagccccctcagtttgtgtgtagagaatgtaaggagactttcagtacgatgactctcctgcggaggcacgagcgcagccatccagagctcagacccttcccatgcacacaatgtggcaagagtttctctgatcgtgcggggcttagaaaacatagcaggacacactcctccgtgagaccgtatacttgccctcactgcccaaaagcctttctctcagcctcagatctgcggaaacacgaacgcacccaccccgttcctatgggcacgccaacgcctcttgagcccttagtggcactgctcggaatgcctgaagaaggaccagcctag

SEQ ID NO: 22003 - DNA, 1395 bp, Artificial Sequence
  Description of Artificial Sequence: Synthetic coding sequence
atggtgagcggcctgcggctggccagccggagcggcgaggagggctggctcaagcctgccgttgcacggctcggaccaccgagacaccggctccggaaccttaggaccgaatccccatggagatcccggggaagcgtactgttttgctccggaccaggacgcgccggtcgcgccgccgagccattacaccccgtgtgcacctgcgggagacactttcggcgcccagagccatgtagggaacccctggcctctcctatacaggactctgtggccttcgaagatgtcgctgtgaactttacacaggaagaatgggcattactggatagcagtcaaaagaatctctaccgggaggtcatgcaagaaacctgcaggaaccttgcatccgtcggatcccagtggaaagatcagaatatcgaggatcactttgaaaaacctgggaaggacatcagaaaccacatcgtgcagcgactgtgcgagagcaaggaagatggacagtacggggaagttgtgtcgcagattcctaatctcgatctcaacgagaatatttctacagggttaaaaccatgtgaatgcagtatctgcggcaaggttttcgtgaggcattctcttttgaacaggcatatactcgcgcattcgggatacaagccttacggagagaagcagtacaaatgcgaacagtgtggaaagtttttcgtatcagtgcctggtgtgcgaaggcatatgatcatgcatagcgggaatcctgcttataagtgcacaatctgcggcaaagccttctacttcctaaattctgtggagaggcaccaacggacccatactggggagaaaccttataaatgtaaacaatgtggaaaggcgttcacagtcagcggttcttgcctaattcacgagcgaacacacactggtgagaaaccatacgagtgtaaagaatgcggaaagactttccgattcagttgcagcttcaaaacccatgagaggactcacaccggcgagcgaccttacaaatgcactaaatgcgacaaagcatttagctgctccacttcactgaggtaccacggaagcatccacacaggcgagagaccttacgaatgcaaacagtgtggaaaggccttcagtcgcttgtcgtcgctctgcaaccacaggagtacccacactggagaaaaaccgtatgagtgcaaacagtgcgatcaggccttcagccggctcagctccctgcatttgcacgagcggatacacacaggcgaaaagccctatgagtgcaagaagtgcggcaaagcctatacacgttcctcccacctgacgcgccacgagcgctcacacgatatcgaagcaggctgtagcgattctgcctataacccttccacactgggtgggcagggagtgtggattgcttag

SEQ ID NO: 22004 - DNA, 474 bp, Artificial Sequence
  Description of Artificial Sequence: Synthetic coding sequence
atggtgagcggcctgcggctggccagccggagcggcgaggagggctggttgaagccagccgtggcccggctcggtccaccaaggcatcggctgagaaatctaagaacggagagcccatggcgctccaggggctcagtgctattctgctcgggcccaggtagagcagggagggctgccgaaccactccaccccgtgtgcacttgtggacgccactttcggagaccagaaccttgccgagaacctctggcctctcctatccaggactctgtggcatttgaagacgtcgctgtgaattttacccaagaggaatgggcacttctagactcttcccaaaagaacttgtatagggaggtgatgcaggagacgtgtagaaaccttgctagcgtcgagattatctcgtatcgggactgtgtaaaggtcaagaagatggtatccatggagaagctgtccgccaaattccagattctcatatag

SEQ ID NO: 22005 - DNA, 216 bp, Artificial Sequence
  Description of Artificial Sequence: Synthetic coding sequence
atggacagcgtggccttcgaggacgtggccgtgaacttcacccaggaggagtgggccctcctggactcctcccagaagaacctttacagagaagtgatgcaggaaacatgcaggaacttagcctccgtggaaatcatttcctatcgtgattgcgtgaaggttaaaaagatggtctctatggagaagctcagtgcgaaattccagatcctgatttag

SEQ ID NO: 22006 - DNA, 186 bp, Artificial Sequence
  Description of Artificial Sequence: Synthetic coding sequence
atggacagcgtggccttcgaggacgtggccgtgaacttcacccaggaggagtgggcactgttggacagctctcagaaaaatctctatagggaagtaatgcaggaaacctgcagaaacctggcctcagaggctaacggcaagaccagaatactaaaaatcacatccaaaaatctgggcaagatatag

SEQ ID NO: 22007 - DNA, 1137 bp, Artificial Sequence
  Description of Artificial Sequence: Synthetic coding sequence
atggacagcgtggccttcgaggacgtggccgtgaacttcacccaggaggagtgggccttactcgattcaagtcagaagaatctctacagagaagtgatgcaggaaacctgcaggaatcttgcctccgttggaagccagtggaaggatcagaacattgaggatcactttgaaaagccaggtaaggacatccgaaatcacatagtccagaggctctgcgagagcaaggaggacggtcaatatggagaggtggtaagccaaatacccaacctcgatctcaacgaaaatatttctaccggactcaagccatgcgagtgttctatttgcggcaaggtgttcgtccgacattccctactgaaccgacatattcttgcccactcagggtataagccttacggtgaaaagcaatataagtgcgaacagtgtgggaaattttttgtgtcagttccaggcgttaggcgccacatgataatgcactccggcaatccagcatataaatgtacgatttgtgggaaggctttttacttcctgaacagcgtggaacggcaccagaggacacacacaggcgagaagccctataaatgcaagcaatgtgggaaggcgttcaccgtgagcggctcttgcctcatacacgaaaggacacacaccggagagaagccttacgagtgtaaggagtgtggaaaaacatttaggttttcatgtagcttcaaaacacatgaacgaacacacacgggcgagcgaccttacaagtgtacaaagtgcgacaaggctttcagctgcagcacgtcactgcggtaccatggcagcatccacaccggcgaaagaccttacgaatgtaagcagtgcggcaaggcctttagcagattgtcatctctgtgcaaccatcggtctacacataccggggaaaaaccctatgagtgcaaacaatgcgaccaggcattcagtagactgtcttccttgcacttgcacgagcggattcacaccggggaaaagccgtatgaatgcaagaagtgcgggaaggcctacactaggtcaagtcacctaactaggcatgagaggagccatgacatcgaagcaggttgcagcgactctgcctacaaccccagcacattgggcggacagggggtgtggatcgcctag

SEQ ID NO: 22008 - DNA, 1137 bp, Artificial Sequence
  Description of Artificial Sequence: Synthetic coding sequence
atggacagcgtggccttcgaggacgtggccgtgaacttcacccaggaggagtgggctttactcgactccagtcaaaagaatttatatagggaggtgatgcaggagacatgtcgcaatctggccagtgttggtagccagtggaaggatcagaatatcgaagatcacttcgaaaaacctggaaaagacatccgaaaccatattgttcagagactgtgcgaaagtaaagaggacgggcagtatggcgaggtggtctcccagatcccgaacctagatctcaatgaaaacatttcaacaggcctgaaaccttgcgaatgcagcatctgcgggaaggtctttgttagacactcactattgaatagacacatactcgcccacagcggatacaagccctatggcgaaaaacagtacaaatgcgaacaatgcggaaaatttttcgtgagcgtccctggagtgaggaggcatatgatcatgcactcaggaaatcccgcctataaatgtacaatctgcggcaaagccttctacttcctgaacagcgtggagagacatcagcgtacacacactggagagaaaccgtataaatgtaagcagtgcgggaaagccttcaccgtttccgggtcttgtttaatccatgaacggacgcacacaggcgagaagccatacgagtgcaaggagtgtggtaaaacctttagattcagctgttcctttaagactcatgaacgcacccatacaggcgagcggccttataagtgtactaagtgcgataaggcgtttagctgcagcacctctttgcgctatcatgggagtatacataccggcgaaaggccttatgagtgcaagcaatgtggcaaagcttttagccggctgagttcactatgcaaccaccggtctactcacaccggcgaaaagccatacgaatgtaagcagtgtgatcaggccttcagccgtctgagcagcttgcacttgcatgagcgcatccatactggagaaaaaccatacgagtgcaagaaatgtggaaaagcctataccagatctagtcacctgacccgacacgagcgatctcacgatattgaagcgggctgttctgactccgcctataaccctagcactctgggtggtcagggggtgtggattgcttag

SEQ ID NO: 22009 - DNA, 1170 bp, Artificial Sequence
  Description of Artificial Sequence: Synthetic coding sequence
atggacagcgtgagcttcgaggacgtggccgtggccttcacccaggaagaatgggcgttgctcgacccaagtcagaagaatctttacagagatgtcatgcaggaaatttttcgaaatttggccagtgtgggtaataaatcagaggatcagaatatccaggacgatttcaagaatcctgggaggaatctgagcagccacgtggtcgaacgcctgttcgagatcaaagaaggaagccagtacggcgagacatttagtcaggatagtaacttgaacctgaataagaaggtttcgactggggtgaaaccgtgcgagtgtagcgtctgcggtaaagtgtttatctgtcactcggcgttgcacagacacatcctatctcacattggtaataagttgttcgaatgcgaggagtgccccgagaagttataccactgtaaacagtgcggcaaagcctttatctctctaacctcagtggatcggcacatggtcacccacaccagcaacggaccctataaggggcctgtttacgagaaaccatttgactttccaagcgtgttccagatgccgcagagtacatatactggcgagaaaacatataaatgtaagcactgtgataaagcattcaattattcctcttacctccgagaacacgagagaacacatacaggagagaagccctacgcctgtaaaaaatgcggaaaaagcttcaccttcagttcttctctgaggcaacatgagcggtctcacaccggggaaaaaccctacgagtgcaaggagtgcggcaaggccttcagccgatcgacctatttggggattcacgagagaacgcacaccggagagaaaccgtacgagtgcatcaagtgcgggaaagcgttccggtgttcccgggtcctgcgggttcacgaacggactcatagcggagaaaagccttacgagtgcaaacagtgcggcaaggcttttaagtattccagcaacctttgcgagcatgaacgcacccatactggggtgaagccttatggttgcaaggaatgtggcaaaagtttcacttcgtctagcgcacttcggtcccacgagaggacacacacaggggagaaaccttatgaatgcaaaaaatgcgggaaggcatttagttgcagttcctccctaaggaagcatgagagggcctacatgtggtag

SEQ ID NO: 22010 - DNA, 357 bp, Artificial Sequence
  Description of Artificial Sequence: Synthetic coding sequence
atgggcctgctggccttccgggacgtggccctggagttcagccccgaggagtgggagtgccttgacccagcccagcgtagcttatacagagacgtgatgctcgaaaactatagaaacctaatctcccttgggttagccatgtctaagcccgagctgatcatctgtcttgaggcacgaaaggagccatggaacgtgaacaccgaaaagacagctcgacattctgtagaaacccggtttcgccacgtaggccaagcaggcctgaagctgttgaccagcggggacccccctgctctagcctcccagagcgccgggataactggcactggtcaccattgtcagccaatctgcgtgttctag

SEQ ID NO: 22011 - DNA, 1605 bp, Artificial Sequence
  Description of Artificial Sequence: Synthetic coding sequence
atgctgagccccgtgagccgggacgccagcgacgccctgcagggcaggaaatgtttaaggcccaggtcccgccggctgcccctaccagccgctgtgagggcacacggcccaatggcagagctcacggacagcgcgagagggtgcgtggtgttcgaggacgtgttcgtgtacttctccagggaagagtgggagctacttgacgacgcacagagactcctttatcatgatgtcatgttagagaacttcgccctcctcgcaagcctgggcatagccttttcccgctcgcgcgctgtgatgaagctcgaaagaggggaagaaccatgggtgtatgatcaagtggacatgacctcagcaacagagcgcgaagcccagaggggcctcaggcctggctgctggcacggtgtggaagacgaggaggtgtctagcgaacagtcgatcttcgtggcaggtgtcagtgaagtcagaactctgatggctgagttggaaagtcacccttgcgatatatgcggcccaatccttaaggacacccttcacctggcgaagtaccatggtgggaaggcgcggcagaagccctacctgtgcggcgcgtgcggcaaacaattttggttttccaccgactttgatcagcatcagaaccagcccaatgggggtaaactgttcccacggaaagagggtcgggacagtgtgaagtcttgtcgagtgcacgtgccggagaaaacactgacttgcgggaaagggcgccgcgacttcagcgccacgagtgggttattgcagcatcaagcatctctatcatctatgaaaccccacaaatccacgaaactggttagcggatttctcatgggtcagcggtatcaccggtgtggggaatgtggtaaagcctttacgagaaaggacactctcgcacgccaccagcgcatccacacaggagagcgcccgtacgagtgtaacgagtgcgggaagttcttcagtcaatcttacgacctcttcaagcatcaaacagtgcataccggggagcgcccctatgagtgctctgagtgcggcaagttcttccgtcaaatcagcgggcttattgaacatagacgagtgcatactggagaacgactctaccaatgtggtaagtgtgggaagttcttttcctcaaagtccaaccttatccggcaccaggaggtgcacacaggggcccgaccatatgtttgctctgagtgcggaaaagaattcagcagaaagcacaccctggtcctccaccaacggacgcataccggggaacggccttacgagtgctctgagtgcggcaaggcattcagccagagctcgcacctgaacgtgcactggagaattcatagttcagactacgaatgcagtcggtgcggaaaggcgttcagctgcattagcaaactgattcagcatcaaaaagttcattctggggaaaaaccctacgaatgtagtaaatgtggcaaggcctttactcaacgccctaacttgatcagacattggaaggttcataccggcgagcgcccctacgtgtgctccgagtgtggcagggaattcatacgcaagcagactctcgtgttacatcaaagagtgcatgcaggggaaaaactatag

SEQ ID NO: 22012 - DNA, 1311 bp, Artificial Sequence
  Description of Artificial Sequence: Synthetic coding sequence
atgaagctggagcggggcgaggagccctgggtgtacgaccaggtggacatgacctctgcaaccgagcgcgaggcacagagaggcttgagacctgggtgttggcatggcgtagaggacgaggaagtatctagcgaacagagtatatttgtggccggcgtctcggaagttagaaccctgatggctgaactggagtctcacccatgtgatatttgtggccctatcctgaaggacaccctccatctggcaaaataccatggcgggaaggcgagacagaagccctacctctgcggagcctgcggcaagcagttctggttcagcacagactttgaccagcatcaaaatcagccaaatggcgggaagctgttccctagaaaggaaggtcgcgactctgttaagagctgtcgtgtgcatgtccctgagaaaactcttacctgtggtaaggggcgcagagatttcagtgccacgtcaggccttctccagcaccaagctagcctgtcaagtatgaagccccacaagtcaacaaagttagtgtcaggcttcttaatgggccagcggtaccaccgatgcggggaatgcgggaaagcattcaccagaaaagacactctggctaggcatcagaggattcacacaggagagcgtccctacgaatgcaacgaatgcggcaaattcttttcccaatcttacgatctattcaagcatcagaccgtccacacgggagaaagaccttatgagtgttccgagtgcggcaaattctttcggcaaatatctggactgattgagcatcggcgcgttcatacaggcgaacgcttgtaccagtgcggtaaatgcggaaagttcttttcatccaaatctaacctgatcaggcatcaagaagtgcataccggcgcccgcccgtatgtttgttcagaatgcggcaaggagtttagtcggaagcataccctggtactccaccagaggactcacactggtgagaggccctatgaatgcagtgaatgcggaaaggcgttttcacaaagctctcacctgaatgtacattggagaatccacagctccgactatgagtgttcgagatgcggcaaagccttttcttgtataagcaagcttatccagcaccagaaggtgcactctggagaaaaaccctacgagtgcagcaagtgcggtaaggcctttacacagaggccaaatttgatccgtcattggaaagtacacaccggggagaggccctacgtatgcagtgagtgtggcagagagttcattcgcaagcagacattagtgctgcatcagcgagtacacgccggggagaaactatag

SEQ ID NO: 22013 - DNA, 1359 bp, Artificial Sequence
  Description of Artificial Sequence: Synthetic coding sequence
atgttcgccaccagcggcgccgtggccgccggcaagccctacagctgctccgaatgtggaaagagcttctgttattcctcagtgctcctccgccatgaaagagcacatggcggagatgggcggttcagatgcctggaatgtggcgaaagatgcgcccgcgcagccgatctcagagctcatcgccggacccacgctgggcagaccctgtatatttgtagcgaatgtgggcagtcatttcgccattctggccggctagatttacatttaggcgctcatcgacagcgctgtcgcacctgcccttgccgcacatgtgggcgtcgatttccccacttgccagccctcttactgcataggagaagacagcatttgcccgagaggcctcggcggtgtccattgtgcgccaggactttcagacagtctgcccttctctttcatcaggcccgagcccaccctctggggacgacctccgaccccgccgcaccaccccacaggtgtgcccagtgcccccgcgcgtttagatcaggggcagggttacgcagccacgcccgcatccacgtttctagaagccctactcgcccaagggtctccgatgcgcaccaatgcggggtatgtgggaagtgcttcggcaaatctagcacgttgacaagacacctgcaaactcatagtggggagaaaccgtttaagtgtcccgagtgtgggaagggctttctggagtccgccaccctggtccgtcaccagcgtacgcacactggcgaaaagccctacgcatgcggagattgcgggcgctgtttctcggagtcatctacacttttgcgtcatcgccgctcacatcagggggaacgcccacacgcttgtgctacctgcggtaagggtttcggccagagatccgatctggtggtccatcagaggatccacacaggagagaagcctttcgcttgcccagaatgcggccgtaggtttagcgatagatccgatctgaccaaacaccggaggactcacaccggggagaagccataccggtgcgagctatgcggtaaacggtttacctgcgtctctaatctgaacgttcaccggcgcaaccacgccggccacaagccccacaagtgtcccgagtgttccaaagcctttagtgtggcctccaagctggccctccatagaaagacacatttgggtgagcgccccgctgaatgtgctgaatgtggcaagtgcttctcccacagtagatccctcagccagcaccagcgggctcatacaagggctcggaccgcggccgctgttgctatccaatccgccgtgggaacagcacttgtgttcgaaggaccggccgaacaggaaaagccaggtttctcggtgtcatag

SEQ ID NO: 22014 - DNA, 672 bp, Artificial Sequence
  Description of Artificial Sequence: Synthetic coding sequence
atgttcgccaccagcggcgccgtggccgccggcaagccctacagctgctccgagtgtggaaaaagtttttgctattcatcggtgttgctgcggcacgaacgggctcatggtggcgatgggaggtttagatgtctggaatgcggcgaaaggtgtgctagggccgctgatctgcgggcccaccgccgcactcacgccgggcagaccttgtacatctgttctgagtgcggacagagctttcgccattcaggaaggctggacttacatcttggcgcacatagacagcgctgtcgaacctgtccatgccgtacatgtgggaggcgcttcccccacctgcccgcgctccttctgcataggcgtcgccaacacttgcccgaaagacctttattaccctgctgcccgaggatcacaaggatcttatcaagcggagtaggcgccggatcccaggggactctgagactaccatgtgtgcaggagccacgctgctggtgcgtccccttgatgctcttgtgcagcctggtgttcttgattttcttgcctctgttctgtctactcctgagttatctcattcccgcccatatctttagctttccagattatttctgttgccccgccagctcgggaaacggacatcgatttgggtgtcgccatgtgacctcaccagttgcctcctag

SEQ ID NO: 22015 - DNA, 114 bp, Artificial Sequence
  Description of Artificial Sequence: Synthetic coding sequence
atgttcgccaccagcggcgccgtggccgccggcaagccctacagctgctcagagtgtgggaagagcttttgctactcttctgtgctcctccgccacgagcgcgcacatggttag

SEQ ID NO: 22016 - DNA, 210 bp, Artificial Sequence
  Description of Artificial Sequence: Synthetic coding sequence
atgttcgccaccagcggcgccgtggccgccggcaagccctacagctgcagtgagtgcggcaagtccttttgttattcatctgttcttctgaggcacgaacgcgctcacggaggggacggcaggtttcgatgcctggaatgtggcgaaagatgcgcgagagctgccgacctccgggcgcatagaagaacccatgcaggacagactctatag

SEQ ID NO: 22017 - DNA, 15 bp, Artificial Sequence
  Description of Artificial Sequence: Synthetic coding sequence
atgttcgccacctag

SEQ ID NO: 22018 - DNA, 1767 bp, Artificial Sequence
  Description of Artificial Sequence: Synthetic coding sequence
atgctggagaactaccggaacctggtgttcctgggcatcgccgccttcaaacccgacctcataattttcttggagcagggaaaggagccatggaatatgaaaagacatgagatggtggaggaaccaccagtcatctgtagccattttagccaagagttttggcccgaacaggggatagaagacagctttcaaaagatgatcctcagaaggtatgacaagtgtggccacgaaaacttacacctaaagattagctgcaccaacgtggatgagtgcaacgtacataaggaagggtacaacaagctcaaccagtccctgacgactacacagtccaaggtgttccagtgtggaaagtatgcgaatgtgttccacaaatgttccaacagtaatcggcacaagattagacatactggcgagaagggactgaaatgtaaagagtatgtccgcagtttctgcatgttatcccacctgtctcagcatgaacggatctatacacgggagaattcctataaatgcgaagagaacggcaaggcgtttaattggagctctaccctgacctattacaagtccatccacacaggcgaaaaaccctacaaatgcgaagaatgtggcaaagccttttctaaattctctattctgaccaaacacaaagtgattcatacgggagaaaagccgtataagtgcgaggagtgtggcaaggccttcaacaggagctccatcctgacaaaacacaaaatcatccataccggcgagaagccctacaagtgcgaggagtgcggaaagggctttagcagtgtttcgacacttaatacacacaaagcaattcatgccgaggagaaaccctacaaatgcgaagaatgcggaaaggcctcaaattcctccagtaaactgatggagcacaaaagaatacataccggcgagaagccgtacaaatgcgaagaatgcggaaaggcattttcatggagctcttctctgacagagcacaaacggatccatgctggggaaaagccctataagtgcgaggagtgcgggaaggcgtttaataggtcctctatactgaccaagcacaaaatcattcatactggggagaagccatacaagtgcgaaggctgcgggaaggctttttctaaagtgtctacactgaatacccacaaagcaatacacgcggaagagaaaccctataagtgcgaagagtgcggcaaggcttcaaactcgtcctctaaacttatggaacacaagcggattcatactggcgagaagccatacaagtgtgaagagtgtgggaaggcattcagctggtcatcctcacttacagagcataaacgcatccatgcaggagagaagccttataaatgcgaggagtgcgggaaagcctttacatggtccagctcgttcaccaaacacaagcgaattcatgccgcagaaaagccttacaaatgcgaggaatgcggcaagggcttttctacctttagtatcctgacaaaacataagatcatccacacaggggagaagcgctacaaatgcgaggaatgtggcaaagccttctcctggtctagtattctcacggagcacaagatcatacacaccggggaaaaaccctacaagtgcgaagagtgcggaaaagcgttctcaaggtcaagttccctgacaaggcacaagaggatacacacgggggagaagccatacaagtgtgaagagtgcgggaaagccttcaagtcaagcagtacggttagctatcacaaaaaaattcatacaggagaaaacccttag

SEQ ID NO: 22019 - DNA, 1755 bp, Artificial Sequence
  Description of Artificial Sequence: Synthetic coding sequence
atggccctgagccagggcctgttcaccttcaaggacgtggccatcgaattctcccaagaggaatgggaatgcctggatcctgcccagagagccttgtacagagatgtgatgctggaaaactacagaaatctgctgagtcttgacgaagacaatattccccccgaggatgatatatccgtagggtttacctcaaaaggtctttcaccaaaggagaataataaagaagaactataccacttagtgatcttggaacgcaaagagagtcatggaatcaacaattttgatttgaaagaggtttgggagaatatgccaaagttcgactcactgtgggattatgacgtgaagaattacaagggaatgccactgacttgtaataaaaatctgacgcatagaaaagatcagcaacacaacaagtcgtctatccatttttccttgaaacagtctgtgtccattagggactcagcccatcagtatttcatacacgataagcctttcatacgaaacctgctcaaacttaaaaacaacatccgttacgcgggaaacaagtacgtcaaatgctttgaaaataaaatcgggctttcacttcaggctcagttggctgaactccagagatttcaaactggcgagaaaatgtacgaatgtaaccccgtggaaaagtcgattaactcctcttctgtcagtccattgcccccatgcgtgaaaaatatctgtaataagtaccggaagatattgaaataccctttgctccatactcagtatggtaggactcacataagagaaaagagctataagtgtaacgactgtgggaaggctttcagcaagtcctctaacctaaccaatcaccagagaatccactcaggacaacgaccatataaatgcaatgaatgcggaaaggcttttaaccaatgcagcaatcttacaaggcatcaaagggtgcacacaggcgagaagccctatcagtgcaatatttgcggaaaggtgtgtagccaaaattcaaacctagccagtcaccagaggatgcacaccggtgagaagccttataagtgtaatgagtgcgggaaggccttcatccaaagatcccacctgtggggtcacgagaggatccatacgggcgagaaaccctataagtgtaacgaatgtgataaggctttcgctgagagatcttctctgactcagcataaacgcatccatacaggagagaagccctatatctgcaacgagtgcggaaaagcattcaagcaatgttcccatctgacccgacaccagaacatccacccgggcgaaaaacctcacaaatgcaacgtgtgcggacgggccttcattcagtcttctagccttgtcgaacatcagagaatacacactggggagaagccttacaagtgcaacaagtgcgacaaagcgttcatcaagcggtcgcacttgtggggccaccagcggactcatactggtgagaaaccatacaaatgcaccgaatgcgggaaagccttcaccgagagatcaaatttaacccagcataaaaagattcacacaggggaaaaaccatataagtgtaccgagtgcggcaaagcgttcacacaattcgcaaacctgacacgccaccagaagatccatatcgagaaaaagcactgcaagcacaatatccacggaaacgccctcttccaaagctctaatttgggggatcaccaaaagagctacaaccgcgaaaagcacattaagtataatgaaactaagattaagtactcttcctgtacctag

SEQ ID NO: 22020 - DNA, 540 bp, Artificial Sequence
  Description of Artificial Sequence: Synthetic coding sequence
atggccctgagccagggcctgttcaccttcaaggacgtggccatcgaattctcccaagaggagtgggaatgccttgatcctgcccaacgggctttgtatcgcgacgtcatgcttgagaattaccgtaacttgttgtctctggacgaggacaatatacctccagaggatgacattagcgtgggctttactagcaagggcttgtcccctaaggaaaacaacaaggaggagctttatcaccttgtcatcctggaaagaaaagagtcccacggaataaataatttcgacttgaaggaagtctgggagaacatgcccaagtttgactctttgtgggattacgatgtgaaaaattacaaaggcatgccactcacctgtaataaaaacctaacgcatcgtaaagaccagcagcataacaaaagcagtatccacttttcactcaagaaaaaaaaaaaaaagaaaaaaaagcagaataagaccaagccaaaagctacgaaagagaagagaagaaaaaacaaaggtaagaacaagactaatacaaagtag

SEQ ID NO: 22021 - DNA, 1578 bp, Artificial Sequence
  Description of Artificial Sequence: Synthetic coding sequence
atgggcaccatcagcctgtgcatcggcgtgtgcgccttcgagggcgcaaatacctccacaagcttctacaaattagtgtacactgctatactatcatattcaatccaggacctcctgcccgagcaagacatgaaggatctgtgtcagaaggtaacactaacccgccatcggtcctggggactggataacctgcatcttgtaaaggactggagaacggtaaacgagggtaaaggccagaaagagtattgcaatcggctgactcaatgttcaagcaccaagagcaagatatttcagtgtattgagtgtgggcgcaatttttcttggcgctctattctgacagagcataagcggatccacacaggagagaagccatacaaatgtgaagaatgcggcaaggtctttaataggtgttctaacctcacgaagcataagaggattcacacaggagaaaaaccctataagtgtgacgaatgcggcaaagtgtttaactggtggagccagctgaccaatcataagaagatccatacaggggaaaagccctataagtgtgatgaatgtgacaaggtgttcaactggtggtcacagctcacatcacacaagaagatccatagcggcgagaaaccctacccttgcgaagagtgcggtaaagcctttacccaattttcaaacttgactcagcacaagcgcatccacactggcgagaagccctacaagtgcaaagagtgttgcaaagcattcaataagttctctaatctgacgcaacataagagaatacatacaggagagaaaccctataaatgtgaggagtgcgggaatgtgttcaacgagtgttcccacttgacaaggcatagaaggatccatactggcgagaaaccatataagtgcgaggaatgtgggaaggcctttacccagttcgctagtctgacccggcacaagcgcatccatacaggcgagaaaccctatcagtgtgaggagtgcgggaagacatttaaccgctgcagtcatctgtcatcccacaagcggatccatacaggagagaagccctataaatgtgaggagtgtggacgcacgtttactcagtttagcaatttaactcagcacaaaaggatccataccggcgaaaaaccctataagtgcaaggaatgcggcaaggcgttcaacaaattcagtagcctgacacagcaccggcggattcacacgggcgtcaaaccatataagtgcgaggagtgcggaaaggttttcaaacaatgcagccaccttacctcccataagaggattcataccggggaaaagccatataaatgcaaagaatgcgggaaagccttctaccagtcatcaatcctttccaaacataaacggattcataccgaagagaagccatacaagtgtgaagagtgtgggaaagcgtttaatcagttctcatcactcacccgccataagcgcatccatacgggcgagaaacgttacaagtgcaaggaatgtgggaaagggttctatcagagtagtatccattccaagtacaaaagaatctacacaggggaagagcctgacaaatgcaaaaagtgtggcagtctctag

SEQ ID NO: 22022 - DNA, 1743 bp, Artificial Sequence
  Description of Artificial Sequence: Synthetic coding sequence
atgcccggccaccccgagagccggaagacccggcggatcctgaccatgctacccaggttggtgctgaattcttttccacaagtgattttattaccaaaccctcccaaagttcttcgactccaggggctccttgctttctccgacgtcgtgatcgagttctcgcccgaagaatgggcctgccttgaccctgcccagagaaacttataccgggacgtgatgttcgagaactacagaaatttggttagtctggcaattctcagttattctatccaggatctgctgcccgagcaggatatgaaggatctctgtcagaaagttacactaacacggcaccggagctggggcttggataatctgcaccttgtgaaggattggagaaccgtcaacgagggcaagggtcagaaggagtactgtaacaggctcactcaatgctcctcgacaaaatcgaagatcttccagtgtatagaatgtgggcggaatttcagctggagaagcattctgacagagcataaacgcatccacacaggagaaaagccatacaaatgcgaggagtgcggtaaggtgttcaataggtgttcaaatctaactaaacacaagcgaatccacacgggggaaaaaccatataagtgcgatgagtgcggcaaggtattcaactggtggtctcagttgacaaatcacaaaaagatccacaccggggagaagccctacaaatgtgacgaatgcgacaaagtcttcaattggtggtcccagctgacttcacacaagaagattcatagtggggaaaagccctacccctgcgaagagtgtgggaaagcatttacccagttcagcaatctgacacaacacaaaagaatccacacgggcgagaaaccttacaagtgtaaagagtgttgtaaggcgtttaacaagttttcaaacctcacccagcataagcgaattcacacaggcgagaaaccgtacaaatgtgaggagtgtggaaatgtatttaacgagtgttctcacctgacccgtcatcggaggattcacacgggagagaagccttacaaatgcgaggagtgtgggaaagctttcacccagttcgccagcctgacaaggcataagagaattcataccggcgagaaaccgtatcagtgcgaggagtgcggcaaaaccttcaacaggtgttctcacctgagctcccataagcgaatccatactggagagaaaccatacaaatgcgaggaatgtgggcgcactttcacccagttcagcaatctcactcagcataaaagaattcacaccggagagaagccctacaaatgtaaagagtgcggtaaagccttcaataagttttcgtcactgacacaacaccgcaggatccataccggggtgaagccttacaagtgtgaggagtgcggcaaggtgtttaagcagtgttctcacttgacttctcataagcgtatccacacaggagaaaagccttacaagtgcaaagagtgcggtaaagctttttatcagtcctccatacttagcaaacacaaacgaatccatacagaggaaaaaccgtataaatgtgaggaatgtggcaaggcatttaatcagttttcgtctctgacccgccataaacggatccacacgggtgagaaacgctacaaatgcaaagaatgcgggaagggcttctatcagtcctcgatccattctaagtacaagagaatctataccggggaggaacccgataaatgtaaaaagtgcgggtccttatag

SEQ ID NO: 22023 - DNA, 684 bp, Artificial Sequence
  Description of Artificial Sequence: Synthetic coding sequence
atgcccggccaccccgagagccggaagacccggcggatcctgaccatgctgcccagactggtgctaaacagcttcccgcaggttatactactgccgaatccccctaaagtgttaaggctccaggggttgctggcattttctgacgtggtgatagaattttcccctgaagagtgggcatgtttggatccggctcagcgtaatctctaccgcgatgtcatgttcgaaaattaccggaacctggtttcattagccatcctgtcatacagcatacaggatctcctgcctgagcaggatatgaaggatctgtgtcagaaggttacgctgacccgccatagatcttgggggctagacaaccttcatctggtgaaagactggaggaccgtgaatgagggcaaaggccagaaggagtattgtaacaggttgacgcaatgctcttctacgaagtctaagatattccagtgtatcgagtgcggaaggaacttttcctggcgctcaatcctgaccgagcataagaggattcatactggtgaaaagccctataagtgtgaggagtgtggaaaagtgtttaaccgatgctctaatttgaccaagcataagcgaattcacacaggcgagaagccctataaatgtgacgaatgtgggaaggtgtttaattggtggtcccagttgacaaaccacaagtag

SEQ ID NO: 22024 - DNA, 1236 bp, Artificial Sequence
  Description of Artificial Sequence: Synthetic coding sequence
atggccaagcggcccggcagccccggcagccgggagatgggcctgctgacttttcgcgatgtggtgatagagttcagcctggaagagtggcagtgtctggaccacgctcagcagaacctctacagggatgtgatgttggaaaactacagaaatcttgtctccctgggaattgccgttagtaagccagatcttatcacttgtcttgaacagaacaaggagccatggaatataaaaagaaacgaaatggtcacaaaacaccctgttatgtgctcacatttcacacaggatctgcctccagaactggggatcaaagacagcctgcagaaggtgatcccacgcagatacggaaagtctggacatgacaacctccaggtaaagacctgcaaatcaatgggcgaatgtgaagtgcagaaggggggctgtaacgaagttaaccagtgtctcagcacgacccagaataagatctttcagacacacaaatgtgtcaaggttttcgggaagttcagcaatagtaatcgccataagaccagacacaccgggaaaaagcactttaagtgtaagaaatacggtaagagtttctgtatggtgtctcagctccatcagcaccaaattatacatacacgggagaattcttaccagtgcgaagagtgtggaaagcctttcaactgcagtagcactctgagcaaacataagcgtattcacaccggcgaaaaaccttatagatgcgaggagtgcggcaaggcgttcacctggtccagcaccctgacaaagcacagacgcattcacaccggcgagaaaccgtatacttgcgaggagtgtggacaagctttctcccgcagcagcactctggcaaatcacaagcggatccatactggtgagaagccttatacatgcgaggagtgtggcaaggcgttctccttgtctagctccctgacatatcacaagcggatacatacaggagaaaagccttacacctgcgaagaatgcggcaaggcgttcaactgtagcagtacacttaagaaacacaaaatcatacacacgggcgaaaagccatacaaatgcaaggaatgcgggaaagcctttgctttctcctcaacactcaatactcataagaggatccataccggtgaagagccatacaaatgcgaggagtgcgataaagcattcaaatggtccagctcccttgccaatcataaaagtatgcacaccggggaaaagccatataagtgtgaatag

SEQ ID NO: 22025 - DNA, 1236 bp, Artificial Sequence
  Description of Artificial Sequence: Synthetic coding sequence
atggccaagcggcccggcagccccggcagccgggagatgggcctgctcacattccgagatgtggtaatcgagttttcactcgaggaatggcagtgtctggatcatgcccagcaaaacctttacagggatgttatgctggagaattacagaaatctggtcagccttggtatcgcagtgagtaagccagacctgatcacctgtctcgaacaaaacaaagagccatggaacatcaagcgcaacgagatggtaactaagcacccggtcatgtgttctcacttcactcaggaccttccccccgagcttggtatcaaggacagcctgcaaaaagtgattccccgccgctacgggaagagtggccatgataacctccaagtgaagacatgtaagagtatgggtgaatgtgaggtgcaaaagggaggttgtaatgaagtgaaccagtgtctgtctaccacccagaacaaaatatttcagacgcacaaatgcgttaaggtctttgggaagtttagtaatagcaacaggcataagacccggcatacgggcaagaaacatttcaagtgcaagaagtatgggaaatcattttgtatggttagccagctgcatcagcaccagattatccatacccgggagaacagctaccagtgcgaggagtgcggaaagcctttcaactgttcatccactttatctaaacataagcgtatccacacaggggaaaagccttatcgctgcgaggagtgtgggaaggcttttacgtggagctcgactctgaccaagcatcgtcggatccacacgggtgagaagccgtacacctgtgaggagtgtgggcaggccttcagccgttcgtctactctggccaaccacaagcggatccacaccggggaaaaaccttacacgtgtgaggaatgtgggaaagctttcagcctgtctagctcattgacataccacaaaaggatacataccggagagaagccttatacttgcgaagaatgtggcaaggcctttaattgctcctccaccctgaaaaagcacaaaatcatccacacaggcgagaaaccctacaagtgcaaggaatgtggcaaggccttcgcctttagttctacgctcaatactcataagcggatccacactggggaggaaccctataagtgcgaagaatgcgacaaagcattcaaatggagctcctcacttgccaaccacaagagcatgcacactggtgagaagccatataaatgtgagtag

SEQ ID NO: 22026 - DNA, 1593 bp, Artificial Sequence
  Description of Artificial Sequence: Synthetic coding sequence
atgcccggcccccccggcagcctggagatgggccccctgaccttcagagatgtggccattgagttcagcttagaggagtggcagtgtttagacacagctcaacggaatctataccgcaaagtgatgttcgagaattatagaaacctggtatttctcggtatcgctgtcagcaagcctcacctgattacctgcttggagcaaggcaaagaaccttggaaccgcaaaagacaggaaatggttgccaaacccccagttatctactcccatttcacagaggacctctggccggagcactcaatcaaggactctttccaaaaggtaatcctccgcggttacgggaaatgtggccacgaaaacctccagctgagaatcagctgtaagagtgtggacgagagcaaggtgtttaaagagggctacaacgagctgaatcagtgcctgcggactacccagagcaaaatcttccaatgcgataaatacgtcaaagtgttccacaaattttcgaacagtaacagccataaaaaaagaaatactggcaaaaaagtgtttaaatgcaaggaatgcgggaaatccttctgcatgctgtctcacctgacacagcatatccgaatccacacaagggaaaatagctataaatgtgaagaatgcggcaaggtgctgaactggttctctgagctaattaagcacaaggggatccatatgggagaaaaaccctataaatgtgaagaatgcgggaaggccttcaatcagagctcaacattaatcaagcataaaaagattcacatagaggaaaagccttttaagtgcgaagaatgtggcaaggcattcagccttttcagtatcttgtcgaaacacaaaattatccatacgggcgataagccttataagtgcgatgaatgccataaggcgtttaattggtttgcaacactgaccaatcataagagaatacacacaggtgagaaacccttcaaatgtgaagagtgtggaaaagattttaaccagttcagcaacctgacgaagcataagaagatccacactggcgagaagccctacaaatgcgaagaatgtggtaaggccttcaaccagttcgctaatcttactcgacacaaaaagatccataccggcgagaaaagctataagtgtgaggaatgtgggaaggcttttattcagtcatcaaatctgactgagcacatgcggattcatacgggcgaaaaaccctataagtgtgaggagtgtgggaaggcctttaatggttgtagtagtctaaccagacataagagaattcacactagggaaaatacatataagtgcgaggagtgcggcaagggtttcaccctgtttagcaccctcacaaaccacaaggtgatccacacaggagaaaaatcatataaatgtgacgagtgcgggaatgtgtttaactggcctgccaccctggctaaccataaacgcatccatgctcgggagaagccctacaaatgcgaagagtgcggcaaagcctttaatcggtcgagccatcttacacgccacaagaaaatccatactggcgaaaagctgtacaagcccgaaaaatgtgataacaactttgataacacctag

SEQ ID NO: 22027 - DNA, 372 bp, Artificial Sequence
  Description of Artificial Sequence: Synthetic coding sequence
atgcccggcccccccggcagcctggagatgggccccctgaccttccgggacgtcgccatcgaattctctctcgaagagtggcagtgtttggacacggcccagagaaacctctataggaaagtcatgttcgaaaactataggaatcttgtgttcctggggattgctgtatctaagcctcatttgatcacttgccttgagcaaggaaaggagccttggaaccgaaagaggcaggaaatggtggcaaagcctcccgagtcctactgcgtggcccaggcggacttggagctcctggtcagctcgtatctgaccgcccttgcttcactgaaaatgtgggactatcgaaacaatcccttgtgccaggccaccatgtag

SEQ ID NO: 22028 - DNA, 1731 bp, Artificial Sequence
  Description of Artificial Sequence: Synthetic coding sequence
atggtggccgagccccccgtgatctgcagccacttcgcccaggacttctcacccgagcaaaacatcaaggactcctttcagaaggtcacgccacgccgctacggaaagtgcgagcatgaaaatttgcagttgtctaagtctgtggatgaatgcaaggtgcaaaaagggggttacaacggcctgaaccagtgtctgcctacgactcagtctaagatttttcagtgcgataaatacatgaaaattttccataagttctccaatctgaatgggcacaaggttagacatacccgaaagaagccatttaaatataaggagtttggaaagtccttttgtatcttctccaatctgacgcagcataaaatcatctgtacgagggtcaacttctacaaatgcgaagactgcgggaaggcctttaacgggtcctcaatcttcaccaagcacaagaggattcatatcggtgagaagagttacatttgtgaggagtgtggaaaggcgtgcaaccaatttaccaacctgaccacccataaaatcatttacacaagggacaagctgtacaagcgcgaggagtgttctaaggccttcaatctgtcttctcacattaccacacacacaattatccacacgggtgaaaacccttacaagagggaggagtgtgataaagccttcaatcagagcctgactcttactacgcacaaaataatacatactagggaaaagctgaatgaatataaggaatgtgggaaagcctttaaccagtcctcccacctcacccgacacaagattatccatacgggcgagaaaccatacaaatgtgaagagtgcggcaaagccttcaaccaaagtagtcacctcaccaggcataagattatccacacgggcgagaaaccatacagatgcgaggagtgcggtaaggcctttaggcaatcctcccatctgaccactcataaaattatccacacaggcgaaaaaccctacaagtgtgaagagtgcggcaaggccttcaacaagtcatcacacttgactcgtcacaagagtattcataccggtgagaaaccgtaccagtgtgaaaagtgcggtaaggccagtaatcagtcgtccaacctgactgaacacaagaacatccacacagaggaaaaaccttacaagtgtgaggagtgcgggaaagctttcaatcagtttagtaacctcactacacataagaggatccacaccggagagaagccgtataaatgcgaggaatgtggaaaggcgttcaatcagagctcaattctgacaacacataagagaattcataccggagaaaagagttataagtgcgaagaatgtggaaaggcattctatcgctcctctaaattgaccgagcataaaaaaatccacacgggcgagaaaccctatacttgtgaggagtgcggtaaagccttcaatcactcatcccacctggccacccacaaggtgattcatactggggagaaaccttaccagtgcgaggagtgcgggaaggcttttaaccaatcctcccatctgacacggcataagagaatccacacgggcgaaaaaccgtaccagtgcgaaaagtgcgggaaggctttcaaccagagtagtaacttgactggacataagaaaattcatacaggcgaaaaactctataaacccaaaaggtgtaactccgatttcgagaacacctctaagttcagcaagcataagcggaattacgcaggagaaaaatcatag

SEQ ID NO: 22029 - DNA, 1938 bp, Artificial Sequence
  Description of Artificial Sequence: Synthetic coding sequence
atggagcccctgaagttccgggacgtggccatcgagttcagcctggaggagtggcagtgcctagatacaattcagcaaaatctataccgaaacgtgatgctggaaaattatagaaacctcgtgtttctgggaatcgttgtctcaaagcctgacctcattacgtgtcttgagcaggaaaaagaaccctggacacggaaaaggcatcgcatggtggcggaacctcccgtgatctgcagtcattttgctcaagacttctctccagagcaaaacatcaaggacagctttcagaaagtgactccacggcgctacgggaagtgtgagcatgagaatctccagttaagtaaaagcgtggatgaatgtaaggtgcagaaagggggatataatggtctgaatcagtgcttgcctaccactcaaagtaaaatctttcagtgcgataaatacatgaagatttttcacaagttctcaaatctgaatggccataaggtacgtcatacccggaagaaaccattcaagtacaaagagttcgggaagtccttttgtatcttttccaatttgactcagcacaaaatcatttgcacgagagtcaacttctacaaatgtgaggactgtgggaaagctttcaacggctcctcaatctttaccaaacacaaacggatacatatcggagaaaagtcctatatatgtgaagagtgcggtaaggcttgcaatcagtttaccaatctcactactcataaaattatctatactcgagacaagctgtataagagggaggagtgtagcaaggcctttaacctgagctctcacatcacgacccacacaatcatacatactggggaaaatccctacaagcgcgaggaatgcgacaaggcattcaaccagtccctcaccctaacgactcacaagatcatccatacccgtgaaaaattaaatgagtataaagaatgcgggaaagcatttaatcagtcttcacacctgacacggcataagattattcatactggcgaaaagccatataagtgtgaagagtgtggaaaggcgtttaatcaatccagccacctcacgagacacaaaataatacacaccggcgaaaaaccctatcgctgtgaggagtgtgggaaggccttcaggcagagcagtcatctaaccactcacaaaatcattcatactggcgagaagccttataagtgcgaagaatgtggcaaggctttcaacaaatcttcccatcttacccgccacaagagcatacatacaggggaaaagccctaccagtgtgagaaatgtggtaaggcaagcaaccaaagctccaacctgactgagcacaagaacattcatacagaagaaaagccctacaagtgcgaggaatgcggcaaagctttcaaccaattctctaacttgactacgcataagcggatccatacgggcgagaagccctacaaatgcgaagagtgcggaaaggcctttaaccagtcaagtatcttgaccacacataaacgaattcatactggagaaaagtcctataagtgtgaagaatgcggaaaggctttttataggagttctaagcttacggaacacaaaaagatacatactggcgagaaaccctatacttgtgaggagtgcgggaaggcctttaatcactcctcccacctggctacgcacaaggtaattcatacaggggaaaaaccctaccagtgcgaggagtgtggtaaagcatttaaccagtcctcacatctgacaaggcataaacgcatccacacaggcgaaaagccttatcagtgcgaaaagtgtggcaaagcgtttaatcagagctctaatttgacagggcataaaaagattcacaccggcgagaagttatataaaccaaaaagatgtaactcagacttcgagaatacctcaaaattcagcaagcataaacgaaattacgccggggaaaaatcgtag

SEQ ID NO: 22030 - DNA, 504 bp, Artificial Sequence
  Description of Artificial Sequence: Synthetic coding sequence
atgcggacccacaccggcgagaagccctacaagtgcgaggagtgcggaaaggcctttaacagcagcagtattctcacagaacataaagttattcatagcggcgaaaaaccatataaatgtgagaaatgcgataaagtgttcaagcgcttcagttatctgacaaagcacaaaaggattcacaccggcgagaagccttacaaatgtgaagagtgcggcaaggcttttaattggtcctcaatcctgacagagcacaaaagaatccatactggcgaaaagccatataattgtgaagaatgtgggaaagccttcaatcgatgcagccaccttactcgccataagaagatccacactgccgtcaaacggtataaatgcgaagaatgcggaaaggccttcaaaagatgttcccacctgaatgaacacaaaagagtccaaaggggggaaaaaagctgcaagtacaagaagtgtggggaggcgtttaatcactgcagcaatctgactacttag

SEQ ID NO: 22031 - DNA, 1401 bp, Artificial Sequence
  Description of Artificial Sequence: Synthetic coding sequence
atgctggagaactaccggaacctggtgagcctgggcctgaccgtgtctaagccagagcttatttcaagacttgaacagcgacaagaaccttggaatgtgaagagacatgaaacaatcgctaagcctcctgccatgtccagccactatacagaagatctgctcccagagcagtgcatgcaagattccttccagaaggtgatccttagaaggtacggaagctgtggcctggaggatctccatcttagaaaagacggcgaaaatgtgggggagtgcaaagatcaaaaagaaatttataacggcctcaaccagtgtctgtctactctaccttcaaagattttcccttataataaatgcgtgaaggtattcagcaaaagtagtaacctcaatcgagagaatatccggcatacaaccgaaaagttgttcaaatgtatgcagtgcggtaaagtgtttaaatcacattcaggactgtcatatcataagataattcacacggaggaaaagctgtgcatttgcgaggagtgtggcaagacttttaaatggtttagctatcttaccaaacataagcgcatccacaccggcgaaaaaccttacaagtgtgaggaatgtgggaaggcgtttaactggtgcagctctctgactaaacacaagcggatccataccggagagaaaccttacaaatgcgaagagtgcgggaaagcattccactggtgttcccctttcgtgagacacaaaaagatccacacaggagagaagccctacacttgtgaggattgtggcagagccttcaatcgtcattcacacctgactaaacataaaaccatccatactggaaagaaaccatacaaatgtaaagagtgcggaaaagccttcaatcactgctcactactgacaattcacgaacgcactcacactggcgagaaaccatacaaatgtgaggaatgtggcaaggcgtttaactcctcatctatcttaaccgagcataaggtcatccacagcggggagaagccttacaagtgcgagaaatgtgacaaggtgttcaagaggtttagctatttgacaaagcacaagagaattcacactggggagaagccatataaatgcgaggaatgtggcaaagcatttaactggtcatccatccttactgagcataaacggattcacacaggtgaaaaaccatacaactgtgaggagtgcgggaaagcattcaatagatgtagccacctgactcggcacaagaagatccatactgcagtgaagagatataaatgcgaggagtgcggcaaggctttcaaacgctgctctcacttgaatgaacacaaacgcgtgcaaaggggtgaaaaaagttgtaaatacaagaagtgcggcgaggccttcaatcactgcagtaacctgactacttag

SEQ ID NO: 22032 - DNA, 1401 bp, Artificial Sequence
  Description of Artificial Sequence: Synthetic coding sequence
atgctggagaactaccggaacctggtgagcctgggcctgaccgtgtcaaagccagagctgatttctcgtctagaacagagacaggaaccttggaacgtcaagagacacgagactattgccaaaccccctgccatgagctcgcactatacggaagatttgctgcctgagcagtgcatgcaggatagtttccaaaaggttatcctacgccgatacggctcatgcggtctcgaagacctccatctgaggaaggatggagaaaacgttggcgaatgcaaggaccagaaagagatctacaatgggctcaaccagtgcctgtctacactgccatcaaagattttcccttacaacaaatgcgtgaaggttttttctaagtctagcaacctcaatcgcgaaaatatcaggcacacgactgagaaacttttcaagtgcatgcagtgtggtaaggtctttaagtcgcactcaggcttgagctaccacaagattatccataccgaggaaaaattgtgtatctgcgaggaatgtggtaagacattcaagtggttttcttacctcacaaagcacaagcgaatccataccggagagaagccgtacaagtgtgaagagtgcggaaaggcttttaattggtgttctagcctgacaaagcacaagagaatccacactggcgagaaaccctacaagtgcgaagagtgtggcaaggcctttcattggtgcagccctttcgtgcgacataaaaaaatccacactggggaaaagccctatacatgcgaggactgtgggagagcgttcaatagacattcccatttaaccaaacacaaaactatccacacagggaaaaaaccgtataagtgtaaagaatgcggcaaggccttcaatcactgctcactactgactatacatgaaagaacgcacactggcgaaaagccatacaaatgtgaggagtgtggcaaggcctttaattcttcttctatcctcacggagcacaaggtgattcacagcggtgaaaaaccttacaagtgtgagaagtgcgacaaggtattcaaacggttctcctatctcactaagcacaagcgaatacacacaggggagaagccgtataagtgcgaagaatgtggcaaagcctttaactggtcaagtattctcaccgaacacaagcgcattcacactggggagaagccatacaactgcgaggagtgcgggaaagccttcaaccgttgtagtcaccttacccgtcacaagaaaattcacaccgctgtgaagcgatacaagtgcgaggagtgtggcaaagccttcaagcgatgtagccatctgaatgaacacaagcgtgtccagcggggagaaaagtcgtgtaaatacaagaaatgtggagaggcattcaaccactgttccaatctcaccacatag

SEQ ID NO: 22033 - DNA, 1497 bp, Artificial Sequence
  Description of Artificial Sequence: Synthetic coding sequence
atggagctgctgaccttccgggacgtgaccatcgagttcagcctggaagagtgggaattcctgaatccagcccagcagtcgctataccgcaaggtgatgttggaaaactatcgcaacttggtatccttgggcttgacagtgtcgaaacccgagctgatcagtcggcttgagcaaagacaagagccctggaacgtgaaaagacacgagaccatcgccaaaccccccgccatgagctcccactacacagaagacctgctccccgagcagtgtatgcaagacagctttcaaaaggtgatactgcgaagatatggctcatgcggacttgaagatttgcacctgagaaaggacggtgagaatgtgggggagtgcaaagaccagaaagagatctacaacggcctaaatcagtgcctgtccacactccctagcaaaatatttccctacaacaaatgcgtgaaggtatttagcaaatcatctaacctgaatcgtgagaacattcgccataccacagaaaagctgtttaagtgcatgcagtgcgggaaggtatttaagtcccatagtggcctttcctatcacaagatcatccatacggaagaaaaactgtgtatctgcgaggagtgcggcaagacatttaaatggttcagctacctgacaaagcacaaacgaatccacactggagagaaaccctataaatgtgaggaatgcggcaaagcattcaattggtgcagctctctgacaaaacacaagcgcatacatacgggagagaaaccttataagtgcgaggagtgtggtaaagcatttcactggtgcagcccctttgtcagacataaaaagattcatacaggcgaaaagccttacacttgtgaagactgtggcagggcattcaacagacattcccacctgactaagcataagaccattcacaccggcaagaaaccatataagtgcaaagaatgcggcaaggccttcaaccattgttctcttctgaccatccacgaacgcacacataccggtgaaaagccatataaatgtgaagagtgcggtaaagccttcaacagctcatcaatcctcaccgaacacaaggtgatccattcgggggagaaaccctacaagtgtgaaaagtgtgataaagtttttaagcgctttagttaccttactaaacataaacggatccacacaggagaaaagccctacaagtgtgaagagtgcgggaaagctttcaattggagctctattcttacggaacataaaagaatccacaccggagagaagccttacaattgtgaggaatgtggaaaggcattcaaccgctgttctcatttgactcgccacaagaaaatccacaccgcagtcaagcgatacaagtgtgaggagtgcggaaaagcctttaagagatgctctcacctcaatgaacacaagagagtgcagcggggtgaaaaatcttgcaaatacaagaaatgtggcgaggcatttaatcattgctccaacctgaccacctag

SEQ ID NO: 22034 - DNA, 1515 bp, Artificial Sequence
  Description of Artificial Sequence: Synthetic coding sequence
atgaaggaggagagcgccgcccagctgggctgctgccaccggcccatggctctcggcggtactggaggctctttgtctccatcactggacttccagctctttagaggcgaccaggtgttcagtgcatgcagacccctgccggacatggtggatgctcatgggccttcctgcgcatcctggctgtgtcccctgccattggccccggggagatcggctctgctggcgtgtctgcaggatcttgatctgaacctgtgcacaccacaacccgcgcccttgggcactgatctgcagggtctccaggaggatgccctgtctatgaagcacgaaccgccagggctgcaagccagttctacggacgacaaaaaattcacagtcaaatatccccagaacaaggacaaactgggcaagcaaccggagcgagcaggcgagggcgctccttgccctgcctttagtagccacaattcctcctcccccccccctctgcagaatcgcaaatctccgtccccacttgcgttctgcccctgcccccccgtgaattcgatctccaaggaactgccattcctgctccacgcgttctatcctggttacccactcttgctgccaccgcctcacctgtttacttacggagccttacccagcgaccaatgccctcatttgctcatgctgcctcaggacccctcgtatccaactatggctatgccaagtctactaatgatggtgaatgagctggggcacccctccgccagatgggagacgctgttgccatatccaggggcattccaagcaagcggacaagccctaccgtcccaggcgcgtaatcccggagcgggcgcggcgcctacagacagtcccggcctggaaagaggaggcatggcttctccagcgaagagggtccccctctcctctcagactggtactgccgcgttgccttatcctctgaagaagaagaatggcaaaatcttgtacgaatgcaacatatgcggcaagagttttggtcagcttagcaatctcaaggtccatctccgtgtgcattccggagaaagaccattccaatgtgccttatgtcagaaatcctttacccagctggctcacctgcagaagcaccatctggtccacactggagagaggccacataagtgtagcgtgtgccacaagagattctctagctccagcaacctgaaaactcatctgcgacttcatagcggcgccaggcctttccaatgttccgtgtgtcgcagtcgctttactcaacacatccatctgaaactccaccacaggctgcacgctccacagccctgcggtctggtgcacacccagttgcctctagctagcttagcctgcttggcccaatggcatcagggtgctctcgatttgatggcggtggcatccgaaaagcacatgggctatgacatcgatgaggtgaaagtgagctccacgtcccaagggaaggcacgggcagtatcattatcctccgccggcacaccattggttatgggacaggaccagaacaattag

SEQ ID NO: 22035 - DNA, 507 bp, Artificial Sequence
  Description of Artificial Sequence: Synthetic coding sequence
atgaaggaggagagcgccgcccagctgggctgctgccaccggcccatggcattgggtggtacaggaggttctctgagcccttccctcgacttccagctattccggggagaccagtctactagccaccagggatgtcgccccgctcccccaatgacccgcaattcccagagctctacccatcgcaccagaacatcctgggagaactctcagaaagaattggcccgaggcccaccggcccaacctagcccccttattacagcgcttccccatcatagatgcaggacagagcgggctccggcaccttggctgagtgcacccgttcctttgtcaactccctctccccgttccagccatttttcatccacaccatctacgctcgatacacacttctcttgtcttcatcccacatgtagccccatggggccctacctcctgacaaacgtgcccactagcagctgctgccccaagacaccgcctaccccaccttggctctgtctcgcttgctag

SEQ ID NO: 22036 - DNA, 1515 bp, Artificial Sequence
  Description of Artificial Sequence: Synthetic coding sequence
atgaaggaggagagcgccgcccagctgggctgctgccaccggcccatggcactcggggggacaggcggatccctgagtcctagtttagactttcaactgttccggggtgaccaggttttcagtgcctgtagacccctgccggacatggttgatgcccatggaccctcctgcgcaagctggctttgtccgctccccttggctcccgggaggagcgccctgctggcgtgtttacaggaccttgatttgaatctgtgcactccacaacccgcaccgctaggtactgacctgcagggactccaggaagatgccctgagcatgaaacacgagccacccggcctccaggcaagttcaactgatgataagaagtttaccgtgaaatacccacagaacaaagataagctgggaaagcagcctgaaagagccggcgagggcgcgccgtgtcccgcctttagcagccacaactcatcttcaccccctccactgcaaaatcggaaaagcccaagtccacttgctttctgcccgtgccctcccgtcaattcaatatcaaaggagttgccgttcctgctgcacgccttctatcctggctacccactgctgttgcccccccctcacctgttcacttatggggcactgccatctgatcagtgtccccacctgctgatgctcccacaggacccatcctatccaacaatggctatgccgtctctgctaatgatggtgaacgagctggggcacccgtctgcacgctgggaaacactgctgccctatcccggcgccttccaggccagtggccaggctttgccatcccaagcccgcaaccctggcgcaggggcagctccaactgatagcccagggttggaaagaggcggcatggcctcccccgcaaagagagtcccactcagctctcagaccggtacagctgctttaccatacccattgaaaaaaaagaacgggaaaattctatatgagtgcaatatctgcgggaaaagtttcgggcagctgtcaaacctgaaagttcacctcagagtccatagcggtgagaggccttttcagtgtgcgctgtgccagaaaagctttactcagctggcccatcttcagaaacatcacctggtccacaccggcgagaggccacataagtgctctgtatgccacaagcgcttcagctcaagctcaaacctcaaaacacacctccggttgcacagcggtgcacgtcctttccagtgttccgtgtgcagaagtagatttacacaacatattcacttgaagctgcatcacagactccacgctccccaaccttgtgggctggtgcatactcaacttccgttagcaagcctggcctgtcttgctcaatggcatcagggagctctggacttaatggccgtggcttcagagaagcacatgggctatgatatcgacgaggtgaaggtctcttcaacctctcagggaaaggcacgcgccgtgtcactttcctccgctggcactcccctggtcatgggacaggatcagaacaactag

SEQ ID NO: 22037 - DNA, 1575 bp, Artificial Sequence
  Description of Artificial Sequence: Synthetic coding sequence
atgaaggaggagagcgccgcccagctgggctgctgccaccggcccatggccttgggtgggactggtggttccttatcgccttctctcgacttccagctgttcaggggcgatcaggtctttagcgcctgccgcccgcttccagacatggtggatgcacatgggccatcttgtgcatcatggctctgtccactgcctcttgctccaggacgctccgccctgttggcatgtttgcaagacttggatctgaacctgtgtaccccgcaacccgcaccgctcgggacggatctgcaaggcctgcaggaagatgctttatcaatgaagcacgaacccccaggactacaggcatctagcacggatgacaagaagtttacagtcaagtacccccagaacaaagataagctcggaaaacaaccagagcgggccggagaaggcgccccgtgtcctgctttctcatcccataactcttcttccccccctcccttgcagaacagaaagtccccttctccactcgccttctgtccttgccctcccgtaaatagtatcagcaaggagttgccgttcctcctgcatgccttttaccctgggtaccccctgctcctccctcccccccatctgttcacgtatggcgccctgccgtctgaccagtgcccccatctcttgatgctcccacaggaccctagctacccaaccatggcgatgccctccctgcttatgatggtgaatgagctgggccatccgtcagccagatgggagaccttacttccctatcctggtgccttccaggcgtccgggcaggctttgccttctcaggccaggaaccccggtgccggagccgcccctaccgactcacccgggctcgaaagaggaggaatggcaagcccagcaaagagggttccacttagttcccagactggcaccgccgctctcccttaccctttgaaaaaaaagaacggcaaaatcctatacgaatgtaacatctgcgggaagtcttttgggcaactgtccaacttaaaagtacacctgcgcgtgcactcgggtgaacgaccgtttcagtgtgccttatgccagaaatcatttacccagctggcccatctgcagaagcatcacctagtccacaccggcgagcgaccgcataaatgttcgatcccctgggtgcctggccgaaatcactggaaaagctttcaggcttggcgggaacgcgaggtgtgtcacaagcgcttctctagtagcagtaacctgaagactcatctgcgccttcactctggggccagacccttccaatgctctgtttgccgcagcagatttactcagcatattcacctgaaactccatcatcgcttacacgcgcctcagccttgcggcctggtgcatactcagctccccctggcaagcctcgcctgccttgcccagtggcaccagggagcacttgacctgatggccgttgcatcagaaaagcacatgggctacgatattgacgaagtaaaagtgtcgagtacctcacagggtaaagctagggctgtttctctcagcagtgcaggcacaccccttgttatgggccaggatcagaataactag

SEQ ID NO: 22038 - DNA, 570 bp, Artificial Sequence
  Description of Artificial Sequence: Synthetic coding sequence
atgaaggaggagagcgccgcccagctgggctgctgccaccggcccatggctctggggggcaccggaggtagcttgtccccatccctggacttccaacttttcagaggcgaccaggttttttccgcttgtaggcccctgcccgacatggtggacgcgcacggtccatcttgcgccagctggctgtgccccctgccactggctcctggccggtctgctctgctggcttgcctccaggacctggacctaaacctttgcacacctcagcccgcacccctgggcacagacctgcaggggctgcaggaagacgcattgtcgatgaagcacgagcccccaggtctccaagccagtagcactgatgacaaaaaatttaccgtgaagtaccctcagaacaaagacaaactggggaaacagccagagagggcaggggagggggccccctgtcctgccttctccagccataattcttcttctccacccccgctccagaaccggaagagtccttcccctctcgcgttctgcccgtgtcctcctgtgaattcgatatcaaaggagctacccttcctgctgtag

SEQ ID NO: 22039 - DNA, 1575 bp, Artificial Sequence
  Description of Artificial Sequence: Synthetic coding sequence
atgaaggaggagagcgccgcccagctgggctgctgccaccggcccatggcactgggcggcactggtggaagcctttctccttctctcgactttcaactcttcaggggggatcaagtcttctccgcatgtcgtcctctgcccgacatggtggacgcccacgggccaagttgcgcatcatggctctgtcccctcccactcgcacccggacggtccgccctgctcgcctgtctgcaggatctcgacctgaatttgtgcacccctcagcctgcgcctctcggcacagatttgcagggcctccaggaagatgcgcttagcatgaagcatgagcctccaggtctccaagccagcagtactgacgacaagaagttcacagtgaagtatccccagaacaaggataagctgggtaagcagccagagcgcgcaggggaaggcgccccgtgcccagctttttccagtcataacagttcctccccccctcctctgcagaacagaaaaagcccgtctcccttagctttttgcccttgccccccagtgaattccatctctaaagagttgccatttctgctgcatgccttttaccccgggtacccattgctacttcctcccccgcacctgtttacctatggtgctctgccgtccgatcagtgcccacatttgttaatgctaccccaggatccctcctatcccacaatggctatgccctctcttctcatgatggttaacgaactgggccacccttcagcaagatgggagactctgctgccctacccaggcgccttccaggctagcggacaggctttgccctcacaagcccgcaacccgggggctggcgctgccccaactgacagtcctggccttgagcgtgggggaatggcaagcccagcaaagagggtgccactgagttcacagactggtacagccgccttaccataccctctaaagaagaagaacggcaaaatcctatatgagtgtaacatttgcggaaagtcctttgggcagctttccaacctcaaagtgcacttaagagttcactccggagagaggccttttcaatgcgcactgtgtcagaaatcctttacgcaacttgcacatctgcaaaagcaccacctcgtccacaccggtgagcgtcctcacaaatgttctattccctgggtgcccggcagaaaccattggaagtcctttcaggcctggcgggaacgtgaggtgtgccacaagcgcttttccagctccagcaatctcaaaacccacctgcgcttacactcgggtgcgcgaccattccagtgctccgtgtgtcgaagccgcttcacacaacacatacacttaaaactccaccataggctccacgctccacagccatgcgggcttgtccacacgcagttaccccttgccagtcttgcatgtttggctcagtggcatcagggcgcactcgacctcatggcagtggcatccgagaagcatatggggtacgacatcgatgaagtgaaggtatcatctacttcccaaggaaaagctcgagccgtgtcactgtccagtgcaggcactcctctggttatgggacaggaccagaacaattag

SEQ ID NO: 22040 - DNA, 810 bp, Artificial Sequence
  Description of Artificial Sequence: Synthetic coding sequence
atgaaggaggagagcgccgcccagctgggctgctgccaccggcccatggctctaggcgggaccggaggctcgctgtccccctccctggatttccagctttttaggggagaccaggtgttcagcgcttgcaggcccctcccagatatggtggatgcccacggtccatcatgtgccagttggctctgtcccctgccactggcccctggcagatctgctctcctcgcctgtctgcaggacctggatctgaatctctgcacccctcagcccgctcccctcggtaccgatctgcagggcctccaggaggacgcactgtctatgaagcacgagccacctggcctgcaagccagtagcacagatgacaagaaattcaccgtgaagtacccacaaaacaaggacaagctgggaaagcaaccggaacgtgcaggagagggagccccctgtccagcatttagttcccataactctagcagtccacctccactacaaaataggaagtctccctccccacttgctttctgtccatgcccccctgtgaactctatctccaaagagttgcctttccttctccatgccttttatcctggatatcccttgctgctccctcccccccatctcttcacatatggcgctctaccatccgaccagtgcccccacctcctgatgctgccacaggacccttcctaccccactatggctatgcctagcctgctgatgatggtgaacgaactcggacacccgtctgccaggtgggagacactcctcccatacccaggagcttttcaggcgtccggtcaggcattgcccagctag

SEQ ID NO: 22041 - DNA, 279 bp, Artificial Sequence
  Description of Artificial Sequence: Synthetic coding sequence
atgatcagcttccaggagagcgtgaccttccaggacgtggccgtggacttcacggctgaagaatggcagctgctcgactgtgcagagcggacgttgtactgggatgttatgctagaaaattaccggaaccttataagcgtcggctgccccataacaaaaacaaaagtcatcctcaaagtcgagcaaggacaggagccttggatggttgagggggccaatcctcacgagtcctcacccggctggtctgcagtagcacaaagtcagctgggatttaaatag

SEQ ID NO: 22042 - DNA, 360 bp, Artificial Sequence
  Description of Artificial Sequence: Synthetic coding sequence
atgatcagcttccaggagagcgtgaccttccaggacgtggccgtggacttcaccgctgaggagtggcaactgttggactgcgccgagcgaacgctgtattgggatgtgatgctagagaattaccgcaatttaatttcggttggttgcccaatcaccaaaaccaaggttattcttaaggtagaacaggggcaggagccctggatggtagaaggggcaaaccctcatgagtcatccccagaatcccgaagtgtcgcccggctggaatgctcaggggccattagcgccagggtgcaggttattctgttgccccaacctcccgaagagctggagctgcaggctcctgccaccatgcccgggtag

SEQ ID NO: 22043 - DNA, 1137 bp, Artificial Sequence
  Description of Artificial Sequence: Synthetic coding sequence
atgatcagcttccaggagagcgtgaccttccaggacgtggccgtggattttaccgcagaagagtggcagttactcgactgtgcagagagaacactgtattgggacgtgatgctggagaactatcgaaaccttattagtgtggggtgtcccattactaagacaaaggtaattctcaaagtagagcaagggcaggagccttggatggtcgagggcgcaaacccccacgagagcagtccagaatccgactacccccttgtggatgaacctggaaagcatagggaaagcaaagacaacttcctgaagagcgttcttctcacattcaataagatacttaccatggagcgcatacaccactacaatatgtctacgtctctgaatcccatgaggaagaaatcctacaaatccttcgaaaaatgcctccctccaaacctggacctgctcaagtacaaccgttcatacacggtggaaaatgcctatgaatgttccgaatgcggaaaagccttcaagaagaagttccactttattcgccatgaaaaaaaccataccagaaaaaagccgttcgagtgcaatgactgcggcaaagcgtactcccggaaagcccacttggcaactcatcaaaaaatccataacggagagagacctttcgtgtgcaatgattgtggcaaggcattcatgcataaagcgcagttggtggtacaccagcgtcttcacaccggcgaaaaaccttatgagtgtagtcagtgcggcaagacattcacatggaattcttccttcaatcagcacgtgaaatcccataccctggagaagtcgttcgaatgcaaggaatgtggcaaaacgttcagatattcctctagtctgtacaagcactcccggttccacactggcgaaaaaccatatcagtgcattatttgcggtaaggcttttggaaatacatcagttctcgtgacacaccaacggatccacacaggggaaaagccctactcatgtattgagtgcgggaaggcttttataaagaaatctcatctcctgcgacaccagatcacacatacaggagaaaaaccctacgagtgtaatcgctgcggtaaggctttcagccaaaagtcgaatttaatcgtgcatcagaaaattcatacatag

SEQ ID NO: 22044 - DNA, 2052 bp, Artificial Sequence
  Description of Artificial Sequence: Synthetic coding sequence
atgagcccccaccccgaggccatcaccgactgcgtgaccctgaacaccgtcggccagctggcagaagggggctatccccttcgattctcgacattgttccaggagcagcagaaaatgaacattagtcaagcatctgtgagttttaaagacgtgaccattgagtttacgcaagaagagtggcagcaaatggcccccgtgcagaagaatttgtatagggatgttatgctcgagaattacagtaatctcgtgtctgtgggatactgttgttttaaacccgaggtaatcttcaagctcgagcagggcgaagaaccctggtttagcgaagaagaattttccaatcagagccatcccaaggattatcggggtgacgatctcatcaagcagaataaaaaaattaaggataaacatctggagcaggccatatgcatcaataacaagacactgaccactgaggaagagaaggtcctcggaaagccttttactctgcatgttgctgcggttgcctctactaagatgtcctgtaagtgcaattcctgggaggtgaacctgcaatccatctctgagttcattatcaacaacaggaattactcaaccaaaaagatcgggtgtggcaatgtttgcgagaactcccctttcaagataaacttcgagaaaacgcagacgggggaaaagttttatgagcacaacaaaaacatgaaggcgctcaactataatgaaaatctccccaagcatcctaagttccagactcttgaacaggcctttgaatgtaataaaatcggcaaggccttcaacgacaaggctaactgcgtaaagcacaactcttcgcatacgggtgaaacatccagcaaggacgatgagttccggaagaattgtgacaaaaagactctctttgatcacaggagaacggggacgggtaaaaaacacctgcacctaaaccagtgcggcaagtctttcgagaaatctaccgtggaggaatacaacaagctgaatatgggaatcaaacactatgaactcaatccgagtggtaacaacttcaatcgcaaagcgcacctgacagacccccagaccgccgttattgaagagaaccctctggtcagtaacgaccgcacccagacttgggttaagtcctctgaatatcatgagaacaaaaaatcttaccagacgtccgtccatagagtgaggcgacgcagccacagcatgatgaaaccatataaatgcaatgagtgcgggaagtcattttgccaaaaaggccacctgatccagcatcaaagaacccacacgggtgagaaaccatttgagtgttcagagtgtggaaaaacattcagtcagaagagccatctatcaactcaccagcgcatccacaccgctgagaagccatataaatgcaatgagtgtggcaaaacgttcgtgcagaagtcaaccctaaggggacatcagcgcatccatacgggcgagaaaccttatgaatgctccgagtgcgggaagacatttgtccagaagagcacgctcagagaccatcaccgcatccacaccggagagaagagcttccagtgtaaccaatgcggaaaaactttcgggcagaagtcaaatctgcggattcaccagcggacacatacaggcgaaaaaacttatcagtgcaacgaatgtgaaaaatccttttggcgcaaggatcacctgattcagcatcagaaaacacatacaggggaaaaaccattcaagtgtaatgaatgcgggaagacgtttgcccgcacatcaactctccgggtgcatcaaagaatccataccggcgagaagcctttcaagtgtaacgaatgcggtaaaaagtttgtccggaaagcgatcctgagtgaccaccagcgcatccacactggggagaagccttttcagtgtaataagtgtgggaaaactttcggacaaaaaagcaaccttcgcatccatcagcgcacacactcgggcgaaaagtcttacgagtgtaatgaatacggcaagctgtgtaagaagtctacactctcactgtaccaaaagattcaaggagaggggaatccatactag

SEQ ID NO: 22045 - DNA, 789 bp, Artificial Sequence
  Description of Artificial Sequence: Synthetic coding sequence
atgccccggagccccctgcggagcagcctgagcaccgaggccagcgggccaagaggaccttttaaatgtcctgcgtcaccccggcctattacagcccagctgctacctggaagctctcctatcatcggccgctgcgttctcagagtgcagagaggctttcccggacccaaacccgcgctcatctcgtggatggaacaggagtcagaggcctggtctcccgccgcccaagatcccgagaaaggcgagcgactgggcggtgctagaaggggggacgtgccaaacaggaaggaggaggaaccagaagaggtccccagggctaagggcccaaggaaggctcctgtgaaggaaagtcctgaggtgctggtcgagaggaaccccgaccctgccatctccgtagcccctgcacgggctcaaccccctaagaacgccgcctgggatccgacaactggcgcccagccccctgcccctattccatccatggatgcccaggcaggccagagaaggcatgtgtgcacagactgtggccgacggttcacatatccctctctgctggtcagtcatcggcgtatgcattctggcgagagaccattcccttgtcctgagtgtggaatgcggttcaaacgaaagttcgctgtggaggctcaccaatggatccatcgtagttgctcagggggacgacgcggaagaaggcctggcattagggccgttcctagggctcccgtccggggagatagggacccaccagtactgtttcggcattatcctgatatctttgaagagtgcggctag

SEQ ID NO: 22046 - DNA, 1503 bp, Artificial Sequence
  Description of Artificial Sequence: Synthetic coding sequence
atggccccccccagcgcccccctgcccgcccagggccccggcaaggcacgcccatctaggaagcgaggtcgaagacctcgtgccttaaagtttgtggatgtggccgtgtattttagcccagaggagtggggatgccttagaccggcccagcgagcactgtatagggacgtgatgcgtgagacgtacgggcacttgggtgctctcggctgtgccgggcccaagccagcactgataagttggctggaacgcaataccgacgattgggagccggctgctcttgatccacaagaatatccccgcggcctgactgtgcagagaaagtctcggacaaggaaaaaaaacggggagaaggaggtgttcccaccaaaagaagcaccaagaaaaggaaaaagagggaggcgcccctccaaacccaggctcatcccgcgccagacttccgggggcccaatctgccctgactgcgggtgcacctttcccgatcaccaggcactagaatcacacaagtgtgcccaaaacctgaagaaaccgtacccttgcccagactgcggacggcgctttagctatcccagtcttttggtttctcatcgccgagcccattctggtgaatgtccgtatgtctgcgaccagtgtgggaaaagattctcccagcgaaagaacttaagccagcatcaggtaattcacacaggagagaagccttatcattgtcctgactgcgggaggtgcttccgccggtctcggtctctcgctaaccatcgaactacccataccggagaaaagccacaccagtgcccatcttgtggacgacgtttcgcttaccccagcttactcgccatacatcagaggacacacactggcgaaaaaccatacacgtgcctggagtgtaacaggaggtttcggcaaagaacagcccttgtcattcaccaacggatacatacaggtgagaaaccctacccctgtcccgattgtgagcggaggttctccagcagtagcaggctggtatcacacaggcgggtgcactccggagaacgcccttatgcctgtgagcactgcgaagcacgtttttcacaacgttctacactgcttcagcatcagctgctacataccggggagaagccatacccctgtcctgattgcggtagggcattcagacggtcaggcagccttgccatccataggagcacacatacagaggagaaacttcatgcgtgtgatgattgtggcagacgtttcgcataccccagtttgctggctagtcaccggagggtccattccggggagcgcccctatgcttgcgacctgtgtagtaaaaggtttgctcagtggtcacacctcgcacagcatcaactgctacacacaggggagaaaccattcccctgcctagagtgcggtagatgttttcggcagcgttggtctctggctgtgcataagtgttccccaaaagcccccaattgttcacccaggtcggctatcggtggctcttcccagagaggcaatgcccattag

SEQ ID NO: 22047 - DNA, 1497 bp, Artificial Sequence
  Description of Artificial Sequence: Synthetic coding sequence
atggccccccccagcgcccccctgcccgcccagggccccggcaaggctaggccgagccgaaagcgcgggagaaggcctagagccctgaagttcgtagatgtggctgtttattttagccccgaagagtggggctgcctaaggcccgcccagagagcactgtatagagacgtcatgcgcgagacatatggacacctcggagcccttgggtgtgcaggccccaagcccgctctgatttcctggctcgaaagaaacaccgatgactgggagcctgccgcgttggaccctcaagaatatccccgtggtctgaccgtgcagcgaaagagtagaactaggaagaagaatggggaaaaggaggtcttcccccccaaagaggcgcccagaaaagggaaaagaggaaggcgcccctctaaaccacgattgatcccaagacagaccagcggtggtccgatatgtccagattgcgggtgcacttttcctgaccaccaggcactggaatcccacaagtgtgcgcaaaacttaaaaaaaccatatccctgtccagattgtggccggcgcttttcctacccctccctactggtgagccatagacgggcacactctggcgagtgcccttacgtatgtgaccaatgcggcaaacgcttctcccagaggaaaaatctaagccagcaccaggtgatacacactggagaaaagccttaccattgcccggactgtggcaggtgtttccggcgcagcaggagcctggccaaccatcggaccactcataccggtgaaaaaccccatcagtgtccatcttgtggtcgtcgattcgcttatcctagcctcctcgctattcaccagcgaacccacaccggcgagaagccctacacgtgcctggaatgcaatcgtcgtttcagacagcggactgccctagtgatccaccagcggattcataccggcgagaaaccgtatccttgccccgactgcgagcgccggttttcctccagttccaggctggtatcccaccgccgtgtgcacagcggagaaaggccctacgcttgtgaacattgcgaagctaggttttcacagcggagcacacttctgcagcatcagctactgcataccggtgaaaagccctatccttgccccgactgtggccgcgcgtttaggcgctccggaagcctggccatccatagatccacccatactgaagagaagctgcacgcctgcgatgactgtggcagacggtttgcctatccttcactgctggctagtcatcggagggtccacagtggggagcgcccctatgcttgtgatttatgctcaaagaggttcgctcagtggagccacctcgcccagcatcagcttctgcacaccggggaaaagccttttccgtgcctagagcccgtgctgcccccagaggtggtctctgcagtgcacaaatgctctcccaaggctcccaactgctccccccgctctgcaatcggcgggtctagccaacgaggaaatgctcactag

SEQ ID NO: 22048 - DNA, 921 bp, Artificial Sequence
  Description of Artificial Sequence: Synthetic coding sequence
atggcccagatcagcagcggcggcggcggccagagccggtgcctgcttttcgcgctgggctctgagatgggaagcgaaaaggaacagtcccctgagcctcatcttccggaagagggtgaggggggtaagccctggagagtggatgactctgagggaagctggatacccccaggtgaaaaagagcacggacaagagagcctgtcagatgagctgcaagagacgcatcctaagaagccatggcagaaggttaccgttcgggcccgggagctgggtgacccaattgcccatccccgacacgaggccgatgagaaaccattcatttgtgcgcagtgtggtaaaaccttcaacaacacatccaacctaagaacgcatcagcgtattcacacgggtgagaaaccttacaagtgctctgagtgtggcaaaagtttctctagatcttctaaccggattaggcacgaacgcattcatctggaggagaaacactacaagtgccccaagtgtcaggagtcattccgacgccgcagtgatctgactactcatcaacaagatcacttgggtaagcgcccttatcgatgcgacatctgtggaaagagtttttcacagagtgccacattggccgtacaccacaggacccacctggagcccgccccttacatttgttgtgagtgcggcaaaagcttcagcaatagctcatcatttggggtccaccaccggacacatacaggggagcgcccatatgaatgcaccgaatgcggacgaacattcagcgacattagcaatttcggggcccatcagcggactcacaggggcgaaaagccctacagatgtaccgtgtgtggcaagcactttagtcgtagtagcaatctgatccggcatcagaagactcacctaggtgaacaggctgggaaggactcatcctag

SEQ ID NO: 22049 - DNA, 939 bp, Artificial Sequence
  Description of Artificial Sequence: Synthetic coding sequence
atgagcctgtgcagccccacccacagcgccgagatgagcctgttcctgcaagggcccgaggagatgctgcccttgagttcagaggggtctgaaatgggcagcgaaaaagagcaaagcccagagccgcacctgcccgaggagggcgaaggtggtaagccctggagagtggacgatagcgagggcagctggattcctcctggagagaaagagcacggccaggagtctctgagcgacgaactgcaggaaacccacccgaaaaagccatggcaaaaggtgacagtcagggctagagaattaggtgaccccatagcccacccacgtcatgaagctgatgaaaaaccgtttatctgtgcccaatgtggaaagaccttcaacaacacctccaatttaaggacacatcagcgtattcacaccggcgaaaagccttataagtgcagcgagtgcggaaaaagcttcagtagatcttctaacaggatcagacatgaacgtatccacctggaagagaagcattataagtgtcccaagtgccaggaaagctttaggagacgctctgacttgactacccatcagcaggatcacctgggcaagagaccatatcggtgcgacatctgcggtaagtcctttagccagagcgcaacactggccgtacaccaccgaacgcatctggaacccgctccatacatctgctgcgagtgcggcaaatccttttcaaactcttcgtcctttggagtgcaccacagaacccacacaggcgaacgcccatacgaatgcaccgaatgtggacgaacctttagtgacatcagtaacttcggggcacaccagagaacccaccgaggggagaagccgtaccgatgcaccgtttgtggcaagcatttctcacgcagtagcaacctgaaacccttcatcccattgtggaggatggtcctctacagtctgtag

SEQ ID NO: 22050 - DNA, 921 bp, Artificial Sequence
  Description of Artificial Sequence: Synthetic coding sequence
atggcccagatcagcagcggcggcggcggccagagccggtgcctgctctttgcgctcggatcggaaatgggctcagaaaaagaacagtcccctgagccacatctgcccgaggagggcgagggcggtaagccatggagggtggatgatagcgagggctcctggatcccaccgggtgagaaggaacacggacaggagagtcttagcgatgagctgcaggaaacacatcccaagaagccatggcagaaagtgaccgtcagggctcgcgaattgggagaccccatcgcacatccaagacacgaggccgacgagaagccattcatttgcgcgcagtgcggcaaaacattcaataatacctccaatctgaggacccaccaaagaatccatactggtgagaaaccatataaatgcagcgaatgtgggaagagtttctcccgatctagcaatcgtataagacacgaaaggatccacctggaagaaaagcattataagtgtccgaagtgccaggagagtttcaggcgcagaagcgacctgacaacgcaccagcaggatcacctgggaaaacggccataccgttgtgacatctgcggaaagagtttcagccagtctgctacactggccgttcatcaccgaacccaccttgaacccgccccgtatatctgttgcgaatgcgggaaatctttttccaacagctcatcatttggcgtgcatcatcggacacacacaggcgagcgcccgtacgagtgtactgaatgcggacggacattcagcgacattagcaacttcggagcccaccagcgaacccaccgaggagaaaaaccctacaggtgcacagtgtgtggaaaacacttttctcggagttctaatctcatccggcaccaaaaaacccatctgggggaacaagcgggcaaagattcttcttag

SEQ ID NO: 22051 - DNA, 855 bp, Artificial Sequence
  Description of Artificial Sequence: Synthetic coding sequence
atgggcagcgagaaggagcagagccccgagccccacctgcccgaggagggcgagggaggaaaaccttggagggtcgatgatagtgagggaagttggattcctcctggtgaaaaggagcatggacaggaaagcctctccgatgaactccaggaaactcacccaaaaaagccctggcaaaaagtaactgttagagccagagagctgggtgacccaatcgcgcacccccggcacgaagctgatgagaagcccttcatttgcgcccagtgtggtaaaactttcaataacacctccaacctgcggacacaccagcggatacatacgggtgaaaaaccttataagtgctcagaatgtggcaaaagcttctctcgtagctcgaatcgaatccgccatgagagaatccatctggaagagaaacactacaaatgtccgaagtgccaggagagcttccggcgccggtccgatttgaccactcaccaacaagaccatctgggtaagcggccctatcggtgcgacatctgcggcaaatcgttcagccagagtgcaaccttggctgtgcaccatcgtacacatctagaaccagctccctacatttgctgtgagtgcggcaagagcttttccaactctagctcatttggcgtgcaccacaggacccacaccggagaacggccgtacgagtgcaccgagtgcggacgcacttttagcgacatcagtaattttggcgcacaccagaggacacacagaggggagaaaccctatcgttgcacagtttgcgggaagcacttttcacgttcttctaatctcattcgacaccagaagacccacttgggcgagcaggccggcaaggattccagttag

SEQ ID NO: 22052 - DNA, 855 bp, Artificial Sequence
  Description of Artificial Sequence: Synthetic coding sequence
atgggcagcgagaaggagcagagccccgagccccacctgcccgaggagggagagggaggtaaaccgtggagggttgatgatagcgaaggatcttggatcccccctggcgagaaggaacacggacaggaatccctctcggatgaacttcaagagacacatcctaagaagccttggcagaaggtcacggttcgcgctcgagaactcggagacccaatcgcacatccccgacacgaggctgacgagaaaccttttatctgcgcacaatgtggcaaaaccttcaataataccagtaacctgaggacgcatcagcggattcacactggagaaaaaccttataaatgcagcgaatgtggcaagagctttagcaggtcgtctaatagaatccgccacgaacggatccacctggaggagaagcattataaatgccctaagtgtcaggaaagttttcgtaggcgttctgatctgacaacccaccagcaggaccacctgggtaagcgcccctatcgctgtgatatttgcggcaagtccttcagccagtccgctacattggctgttcatcatcggacccacttagaaccagccccgtatatttgttgtgaatgcggcaagagcttttccaactctagcagttttggagtacatcacagaacccacactggggagcggccttatgagtgcacagaatgtggacgcactttcagtgatatctccaatttcggagcccaccagcggacacataggggcgagaagccttatcggtgcacggtatgtggcaagcattttagtcggtccagcaaccttatcagacaccaaaagacccacttaggtgaacaagccggaaaggatagcagctag

SEQ ID NO: 22053 - DNA, 855 bp, Artificial Sequence
  Description of Artificial Sequence: Synthetic coding sequence
atgggcagcgagaaggagcagagccccgagccccacctgcccgaggaaggcgagggtggcaaaccctggcgtgtggacgatagtgaaggctcttggatcccccctggcgaaaaagaacatggacaagaatctctctcggacgagctgcaggagacccatcccaagaagccctggcagaaggtgacggtacgggcccgagaactaggtgacccaatagcccacccacgacacgaagcggacgaaaaaccatttatatgtgctcagtgcggaaaaacatttaataacacatctaatttgcgtactcaccagcgcatccataccggcgaaaagccttacaagtgtagcgagtgtggcaaaagcttctctcggagctcaaaccgcataaggcatgaacgaattcatctagaggaaaaacattataaatgtcccaagtgccaggagtcatttcgacgcaggtctgacttgactacccaccagcaggatcacctaggaaagaggccttatcgctgtgatatctgtggtaagtcttttagccaaagcgccacacttgctgtacatcaccgtactcatctcgaacctgccccatatatctgctgcgaatgtggaaagtccttcagcaactcctcaagtttcggtgtgcatcatcgtacccacactggagaaaggccgtacgaatgcaccgaatgtggccggaccttcagcgatatctcaaacttcggagcgcaccagagaacacaccgcggggagaaaccctatagatgtacggtctgcggcaaacacttctcgagatctagtaatctgattcgccatcagaagactcacttgggggagcaggctggaaaggatagtagttag

SEQ ID NO: 22054 - DNA, 402 bp, Artificial Sequence
  Description of Artificial Sequence: Synthetic coding sequence
atggcccagatcagcagcggcggcggcggccagagccggtgcctgctgttcgcattagtgcttgcaatctgtgtgcattcacagggtagtgagatggggtccgagaaggagcagagtcccgagcctcacctgccagaggagggcgagggagggaaaccttggagagtggacgacagcgaggggtcctggatcccaccaggcgagaaggagcacggacaggaatctttgtcagatgaactgcaggaaacgcaccctaagaaaccatggcagaaagtgacggtgcgcgctcgggaattgggcgatcctatagcccacccgcgacatgaggccgacgagaagccatttatctgcgcacagtgcggcaaaactttcaataacacaagtaacctaagaacgcactag

SEQ ID NO: 22055 - DNA, 948 bp, Artificial Sequence
  Description of Artificial Sequence: Synthetic coding sequence
atgagcctgtgcagccccacccacagcgccgagatgagcctgttcttgcagggtcccgaagagatgttgcctctttcctctgaaggcagcgaaatgggtagcgaaaaagagcagagtcctgagccccatctgccggaggaaggagagggtgggaagccgtggagagtagacgattccgaaggctcctggatacctcccggtgaaaaggagcacgggcaggaaagtctttctgacgagctgcaggaaacccatcccaaaaaaccatggcagaaagtcactgtaagagctcgtgagctcggggatccaatcgcccatccccgtcacgaggcggatgagaaaccttttatttgcgcgcaatgtggcaagactttcaataacacaagtaacttacgcacacatcagcgaatccacacaggggaaaaaccctacaagtgtagtgagtgcgggaaatctttctctcggagttctaaccgtatccggcatgaacgtatccacctggaagagaaacactacaagtgcccgaagtgccaggaaagcttcaggaggagaagcgacctgaccactcaccagcaggatcacctggggaagagaccttaccgctgtgatatctgcggtaagtcatttagtcagtcagccacattggcagtacatcataggacacatctcgaaccagctccttacatctgctgcgagtgtgggaaatcatttagcaactcaagcagttttggagtgcaccatcggacccatacgggcgaacgtccctatgaatgcactgaatgcggaagaacttttagtgatatctctaacttcggcgctcatcagcgcactcataggggcgagaagccttaccgctgcaccgtatgcggaaaacacttttcaagaagttccaacctgattcggcaccaaaaaacacacctgggcgaacaagctgggaaagacagtagctag

SEQ ID NO: 22056 - DNA, 1560 bp, Artificial Sequence
  Description of Artificial Sequence: Synthetic coding sequence
atggccagcagccccgccgtggacgtgagctgccggcggcgggagaagcgcaggcaactggacgctagacgatctaaatgccggatccggctaggaggccacatggaacagtggtgtctgttgaaagaacgtttgggattctccctacacagtcagcttgccaagttcttgctagacagatatactagctcaggatgcgttttatgcgccggcccagagcccctgccaccaaaagggttgcagtatctggtcctgctgtcccacgcccactctagggaatgctccctggtgccaggtctgagaggcccaggcgggcaagacggcggattggtttgggaatgctctgccggacatactttctcgtggggaccgagtctctccccgaccccctcagaggcccccaaaccagcttcattgccccacactacaaggcgcagctggtgctctgaggctaccagcggtcaagaattggccgacttagagtctgaacacgacgaacgtactcaggaagcacgcctgccccgccgagtggggcccccgcccgagactttccctccacctggggaagaggaaggcgaggaagaggaggacaacgacgaagacgaagaggagatgctgagtgacgcttcactgtggacctattcttcttccccagatgatagcgagcccgacgcccctaggctgctgccctctccagttacctgtacccccaaggagggtgaaaccccaccagcccccgcggcattatccagccctttggctgtccccgccttgagtgccagttcgttgtcaagtcgtgccccaccccccgctgaagtgcgggtgcagccgcaactgtccaggactccacaggcagcacagcagacagaggccctggcatccaccggcagccaggcacagagtgcccccacaccagcctgggatgaggataccgctcaaatcggcccaaagcgcatccgcaaggccgcgaagcgggaactaatgccatgcgactttcctggatgtggccggatattctccaaccgtcagtatttaaatcaccacaagaagtatcaacatatacatcaaaaaagttttagttgtcctgaacccgcctgcggcaagagcttcaactttaagaagcatctgaaagaacatatgaaactgcacagtgacacaagggactatatctgtgagttttgtgcacgttcatttcgcacgtcctcaaacctggtgattcacagaaggatccacactggggagaaacccctacagtgcgagatatgcggctttacatgcagacaaaaggcaagcctgaattggcaccaacgcaaacatgctgagacggttgcagctctccggttcccctgtgagttttgtggaaaaagatttgagaagcccgacagtgtagcagcacacaggtccaagtcccaccctgcgctgctgctggctccccaagaaagtccctccggccctctcgagccttgcccgtctatttctgcacccggccccctggggtctagcgaaggctctaggcccagcgcgtctccccaggcccccaccctccttcctcaacaatag

SEQ ID NO: 22057 - DNA, 1044 bp, Artificial Sequence
  Description of Artificial Sequence: Synthetic coding sequence
atggccagcagccccgccgtggacgtgagctgccggcggcgggagaagcgcagacagttagacgccagaaggtctaaatgtagaattcgcctgggtggacacatggagcagtggtgcctacttaaggaaagactgggattctctttacacagtcagctagcgaagttcctgctcgaccggtatacatccagcggctgtgtgctttgcgctggccctgagcctctgcctccgaaaggtctgcaatatctagtactgctctctccctcttcgctatccagtcgcgcccctcctcctgccgaggttagggtgcagccccagctcagtcggacaccacaggcagcccagcaaacagaggccctggcttctactgggtcccaggcacagtcagcaccaacacctgcgtgggacgaagacaccgctcagattgggccgaagagaattcgcaaagctgcgaaaagggagcttatgccatgcgatttcccaggatgtggaaggatcttcagcaaccgccaatacctgaatcaccacaaaaaatatcaacatattcaccagaaaagtttcagttgtcctgagcccgcatgcggtaagagtttcaattttaaaaaacatttaaaggaacatatgaagctgcactccgacacccgtgactatatttgcgagttttgcgctcgcagcttccgcaccagtagcaacctggttatacacagacggatccacaccggagagaagcccctgcagtgcgagatctgtggtttcacatgtaggcagaaagcgagcctgaattggcaccagcggaaacacgccgaaacagtggctgctctgcgcttcccctgtgagttttgtggaaaacgtttcgaaaagcctgattccgtggcagcacaccgctccaagagccacccagcgctactcctggctccccaggagagccctagcggcccactcgagccatgcccatctatctctgctcctggccctcttgggtcatctgaggggagtaggcctagtgcttctccacaagcccccaccctgctcccacagcagtag

SEQ ID NO: 22058 - DNA, 1425 bp, Artificial Sequence
  Description of Artificial Sequence: Synthetic coding sequence
atggccagcagccccgccgtggacgtgagctgccggcggcgggagaagaggcgacaactggatgcaaggaggtccaaatgccgaatccggctgggagggcacatggagcagtggtgtctgctgaaggagagactcggcttctcactgcactcccagttagccaagtttcttctggaccgctatacttcaagtggttgtgtgctctgcgctggcccggaacctcttccacctaaaggcttgcagtacttagtccttctatcccatgcacacagcagagagtgcagcctcgtccccggcctcagaggcccaggagggcaggacggtggtcttgtctgggagtgctcggccgggcacaccttcagttgggggcctagcctttctccaacaccctccgaggcccctaagcccgcctcacttccccatacgactcggcgatcctggtgttctgaagcaaccagtggacaagaactcgcagatttagagagtgagcatgatgagaggacccaagaagctcgactaccatctagtgaaccagatgctccacggctcttgcccagtcccgttacatgtacaccaaaggaaggcgagactccgcccgctcccgctgctttatcatctcctctcgcagtcccagcccttagtgcatcatccctgagtagcagggcccctccacctgcggaagtgcgggtgcagcctcagctgtcgcgcactccccaggctgcacaacagactgaagctctcgcctctaccggttcccaggctcagagtgcgcccacaccagcttgggacgaggacactgcacaaatcggccccaaacgcatccgtaaggcagccaagagagagctgatgccttgtgatttcccagggtgcggtcgtatattttccaatcgtcaatatctcaatcaccacaagaaataccagcacatccatcagaaatcgttctcttgtcctgaaccagcctgtggcaagagcttcaatttcaagaaacatctgaaggagcacatgaagcttcactccgacactagagattacatttgcgaattctgcgctagatcattcagaaccagcagtaatctggtaatccatcggcggatccataccggcgagaagcccttacagtgtgaaatctgcggttttacctgtaggcagaaagctagtctgaactggcaccagcgcaaacacgccgaaactgtggcagccctccgctttccctgcgagttctgtggcaaacgatttgagaagcccgattctgtcgctgcacacaggagtaaatctcatccagcacttctactagctccccaggagtctcctagcggcccccttgagccatgtccttctattagtgctcctggcccactcgggagctccgaggggagtcgcccctccgcgagtccccaagcccccaccttgctcccccaacagtag

SEQ ID NO: 22059 - DNA, 291 bp, Artificial Sequence
  Description of Artificial Sequence: Synthetic coding sequence
atggccagcagccccgccgtggacgtgagctgccggcggcgggagaaacggaggcagctcgatgcccgacggtcgaagtgtagaattcggttaggaggccatatggagcaatggtgcctgctgaaagagcgattgggctttagtctccatagccagctagccaagtttttgttggacagggcatgccccgcagctctgttccacccacaggtgtcccactttacgaggaccgcatgcgtcacgtgtggcttgcggggctcttgcagccctccccatgggctcagtgaatag

SEQ ID NO: 22060 - DNA, 1425 bp, Artificial Sequence
  Description of Artificial Sequence: Synthetic coding sequence
atggccagcagccccgccgtggacgtgagctgccggcggcgggagaagaggcgacagctggatgcgcggcgttctaagtgcaggattcgactggggggccacatggaacagtggtgcctcttaaaagaacggctgggttttagcctccatagtcagctggccaagtttctgttagacagatatacaagctcaggttgtgtgctgtgtgctggaccagagcctctgcctccgaagggcctacagtacctcgttttgctgtctcacgcacattcaagagaatgttccttagtgccagggctgcgtggacccgggggacaggatgggggactcgtctgggagtgttctgcggggcacactttttcctggggaccgtctttgagccctacaccaagcgaagcgcccaagcctgcatcccttcctcacacaactcgccgtagttggtgttcagaggccacctccggtcaggaactcgccgacctggaatcagaacatgacgagcgaactcaggaggcacgcttacccagctctgagccagacgctccccggttgctaccgtcacctgttacttgtacccctaaggaaggcgagacgccaccggcccctgccgccctttcttcacctctagcagttcctgctctcagtgcctccagccttagctcccgggcccctcctccggcagaggtgcgagtgcagcctcagctttcgagaactccccaagccgcgcagcagaccgaagctctcgcctccacaggttcccaggcgcagagcgcgcctacaccggcgtgggacgaggacactgctcaaattggaccaaagcgaataaggaaagctgccaagagagaactcatgccctgtgacttcccaggttgtggacggatcttttccaatcggcagtacttgaatcatcacaagaagtaccagcacatccaccagaagtccttctcctgccccgaacccgcctgtgggaagagcttcaacttcaagaagcacctgaaagagcatatgaagctgcacagtgacactcgcgactacatttgtgagttttgcgcccgatctttcaggacgagttccaacttggtgattcataggagaatccataccggtgaaaagcctctacagtgtgaaatttgcggtttcacttgcaggcagaaagcatccctgaattggcatcagcggaaacatgccgagacagtggccgcattgagattcccttgtgaattctgtggcaaaaggtttgagaagccagattccgtcgctgcacacagaagtaagtctcaccctgctcttctgttggcgcctcaggaatcacctagcggccctctggagccttgtcccagcatcagtgccccaggcccactgggttcctccgagggctcccggcctagcgcttccccacaggcgcctaccctgctcccacaacaatag

SEQ ID NO: 22061 - DNA, 1575 bp, Artificial Sequence
  Description of Artificial Sequence: Synthetic coding sequence
atgcccctggtgcacatggccagcagccccgccgtggacgtgagctgtcggagacgggagaaaagaagacagctagacgccagacggtcaaaatgtaggattcggcttggtggacacatggaacagtggtgcttgcttaaggagaggctgggattttccctgcactcccagcttgccaagtttctgcttgaccgttacactagcagtggatgcgtcttatgtgccggaccggagcccttgcctccaaaagggctccagtacctggttcttctgtcacatgctcactctcgtgaatgctctctcgttccaggtcttcggggtccaggcggacaggatggaggactagtgtgggaatgttccgctggccatacgttcagttgggggccttctctgtccccgaccccttccgaagcccccaagcctgcaagtctccctcacaccacccgaaggtcctggtgcagcgaagcgacaagcggccaggaactggccgatctggagagcgaacatgacgaaaggactcaggaggcccggctgcctcgacgggtggggccaccacctgagacctttccgccgcctggggaggaggagggagaggaggaagaagataatgacgaagatgaagaagagatgctgtctgatgctagcttgtggacctatagctcttccccggatgacagtgagcctgacgcaccacgactgttacccagtcccgtgacgtgcacgccgaaagagggggaaacaccacccgctcctgctgcgctgagtagccccttggcggtgcctgctttatctgcatccagcttgtcctccagggctccccctccagctgaggttagagttcagccccagctctcacggacaccacaggctgcacagcagacggaggcactggcctcgacaggttctcaggcacaatccgcacccacgcctgcgtgggacgaggataccgcccagattggccctaaacgaattcgcaaggcagccaaaagagaattgatgccgtgtgattttccaggctgtggacgaatctttagtaataggcagtacctgaaccaccacaagaaataccagcatatacaccagaagtcctttagttgtccagaaccggcctgtggcaagtccttcaatttcaaaaagcacctgaaggagcatatgaaactccatagtgacactagagattacatatgtgaattctgcgccagatcattcagaacctcctcaaatttagtcatccacagacggatacacaccggggaaaagcctctccagtgcgaaatttgtggatttacgtgccggcagaaggctagcctcaactggcaccagcgcaaacatgccgagactgtcgcagccctacgctttccctgtgagttttgtggaaagagatttgaaaaacctgattccgtggcagctcaccggagcaagagtcaccccgctctgctgttagcaccgcaggagtcacccagtggccctttggagccatgcccgagcatctccgcccctggcccgctgggcagctctgaaggttcgcgaccgagcgcttccccccaggcccctaccttgctgcctcagcaatag

SEQ ID NO: 22062 - DNA, 399 bp, Artificial Sequence
  Description of Artificial Sequence: Synthetic coding sequence
atggccagcagccccgccgtggacgtgagctgccggcggcgggagaaacgacgtcagctggacgcaaggcgcagtaagtgcaggattcggctgggaggtcacatggagcagtggtgcctgcttaaggaaaggctggggttcagtttgcactcccaactggccaagtttctgcttgacagatacacctcttcagggtgtgtgttgtgtgcaggccccgaacctctgccacccaagggacttcaatatctggtcctgcttagtcatgcccactctcgcgagtgctccctggtgcccgggctgaggggaccaggggggcaggacggtggcctcgtgtgggaatgcagtgctgggcatacattcagctgggggccttctctgagtccgaccccaagcgagtag

SEQ ID NO: 22063 - DNA, 1548 bp, Artificial Sequence
  Description of Artificial Sequence: Synthetic coding sequence
atgggcctgctggccttccgggacgtggccctggagttcagccccgaagagtgggaatgtcttgaccccgcccagcgcagcctgtaccgagatgtgatgttagaaaactacaggaacctgattagcttgggcgaggactcttttaacatgcaatttctgtttcacagtcttgctatgtctaagcctgaactgataatatgcctcgaggcgaggaaagagccgtggaacgtgaatactgagaagacagctcgacactctgtcctatcaagctacttgaccgaggacatactgcccgaacagggactgcaagtgagttttcagaaagttatgctccgcaggtatgagcggtgctgtctagaaaagcttagactgaggaatgactgggaaatcgtgggcgaatggaaaggacagaaggctagctataatgggctcgatctatgtagtgccacaacccattctaaaaactttcaatgtaacaaatgcgtgaagggtttttccaagtttgctaatcttaacaagtgcaagataagccacacaggagaaaagccattcaagtgcaaggaatgcggaaatgtaagctgcatgagccttatcatgacccagcagcaacgtatacatataggggaaaatccataccagtgtaagaagtgcggcaaggccttcaatgagtgctcatgctttactgactgtaagagaattcacgtgggagaaaagcattgtaagtgtgaagaatgtaataacatttttaaatcatgttctagcttggccgtcgtcgaaaaaaatcatacggagaaaaaaacttatcgatgtgaggaatgcgggaaggcgttcaacctgtgtagtgttcttactaagcataaaaagatccataccggggagaagccttacaaatgcgaagaatgcgggaagagcttcaaactgttcccatatttgactcagcacaagagaattcacagccgcgaaaaaccctacaagtgcgaggagtgtgggaaagttttcaaactgttaagttacctgactcaacaccgccggatccacaccggagaaaaaacgttcaggtgcgaggagtgtggaaaagcctttaaccagtcctcacacctcactgaacaccgaaggattcacacaggggagaaaccttataagtgtgaagaatgtggcaaggccttcacttggttttcctatctaatccagcataagaggatccacacgggacaaaaaccctacaagtgtgaggaatgtgggaaagcatttacctggttttcctatctaactcaacataagagaatccatacgggagagaaaccctataaatgcgacgagtgcggaaaggccttcaactggttttcttatctgacaaatcacaaaagaattcacacaggtgagaagccatataagtgcgaggagtgcggaaaagcattcggccagtctagccatctcagtaagcataaaactatccacaccagggagaagccatacaagtgcgaagaatgcggtaaagccttcaatcactctgctcagctcgcggtccatgagaagacacacacttag

SEQ ID NO: 22064 - DNA, 519 bp, Artificial Sequence
  Description of Artificial Sequence: Synthetic coding sequence
atgggcctgctggccttccgggacgtggccctggagttcagccccgaggagtgggagtgtctcgatcccgctcagaggtctctatatagggatgttatgctagagaactatagaaatctgattagcttaggcgaggactcattcaacatgcagtttctgtttcactctctcgcaatgagcaaacccgagcttatcatctgcttggaagcccgaaaggaaccttggaacgtgaacacggaaaaaacagcccgacacagtgtcctcagctcctatctgacagaagatattttaccagagcaggggttgcaggtgagtttccagaaagtcatgctgcgccggtacgaaagatgttgcttggagaagctgagactgcggaacgactgggaaatcccctgtgaggatgtgttggcctctcctttgccctctgcgatgatattatctttcctccggccaccacagaagcagaagcacgtgaagcctaccgagccaatccagagcaaaaccctccagtggctgtag

SEQ ID NO: 22065 - DNA, 519 bp, Artificial Sequence
  Description of Artificial Sequence: Synthetic coding sequence
atgggcctgctggccttccgggacgtggccctggagttcagccccgaagaatgggaatgccttgatccagcccagagatcactttacagggatgtgatgctcgaaaactataggaacctgatttctctgggcgaagacagttttaatatgcaattcctctttcatagtctggcgatgtccaagccggaactgataatctgtctggaggctaggaaggaaccatggaatgtgaacacagagaagacggccagacacagtgtgctgtcctcgtacctgaccgaggatattctacccgagcaggggctacaggtgagcttccaaaaggtcatgctgcggcggtacgagcgatgttgtctggaaaaactcaggctgagaaatgattgggagatcccttgtgaggacgtcttagcatcccccctgccgagtgccatgatcctttccttcctgagacccccgcagaaacagaagcatgtgaagcccacagaaccagtgcagagcagcactatcgaacttctgtag

SEQ ID NO: 22066 - DNA, 1125 bp, Artificial Sequence
  Description of Artificial Sequence: Synthetic coding sequence
atggagcccggcggcgagcccaccggcgccaaggagagcagcaccctcatggaaagtctggctgcagtaaaggccgccttcctcgcccaggcgccctccggctccagatctgccgaggttcaggccgcccagagcactgagcccgccgccgaggccggcgccccggaaggggaaggccaccgaggaggccctccccgggcacttggcagtttgggcctctgcgagaaccaagaagctagagaacgccctggcggttcacctcgggggcccgtcacatctgaaaagacaggcggacagtccggtctggaatccgatgtgccacctaacgcagggcctggggcagaaggaggagggagctggaagggaaggccttttccatgcggcgcctgcggccggagctttaaatgctcatctgacgccgcgaaacatcgttctatacattcgggtgaaaagccctacgagtgttccgattgcggcaaagcctttatccattcctcacacgtggtgcgacaccaaagggcccattcaggggaacggccatatgcttgcgccgaatgcggcaaggccttcggccagtcctttaacctcctcagacatcaaagagtgcataccggtgagaaaccctatgcttgtgccgactgtggcaaggccttcggacagcgttctgacgccgccaaacatcgtcgcacccatacgggcgaaagactgtacgcgtgtggggaatgcggcaaacggttccttcattccagcaatgtggtgcgccataggaggactcaccacggcgaaaacccatatgaatgcagagagtgtggccaggcattttctcagtcatcaaatttgctgcagcatcaacgggtccacacaggtgaacgccccttcgcctgccaggattgtggaagggcattcagccgaagcagtttcctgcgggaacacagacggatccatacgggtgagaaaccacatcagtgtggtcactgcgggagagcgttccgcgctttaagcggcttcttcaggcaccagagattgcacacaggagagaagccgtttcgctgcaccgagtgcggacgtgccttcaggctgagtttccatttaatccagcataggcgagtgcacggcgcagagtag

SEQ ID NO: 22067 - DNA, 324 bp, Artificial Sequence
  Description of Artificial Sequence: Synthetic coding sequence
atggagcccggcggcgagcccaccggcgccaaggagagcagcaccctaatggagtctctggctgcagtgaaggccgcttttctggcccaggccccttcaggaagtagaagcgcggaggtgcaggccgctcagtccactgaacccgctgcagaggctggagcaccagaaggggaggggcacaggggtggccccccacgggcacttggctccctggggctgtgtgaaaaccaggaagccagggagcgccccggggggtctcctagaggccccgtcaccagtgaaaagaccggtggccaatctggactggagtcagacgtgccatag

SEQ ID NO: 22068 - DNA, 615 bp, Artificial Sequence
  Description of Artificial Sequence: Synthetic coding sequence
atggagcccggcggcgagcccaccggcgccaaggagagcagcaccctgatggagtccctggccgccgtcaaggcagcattcctggcccaggccccttctgggagtaggagcgccgaggttcaggccgcacaaagtacagaaccggccgctgaagccggggccccggagggtgaaggacacaggggagggccccctagggcacttggttccctgggcctgtgcgagaaccaggaggctagggaacgtcctgggggctctccacgcggccctgtgacctccgagaaaactggaggacagtctggcctcgagagcgatgttccacctaatgcaggaccaggggccgagggaggggggagctggaaaggtcgcccatttccctgtggcgcctgcggaagatcattcaaatgttcctcagatgccgccaagcacagaagcatccactccggcgagaagccctatgagtgctcggattgtggcaaagccttcatccacagtagccacgtggttaggcaccagagagcccacagcggcgagcgtccctacgcttgtgccgaatgtggtaaagcctttgggcagagttttaatctgctgcggcatcagagggtgcatacatag

SEQ ID NO: 22069 - DNA, 1638 bp, Artificial Sequence
  Description of Artificial Sequence: Synthetic coding sequence
atgaagcaggaggacaaccagggcgtgtgcgcccaccaggacagcgaagataagggcatgggatcagattttgaagattcagaggaccgggaaggcgaccccgaagaaagggagatgggttctaatccccacgacacaaataagagggaaggccacccagagcctgaaatgggttctaatccacaggattccaggcaccgcgaagcagttcctgatatctgtacggaaggtcagctgtctgaggaggagggcgtttccgtccggggagaagaagatgaccagtccggcgttgctgacatggcaatgtttccgggactttcagaatccgattcaataagccggtcattgcgggaagatgacgacgaatccgctggagaaaaccggctcgaagaggaagaggaacaacccgcgcctccggtgctcccgtggcgtagacatttatctttgggctcacgccatagaggcgacaaaccggcgcaccgcaggtttcatcgcctccatcatcctatggcggtggacttgggagaactggacagtctcgtggcgagtatcatggatgcgccaactatatgcccagattgcggcgaaagtttttcccctggagcagcttttctacagcaccaaaggatccaccggttggccgaggctgctgctgctgcctccctggagccctttggtctagctggagaatgtgatgcaatggtggggatgatgggcgtaggagtcgccggaggcttcggggccggtccacccctggcacggcctccacgggaaaagccctttcgttgcggggagtgcggtaaggggttttctaggaacacctacctaacaaatcacctgcgattgcacaccggtgagagacccaatttatgtgccgattgtgggaagtctttctcttggagagccgatctcctgaagcaccgccgcttgcatactggggaaaaaccatacccatgtccagaatgtggcgaagcattctctctgagcagtcacctgctcagccaccgacgagcccatgcagccgccagtggggccggcgccgcagctctgcgcccgttcgcatgtggtgagtgtgggaagggcttcgtgcggcggtcccatcttgccaatcaccagcgaattcacaccggcgagaaaccccacggctgcggtgaatgcggtaagcgtttctcatggaggtccgatctagttaagcatcagagagttcacaccggcgaaaagccgtacatgtgctcagagtgtggggaaacatttagcgtgagctcccacttgttcacacataaacgtacacatagtggcgagaggccttatgtctgccgggaatgcggtaaaggtttcggtaggaattcacatctggtgaatcatctaagggtccacaccggtgaaaaaccctttcgctgcggacaatgtgagaaacgattcagcgatttcagcactttgactcagcaccagcgaacccacacaggcgagaagccttatacttgcatcgaatgcgggaaaagctttatccagtcaagtcatttaatccgccaccgtaggatccacacaggtaataagccacacaaatgcgctggctgtgggaaaggatttcgttataagactcacctcgcccagcaccaaaagctgcatctgtgctag

SEQ ID NO: 22070 - DNA, 1929 bp, Artificial Sequence
  Description of Artificial Sequence: Synthetic coding sequence
atggaggaggagcggaagaccgccgagctgcagaagaaccggatccaggatagtgtagtcttcgaggatgttgcagttgacttcacacaggaggagtgggccctgctcgatctcgctcaacgaaacttgtatcgggacgttatgctcgaaaactttcagaacctggccagcctgggctaccctctccacacaccacacctcattagccaatgggagcaggaagaagacctgcaaaccgtgaaacgggaactgattcaaggcatctttatgggcgagcatagggagggctttgagacacagctaaaaaccaatgaatcggtggcaagtcaggacatatgcggagagaagatcagcaatgagcagaaaatcgtgcgctttaagaggaatgattcttggttctctagtctacatgagaatcaagagagttgcggcattgactaccagaacaagtcccatgagcgtcaccttcggaaccacatggtcgagaacatctatgagtgctacgaagaaaaccaagatgggcagacattctctcaggtccccaacctagattctctgaagaggaataccgaggtcaaaagctgcgagtgccacgaatgcggcaaggcattcgtggatcactccagcctgaaatcccacattagatcacacaccggatctaagccctatcagtgcaaggagtgcggcaaagcgtttcacttcctagcgtgctttaagaagcacatgaagacacctactgaagagaagccatacgagtgtaaggagtgcactaaggccttctcgtgctcctctttcttcagagcacacatgaagatccacattggaaaaacaaactacgagtgcaaggaatgcggaaagggattcagttgcagctccagcctcaccgagcataagaggatccactcaggtgacaagccctatgagtgcaaagagtgcggcaaggcttttagctgctcgagcagcttatctaaacataaaaggatccactcaggtgacaaaccttacgagtgcaaagaatgcgggaaagcattcagttcttcaagccacctgattatccatattagaatccacacaggagagaagccctatgagtgcaaggaatgcggtaaagcgttttcagaaagttccaagctgacagtgcacgggcgcacacacaccggagaaaaaccttacaagtgcaaagagtgtggtaaggcttacaattgcccttccagcctcagtatacacatgcggaaacatactggcgaaaagccatatgaatgcctcgagtgtggaaaagccttctacctgcctacctctcttaatacacatgtcaagaaccaatcccgcgagaagccctacgagtgcaaggaatgcggcaaggccttctcctgtccttcctcctttagggcccatgttagagaccacacgggtaaaattcagtatgaatgcaaggaatgtggcaagacattttctcgttcttcttccctcactgaacatcttaggacacattccggagaaaagccatacgagtgcaaagaatgtgggaaggcttttatctcaagctctcacctcaccgtgcacattcgcactcacacaggggaaaaaccctacgagtgcaagaagtgtggcaaagcatttatttatccgagcgctctgaggattcacatgaggacacataccggtgaaaagccctacgaatgtaaagaatgtggaaaagccttcaggcattcttcttatcttaccgttcatgcaaggatgcatacgggcgaaaaaccgtttgagtgcctggagtgtggcaaggcattctcttgtccatctagcttccgtagacatgtgcgctcacataccggagaaaaaccctacgagtgtaaggaatgcggtaaagcattcgtgtgccccgcctatttccggagacacgtcaagactcatactagagaaaatatctag

SEQ ID NO: 22071 - DNA, 2229 bp, Artificial Sequence
  Description of Artificial Sequence: Synthetic coding sequence
atgccctgctgcagccaccggagctgccgggaggaccccggcacctctgagtcccgcgagatggatcccgtggcttttgaagacgtcgctgttaatttcacacaggaagaatggactctgttggacatctcccaaaagaacttgttcagggaggtgatgctggagacttttcgcaaccttacaagtatcgggaagaagtggagcgatcaaaacattgaatatgagtaccagaacccccggcggtcttttagaagccttatcgaggaaaaagtcaatgaaataaaagaggactcccactgtggtgaaacattcacccaggtacccgacgaccggctcaatttccaggaaaagaaggcgtctccagaggttaagagctgcgactcctttgtgtgcgccgaggtcggcattggaaactcctcatttaatatgagtatcaggggagacacagggcacaaagcctatgagtatcaagaatacggaccgaaaccatataaatgccaacagcctaagaataagaaagcctttaggtaccggcccagtattcggacccaggagagggaccacaccggagaaaagccatatgcctgtaaggtctgcggtaaaacgtttatattccacagctcgatcaggcgtcacatggtcatgcactcgggggacggtacctacaagtgtaagttctgtgggaaggcattccactcctttagcctttacctcattcatgaaaggactcacaccggtgaaaaaccgtatgaatgtaaacaatgcgggaaaagttttacatattccgcaacactgcagatccatgagagaacacacactggcgagaaaccctacgaatgctctaaatgtgacaaggcgtttcactcgagttcctcatatcatcgccatgagaggtcccacatgggcgaaaaaccctatcagtgtaaggaatgtgggaaggcgtttgcttacacctcatccctacgaagacacgaaagaactcattctggaaaaaagccatatgaatgcaaacagtatggtgaaggtctcagttatctgataagctttcagacacacattcgtatgaactccggtgaaaggccatataagtgcaagatatgcggtaagggattttactccgccaaaagttttcagacacacgagaagacccacactggggaaaaacggtacaagtgtaagcaatgtggaaaggcctttaacctgtcaagtagttttcgataccacgagcggatccatacgggcgagaagccatacgaatgcaaacagtgcgggaaggccttccggagtgccagccagctgagggtgcatggcggcacccacaccggagagaagccctatgagtgcaaagaatgtggaaaggccttccggtctacatcccacctccgtgtgcatggtcgcacgcatacaggtgagaaaccctacgaatgcaaggagtgtggcaaggctttcaggtacgttaaacatctccagattcatgagaggacggagaagcacatcaggatgccgtcaggagagcggccttataagtgctctatttgtgaaaagggtttttattccgccaagagctttcaaacacacgaaaaaacccacactggggagaaaccatatgagtgcaatcagtgtggaaaagccttcaggtgttgcaactcactcagataccatgagcgaactcatacaggtgaaaagccatatgaatgcaaacagtgcgggaaggcattccggtccgccagtcatcttcgcatgcatgaacggactcatactggagagaaaccttacgaatgtaaacagtgtggaaaggcattcagctgcgcttctaacctgagaaaacatggtagaacgcacacaggggagaaaccttacgaatgcaaacaatgcggtaaggcgttccgttccgcctccaatttacagatgcatgaacgcacccataccggggaaaaaccatacgaatgtaaggagtgcgagaaggccttctgtaagttctcatcatttcagattcacgagcgcaagcaccgtggagagaagccctatgaatgcaagcattgcggaaatggtttcacgagtgccaaaatcctacaaatccacgctcgcacccacatcggcgagaagcactatgaatgcaaggagtgtggcaaagctttcaactacttttccagtctgcacattcacgctaggacccatatgggggaaaaaccctacgagtgtaaagactgtgggaaagcatttagttag

SEQ ID NO: 22072 - DNA, 1596 bp, Artificial Sequence
  Description of Artificial Sequence: Synthetic coding sequence
atgggcttcctgcacgtgggccaggacggcctggagctgcccacctcgggcgacccacctgcctcggcatcacagtctgcggggattacgggcgtatcacatcgcacccagccaccttgtttcgaaggtctgacgtccaaggatttagtgcgtgaggaaaaaacccgtaaaaggaagcgaaaggccaaagagagcgggatggccctgctacaggggctcttgaccttccgcgatgtagccattgagtttagtcaggaggagtggaagtgcctagaccctgcacagaggactctgtacagggacgtcatgctcgagaattatcgaaacctggtgagtctagacaccagcagcaagtgcatgatgaagatgttcagtagcaccggtcaaggtaacacagaagtggttcatacaggtaccctccagatccacgcttcacatcatatcggggacacctgctttcaggagatagaaaaagatatacacgactttgtgttccagtggcaggagaatgagactaacggacacgaggctttgatgaccaaaaccaaaaagctgatgagctctactgagagacatgatcagaggcatgccgggaataaacctataaaaaacgagctgggcagctcgtttcactcacatctgcccgaggtgcacatcttccacccagagggtaaaatcggcaatcaagtcgagaaagctattaatgacgccttcagcgtttccgcctcccagagaatctcttgtagacctaagacccgcatatcaaataaataccggaataatttccttcagtcttccctacttacccagaagagagaggtgcatactcgggagaaatcttttcagaggaacgagagcggaaaggcctttaatggtagttcgctactcaagaaacatcagatcatacatctgggagacaagcagtataagtgtgacgtgtgtggtaaagactttcatcagaagagatacctggcctgccacagatgtcatacaggagagaacccctatacctgcaatgaatgtggcaagactttcagtcataatagcgctctgctggtgcataaggcaattcacaccggagagaagccatacaaatgtaatgagtgcgggaaagtattcaatcagcaatcgaacctggctcgtcatcatcgggtccatactggggagaagccctataaatgtgaggagtgtgacaaagtcttttcacgaaagtctcatctcgagcgacaccggcggatacacactggggaaaaaccctacaagtgtaaggtttgcgacaaggctttccggagagactcacacttagcccagcacacagtgattcacacaggggagaagccttacaagtgcaatgagtgcggtaaaacttttgtgcagaacagttcccttgtcatgcacaaagtaatccacacgggagagaaacggtacaaatgtaatgagtgcgggaaggtgttcaaccataaaagtaatctcgcatgtcaccgtcgcctgcacactggtgagaaaccttataagtgtaatgagtgtggtaaggttttcaaccgaaaatcaaacctggaaaggcaccacaggcttcacacaggtaaaaagagctag

SEQ ID NO: 22073 - DNA, 1398 bp, Artificial Sequence
  Description of Artificial Sequence: Synthetic coding sequence
atggccctgctgcagggcctgctgaccttccgggacgtggccatcgagttcagccaggaagaatggaagtgccttgaccctgctcagcgcaccctctacagagatgtcatgttggagaactacaggaatctcgtgagcttagatacttctagcaagtgcatgatgaagatgttttcctctactggtcaggggaacacagaggtggtgcataccggaacgctgcagatacatgcctctcatcacatcggagacacctgctttcaggagatagagaaagatatccatgactttgtgttccagtggcaggaaaatgagactaacgggcacgaggccctgatgacaaagactaagaaactgatgtccagcacagagagacatgaccaacgccacgccggcaacaagcctattaagaacgagctcggttcctcttttcactcacatcttcccgaagtgcatattttccatcctgaaggtaagatcgggaaccaggtagaaaaagctatcaatgacgctttcagcgtgtctgcgtcacagcgaatcagctgtcgccctaagactcgaatcagcaataaataccgtaacaattttctccaaagttctctcctgacccaaaaaagagaggtgcatactcgcgaaaagagcttccaaagaaatgagtctggcaaggcttttaatggctcgtccctgcttaagaagcaccagattattcacttgggagataaacaatacaaatgcgatgtgtgtggaaaggacttccatcaaaaacgctacctggcgtgtcaccggtgccacacgggcgagaacccgtatacctgcaacgagtgtggaaagaccttctcgcacaacagcgccctcctcgtgcataaagctattcacacaggcgaaaagccatataagtgtaacgaatgtgggaaggtcttcaatcagcagagcaacctagcgcgccaccatcgggtgcacacaggagagaaaccctacaagtgcgaggagtgcgacaaagtgttctcccggaaatcccacctagaacgacacagaaggatacacactggtgaaaagccatacaaatgtaaagtttgcgacaaagcatttcggagagacagtcatctcgcccagcatactgtgatccacaccggagagaaaccttacaaatgcaacgaatgtggcaagacatttgtccagaactccagcctggtcatgcataaggtgatacacactggggagaaacggtataagtgtaatgaatgcggaaaggtgttcaatcacaagtctaacctcgcatgccaccgacgccttcacacaggggagaagccttacaagtgcaatgaatgcggcaaagtatttaaccgcaagtctaacttagagagacaccaccgcctgcataccggcaagaaatcctag

SEQ ID NO: 22074 - DNA, 1596 bp, Artificial Sequence
  Description of Artificial Sequence: Synthetic coding sequence
atgggcttcctgcacgtgggccaggacggcctggagctgcccacctccggcgacccccctgcttcagcgtcgcagtctgcggggattacaggagtctcgcatagaacgcagcctccgtgctttgaggggctgaccagcaaagatctggttagagaagagaaaaccagaaagcggaaaaggaaggcaaaagagagtggcatggcgctcttacagggtctcttgacctttagggacgtggctatcgagttcagtcaggaggagtggaagtgcctggaccctgctcagagaacgctgtacagagatgtgatgctggagaactatcgaaacttagtgtccttagatacgagctctaaatgcatgatgaaaatgttcagttctaccggccagggtaatactgaagtcgtacacaccggaacactccagattcacgcctcacaccacatcggtgacacttgctttcaggagattgagaaggacatacacgactttgtttttcagtggcaggaaaatgagacaaacggtcatgaggccctaatgaccaagaccaagaaactgatgagctctaccgaacgccatgatcagcgccatgccggcaataagcccataaagaatgagctggggtccagctttcacagccatctgcccgaagttcatatcttccaccctgaagggaaaattggtaaccaggttgagaaagcaattaatgatgcttttagtgttagcgcctcccagcgcatctcttgtagacctaagacacgcatatctaataagtacagaaacaattttctgcagtccagtctactgacccagaaacgcgaagtacataccagagagaaatcgtttcagcgcaatgagagcggcaaggccttcaacggctctagtctgctcaagaaacatcagataatccacctaggcgataaacagtataaatgcgatgtctgcggcaaagacttccaccagaaacggtacctggcctgtcaccgatgccatactggcgaaaatccatatacctgcaacgaatgtggaaagaccttcagtcacaattccgctcttcttgtgcacaaagccatccacacaggcgaaaaaccctataagtgtaacgaatgtggcaaggttttcaaccagcaatcaaacttggctaggcaccatcgcgtccatacgggcgagaagccatacaagtgcgaggagtgtgataaggtgttctctagaaaaagtcacctagaacgtcaccggcgcattcataccggtgagaagccatacaagtgtaaggtctgtgacaaggcttttcgccgtgattcgcacctagcacagcatacggttatccatactggggaaaaaccctacaagtgcaatgagtgtggtaaaacctttgttcagaattcctctttggtcatgcacaaagtgatccacacaggtgaaaaacgatataagtgtaacgagtgcgggaaagtcttcaaccacaagagcaaccttgcctgccaccgtcgtctgcacacaggggagaaaccctataagtgtaatgagtgtggcaaggtctttaatagaaaatcgaacctggaaaggcaccatcggttgcataccggtaaaaaatcttag

SEQ ID NO: 22075 - DNA, 903 bp, Artificial Sequence
  Description of Artificial Sequence: Synthetic coding sequence
atgcacagcctgaagaaggtgaccttcgaggacgtggccatcgactttacacaggaggaatgggcaatgatggataccagcaagcgtaagttatacagggacgtgatgctcgagaacatatctcacctggtcagcctgggctatcaaatctcaaaatcctacattatactccaactggagcagggcaaggaactgtggagggagggacgagaatttctccaagaccagaatcccgaccgagaaagcgcactcaagaagaaacatatgatctcaatgcatcccattactagaaaagatgcgtctacaagcatgacaatggagaactctttgattcttgaggatccttttgagtgtaatgacagcggagaggattgtacacactcaagcactatcactcagcgactgttgactcattcagggaaaaagccctacgtgagcaaacagtgcgggaaatctctgcggaacctgttctccccaaaacctcataagcagatccatactaaaggaaaatcctaccagtgtaacctctgtgaaaaggcctatacaaactgtttcagattgcggagacacaagatgacccacacgggggagcgcccctatgcctgccacctgtgcggcaaggcattcacgcaatgctcgcacctcaggagacacgagaagactcataccggcgagcggccgtataaatgccatcagtgtggaaaggccttcattcagtcatttaacttaagacgacatgaaagaacccatctcgggaagaaatgctacgagtgtgacaagtctggcaaagccttttcacaatccagcggcttcagaggcaacaagatcatacacaccggtgagaaacctcacgcttgcctcctgtgcgggaaggccttcagcctgagttcagatctgagatag

SEQ ID NO: 22076 - DNA, 624 bp, Artificial Sequence
  Description of Artificial Sequence: Synthetic coding sequence
atgcacagcctgaagaaggtgaccttcgaggacgtggccatcgacttcactcaagaagaatgggctatgatggatacctcaaagaggaagctgtatcgggacgtgatgctcgagaatatttcccacctagtgagcctgggctaccaaattagtaagagttacattattctccagctagagcagggcaaggagctatggcgggaaggaagagaatttctgcaagatcagaaccctgatagagagtcggctctaaagaaaaaacatatgattagcatgcaccctatcactagaaaggatgcatcgacttctatgactatggagaactcactcatcctggaggatccgttcgagtgtaatgatagcggcgaggactgtactcactcgtccaccattactcagcgcttgttaacccacagcggtaagaagccctacgtttccaaacagtgtggcaaatctctaaggaatctctttagccccaaaccacacaaacagattcacacgaaaggaaaaagctaccagtgtaacttgtgcgaaaaagcatacactaactgctttaggctgaggcgccacaaaatgactcacacaggtgaaagaccttacgcctgtcatctctgcggaaaatag

SEQ ID NO: 22077 - DNA, 234 bp, Artificial Sequence
  Description of Artificial Sequence: Synthetic coding sequence
atgcacagcctgaagaaggtgaccttcgaggacgtggccatcgactttacccaggaagaatgggcaatgatggatacaagtaagagaaagttgtatcgagacgtgatgctcgaaaatattagccacctggtttccctagggtatcaaatctctaaatcatatatcattctgcagttagagcaagggaaagagctgtggcgggagggccgcgagttcttacaagaccagaactag

SEQ ID NO: 22078 - DNA, 903 bp, Artificial Sequence
  Description of Artificial Sequence: Synthetic coding sequence
atgcacagcctggagaaggtgaccttcgaggacgtggccatcgactttacgcaggaagagtgggatatgatggacactagcaagagaaaactgtacagagacgtgatgttggagaatatctctcatctcgtcagccttggataccagatcagcaagagctacatcattctgcaactggagcaggggaaggaactgtggcgtgagggtcgtgtatttctccaggaccagaatccagatagagaaagcgctctgaaaaagaagcacatgatttctatgcatccgattatccggaaggatgcttcaactagcatgacaatggagaattctctcatcctggaagatcctttcgaatataacgacagcggcgaggattgcactcattcttcaacgatcacccagtgcctgttgactcacagtggaaagaaaccatgcgtctcaaagcagtgcggaaaatccttacgcaatcttctgagcccaaaacccagaaaacagatccacaccaaaggcaagtcctaccagtgtaacctctgtgagaaagcatataccaactgtttctatctgcggagacataagatgactcacacaggcgagcgcccctatgcttgccacctttgcggaaaggcattcactcagtgttcgcacctgcgtcggcacgagaaaacacacacaggtgagaggccctataagtgtcaccagtgtgggaaagctttcatacagtccttcaacctgcgccggcatgaacggacacacctcggacagaagtgctatgaatgcgacaaatctggcaaagctttcagccagagcagcgggttccggggtaataaaatcatacatattggagagaaacctcacgcctgcctattgtgtggcaaggctttttctctgagctcagacctcaggtag

SEQ ID NO: 22079 - DNA, 1116 bp, Artificial Sequence
  Description of Artificial Sequence: Synthetic coding sequence
atggacatggcccaggagcccgtgaccttccgggacgtggccatctattttagtcgtgaggaatgggcttgtcttgaaccttcccagcgggcgctctatagggacgtgatgcttgacaacttttcatcagtagccgccctgggcttttgtagccctaggccggacctggtcagcagactggagcagtgggaagaaccttgggtggaggacagagagagacctgaattccaagccgtgcagagaggccctagacccggagccagaaaaagcgccgaccccaaacgcccttgtgatcacccagcttgggcccacaagaagacacacgtgcggcgcgagagagccagagaaggcagctcattccggaaagggttccggcttgacaccgacgatgggcagttaccccgcgccgcacccgagaggacagatgctaagcccacagccttcccctgtcaagttctgacgcagaggtgcggccggagacctgggagaagggaacgtagaaagcaacgggctgtcgagttgtcctttatttgtggcacttgtgggaaggctttgtcctgccatagtcggctgctggcccaccagaccgtccacacgggaaccaaagcctttgaatgccccgagtgtggtcagacatttagatgggcgtctaacctgcagcgccatcaaaagaaccacacccgtgagaagcccttttgttgcgaggcatgcggacaggccttcagtcttaaggacagactcgctcaacatagaaaggttcatacagagcaccggccatactcttgcggagactgcggaaaggccttcaaacaaaaatctaatctgttgaggcaccaactggtccacacgggcgagcgtccattctattgcgccgattgcggaaaggcttttcggacaaaagagaacctgtctcatcatcagagggtccacagcggtgagaaaccctacacatgcgctgagtgcggtaagtccttccgatggcccaaaggattctctatacacaggcggctgcatctaacaaagcgtttttatgaatgtggacattgcggcaagggattcagacacctgggattttttacgcgtcatcagaggactcatcgacacggcgaggtgtag

SEQ ID NO: 22080 - DNA, 1116 bp, Artificial Sequence
  Description of Artificial Sequence: Synthetic coding sequence
atggacatggcccaggagcccgtgaccttccgggacgtggccatctacttcagcagggaggaatgggcttgcctcgagccttcacagagggcactttaccgggacgtcatgctcgacaacttttcatctgttgccgctttgggattctgcagtcctaggccagatttggtttccaggttggaacagtgggaggagccctgggtcgaggatagagagaggcctgaattccaggctgtccagcgaggtccccggccaggagcaagaaagtccgccgatcccaaacggccctgtgaccaccctgcatgggcccataagaaaacacatgtgagacgcgagcgcgctcgtgaggggagtagcttccggaaaggcttccggctggatacagatgacgggcagctgccgagagccgcccccgagcgaaccgatgctaagcccaccgcatttccatgccaagtcctgacgcagcgctgtggaaggcggcccggaagaagagagcgcagaaagcagcgagcggttgagctgtcttttatttgcggaacttgcgggaaggctttgagctgccactccagattactggcccaccagacagtgcacaccggtacgaaggctttcgagtgcccagagtgcgggcagacttttaggtgggcaagcaacctccagagacaccagaagaatcacactagagaaaagcccttttgttgcgaagcctgtggacaggctttttctctcaaagaccggctggcgcaacaccgaaaggtgcacacggagcacaggccctactcctgtggtgactgtggaaaagcattcaagcagaaaagcaacttgctgaggcatcagctagtacacacaggggaacggcccttctattgtgctgattgcggaaaagcattccgaacaaaggagaacctgagccaccaccagagggtccattccggggaaaagccttacacatgtgccgaatgtgggaagagctttcgctggccgaagggtttttctatccatcggcggctacatctgacaaagcgcttttacgaatgcggtcattgcggcaagggatttcggcatctcggcttctttacccgtcaccagaggacacatcgacacggagaagtttag

SEQ ID NO: 22081 - DNA, 1116 bp, Artificial Sequence
  Description of Artificial Sequence: Synthetic coding sequence
atggacatggcccaggagcccgtgaccttccgggacgtggccatctacttttccagggaagagtgggcttgccttgaacccagtcaacgggccttataccgtgacgtgatgctcgacaactttagcagcgttgcagcactgggcttctgtagcccccgacccgacctggtttccaggctggaacagtgggaagagccctgggtggaagacagagagagaccagagtttcaggctgtgcagagaggtcctcgccccggtgcccggaaatcagccgatcctaagaggccctgcgatcaccctgcttgggcccacaaaaaaactcacgtacgaagggaaagggctagggaaggaagcagtttccgcaagggctttcgtcttgatacagatgatggccaactccctcgggccgcacccgagcggacagatgctaaacccaccgcattcccatgccaagtcttaactcagagatgcggccggcgtccaggacggcgggagcgcaggaaacagcgcgcagtggaactttcctttatctgcggtacatgtggaaaggcgttgtcatgccattcgcgacttttggctcatcagacagtgcacacagggacaaaggcgtttgaatgtccagaatgtggtcagacttttagatgggcttccaatctgcagagacatcagaaaaatcacacacgagagaagccattttgctgtgaagcatgtggccaggctttctccctcaaggaccgcctggcccagcaccggaaagtgcatactgagcaccggccctatagttgcggagactgcggcaaagccttcaagcagaagtcgaatctgctccggcaccagttagtacacaccggcgaaagacccttttactgcgccgactgtggtaaagccttccgcactaaagaaaatttatcccatcatcagcgggtgcattcaggggaaaagccctatacctgtgccgaatgcggcaaatccttccgatggcctaaaggtttttccattcatcggaggctccatttaacaaaacgcttctatgaatgtggtcactgtgggaagggtttccggcacttaggtttctttactaggcaccaacgaactcatagacacggggaggtgtag

SEQ ID NO: 22082 - DNA, 144 bp, Artificial Sequence
  Description of Artificial Sequence: Synthetic coding sequence
atggacatggcccaggagcccgtgaccttccgggacgtggccatctattttagtcgcgaagagtgggcgtgtctggagccatcgcaacgtgcactgtatcgagatgtcatgcttgacaatttttcttccgttgctgctctgtag

SEQ ID NO: 22083 - DNA, 240 bp, Artificial Sequence
  Description of Artificial Sequence: Synthetic coding sequence
atggacatggcccaggagcccgtgaccttccgggacgtggccatctacttctctcgggaggaatgggcatgcttggagccatcacaacgagctctctatcgggacgtcatgcttgacaatttttccagcgtggcagcgctgggcttctgctcgcctagacctgacctggtgtccagacttgagcagtgggaggaaccctgggtcgaagatcgcgaacgacccgagtttcaggctgtgtag

SEQ ID NO: 22084 - DNA, 1116 bp, Artificial Sequence
  Description of Artificial Sequence: Synthetic coding sequence
atggacatggcccaggagcccgtgaccttccgggacgtggccatctacttcagcagagaggagtgggcttgtctggaaccttcacagcgtgcactttaccgcgatgtgatgctagacaatttcagcagcgttgctgccctcgggttctgctcgccacgacccgatctggtttcccgccttgagcagtgggaggagccctgggtggaggaccgcgagcgcccagaatttcaagcggtacagcggggaccccgaccgggagcccgaaagagcgcggacccaaaacgaccttgtgaccatcccgcctgggcccacaaaaagacgcacgtgaggcgggagcgcgccagagagggttcgtcttttcgtaaggggtttcgattggacacagatgacggccaactccctcgtgccgcccctgagcggaccgatgcgaagccaaccgcatttccttgccaggtcctgacccaaagatgtggaagacgcccaggacgtcgggaacgccgtaaacagcgggccgttgagctctcttttatttgcggtacctgcggtaaagccctgtcctgtcacagtcgtctcctggcccaccaaactgtccacaccggaacgaaggccttcgagtgccccgaatgcggccagacattcagatgggcttcaaacctccagcggcaccagaaaaaccacacacgcgaaaagcctttctgttgcgaagcatgtgggcaggctttctccctgaaggataggctggcccagcatagaaaggtgcataccgagcatagaccctactcgtgtggggattgcgggaaggcattcaagcagaagtcaaacctgttgagacatcagctggtacacactggcgagaggcctttttattgcgcggattgcggtaaggcctttagaaccaaagagaatctgagccaccaccagcgggtacactctggagagaagccgtatacgtgcgccgaatgcggcaagtcatttcgatggcctaaggggtttagcatccaccggaggttgcacctgaccaagcgcttctacgaatgtggccactgcgggaagggatttagacacctgggatttttcacccggcatcagcgcacacacaggcacggcgaggtctag

SEQ ID NO: 22085 - DNA, 1116 bp, Artificial Sequence
  Description of Artificial Sequence: Synthetic coding sequence
atggacatggcccaggagcccgtgaccttccgggacgtggccatctacttctcccgtgaggagtgggcctgcctggaaccttcacagcgagccctgtatagagacgttatgttagataacttctcaagcgtggccgctctgggtttttgtagcccacgcccggatctggttagtaggctcgagcagtgggaggagccttgggtcgaggatcgtgagaggccagaattccaagccgtgcaacgcggtcccagacctggagcgagaaagagcgcagaccctaaacgtccttgtgatcaccccgcatgggcccacaagaaaacccatgttcgcagggagcgcgcacgagaaggatcttccttccgtaagggcttcaggttggataccgatgatgggcagctcccacgcgcagctcccgaacgcactgatgctaaaccaaccgcatttccgtgccaggtcctgacccagcggtgcggccggcgcccaggcagacgcgagcgtcggaaacagcgagccgtggagctttcgtttatctgtggaacctgtggcaaggcgttgtcctgccatagcaggctactggctcaccagacagtgcacacaggcactaaggctttcgagtgtccagagtgtggtcagaccttcagatgggcctcaaacttgcaacgccaccagaagaaccacacacgtgaaaagccgttctgctgcgaagcctgtggacaagccttctctctgaaggaccgcctcgcccagcatcgcaaagtacatacagagcatcggccatactcctgtggcgattgcggtaaggctttcaagcagaagtcgaatctcctgaggcaccagttggttcacaccggtgagaggccattctattgcgcagactgcgggaaagcgttccgaactaaggagaaccttagccaccaccagagagtccattctggtgaaaagccctatacatgtgccgagtgcggaaagagttttaggtggccaaaagggttctcaattcaccgcagactgcacctaactaaacgattttacgagtgtggtcactgcggaaagggttttcgccatttgggatttttcactcgccatcagaggactcatagacacggagaagtctag

SEQ ID NO: 22086 - DNA, 426 bp, Artificial Sequence
  Description of Artificial Sequence: Synthetic coding sequence
atggacatggcccaggagcccgtgaccttccgggacgtggccatctactttagtagggaagaatgggcttgcctcgaacctagccaaagagccctttacagggatgttatgctggataacttcagctcagtcgccgccctcggcttctgtagtcctaggcccgacctggtgagcagactggaacaatgggaggaaccttgggttgaagacagggaacgacctgaattccaggccgtgcagcgtggaccgcggccgggggccaggaaaagcgccgatccgaagcgcccctgcgaccacccagcatgggcccacaaaaagacccacgtgaggagagagagggcccgagagggcagcagcttccgcaaaggcttcaggttagatacagatgatggtcagctgccgagggcagctccagaaaggacttag

SEQ ID NO: 22087 - DNA, 1692 bp, Artificial Sequence
  Description of Artificial Sequence: Synthetic coding sequence
atgggccccctgaccttcatggacgtggccatcgagttcagcctggaggagtggcaatgccttgacacagctcaacagaatttgtatcggaacgtgatgctggagaattacaggaatcttgtgttcctcggcattgccgtatctaacctcgatctgatcacttgcctcgagcaagggaaggaaccatggaatatgaagagacacgaaatggctgccaagccgcctgccatgtgcagccatttcgctaaagacctgaggccggagcagtacatcaagaactctttccaacaggtgatactgaggcgctacgggaaatgcggttaccagaaaggctgtaagtctgttgacgagcacaagctccacaaaggcggtcacaaggggctgaacagatgtgttaccactacccaatcgaaaattgtccagtgtgacaagtacgtcaaggtgtttcataaatattccaatgccaagcggcacaagatcaggcacacaggtaagaacccattcaaatgcaaggaatgcgggaaatctttttgtatgctttcacagttgacccaacatgagataattcatacaggcgagaagccctacaaatgcgaggaatgcggaaaggcattcaaaaaaagtagtaatcttacaaaccataagatcatccataccggagagaaaccttacaaatgcgaggagtgtggaaaagcttttaatcaaagcagcacactgaccagacataagataatacacaccggcgaaaaactgtataagtgtgaggagtgtggcaaagctttcaatagatccagtaacctgacaaaacataagattgtccacactggcgagaaaccttataaatgcgaagaatgtggaaaagcgtttaagcaaagcagcaatctgaccaaccataaaaaaatccataccggagagaagccatataagtgcggggagtgtgggaaggcgtttactctaagctctcatctcacaacgcacaagcggatacatacgggagagaagccttacaaatgcgaggagtgcggtaaagccttttcagtgttctctactctgactaaacacaagattattcatacagaagagaaaccttataagtgcgaagaatgtggcaaggctttcaatagatcctcacatttaaccaatcataaagtaatccacacgggcgagaagccctacaagtgtgaggagtgcggcaaggcattcacaaagtctagtacccttacctaccataaggtaatccacactggcaaaaaaccttataagtgtgaggagtgcggcaaagcctttagcatcttcagtatcttgaccaagcacaaggtgattcataccgaggacaagccctataagtgtgaggaatgcggcaaaacgttcaattattcttcaaacttcactaaccacaaaaaaatccatactggggagaagccatataaatgcgaggagtgcggaaagtcattcattctcagctcccatctgacgacacataagattatacacaccggcgaaaagccttacaagtgtaaagagtgcggcaaggcattcaaccagtcttccacattaatgaaacataaaatcattcatactggcgagaaaccttacaagtgcgaagagtgtggaaaggcctttaatcaaagtcccaatctcactaagcataagaggatacacacaaaggaaaagccgtacaagtgcaaatag

SEQ ID NO: 22088 - DNA, 1926 bp, Artificial Sequence
  Description of Artificial Sequence: Synthetic coding sequence
atggacagcgtggtgttcgaggacgtggccgtgaacttcacccaggaggaatgggctcttctgggcccgagccaaaaaaaactttatcgggacgtcatgcaggagaccttcgtcaatctagcctctattggcgagaattgggaggagaaaaacatagaagatcacaagaatcaagggcggaaactgagatcgcacatggtggagaggctgtgcgagagaaaagagggctcacagtttggagagacaatctcacaaacaccgaatcccaagcccaacaaaaaaacctttactcgcgtgaagccctatgagtgttcggtgtgtggtaaagactacatgtgccacagtagcctgaatcggcacatgcgctctcatacagagcaccggtcctacgaataccataagtatggagagaagtcctacgagtgtaaagagtgcggaaagaggttttccttcagatctagcttccggatccatgagcggacacatacaggcgaaaagccatacaaatgtaagcagtgtgggaaagcctttagctggccctctagcttccagattcatgagcgcacacacacgggcgaaaagccatatgagtgcaaggagtgtgggaaagcctttatttatcataccacctttaggggtcacatgagaatgcatactggcgaaaagccatataagtgtaaggagtgcgggaagactttctctcatcctagctcattcaggaaccatgagagaactcacagcggcgagaagccctacgaatgcaaacagtgtggcaaagcctttcgctactatcagaccttccaaatccacgagcggacccacaccggggagaagccatatcagtgcaagcagtgcggtaaggccctatcctgtcctacaagttttcgctctcatgaacgcatccatacaggcgaaaagccatataaatgtaaaaagtgtggcaaagccttctcctttccttcctccttcagaaaacacgaaaggatacataccggcgagaagccctacgactgcaaggagtgcggaaaggctttcatctccctgcccagctaccgcaggcacatgattatgcacacgggaaacggcccttataagtgtaaggaatgtggcaaggcatttgattgcccttcttctttccagatccatgaacgtacccacactggtgagaagccttacgagtgtaagcagtgcgggaaagccttttcgtgttcaagctcctttcggatgcatgagcggactcatacaggcgagaagcctcatgaatgtaagcagtgcggcaaagcattttcttgttcatctagtgtccgcatccacgagagaactcatacgggagagaaaccctacgagtgtaaacaatgtggtaaagctttctcctgctcatccagcttcagaatgcacgagcgtatccacacaggcgagaagccatatgagtgcaagcagtgtgggaaggccttcagcttttctagcagctttagaatgcatgaacggactcatacaggagaaaaaccatatgagtgtaagcaatgcggcaaagcttttagctgttccagctcttttcgcatgcatgaacggacacatacaggcgaaaaaccatacgaatgtaagcagtgtgggaaggcattcagctgctccagtagtatcagaattcacgaaagaactcatacgggggagaaaccctatgagtgtaagcagtgcggaaaggcatttagttgtagctcatccgtaagaatgcatgaaagaacccacacaggtgtgaagccgtacgagtgcaaacagtgcgacaaggccttttcctgttcccgatcttttcgaatacatgagcggacacacaccggggaaaaaccatatgcgtgccagcagtgcggcaaagctttcaagtgcagtcgctcgttcagaatacacgaacgagtccatagcggcgaatag

SEQ ID NO: 22089 - DNA, 1926 bp, Artificial Sequence
  Description of Artificial Sequence: Synthetic coding sequence
atggacagcgtggtgttcgaggacgtggccgtgaacttcacccaggaggagtgggccctgctcggacctagccagaaaaaactctatcgggacgtgatgcaggaaaccttcgtcaacctcgcgtcaattggagaaaattgggaggagaaaaacatcgaagatcacaagaatcaagggaggaaactgcgctcccatatggtcgaaagactctgtgagcggaaagaggggtcccagttcggtgagaccatctcccagactcccaaccccaagccgaataagaagacatttactcgggtgaagccctacgaatgtagcgtctgtggtaaggattacatgtgtcattccagcttaaaccgccacatgaggagccacactgaacacagatcatatgagtaccataagtacggtgagaagtcttacgagtgtaaagaatgtgggaagaggttcagctttcgcagcagtttccgcatccacgaacggactcataccggcgaaaaaccatataagtgtaagcagtgtggcaaggctttttcatggccgagttcatttcagattcatgagcgtacgcacacaggcgaaaaaccctatgagtgtaaggagtgtggaaaagcatttatttatcacacaacattcaggggacatatgcggatgcataccggcgaaaagccctataagtgcaaggagtgtggcaaaaccttttcccatccctctagtttcagaaaccatgagcgtacacatagtggggagaaaccatatgagtgtaagcagtgcggaaaggcgtttcggtactatcagacatttcagattcatgagaggacccacacgggcgagaagccttaccagtgcaagcagtgtgggaaggccttgagctgccccacctcctttcgctcccacgagagaatacacaccggtgagaagccctataagtgcaagaagtgcgggaaggcgttctcatttccgagctccttcagaaagcacgagaggatccataccggagagaagccttacgactgtaaagaatgtgggaaggcttttatttccctcccatcgtataggcggcatatgatcatgcacaccggcaacggcccctacaagtgtaaagaatgtggcaaagcctttgactgcccgtcatcctttcaaattcatgagcgcacccatactggggagaagccatacgagtgtaagcagtgtggaaaggcatttagctgcagcagttcgtttcggatgcatgagcgcactcacacgggcgaaaagcctcatgaatgtaaacagtgcggcaaggccttcagttgctcttcatccgtccggatccatgagaggacacatacaggtgagaagccctatgagtgtaaacagtgtggaaaagctttttcctgttcatcttcttttcgaatgcatgaacgcatccatacaggggagaaaccttatgagtgcaagcaatgtgggaaggcattctctttttcatcaagctttagaatgcacgagagaactcacacaggagagaagccctacgaatgtaagcagtgtggaaaagctttcagttgttcttcaagctttcgcatgcacgaacgcacgcatacaggggaaaaaccgtacgaatgcaagcaatgtggaaaagccttttcctgttcctctagcattcgcatccatgaacgtacacataccggcgagaagccttacgaatgcaaacagtgcggaaaggccttctcctgttcttcatcagtccgtatgcacgagcgtacccatacaggggtgaagccctacgaatgtaaacagtgtgataaagccttttcctgttcccgcagcttcagaatccatgagaggacccacaccggggagaaaccctatgcctgtcaacagtgcggaaaggctttcaagtgttcccgttccttccgcatccacgaacgagtgcatagtggggagtag

SEQ ID NO: 22090 - DNA, 1995 bp, Artificial Sequence
  Description of Artificial Sequence: Synthetic coding sequence
atggagggcttcatggacagcggcacccagaccgacgccgtggtggtcctctctctggcacaggctgctgtcctgggacttgtgtccgagaatgaactctttggcgccacgatttccgccgaagcattttatccagatctgggtcctgagctgagcggcgcagccatgggcgagccagaaccacctggtccggacgtgtaccagttggcttgtaatggcagagcactggaagagcctgccgaggaggaggtcttggaggtggaggccgcttgtgagaagcataccagacgcaaaacaaggcctccagtacgcctagtccctaaggtcaaatttgagaaggtagaagaagaggagcaggaggtatacgaagtcagcgtgcctggggacgacaaggatgccgggcccgcagaggcaccagcagaggccgctagtggtggatgcgacgcccttgtacagtcatctgcagtgaagatgatagacctatccgctttctccagaaaacctagaacactcagacacctcccgaggactcctcgcccagagctaaatgtggcgccttacgatccacacttccccgcccctgctagagacggatttcccgagccgtccatggcactccctggacccgaggccttgccaaccgaatgtggcttcgagccgccccatctagctcctctatccgatcccgaagctccgtctatggaaagcccagaaccagtcaaaccagaacagggttttgtctggcaggaggcttcagagtttgaggcagacacagccggcagtactgtggaaagacacaaaaaagcccagctggaccgcctagacatcaacgtgcagattgacgattcctatcttgtagaggctggcgatcgtcagaaacgctggcagtgccggatgtgtgagaagagttacacctcaaaatataatctcgtgacccatatactcggtcataatggcatcaagcctcattcttgtcctcactgttcaaagctctttaagcaaccaagccacctgcagactcatctcctaacccaccaggggacacgcccacacaaatgccaggtgtgtcacaaagcctttacacaaacctcccacctcaaaagacacatgctgctccacagcgaagtgaagccgtattcatgtcacttctgcggccggggatttgcatacccatcagaactgaaggcccatgaagtgaagcacgagtctggtcggtgccacgtgtgcgtagaatgcggactggatttctccacactcacccaactcaaaaggcatttagcttcccaccagggtccaaccttgtatcagtgtctggagtgtgataaatcctttcattatcgatcgcagttgcagaatcatatgctgaagcatcaaaacgttaggccatttgtttgcaccgagtgcgggatggaatttagccagattcatcatctgaaacaacacagcttgacgcataagggcgtgaaggagtttaaatgcgaagtgtgtggtcgggagtttactctccaagccaatatgaagaggcatatgttgattcacacctcggtgcgtccctaccagtgccacatttgctttaaaactttcgtccagaaacagacattaaaaacgcacatgattgtgcacagccctgtcaagccctttaaatgcaaggtctgcggcaagtctttcaacagaatgtacaacctgttgggacacatgcacctgcacgctggatccaaaccattcaagtgcccatactgttcttccaaattcaacctgaagggaaatttgtctcggcatatgaaggtcaagcacggtgtaatggacatcggcttagactctcaggatccgatgatggagctcaccggaaccgacccatccgagctggacggccaacaggaaatggaagacttcgaggagaacgcctattcttacgcttccgtagatagttccgcggaggcatcagtcctaactgagcaggctatgaaggaaatggcctattacaatgtcttgtag

SEQ ID NO: 22091 - DNA, 240 bp, Artificial Sequence
  Description of Artificial Sequence: Synthetic coding sequence
atggagggcttcatggacagcggcacccagaccgacgccgtggtggtgctgtccctcgcccaggctgcagtactaggactggtgtccgagaacgaattgttcggggcaactatcagcgctgaggcgttctaccccgacctcggcccagagttgtctggagcagccatgggtgagccggagccacctggtcccgatgtttaccaactggcatgtaatggcagggcactggaagagccatag

SEQ ID NO: 22092 - DNA, 1293 bp, Artificial Sequence
  Description of Artificial Sequence: Synthetic coding sequence
atggaggaggaggagatgaacgacggcagccagatggtgcggagccaagagtcactcaccttccaggacgtggccgttgatttcactcgtgaggagtgggaccagctctatccagcccaaaagaatctgtatagagacgtaatgttggagaattaccggaacttagtcgccctaggataccagctgtgtaaaccagaagtgatcgcacagctcgagctggaggaggagtgggtgattgaacgagactcactgctggatacacacccagacggagaaaaccgccccgagatcaagaaatcaactacttctcaaaatataagtgacgaaaatcagacgcatgagatgattatggagcgactcgctggcgatagcttttggtattctatcctgggcgggctgtgggactttgattaccatcccgagtttaatcaggagaaccacaagcgctatcttggccaagttaccctcacacacaagaagataactcaggagaggtcccttgaatgtaacaagttcgccgaaaattgcaaccttaatagcaacctcatgcagcaaaggattcctagcatcaaaattcctctgaactcggacactcaggggaatagcatcaagcataactctgatctcatttactatcaaggcaattacgtgcgcgaaacaccatatgaatacagcgaatgtggtaagatctttaaccagcatatcctgctgaccgatcacattcatactgcagaaaaaccgtcggagtgcggcaaagctttttctcatacctcatctctttcccagccgcagatgctgctgaccggcgaaaagccttacaagtgtgatgagtgtggcaagcgctttagccagcggatccatctgattcaacatcaaagaatccacaccggcgaaaaacccttcatctgcaacggttgtggcaaagcattcagacagcattcctcctttacccaacatctgcgtattcacaccggagaaaagccatataagtgcaatcagtgcggtaaggcgtttagcagaataacctctcttaccgaacatcacagactgcacacaggggagaaaccctatgagtgtgggttttgcggtaaggcattctcacagaggactcacctgaaccagcatgaacggactcacacaggagagaagccttacaaatgtaatgagtgtggaaaggcttttagtcagtctgcccatttaaatcagcacagaaagatccacaccagagaaaagctttgcgaatacaaatgcgagcaaaccgtgcgccacagccccagcttttctagcacctag

SEQ ID NO: 22093 - DNA, 2736 bp, Artificial Sequence
  Description of Artificial Sequence: Synthetic coding sequence
atgtgcagccacttcacccaggacttcctgcccgtgcagggcatcgaggattccttccacaagctgatcctcaggcggtatgaaaaatgcggccacgacaatctgcaattgaggaaaggttgcaagtcaatgaatgtgtgcaaggtacagaaaggagtatacaacggtatcaataagtgtctctcgaacacgcaatcaaaaatcttccagtgcaatgcgcgggtgaaggtgtttagcaaattcgccaacagcaacaaagacaagaccagacatacaggcgaaaaacattttaagtgcaacgaatgcgggaagtccttccagaaattttcagatctaacacagcacaagggtattcatgctggcgagaagccctacacctgcgaggagcggggaaaggactttggctggtacacggacctcaatcaacataagaaaatccacacgggagagaaaccttacaagtgcgaagaatgtggaaaggcattcaaccgtagcactaatctcactgcccacaaacgcatccacaacagggaaaaagcatacacaggtgaggatagagaccgcgccttcgggtggtccacaaacctgaatgagtataagaagatccatactggcgataaaccatataagtgcaaggaatgcggaaaagcattcatgcactcttctcatttgaataaacacgagaaaatccatactggggagaaaccttacaaatgtaaagagtgcggaaaagtgattagctcttcatcttcatttgcgaagcataagcgcattcacaccggagaaaaaccatttaagtgtctcgaatgtgggaaagcattcaatatctcaaccaccctaaccaagcatcgccgaattcataccggcgagaagccttatacctgcgaggtttgtgggaaggcattccgccagtccgccaatctctatgtccatcggagaatccatactggcgagaagccatatacttgtggcgaatgcggaaaaacgtttcgccagtccgccaatctgtacgttcacagacgaatacacaccggagagaagccatacaagtgcgaagattgtgggaaagccttcggtaggtacacagctctgaaccagcataagaaaattcacactggcgaaaaaccctacaaatgtgaggaatgcggcaaggcctttaactcttccactaacctcacggcccataaaaggatccacacgcgcgaaaagccatacacttgcgaagaccgggggcgggcctttgggctgtctacgaaccttaacgagtacaagaagatccacacgggagacaagccctataagtgtaaggagtgcggcaaggcctttatccacagcttacacctgaacaagcacgaaaagatccatacgggcaaaaagccttacaaatgcaagcagtgtggtaaggtcattacctcttctagctcctttgctaagcacaagcgcattcacacaggcgagaagccattcgagtgcctggaatgtggtaaggctttcacatccagtactacactaaccaagcaccgccgaatccatactggcgagaaaccctatacttgtgaagtatgtggcaaagcgttccggcagagcgcgatcctctacgtgcaccgacggatacacactggcgagaagccatacacttgtgaggagtgtggcaagactttccgccaatctgctaacctctatgtccaccgccgtattcacactggcgagaagccttacaagtgcgaagagtgcggcaaggcattcgggcgctatacagacctgaaccagcacaagaaaattcatacgggtgaaaagctttataagtgtgaggaatgtggtaaggatttcgtgtggtacacggacctcaaccagcagaaaaaaatctacaccggggagaaaccatataagtgcgaggaatgcgggaaagcattcgccccatctacagacctcaaccagcacaccaagatcctgacaggcgaacagtcctacaaatgcgaagaatgcgggaaggctttcggttggtctatcgctctgaaccagcacaaaaagattcacacgggagaaaaaccatataaatgtgaagagtgtggcaaggcttttagccgcagtcggaacctgacgacacaccgacgggttcacacacgggagaagccttataagtgcgaggataggggtcggtcttttggttggtccacaaacttgaatgagtacaaaaagattcatacgggcgataaactgtacaagtgcaaggagtgcggaaaggtgtttaagcaatcatcccatctcaacaggcatgagaagatccacaccgggaaaaaaccatacaagtgcaaggagtgcggcaaggtgataacttcttcatcatcctttgccaaacacaagaggatacacacgggcgagaagcccttcaaatgtctggaatgcggtaaggccttcacttcttccacaaccttgaccaaacacagaagaatacacacaggcgaaaagccctacacctgtgaagaatgcgggaaggccttcaggcagtccgccatcctgtatgttcataggcgtatccacacaggggaaaaaccctacacttgtggggagtgcggtaagaccttccgccaatctgctaacttatacgcccataaaaagatccacaccggcgagaaaccctacacttgtggggactgcgggaagactttccggcaatccgccaacctttacgcccacaaaaagatccacacaggggataaaacaatacaggtctag

SEQ ID NO: 22094 - DNA, 399 bp, Artificial Sequence
  Description of Artificial Sequence: Synthetic coding sequence
atggagcccctgaccttccgggacgtggccatcgagttcagccccgaagaatggaagtgcctcgatcccgcccagcagaatctctaccgcgacgtcatgctcgagaattaccgcaacttagtttcattggcaatgtgctcacattttacgcaagacttcttaccagtccagggcatcgaagacagctttcacaaactgatactgcgaagatacgaaaagttttcatcgctcatcagtagctgcagagtgatctctcatgggttatcaagagggaggaatcgcgcgacagaaaagaacgacttactcacaaccgaggagccagtggtcaagcacaggtttgatctacagtatcccgaagaaatgtggaggaataccgtggtgcagaaaggacgcaaatag

SEQ ID NO: 22095 - DNA, 2772 bp, Artificial Sequence
  Description of Artificial Sequence: Synthetic coding sequence
atgctggagaactaccggaacctggtgagcctggccatgtgcagccacttcactcaggactttctgcccgtgcagggaatcgaagatagctttcataagctgattctgagaagatacgagaagtgtggccatgacaacctccagttgcgcaaaggttgcaagagtatgaacgtgtgtaaggtgcagaagggcgtgtataacggcattaacaaatgtctgtccaatacacagtccaagatcttccaatgtaacgcccgagttaaggtattctcaaagtttgcaaactccaataaggacaagacccgtcacaccggggaaaaacattttaaatgcaacgagtgtgggaaaagctttcagaagttttcagacttgacgcaacacaaaggaatccacgctggggaaaagccctacacatgcgaggagaggggcaaggactttggctggtatactgatctgaaccaacataagaagattcataccggggagaagccatataaatgcgaagaatgtggaaaggccttcaacaggagtacgaacctcacggcccacaaacgcatccataaccgtgagaaggcctatacaggcgaagatcgggaccgggcctttggatggagcaccaacctgaacgagtacaagaagatccacacaggagacaagccctacaagtgtaaggagtgcggaaaagcctttatgcacagcagccatcttaacaagcacgagaagatacacaccggagaaaaaccttacaagtgcaaggaatgcgggaaggtaatcagtagtagctcctcttttgccaagcacaagcgcattcacacaggggaaaagcctttcaaatgtctggagtgcggtaaagcatttaacatttcgactaccttaaccaaacaccggcgaatccataccggagagaagccttacacatgcgaggtgtgtggaaaagcgttcagacaatctgccaacctttacgtgcacaggcgcatacacacaggcgaaaagccatacacatgcggggaatgtggcaagacattccggcagagtgccaatctgtacgtgcaccgcagaattcataccggagagaaaccatataaatgtgaggactgcggcaaggcctttggacgctacaccgcacttaatcagcataagaaaattcacaccggagagaagccttataaatgtgaggaatgtggaaaagccttcaacagtagcacaaacctaaccgctcataaaaggatacacaccagagaaaagccctacacctgcgaagaccggggacgcgccttcgggttaagcacaaatctcaatgagtacaagaagattcacaccggcgataagccttataaatgcaaggaatgcggtaaagctttcattcactccctccacctcaacaaacatgaaaaaatccacaccggcaagaagccgtacaagtgtaagcagtgcggcaaagtcataacgtccagttcatcattcgccaagcacaagcggatccacacaggcgagaaaccgttcgaatgtctcgagtgtggcaaagctttcaccagctccacaacactgactaagcacaggcggatccacacgggtgagaagccttacacctgtgaagtatgcgggaaggctttcaggcagtccgcgattctctatgttcatagacgaatccacactggcgagaaaccctacacctgcgaagaatgtgggaagacatttaggcagagcgcgaacctctatgttcatcggaggatccacacaggcgagaagccctacaagtgcgaggagtgtgggaaagctttcggcagatataccgatctgaaccagcacaagaagattcacaccggcgagaaattatataagtgtgaggagtgcggaaaagattttgtgtggtacacagaccttaaccagcaaaaaaaaatatataccggcgagaaaccatacaagtgtgaggagtgcggtaaggctttcgcacccagcaccgacctgaatcaacacactaagattctcacaggcgagcagtcatacaagtgcgaagaatgcggcaaagcattcgggtggagtattgcccttaaccagcacaagaaaattcatactggagagaagccatacaaatgcgaggagtgcggcaaggcatttagccggagtaggaacctaactactcataggagagtgcatacccgcgagaaaccttacaaatgtgaagaccggggccgcagtttcgggtggagtaccaacctaaacgagtataagaagattcatacgggtgacaagctgtacaaatgcaaggagtgcggcaaggtgttcaagcaaagctctcacctaaataggcacgagaagatccacacgggcaagaaaccttataagtgcaaagaatgtggcaaagtgatcacgtccagttcttccttcgccaagcataaaaggatacataccggtgaaaagccctttaagtgcctcgagtgtggcaaagcatttactagctctacaacattaaccaagcatcgcagaatacataccggggaaaaaccttatacatgcgaggagtgtggcaaggccttccgccaatcagcgatactgtacgttcaccgccggatccataccggcgaaaagccatacacttgcggggagtgcggcaagacattcagacagtcagccaacctgtatgctcacaagaagattcatacaggggaaaaaccctatacatgcggcgattgcggcaagacttttcgtcagagcgctaatctgtatgctcacaagaaaatacacacgggggacaagaccattcaggtgtag

SEQ ID NO: 22096 - DNA, 2217 bp, Artificial Sequence
  Description of Artificial Sequence: Synthetic coding sequence
atgggcctgctgaccttccgggacgtggccatcgagttcagcctggaagaatggcagtgtcttgacaccgcccagaaaaatctttataggaatgtaatgttagagaattatcgcaacctggcttttctgggaatcgccgtgtctaagccagatctgattatctgtcttgaaaaggaaaaagagccttggaacatgaagcgcgacgaaatggtggatgagcccccggggatctgcccccatttcgcgcaggacatatggcctgagcagggagtcgaagactcattccagaaggtcattttgaggaggtttgagaaatgtgggcatgaaaatttgcagctaagaaagggctgtaagagtgtggacgagtgtaaagtacataaggagggatacaacgggcttaaccagtgcttcacaacaacccaagggaaggcctcccagtgcggcaagtacctgaaggtcttctacaagtttattaatctgaatcgatataaaatccgtcacacgagaaagaaaccattcaagtgtaaaaactgtgtgaagagtttttgcatgttttctcacaagacgcagcacaagtctatttacactaccgaaaagagctacaagtgtaaggaatgcggaaagaccttcaactggtccagtaccctgaccaaccacaagaagacacatactgaagagaagccctataagtgtgaagaatacggaaaagcatttaaccaaagcagtaattacactacccataaagtgactcacaccggcgaaaagccatacaagtgcgaggagtgtggaaaggccttctcccagtcctccaccctgacgatacataagcgaatacataccggcgagaaaccatgcaaatgtgaggaatgcggtaaggctttttcccagccctccgccttaaccatacataaacgtatgcatattggtgagaaaccttacaagtgcgaggaatgcggaaaggcattcgtctggagctccacacttacaagacataaaagattgcactcgggcgagaagccctataagtgtgaggagtgcgccaaagcttttagccagttcggacatctgacaacgcacaggatcattcacaccggagagaaaccctacaagtgcgaggagtgcggcaaggcattcatttggccctccaccttgactaaacataagcgcattcataccggggagaagccctacaagtgcgaggagtgcggaaaggccttccacagatcctccaaccttactaaacacaaaattattcacacaggcgaaaagccctacaaatgcgaagagtgcggcaaagcattcatctggtctagcaaccttaccgagcacaagaagatccacacacgggaaaagccatacaaatgtgaggaatgcagcaaagcctttagtagatcctcggccttgaccacacataagagaatgcacactggggaaaagccttataagtgcgaggagtgcggaaaagccttctcccagagctcgactctcactgcccacaagattattcacaccggagaaaaaccatacaagtgcgaagagtgcggaaaagcgtttattctctcttctacactctccaaacataaaagaatacacaccggcgagaaaccttacaaatgtgaggaatgcggcaagaccttcaaccagtccagtaatctatctacccacaagatcattcacacaggagaaaaaccttacaagtgtgaggaatgcggtaaggcatttaacagatcatctaacctttcgacccataaaattatccacacgggcgaaaagccttacaagtgcgatgagtgcggcaagtcttttatttggagtagcaccctcttcaagcacaagattatccatacaggagagaagccatataagtgcgaggaatgtggaaaggcttttaaccactcacagatcctccttcacattagacacaaaagaatgcacacaggcgagaagccatacaagtgcgaagaatgtggtaaaagctttaacctctcaagtacatttatcaagcataaagttatccacacaggagtgaaactctacaaatgtgaggagtgcggaaaggttttcttctggtcttccgcgctgaccaggcataaaaagatccacgctggtcagcagccctacaaatgggagaagatcgggaaagccttcaaccaaagttcgcatctaaccactgacaagataacccacataggtgaaaagtcttacaagtgcgagtag

SEQ ID NO: 22097 - DNA, 327 bp, Artificial Sequence
  Description of Artificial Sequence: Synthetic coding sequence
atgggcctgctgaccttccgggacgtggccatcgagttcagcctggaagagtggcagtgcctggacacagcgcagaagaacttgtacagaaatgtgatgcttgagaattaccggaatctggccttcctgggcattgctgtttcaaaacccgacttaatcatctgcttggagaaagaaaaggaaccctggaacatgaagcgtgacgagatggtcgatgagcctccaggactggctgtaagcaatccagacctgatttcatgtctcgaacagatcaaagagccttggaatgttaaaaggcacgaaacagtggtgaaatacagcgggtag

SEQ ID NO: 22098 - DNA, 270 bp, Artificial Sequence
  Description of Artificial Sequence: Synthetic coding sequence
atgggcctgctgaccttccgggacgtggccatcgagttcagcctggaagagtggcagtgtctggacaccgctcagaagaatctgtatcggaatgtgatgttagagaactaccgcaacctggccttcctgggcatcgccgtgtccaagcccgatttgataatttgtctcgaaaaggaaaaggaaccttggaacatgaaaagagatgaaatggtcgacgagccacctgatggggtctcgctctgccatccaggttggagcgcagtcgcctag

SEQ ID NO: 22099 - DNA, 234 bp, Artificial Sequence
  Description of Artificial Sequence: Synthetic coding sequence
atgggcctgctgaccttccgggacgtggccatcgagttcagcctggaggagtggcagtgcctggatactgcacagaaaaatctgtacagaaacgtcatgctggagaattatagaaacctggcttttttgggcattgccgtctcgaagccagatcttataatttgtttggagaaagagaaggaaccatggaatatgaagagagacgagatggtggacgaacccccaggacggtag

SEQ ID NO: 22100 - DNA, 1851 bp, Artificial Sequence
  Description of Artificial Sequence: Synthetic coding sequence
atgggcctgctgaccttccgggacgtggccatcgagttcagcctggaggaatggcagtgcctcgatactgcacagaagaacctttatcgcaatgtgatgttggagaactatagaaaccttgcttttctcggaattgccgtgtctaagccagatctgattatttgtctggaaaaggagaaagagccctggaatatgaagcgagacgaaatggtcgatgagccccccgggatttgtccacatttcgcccaggatatatggccagaacaaggtgtcgaggactctttccaaaaggtgattcttagacgttttgagaagtgtggccatgaaaaccttcaactccggaaggggtgtaaaagcgtggacgagtgcaaagtgcacaaagaaggttacaacggactgaatcagtgctttactaccacacagggtaaggcctcccagtgcgggaagtatcttaaggtcttctacaaattcattaacctcaatagatacaagataagacacactcgcaagaaaccctttaaatgcaagaactgtgtgaaatctttttgtatgttctcccacaagacccagcataaatctatctatacaaccgagaaaagttacaagtgcaaggagtgcggcaagacctttaactggagcagtaccctgacgaatcacaagaaaacacacaccgaagaaaagccttacaagtgtgaggaatatgggaaggcctttaaccagtccagcaattacaccacccacaaggtcactcatactggagagaagccatataaatgtgaggagtgcggcaaagccttctcccagtccagtacacttaccatccacaagagaattcataccggcgagaagccctgtaaatgtgaggagtgcggcaaggcgttctcccagccatctgcgctgactatccacaaaaggatgcacataggcgagaagccgtacaagtgtgaggaatgtgggaaagctttcgtctggtcctctactctaaccaggcacaaacggttgcacagcggggagaaaccttataagtgcgaggaatgcgcgaaggcgttcagccaattcgggcacttgactacccatcggattatacacacgggtgagaagccatataaatgcgaggaatgtggaaaggccttcatctggccgagcaccttaacaaaacacaaacgcattcatacaggtgagaagccttataagtgcgaagaatgcggcaaggcgttccaccggagctcaaacctgactaaacacaagatcattcacacaggggagaaaccgtacaaatgcgaagaatgtggcaaagcttttatctggtcttccaacctgacagagcacaaaaagattcacacgcgcgagaaaccgtacaaatgtgaggagtgcagtaaggccttctccaggtctagcgcgctcacaactcataaacgcatgcacaccggcgaaaagccctacaagtgcgaagagtgcgggaaggcattcagtcaatccagcaccctgacagcccacaagatcattcataccggggaaaagccctataaatgcgaggaatgtggcaaggcctttatcctctcgagtaccctgagtaagcacaaacggattcacactggagaaaagccttataaatgcgaggaatgcggaaagacattcaaccagagctctaatctctccactcacaagatcatccatacgggcgaaaaaccatacaaatgtgaagagtgcggtaaggcgtttaatcgctcctccaacctctctactcacaagatcatccacacaggggagaagccttacaaatgcgacgaatgcggcaaatctttcatctggtcttctacactgtttaagcacaagaggatccacacgtag

SEQ ID NO: 22101 - DNA, 3759 bp, Artificial Sequence
  Description of Artificial Sequence: Synthetic coding sequence
atgcccggcgcccccggcagcctggagatgggccccctgaccttcagggacgttacaattgaatttagcctggaggagtggcaatgcctcgatacagtgcagcagaacctgtatagagatgtgatgttggagaactaccgcaacctcgttttcctgggcatggcagtgttcaagccagatctaatcacctgtctcaaacagggaaaggagccctggaacatgaagagacacgagatggtcaccaaacctccagtcatgcggagccacttcacccaagacctctggcctgaccagagcacaaaagactcctttcaagaggtgatactcagaacctacgcccgctgtggccacaaaaatctgcggttgcggaaggactgtaaatctgctaacgaggggaagatgcacaaggaaggttacaataaactgaaccaatgccggactgccacccagaggaagatcttccagtgtaacaaacatatgaaggtatttcataagtatagtaatagaaacaaagtgcggcacaccaagaagaagacgtttaaatgtataaagtgtagtaagagcttctttatgctgagctgcctgatccgtcacaagagaatccatattcggcagaatatctataaatgtgaggagcgcggcaaggcttttaaatcattttctactctgacaaaacacaaaatcatccacacggaagacaagccttacaagtacaaaaaatgcggaaacgccttcaagttttcctcaacgtttaccaagcataaacggatccatactggcgagaccccattccggtgcgaagaatgtggtaaggctttcaatcagagcagtaacctgaccgatcacaaacgtatccataccggcgagaagacttacaaatgtgaggagtgtgggaaggccttcaaggggtcctcaaacttcaacgctcataaggtcattcacacagctgagaagccttataagtgcgaagattgtggcaagacatttaaccacttcagcgcactgcgcaagcataaaatcattcacactggcaaaaaaccttacaaaagagaagaatgtggaaaggctttctctcagagctccacgctgaggaaacacgaaattatccacaccggagaaaagccctataaatgtgaggaatgtggaaaggcatttaaatggtcttcaaagctgaccgtacacaaggtcgtgcacaccggcgagaagccctacaaatgcgaggagtgcggcaaagcattttcacagtttagcacactgaaaaaacacaagattatccatactgggaaaaaaccctataaatgcgaggagtgtggtaaagcattcaatagttcatctacgcttatgaaacataaaattattcatacgggcgaaaaaccctataagtgtgaagagtgcggcaaagcctttagacaatcatcccacctgaccaggcacaaagccatccataccggagaaaagccctataagtgtgaggagtgtggtaaggcctttaatcatttcagcgacttgagacgccacaaaattattcacacggggaaaaagccatataaatgtgaagagtgcgggaaagccttctcacaatctagtacactccggaaccaccaaattatccatacgggcgagaaaccatataaatgtgaagaatgtgggaaggccttcaagtggtcctctaagctcacagttcacaaggtgattcacaccggggagaaaccctgcaaatgtgaggaatgcggaaaagcattcaagcacttcagcgcacttcgcaaacacaaagtcattcacacacgcgagaaactctacaaatgcgaggaatgtggaaaggcatttaataatagcagtatcctcgccaagcataagataatccatacgggcaaaaaaccctacaaatgcgaagaatgcggtaaggccttcaggcagtcttcccatctgacaagacacaaagccattcacaccggagagaaaccgtataaatgtgaagaatgcggcaaagccttttcccacttctcagcacttcgccggcacaagatcatccataccggtaagaaaccatacaagtgcgaagagtgcggaaaggctttcagccatttctcggccctgcggcgtcacaaaattattcatactggcgaaaaaccttacaagtgtgaagagtgcggcaaggccttcaaatggtcgtccaaacttactgtgcacaaggtcatacatacagctgaaaagccttgcaagtgtgaggagtgtgggaagagctttaaacacttcagcgcccttaggaaacacaaggtgatccatactagggagaaattatataagtgcgaggaatgtgtcaaggcatttaacagtttctctgcgctcatgaagcacaaggttattcacaccggagagaagccatacaaatgcgaggagtgtggcaaagcattcaaatggtcaagtaaactaaccgtgcataaagtaatccatacaggcgaaaagccctgcaagtgcgaggaatgcggcaaggcttttaagcacttttccgctctgcgtaagcataaggttatccatacaggaaaaaagccatacaagtgtgaggagtgcggaaaggcctttagtcagagcagttccctccgaaagcatgagattattcattcgggagagaaaccttataagtgcgaagagtgcggcaaggcctttaaatggttatcaaaactgaccgtgcataaagtaattcacaccgcggagaaaccatgcaagtgtgaggaatgcgggaaagcttttaaacacttctccgctttgcggaagcataagatcatacataccggaaaaaagccatacaagtgtgaggaatgcggtaaagctttcaacgatagtagcaccctcatgaagcacaaaatcatccatacaggaaaaaagccgtacaaatgtgccgagtgtggcaaggcctttaaacagtccagccatctgaccaggcacaaggcaatccacactggtgaaaagccttataaatgtgaagaatgcggaaaggactttaacaactcgagtaccctgaagaagcataagcttatccatactcgggagaaactctataagtgtgaggaatgtgtgaaagcattcaataatttttccgccctgatgaagcataagataattcacactggagagaagccttacaagtgcgaagaatgtggaaaagcctttaaatggtcttcgaaattaactgagcataaagttatccatacaggagagaagccttgtaaatgcgaggagtgcgataaagcgtttaagcacttctccgcactgcgcaagcacaaagttatccatacgggcaagaagccttaccagtgcgacgagtgcggcaaggcattcaacaactccagtacgctgacaaaacacaagatcatacatacaggagagaagccgtacaagtgtgaagaatgcgggaaggctttctcacagtccagcattcttacaaagcacaaaattattcatagcgtcgagaaaccctacaaatgtgaggagtgcggcaaggcttttaaccagtcttcccatctaactaggcataagaccatccataccggtgagaagccatacaagtgtgaagagtgcggtaaggccttcatccagtgttcatatcttattcgtcacaaaaccatccacacgcgtgagaagcctaccaacgtgaagaaggtaccgaaattactgtctaatccccacaccttgctggacaaaaccattcacaccggggagaagccgtataaatgcgaagagtgcgcgaaggccttttag

SEQ ID NO: 22102 - DNA, 1512 bp, Artificial Sequence
  Description of Artificial Sequence: Synthetic coding sequence
atgggcgccctgaccttccgggacgtggccatcgagttcagcctggaggaatggcagtgcctggacaccgaacagcagaacctgtatagaaacgtgatgctggacaattaccggaatctcgtgttcttgggtattgccgtgtcaaaacccgatctgattacctgtctcgagcaggagaaagaaccctggaatttgaaaacacatgacatggtggcgaagccacccgtgatctgttcccacatcgctcaagatctgtggcctgagcaggggataaaggattactttcaagaggtgatcctgcgtcagtacaagaagtgcagacacgagaatttgttgttacggaagggctgtaagaatgtcgacgaattcaaaatgcataagaagggctataataggcataaccagtgcctcacaacttcccacagcaaaatcttccaatgtgacaagtacgtgaaggtctttcacaagttctcgaactcaaatcggcacaaaattagacacaccagcaaaaaaccctttaagtgtaaggaatgcggaaaactgttttgcatcctatcccacctcgcccagcataaaaagatccacacaggcgaaaagagttacaaatgtgaagagtatggaaaagctttcaatgagagttccaattgcactacgcacaagcggataactgaaaagaagccctataagtgtaaagaatgcggaaaggcgttcaactggtttagtcattttaccacccataaacgcattcacacaggtgaaaaaccctaccaatgcgaaaaatgtggcaagttcttcaaccaatctacaaacttgactacacataagagaatccatacaggagaaaaaccatataaatgcgaagagtgcggcaaagcgtttaaccagtcctccaacctgacggaacacaagaagattcatactaaggagcagccgtataagtgtgagaagtgtggcaaagctttcaaatggagctctaccttgacgaagcataagagaatccacaatggggagaagccttataaatgcgaggaatgcggcaaggccttcaaccgcagcagtaccctgaatcggcacaagatcacacacacagggggcaagccttacaagtataaagagtgcggcaaggcctttaatcagagctctactcttacaatccacaaaattatacatacagtggagaaattttacaaatgcgaagagtgcgggaaggcgttttccaggatctcacacctcacaactcataagaggattcacactggagaaaaaccatataaatgtgaggagtgtggaagggcttttaaccagtcctctactcttactacccacaagagaatccacacaggcgagaagccctacgagtgtgaagagtgtggtaaggcgtttaatagaagttctaccctgaccactcataaaatcattcacagtggggaaaagatatacaaatgcaaggagtgcggtaaggcctttagaagattttctcatcttactcggcataagactatacacacttag

SEQ ID NO: 22103 - DNA, 1758 bp, Artificial Sequence
  Description of Artificial Sequence: Synthetic coding sequence
atggagctgctgaccttccgggacgtggccatcgagttcagccccgaagaatggaaatgcttggatccagctcagcaaaacttgtacagggacgtaatgttggagaattatagaaatctgattagccttggtgtagcaattagtaacccagaccttgtgatctatttggaacagcgcaaggagccctacaaggttaagatccatgagaccgtggccaaacatcccgccgtttgctcgcatttcactcaagactttctccctgtccaaggaatcgaagacagttttcataagctcatcctgaggcgatatgagaaatgcggacacgagaatctagagctgcgcaagtcatgcaagaggaaggtccagaagggaggatacaacgagttcaatcaatgcttgagcactatccaatccaaaatcttccaatgtaacgtgcatgtaaaagtcttttctacattcagtaatagcaaccagaggaggatcagacataccggcgagaaacactttaaagagtgtgggaaatctttccagaagttttccgacctaactcagcaccagggtattcatgccggggagaagccctacacatgcgaggagtgcgggaaggattttaagtggtacctgattttcaacgaatacgagataattcacactggtgaaaagccgttcacgtgcgaggagtgtggcaacatcttcacaacgagcagtaattttgccaagcacaaggtacatactggtgagaagtcctacaaatatgaggaatgtggaaaggcttttaaccgctcaagcactctcactaaacacaagcggatccacgcagaggaaaagccctttacctgtgaggaatgtgggaagattattacgagttccagcaatgtcgcaaaacataaaaaaatccacactggcgaaaagctctacaagtgtcaggaatgcggcaaagttttcaatcgctcaactacgctgaccaagcataatcggatacacaccggcgagaaaccttacacttgtgaggagtgcggaaaagccttctctaggagtagcgtgctgaatgagcataagagaatacacactggagaaaagccctacaagtgtgaacagtgcggtaaggcattccgacagagcgccacactgaataaacataaatcaattcacaccggggagaaaccctatacatgcgaggaatgcggtaaagcattctccagattcaccaccctgaatgaacacaagcgaatccacaccggagaacgcccccacaaatgtgaggagtgcggcaaggccttcggctggagcactgacctgaataagcacaaaatcattcacactggggagaagccttacaaatgcgaagagtgcggcaaggcttttggctggtccgcttacctgtctaaacacaagaagatccatacaggcgagaagccatatcgatgtgaagagtgtggcaaagcattcctgtgtagccgagccctcaacaagcacaagaccatccacaccggagaaaaaccttatgagtgcgaagagtgcggcaaggccttcggctggagcacctacttgtccaagcacaaaaagatacatacaggggaaaagccttaccgatgtgaggagtgcggaaaagccttccgacggtcgcgcgttttaaacaagtacaagacaattcacacaggcgataaaacccctaagtgtaagggatgcggaaaggccttcaagtggtcctcttacctaaatcagcataacaagatctacaccggagagaaactttag

SEQ ID NO: 22104 - DNA, 1284 bp, Artificial Sequence
  Description of Artificial Sequence: Synthetic coding sequence
atgggcgtgctgaccttccgggacgtggccgtggagttcagccccgaagaatgggaatgtctggactctgcacagcagcgtctgtaccgcgacgtgatgctggaaaattatgggaatctggtaagcttggggctggcaatctttaaacctgacctcatgacttgtttggaacagcgaaaagagccatggaaggtcaaaaggcaggaggccgtcgcaaagcatcctgccggaagctttcatttcacagccgagattttacctgaccatgatatcaaagatagcttccagaaggtcattctgaggaagtacggcagttgcgatctgaacaatctccacctgaagaaagattatcagagtgtcggcaactgtaagggacagaaatcgtcttataatggtctccatcaatgcctgtctgctactcactccaaaacgtgccagtgtaacaagtgcggacgaggttttcaattatgcagtatttttaccgaacacaaggacatcttttcaagagagaagtgccacaaatgcgaggaatgcggcaaagactgcagattgttttctgacttcaccaggcataaaaagatccatactgtcgagcgctgttacaagtgtgaggagtgcggaaaagcattcaaaaaattttctaatctgacagaacataagcgggtgcataccggagaaaaaccttataagtgtgaaggctgtggcaaaactttcacatgttcttctactttggtaaagcataagcgcaaccacacgggtgatcgaccgtataaatgtgaggagtgcggaaaagccttcaagtgcttcagtgatctaactaaccataagcggatccacactggcgagaagccatataagtgtgaggagtgcaacaaagcttatcggtggttttccgaccttgctaaacacaaaattattcacactggagacaagccttacacatgtaacgaatgtggcaaagccttcaagtggttctcagccctgtctaaacacaagcgcatccataccggggaaaagccttacatctgtgaggagtgtgggaaggcatttacccgcagctctaccctgttcaaccacaagcggatccacatggaggaaagaccatacaaatgtgaagaatgtagcaagacattcaaatgcttttccgacctaactaatcataagagaatccatacgggcgagaagccttacaaatgcgaggagtgcgggaaagccagcagctggttctctcacctcatcagacataagcggattcacaccagagagaaactgcataagtgttag

SEQ ID NO: 22105 - DNA, 1284 bp, Artificial Sequence
  Description of Artificial Sequence: Synthetic coding sequence
atgggcgtgctgaccttccgggacgtggccgtggagttcagccccgaagagtgggagtgtcttgattctgcacagcagcgactttaccgggacgttatgttggagaactatggaaatctggtgagcctgggcctggcgattttcaaaccggacctgatgacctgcctcgaacaaagaaaggagccctggaaagtgaaacggcaggaggctgtggctaaacacccagctggaagcttccacttcaccgccgagatcctgcctgatcacgacataaaggatagtttccagaaagtcatccttcgaaagtatggtagctgcgacctcaacaatttgcatctgaaaaaggactaccagtctgtaggaaattgcaaaggccagaagagctcctataatggactgcatcagtgtttgagtgccactcactcaaaaacttgccagtgtaataaatgcggcagaggtttccaattgtgcagcatatttacagagcacaaggatatcttcagtagagagaaatgtcataaatgtgaggaatgtgggaaggactgtcgcttatttagcgatttcacacgtcataagaaaatacacacggtggagcggtgttataagtgcgaggagtgtgggaaggcctttaagaagttctcaaacctcacagagcataaacgggtgcatacaggcgaaaaaccctacaaatgtgaagggtgtggcaaaaccttcacctgctcttccactctcgtgaagcacaaaaggaatcacaccggagaccggccgtataagtgcgaagagtgtgggaaggcttttaagtgtttttcagatctgacaaatcacaaaaggattcatactggggaaaaaccttacaagtgcgaggaatgtaataaggcctacaggtggttttccgatttggctaagcacaagatcattcacacgggggacaagccatatacctgtaatgagtgtggtaaggctttcaagtggttcagtgcgctgagcaagcataagaggatacataccggagaaaagccatacatctgtgaggagtgcgggaaggcgttcacgcggagctccaccctattcaaccataaacgaattcacatggaggagcgaccatacaaatgcgaggagtgctcaaaaacttttaagtgcttttcagacctgacaaaccacaaaagaattcacacaggcgagaaaccctataagtgcgaagagtgcggtaaagcgtcctcttggtttagccatctgatcaggcataaacggatccacacacgggaaaaactacacaaatgttag

SEQ ID NO: 22106 - DNA, 414 bp, Artificial Sequence
  Description of Artificial Sequence: Synthetic coding sequence
atggacgacctgcggtacggcgtgtaccccgtgaagggcgccagcggataccctggagccgaacggaacctactggagtatagctacttcgagaagggtcctctgactttccgcgacgtggtgattgagtttagccaggaggagtggcagtgcctcgacaccgctcagcaggacctttaccgcaaagtgatgctagaaaattttcgtaacctggtttttctcggcatcgacgtttcaaaacctgatttgattacctgccttgagcaagggaaagatccctggaatatgaaacgtcattctatggtagcaactcctcccgaaagcggtgtgttgaaattccctactattatcatactgctgtctcggtgcttcttccagtctgtgaatatttgtttcatatatctagaaccttag

SEQ ID NO: 22107 - DNA, 354 bp, Artificial Sequence
  Description of Artificial Sequence: Synthetic coding sequence
atggacgacctgcggtacggcgtgtaccccgtgaagggcgccagcggctaccccggggccgaaagaaacctgctggaatacagctatttcgagaaggggccgctgactttcagggacgtggtgattgaattttcgcaggaagagtggcaatgccttgataccgctcagcaggacctgtaccggaaggttatgctagaaaactttaggaatctagtcttcctgggcattgatgtctccaaacctgaccttatcacgtgtctggagcagggaaaagacccctggaacatgaagcggcattcaatggtggccacccctcccgatggggtgagccttctgtttcctaggcccgagtag

SEQ ID NO: 22108 - DNA, 582 bp, Artificial Sequence
  Description of Artificial Sequence: Synthetic coding sequence
atggcccaggccagcctgctggcctgcgagggcctggccggcgtgtccttagtccctaccgcagcgtcaaaaaaaatgatgctctcccagatcgcaagcaagcaggctgagaatggagagcgggctggcagcccagacgtactgagatgcagctctcagggtcatcggaaggactctgacaagtctcgatctagaaaagatgacgacagcctgtcagaagcatcacactctaaaaaaactgtaaaaaaggtagtcgtcgtggagcagaacgggtccttccaggttaaaatccccaagaacttcgtgtgtgaacactgcttcggggctttccgcagttcctatcatttgaagcgtcacatattgattcatacaggcgaaaagccttttgagtgtgatatctgcgacatgcgattcattcagaagtaccacctagagcggcataaacgtgtccactcgggcgaaaagccttatcagtgcgagcgctgtcaccaatgtttttccagaaccgatcgtttactgaggcacaaacggatgtgccagggatgtcagtcaaagacctctgatggtcaattttccctgtag

SEQ ID NO: 22109 - DNA, 2337 bp, Artificial Sequence
  Description of Artificial Sequence: Synthetic coding sequence
atgaacctgaccgaggactgcatggtgttcgaggacgtggccatctatttttcgcaggaggaatggggcatcctaaatgatgcgcagcggcacctgcacagtaacgtgatgcttgagaacttcgccttgttatcaagcgtaggctgttggcacggagcaaaagatgaggaggtcccttccaagcagtgcgtgagcgtgcgcgtcctccaggtaacgattcccaaaccagcattatctacattgaaagcacagccctgtaaaatgtgctctagcattctcaaagacatcctgcacttggccgagcatgatgggacacaccctgagcagggcctgtatacctgcgccgctgagcacgacctccaccagaaggaacagattcgagaaaagctgaccaggtctgacgaatggagacccagtttcgtcaatcactctgcgcacgtgggcgagcgaaatttcacctgtacacagggtgggaaagacttcacagccagttccgacctcctgcaacagcaggtactcaatagtggctggaaactctaccgggatactcaagatggcgaggcttttcagggcgagcaaaacgacttcaattcgtcacagggcggcaaggatttttgtcatcagcacggcctcttcgaacatcagaaaactcataatggtgaaagaccctatgagttctctgagtgtggtgagctgtttcggtataattccaacctgatcaagtatcagcagaaccacgctggagaacggccatatgaggggaccgagtacggtaaaactttcattcgcaagtccaacctcgtgcagcaccagaaaatccattcggaaggcttcctgtccaagcgaagcgatccaatagagcaccaggaaatcctgtcaagaccaactccctacgaatgcactcagtgcggaaaggcctttttgacgcaggcccacttggtcggccaccagaagacacacacaggcgaacagccctatgagtgcaataagtgtggaaaattttttatgtataatagtaaactcattaggcaccagaaggttcacaccggagagcgacgctatgaatgttcagagtgtgggaagttgtttatggattcttttacgctgggccgacaccaaagagtacacacaggtgagcggccttttgagtgttcaatctgcggcaaattctttagtcatagaagtactttaaatatgcaccagcgcgtgcatgctggaaagcgactgtacaaatgcagcgagtgcgggaaagccttttccctgaagcacaacgttgtccagcatttgaaaattcatactggagagagaccatacgagtgcactgaatgcgagaaggcattcgtgcgcaagtcccacctggtccagcatcagaagattcacactgatgctttctcaaaacgctccgatctgattcagcacaagcgtatcgacattcgaccaagaccctacacatgttccgagtgcgggaaagcgtttttgacccaggctcatttggtgggacatcagaaaatccacactggcgaacgtccctacgaatgtactcagtgtgccaaggcattcgtgaggaagagccatctggtgcagcacgaaaagatccatacagatgcatttagtaagagatccgacttgattcagcacaagcggatcgacctgcggccaagaccatatgtgtgctctgagtgtggcaaagccttcctgacacaagcccatttggatgggcaccaaaaaatacagacaggcgaaagacgctacgagtgcaatgagtgcggcaaattcttcttggattcttataaattggtgatccatcagcggatacacactggggaaaagccgtacaagtgttctaaatgcggcaagttttttcgttaccggtgcaccctgtctcgccaccagaaagtccacaccggtgagaggccctacgagtgttcagaatgcggcaagttcttccgggattcttacaaactcatcatccatcagagagttcacacgggagaaaaaccttatgaatgcagcaactgtggaaaatttctgaggtaccggtccacctttatcaagcaccataaagtgtgcaccggggagaaaccgcatgaatgctctaagtgccgggagctgtttcggaccaagtccagcctcatcatccaccagcaatctcacaccggtgaaagtccctttaagctgcgagagtgcgggaaggacttcaacaagtgtaatactgggcaacgccagaagacacacacaggggagcgaagttatgaatgcggcgaatccagcaaggtgtttaagtataattcatccctcattaagcatcagataattcacacaggaaagcgtccttag

SEQ ID NO: 22110 - DNA, 1194 bp, Artificial Sequence
  Description of Artificial Sequence: Synthetic coding sequence
atgatgttccaggaccccgtggcctgcgaggacgtggccgtgaactttacacaggaggagtgggccttgttggacatctcacaaagaaaactttatcgcgaggtgatgcttgagacgtttaggaacctgacgtcgatcgggaaaaagtggaaagaccagaacatcgagtacgagtaccagaatcctagacgcaacttccggagcctgatcgagggaaacgttaatgagatcaaggaggactctcattgtggagagacttttacccaagtgccggatgatagactcaactttcaggagaagaaagcctcccccgaggccaagtcatgcgacaactttgtttgcggtgaagttgggatcggtaactccagctttaacatgaatatccgcggtgatattgggcacaaagcctacgaatatcaggactatgcacctaaaccttataagtgtcagcagcctaagaaggcttttcgataccacccctcatttcggactcaggaacggaatcataccggagaaaaaccgtatgcttgcaaggaatgtggtaaaacattcattagtcatagcggaatccgcagacgcatggtgatgcactcgggggacgggccatacaaatgtaaattctgtggcaaagcggtgcactgccttaggctatacctcattcatgagcgcacacacaccggcgagaagccatacgagtgcaagcagtgcgttaagtccttctcctactctgccacccaccgaatccatgaacggacgcatactggcgaaaaaccttatgaatgccagcagtgtggaaaggctttccacagtagcagcagtttccaggcccataagaggactcacaccggaggtaaaccctacgagtgtaagcaatgtggcaaaagttttagctggtgccacagcttccaaatccatgaaaggacccataccggggaaaagccctgtgagtgtagcaagtgcaacaaggctttccgctcttatagatcttacctcagacataaacggagccatactggcgagaaaccataccaatgtaaggaatgtagaaaagccttcacgtacccgagttccctgaggcggcacgaacgcacccacagcgctaaaaaaccttatgagtgtaaacaatgcgggaaggctctaagttataaattctctaatacaccgaagaacgcactctggcgcaaaactctgtag

SEQ ID NO: 22111 - DNA, 1185 bp, Artificial Sequence
  Description of Artificial Sequence: Synthetic coding sequence
atggaccccgtggcctgcgaggacgtggccgtgaacttcacccaggaagaatgggcactattggatattagtcagcgaaaactgtatcgagaagtgatgttggagacgttccggaatcttacttctattggcaaaaagtggaaagaccagaatatcgagtacgaatatcaaaacccccgacgcaattttagatctctcatcgaggggaatgtgaacgaaatcaaagaagacagccactgtggtgaaacctttacccaggtacctgatgatcggttgaacttccaagaaaagaaggcttcaccagaggccaagtcttgcgataactttgtctgcggcgaagtgggcatcggcaattcttcattcaatatgaacattagaggcgatattggccataaggcttacgaatatcaggattatgcccccaagccctacaagtgccagcagcccaagaaagcttttcgataccatcctagtttccgtacacaggagaggaatcacacgggcgagaagccttatgcatgtaaggagtgtggcaagacattcatttcacactcgggaatacggagacgcatggtaatgcacagcggagacggcccatataaatgtaaattctgcgggaaggctgtccactgtttgcgactatatctcattcatgaacggacccatacaggcgaaaaaccctatgaatgtaagcagtgtgtgaaaagcttctcttattctgccacccaccgcattcacgagagaacccacaccggcgagaagccctatgagtgccagcaatgcgggaaagcattccatagctcctcaagtttccaggctcacaagcggactcacactggggggaagccctatgagtgcaagcagtgtgggaaatcattctcttggtgccactcctttcaaatccatgaacgcacccacacaggggagaaaccatgtgagtgctcaaagtgcaataaagcctttagaagttaccggagttacctgaggcataagaggagtcacactggagagaaaccgtaccagtgtaaggaatgtaggaaggcttttacctatccttctagtttaagaagacacgaaagaacccactcagcaaagaagccctacgagtgtaagcagtgcggaaaagcacttagctataagttcagtaatacccctaaaaacgccctgtggcgcaaaactctgtag

SEQ ID NO: 22112 - DNA, 1245 bp, Artificial Sequence
  Description of Artificial Sequence: Synthetic coding sequence
atgccctgctgcagccaccggagctgccgggaggaccccggcaccagtgaatcacgggaaatggatccagtggcttgtgaagacgtggccgtgaactttactcaggaggaatgggctctactggacatctcccagaggaagctgtaccgtgaagtgatgttggagacctttagaaacctgacgtcaatcgggaagaaatggaaggaccagaatatcgagtacgagtaccaaaacccaaggagaaactttcggtcactgattgagggtaacgtcaacgagataaaagaggatagccactgcggtgaaacctttactcaggtgcctgatgatagactcaacttccaggagaagaaggctagcccggaggccaaatcctgtgataactttgtttgtggggaggtaggaattggcaactcgagcttcaacatgaacatcagaggggatattgggcataaggcctacgaataccaggactacgcgccaaagccttataagtgccagcaacccaagaaggcgtttcgctatcatcctagcttcaggacacaggagagaaatcacactggggagaagccctatgcctgcaaggagtgtgggaaaactttcatcagtcactctggtatccgacgtcgaatggtgatgcactccggagatggcccctataaatgtaagttttgcggtaaggccgtccattgtcttcggctttacctgattcatgaaagaacccataccggggagaaaccctacgagtgcaagcaatgcgtgaaaagcttctcatactccgccacacatcgcatccatgagcggacccacaccggggagaagccttatgagtgtcagcaatgtggtaaggctttccatagctcctcaagcttccaagcacataagcgtactcatacaggtggtaaaccttatgaatgtaaacagtgcggcaagtccttctcgtggtgccactcgttccagattcacgaaagaacccacacaggcgagaagccctgtgaatgctccaaatgtaacaaggctttccgctcttacagatcatatctcagacacaagcgctcacataccggtgagaagccataccagtgtaaggaatgtcgcaaagcttttacgtatccatccagccttcgcagacatgagaggacacattcagctaagaagccctatgagtgcaagcagtgcggcaaagcgctatcatataaatttagcaacacacccaagaacgctctgtggcggaagaccctctag

SEQ ID NO: 22113 - DNA, 819 bp, Artificial Sequence
  Description of Artificial Sequence: Synthetic coding sequence
atgaacatccggggcgacatcggccacaaggcctacgagtaccaggactatgctcccaaaccatataagtgccagcaacccaagaaagcttttcgctaccatccatctttcaggacgcaagagcgaaatcacaccggcgaaaagccctatgcctgtaaggagtgtggcaaaacatttatatcacattctggtattaggcgtcgaatggtcatgcactccggagatggtccttataagtgtaaattctgtggtaaggcagtacattgcttacgtctgtacctgatacatgagagaacccacacaggcgagaaaccctatgaatgcaagcagtgtgtgaaatccttttcctatagtgctacacaccgcatccacgaacgcacccacaccggtgaaaaaccttatgaatgtcagcaatgcggtaaagctttccatagctcctcttcattccaagcccataaacgtacccataccggcggaaaaccatatgaatgcaagcaatgcggcaagtcgttctcctggtgtcatagttttcagatccacgaaagaactcatactggcgaaaagccttgcgagtgctctaaatgtaataaagctttcaggtcatatagatcatacttgcgccataaaaggtcccacacaggcgagaagccatatcagtgcaaggagtgtagaaaggcctttacctatcctagctcactccgaaggcatgagagaacacatagtgccaagaagccctacgagtgcaaacagtgtgggaaagcactgtcttacaagttcagcaatacaccaaaaaatgcactgtggcgaaagactctgtag

SEQ ID NO: 22114 - DNA, 1227 bp, Artificial Sequence
  Description of Artificial Sequence: Synthetic coding sequence
atggccccccccctggcccccctgcccccccgggaccccaacggcgctggcccagaatggcgggagcccggagcagtaagcttcgctgatgtcgctgtatatttctgccgagaggagtggggctgcttgcggcctgcacaacgggccttgtatcgcgatgttatgcgcgagacatacggacacctttccgccctggggatcggagggaacaaacctgccctcatttcctgggtggaggaagaagccgagctttggggcccagcagcgcaggaccccgaagtggctaagtgccagacacagactgaccccgccgactcacgcaataagaagaaagaacgccagagagaaggtaccggcgccttggagaagcctgacccggttgccgcaggctcccctgggctgaaatccccccaggcaccaagtgccggaccaccctacggctgggagcagttaagtaaggctcctcatcgcgggcggccatctctttgcgctcacccccctgtgcctcgggctgaccaaaggcatggatgttatgtttgtggaaagagctttgcatggagaagcaccctggttgaacatgtgtactcacacactggcgagaagccattccactgcaccgactgcggcaagggcttcggtcacgccagttccctgtccaaacacagagcgatccacagaggcgagcgcccccatcggtgcctggagtgcggcagggcttttacccaacgttcagcactgactagccacttgcgcgttcatacaggagaaaaaccatacggatgcgccgattgcggaaggcgtttctcgcagtcttccgctctttaccagcaccgtcgggttcacagtggcgagacgccattcccctgccccgattgtggaagggcatttgcatatccttccgatctcaggcggcacgtgcgcacacacacaggagaaaaaccttacccgtgtcccgactgcggcagatgttttaggcaatctagcgagatggcggcacaccggaggacacattctggcgagaagccctatccatgtccccaatgcggccggaggttcgggcagaaaagtgcagtggcgaaacatcagtgggttcatcgtcccggcgcaggaggccaccggggcagagtggcaggtcggctctctgtgaccctgacaccaggacatggcgatctagatcctccggtggggttccaactttacccagagatcttccaggagtgtggctag

SEQ ID NO: 22115 - DNA, 1224 bp, Artificial Sequence
  Description of Artificial Sequence: Synthetic coding sequence
atggccccccccctggcccccctgcccccccgggaccccaacggcgccggaccagaatggcgtgaaccgggggcagtgagtttcgccgacgtggccgtctacttctgccgtgaggaatggggctgcctgcgaccagcccagcgcgcactgtaccgggacgtcatgcgagaaacgtacggccacctcagcgcactcgggatcggcggaaacaaacctgcccttataagttgggtcgaggaggaggctgaactgtggggcccagctgcacaggatcccgaggtggctaagtgtcaaactcagaccgaccctgattccagaaacaagaagaaggagaggcaacgagagggcacaggagcgctggagaagccagacccagttgccgcaggctcccccggcctgaagagtccacaggctccgtcagccggtccaccttatggttgggagcaattgtctaaagccccccacaggggaagaccaagtctgtgcgcgcatcctcccgttcccagagccgatcagcgccatggctgttacgtctgtggtaagagctttgcttggaggtcgacacttgtcgaacatgtttatagccataccggcgagaaaccattccactgcacagattgcggtaagggcttcgggcacgcatcctctttaagcaaacaccgggctatccaccgcggggaaagaccccacagatgtcttgagtgcggaagagcttttactcagcgttccgctttaacctcacacttgcgggttcacacgggggaaaaaccctatggatgcgcggattgtggaaggaggttcagtcagtcatctgcattgtaccagcacagaagagtgcatagcggtgagactccattcccgtgtcccgattgtggtcgtgccttcgcatatccctccgatctccggagacacgtgcggactcataccggtgaaaagccttacccgtgccccgattgtggaaggtgtttccgccagagtagtgaaatggcggctcaccgtcgaacacacagcggagaaaaaccttatccgtgcccccagtgtgggaggaggttcgggcagaagagcgcagtggctaaacaccagtgggtccatcggccaggtgcggggggtcatcggggtagggtcgcgggacgactttcggtgactctaactcctggccacggagatctcgatccgcccgttggcttccaactctatccggagatttttcaggagtgtgggtag

SEQ ID NO: 22116 - DNA, 21 bp, Artificial Sequence
  Description of Artificial Sequence: Synthetic coding sequence
atgatgaaggagttcagctag

SEQ ID NO: 22117 - DNA, 1572 bp, Artificial Sequence
  Description of Artificial Sequence: Synthetic coding sequence
atggccctgccccagggcctgctgaccttccgggacgtggccatcgaatttagtcaggaggagtggaaatgcctggatcctgcacaaaggaccctttaccgcgacgtaatgctggaaaattaccgaaacctggtgagtctagatatcagctcgaagtgtatgatgaaggagttcagtagcacggctcagggcaaccgcgaggtgtttcacgccggcacctcgcagagacacgaatctcatcacaatggggacttctgcttccaggatatagacaaggacattcatgacattgaattccagtggcaagaagacgagagaaacggtcatgaagctctcatgacgaagatcaagaagctgacaggcagcactgagaggtacgaccagaattacgctggtaataagcccgtgaaataccagctcggcttttcatttcactcccacctgcccgagctgcacatttttcatacagaggaaaagatcgataatcaagttgttaagtctattcatgatgcatctctggtttcaaccgcacagcgcatctcatgcaggccagaaacacacatctcaaatgattacggcaacaatttcctcaactcatccctgtttacacaaaaacaggaggtccacatgcgcgagaagtcatttcagtgtaatgattctggcaaggcatacaactgttctagtttgctcaggaagcatcagcttattcacttgggtgaaaaacagtacaaatgcgatatatgcggcaaggttttcaactctaaaagatacgtggctcggcacaggaggtgccatacaggtgaaaagccttacaaatgtaacgagtgtggtaagactttttcccaaacctactatctaacttgtcaccgtcggctccacaccggggaaaagccatataaatgcgaagaatgtgataaggccttccatttcaaatccaaactccagatacatagaaggatccacacgggagaaaaaccgtataaatgcaacgagtgtggcaagacattctcgcaaaaaagctacctgacatgtcaccgtaggctccacactggcgagaagccttacaagtgtaatgagtgcggtaagactttcagtcgcaagtctcatttcacatgccatcaccgggtgcacaccggcgaaaagccatacaagtgcaacgagtgtagcaagaccttttcccataaatccagccttacctatcatcggcgcctccacaccgaagagaagccttataaatgtaatgagtgtggaaaaactttcaatcaacagctgactcttaatatctgcagactgcattccggtgagaagccttataagtgtgaggagtgtgacaaagcctattccttcaagtccaatctggaaattcaccagaaaattcacaccgaggagaatccttacaagtgtaatgaatgcggcaagacgttttcgcggacaagttcccttacctaccaccacaggttgcacacagggcagaaaccatacaaatgcgaagactgtgacgaagctttcagtttcaaatcaaacctggagaggcaccgccggatatatactggggagaaactgcacgtttag

SEQ ID NO: 22118 - DNA, 387 bp, Artificial Sequence
  Description of Artificial Sequence: Synthetic coding sequence
atgatgaaggagttcagcagcaccgcccagggcaaccgggaggtgttccacgcaggcacctctcagagacacgagagtcatcacaatggtgatttttgctttcaggacatcgataaggacatccacgatatagagttccaatggcaggaggacgagcggaacggacatgaggcactgatgacaaagatcaagaagctgactgggtctacagagagatacgatcaaaactatgccgggaataagcccgttaagtaccagctcggcttctcattccactcccacctacccgagctgcacatttttcatactgaggagaaaatcgacaatcaggtcgtgaaatctatccatgacgcaagcttggtgagtaccgcacaacgcatctcttag

SEQ ID NO: 22119 - DNA, 1416 bp, Artificial Sequence
  Description of Artificial Sequence: Synthetic coding sequence
atgctgtgcgagggcgaggcccagaagcggaaggccgaggagagcggaatgcctctaacccaagggcacctaacctttagagacgtggccatcgagttctctcaggaagagtggaagtgtctcgatccagttcagaaagcactgtaccgtgatgtgatgctggagaattatagaaacctcgtgagcctcggcatctgtctgcctgacctgtcgattatctcaatgatgaagcagagaacagaaccatggacagtggagaatgagatgaaggtcgctaagaaccccgacaggtgggaaggaataaaggatattaatacaggacgatcttgtgccgttagatccaaggctggtaacaagccgatcacgaatcaactgggactgaccttccagctgcctctgccagagctggagatctttcagggggaaggaaagatttatgaatgcaatcaggtgcagaagttcatctcccatagctcctccgtgagccccttgcagagaatctatagtggagtaaaaactcatatttttaacaaacatcgaaacgactttgtagacttcccgctcctctcccaggagcagaaggcccacatccggcgtaagccctacgaatgcaacgaacaaggcaaggttttcagagtgagttcctctttgcccaaccatcaggttattcacacagccgacaaaccaaacaggtgtcatgagtgtgggaagaccgtgcgtgacaaatcaggtcttgctgagcattggagaattaggacaggggaaaagccctacaaatgtaaggagtgtggcaaattgtttaaccggatcgcctaccttgccaggcatgaaaaggttcacacaggagagtccccatacaagtgtaacgaatgcggcaaggtgttctccaggatcacctatctcgttagacaccagaaaattcataccagggaaaaaccccacaagtgcaacaagtgtggaaaggtctattcatcctccagctatctcgcccagcactggaggatccatacaggagagaaactgtataaatgtaataagtgtggtaaggagttttctgggcactcctccctgaccactcatctgctcatccacacaggtgagaagccttacaaatgtaaggagtgcgacaaggccttcagacataaattctcactgaccgtgcatcagcggaatcacaatggagaaaagccttataaatgtcatgagtgcggtaaagtcttcactcaagtgtctcatctggcccgacaccagaaaatacacactggggagaagccctacaaatgcaacgaatgtgggaaggttttcacacagaactcacatctcgccaaccaccagaggatccataccggtgaaaagccctataaatgtcacgtctgtgggttaagcctgtggtccgggaaagagtcggtgcggtag

SEQ ID NO: 22120 - DNA, 1407 bp, Artificial Sequence
  Description of Artificial Sequence: Synthetic coding sequence
atggcccagctgcggcggggccacctgaccttccgggacgtggccatcgagttttcacaggaggagtggaagtgtttagatcctgtccagaaggcactgtaccgtgatgtaatgctcgagaactaccgaaatcttgtttcattaggcatctgccttccggacctgagtattattagcatgatgaagcaacggaccgagccctggaccgtggagaatgagatgaaagtcgccaagaacccagaccgatgggaaggcattaaagatatcaacacgggaaggtcatgcgcggtccggtcaaaggcggggaataagcccattacaaaccagctcggcttaacgtttcagctccccctgcctgaacttgaaatctttcaaggcgagggcaaaatctacgaatgtaatcaagttcagaaattcatcagccacagttctagcgtgagtccactgcagagaatctattctggcgtcaaaacgcatatctttaacaaacaccggaatgatttcgtggattttcctttgctgagccaggaacagaaagctcacatccgacggaagccatacgagtgtaatgagcaggggaaagtgttccgagtgtcatcatcattgcccaaccaccaggttatccacacggcggataagcctaatcgatgccatgagtgcggaaagacagtacgggacaagtctgggctggctgagcactggcggatccggaccggcgagaaaccatacaaatgcaaggaatgcggaaaactgtttaacagaatagcatacttggctcgccacgaaaaggtgcacacaggggagagcccctataagtgtaatgagtgcggaaaagtgttctcccggattacatacctggtgcgccatcagaagatacacactagggaaaaaccccacaagtgcaataagtgtggcaaagtatactccagttcatcctacctcgctcaacactggaggattcacaccggagagaaactctacaagtgcaacaagtgtggtaaagagttttcagggcacagcagcttgacgacccatctcttaatccatacgggggaaaagccatacaaatgtaaggaatgcgataaggccttcagacataaattctcgctcaccgttcatcagcggaaccacaatggcgaaaaaccatataagtgccacgagtgcggaaaggtatttacccaggtctcgcatctcgcccgccaccagaaaattcacactggggaaaagccatacaagtgtaatgagtgcgggaaagtatttacgcaaaacagtcatctggccaatcaccagcggattcacactggtgaaaagccttataagtgccatgtgtgtgggaaggtattccgccacagctcttggttcgtccaacatcagagatcagtgcacgagcgtgttctaacaaactag

SEQ ID NO: 22121 - DNA, 1623 bp, Artificial Sequence
  Description of Artificial Sequence: Synthetic coding sequence
atggagcgggaggccctgccctggggcctggagccccaggacgtgcaaagctctgatgaaatgcggtcaccagaaggctatctccgaggcaatatgagtgagaacgaagaggaagaaatcagtcagcaggaggggtcaggggactatgaggtagaggagatcccattcggcttagagcctcagagtccaggttttgaaccccagtccccagagttcgaacctcagtccccacggtttgagccagagagcccaggattcgagtcaaggtcgcccggcctcgtcccgcctagccctgaattcgcgccgcgcagtcccgagtctgactcccagagccccgaatttgagtctcagagccctaggtatgaaccccagagcccagggtacgaacccaggtctcctggctacgagccgcgatcccctggatacgaatctgagtcttcgcggtacgaaagtcagaacaccgagttgaaaacacagagccctgagtttgaggcccagtctagtaaattccaggagggcgccgaaatgctcctcaatccagaagaaaaatcaccccttaacataagcgtaggcgtccaccctctcgacagtttcacccagggattcggggagcaaccaacgggcgacctacccatcggccctccgtttgaaatgccaaccggtgccttactgtccacgcctcaattcgagatgttacagaatcctctgggattgacgggagcgctccggggtcccggtcgcaggggaggaagagcacgtggcggccagggccctcgcccaaatatctgcggtatctgtggcaaatcatttgggagagggagcacgctcattcagcaccagcgtatacatactggggagaagccttataaatgtgaggtgtgctccaaggccttttcccaatccagcgatctaatcaagcaccagcgcacacataccggggagcggccttacaagtgcccccggtgtggcaaagcatttgcagattctagctacctccttcgccaccagcgaactcactcaggccagaaaccatataagtgtccgcactgcggcaaggccttcggcgattctagctacttattgagacaccagagaacacacagtcacgaaaggccctatagttgcaccgagtgcgggaaatgctattcacagaatagtagcctgcgcagccatcagagagtccacactggacagaggcccttttcctgcgggatttgtgggaagagtttctcccaaagatcagctctgattccccatgcacgaagtcatgcacgagagaagccctttaaatgcccagagtgcggaaaacgctttggccagagctccgtgctcgccatacatgcccgaacccatttgccgggacgcacttacagctgccctgattgcggtaagacctttaacaggagttcaacgctcatccagcaccagcggtctcacacgggagaacggccttacagatgcgccgtatgtggcaagggcttttgcaggtcatcaacgctgctccaacatcaccgcgtacatagtggggaacgcccttacaagtgcgacgattgcggtaaagccttctcacaaagcagtgatttgattcggcaccagcgcactcacgccgccgggagacgatag

SEQ ID NO: 22122 - DNA, 1362 bp, Artificial Sequence
  Description of Artificial Sequence: Synthetic coding sequence
atgagcgagaacgaggaggaggagatcagccagcaggagggcagcggggactacgaagttgaggagattcccttcggactggaaccccagtctcccggtttcgaacctcagtctccagaatttgaaccccagtctcccaggttcgagcctgagagcccagggttcgagagtaggagtcctggactcgtgccccctagtcctgagttcgcccccagaagtcctgagtctgactctcagagtccggagttcgaatctcaatctcctcgttatgaaccacagagcccgggctatgagccgcgtagccccggctatgagccccgctctccagggtatgagagcgagtcctctaggtatgagagccagaacaccgagctgaaaactcagagtcctgagttcgaggcgcagagcagtaagttccaggaaggcgccgagatgttgcttaatcccgaagagaagagtcctctgaatatctctgtgggcgtgcatcccctggactcattcactcagggtttcggcgagcagcctacaggtgacctgccaattggccctccattcgaaatgcccactggagcgctgttatcgactcctcagttcgagatgttacaaaacccgcttgggctgaccggagctctgagaggacctggacgcagaggcggtcgcgccaggggcggtcagggaccccgtcctaatatctgtggtatttgtggaaagagcttcggcagagggagtacactcattcagcaccagcgaactcactctggccaaaagccatataagtgtccacattgcggcaaagccttcggtgattctagctacttgctcaggcaccagcggactcactcccatgagcgcccttactcttgtaccgagtgtggcaagtgttactcccagaattccagcttgcgcagtcaccaacgtgtgcacacaggccagcgcccgttctcatgcgggatttgtggcaaatccttttcccagcgcagtgccctcataccccatgcaagatcgcatgctagggagaaacccttcaagtgcccggaatgcggtaagcgattcggccagtctagtgtgttagctatccacgccagaacgcacctgcctggcaggacgtattcttgcccagattgcggcaagaccttcaatcgatccagcactctcatccagcaccagagatcccatactggggagagaccttatcgctgcgccgtgtgcggcaagggtttttgccgctcatccaccctactacagcatcatagggttcattcaggggagcggccgtacaagtgtgatgattgcggcaaggcgttttcacagagctccgatttgatcaggcatcagagaacacacgctgccggtcgaagatag

SEQ ID NO: 22123 - DNA, 2076 bp, Artificial Sequence
  Description of Artificial Sequence: Synthetic coding sequence
atgatggccgagaacaacctgaagatgctgaagatccagcagtgcgtggtcgccaataagctgccacggaatagaccttatgtgtgtaatatctgctttaagcactttgaaacacccagtaaactggccagacactatttgattcacactgggcagaaacccttcgaatgtgatgtgtgccataagacattcagacaactcgtccacctcgagaggcaccagctgacccattccctgccctttaagtgttctatatgccagcgacatttcaagaacctgaaaacgttcgttaagcaccagcagctgcataatgaaacttaccaaaataatgtgaaacaggtgcggagacttctggaagcaaagcaggagaaaagtatgtatggggtttacaacacctttaccactgaagagagatgggccctgcacccatgttccaagagtgaccccatgtacagcatgaaacgtcggaagaacatccacgcgtgcacgatctgcggcaaaatgtttcccagccaaagcaaactcgatcgccatgtgctaatacatacaggtcagcgccctttcaagtgcgtcctatgcactaaatccttcaggcagtcaacacacctgaaaatccaccagttgacacactccgaggaaaggcctttccagtgctgcttctgccagaaagggttcaagatacaaagtaagctgctgaagcataagcagattcatacccgtaacaaggctttcagagccctgctcttaaagaaaagaagaaccgagtccaggcctcttccaaataagctgaatgccaaccaaggaggatttgaaaatggggaaatcggggaatctgaggaaaacaaccccctagacgtgcactctatctacatcgttccgtttcagtgcccgaaatgtgaaaaatgctttgagtcagaacaaatcttaaacgagcattcttgtttcgcagccaggagcggaaaaatacccagcagatttaagagaagttacaattacaagaccatcgtcaagaaaatactggctaagctaaagcgcgcccgtagtaagaaactggataatttccagagcgagaagaaggtgttcaagaagtccttcctgaggaactgtgatttaattagcggcgagcagagctccgaacagactcaaagaacctttgtcggcagcctgggtaaacacgggacctacaaaaccatagggaaccggaaaaaaaagacgctgaccttgcctttttcctggcaaaatatgggcaagaatctaaaagggattttgactacagagaacattctaagtatagacaattcggtaaacaagaaagacctctctatctgtgggagtagtggcgaagagttcttcaataattgcgaggtgctgcaatgcggtttctccgtcccacgcgaaaatatcagaaccaggcataagatctgtccatgtgacaagtgcgagaaagtgtttccatctatctctaaacttaagcgccactaccttatacatacggggcagcggccctttggttgcaacatctgtggaaaaagttttcgccagtccgcccatctgaaacggcatgagcaaacccacaatgagaagagtccgtatgcttcactgtgtcaagttgagtttggcaactttaataaccttagcaatcattctggaaacaatgtcaactacaatgcgtcccaacaatgccaagctccaggtgttcagaagtacgaagtatcagaatccgaccaaatgagcggggtgaaggcagagtcacaggacttcatccccggtagcactggccaaccgtgtttgccaaatgtgctgttggaaagtgaacagtctaaccccttttgctcctacagcgagcaccaggagaagaacgatgtgttcctgtatcgctgcagcgtgtgcgccaaatcatttcgctctcccagcaaattggagagacactatttaatccacgctggccaaaagcccttcgagtgctccgtatgcggaaaaacatttcgccaagctcctcattggaaacgccatcagctgacccactttaaggaacgaccgcaggggaaagtggtcgctctggattccgtcatgtag

SEQ ID NO: 22124 - DNA, 399 bp, Artificial Sequence
  Description of Artificial Sequence: Synthetic coding sequence
atgatggccgagaacaacctgaagatgctgaagatccagcagtgcgttgtcgccaacaagctgccgcgaaaccgtccctacgtctgcaacatctgtttcaagcacttcgagacacccagcaagcttgccagacattatcttatccacactgggcaaaagccgtttgagtgtgatgtttgccacaaaacctttcggcagctggtacacctggagagacatcagctgacacatagcctccctttcaagtgtagtatatgccagagacactttaagaatttgaagacttttgtcaagcatcagcaactccacaacgagacataccaaaataatgtgaagcaagtcagaaggctgctggaagccaaacaagagaaatcaatgtacggagtgtacaacacttag

SEQ ID NO: 22125 - DNA, 954 bp, Artificial Sequence
  Description of Artificial Sequence: Synthetic coding sequence
atgcccggcgagcagcaggccgaggaggaggaggaggaggagatgcaggaagagatggtgctcctggtgaagggagaggaggatgaaggtgaagagaaatatgaggtggtgaagctgaagattccaatggacaacaaggaggtgcccggcgaagccccagccccatctgctgaccctgctagacctcacgcatgtcccgattgtggccgagcctttgcacgacggtccacactggccaaacacgcccgaacccatacaggagagagaccattcgggtgtaccgagtgtgggagaaggttttcacaaaagtctgccctgaccaaacacggccgcacccacaccggcgagagaccatacgaatgtccagagtgtgataaacggttcagtgctgcaagcaatttaagacaacaccgtaggcgccacaccggggagaagccttacgcgtgtgcccactgcggtcgcagatttgctcaaagctcaaactatgcccagcatctgagggttcatacaggggaaaagccctacgcatgcccagactgtggaagggcttttggtgggtcatcctgtcttgccaggcaccgaaggacccacaccggcgaaagaccctatgcctgtgctgattgtggtactcggtttgcacagtcttcagccctggccaagcaccggcgggttcacactggcgagaaaccacatagatgtgctgtatgcggtagaaggtttggccacagaagtaacctggcagaacacgctcggacccacaccggagaacgaccatacccctgtgccgagtgcggacgaaggttcagactgagtagccattttatccgccatcgcagggctcatatgaggcggcgcctatacatttgcgccggatgcggccgtgattttaagctgcctcccggagcaactgccgcgactgccacagagcgatgtcccgagtgtgaagggagctag

SEQ ID NO: 22126 - DNA, 954 bp, Artificial Sequence
  Description of Artificial Sequence: Synthetic coding sequence
atgcccggcgagcagcaggccgaggaggaggaggaggaggagatgcaagaagagatggtgcttctggtcaagggtgaggaggacgagggagaggagaaatacgaggtagtgaagctcaaaatccccatggacaataaagaggtgcccggcgaagcccctgccccaagcgctgacccagctaggcctcacgcatgtccagattgtggaagggcctttgccagaagaagcacactcgccaaacatgcaagaacacacactggtgaaaggcctttcggatgtaccgagtgtggcaggcgctttagccagaaatccgcactcactaagcacggaagaacccatacgggcgaaaggccatatgaatgcccggaatgcgataaaaggttttctgcagcctctaacctgcggcagcatcgtcgccgccataccggcgagaaaccatacgcatgcgcccattgcgggcggcgtttcgctcagagctcgaactacgctcagcatttgcgtgtgcacacaggggagaagccctatgcctgccctgactgtggacgcgccttcggaggtagttcctgcctggctcggcaccggaggacacataccggcgaacgtccctacgcctgtgctgactgcggcactcgtttcgcccagtcatctgctctcgccaagcatcgtcgcgttcacaccggcgagaaaccccacaggtgcgcagtttgtggacgacgattcggacaccgaagtaatttggcagaacacgctcgaacccacacgggtgaaagaccctatccctgtgccgagtgtgggaggcgatttaggctgagctctcacttcataagacacaggcgtgcgcacatgcgaagacggttatacatctgcgcggggtgcggccgggatttcaagctgccccctggggccacagcagccacagctacagagcggtgtccagaatgcgaggggtcctag

SEQ ID NO: 22127 - DNA, 1245 bp, Artificial Sequence
  Description of Artificial Sequence: Synthetic coding sequence
atgaacagcgaggtgatcgtggaccccatccagggccaggtgaacttcgaggacgtgtttgtgtatttctcgcaggaagaatgggtgctgctcgatgaagcccagcgcctcctgtaccgcgatgtgatgctcgaaaattttgcactcatggcatctctgggccatacctctttcatgagccacatcgttgcgtcgttggtgatgggctcagaaccatgggtgccggattgggtggatatgacgttagccgtggccacggggtgctggcatgggatggaagacgaggagattccatttgagcagtccttttcaattggtatattctcggcgaatctgcaccagcaccaaaagcagcactccggcgagaaaccttttaggtccgataaaagcaggcctttcttgctgaataattgtgctgttcaatccatggagatgtcctttgtgacaggggaggcatgcaaggacttcctagcctcaagcagcatctttgagcaccacgccccgcataatgagtggaagccgcattccaataccaagtgtgaagaggcgtctcattgcggcaagagacactataagtgttccgaatgtggcaaaaccttttcacggaaggactctctggtccagcaccagagagtgcacacaggtgagcggccctacgagtgtggagaatgcggaaaaaccttctcgcgaaagcccatcttggcccagcaccagcggatacataccggggagatgccgtacgagtgtggaatttgcggcaaggtatttaaccatagtagcaacttgattgtacaccagcgtgtgcacaccggggctagaccttataaatgttccgagtgcgggaaagcgtacagccataagtccacacttgttcagcacgagtctattcacacaggagagcggccatacgagtgctctgagtgcggcaaatatttcgggcacaaataccggctgatcaagcattggtcagtgcatactggggcccggccatacgagtgcattgcttgcggaaaattttttagccagtcgtcagacctgatagcccaccagcgtgtgcacaatggagagaaaccttacgtgtgctcggagtgcggtaaggcgttcagccacaaacatgtcctggtgcagcatcacaggatccataccggagagaggccatacaagtgttccgaatgtgggaaggcgttcagacaacgggcctctctgatccgtcactggaagatccacaccggagagagaccttag

SEQ ID NO: 22128 - DNA, 735 bp, Artificial Sequence
  Description of Artificial Sequence: Synthetic coding sequence
atggccgccgccgagcccatgggccccgcccagggccaggtgaacttcgaagatgtgtttgtgtattttagccaggaagagtgggtgctccttgatgaagctcagagactcttgtatagagatgtaatgctggaaaattttgctctcatggcctcgctgggctgctggcacggaatggaagacgaggagatccctttcgagcagtcattcagcattggtatgtcgcagatcaggatccctaagggcggcccgagcacccagaaagcctacccgtgtgggacctgtggactggtgctgaaggatatcctccacctcgccgaacatcaagagacacatcccggtcagaagccatatatgtgtgttttgtgcggcaaacaattctgcttcagtgccaatctccatcaacaccagaagcagcattccggtgagaaaccatttcgaagtgacaagtctcgtccgtttctgctgaacaattgcgctgtacaatcaatggaaatgtcttttgtgaccggtgaggcatgcaaagatttcctggcaagcagttcgatctttgaacatcatgctccacacaatgaatggaaaccacactccaataccaaatgcgaggaggctagccattgcggaaaaagacattacaagtgctcagagtgcgaaaaaaccgctgccaactatagagagtatgatcccagtaagggaaccagcacttgtgtgtctatcacactggctcccctgtag

SEQ ID NO: 22129 - DNA, 1470 bp, Artificial Sequence
  Description of Artificial Sequence: Synthetic coding sequence
atggccgccgccgagcccatgggccccgcccaggtgcccatgaacagcgaagtgattgttgatcccatccagggccaggtgaacttcgaggatgttttcgtatattttagccaggaggaatgggtactgctggacgaggcccagagacttctgtatcgggacgttatgttagaaaactttgccctgatggcctcattggggcacacctctttcatgtcacatatcgtcgcctcactcgtcatgggctccgagccgtgggttccagattgggtagacatgaccctggccgtcgctactgaaacaccagggggcagcgacccaggctgctggcacggtatggaggatgaggaaatcccattcgaacagtccttcagtatcggaatgtctcagatcagaatcccaaaagggggaccctccacccagaaggcctacccgtgcggtacatgcggcctggtcttaaaagacatcttgcatctagctgaacaccaggagacacaccctggccagaagccttatatgtgcgtgctctgtggaaagcagttctgcttcagcgcaaacctgcaccaacaccagaagcaacacagcggtgagaagccattcagatctgataaaagccggccattccttctgaacaactgcgcagtgcagagtatggaaatgtcttttgtgaccggagaggcctgcaaggactttttagccagttcttccatcttcgagcatcatgcccctcataacgaatggaaaccgcactccaacaccaagtgtgaggaggcaagtcactgtggcaagcgccattacaaatgttctgagtgcggcaagacgtttagtagaaaggactctctcgttcagcaccagagagtgcatacaggggagcgtccatacgagtgtggcgaatgcggtaagacttttagcagaaagcctatcttggcccagcaccagagaatacacacaggcgagatgccctacgagtgtggaatctgcggcaaagtgttcaaccactccagcaatctgattgttcaccaacgggtgcacacgggcgccagaccctataaatgctcggagtgtggaaaagcctactcacacaagagcacactagtgcagcacgagagcattcataccggcgagcgcccctacgagtgctcggaatgtggcaagtacttcggccataaataccgcctgatcaagcactggagtgtccatacaggcgccagaccgtacgagtgcatcgcctgtggtaaattcttttcgcagagctcggatctcatcgcccaccagcgagttcataatggcgagaagccttatgtgtgctccgaatgtggcaaggccttctcccataagcacgtactggtgcagcatcatagaattcatacgggtgaacgaccttacaaatgctccgaatgcggcaaagcgttccggcagcgggcaagtctgatccggcactggaagattcacacaggcgagaggccatag

SEQ ID NO: 22130 - DNA, 1347 bp, Artificial Sequence
  Description of Artificial Sequence: Synthetic coding sequence
atggccgccgccgagcccatgggccccgcccaggtgcccatgaacagtgaagtgattgtggatcccatccagggtcaggtcaattttgaagatgtattcgtctatttttctcaggaggagtgggtgctcctcgatgaggcacaacggcttctatatcgggacgtcatgctggagaatttcgctcttatggcgtctctaggctgctggcacgggatggaagacgaggaaatccccttcgagcaaagtttttcaatcggcatgagtcaaattcgcatccccaaaggtgggccctcaacgcagaaagcgtatccttgtggaacttgtgggcttgtgttgaaggacattctgcatctggccgaacatcaggaaacccacccaggtcagaaaccatacatgtgtgtcctatgtggcaaacagttctgtttcagcgccaacctacaccaacaccagaaacaacatagtggggaaaagcccttcagaagcgataagagccgaccctttctcctgaacaactgtgctgtgcagtccatggaaatgtcgttcgttacgggggaggcctgcaaagactttttagcctctagttctatctttgaacatcacgcccctcacaacgaatggaaaccacacagcaacaccaaatgtgaagaagcctctcattgcgggaaacgccactacaagtgctcagaatgcggcaagacatttagtaggaaggacagccttgtccagcatcagcgagttcataccggtgagagaccctacgagtgcggggagtgtggaaagaccttttcccgcaaaccaattctcgcccagcaccaaagaatccataccggcgaaatgccatacgagtgcggcatctgcggcaaggtatttaatcatagctccaacctgatcgtgcaccagcgcgtgcatacgggcgccaggccctacaagtgctccgagtgcggaaaggcctattctcataaaagcacccttgtgcagcatgagtccatacatacgggggagcgcccttacgagtgctccgagtgcggcaagtactttggacacaagtacagactgataaagcattggtctgtccacaccggtgcgcgcccttatgagtgtattgcctgcggaaagtttttctctcagagtagcgacctcatcgcccaccagcgtgttcacaatggtgaaaaaccgtatgtgtgcagcgagtgcggcaaagccttttcccataaacacgtcctggtccaacatcacagaattcacaccggagaacgaccatacaaatgcagcgaatgcggaaaggctttccgtcagagggcctccctcattagacattggaagatccatactggtgaacgaccttag

SEQ ID NO: 22131 - DNA, 1134 bp, Artificial Sequence
  Description of Artificial Sequence: Synthetic coding sequence
atggaggacgaggagatccccttcgagcagagcttcagcatcggcatgagtcaaatccgcattccaaaagggggcccaagcacacagaaggcctacccttgtggcacatgcggcttagtcctgaaagatatactacatctggccgagcaccaggagactcatcctggccagaaaccgtacatgtgtgtgctgtgcggcaagcagttttgttttagtgcaaatttgcatcagcaccagaagcagcatagtggcgagaagccttttcgttcagataaaagtagaccattcctgctgaacaactgcgcagttcagtcaatggagatgtccttcgtgaccggagaagcctgtaaggacttccttgctagttcctccatcttcgagcatcacgccccgcacaatgagtggaagccacactcaaatacaaaatgtgaggaagccagccactgtggaaaacgccattataagtgctctgagtgcggcaagacattctcccgcaaggacagtttagttcagcaccaacgagtccatactggcgaacggccttatgagtgcggcgaatgtgggaagacattttccaggaaaccaattctggcccagcatcagaggatccacacaggggaaatgccatatgagtgcgggatttgcggcaaggtgttcaatcacagttcaaatctgattgtccatcagagagtacatactggcgctcgtccctacaaatgctcagagtgtggcaaggcttacagccataaatctacattagtgcagcacgagagcattcatacaggcgagagaccttacgaatgcagtgaatgtggaaaatactttggccataagtatcgactgatcaaacattggagtgtgcacacaggggctcgcccctacgagtgcatagcctgtggaaagtttttttcccagtcatctgaccttatcgctcatcagcgcgtccacaatggcgagaagccatatgtctgtagcgaatgcggaaaggccttcagtcataaacatgtcctggtccagcatcaccgtattcacactggggagcggccatataagtgcagcgaatgcggcaaggctttccgccagcgtgcgtccctgatcagacactggaaaatccacactggcgagagaccctag

SEQ ID NO: 22132 - DNA, 1329 bp, Artificial Sequence
  Description of Artificial Sequence: Synthetic coding sequence
atggccgccgccaccctgcgggaccccgcccagcagggctacgtgacttttgaagacgtcgccgtctacttcagtcaggaagaatggagactgcttgacgatgctcagcgccttctgtaccggaacgtaatgctggaaaactttacactactggcctccctcggactggcctcgagcaaaactcacgagataacacaattggaatcatgggaggaacctttcatgccggcgtgggaggtggtgacctctgcgattctgaggggatcgtggcagggggctaaagcagaggccgcggcagagcagagcgcgagcgtggaggttccctcttccaacgtacaacagcatcaaaaacaacattgcggggagaagcctctgaagaggcaggagggtcgggtccctgtcctgcgaagctgtagggtgcatctctccgaaaaatcactgcagagcagagaggtgggtaaagacttgctcacatcttctggggtcttgaagcaccaggttacccatactggcgaaaagtcacatcgctcgtctaaatcgcgggaggcattccacgcaggaaagaggcactataagtgctctgaatgtggtaaggccttcgggcagaaataccttcttgtgcagcaccagagactgcatacaggcgagaaaccgtatgaatgcagtgagtgcggcaaactgttttcacacaagtctaatctcttcattcaccaaatcgtgcataccggagaaagaccatatggctgttcagactgcggcaagtccttctctcgtaacgctgatttaatacaacatcagcgggtccataccggagagaagccgtttacctgctcagaatgcggtaaagccttccgacacaatagcaccctggtgcagcaccaccgcattcatacaggagttcggccttatgaatgttctgagtgtggcaagctgtttagcttcaactcatcacttatgaagcatcaacgggtacatactggggaacggccctacaagtgtagcgagtgcgggaagttctatagtcataagagctctctgatcaatcattggagagtacacactggtgagaggccttatgagtgctcagagtgcgggaaatttttctctcaaagctcaagtctgatgcagcaccggaaagtacatactggagagaagccttttaagtgtaacgaatgtgggcggttctttagcgaaaattcatccttggtgaagcaccagagggtgcacactggcgcaaagccttacgagtgccgggagtgcggcaagtttttccgacatagcagcagcctagttaaacaccgtcgtatccatacaggcgagattcagtag

SEQ ID NO: 22133 - DNA, 423 bp, Artificial Sequence
  Description of Artificial Sequence: Synthetic coding sequence
ggcagcgtggccgccccccgggtggcccgggccctgagcagcgtggtggtatcccccccccaagcccccatggctgctgcaacgctaagggatcctgcacaacagggatatgtcacatttgaggacgtcgcggtgtacttcagtcaggaggaatggcgactccttgatgatgctcagcggcttctctaccggaacgtgatgctggaaaacttcacccttctcgcctccttgggtctggcctccagcaaaactcacgagatcacacagctggagtcttgggaagaacccttcatgccggcctgggaggtggtgacctccgctatactcagggtgtggcttagaaatagatcggcgaaccttctgactcagattttttttcctaatcggcagcctcaggttgccccggagcaaggcagggaatag

SEQ ID NO: 22134 - DNA, 1452 bp, Artificial Sequence
  Description of Artificial Sequence: Synthetic coding sequence
atgtggctgggcaccagcggcaagagcggcctgcccggccactgcctggagaatcccttacaggagtgccatcccgctcagctggaggagtgggcgctgaaaggcatctcccggccatccgtgatcagccaacctgaacagaaagaagagccctgggtgctacctctgcagaattttgaagctcgaaaaatccccagggaaagtcacacagactgcgagcaccaggttgcgaagctaaatcaagataattcagagacagccgaacaatgtggaaccagttctgagcgtactaataaagacctgagtcacactctatcctggggaggtaactgggagcagggtctggagcttgagggccaacatggcacactccctggcgaaggccaactcgaatccttcagccaggaaagggatctgaataaacttctcgatggctatgtcggcgagaagcccatgtgtgcggaatgcggcaagtcgtttaatcagtcttcgtacctcatcaggcaccttcggacacatactggcgagagaccctacacctgtattgaatgcggcaagggattcaagcagtcctctgacctggttacccaccgaaggactcacacaggggaaaaaccctaccaatgtaaaggatgtgagaaaaagttcagtgactccagtacgcttatcaaacaccagcgtactcacaccggcgagaggccctatgaatgccccgaatgcggcaaaacctttggccgaaaaccacacctgatcatgcaccagcggacccataccggggagaagccctatgcgtgtttagagtgccataaatcattttctaggtctagtaacttcattacacatcagcgcacacatacaggtgtaaagccttacagatgcaatgattgcggtgaaagcttctcacagagtagtgacttaatcaagcatcagcgcacacatacaggcgagcggcccttcaaatgtccagagtgcgggaaaggatttagagatagctcgcatttcgttgcacatatgtcaacgcactcgggtgagagacccttcagttgtccagattgccacaagtcattctctcagtccagccacctggtgacccaccagagaacccacacaggcgagcgaccatttaagtgtgaaaattgtgggaaaggctttgctgactcctccgccttgataaaacaccaacgcatccacactggcgagaggccgtacaagtgcggtgaatgcggtaagtcctttaaccagagctctcacttcataacacatcagaggatccaccttggtgatagaccttatcggtgtcctgaatgcggcaagactttcaatcaacggagccacttcctgactcaccaacgtactcatacaggggaaaaaccattccactgctctaagtgtaataaatctttcagacaaaaggcacacctactatgtcatcagaatacacatctgatctag

SEQ ID NO: 22135 - DNA, 240 bp, Artificial Sequence
  Description of Artificial Sequence: Synthetic coding sequence
atgtggctgggcaccagcggcaagagcggcctgcccggccactgcttagaaaatccactgcaggagtgtcatcccgcacagctggaagagtgggctttgaaaggtatttctcggcctagcgtcataagccagccagaacagaaggaagagccttgggtgctgcccttacaaaactttgaggcaaggaagattcctcgagaaagccacacggattgcgagcaccaggtcgcaaaactgtag

SEQ ID NO: 22136 - DNA, 1614 bp, Artificial Sequence
  Description of Artificial Sequence: Synthetic coding sequence
atggagagcggcctggccggcaacggcaccggcgccggcctggtgatgaaagttaagcaagaaaagcctgagagacttctacagactctcgctccccaggccatgttggtggaaaaggataaggaaaatatcttccaacagcaccgtgggttgccccccaggcaaaccatggggcggccaagagccctgggcggccaagaagaaagtggaagtccgagatgggcgccgcccaccgaacaggatgctggcctggcaggtcgagcaccgggttccgctagcggcccattaagcccaagcctgtctagcggcgagggccactttgtgtgtctggactgcgggaagcgatttagttggtggagctctctgaagattcatcaaagaacccacactggtgaaaagccatacttatgtggaaagtgcggcaaaagttttagccaaaagcccaatctggctaggcaccagcgacatcacaccggagaaaggcccttttgctgccccgaatgcgctagacgcttcagccagaaacagcacctgctcaagcatcagaagacacacagtcgccccgccactcattcgtgccccgagtgtgaaagatgtttccggcaccaggtggggctcagaatccaccagcgcgctcatgctcgtgatcgccagggttctcgagcaggactgcatgagttaattcaagatgctgcggcccgaagggcctgtagactgcaacctggtcccccccgcggaagacccgaatgggcctggcttgggttatgtcagggttggtggggtcagcctggtgcgagggccgctgtgtcgggacctgaagggcctggcgagcccaggcagttcatctgtaacgaatgcggcaagtcctttacatggtggtcttctctgaacattcaccagcgaatccacaccggggagagaccatacgcgtgccctgaatgcggcagacggttttcgcagaaacctaatctgacaagacatctgcggaatcacacaggagagagaccccatccttgtccccactgtggccgcggtttccgtcagaagcagcacctgctgaaacatttacgaacacatctacccggcgctcaagcggccccatgtccttcctgcggtaaatcgtgtcggtcacgcgccgcgctccgggcccatcagcgggcccacgccgtagctgaaccagccgtgcctgcgggggaacctggggaccaaccacaggcagaggcgattccaggcttagcggcaagaccaagatccagccagagaagtccaggggctcgtgacactctgtggggcaggggacaggccggccttgcaggccctggagaaccccggcagtttatttgtaacgagtgtggtaagagttttagctggtggtcagctttaaccattcatcagcggatccacacaggtgagagaccgtacccttgtccggagtgcggccgtcgcttttcccagaaaccaaaccttacacgacatcgtagaaatcatactggagagcgcccatatctgtgtccggcctgtggtcgggggttttctcagaaacagcatttactcaagcaccaacgtgtccatcgggctgctcccgcttgctcccctaaagaggaggcacgctag

SEQ ID NO: 22137 - DNA, 435 bp, Artificial Sequence
  Description of Artificial Sequence: Synthetic coding sequence
atggagagcggcctggccggcaacggcaccggcgccggcctggtgatgaaagtgaagcaagagaagcccgaacggctcctgcagacactcgctcctcaggcgatgctggtagaaaaggataaagagaacatctttcagcagcacaggggattacccccccgacagactatggggaggccaagagccctgggagggcaagaagaatcaggatcccccagatgggcccccccgactgaacaagatgccggtctggctggacgcgctccggggagcgcgtccggtcctctgtcacccagtctgtcatccggagagggacattttgtgtgtcttgactgtggtaaacggttctcttggtggtcatctttaaaaatccaccagcgtactcacactggcgagaaaccttacctgtgcggcaaatgtggtaaaagcttctag

SEQ ID NO: 22138 - DNA, 501 bp, Artificial Sequence
  Description of Artificial Sequence: Synthetic coding sequence
atggagagcggcctggccggcaacggcaccggcgccggcctggtgatgaaggttaaacaggagaaaccggagcggctccttcagacattagccccgcaggcaatgctcgtagagaaggacaaagagaacatatttcagcagcaccgaggactgccaccccgccagacaatgggcaggccacgggcactaggcggccaggaagagtctggctctcctcgctgggctccgcctaccgaacaagatgccggcctcgctggcagagccccaggcagcgccagcggacccctctctccctcactctcgagtggtgagggccatttcgtgtgcctggattgtggaaaacggttcagctggtggtctagtcttaaaatccaccagcgaactcacactggcgagaaaccatacctgtgtggcaagtgcgggaaaagtttcagtcagaaaccgaacttggctaggcaccaacgtcatcatactggtgaacggcctttctgctgcccatag

SEQ ID NO: 22139 - DNA, 1557 bp, Artificial Sequence
  Description of Artificial Sequence: Synthetic coding sequence
atggccgccgccgccctgcggccccccgcccagggcaccgtgacctttgaagacgtggctgtgaacttctcgcaggaagaatggtcacttctgtccgaggcccaacgttgcctataccacgacgtgatgctggagaaccttacgctaataagctctctggggtgttggtacggggccaaggacgaaactccaagcaaacagactctaagcattcagcaggaaagtccattaaggacacattggactggtgtgtgcactaagaaagtgcatctgtggggcatgtgcggcccccttttgggagatatcttacaccagggcactcaacataatcaaaagcttaacgggttcggcgcctacgaaaaaaagttggacgacgatgccaaccaccatcaggaccagaaacaacacatcggggaaaagtcttataggtctaatgcaaaaggcacgtctttcgtgaaaaattgtaaattccacatgtcacacgagccattcatcttccacgaggtgggtaaagatttcctgtcaagcttacgactcctacagcaggaggatatccatactagtggcaaatccaattttgagacaaaacatggcatccctttacaggggggaaaaactcactatatctgcggagagagcaccattcccttctcaaacaagcactccttagtactccaccaaagactgctgcctagagagggtccttatgtgtgtagcgattcaggcaagtttacaagcaagtctaattctttcaacaatcaccaaggcgttcgcaccggaaaaaggccttatcagtgcggacagtgtgacgaatctttttggtacaaagcacatctgaccgaacatcagagggttcacaccggagagaggccatacgagtgcggtgagtgcgataaatccttctcccataagcacagcctcgtcgaccatcagcgagtgcataccggcgagcggccctatgaatgcgacgaatgtggaaagagcttcagtcataagagatccctcgttcaccaccagcgggtccacactggagagcggccttaccagtgcggagaatgtggaaagtcctttaaccacaagtgtaatctgatacagcaccagcgggtgcacaccggggaaagaccttttgagtgcacggcatgcggaaagcttttcaggtccaactcacacctgaaggagcaccagagagtgcacacaggagagcgcccgtacgagtgtaaggaatgtaggaaatcctttaggtataaaagccacctcacggagcaccaacgcgtgcacacaggtgaacgtccttatgagtgcagagaatgtgggaagtgctttcaccagaagggctcacttattcagcaccaacaaatccactccggagagagaccgcatgagtgcggtgaatgtggcaagtgttttcatcagaaagggagcctcatcagacatcagcagatccattccggtgaaaggccacacgaatgtggagagtgtggaaagtgttttagacagaaagggaatctgatcaagcatcagcgcgtccacaccggtgaacgccatcacgaatgctag

SEQ ID NO: 22140 - DNA, 2064 bp, Artificial Sequence
  Description of Artificial Sequence: Synthetic coding sequence
atgctggagaactacgagaacctggccagcgtgggccaccacctgttccagcccagtgttatctattggctcgaacaagaagaagaattacgggcagggcgacgcgcggtgcttcaggagtggcggctgaaaacaaaaggacctgcccttcggcaggatcggagctggttccgggcatcaaatgagacacagactgcgcgaagccacaacggcggccaactctgtgacaggacccagtgtggggaggcgttctcagagcactccgggctgtccactcatgtgcgaactcaaaatacaggggattcctgcgtatctaaccattatgaacgggacttttttatcccatgccagaagacgctgttcaagattggagagcagttttctgtcttggggcagtgtggaaaggccttttcatccactccaaatgtggttagtcagcaggcctgcaccagagacagaagcctggattacagcagctgtggggaagtcttcctgaaccagagttatctacaagctagagctggttctcacaatggggaagagacctggaaatggaaaccctgcggcaaagcgctcactcattccatggggtgcgcaacgcctgttgagatgcacgcagtgaggaacccccatgtttgtcgtgagtgtgggaaggctttccgctatactgcatatcttaccgggagagtccaggttcatcccggcgaaaagccctgtgaacttgaggaatgcggcaaggcaagtcctgtcagtagttcactcactcaacatgttcgaatccatgccgctgaaaagccgtgtgaatgcaaggagtgtgggaaagcatttaccgggctgagcggactaagtaagcacgtccaaacagatcctggtcaaaaaccctatgaatgcaaagattgtggtaaagcctgtggcgggttttatcttttgaatgagcacggaaagactcatactcgcgagaaaccattcgcatgcgtggtttgcggtaagtactttcgaaattcttcatgccttaataatcatgttcgtatacacaccggcattaaaccctacacatgctcctattgtgggaaagcctttaccgtacgctgtggccttacccggcatgtgcgcacccacactggcgaaaagccctatacatgtaaagactgcggaaaggcattctgtacatcgagtggcctgactgaacacgtacggacccatacaggtgaaaaaccttatgaatgtaaagactgtggcaagagctttacagtgagttcctcgctgactgaacacgcaaggattcacaccggagaaaagccatacgaatgcaagcagtgtggtaaggcttttaccggaagatccggactgacaaagcatatgcgcactcacacaggagaaaagccttacgaatgcaaagattgcggtaaggcgtataaccgggtgtatctattaaatgaacatgtcaagacgcacactgaggagaagccgttcatttgtaccgtctgcaggaagtccttcagaaactctagttgtctgaacaagcacattcagattcatacaggaatcaagccttatgagtgtaaagattgtggaaagaccttcaccgtcagctcatcacttacagagcatatccggacacacacaggagaaaagccttacgaatgcaaggtttgtggtaaagcattcactacctcctcccatttaatcgtacacatcagaacccataccggcgaaaagccctatatctgcaaagagtgtggaaaggccttcgcaagttcaagccatctgatcgaacaccgcagaacacatacaggtgaaaaaccctatatttgcaacgaatgcgggaaggctttcagagcttccagccatttgcacaagcatggccgtatccatacgggacagaaaccctacaagtgcaaagagtgtgggaaagcttacaaccgcttctatctgctcaaagaacatctgaagacctatacagaggagcaagtgttcgtctgcaaggattgcggtaagtctttcaaaaacagctcttgcctgaaccatcatacgcagattcatactgacgagaaacccttctag

SEQ ID NO: 22141 - DNA, 2190 bp, Artificial Sequence
  Description of Artificial Sequence: Synthetic coding sequence
atggccgcccccgacctggcccacggcggccacgtgagccgggactcagtatgcttgcacgaggagcaaacacaggccgctggtatggttgccgggtggttgattaactgctatcaggatgccgtgaccttcgatgacgtagcagtcgattttacccaggaagaatggacccttctggacccctctcagcgagacctctaccgggacgtgatgttggagaactacgagaacttagcgagcgtggaatggcgtctgaagactaaaggccccgctttgagacaggatagatcctggtttagggcaagcaatgagacacagaccgcccgcagccacaacgggggacagctgtgtgaccgcacacagtgcggtgaagcctttagcgagcattctggactgtccactcacgtgcgcacacagaatacaggtgacagctgtgtgtctaaccattatgaacgggatttttttattccatgtcagaagaccttgtttaaaattggggagcagttctcagtactggggcagtgcgggaaggctttttcgagcactccgaatgtggtgagccagcaggcatgtacaagagatcgaagtcttgactatagttcctgcggcgaggttttcctaaatcagtcctacctgcaggcccgggcaggctcacacaacggggaagaaacctggaaatggaagccatgcgggaaagccctgacacacagcatggggtgtgcgacccccgttgaaatgcatgctgtgcgaaacccacatgtttgcagggaatgtggcaaggcttttaggtataccgcgtaccttacgggacgcgtgcaagtccatccaggcgagaagccatgtgaactcgaggagtgtggtaaagcaagtcccgtgagttctagcctaacacaacacgtgcggatccacgccgcagagaaaccctgcgaatgcaaggaatgtggaaaagcctttacaggtctttctggactctccaaacatgtacagaccgatcccgggcagaaaccatatgagtgtaaggactgcggaaaagcctgcggcggtttttatcttctaaatgagcatgggaagacgcacacgcgtgaaaagccctttgcatgcgtggtatgcggcaagtattttcgaaactctagctgcctgaacaaccacgtgcggatacataccgggataaagccttatacatgttcttattgtggtaaggcattcacagtgagatgcggattgacccgccacgtgaggacacacacgggcgagaagccatacacttgtaaagattgcggaaaggctttttgcacatcatccggtcttacggaacatgttcggacccacaccggtgagaaaccttacgaatgtaaggattgtggtaagtcattcaccgtgagctctagtcttacagaacatgccaggatccacacaggcgaaaagccttacgagtgtaagcagtgtggtaaagctttcaccggacgttccggcctgacaaaacatatgcggacccacactggcgaaaagccttatgaatgcaaagactgcgggaaagcctacaaccgtgtgtacctgttgaacgaacacgttaaaacacacaccgaggagaaacccttcatctgtaccgtgtgccgcaaatctttccgcaactcatcgtgccttaacaaacatatccagatccatactggaataaagccgtatgagtgcaaggattgtggaaagacttttacggtctcctcctccctgactgaacacatccggacgcatactggcgaaaagccatacgagtgtaaagtctgtggcaaggcctttacaacatcatctcatctcatcgttcacatcaggacccacacaggagagaaaccctatatttgtaaggaatgtggaaaggcttttgcctcttctagccacctaatagagcaccgccggacccatactggcgagaagccctatatctgtaacgaatgtggcaaggccttccgagcatcctcccatttgcacaagcacggacggatacataccggccagaaaccgtacaaatgcaaggagtgtggcaaagcttataacagattctacttgctgaaggagcacctgaagacgtataccgaggagcaggtttttgtctgtaaggactgtggaaaatcgttcaaaaattcgtcctgtttaaaccatcatacacaaatccacacagacgaaaaacccttttag

SEQ ID NO: 22142 - DNA, 1926 bp, Artificial Sequence
  Description of Artificial Sequence: Synthetic coding sequence
atggtgcacggcagcgtgaccttccgggacgtggccatcgacttcagccaggaggaatgggaatgtcttcagccagaccagaggaccctgtatcgggacgtgatgctcgaaaactacagtcacttgatctcactgggcagcagcattagtaaacccgatgtgatcactttgctcgagcaggagaaggagccatggatggtggtgcgcaaagagacttcccggcgatatccagatttagagctgaagtatggacctgagaaagtgagccccgagaacgatacttctgaagtcaacctgcctaaacaggtgataaagcagatctcaaccacattgggtatcgaagctttctattttaggaatgacagcgaataccggcagttcgagggactgcaaggttaccaggagggcaatataaatcaaaaaatgatctcctacgagaagctgcccacacatacgccccatgctagcttgatctgcaatacgcacaagccatacgaatgtaaggagtgcggaaagtacttcagtagatcagccaacctgatccagcatcaatctatccacacgggggaaaagccctttgagtgcaaggagtgcggtaaagcatttaggcttcatatccagtttacacggcatcagaaattccatacaggggagaagcccttcgagtgcaacgagtgcggcaaagcgttctctcttctgaccctgttgaaccggcacaagaatatccatactggagagaagctcttcgagtgtaaggagtgtggaaaaagtttcaaccgctcctcaaacttggtgcagcaccagagcatccacagtggggtcaagccatacgagtgtaaggagtgcggcaagggcttcaatcggggggcccacctgattcagcaccagaaaatccacagtaatgaaaagccgttcgtttgcaaggagtgcgggatggcatttcgttatcattatcaacttatcgagcactgccaaatacacacgggtgaaaagccatttgagtgtaaagagtgcggaaaagctttcacgctgctgaccaagctggtccgacatcagaaaatccacacaggggaaaagcctttcgagtgtcgagaatgtggaaaagcatttagcttgctcaaccaactgaaccgacataaaaatattcacaccggggaaaaacccttcgaatgtaaagagtgtggcaagagtttcaataggagctccaacttggtgcaacatcaatctattcacgccggcattaagccttacgaatgcaaggaatgcgggaagggattcaaccgcggcgcccaccttattcagcatcagaaaattcattctaacgaaaagccatttgtgtgccgcgaatgtgaaatggcatttcgataccattgccagttgatcgagcactcaagaattcatactggagataagccgttcgaatgtcaggactgcggaaaggctttcaatcggggttcatctctggtccagcaccagtcgatccacaccggtgagaaaccatatgaatgcaaggaatgcggaaaagcctttcgtctttacctgcagctgtcgcaacatcagaagactcacaccggcgaaaaacctttcgaatgtaaggagtgtgggaaattctttcgcaggggctctaacctaaatcaacatcgcagcatccacaccggaaaaaagccatttgagtgtaaagagtgcggtaaggcgtttcggttgcacatgcatcttattagacaccagaaattgcatacaggggagaaaccattcgagtgtaaagagtgcggaaaggctttccggctccacatgcagctgattcggcatcagaagcttcatacaggtgagaagcctttcgagtgtaaggagtgcggtaaagtgtttagtctgccgacccaactgaaccgccacaagaacatccatactggggaaaaagcaagctag

SEQ ID NO: 22143 - DNA, 477 bp, Artificial Sequence
  Description of Artificial Sequence: Synthetic coding sequence
atgggccggagcccccggaagatcgaccagttctgcaacagcagcaatatggtccatgggtccgtcacatttcgtgatgtggccattgacttctcccaggaagaatgggaatgcctgcaacccgatcagagaacactgtatcgggacgtcatgctagagaattacagtcacttaatcagcctggggagctccatatccaagcccgacgtcataacactcctggagcaagaaaaggagccatggatggtggtcagaaaggaaacgagccggcgctatccggatctggagctgaaatatggcccagagaaagtgtcccccgagaatgacaccagtgaagtgaatctcccaaagcagattagtagcctggcatctaagcctagttttacagcgatacatatccaaaggagaatccactgtaggatctgcatagcctttggatacctgtccttggtgtattgttcgctggaaattctttag

SEQ ID NO: 22144 - DNA, 348 bp, Artificial Sequence
  Description of Artificial Sequence: Synthetic coding sequence
atggtgcacggcagcgtgaccttccgggacgtggccatcgacttcagccaagaggagtgggagtgcctacaaccagatcaaaggaccttatatcgagacgtgatgctggagaactacagccatcttatcagtttaggcagctcaatttctaagcccgatgtcattaccctattggaacaagagaaagagccttggatggttgtgcgaaaggagacctcgcgacgctaccctgatctggagctgaagtatggaccagaaaaggtgagccccgagaacgacacaagcgaggttaacctcccaaagcaggtgatcaaacagaagaagggaaaaaagaaaaaaaagaagtag

SEQ ID NO: 22145 - DNA, 1926 bp, Artificial Sequence
  Description of Artificial Sequence: Synthetic coding sequence
atggtgcacggcagcgtgaccttccgggacgtggccatcgacttctcccaggaggagtgggaatgcctccaaccggatcaacggacactttaccgggacgttatgctggagaattatagtcatctcatctcactgggcagctctatcagtaagcccgacgtcattacactcctcgaacaagaaaaggagccatggatggtggtgagaaaggaaacatccagacgctatcctgacctggagctgaaatatgggccagaaaaagttagccccgagaatgataccagtgaagtgaacctaccaaaacaggttataaagcagatctcaacaacccttggcatagaagcgttctatttccggaatgattctgagtatcgacaatttgaggggctgcagggctaccaggagggcaacataaaccagaagatgatatcttacgagaagttgcccactcatacaccacatgcatctcttatctgtaatacgcacaagccatacgaatgtaaagagtgcgggaaatatttctctaggtctgccaatctcattcagcatcagtccatccatacaggagagaagccctttgaatgtaaggagtgcggtaaggcctttcgacttcacatccagttcacacggcaccagaagtttcacacaggcgagaaaccctttgaatgcaacgagtgtgggaaagcattctccttactcaccctgctcaatcggcacaagaacattcataccggcgaaaaactgtttgaatgtaaggaatgtgggaagagttttaatcggtcatccaacctggtgcagcatcagtctattcactcaggagtgaagccttacgaatgtaaagaatgtggaaagggattcaatcggggggctcaccttattcaacatcagaaaatccacagtaatgagaagccgttcgtctgcaaagaatgtggaatggcttttagatatcactaccaactgatcgaacattgccaaatacataccggcgaaaaacccttcgaatgcaaagaatgcggaaaagcatttactcttctcaccaaacttgtcagacatcagaagatccatacaggggagaaacccttcgagtgccgggagtgtggaaaggctttctccttactgaatcaactgaaccggcataaaaacatccacaccggagaaaaaccctttgagtgtaaggaatgtggcaaatcattcaatcgctcctccaacctggtccagcatcagtccatccatgccggtattaagccctacgagtgtaaagagtgcggaaaaggcttcaatcgcggcgcgcatcttatacaacatcaaaaaattcactctaacgagaaaccctttgtgtgcagagagtgtgaaatggcttttaggtatcattgccagctaatagagcactcaaggattcacaccggagataaacccttcgaatgccaagattgtggaaaagcattcaatcgcggctcatcactggtgcagcaccaaagtatccatactggcgaaaaaccctacgagtgtaaggaatgcgggaaagcatttcggctgtatctccagttaagtcagcaccagaaaacccacaccggcgaaaaaccttttgaatgcaaggagtgcggaaaattcttccgcagaggttcaaacttaaaccagcaccgatctattcacacaggaaagaaacccttcgaatgcaaggagtgtgggaaggcattcagactgcacatgcacctgattaggcaccagaaactccacacgggagaaaaacctttcgagtgtaaggagtgcgggaaggctttccggctccatatgcagttaattagacaccaaaagcttcacaccggagagaagccgttcgagtgcaaggagtgcggtaaagtcttttcactgccaacacaattgaatcgtcacaagaacattcacaccggggagaaggcttcctag

SEQ ID NO: 22146 - DNA, 1929 bp, Artificial Sequence
  Description of Artificial Sequence: Synthetic coding sequence
atggtgcacggcagcgtgaccttccgggacgtggccatcgacttcagtcaggaagagtgggaatgcctgcagccggatcaaagaaccctgtacagagatgtgatgctcgagaattattcacacctcatctccctagccggctcctctatttccaaacctgatgttataactctgttggagcaggaaaaggaaccgtggatggtggtccgaaaggagaccagccgtcgatacccagacctggagttaaaatacggcccggaaaaggtgtctcctgagaacgataccagcgaggtgaacctgccaaagcaggtgatcaaacaaattagtacgactcttggaattgaggccttctatttcagaaacgattccgaatatagacagttcgagggattgcagggttaccaagagggaaatattaaccaaaagatgatctcttatgagaagctgccaacacacacccctcacgccagcctgatctgcaacactcataaaccttacgagtgcaaagaatgcggaaagtacttcagtaggtccgcaaatctaatccaacaccaaagcatccacaccggggaaaaaccattcgagtgtaaggaatgcgggaaggctttccggttgcatattcagttcacccggcaccagaagtttcacacgggcgaaaaacctttcgaatgtaatgagtgcggaaaggctttcagtttactgacactgcttaaccgacacaagaacattcacaccggtgaaaagctgtttgagtgtaaggaatgcggaaaatcctttaatcggtccagcaacttggtgcagcatcagtctattcattcgggcgttaaaccctatgagtgcaaagaatgtggtaagggttttaatcgtggagcccatctcatacagcaccagaagatccacagcaacgaaaagccatttgtttgcaaggaatgcggcatggcctttaggtatcactaccagttgatcgaacactgccagatacacacaggtgagaaaccttttgaatgtaaggaatgcgggaaggccttcactcttctcacgaaactggtgcggcaccaaaagatacacacaggcgagaaaccattcgagtgcagagaatgcggaaaggctttttccctgcttaaccagcttaaccgacataaaaatatccacactggggagaagccctttgagtgcaaagagtgcggcaagtcgttcaacagaagttcgaacctggttcaacaccagagtattcacgctggaattaagccctacgaatgtaaggaatgcggcaagggatttaaccggggcgcccatctgatccagcaccagaaaatccactcgaatgagaaacccttcgtgtgtcgtgagtgcgagatggcctttcgctaccactgccaattaatagagcattccaggatccacacaggcgacaaaccattcgagtgccaggattgcgggaaggcattcaaccggggatcgtcattagttcaacatcaatctattcataccggcgagaagccctacgagtgcaaggagtgtggcaaagcctttcgcctctacttgcagttgtcccaacatcagaagacacatacaggggaaaagccgtttgagtgtaaggagtgcggaaaatttttccgccggggatctaatctaaaccaacaccgctcaatccacacaggaaagaagccattcgagtgcaaggagtgtgggaaagcttttaggctccacatgcacctgataaggcaccagaagctgcacaccggtgagaagcccttcgaatgtaaagagtgcgggaaggcttttaggctgcacatgcagctgatccggcaccagaagctacatacaggtgagaaaccattcgagtgcaaggagtgtggcaaagtgttcagtctccctacccagttgaacagacacaagaatatacacactggtgagaaagcgtcctag

SEQ ID NO: 22147 - DNA, 1926 bp, Artificial Sequence
  Description of Artificial Sequence: Synthetic coding sequence
atggtgcacggcagcgtgaccttccgggacgtggccatcgacttcagccaggaggaatgggagtgtttacagcccgatcagcgtacactctatcgcgatgtgatgttggagaattactcccatttgatcagtctgggctccagcatttctaagcccgatgtcatcactcttctggagcaggagaaggagccttggatggtggtgcgcaaagagaccagccggagataccctgatctagaacttaaatacggccctgagaaagtaagccctgaaaacgacacctcagaagtcaaccttccgaaacaggtcatcaaacagatttccactaccttggggatcgaagccttttactttcgcaatgattcagagtaccggcaatttgaaggccttcagggataccaggaaggcaacatcaaccagaaaatgatatcctacgagaaactccctacacacacacctcatgcaagcctgatctgtaacacacataaaccttatgagtgtaaagaatgcggcaagtacttcagtaggagcgccaacctcattcagcaccagagtatacacactggcgaaaagccattcgaatgcaaagaatgcggaaaggcattcagactccatatccaatttacacgccatcagaaatttcataccggggagaagccctttgagtgtaacgagtgtggcaaagctttttctctcctgacactgttgaacagacataaaaatatacatacaggagagaaacttttcgaatgcaaggagtgtgggaaaagtttcaaccgctcatccaatctggtgcagcatcagtctatacattctggagtcaaaccctacgaatgcaaagagtgtgggaaaggctttaacaggggagctcatctgatccagcaccagaaaattcacagcaatgaaaaacccttcgtctgcaaggaatgcggaatggcgttccggtatcactaccagctgatcgagcactgccagattcacaccggcgaaaaacctttcgaatgtaaagagtgcgggaaggctttcacgctactaacaaagctggtgaggcaccagaagattcacacaggagaaaagccatttgagtgccgagagtgcggtaaagccttttctctgttgaaccagttaaataggcacaaaaacattcacactggggaaaagccctttgagtgtaaagaatgtggaaagtcattcaaccggagctctaacctcgtacaacatcagtcaatacatgctggcatcaaaccttatgagtgtaaggagtgcggcaaagggttcaatcgtggcgcacacctcatacagcaccagaagatccactccaacgaaaaaccgtttgtatgccgagagtgtgaaatggcattccgctatcactgtcagttaattgagcattcgcgaatacatactggagacaaacctttcgagtgccaggattgtggaaaagcattcaaccgaggtagttccctcgtccagcaccagagtatacataccggggaaaagccttatgagtgcaaggagtgtggcaaggccttcaggctgtacctgcagctatcccagcaccagaaaacccacacgggagaaaagcccttcgaatgtaaggagtgtgggaaattttttcgaaggggatccaacttgaaccagcacagatcaatccatacgggcaagaaaccattcgaatgcaaggagtgcggaaaggcttttcgactccacatgcatttaatccgccatcaaaaactgcatacaggagaaaagcctttcgagtgcaaggagtgtggcaaagcgtttcgcctgcacatgcagttgatccgacaccagaaactgcacaccggcgaaaagccctttgagtgcaaagaatgtggtaaggtctttagcctgcccacccagctcaaccgtcacaaaaatattcataccggcgagaaagctagctag

SEQ ID NO: 22148 - DNA, 16218 bp, Artificial Sequence
  Description of Artificial Sequence: Synthetic coding sequence
atgggcgccctgtggagctggtggatcctgtgggccggcgccaccctgttatggggcctaacacaggaagcgtcagtggacctgaagaataccggaagggaagagtttctgaccgccttcctgcagaactaccagctggcgtattccaaagcttacccccggctcctgatctcctcccttagcgaatccccagcctcagtctctattctttcacaggccgataacacttctaaaaaagttacagttcgtcctggggagagcgtgatggtcaatattagcgctaaggcagaaatgatcggatcaaagatctttcagcatgcggtggtgatccatagcgactatgcaatctctgtccaggccctcaatgctaagccggatacagctgagctgaccctgctaaggcccattcaggccctggggaccgaatacttcgttcttacgccacccgggacaagcgcacgtaatgtgaaagagtttgctgtggtggccggcgccgcaggagcgagcgtgtccgtgaccctgaagggcagcgtcacctttaatggaaaattttatcccgcgggggatgtgctgagggtaactctgcaaccttataacgtggcccagcttcaatccagcgtagacctgtccgggtccaaagttacagctagctctcctgtcgctgtcctgtccggacattcttgtgctcaaaaacatacaacctgtaatcatgtcgtggagcagctgctgcctacttctgcatggggaactcactacgtcgtgcctacccttgctagccagtctcgctatgatctggcgttcgtcgtcgcgtctcaggcaacgaagctgacttataatcatgggggcatcactggcagtagagggctgcaggctggtgacgtggtggagtttgaggttcgcccttcctggccattgtacctgagtgccaatgttggaatccaagttctgttgtttggtactggtgccatccgaaatgaggtaacatatgacccatatctggtgctaatccctgacgtcgccgcttattgcccagcatacgtggttaagtctgtccccggctgcgaaggcgtagctctggtcgtggcccaaaccaaagcgattagcggattgaccatagatgggcatgccgtaggggccaaactgacatgggaggcagtgccgggaagtgagttctcttatgccgaggtcgaactcgggaccgcagacatgattcataccgccgaagccaccacaaatctggggctgttgacatttggtctggcgaaggccattggctacgccacggctgccgactgtggcagaactgtcttgagcccggtggaacccagctgcgaaggaatgcagtgtgcggcagggcagagatgccaggtcgtaggcggcaaagccggatgtgtggctgagagcaccgccgtctgcagggcgcagggtgaccctcactatactacattcgatggccgccgctatgacatgatgggcacctgcagctataccatggtggaactctgtagtgaagacgacactttgcccgctttctccgttgaagcgaagaatgagcaccgagggtcaagaagagttagctacgtcgggcttgtgacagtccgggcatactcgcacagtgtgtctctgactaggggcgaggttggcttcgtcctggtagacaaccaacgctccagactgccagtcagcctaagcgaggggaggctgagagtgtaccaaagcgggccacgagccgtggttgagctggtgtttggattggtcgttacgtacgactgggattgccagctcgctctgagcctgccagcccgttttcaggaccaggtttgtggcctgtgcggcaactacaacggcgatcctgctgatgattttctcactcctgatggcgcactggctcccgacgctgtcgagttcgcatctagctggaaactggacgacggtgattatctatgcgaagatggatgtcagaacaactgtccagcctgcactcccggccaggcccagcactacgaaggagaccgattatgcggcatgttgacaaaactcgatggcccttttgccgtctgtcatgatactttggaccctcggcctttcctggagcagtgcgtatatgacctgtgcgtggttggtggagaacggctgagtctctgcagaggcttgtcagcttatgcccaagcgtgcctggagctcggaatctccgtgggcgattggcgcagccctgccaattgccctctgtcgtgtccagcaaattctaggtacgaactgtgcgggccggcatgtccgacctcttgtaatggcgcagccgcccccagcaactgtagcgggcggccatgtgtggagggctgcgtatgcctcccaggatttgtcgcctccggcggcgcctgcgtgcctgcctcttcttgcggctgtacctttcaaggcctccagttggcccctgggcaggaagtgtgggctgatgagctctgccagcgccggtgcacatgcaatggcgccacgcaccaggttacctgccgtgacaaacaaagctgtcctgccggtgagcgttgctccgttcagaacggtcttctaggttgctacccagacagattcggaacgtgccagggcagtggggacccccactatgtctcgttcgacggccgccgatttgactttatgggcacttgtacttacctgcttgtgggatcgtgtgggcaaaatgcggcattgcccgcgtttcgggtcctggtggagaacgagcacagaggctcacagaccgtgagctatacacgcgctgtacgggtggaggcccgtggagttaaagtggctgtgcgaagagaataccctggccaggttctcgtggacgatgtgttgcagtacctgccattccaggcagccgatggccaggtgcaggtgtttcgacagggaagagacgctgtggtcaggactgactttggtctgacagtcacctacgactggaacgctagggtgactgctaaggtcccaagcagctatgccgaggctctctgtggcttgtgtgggaatttcaacggcgatcctgcggatgacttggcactacgggggggaggccaagctgcgaacgcgctcgcatttggtaactcttggcaagaggaaacccgacctggatgcggtgccacagagccaggcgattgtcctaagctggactccctagtagcacagcagctgcaatcaaagaatgagtgtggaatcctggccgaccccaaaggaccttttcgggaatgtcattctaagttagatcctcagggcgccgtgcgtgactgcgtgtatgaccgctgtctgttgccgggccagtctggcccattgtgtgacgccctagctacttatgctgccgcctgccaggctgccggggcgacagttcatccgtggcgaagcgaagaactatgtcccctgtcttgtcctcctcatagccactatgaagcatgctcatatgggtgcccactctcttgcggcgacctgccagtgcccgggggatgtggctccgagtgtcacgagggatgcgtgtgtgacgagggattcgccttaagtggtgagtcctgccttcctctcgccagttgtggctgtgtccaccagggcacctaccacccacctggccagactttttatccgggccccggttgtgactccctatgtcactgccaggagggaggtctcgtgagttgtgagtctagttcgtgcggaccccacgaagcttgtcagcctagtggcggctcccttggatgcgttgccgtggggtcctcgacctgccaggcctccggggacccgcactacactacctttgatggtcgccggtttgactttatggggacctgcgtctacgttctcgcccaaacatgtggtacaagaccagggctacacaggtttgccgtactgcaggagaacgtggcctgggggaatggcagagtgtcggttaccagagtgataaccgtccaggtggcgaatttcaccctccgtctagaacagcggcaatggaaggtcactgtcaacggggtggatatgaagctcccagtggtcttggcgaatggtcagatcagggcatcccaacacggtagtgacgtggtgattgagaccgattttggattgagggtcgcatacgacctggtctactacgttagggtaacagtgcctggcaactattaccagcaaatgtgtggattatgtggcaactacaatggggaccctaaagatgacttccagaaacctaacgggtctcaggcaggaaacgcaaacgaatttgggaatagctgggaggaggtggtgccagattcgccctgcctaccccctacaccttgccccccaggaagtgaggactgcatacccagccataaatgcccacctgagctggagaagaaatatcagaaggaggagttttgcgggctactctccagccctaccggacctctctctagctgccataagcttgtggaccctcaggggccgctgaaggattgcatttttgatctctgcctgggaggtggtaacttatcaattctgtgttccaatatccacgcctatgtttccgcgtgccaggcagctgggggccacgttgaaccatggcggactgagacattctgcccaatggaatgtcctcctaatagtcattatgagctgtgcgcagacacgtgttccctaggttgctctgctctctccgcccctccacagtgccaagatggctgtgctgagggctgccagtgcgatagtggcttcctatataacggacaggcatgtgtgccaattcagcagtgtgggtgttatcacaacggagtctactatgaacccgagcagaccgtactgatcgacaattgcaggcagcagtgcacatgccacgcgggaaagggcatggtgtgccaggaacactcatgcaagcccgggcaggtgtgccagccaagcgggggcatcctgtcatgtgttaccaaggatccctgccatggcgttacctgcaggccgcaggaaacatgcaaagaacaaggcgggcaaggtgtttgcctgcccaattacgaggcaacctgctggctgtggggcgatccacactaccacagtttcgacggtcggaaatttgacttccagggaacatgtaattacgtcctggctaccaccgggtgccctggagtgagcacacagggtttaacccccttcaccgtcactactaaaaatcagaaccggggcaaccccgccgtgtcttatgtgagggtagttactgttgctgctttgggtactaatatctctatacataaagatgaaataggaaaagtgcgagtcaacggcgtcctgacagccttgcccgtctccgtggctgacggcagaattagcgtgactcagggtgcttcgaaggctctgttggtggccgactttggcctgcaggtctcctacgactggaattggagagtggatgtcacccttcccagcagttatcatggagctgtgtgcggcctgtgcggaaatatggaccgcaaccccaataacgaccaggtttttccaaatggtactctcgctccgtccatcccaatctggggagggtcttggcgggcgcctggctgggaccctctatgttgggatgaatgtagaggttcttgtcctacatgtccagaggatcggctggaacagtatgagggtccaggtttttgcgggccattggcccccgggaccggcggacccttcaccacatgccacgcccacgtccccccagagagtttcttcaaaggctgcgtgcttgacgtatgcatgggcggcggggatcgtgacatcctttgtaaggccctggcttcatacgtcgcggcctgtcaggctgccggcgtcgtaattgaagattggagggcccaagtcggctgtgagatcacatgccctgaaaactcacactacgaagtgtgcgggtcaccatgccccgctagctgcccatctccagctcctttgaccactccggctgtgtgtgaggggccctgtgttgagggctgtcagtgcgacgcgggtttcgttctatctgccgaccgatgtgtccctttaaacaatggttgcggatgctgggctaacggcacttaccatgaggccggaagcgagttctgggccgatggcacctgctctcagtggtgcaggtgtggcccaggaggggggtctctggtctgcacacccgcatcttgtggtctcggcgaagtttgtggcctgctaccttccggacagcacggctgccagccggtaagcacagctgaatgtcaggcttggggagaccctcattatgtgaccctcgatggccacaggttcaatttccagggtacctgtgagtacctgctctcagctccgtgtcatggaccaccactgggggctgaaaactttactgtgaccgtcgctaatgaacatcgtggctcacaggccgttagctatacgcgcagcgttactctgcagatttacaaccacagtctgaccctaagtgcccgctggccgagaaaactgcaagtggacggtgtgtttgtgaccctccccttccagctggactctctgctccacgctcatctgtctggagcagacgtggtggtgacaaccaccagcgggctgtccctagcgttcgacggcgacagtttcgtccggctcagagtacccgcagcatacgctgggtccttatgcggactgtgtgggaactataaccaggaccctgcagatgacctgaaagctgttggtggcaagcctgccgggtggcaggtgggaggggcccaagggtgtggggagtgtgtgtctaaaccctgtccgagcccgtgcacgcctgagcagcaggagtcgttcggcggaccagacgcctgcggcgttatttctgcaacagacggcccactggcgccgtgtcatggcctggtgccacccgcccagtacttccaggggtgcctactcgacgcatgtcaggtacagggccaccccggtggcctctgcccagccgtggccacttatgtagcagcgtgccaggcagccggtgcacagttgcgtgaatggagaagacccgatttttgcccattccagtgtcctgcacacagccattatgaactttgtggtgatagttgccccgggtcttgccctagtctttctgcacctgagggttgtgagagcgcctgccgagaaggctgcgtttgcgacgctggattcgtactgagcggagacacttgcgtgccagtgggccagtgcggctgtttgcatgacgaccgctactatcccctagggcagacattttatccaggtcccgggtgtgacagcctgtgtcgatgtagagaagggggcgaagtttcttgcgagcccagtagttgtgggccccacgagacatgtaggccatcaggcggctcactcgggtgcgtggcagtgggcagcacaacttgtcaggcatccggggatccccactacactacattcgatggaaggcggttcgactttatgggcacttgcgtctacgttttggcccaaacatgcgggactaggcccgggctgcatagattcgcagtccttcaggaaaatgtcgcttggggcaacgggcgagtctccgtaacccgtgtaatcacagtacaggtcgccaactttactttgcggctggagcagagacagtggaaagtgacagtgaacggggtggatatgaaactccctgttgtgctggctaacggtcagataagagccagtcaacatggatccgatgtcgtgattgagaccgatttcggtttgcgcgtggcctatgacctggtgtactacgtacgcgttactgtgccaggcaactattaccagcttatgtgcggtctctgcggcaattacaacggtgatccaaaggacgactttcagaaacctaacggctcgcaggccggtaatgctaacgagtttggcaattcttgggaagaggtggtcccagacagcccgtgcctgcccccgcccacgtgtccgcctggatcagaagggtgcattccaagtgaggaatgtcctcctgagctcgagaagaaatatcagaaggaggagttctgtggcctgctgtcatctcccaccggcccactgagctcctgtcacaagctcgtggatccgcagggccctcttaaggattgcattttcgacctgtgtttgggcggtggtaacttatccattctgtgttcaaacatacacgcttacgtaagcgcatgccaggccgccggaggccaggtggagccgtggcgcaatgaaaccttttgtccaatggagtgtcctcagaactcccactacgagctgtgcgctgacacatgtagcctcggttgctccgcactttctgcccctttgcagtgtccagatgggtgtgccgaggggtgccaatgtgactcggggttcctttacaatgggcaggcttgtgtccccattcagcaatgcgggtgctaccacaacggagcctactatgaaccagagcagaccgtcctgattgataactgtaggcagcagtgcacttgccatgttggaaaggtggtcgtctgtcaagagcactcatgtaagcctggacaggtctgtcaacctagtggtggaatactgagctgtgtgaataaggacccctgccacggtgttacatgcaggccccaagaaacctgtaaagagcagggcgggcagggggtctgtctccctaattatgaagcaacctgttggttatggggcgaccctcattaccatagttttgatggccgcaaattcgactttcaaggcacctgcaactacgttctggcgacaaccggttgtcccggggtcagtacacaaggactcacacccttcacagtcaccacaaaaaatcagaaccgggggaaccccgctgtctcttacgttagggtcgttacagttgcggcacttgggacaaatatttctatccataaggacgaaatcgggaaagtgagggttaacggagtcctgactgcactgcccgtcagcgttgcagacggtagaatctcagtgacacagggcgctagtaaggcattactggtggcagacttcggactccaggtgtcctatgactggaactggagagtggacgttacccttccctcaagttaccacggagctgtgtgcggcctgtgcgggaatatggaccgaaaccctaacaatgatcaggtctttccaaacggcacactcgctcccagcattccgatatgggggggttcatggcgagccccaggctgggatcctctgtgttgggacgaatgcaggggatcctgcccaacttgccccgaggatcgcctggagcagtatgaaggccccgggttttgcgggcccctggctcctgggaccgggggcccctttaccacgtgtcacgcacatgtcccccccgaatcgtttttcaaagggtgcgtattggatgtgtgtatggggggaggtgatcgggatattttgtgtaaagcactcgcctcgtacgtagcagcgtgccaagctgcaggcgtggtaatcgaggattggagggcacaggtcgggtgcgaaataacatgccccgagaactctcactacgaggtctgtgggccaccatgtcctgcttcctgcccctcgccagcacccttgactaccccagcagtatgcgagggcccctgtgtcgagggatgccaatgcgatgccggcttcgtgctctccgctgaccggtgcgtccccctcaacaacggatgtggatgctgggccaatggcacctatcacgaagctggcagtgagttctgggcggatggcacatgctcccagtggtgcagatgcggacctgggggagggtcactcgtctgcaccccagccagctgtgggctcggggaggtctgcgggcttctcccatccggccaacatggatgccaacctgtcagcactgcagagtgccaagcctggggagatccacattacgtgactttggatggtcacagatttgacttccagggaacgtgcgagtatctgctgtccgctccttgccacgggcctccgttaggggcagagaactttactgttaccgtcgcaaacgagcacaggggatcacaggctgtgagttatacgaggagtgtaacactgcagatctataaccactcccttacactgtcagctcggtggccccggaaattacaggttgatggcgtgtttgttaccctgccctttcaactagactccctcctccacgcgcatctgagcggcgccgacgtggtggtgacaaccacatccgggctgagtttggcatttgatggcgatagttttgtccggctgcgcgtccctgctgcatatgcagggagcctctgcgggctctgcggtaactataaccaggaccccgccgatgacctgaaagcggtaggcggaaagcccgccgggtggcaggttgggggcgctcaggggtgcggcgagtgtgtgtctaaaccatgcccatccccatgtacaccggagcagcaggagagtttcgggggccccgatgcctgcggagtgatctcagccacagatggccctttggcaccctgtcatggtctggtgccgccagcccagtacttccaaggatgccttctggacgcatgtcaggtgcaagggcacccagggggtctgtgccctgctgtggccacctatgtggcggcctgccaggcagcgggcgcccagctcagagaatggcgccgcccggatttttgtccctttcagtgtccggcccacagccattacgagctttgtggagattcttgtccaggctcctgcccgagcttaagcgcaccggaaggttgtgagtccgcttgccgggaaggatgtgtttgtgatgctggtttcgtgctgtctggcgatacctgcgtgcctgtggggcagtgcggctgcttgcatgatgatcgctattacccccttggccagacattctaccccggccccggatgtgacagcctttgcagatgcagagaaggaggtgaggtgagctgcgaacccagcagctgcgggccacatgagacctgtcgtcctagtggcggttctctcgggtgcgtagccgtcggttccaccacatgtcaagctagtggcgacccacattatacaaccttcgacggccatcgcttcgatttcatgggcacctgtgtgtacgtgctcgcccagacctgcggtaccaggcccgggcttcatcggttcgcagtgctccaagagaacgtcgcgtggggaaatgggcgcgtcagcgttacacgcgtgatcactgttcaggtggcaaattttacactgaggctggaacaacggcagtggaaggtcactgttaatggggtggacatgaagttgcccgtggtactggcaaacggccagatccgagcgtcgcaacacggctctgacgttgtcatagaaaccgatttcgggctgcgtgttgcctatgatctcgtgtattatgtgcgggtgaccgtgcctggtaattattaccagctgatgtgcggcctctgcgggaattataacggggatcctaaggatgactttcagaaacctaatggctcacaggccgggaacgctaacgaatttggaaactcttgggaggaagttgtgccggactcaccctgcctgccaccaccaacatgcccccccgggagcgccgggtgcataccatcagacaaatgtccgcccgagctggaaaagaagtatcaaaaagaggaattctgcggcctgctgtctagccctaccgggcctctctcctcttgtcacaaactggtcgacccacagggccccctgaaggattgcatctttgatctgtgtctcggagggggtaacctgtccatattgtgcagcaatatccacgcttacgtctcagcatgtcaggcggcaggcggccacgttgagccctggcggaatgagactttctgtccgatggaatgccctcagaatagtcactatgagttgtgcgcagacacatgctctctaggctgcagtgccttgtccgcaccccttcagtgccccgacggctgtgctgagggctgccaatgtgacagtggcttcctgtataacgggcaggcttgcgtccctatccaacagtgtggctgctatcacaatggagtctattatgagcccgagcagacagtgctgatcgacaattgcagacaacagtgcacctgtcatgtgggcaaggtcgtggtgtgtcaggaacactcatgtaaacctggccaggtatgtcaaccgtcagggggaattctgagctgcgtcactaaggacccatgtcacggagtcacctgtcggccccaggaaacgtgcaaggaacaaggcgggcagggcgtgtgcctgcccaactatgaagctacgtgctggctgtggggtgacccacactatcacagttttgacggcagaaagtttgacttccagggtacttgcaattacgtgctggcaacaacgggttgccctggtgtgtccactcagggactcacccctttcacagtgacgaccaaaaatcagaatcgcggcaatcccgctgtgtcatacgtgcgcgtcgttacagtggctgccctgggcactaatattagtatccacaaggacgaaataggcaaggtccgggttaacggcgttcttaccgcccttcctgtgtctgtggccgacggtcggataagcgtggcccagggggcctcgaaggctttgctggtggcagatttcggacttcaggtgtcgtacgactggaactggcgagttgacgtaaccctgcctagcagctaccacggagccgtatgcggcctttgtggcaacatggacagaaacccgaataacgatcaagtctttcccaacggaaccctggcccccagtatacccatctgggggggcagttggcgggctcccgggtgggaccccctctgttgggacgaatgtagagggagctgcccaacttgccctgaggatcgcttagagcaatacgaggggcctggtttctgtggcccactgagctcgggaaccgggggtccattcactacttgccacgctcacgtgccgcccgaaagctttttcaagggttgtgtgcttgatgtttgcatgggtggcggcgaccgggacatcctgtgtaaagctcttgcgagttatgtcgcagcctgtcaggcagccggcgtggtaattgaagactggcgtgcccaggtgggctgcgagattacttgtcccgagaatagtcattacgaggtctgtggccctccgtgcccagcgagctgcccttctcccgcaccacttaccacgccagccgtttgtgaagggccatgcgtcgaaggttgccaatgtgacgctggatttgttcttagcgcagaccgatgtgtcccgctcaacaatgggtgcgggtgttgggcaaacgggacataccacgaagcaggaagcgagttctgggctgacgggacttgtagtcaatggtgtcggtgcggcccagggggcggcagtctggtatgtacacctgcatcatgcggcctgggtgaggtgtgcggcctgctgccctccggccagcacgggtgtcaacccgtatctacagcagaatgccaagcctggggcgacccacactatgtcacactcgatggccaccgcttcgattttcagggaacatgcgagtatctgttgtctgccccatgccacggaccccctctcggtgcagagaactttactgttactgtcgccaacgaacaccgaggttctcaggcagtctcatacactaggtccgtcacactgcagatttacaatcattccctgaccctgtctgcgagatggcctagaaaattgcaggtagatggtgtttttgtggcactccctttccagctggactctctattacatgctcatctgtccggcgcggatgttgtggtcaccactacttccggtttgagtctggcttttgatggagattcgtttgtcagactccgggtacctgccgcatacgctgcctccctgtgtgggctttgtggaaactacaaccaagatcccgccgacgatctcaaagctgtagggggaaaacctgccggctggcaggtgggaggcgcccagggatgtggcgagtgtgtgtccaaaccgtgtccttctccctgtaccccagagcagcaggaatcctttggcgggccagatgcctgtggtgtgatctccgctacagacgggcctctggctccgtgccatggcctggtgcccccagcccagtatttccaaggctgcctgctagatgcatgtcaggtgcagggccatcccggggggctctgtcctgccgtagctacctacgtagccgcgtgtcaggccgcaggcgcccagttgggagagtggaggcgtcccgatttctgcccactacagtgccctgcccacagccattatgaattgtgtggggactcctgtcctgtgtcctgtccatccctgtccgcccctgaggggtgcgaatccgcatgcagggagggctgtgtatgtgacgccggatttgtgctctcaggcgatacttgcgtgcccgtgggccagtgcggctgcctgcatgatggcagatattaccccttgggagaggtcttttaccccgggccagaatgcgagcgacggtgcgagtgtgggccagggggtcatgtaacctgccaggaaggggccgcatgcggtccacatgaggaatgccgcctggaggatggcgtgcaggcatgtcatgcaaccggatgcggtcggtgcttagcgaacgggggcatccactacatcactttggatgggcgcgtgtatgacctacacgggtcctgttcctacgtcttggctcaggtgtgccaccccaagccgggggatgaggatttttcaatcgtcctggagaaaaatgccgctggggatctgcagaggcttctggtgaccgtggctggccaagtggttagcttagcccagggtcagcaagtcaccgttgatggggaagccgttgctcttcctgttgccgtggggcgggtgagagtgactgccgagggtaggaacatggtgctccagaccacaaagggcctacgattgttgtttgatggagacgcccatctactcatgagtatccctagcccattcagaggccgcttgtgcgggctctgcgggaactttaacggcaattggagcgatgactttgttctgcctaatgggtcagctgcatccagcgtggagaccttcggcgccgcctggcgcgccccaggaagctcaaaaggctgtggtgaaggatgcgggcctcagggatgcccagtgtgcttggcagaggagaccgcaccatacgagagcaatgaggcctgtggccagttgagaaacccacaaggacccttcgccacatgtcaggccgttcttagtccttccgagtacttccgacagtgtgtgtatgacctctgcgcacagaaaggagataaagccttcctctgcagatcacttgccgcctatactgcagcctgccaggctgcgggggtcgccgttaaaccttggaggaccgactctttctgtccactgcattgcccagcacattctcactattctatctgtacccgtacctgtcagggctcttgtgcagccctgtcaggccttactgggtgcaccacaaggtgcttcgaaggatgcgaatgcgatgacaggtttcttttatctcaaggggtctgcataccagtgcaggactgcgggtgtactcacaacggcagatacctgccagtcaacagcagtctgctaaccagtgattgttcagaacgctgtagctgttctagctctagtggtctgacatgtcaagccgccggctgccccccaggaagagtgtgcgaagtgaaagctgaggccaggaattgttgggccactcgtggcctttgtgtgctgagtgtgggagcaaacctgaccacatttgatggggctcgaggcgctaccacaagtcccggcgtgtacgaactctcttccaggtgccccggcttgcagaacaccatcccttggtatagggtggtcgcagaagtgcagatttgccatggaaagacagaagccgtgggtcaggtgcatatctttttccaggatggaatggttacgctaactccaaacaagggagtttgggttaatgggctccgggtggacctgccagcagaaaagctggctagcgtgagtgtttcacgaacccccgatggtagtttactcgttaggcagaaggccggagttcaagtctggcttggcgctaatgggaaagtcgccgtgattgtctcgaacgaccacgccgggaagctttgcggagcgtgcggaaattttgatggagaccagactaatgactggcatgactctcaggagaagcccgccatggagaagtggcgagcccaggacttctcaccatgctacgggtag

SEQ ID NO: 22149 - DNA, 2502 bp, Artificial Sequence
  Description of Artificial Sequence: Synthetic coding sequence
atggtgcacggcagcgtgaccttccgggacgtggccatcgacttcagccaggaagaatgggagtgtttgcagcccgaccagcgcaccttgtatcgagacgtgatgttggagaactatagtcatcttatttcactgggttcctccattagcaaacccgatgtgatcacattgctggaacaggagaaggaaccctggatcgtggtatccaaggaaaccagccgatggtaccccgacctggaaagcaagtacggacccgagaagatcagccctgagaatgacatctttgaaataaacctgcccaagcacgtgatcaaacagatatctaagacgctggggctggaagctttctactttcgtaatgacagcgaatataggagcaggtttgagggtagacagggacaccaggaaggctatatcaatcagaagataatctcatacgaggagatgcctgcatacacacacgcttcacccatccacaacacacacaaaccctatgagtgtaaggagtgtggcaagtatttcagctgtggttctaatctcattcagcatcagtctatacacacaggcgaaaaaccttacaagtgtaaagaatgcggaaaggcctttcagttacatatccagctcactcgccaccaaaagttccacacaggcgagaaaacttttgaatgcaaggagtgtgggaaggcttttaatctgcccacccagctgaatagacacaaaaatattcacacagttaaaaaattgttcgagtgcaaggaatgcgggaagagcttcaacaggtctagcaaccttacgcagcaccagtccattcacgctggagtcaagccgtatcaatgcaaggagtgcgggaaagccttcaaccggggcagcaacctgatccagcaccagaaaatacactccaatgagaagccgtttgtatgtcgcgaatgcgagatggcatttcgctaccattatcagttgatcgagcattgcagaattcacaccggggagaaacctttcgagtgtaaggagtgccgtaaggctttcaccctgctgacaaaactggtgcgacatcagaaaatccacatgggagagaagccctttgaatgtcgtgaatgcgggaaagcattttctttgcttaatcaattgaatcggcacaaaaatatccataccggcgagaaacctttcgaatgcaaggagtgcggcaaatccttcaacaggtcatcaaaccttatccaacaccagtccatccacgctgatgtgaaaccatatgagtgcaaagaatgtgggaaaggatttaatagaggggccaatctgattcagcaccagaaaatacactccaatgaaaaaccatttgtgtgtagggagtgcgagatggcgttccgctaccactaccagctgattcagcattgccaaatccatacggggggcaaaccctttgaatgcaaagaatgcggaaaagcgttttctcttcttactcagctggccagacacaagaatatccacacgggagagaagccatttgaatgcaaagattgcggtaaggcattcaaccgaggatcaaatctcgtgcaacaccagtcaatccataccggcgaaaagccttacgagtgcaaggaatgcggaaaggcgttcaggctgcacttgcagctttctcagcacgagaagacacacacaggtgaaaagccattcgagtgcaaagaatgtgggaagttctttcgcagagggtctaacctcaaccagcatcggagcatccatacagggaagaaaccctttgaatgcaaagaatgtggaaaggctttccgcttacacatgcacctcatcagacatcaaaagtttcacacaggcgaaaagcccttcgaatgcaaagaatgtggtaaagctttcagcctccacacacagctgaatcaccacaaaaatatccataccggcgaaaagccatttaaatgcaaggagtgtggaaagtcatttaatagagttagcaacctcgtacaacaccagagcatccatgcaggtgttaaaccttacgaatgtaaggagtgtggtaagggattcagtcgagtgtctaatctgatccagcatcagaaaacacattctagtgccaaacccttcgtatgcaaggagtgtcgcaagaccttccggtaccactaccagcttaccgagcactaccggatccacacaggagagaaaccattcgaatgcaaagaatgtgggaaggcattcgggttgctcacccagcttgcccagcaccagatcatccacactggggagaagccatttaagtgcaaggaatgcggcaaggcatttaatcgtggctctaacctcgtgcaaccacagtccatccatactggtgagaagccctatgagtgcaaagagtgcggtaaggccttccgcctgcatttgcagttgtcactccaccaaaagctcgtgcaggtcaggaatcccctgaacgtgaggaatgtgggccaacccagtgacattagctctaacttgctgaacattcgaaagttcatcctcgggtag

SEQ ID NO: 22150 - DNA, 618 bp, Artificial Sequence
  Description of Artificial Sequence: Synthetic coding sequence
atgaacaccttccaggccagcgtgagcttccaggacgtgaccgtggaattcagccaagaagaatggcagcatatgggaccagtcgagcggaccctctatcgcgatgttatgctggagaattattcgcatctggtatccgttggttactgcttcactaagccagaactcatattcactctcgagcagggggaagatccatggttactagagaaggaaaagggctttctctctcgcaatagtcctgaagacagccagcccgacgaaatctctgagaaatcccctgagaatcagggcaagcatcttctacaggtgttatttaccaacaagctgttgactaccgagcaggagattagtggcaaaccccataacagagacatcaatatcttccgggccagaatgatgccttgcaaatgcgatatcgctggttcggcctgccagggcttaagtctcatggctccgcattgccaatactctaaggaaaaggcccacgagcggaacgtctgcgataagtggctgatcagcattaaagacggtcgcactaatacccaggagaagtcatttgcatactccaagatcgtcaaaacattgcaccataaggaggaggttattcaacactag

SEQ ID NO: 22151 - DNA, 2100 bp, Artificial Sequence
  Description of Artificial Sequence: Synthetic coding sequence
atgaacaccttccaggccagcgtgagcttccaggacgtgaccgtggaattttcccaagaggagtggcaacatatgggtccagtggagcgaaccttgtaccgagacgtgatgctcgagaattactcacacttagtaagcgtcggctattgcttcactaaacccgaactgatttttacgctagaacaaggcgaggacccgtggctcctggaaaaggagaaagggtttctgagccgaaattctccagaagactcccagccagacgagatcagcgagaaatctcccgagaatcaaggaaagcacctcttgcaggtactgttcacaaacaaactactgactacagaacaggagatttccggaaaaccccacaatagagatatcaatatatttcgggcccggatgatgccatgtaaatgtgatattgcgggaagcgcctgccaggggctctctctgatggctccacattgtcaatacagcaaagagaaggcccacgaaaggaacgtctgcgataagtggctaatatcgatcaaagatgggcgaaccaatacccaggagaaatctttcgcctactctaagattgtcaagactttgcatcataaggaggaggtgattcagcaccaaacaattcagacgctgggccaggatttcgagtataacgagtccaggaaagcctttctggaaaaagccgccttggtgacctcaaactccacccacccaaaaggaaaatcttataacttcaacaaattcggtgagaacaaatacgacaaaagtaccttcatcataccgcagaatatgaacccagagaaatcccattacgagttcaacgatacaggcaattgtttctgcagaattacccacaagactttgaccggcggtaaaagcttcagtcagaaatcacatatccgcgaacatcaccgcgtgcatataggcgtgaaaccatttgagtatggtaagagtttcaatagaaactctaccctgccagtgcaccagaggacgcatgctactgacaagtattccgattaccacccctgcactgagacattctcatatcagtcgactttctcagtgcaccagaaagtgcacattagagcgaaaccttacgaatataatgaatgtgggaaatcctgttccatgaacagccatctaatctggccccagaagtcacacacgggcgagaagccatatgagtgtcctgaatgcgggaaggccttcagtgagaaatcacggctgcgcaagcaccagcgcacccataccggggagaaaccctacaaatgcgatgggtgtgacaaagccttcagtgctaagtcaggtctccggattcatcaaaggactcacaccggggagaagccctttgagtgccacgagtgcggcaagagctttaattacaaaagtatcctcatcgtgcaccagagaactcacactggggagaaaccattcgaatgcaacgaatgcggaaagtcattctcccatatgagcggcctgaggaaccatcgcaggacccacactggagagagaccctataagtgtgacgagtgcgggaaagcattcaagctgaagagcggactgcggaagcatcaccgtactcacaccggcgagaaaccatataagtgcaaccagtgtggcaaagccttcggacaaaagtcgcaattgcgggggcaccaccggattcacacaggtgaaaagccgtacaagtgcaaccactgcggcgaagccttctctcagaaaagcaatcttagagtccatcatcgcacacatacaggagagaagccttaccagtgcgaggaatgcggcaagacgttccgccagaaaagcaatcttaggggtcaccagcggacgcatactggagaaaaaccctacgagtgcaacgaatgcggaaaagcctttagcgagaagagcgtgttaagaaagcatcagagaacccataccggagagaagccctataactgtaaccagtgtggagaagccttctcccagaaatccaacctcagggtccaccagcggacgcataccggggaaaagccatacaagtgcgacaaatgtggtcgcacattcagtcagaagagtagcctacgcgaacaccaaaaagctcacccaggagattag

SEQ ID NO: 22152 - DNA, 1704 bp, Artificial Sequence
  Description of Artificial Sequence: Synthetic coding sequence
atgatgccctgcaagtgcgacatcgccggcagcgcctgccagggcctatctctgatggccccgcactgccagtacagtaaagagaaggcccatgaaagaaacgtgtgtgataagtggttaatttctatcaaggacgggcgaaccaatacgcaggagaaatccttcgcttacagcaagattgttaagacactgcatcataaagaagaggtgattcagcaccagacaatacagacactcggtcaagatttcgagtacaatgagtcacgcaaggccttcctggagaaagcggccttggtaacaagcaattccacacaccctaaaggaaaaagttacaactttaataaattcggcgagaacaagtacgacaaatctactttcattattcctcagaacatgaatccggagaaatcacattacgaattcaatgataccggcaattgcttctgcaggattacccataagacactgaccggcggtaaatccttcagccagaagagtcatatacgtgagcaccatagagtgcatattggggtgaaacctttcgaatatggaaaatcttttaatcggaattccactcttcctgtgcaccagcggacccacgctactgacaaatactctgattaccatccttgtaccgagacattttcctaccagtcaaccttttctgtgcaccagaaggtacatattcgtgccaagccatatgagtacaatgagtgtgggaagtcatgtagtatgaattctcatttgatctggccgcaaaaaagtcatactggggagaaaccctacgagtgtcccgaatgtggcaaagctttctcggaaaaaagcaggctgaggaagcatcagaggacacatacaggagagaagccatataaatgcgatgggtgcgataaagccttttccgcaaagtcaggattgcgtatccaccaaaggactcataccggggagaagccattcgaatgccacgagtgcggcaagtcttttaattacaagtctattttgatagtgcatcagaggacacataccggggaaaagccatttgagtgtaacgaatgcggaaagagctttagtcatatgagtggcttgagaaaccatcgccgcacacacaccggggaacggccgtataaatgtgacgagtgtggaaaagcattcaagctgaagtctggactccggaagcaccatcgaacacatacaggtgaaaaaccatacaaatgtaaccagtgcggcaaggccttcggccagaaatctcagctcagaggacaccaccgaatccatactggggaaaaaccatacaaatgcaaccattgcggcgaggccttctcacagaagagcaatttaagagtgcaccatcggacccatacgggcgaaaagccttatcaatgcgaggagtgcgggaagaccttccgccagaagagcaatctcagaggacatcaacgcacgcacacaggggagaaaccatatgagtgtaatgagtgtggcaaggcattcagcgagaaatcagtgttgagaaagcatcagcggacacacacaggggaaaagccttataactgcaaccagtgtggggaggccttcagccagaagtcaaacttaagggtgcaccagagaacacatactggcgaaaaaccctacaagtgcgacaagtgcggccgcacttttagccagaagtcctcccttagggagcatcagaaggcccatcctggtgactag

SEQ ID NO: 22153 - DNA, 972 bp, Artificial Sequence
  Description of Artificial Sequence: Synthetic coding sequence
atggccgccgcccggcccgaggcccagagccggagcagccccacccctgagagtagatcacaggaacctcttgatcttgttctggttcctgatgactgtagaccaggaactcctcctagtgaccttatcgaaatccaagtggtcaaagtgacagatacgactttggttcctgagcctcctgaaccaggaagcttccactgcgctctgtgcccggctgcctttcgcctggtctctgagctcttgtttcacgagcacggccaccttgccggtgctgaggggggcggacagggtggagaccccagcaggtgccacgtttgcgggcattcttgcccggggcctgcctcactccgcgcccattattctcttcatactggcgaacgtccctacagatgcgccctgtgtccccgagcctttaaagccctggcccctctccttcgacaccaacatcgccatggggtcgaaccaggtacaagcagacgcccacctgacaccgctgctgtcgcagagcagaggcccggagtcgctcctgagcgggccgaggtcgtcatggcagcagccgccgcgggagcagcagtaggtaaaccctttgcatgtcgtttctgcgcgaagccttttcggcggtcttctgacatgcgggatcacgagcgggtacacaccggcgagcgcccatatcactgcggcatctgtggaaaggggtttacacagagcagtgttttgagtggccacgctaggatccacaccggggagcgtccttttcgctgcaccttgtgtgatcggacttttaataactctagcaactttagaaagcaccagcgtacacattttcatgggcctgggcccggtctcggcgacagcgggggccagctaggtagtagcgctgcagaaggttcggggagcggttgtggggttggcgacccggctgaagagggtaggggcgaaacagccaaggtgaaggtcgaagcggaccagtag

SEQ ID NO: 22154 - DNA, 1218 bp, Artificial Sequence
  Description of Artificial Sequence: Synthetic coding sequence
atgggcccccccctggccccccggcccgcccacgtgcccggcgaggctgggccccggagaaccagggaatccagacctggtgcagttagctttgctgatgtggctgtgtatttcagcccggaagaatgggagtgtttaaggcctgcccagcgcgccctctacagggacgttatgagagaaaccttcggacacctgggcgcattgggattttctgtacctaagcctgcttttatctcttgggtggaaggagaggtagaggcctggtcccctgaagctcaagatccggatggtgagtctagtgccgccttctcgcgcgggcaggggcaggaagctggatccagagatgggaacgaggagaaggagcgcctgaaaaagtgccctaaacaaaaggaggttgcccatgaggtggccgtcaaggaatggtggccatcagttgcctgtccagagttttgcaatccccgacaatcaccgatgaacccctggttaaaggatacattgactcgtagactgccacattcttgccctgattgtggcaggaacttctcttacccatctctcttagcctcgcaccaacgtgtgcacagcggcgagcgaccgttttcctgtggtcaatgccaggccaggtttagccagaggcggtacctcttgcagcaccaattcatccatacaggcgagaagccctacccttgccccgactgcggtcgcaggtttaggcagaggggctctttggctatccaccgtagggctcatactggagaaaaaccatacgcttgttccgactgcaaaagtcggtttacctatccctacctgcttgccatccaccaaaggaagcataccggggagaaaccttatagttgtcccgattgctctttgcgtttcgcatatacctctcttctggccatccatcggcgaatccacacgggcgagaaaccttacccgtgccctgactgtggcagacgctttacttactcttccttgctgctttcgcatcgtaggattcattccgattccaggccatttccttgcgttgagtgcgggaaaggctttaagcgtaagacagctctcgaggcccaccgatggattcaccggtcctgtagtgaacgtagagcttggcaacaggccgtagtaggccgtagcgagcccatacctgtgttaggggggaaagatccgcccgtgcacttccggcatttcccggatatcttccaagaatgtggatag

SEQ ID NO: 22155 - DNA, 1113 bp, Artificial Sequence
  Description of Artificial Sequence: Synthetic coding sequence
atgcccgccgccagcgccgagggccccgtgcccggccgggacgccggcgacttgagacccccagggcgcgctggtagggcccattgtttctcttttgcggggttctcagtgcccaagccagcctttatttcatgggtggagggagaagtagaggcctggtctcctgaggctcaggaccccgatggagaatcaagtgctgcgttctcccgcgggcaaggtcaggaagctgggtctagggatggaaacgaagagaaggagcgacttaagaagtgtccaaaacagaaagaagtcgctcatgaggtggcagtgaaggagtggtggcctagtgtggcatgccccgagttttgtaacccacggcagagccctatgaatccatggttgaaagatacgctgacccgccggctaccacactcctgtcccgactgtggccgcaattttagctatcccagcctactggcctctcaccagagagtacattcaggagaaaggccattcagttgcggacaatgtcaagctaggtttagccagagacggtacttacttcagcaccagttcattcacacgggagagaaaccctacccctgcccagattgcggacggaggtttagacaaagaggaagccttgccatacatcggcgggctcatacaggtgagaagccttatgcgtgtagcgattgtaaatccagattcacctatccttacttgctagccattcaccagagaaagcatacaggcgagaagccatactcttgccctgattgttccctccgtttcgcctatacgtcacttctcgccatccatagaagaattcacacaggtgagaagccttatccatgccctgattgcggcagacgctttacatatagctctctgctactctcccatcgccgcattcattcagactcaaggcctttcccttgtgtggaatgtgggaaaggatttaagcgcaagacagccctggaggcccacaggtggatccatcgaagttgctccgagaggcgcgcctggcagcaagccgtggtggggcgttcggagccaatccctgtcctgggtggcaaggatccacctgttcactttaggcacttcccggacatcttccaagagtgtggctag

SEQ ID NO: 22156 - DNA, 1173 bp, Artificial Sequence
  Description of Artificial Sequence: Synthetic coding sequence
atgggcccccccctggccccccggcccgcccacgtgcccggcgaggccggtccccgtcggactagagaaagccgccctggggctgtttcttttgccgacgttgccgtgtacttctcacccgaagagtgggagtgcctccgtcccgcgcaacgggccttgtatcgcgacgtgatgcgagaaaccttcggccatttaggagccttaggcttcagcgtccccaaacctgcatttatcagttgggtggagggcgaggtcgaagcttggtctcctgaggctcaggatccagacggtagcagggacggaaacgaagagaaagaacgcctgaaaaaatgccccaagcaaaaggaggtggcccacgaggtggccgtgaaggagtggtggccctcggtcgcctgccctgagttctgcaatccaaggcagtcccctatgaacccgtggctgaaagacacattgacgagacggttgccccactcctgtcctgattgtggacgcaacttcagttatccctccctactcgcaagccaccagcgggtacacagcggagaacgaccttttagttgcggccagtgccaagccaggttttcccaacgaaggtatctcctgcagcaccagttcatccatacaggggaaaaaccatacccgtgccccgactgcgggaggaggttcagacagcgcggctcactggccatccacagaagagcccacaccggggaaaaaccatatgcttgttcagactgcaaaagcaggttcacgtacccctacctgctcgcaatccaccagcgcaagcacacaggcgagaaaccatatagttgtccggattgtagcctacggtttgcgtacacctccttgttagccatccatcggcgaattcacaccggcgagaagccatatccttgccctgactgcggcagaaggttcacctattcgtcccttttactctctcacaggcgaatccattccgactcaaggccctttccttgtgtggagtgtggaaaggggtttaagcgaaaaaccgccttggaagctcacaggtggattcataggtcatgcagtgaacgccgtgcctggcaacaggctgttgtcggcaggtcggagccgattccagtcttgggtgggaaagacccaccagtccacttccgacattttcctgatatcttccaggagtgcggctag

SEQ ID NO: 22157 - DNA, 2238 bp, Artificial Sequence
  Description of Artificial Sequence: Synthetic coding sequence
atgcggagcaactacgagaccctggtgagcctggacgacggcctgcctaaacccgagcttatttcttggatcgagcacgggggagagccttttcggaagtggcgggagtcccagaaaagtggtaacattatttgttcgagcgttgatatgcactttgatccaggcttcgaagagcagcttttctggggcagccaacaggccatgaacagcggaaaaacaaagagccatttccagctcgatccagaatctcaatgctccttcggctcttttgtgtcatttcgcccagatcaggggattacattgggatctccacagagacacgatgctcgagcaccgccgccactcgcatgtggcccaagcgaatccacactgaaagagggcatcccaggccccagaaatctggatttgcccggactctgggatgtgcctgcctgggagtccacccaacacccatggccagtgtgtggggagtcatgctgggaaaataatcacctggttatgcaccaaagaggtcactctaaggatagaacgcggagggcctgggaaaagttcaataagagggcggagacacagatgccgtggtccagtcccagagtgcagagacatttccgctgcggcgtttgcggcaaatccttccggaggaagctttgtctattgagacatcttgcagctcacaccggccgggggccattcagaaatgcggacggcgagatgtgcttcagacatgagttaactcacccaagtcatcgtttgcctcaacagggagaaaagcccgcccagtgcaccccgtgtggtaagcggtcactccctgtggactctacgcaggctcggcgttgccagcactctagagaagggccagccagttggcgcgagggccgcggtgcaagttctagtgtgcactctggacagaagccaggctcgaggctaccgcaggagggtaatagccatcaggagggcgatactgaggccctccagcacggtgccgaagggccatgctcctgctccgaatgcggagagagatctcctatgagcgcgaggctggcctccccatgtagagctcataccggagagaaaccttttcagtgcgcccactgtacgaagagatttcgtttgcgacggctcctgcaggtccaccaacacgcccacggaggcgagcggcccttcagctgccggaagtgcggaaaaggtttcgctaaacagtgcaagctcactgagcatatccgcgtacattctggggaaaaacccttcaggtgcgccaagtgtggccggaatttcagacaaaggggccagttactccgacatcagcgactgcatactgatgagaagcccttccagtgcccagaatgtggcctgtcattcagactggagtctatgctgagagctcaccggctcagacacggtggggagaggcctttcagctgctcggaatgcggcagaggcttcacccatcagtgtaaattgagagagcatttgagggttcattccggcgaacgtcctttccagtgtttaaaatgcgataaacgtttccggttgaagggcatccttaaagcccaccagcacactcattccaaagaacggccattctcatgtggagagtgtgggaagggctttacgcggcaatccaagctcactgaacacctgcgtgtgcattcaggagaaagacccttccagtgtcccgaatgtaatcgctcttttaggcttaagggtcaactgcttagccaccagcggctccatactggggagagaccctttcagtgcccagaatgcgataagcgttaccgcgtcaaagccgacatgaaggcacaccagcttctccattctggggagatgcccttctcatgcgaatgcggaaaaggcttcgtcaagcacagcaaactcatcgagcacattagaacgcacacaggagaaaagccttttcaatgtcccaagtgcgacaaaagctttcgactaaaggctcagctgttgtctcaccaagggctccataccggtgaacgtcccttccattgccctgagtgcgataaaaattttcgtgagcgagggcacatgctgagacaccagcgtatccacagacctgagagaccttttgcctgcggcgactgtggcaagggattcatttataagtctaaactggctgagcatatccgagtccacactaaatcctgccctgcgccaaatgagcttgatatcaagaaaaggctgtcccagctgtttgccatgatagaagccgactggtcgtag

SEQ ID NO: 22158 - DNA, 2349 bp, Artificial Sequence
  Description of Artificial Sequence: Synthetic coding sequence
atggccgagcccccccggctgcccctgaccttcgaggacgtggccatctacttctcagagcaagaatggcaggacctcgaagcttggcagaaagagctctataagcacgtaatgaggtcaaattacgagaccttggtgtcattggatgacgggttgcccaagccagaattgatttcttggatcgaacacggcggcgaacccttccgcaagtggcgggagtcacagaagtccgggaatatcatctgcagttctgtagacatgcacttcgaccctgggttcgaggagcagcttttctgggggagccaacaggctatgaacagcggtaagactaagtcgcacttccagctggatcccgaatctcaatgcagcttcgggagcttcgtgagcttcagacctgatcagggcatcacgctgggctctccccaacgccacgatgccagagctccaccccctctggcgtgtggcccttccgaatccaccctgaaggaggggatacctgggcccaggaatttggatctcccagggctgtgggacgtgcccgcatgggaatctactcagcacccctggcctgtgtgtggtgaatcatgttgggagaacaaccatttggtgatgcaccagcgagggcactccaaggaccgtacacggagagcatgggaaaagtttaataagagagcagagacacagatgccctggtcaagtccccgtgtgcagcgacatttcaggtgcggcgtgtgcggcaagtctttccgacgaaaattgtgcctcctacgacacctcgctgcacacaccggaagaggtccgttcaggaacgccgacggagagatgtgctttcgccacgaactgacccacccttcacatagactgcctcagcaaggggagaagccagctcagtgcactccatgtggcaagagaagcctgccagtggacagtacccaagctcgacgatgtcaacattcaagggaaggacccgcctcctggagagagggacgaggggccagcagctctgtgcacagtggtcagaaacccgggagtcgactgccccaggaaggaaattcccatcaggagggagacaccgaggcacttcagcatggagccgaaggaccctgtagttgttcagaatgtggggagcggagtcccatgtccgctaggcttgcttcaccctgccgggcacacaccggtgagaaaccttttcagtgcgcacactgcaccaagagatttcgcctgagaagactcttacaggtgcaccaacatgcacatggaggggagcggcctttctcctgccggaagtgtggcaagggcttcgccaaacaatgcaagctcactgagcacataagggtgcatagcggcgaaaagccctttcgatgcgctaagtgcggcagaaatttcaggcagaggggacaactgctccggcaccagcgcttgcacaccgatgaaaaacccttccagtgtcccgagtgcggcctgtcttttcgactggagtcaatgttacgggcccataggctgagacacgggggcgaacgcccattttcttgcagcgagtgtggaagaggctttacccatcagtgcaaactccgcgaacatttgagagtgcacagtggagaaagaccgttccaatgtctgaagtgcgacaagaggtttaggttgaaagggattcttaaggctcaccaacacactcattcgaaggagagaccgttctcatgtggggaatgcgggaagggatttacacggcagtcaaaactcaccgagcatctgagggtgcattccggggaaagaccttttcaatgccccgaatgtaatcggagcttccggttgaaagggcagctgctctctcatcaaagattgcacactggagagcgaccatttcagtgcccagagtgtgacaagaggtaccgtgtcaaggcagacatgaaggcccaccagctgctccactccggtgaaatgccgttttcctgtgagtgtggaaaaggattcgttaaacactcaaagctgattgagcacatcagaacgcatactggagaaaaacctttccagtgtcctaaatgtgacaagtcattccggcttaaggcccagcttctaagtcaccaaggactacacacaggtgaaagaccatttcattgtcccgaatgcgacaaaaacttccgagaacgtggacatatgctgcgccaccagcgtattcacaggcccgagagacccttcgcctgtggagattgcggcaagggttttatttacaaaagtaagctggccgaacacatcagggtccacaccaagtcatgtcccgccccaaatgaactcgacattaagaagcgactgtcccagctctttgctatgatagaggctgactggtcctag

SEQ ID NO: 22159 - DNA, 1056 bp, Artificial Sequence
  Description of Artificial Sequence: Synthetic coding sequence
atgcacttcgaccccggcttcgaggagcagctgttctggggcagccagcaggccatgaactccggtaagactaagtcgcacttccagttggatcccgaatcccagtgcagtttcggcagcttcgtctcttttagacccgaccagggtattaccctggggagcccacagcgccacgatgcaagggccccacccccgctggcctgcggacccagtgaatctaccttgaaggagggtattccaggacccagaaacctcgacctgccgggactgtgggacgtgcctgcctgggaaagtacccaacacccttggcccgtgtgcggcgagtcctgctgggaaaataaccatctggtgatgcaccagaggggccactccaaggaccgcacccgtagagcctgggaaaaattcaataaaagggcagagacacagatgccatggtcgtcgccccgcgtacagcgtcattttcgctgtggggtctgtggtaaaagcttcaggcgcaaattatgtctcctccgacaccttgctgcccacacagggaggggacccttcagaaatgcagacggggaaatgtgcttcaggcatgagttaacacaccccagccatcgcctacctcagcaaggagaaaagcccgctcagtgcaccccctgcggaaagagatcactcccagtcgacagtacccaggcccgcaggtgccaacactccagggagggccctgcttcctggagagaggggcgcggcgctagcagttcggtccattcaggtcagaagccaggttccaggttacctcaggagggtaatagccatcaagaaggtgacacggaggccttgcagcatggggccgagggtccctgcagctgttctgaatgtggggaaaggagtccaatgtccgccaggctggcctccccctgtcgcgcacacacaggcgaaaagcctttccaatgcgcccattgcactaaaaggttccggctgcgccgcctactgcaagtacatcagcatgcacacgggggcgagaccgtactgttgcaagaagtctggcaggggttgcgccaggccgtctag

SEQ ID NO: 22160 - DNA, 1152 bp, Artificial Sequence
  Description of Artificial Sequence: Synthetic coding sequence
atggagctgcgggaggaggcctggagccccggccccctggacagcgaggaccagcaaatggcttctcacgagaatccagtggatatacttatcatggacgacgacgacgtccccagctggcctcccacaaaactcagccctccacagagcgcacccccggcgggcccacccccaagaccacgcccccctgccccgtatatctgcaatgagtgcggcaagagttttagtcattggtcgaagctgacaagacaccagaggactcacaccggcgagcggcccaatgcgtgtgctgactgtgggaaaacttttagccaatctagccatctggtccagcacagacgcatccacacaggtgagaaaccttatgcttgtctggaatgtgggaaaagattttcttggtctagcaatctgatgcaacatcaaaggatacacacaggagaaaaaccttatacgtgccctgattgcgggcggagtttcacacagagcaagagcctggccaaacaccgaaggtctcattccggactgaaacccttcgtgtgtcctaggtgtggtaggggtttctcccagcccaaaagtctcgcacgtcacctcaggctccatcccgaactgagtggaccaggcgtagcagcaaaagtcctagctgcatccgtccgccgcgccaaagggccagaagaggccgtggccgcagacggtgaaatagcaattccggtgggagatggtgaggggatcatcgtcgtgggagcacccggagagggtgcagctgctgccgcggccatggcaggagcaggtgccaaggctgctggccctcgatccagaagagctccagcccctaagccctacgtgtgcctggagtgtggcaaaggttttggccacggcgctgggttacttgctcaccagcgggcccagcacggcgatggcctcggtgcggccggtggcgaagagcccgcccacatctgcgtagaatgcggagaaggcttcgtgcagggagccgccctcagacggcacaagaaaattcacgccgtgggtgcaccgtcagtgtgctccagctgtggtcagagctattaccgggccggcggtgaggaggaagacgatgatgacgatgaagcagccgggggaagatgtccggagtgcaggggcggagagggccgatag

SEQ ID NO: 22161 - DNA, 1848 bp, Artificial Sequence
  Description of Artificial Sequence: Synthetic coding sequence
atgaacgtgcggatcctgcggcggcacctggtgttccccttcatcttcattgtcataaaggagctcacactggaaggaaccccaatgaatgtgaacaatttagagaatccactggatgcaccccagaattttaagtgcatgcaagggctgagtgttgaaaagccttacaagtgcaagaagtgcgaaaaggcctttaataatctctcaagctttcaaattcatgagaggatgcatcgaggcgggaaatatcatgcgtgcaaaggttctgggaacacctatagattttccgggttctatcaccggcataagatgcctcacgccggggggaagttctatgggtgtaagaaatgcggaaaggcgttcatatctttttgcgccttcaggtaccaccagcgaacacacaccaaggagaaaccctacgcgtgtaagcagtgcggcaaagcatatatatcatacacttcctttcagtatcaccaactgaatcacaccggagcaaaatgctatgagtgtaagcagtgtggcaaaggatttgacttaccaaattctattcgctatcatgaaatgacccacacaggtgagaaaccccacgaatgtaagcaatgcggaaagacattcagatgtgccagtagcttacgtattcacggccgcacccacacaggggagaagccctacgaatgcaagcagtgcggcaaggtttcccggtattggtctggactgcaggtacacgaagtgacccacataggcaagaaactgtacgaatgcaaggaatgtggcaagagctattacagctcaggatctttcttgaaccataaacgaattcacacccgcgaaaagtcttatgaatgcaaagaatgcggcaaggcctttgggaacccgatctcattccaaaaacacgaaggcagccaccgcaagtggaaaccctacgaatgtaaggaatgcggaaaagtgttttcttttagctcatccctgagaagacacgagagaacgcacacggaaaagctatgcgagtgcaaacagcacggcaagggcttttttcataggtcatgtcctcgccacatgaaaatcgatacgggtgaaattctccataagaggaaaattagagggaaggtgtttcacagtccaagttccttccagacctgtgagcgatcccacacccgagagaagcgctacaagtgtaagcagtgcggaaaaccgttcatatacttcaatgctttccagaggcaccagcgttcccataccggggaaaacccttatgaatgcaagcaatgtggaaaagcgtgcatctcgtccactgcgttccagtgcagagagctctcccatacaggagccaagcgctacaaatgtaaacaatgcggaaagggctttaatctccccagcagcatcagataccacgagatgacccacacaggagagaaaccgtacgaatgtaaacagtgtgggagggcctttcggagcgcatcccacctgagaacacacgaaagaacccatattggggagaagccctatgaatgcaagcaatgcggaaaggtatatcgctactggtcaggattgagaatccacggcctaacccacataggtaaaaaaccgtacgagtttaatgatcgtggtaaaagcttctacagcagcaatttcttcctaaatcacaaaagagtccatactagagttaagacatacgaatgtaaggagtgtggcaaggcctttgacaatccaacatcttttcaaaaacacgaaggatcccacaggaagggtaagtcctacgagtgtaaggaatgtggcaaagtattctctttcagcaggtcatttcgacgctatgagcgtgcgcatacaggtgagaagccgtgcgaatag

SEQ ID NO: 22162 - DNA, 780 bp, Artificial Sequence
  Description of Artificial Sequence: Synthetic coding sequence
cggagccacacccgggagaagcggtacaagtgcaagcagtgcggcaaaccattcatttatttcaacgcatttcagaggcaccagaggagccatacgggagaaaacccttatgagtgtaaacagtgcgggaaggcatgcatcagcagtaccgcttttcagtgtcgagagctgtctcacactggcgccaaacgctacaagtgtaagcagtgcgggaagggctttaatctccccagttcaattcggtaccacgaaatgactcatactggggagaagccatacgagtgcaaacaatgtggacgcgcattcaggtctgcttctcacctgaggactcacgagcggacccatataggggagaagccttatgagtgcaaacaatgtggtaaggtctatcgatactggtccggactccggattcacgggctgacacacattggcaagaaaccatacgaatgcaaagaatgtgggaaggcattcgataatcccaccagcttccagaagcatgagggctcccacagaaaaggaaaatcctatgagtgtaaggagtgtggcaaagtgtttagcttcagtaggagctttcgccgtcacgggcgcatgcatacaggggagaagccatatgaatgtaaaaactgtgggaaggcattcaccagtgccaagtccctgcagaatcacggtcggactcataccggggagaaaccatgcgaatgtaagcagtgtggaaaggcatttatttgttcttcatcatgtcaacgacacgaggaaactcattcagtgaacatgtag

SEQ ID NO: 22163 - DNA, 1278 bp, Artificial Sequence
  Description of Artificial Sequence: Synthetic coding sequence
atgttcccccccgcccggggcaaggagctgctgagcttcgaggacgttgccatgtacttcacaagagaagaatgggggcacctaaattggggccagaaagatctgtatcgagatgtcatgcttgaaaactataggaatatggtgcttctgggcttccagttccccaaaccagagatgatctgccagctggagaattgggatgagcagtggatccttgatctgccgcgcacaggaaaccggaaggcttcaggctcggcctgtccaggaagcgaggcccgccacaaaatgaaaaagctcacccctaaacaaaagttcagcgaagatctggaatcttacaagatttcagtggtgatgcaggagtctgcggaaaagttaagcgagaagctccacaaatgcaaggagttcgtcgatagctgccggctcaccttccctacctcaggtgacgaatatagcagagggttcctgcagaacttgaacctgatccaggaccagaacgcacagactcggtggaaacaaggccgctacgacgaagacggcaagcctttcaaccaacggtccctacttctgggccacgagcgcatccttacacgtgccaagagttacgagtgttcagagtgtggcaaagtcattcggagaaaagcgtggtttgatcagcaccaacggattcactttttggagaaccctttcgaatgtaaggtgtgcggacaagcttttagacagcggtccgccctcactgtgcataaacagtgccaccttcaaaataaaccatacagatgccacgattgcggaaaatgctttagacaactggcttacctcgtggagcacaaacgcatacacaccaaggagaaaccatacaagtgcagcaaatgtgaaaaaacattcagtcagaatagcaccttgattcggcaccaggtgatccatagtggggaaaaaagacataaatgtctagagtgtggtaaagcctttggccgccacagtactttgctctgtcatcagcaaatacactctaagcctaatactcacaagtgtagtgagtgcgggcaatcattcggtcgcaacgtggatctgatacaacaccagcgaatccacaccaaagaagagttttttcagtgcggtgaatgtggaaaaaccttttcatttaaacgaaatctgtttcgccaccaggtcatccatacaggaagccagccttaccagtgcgtgatctgtggcaaatcattcaaatggcacacttccttcataaagcatcagggtacacacaaggggcagatcagtacctag

SEQ ID NO: 22164 - DNA, 189 bp, Artificial Sequence
  Description of Artificial Sequence: Synthetic coding sequence
atgttcccccccgcccggggcaaggagctgctgagcttcgaggacgtcgcgatgtattttacgcgagaggagtggggacacttaaactggggccagaaagacctataccgggacgtgatgcttgagaactaccgtaacatggttctcctggtgtattttcagtttgatgcggcaataccgctgtgttag

SEQ ID NO: 22165 - DNA, 1911 bp, Artificial Sequence
  Description of Artificial Sequence: Synthetic coding sequence
atggcccacctgatgatgttccgggacgtggccgtggacttcagccaggaggagtgggaatgcctggatctggagcaacgagacttgtacagagacgttatgttggagaattatagtaacatggtcagcctaggtttctgcatctaccagcccgaggcctttagtctccttgagaagggtaaagagccctggaagatcctgcgggatgagacacgcggcccatgccccgatatgcaaagccgctgccagaccaaaaagctcctgcccaaaaatggaatcttcgagcgggagatcgcacagctggaaataatgcgtatttgcaagaaccatagtttagattgcctgtgctttcgcggggattgggagggcaatacgcagttccagacattgcaggacaaccaggaggagtgctttaagcaagtaattagaacctgtgagaagcgccccacctttaatcagcacacagttttcaatctccatcaacggctgaacaccggcgataagttgaatgagttcaaggaattgggaaaggctttcatcagcggatcggatcatacacagcatcagcttattcatacttccgagaaattttgcggcgacaaagagtgcggcaacacattcttgccagattctgaggtgatccagtaccaaactgtccatactgttaagaagacgtacgagtgtaaagagtgtggtaagtccttttctctgcgcagttcccttactggtcacaagcgcatccatacgggggagaagcctttcaagtgcaaggattgcgggaaggcctttcgctttcatagccagcttagtgtgcacaagagaatacacacaggtgagaagagttatgagtgtaaagaatgcggcaaagccttcagctgcggctcggacctgaccaggcatcagagaatccacactggcgaaaaaccatatgagtgtaatgaatgcagaaaggcattcagccagcgctctcatctgattaaacaccagagaattcacacaggcgaaaaaccatacgagtgtaaagagtgtggtaaagcctttacgcgcggttcacacctcacacagcaccagagaattcacacaggcgagaagtcacacgagtgtaaggagtgtggcaaggcttttatcagaggtagcaatcttgcacaacaccaaaatgtccacgtgggacggaagccctacaaatgcgagaaatgcggcaaagcctacatttggtcaagccacctggcacgccaccagaggatccatacaggaagaaaaccatacgaatgtaaacagtgtggcaagacttttacatgggcctcttatctggcgcaacacgaaaaaatccacaacgagaggaaatcctacgagtgcaaggagtgcgggaagacattccttcatggatcggaattcaatcgccatcagaagattcataccggggagagaaactatgagtgcaaagagtgcggcaagactttcttcagggggtccgagttaaatcgccaccagaagattcacacgggaaaaagaccttacgagtgtgaggaatgcggcaaagcctttctgtggggatcccaattgacacggcatcagcgcatgcacacaggtgaagaaccatatgtttgtaaggagtgcggcaagagctttatttgggggtcccagttaacgcggcataaaaaaatccacacagacgccgagccatatggctgtaaaaagtcctcgcatattttcagccatcatagctactttaccgagcaaaaaatccataactctgctaacctctgtgagtggacggattatggtaatactttttcccatgagtcgaacttcgcacagcaccagaatatctacacgttcgagaaatcctacgaatttaaggactttgagaaggcgttctctagttcttcccatttcatcagtctgttgtag

SEQ ID NO: 22166 - DNA, 408 bp, Artificial Sequence
  Description of Artificial Sequence: Synthetic coding sequence
atggcccacctgatgatgttccgggacgtggccgtggacttcagccaagaagaatgggaatgcctggacctggaacaacgagacctgtatagagacgtgatgttggagaactactctaacatggtttccctgggattttgtatttatcagcccgaagccttctcccttctcgagaagggaaaagagccctggaagatcctgagagacgagaccagaggaccttgccctgatatgcaaagtagatgccagaccaagaagctgttgcccaaaaatggcatattcgaaagagaaattgcccagctggagattatgcgtatctgcaaaaaccatagcctggactgcctttgttttaggggggattgggaggggaacacccaatttcagacacttcaagataatcaggagtag

SEQ ID NO: 22167 - DNA, 150 bp, Artificial Sequence
  Description of Artificial Sequence: Synthetic coding sequence
atggcccacctgatgatgttccgggacgtggccgtggacttcagccaggaagagtgggagtgcctggacctggagcagcgggatctgtatagggatgtgatgttagaaaactatagcaacatggtctcactgggcttttgtatctactag

SEQ ID NO: 22168 - DNA, 540 bp, Artificial Sequence
  Description of Artificial Sequence: Synthetic coding sequence
atggcccacctgatgatgttccgggacgtggccgtggacttcagccaagaggagtgggagtgcctggacttggagcaaagggatctgtaccgagacgtgatgcttgagaactactcgaatatggtaagcttagggttttgcatttatcagcctgaggctttcagcctgctcgagaagggaaaggagccttggaagattcttcgtgatgaaacaagagggccatgtcccgacatgcagtcaagatgtcagaccaaaaagcttcttccaaagaacggcatcttcgaacgcgaaatcgctcaattagaaatcatgagaatctgtaagaaccactcactggattgtctatgtttcagaggtgactgggaggggaacacacagttccagactctgcaggacaatcaggaggagtgtttcaaacaagtaattcggacttgcgaaaagcgtcccacatttaaccagcacactgtgttcaatttacaccagagacttaatacaggggataaactcaacgaatttaaggaactgggtaaggccttttag

SEQ ID NO: 22169 - DNA, 1731 bp, Artificial Sequence
  Description of Artificial Sequence: Synthetic coding sequence
atggacagcgtggccttcgaggacgtgagcgtgagcttcagccaggaagagtgggccctgctagctccctcacagaagaaattgtacagggacgttatgcaagagacctttaaaaatctggcctcgatcggagaaaagtgggaggaccctaatgttgaagaccagcataagaatcagggcagaaatctgcggtcccatactggtgagcgtctttgcgaagggaaggagggcagccagtgtgccgaaaacttctcgcctaacctgagcgtgaccaagaaaacagctggtgttaagccctacgagtgtaccatctgcggcaaggcgttcatgagactcagcagcctcactcgacacatgcggtctcacacgggatacgagttattcgagaagccctataagtgcaaagaatgtgagaaggcctttagttacctcaaaagtttccaacgccacgaaagatctcacaccggagaaaagccttacaaatgcaagcaatgcggtaagaccttcatctaccaccaaccatttcagcgccacgaaaggacgcatattggggaaaagccttacgagtgcaaacaatgcgggaaagccctttcgtgcagctcctccttgcgagttcatgagcggatccataccggcgagaaaccttatgagtgcaagcagtgtggaaaggcctttagctgttcctcatcaatccgggtgcacgagaggacgcacactggagagaagccttacgcttgtaaggagtgcggtaaagcctttatttctcacacatccgtgctgactcatatgattacacacaatggtgatagaccctacaagtgtaaagagtgtgggaaagccttcattttcccctctttcctccgcgtccacgaaaggattcatactggcgaaaaaccttataaatgcaagcagtgcgggaaggcattccgctgtagcacatctatccagatacacgaacgcatacacaccggggagaaaccctataaatgcaaagaatgtggcaagtcattctccgctcggccggcattccgggtacatgtgcgtgttcataccggcgaaaaaccgtacaaatgtaaggaatgcggcaaagcatttagtcgcatctcctactttagaatccacgaacggacccacaccggggaaaagccctacgagtgcaaaaaatgcggcaagacgtttaactaccctctagatttgaagatccacaaacgtaaccacaccggcgagaagccttacgaatgcaaagagtgcgccaagacatttatctcactggagaactttagaaggcacatgatcacccatacgggagacgggccctacaaatgcagggactgcgggaaagtgtttatctttccctccgcacttcgaactcatgagagaacacacaccggagagaagccttacgagtgcaaacagtgcggaaaggccttttcttgcagcagctacatccgaatacacaaaaggacccacacaggcgaaaagccatatgagtgtaaagaatgcggcaaagccttcatctaccctacctcctttcagggacatatgaggatgcatacaggcgagaagccttacaaatgcaaagagtgcgggaaagccttctccctgcactcaagcttccaaagacatacacggattcataactatgagaagcccctggagtgtaaacaatgcggcaaggctttcagtgtttcaactagccttaagaaacacatgagaatgcacaatcggtag

SEQ ID NO: 22170 - DNA, 1434 bp, Artificial Sequence
  Description of Artificial Sequence: Synthetic coding sequence
atggacagcgtggccttcgaggacgtgagcgtgagcttcagccaggaggaatgggccttactggccccttcacagaagaagctgtatagagatgttatgcaagagaccttcaagaaccttgcctccataggggagaagtgggaagaccccaatgtggaagaccagcataagaatcagggccgcaacctccgtagccacactggcgagcgcttgtgtgagggaaaagaggggtcacagtgcgccgagaattttagtccaaacctcagcgtcaccaagaagactgccggcgtgaagccatatgaatgcacaatctgcggtaaggcattcatgcggctatcctcactgacccgacatatgaggtctcataccggttatgaactgtttgagaagccgtataagtgtaaggaaagcggcgagaagccttataaatgcaagcaatgtggcaaaactttcatttaccaccaaccatttcagcgacacgaaaggacccatattggagagaagccgtacgaatgcaagcagtgtggtaaagccctctcctgctcaagcagcctgcgggtccatgagcgaatacacacaggcgaaaagccatacgaatgtaaacagtgtggcaaagcgttttcatgcagttcgagtatccgcgtacatgagcggacccatactggagagaagccatacgcctgtaaagagtgcggaaaagcctttatatctcacacaagcgtcctcacccacatgatcacccacaatggggacaggccctacaagtgcaaagaatgcggcaaggcttttatctttccgtcttttttaagggttcatgagcgcatccacacaggcgagaagccttacaagtgtaaacagtgtggtaaagcctttcgctgctctacctctatccagatccatgagcggattcataccggcgagaaaccgtataaatgcaaagagtgtggtaaatcttttagcgctaggcctgcttttcgcgtgcatgttcgggtacataccggcgaaaaaccatacaagtgtaaggagtgtggaaaagcattctcccggatctcctattttcgcatccacgaaaggacacatacaggcgagaaaccatacgaatgtaaaaaatgtggcaagacatttaactaccctttggatttgaaaatccacaagagaaaccatacaggagagaagccgtacgaatgcaaggactgcggaaaggtatttatatttccctctgctttgcgcacccacgagcgcacgcataccggcgaaaaaccttatgagtgtaagcagtgcgggaaggcgttcagttgttcctcttacattcgcatccacaaaaggactcatacgggcgagaagccctacgaatgcaaggaatgcggtaaagcatttatctaccccacgagttttcaggggcacatgaggatgcacaccggagagaaaccctag

SEQ ID NO: 22171 - DNA, 1635 bp, Artificial Sequence
  Description of Artificial Sequence: Synthetic coding sequence
atgcaggagaccttcaagaacctggccagcatcggcgagaagtgggaggaccccaacgtagaagaccagcataagaatcagggcagaaatctgcggtctcacacgggcgaacgattgtgcgagggcaaggaggggagtcaatgtgctgagaacttttcccctaatctgtcagtgaccaaaaaaactgccggagtcaaaccttacgaatgcaccatctgtggaaaagcctttatgagactctctagtctaaccaggcacatgagatcccatacaggatacgaactcttcgagaagccctacaagtgtaaagagtgcgagaaggcattttcatacctgaagtcttttcagcgccatgagcgcagtcacacaggcgagaagccgtataaatgtaagcaatgtgggaagaccttcatctaccatcaacctttccagcgtcacgagcgcacgcacattggagaaaaaccgtacgagtgcaagcaatgcggtaaagctctgtcatgtagttcatccctcagggtgcacgaacggattcatacaggggagaagccatacgaatgcaaacagtgcggtaaggccttctcctgcagcagttcaattcgagtccacgaaagaactcacacaggcgagaagccatatgcgtgtaaggaatgtggcaaggcattcatctcccacacctctgttctcacacacatgatcacacacaacggggatcgaccctacaagtgcaaggagtgcggcaaggcatttatattcccatctttcttgagggtgcacgaaagaatccacactggcgagaaaccctacaagtgtaagcaatgtggtaaggcgttccgctgtagcacgtccatccagatacatgaaaggattcataccggcgagaagccctataaatgtaaggagtgcggcaagtcgttctctgccaggccggcattcagagtgcacgttcgtgttcacactggggaaaagccctacaagtgcaaagaatgtggaaaagcattttcaagaatcagctacttcaggatccacgaacgtacccacaccggagaaaagccctatgaatgtaaaaagtgcggcaaaacatttaattaccccctggacctaaaaatccataagcgcaatcacaccggggaaaagccttatgaatgcaaagagtgtgctaagacattcatttccctggagaacttcagacgtcacatgattacccacaccggcgatggcccgtataaatgtagagattgcgggaaagtcttcatttttccctctgccctccgcacccatgagaggacgcacacaggtgaaaagccctatgagtgtaagcaatgcgggaaagccttttcctgctcctcttacattcgaatccataagcgaactcatacgggcgagaagccatacgagtgcaaggaatgcggaaaggcattcatctatccgacttcttttcagggccacatgaggatgcatacgggggaaaagccatataaatgtaaggaatgcgggaaggctttcagcctccattcaagcttccaaaggcacacaaggatccacaattatgagaagcctttagagtgcaaacagtgtggtaaggcattttccgtgtccacttctttgaaaaagcacatgcgaatgcataatcgctag

SEQ ID NO: 22172 - DNA, 1404 bp, Artificial Sequence
  Description of Artificial Sequence: Synthetic coding sequence
atgcggctgagcagcctgacccggcacatgcggagccacaccggctacgagctgttcgaaaagccctacaagtgtaaggaatgcgagaaagccttttcatacttgaaatcatttcagagacacgagaggtcccataccggcgagaaaccttacaagtgtaaacagtgcggaaaaacttttatatatcaccagcctttccagagacacgaacgcacccatataggagagaagccttacgaatgcaagcagtgcgggaaagcactcagctgctcaagctccttaagggtccacgagaggatacataccggcgagaaaccttacgaatgcaagcagtgcggtaaggctttctcgtgctcttcctctataagagtacatgagagaacccacacaggcgagaagccatacgcttgcaaagagtgtgggaaagcgtttatatcccacaccagcgtgctgacacatatgatcacacataacggtgaccgcccgtacaagtgtaaagagtgtggcaaagctttcattttcccctcatttcttcgtgtgcacgaaaggatccacacaggtgagaagccgtacaagtgtaaacaatgcggcaaagcctttagatgctcgacatctattcagatccacgagcgtatccacactggggagaagccatacaagtgcaaggaatgcggtaagagcttttccgcacggcccgctttccgggtgcacgtccgcgtccacaccggtgaaaagccgtacaaatgcaaggaatgtgggaaagccttctccagaattagctattttaggatccatgagcggacacacaccggggagaaaccctatgagtgtaaaaagtgtggcaagacgtttaattaccctctggatctgaagatccataagcgcaaccacaccggcgaaaagccctatgagtgtaaggaatgtgccaagacctttatatctttggagaactttcgtaggcatatgatcacccacaccggcgacggcccatacaaatgccgagattgtggcaaggttttcatcttcccttctgctttgagaacgcacgagcggacccacacaggcgagaagccctatgagtgcaaacagtgcggcaaagcgttcagttgtagtagctacatccggattcacaaaagaacgcacacaggcgaaaagccatacgaatgcaaggagtgcggcaaggccttcatctatcccacatcatttcaaggccacatgcggatgcatactggcgagaagccatacaagtgtaaagaatgtggaaaggcgttctctttgcattcaagtttccagagacatactagaatccacaactacgagaaaccccttgaatgtaaacagtgtggcaaggccttttctgtgagtactagcttgaagaaacatatgcggatgcacaatcggtag

SEQ ID NO: 22173 - DNA, 1035 bp, Artificial Sequence
  Description of Artificial Sequence: Synthetic coding sequence
ctggccgagcaccagaccacccacccccggcagaagcccttcgtgtgtgaagagtctggtgacgccttcaataataaatcgactctggtgcaacaccagaggatccactctcgggaaaggccttatgaatgcagtaagtgcggcattttcttcacatacgcagcagatttgacccagcatcagaaggtgcacaatcgagggaaaccttacgaatgctgcgaatgtggcaagttctttagccagcattcaagcctagttaagcacagacgcgtccacaccggggaaagcccacatgtgtgcggggattgcggtaaatttttctcaagaagctcaaacctcatccagcataagagagtccatacgggggagaaaccttacgagtgttccgactgcgggaaattttttagtcagagatccaatcttattcaccacaaaagagtgcataccgggagatcagcccatgagtgcagtgaatgcgggaagagtttcaattgcaatagcagcctgattaagcactggcgggttcacactggggagcggccatacaaatgcaatgaatgtgggaagtttttttcccacatcgctagcttaatccagcaccagatcgtgcacactggagagagacctcacggatgcggggagtgcggaaaggctttcagcaggagtagtgacttgatgaagcaccagagggtgcacacaggcgagcgaccgtatgagtgtaacgagtgcgggaaactcttttcccaatcatcgtccctcaacagtcacaggcggttacataccggcgagcggccctaccagtgcagcgaatgcggaaagttttttaaccagtcttcttcactcaacaatcaccgccggctgcatacaggagagcgaccgtatgagtgcagtgaatgtggcaagacattccgtcagcgatctaacctgaggcagcatctcaaagtccacaagcccgatcggccatacgaatgttccgagtgtggcaaagccttcaatcagcggcctactcttattagacatcagaagatacactag

SEQ ID NO: 22174 - DNA, 1899 bp, Artificial Sequence
  Description of Artificial Sequence: Synthetic coding sequence
atggccgccgccgccctgcgggaccccgcccagggctgcgtgaccttcgaagatgtaactatctacttcagccaggaagagtgggtcctactcgatgaggcccagaggctcttatactgtgatgttatgctggagaactttgcgctgattgccagtcttggcctgatttccttcagaagccatattgtgtcgcagctcgaaatgggtaaggagccctgggttcccgatagcgtcgatatgactagcgcaatggcacggggcgcctatggacgcccgggctccgacttttgccacggcactgagggcaaagatctccccagcgaacacaatgtctcagtagaaggagtggcacaggacaggagcccagaggcaacgctgtgcccccaaaagacttgtccttgtgacatttgtggtctgcggctgaaagatattctgcacttagctgagcaccagacaacccatccgcgacaaaagccttttgtgtgcgaggcctacgtgaagggcagtgaattttccgcgaacctaccccgcaagcaagttcagcagaacgtgcataacccgatcagaaccgaagaagggcaggcgtctccagtgaaaacctgcagagatcacaccagcgaccagctgagcacttgcagggagggcgggaaggatttcgtcgctaccgctggattcttgcaatgcgaggtgaccccatcggacggagagccacatgaggcaacagagggcgtcgttgattttcatatagcactgcgccataataagtgctgtgagagcggtgatgctttcaacaacaagtccacgctggtgcagcaccagaggattcattcgcgagagcgaccctatgagtgcagcaagtgcgggatttttttcacttatgcagccgatttaacacagcatcagaaagtgcataataggggaaagccctatgaatgctgcgaatgcggtaagtttttcagtcaacacagcagcttggtaaagcatagaagggtgcatacgggagagtccccccacgtctgtggggactgcgggaaatttttcagcaggagctcaaacttaattcaacataaaagggtccacacaggggaaaaaccatacgagtgctccgattgtgggaaattctttagtcagcgtagcaacctgattcaccacaagagagttcacaccggacggtccgcccatgaatgtagcgaatgcggtaaatcttttaattgcaacagctcattgatcaagcattggagggtccacaccggggaaagaccatacaaatgcaatgaatgtggaaagtttttcagccatatcgcatccctgattcagcaccaaatcgtgcacacaggcgaacgcccgcacggatgtggcgaatgtggtaaggccttttcgagatcatctgatctgatgaaacaccagagagtccataccggggaacggccttacgagtgcaatgaatgtgggaaactcttctctcagagctcttctctgaatagccacaggcggctgcacaccggcgagagaccttatcagtgtagcgagtgtggcaaattcttcaatcagtccagttctctgaataatcacagacgcctgcatacaggcgagcgcccctacgagtgtagcgagtgcgggaagaccttccgccagcgaagcaatcttcggcagcacctgaaggtacataaacctgacaggccctatgaatgtagcgagtgcggcaaggcgttcaatcaacggccaaccctgataaggcaccagaaaatccacattagagagcggtccatggaaaacgtgttgctcccttgctcacagcatacacctgaaattagctctgagaatcgaccgtatcagggcgcggtgaactataagctcaagttagtccacccctcgacacatccaggcgaggtgccctag

SEQ ID NO: 22175 - DNA, 1836 bp, Artificial Sequence
  Description of Artificial Sequence: Synthetic coding sequence
atgcaggagaccatccggaacctggactgcgtgggcatgaagtggaaagatcagaacatcgaggatcagtataggtacccgcgcaagaatctcaggtgtcgcatgctcgaacgctttgtggaatcaaaggatggtacccaatgtggcgagacttcctctcagatacaggacagtatcgtgaccaagaataccctgcctggcgttgggccttacgagagccggatgtcaggggaagtgatcatgggccatagctccttaaattgctacatcagggtcggtgccggacacaagccctacgaatatcatgaatgcggcgagaagcctgatactcataaacagaggggcaaggcattttcttaccataactcactgcagacccacgaaaggctccacactgggaagaaaccctacaattgcaaggagtgtggtaaaagtttcagttcactgggaaacttgcagcggcacatggctgtacaacggggagacggaccttataagtgtaaactgtgtggcaaggcattcttctggccttctctactgcacatgcacgagcggacacatactggagagaagccttatgaatgcaagcagtgcagcaaagcattcagtttctatagtagctatttgagacacgagaggacacacacaggggagaaactctacgagtgtaaacagtgctccaaggcgttcccggattatagctcttgcttgcgccacgaaaggactcacaccggcaagaagccatatacctgcaagcaatgcggcaaagccttctctgcgtcaacaagcctgagacgccacgaaaccacccacactgacgagaaaccttacgcctgtcagcagtgtggcaaagccttccatcatctcgggtcatttcaaagacatatggtgatgcatacacgcgatgggcctcacaagtgcaaaatctgcggaaaaggcttcgactgtccctcgagcttgaagtcgcacgaaaggacacacacaggcgagaaactgtacgaatgcaagcagtgtgggaaggcactcagccatagcagttccttccgtaggcacatgactatgcacactggagatggcccgcacaagtgtaaaatttgcggcaaggctttcgtctacccctcagtcttccagaggcatgagaagactcatacagcggaaaaaccctataagtgtaagcagtgcggaaaagcctaccggataagtagtagccttagacggcacgaaactacgcacaccggcgaaaagccttataagtgtaagtgcgggaaagcgttcatcgacttttattccttccagaatcataagactacccatgctggcgagaaaccttatgagtgcaaggagtgtggcaaagccttcagttgcttccagtatcttagccagcaccggaggacccatacaggcgaaaagccctacgagtgtaacacctgtaagaaggccttcagccactttggtaacctgaaagttcatgagaggatacacagcggggagaaaccatacgagtgcaaagagtgcggcaaggcattctcttggctgacttgcttcttacgtcatgaacggatccacatgagggagaagccctacgagtgccagcagtgcggaaaagcattcacgcactctcggtttttgcagggccacgaaaaaacccacacaggcgagaacccatatgaatgcaaggaatgcggcaaggcctttgcctcgctcagttccctccatcgccataaaaaaacccactggaaaaaaacacatacaggcgagaatccgtatggctgcaaagagtgcggcaaggcgttcgccagcctgagcagtctgcaccgccacaagaagacgcactag

SEQ ID NO: 22176 - DNA, 1932 bp, Artificial Sequence
  Description of Artificial Sequence: Synthetic coding sequence
atggccagcgtggccctggaggacgtggccgtgaacttcacccgggaggaatgggcattgctcgggccctgtcagaaaaatctgtacaaggacgtgatgcaagaaaccattagaaatctggattgcgtcggcatgaagtggaaggaccagaatatcgaagatcagtaccgttacccgcggaaaaacctgcggtgtcgaatgctggagaggtttgtggagagcaaggacggaacacagtgtggagaaacatcttctcaaattcaggattccattgtcaccaaaaatacccttccgggcgtgggaccgtacgagagtcggatgtccggcgaagtgataatgggccactcatcacttaattgttatatccgcgtgggagccggtcataagccatacgagtatcatgagtgtggggagaaaccggacacccataagcaaaggggcaaagcattctcatatcataactctctgcagacgcacgagaggctccatactgggaaaaaaccatataattgcaaagagtgcggtaagagcttttcctccctgggcaatctacaaaggcacatggcggtccagcggggcgacgggccatacaagtgtaagctgtgtgggaaagcattcttttggccatcactcctccacatgcacgaaagaacccacaccggggaaaagccttacgagtgtaaacagtgctctaaagccttctcgttctacagttcatacctgaggcacgaacggactcacacaggggaaaagctatacgagtgtaagcagtgtagtaaggcgttccctgactatagcagctgcctaaggcacgagagaacccacactgggaaaaagccttacacatgtaagcaatgtggcaaggctttcagtgcttcgacaagtctccgcagacatgagaccactcataccgacgaaaagccttacgcgtgccagcaatgtggtaaggcatttcatcaccttggctcatttcagcggcatatggttatgcataccagagatgggccccataaatgtaaaatttgcgggaaaggatttgactgcccgagcagtttgaagagtcatgagaggacgcacactggcgagaagttgtacgagtgcaagcaatgcggtaaagctctgtcacactcatcgtcttttcggaggcatatgactatgcacactggagatggaccacataagtgcaagatctgcgggaaggcgtttgtgtacccttcagtcttccagagacacgagaagacccatacggccgagaagccctacaagtgtaaacagtgcggcaaggcctataggatcagtagcagccttagaaggcatgaaaccacacataccggggaaaaaccttacaaatgtaagtgtggtaaagcgttcatagatttctacagcttccagaatcacaagaccactcatgcaggagagaagccctacgagtgcaaagaatgcggcaaggcgttcagctgctttcagtacctgagccaacaccggagaacccatactggggagaagccttatgagtgcaacacctgtaagaaggcattttcacattttggtaacctgaaagtgcatgaacgtattcacagcggtgagaaaccttatgaatgcaaggaatgtgggaaggcattctcttggttgacctgttttctgaggcatgaacggattcatatgagagagaagccttacgaatgccaacagtgcggaaaggcattcactcatagcagatttcttcagggacacgagaagacacacacaggtgaaaacccttacgaatgtaaagaatgcggcaaggcattcgcttccctctcttcactgcaccggcataagaagactcactggaagaagacccataccggggagaacccatatggctgcaaggaatgcggcaaagcctttgccagcctgagctcactacacaggcacaaaaagacccactag

SEQ ID NO: 22177 - DNA, 1995 bp, Artificial Sequence
  Description of Artificial Sequence: Synthetic coding sequence
atgcccctgcgggacaagtactgccagaccgaccaccaccaccacggctgctgcgaaccagtgtacatactggaaccaggggacccaccactgctgcagcaaccactgcagacctcgaagtccggaatccagcagatcatagagtgcttcagatctggcaccaagcagctcaaacacatcctgctcaaagacgttgatactatattcgagtgcaagctgtgtaggtcattgttccggggtctccccaaccttatcactcacaagaaattctactgcccccctagcctccagatggacgataacctgcccgacgtgaacgataagcagagccaggcaattaatgacctccttgaggccatatatccatccgtggacaagcgggaatacattattaaactcgagccgattgagacaaatcagaatgccgtctttcagtacataagcaggaccgacaaccctattgaagtcaccgagtcatcctctaccccagaacagaccgaagtgcagatacaggagacctccacggaacagagtaaaaccgtccctgtcacggacaccgaggtagaaacagtggagccccctccagtggagatcgtcactgacgaagttgcccccacgtccgatgagcagccacaggaatcacaggccgacctggagacctcagacaactcagatttcggccaccaactaatatgttgtctgtgtagaaaggagtttaacagccgacggggcgtgcgaaggcacatccgcaaggtacacaagaaaaaaatggaggagcttaagaaatatatagaaaccagaaagaatccaaatcaatcgagcaaaggacgcagtaagaatgttttggtcccgctgagtagatcttgtccagtctgctgtaagtcatttgcaacaaaagctaacgtcagacggcatttcgacgaggtccatcggggcctccggagggatagtataacccctgacattgccactaaacccggacagcccctgttcctggatagtatatcaccaaaaaagtccttcaaaacaagaaagcagaagtcctcatcaaaagccgagtataacttgacagcgtgtaagtgtttgttatgcaagagaaagtattcaagtcagatcatgctaaaacggcatatgcaaattgtccacaaaattaccttgtccggtacaaattccaaacgtgagaagggcccgaataacacagccaattcatccgagataaaggtcaaggtcgaaccagccgatagcgttgaaagctccccccctagtattacccatagccctcagaatgaattgaagggaacaaatcattccaacgaaaaaaaaaatacccccgccgcgcagaagaacaaagtcaagcaggattctgagtctcctaagagtacgtctccgagtgcagccggcggccagcaaaagacacggaaaccaaaactgtccgcgggcttcgattttaagcagctgtattgtaaactttgcaagagacagtttacttcgaaacagaaccttactaagcatatcgaactccatactgacggcaataatatatacgtgaagttttacaagtgcccactatgcacatatgagacacgccgcaaaagagatgttattagacacatcaccgttgtgcataagaagagctcccgctatctaggtaagattactgccagtctggaaatccgggccataaaaaagcccatcgactttgtgctgaataaggtggcaaaacgcggaccaagtcgcgatgaagccaagcacagtgactccaaacatgatgggacatcaaactctccttccaaaaagtacgaggttgccgacgttgggatcgaggtcaaggtgaccaaaaatttttcactccatcgctgcaataaatgcggtaaggcgttcgcgaaaaaaacttacctcgagcaccacaagaagacccataaggccaatgcctctaattctccggagggcaataaaaccaaagggaggagtacccggagcaaagcgctggtttag

SEQ ID NO: 22178 - DNA, 1995 bp, Artificial Sequence
  Description of Artificial Sequence: Synthetic coding sequence
atgcccctgcgggacaagtactgccagaccgaccaccaccaccacgggtgttgtgagcccgtgtacatcctggagcccggtgaccctcccctgcttcagcagccgttgcagacttcaaaatcagggattcaacagatcattgaatgtttccggagcgggactaaacagttgaaacacattttactgaaggatgtagacacaatttttgagtgtaaattgtgccggtcattgtttcgagggctccctaaccttatcacacacaagaaattttattgtcctccaagtctccagatggatgacaacttaccggacgtcaacgacaagcagtcacaggctattaatgacttgctggaagcgatttacccatccgtggacaagcgagagtacattatcaagctggagcctatcgagacgaaccaaaatgccgtttttcagtatatcagtcgcaccgacaatcctatcgaagttacggagtcaagctccactccagagcaaacggaagttcagatacaggaaaccagcacagagcagtcaaagaccgtgcctgtgaccgataccgaggtggagacagtggagccccctcctgtcgagatcgtgacagacgaggtagctcccacttccgacgagcagcctcaggagtcgcaagctgacttggagacttctgataactcagacttcgggcaccaactcatatgctgcttatgtaggaaggaatttaactcccgacgcggggttcgtcgacatatacggaaagttcataagaaaaaaatggaagaactcaaaaagtatatcgaaacgcgaaaaaatcccaatcagagttcgaaaggacggtccaagaatgtgctggtgcccctgtcaagatcctgtcccgtgtgctgcaaaagtttcgcgactaaggccaacgttcgtcggcatttcgacgaagttcatcgaggcctgaggcgtgacagtatcacccctgacattgccactaaaccaggtcagcctctgtttcttgactctatttctccaaaaaaaagtttcaagaccaggaaacagaaatcttcttctaaagctgaatataacctgaccgcctgtaagtgtctcttgtgcaagaggaaatatagctctcagatcatgctgaagcgacacatgcagatcgtgcataagatcactctgagtggcaccaattccaaacgagaaaagggccccaacaatacagccaatagtagcgagattaaagtcaaagtggagcctgcagatagcgtagagtcaagcccccccagtatcacccacagtccccaaaacgagttaaaagggactaaccactcaaatgagaagaaaaacactccggctgcccagaagaacaaggtaaagcaggactccgaatcacctaagtcaactagcccatcagctgccggaggccagcaaaagacccggaagcctaagttatcggctgggtttgattttaagcagctgtattgcaagttgtgcaaacggcaatttacttccaagcagaacctcactaagcacatcgagctgcatacggacggaaataacatctatgtgaaattctataaatgccccttatgcacctacgagacgagaagaaaacgggatgtgatcagacacatcaccgtggttcacaaaaaatcctctcgctatttggggaagatcacagcaagcctcgagattcgggcaattaagaagcctatcgattttgtccttaacaaagtggcgaaacgcggccccagccgtgatgaggctaagcattctgattctaaacatgatggcacatcaaattctccatccaagaaatatgaagtggccgatgtggggatagaagtgaaagtaacaaaaaatttcagtctacaccgctgtaacaaatgcggtaaggctttcgccaaaaagacctatctggaacaccataaaaagactcataaggcaaatgcctcaaatagcccagagggcaacaagaccaaggggcgtagtacgcgctctaaggcacttgtgtag

SEQ ID NO: 22179 - DNA, 1995 bp, Artificial Sequence
  Description of Artificial Sequence: Synthetic coding sequence
atgcccctgcgggacaagtactgccagaccgaccaccaccaccacgggtgttgtgaaccagtgtacatcttggaacctggcgatccccctctgctacagcagcctttgcagactagtaagtctggaatccagcagatcatcgagtgtttccgctctggaaccaaacagctgaagcatatcctcctgaaagacgtggacactatctttgagtgtaaactgtgccgatccttattccgcggcctgccaaatctcattacacacaaaaagttttactgtcccccttcactacagatggatgataatctaccggacgtgaatgataagcagtctcaggctataaatgatcttctggaggcgatatacccctccgtcgacaagagggagtatatcataaagttggaacctatcgagactaatcagaacgccgtctttcagtatattagtcgcacagataatcctattgaggtgaccgaatcttcctccaccccggagcagaccgaagtgcagattcaggagaccagcacagagcaatcaaagaccgtccccgtcacagatacggaggttgagaccgtggagccacctccagtggaaattgtgacggatgaggtggctcccaccagcgatgagcagccgcaggagtcacaggcagatctcgaaacttccgacaatagcgatttcggccatcagcttatatgctgtctttgccgaaaggagttcaattctcgtcgcggggtacgacggcatatcagaaaggtgcataagaagaagatggaggaactaaaaaagtacattgagacgcggaaaaatcccaaccagtccagtaaagggaggtctaaaaacgttctggtcccgctgtccagatcctgtcccgtgtgttgtaagtccttcgccaccaaggcgaatgtccggcgccatttcgacgaggtccatcggggcctgagacgtgactccatcacacctgatatcgctacaaaaccaggacagccgttgttcttggattctatcagtcctaagaagtcctttaagactaggaaacaaaaaagttcctcgaaggcagaatacaaccttaccgcctgcaaatgtttgctgtgtaaacgcaagtactcctcacagatcatgttaaaacgccacatgcagatcgtccataaaatcactctgagcggaactaattccaagagagagaaaggaccaaacaatacagcgaattccagtgaaattaaggttaaagtggagccggctgactcagtcgagtcctcccctccctcaattacccactcgccccagaatgaactgaaaggcactaatcatagcaacgagaaaaagaacacacctgctgcacagaagaacaaggtgaagcaagactccgagagcccgaagtccactagtccttcagctgccggcggacagcagaagaccaggaagcccaaactgagcgcaggcttcgacttcaaacagctgtactgcaaactctgtaagcgccagttcacatctaaacaaaacctgacaaagcacatcgagttgcacaccgatggaaataacatttacgtgaagttctacaaatgccccctttgtacttacgaaacccggcggaagcgggatgtaatccgccatattaccgtggtacacaagaaatcgagtcgctacctgggcaaaatcaccgcttctcttgagatccgggctatcaagaaacctattgactttgtgttgaacaaggtcgcaaagcggggaccatctcgtgacgaggccaagcatagtgatagcaaacatgatggaaccagtaatagtccctccaaaaaatacgaggtagccgacgtggggatcgaggtcaaagtgaccaaaaatttttccctccaccgttgcaacaaatgtggcaaagcatttgctaagaaaacctacctggaacatcataagaagacacataaggccaatgctagtaactcccctgaggggaataaaacgaaagggcgcagtacaaggagtaaagccctggtgtag

SEQ ID NO: 22180 - DNA, 729 bp, Artificial Sequence
  Description of Artificial Sequence: Synthetic coding sequence
atgcccctgcgggacaagtactgccagaccgaccaccaccaccacggatgctgcgagcccgtctacattctcgaacccggggatcctcccctcctgcagcaaccactgcaaacttccaaaagcggtatccaacagatcattgagtgtttcaggtccggcactaagcagctcaagcatatcctgctaaaggatgtcgatactatctttgaatgcaagttatgccgatcgcttttccgcggcttaccaaatctgattacgcataaaaaattctattgcccacctagtctgcagatggatgataatctgcccgatgtgaatgataagcagtcccaggccatcaacgacttgctggaagccatctaccccagcgtggacaagagagagtacatcattaaattggaaccgattgagactaatcagaatgccgtctttcagtatatctctcgaaccgataatccaatcgaagtgaccgagtcgagctctacacccgagcaaacagaggtgcagattcaggagacgtcaactgagcagtcgaaaaccgtgcctgtcacggataccgaagtggagactgtggagcccccccccgtggagattgtcactgacgaagttgctcccacctcagacgaacaacctcaggaatcccaggccgacttggagacatccgacaactctgactttggacaccagctgatttgttgcctttgtcgcaaggagtttaactcacgatag

SEQ ID NO: 22181 - DNA, 393 bp, Artificial Sequence
  Description of Artificial Sequence: Synthetic coding sequence
atgcccctgcgggacaagtactgccagaccgaccaccaccaccacgggtgctgtgaaccggtctatatactggagccgggcgacccacccctcctgcagcagccactccagaccagcaagtctggcatccaacaaatcattgaatgttttagaagcggaacgaagcagctgaaacatattctactgaaagacgtggacactatctttgaatgtaagttatgcaggtcccttttcagggggcttccaaatctcataacccataaaaagttttactgccctccttccctgcagatggatgataacctccctgacgtgaacgacaagcagtctcaagccattaacgatttgctggaggccatctatccgagtgtcgacaaacgagaatacatttag

SEQ ID NO: 22182 - DNA, 297 bp, Artificial Sequence
  Description of Artificial Sequence: Synthetic coding sequence
atgcccctgcgggacaagtactgccagaccgaccaccaccaccacggatgctgcgagcctgtatacattctcgaacctggcgatccccctcttctgcaacaaccactgcagacgagtaagagcggaatccagcagatcatcgagtgcttcagatccggcaccaagcagctgaagcatattctgctgaaggacgtggacaccatctttgaatgcaaactgtgtcggagcctttttcgtggcctgcctaaccttattacgcataagaagttttactgtcccccatccctgcaaatgtag

SEQ ID NO: 22183 - DNA, 1485 bp, Artificial Sequence
  Description of Artificial Sequence: Synthetic coding sequence
atgcagggcgagcggctgcggcccggcctggacagccagaaggagaagcttccgggcaaaatgagccctaaacatgacgggctggggacagcggatagcgtgtgttccaggatcattcaggatagagtatctctcggcgatgatgttcacgactgtgactcccatggttccggcaagaatccagtgattcaggaagaagagaacatcttcaaatgcaacgagtgcgagaaagtgtttaacaaaaagcgcctgttggccaggcatgagcgcattcacagcggagtgaagccgtacgagtgtactgagtgcggcaagacattcagcaagagtacctatctcctgcagcaccatatggtgcacaccggcgaaaagccttacaaatgcatggagtgtggaaaggcattcaacaggaaatctcacctcacccagcaccagagaattcacagcggcgagaaaccatacaagtgtagcgaatgtgggaaagcattcacacataggtcgaccttcgtactccataacagatcccacactggtgagaagccttttgtatgcaaggagtgcggaaaggcctttagggacaggccgggattcattcggcactacattatccactccggggagaatccatacgagtgcttcgaatgtgggaaggtcttcaagcataggagctacctcatgtggcatcagcaaacgcacactggcgagaaaccctatgagtgctccgagtgtgggaaggccttctgcgagtcagcagccctgattcaccattatgtaattcatacaggggagaaacccttcgaatgtctggaatgcggcaaggcctttaaccatagatcatacctgaagcgtcaccaaaggatccacacgggtgagaagccctacgtgtgttcggagtgtgggaaggcctttacacattgcagtacattcatattgcacaagcgagctcacaccggtgagaagccgtttgaatgtaaagaatgcggcaaggctttctctaacagggcagatctgatccgtcacttttccattcatacaggagagaaaccttacgaatgcatggaatgtgggaaagcatttaataggcgctctggattgactaggcatcagcggatacactctggcgaaaagccttacgagtgtatcgagtgcgggaaaacattctgctggagcaccaacctgattaggcacagtatcattcacactggggaaaagccctatgaatgcagcgaatgtggcaaagctttctcccggtcctctagtctaacccagcaccaaagaatgcatactgggcgaaaccctatttcagtgacagacgtcgggcggccgttcacttctggacagacatctgttaatatccaggaactgctgctaggcaagaacttcctgaacgtcacaacggaggaaaatctactgcaggaggaagcgtcttacatggcttcggatagaacctatcagcgtgagactccccaggtgtctagcctctag

SEQ ID NO: 22184 - DNA, 1884 bp, Artificial Sequence
  Description of Artificial Sequence: Synthetic coding sequence
atggccatggccctgaccgaccccgcccaggtgagcgtgaccttcgacgacgtagcggtgactttcacccaagaagagtgggggcagcttgatctcgctcagcgtaccctgtaccaggaggtaatgttagaaaattgcggtctgttggtttctctgggctgtcccgtaccgcgaccagagctaatctaccatctggagcacggccaggagccatggacccgtaaagaggatctgtcacaaggcacttgtcccggagataaaggaaaaccgaaaagcactgaacccaccacctgcgagctggccctgtctgagggaatatccttctgggggcagttgacccagggagctagcggcgactcccagcttgggcaacccaaagaccaggacggctttagtgagatgcagggggagagacttcgcccgggtctggatagtcagaaagagaaattgcctggaaagatgtcacccaagcatgacggtctgggaaccgccgactcggtttgctcaagaatcattcaagaccgtgtgagcctgggcgacgacgtacacgattgtgacagccacgggtccggcaaaaacccggttatccaagaggaggaaaatatttttaagtgcaatgagtgtgaaaaggtcttcaacaaaaagcgactactggctaggcacgagcggatccactctggcgtgaagccctacgagtgcacagaatgtggtaagacttttagcaaaagcacatacctcttacagcaccatatggtccacaccggagagaagccttataaatgtatggagtgcggtaaagccttcaaccgaaagtctcaccttactcaacaccagaggattcactccggagaaaaaccctataagtgtagcgaatgcggaaaggccttcactcaccgcagtacattcgttctgcataaccgatcacacaccggagaaaagccttttgtctgcaaggagtgtggaaaggcatttcgcgaccgcccagggtttatccggcactatattatccacagcggagaaaacccttacgaatgttttgaatgcggtaaagttttcaagcaccgaagctacttaatgtggcatcagcagacccatacaggcgagaagccttacgagtgtagcgaatgtggcaaggccttttgcgagtctgccgccctcatccaccattacgtcattcataccggcgaaaagccatttgagtgcctggagtgtgggaaagcctttaaccatcggagctacctgaaaaggcatcagcgcatccacacaggggaaaagccctatgtgtgttctgagtgtggaaaggccttcacacactgtagcactttcattctgcacaaaagagcacacacaggagagaagccattcgagtgtaaagagtgcggcaaagcattctcaaaccgggcagaccttatcagacatttctccatccacaccggggaaaaaccatatgaatgcatggagtgtggaaaggcatttaataggcgttccgggctcactaggcaccagaggatccactcaggggaaaaaccctacgagtgtattgaatgcgggaagaccttttgttggagtactaatctgatcagacactccatcatccataccggagaaaagccatacgaatgctcagagtgtggcaaagcctttagccggagcagtagtttgactcagcaccaacggatgcataccgggagaaatcctatcagtgtcacagatgtgggtaggccatttacttctggacagactagcgtgaacatccaggaactgctgctgggaaagaatttcttgaatgtcacaacggaggaaaatctgctccaggaggaagcatcctacatggcctcagaccggacctaccaaagggagactccccaagtctcgagcttgtag

SEQ ID NO: 22185 - DNA, 1485 bp, Artificial Sequence
  Description of Artificial Sequence: Synthetic coding sequence
atgcagggcgagcggctgcggcccggcctggacagccagaaggagaagctcccggggaagatgtccccgaagcacgatgggctgggaacagccgactcagtctgttctcgaatcatccaggacagggtatctcttggcgacgacgtccacgattgtgatagccatggttccggtaagaaccctgttatccaggaggaagaaaacatctttaagtgtaatgaatgcgaaaaagtgtttaacaagaagagactcctggctagacatgagagaattcactccggcgttaaaccatatgagtgcaccgaatgtggaaaaactttctctaagtccacttatttgctgcagcatcacatggtgcatactggcgaaaagccctacaagtgcatggagtgtggcaaggcttttaatcggaagtcccatctcacgcagcatcagaggatccatagcggagagaagccgtataaatgtagcgagtgcggtaaggctttcacgcatcgatcgacattcgtgctccacaaccgaagtcacaccggcgaaaaaccgttcgtgtgtaaggaatgcggcaaagccttcagggataggcccggattcatccgccactacatcatccatagcggagaaaatccctacgagtgcttcgaatgtggaaaggttttcaagcaccgatcctacctgatgtggcaccagcaaacacacacaggagagaagccttatgaatgttccgaatgtgggaaggcattctgcgaatctgccgctctcattcaccactacgtgatacacacgggtgagaagccattcgagtgtcttgagtgtgggaaggcttttaaccacagatcctatttaaagaggcaccaacgcattcataccggggagaaaccctatgtctgttccgaatgcggcaaagccttcacacactgctcaaccttcattttgcacaaacgcgcccataccggtgaaaaaccttttgagtgcaaagaatgtggcaaggctttctcaaatcgcgcagatctgatcagacatttctccatccataccggagagaagccctacgaatgcatggaatgtggaaaagcatttaatcggaggtctggcctcacgagacaccagcggatacacagtggagagaaaccgtacgaatgtatcgagtgcggaaagaccttttgctggtcaaccaatctcatcagacatagcatcatccacactggggaaaagccctacgaatgttctgaatgcggcaaggcgttctcccggagttcgtcgttaacccagcaccagcggatgcacacaggccgcaacccaatctccgtcaccgacgtgggccggccttttacatcaggccagacatctgttaacattcaagaactccttttggggaaaaactttctgaacgtaactactgaagagaatcttctccaagaggaggctagttatatggcatcagaccgcacttaccagcgggagacgccccaggtctcctctctctag

SEQ ID NO: 22186 - DNA, 153 bp, Artificial Sequence
  Description of Artificial Sequence: Synthetic coding sequence
gcccccctgctgagctgcatcaccggcgccaccctggagaccctgtgtgtgcagcgcgttaaggccttcagggatcgccccgggttcattcggcactatattattcactcaggcgagaacccttacgagtgcttcgaatgcgggaaagtgtag

SEQ ID NO: 22187 - DNA, 2712 bp, Artificial Sequence
  Description of Artificial Sequence: Synthetic coding sequence
atgctgcgggaggaggccgcccagaagcggaagggcaaggagagcggaatggcccttcctcagggccgtcttacattccgtgacgtggcaatcgagttcagtttggccgaatggaagttcctgaatccggcacagagagctctgtaccgggaggtcatgttggagaattaccgaaaccttgaagctgtggatatatcatctaagcacatgatgaaagaggttctgtccactggacaggggaaccgcgaagttatacacacagggaccttgcaaaggcaccagagttaccacatcggcgacttctgttttcaggaaatagagaaagaaatccacaatatcgaattccagtgtcaggaagacgagagaaacggccacgaggcacctacgactaagattaaaaagttgacgggctcgactgatcagcatgaccaccggcatgcaggcaacaaaccaattaaggaccagctgggcagttccttctattcacatttacctgagctgcacatattccagattaaaggtgagattgccaaccagctggagaaaagcacctcagacgctagttctgtgtccacttcccagcgcatctcatgtcgtccccagatccacatcagcaataattatggtaataatcctctaaacagctcgctgttgccacagaaacaggaggtgcatatgcgggaaaagagctttccctgtaatgagagcggcaaggctttcaattgtagtagtctgcttagaaaacaccagattcctcacctgggagacaagcagtataagtgcgacgtatgcgggaagctcttcaatcacaagcagtacctggcttgccaccggcggtgtcacacgggagagaaaccttacaagtgcaaagagtgcggcaagtccttcagttacaagagcagtttaacctgtcaccatcggttgcacacaggtgtcaaaccatataaatgcaacgagtgtggaaaagtgttccggcaaaatagcgcactagtgatccacaaagctatccacaccggcgagaagccctataagtgtaacgaatgtggtaaggcctttaatcagcaaagtcacctgtctaggcatcagcggctgcataccggagtcaagccttataagtgcaagatttgcgagaaagcctttgcttgccactcttacctcgccaatcatacccggatccattcaggggagaagacttacaagtgcaacgagtgtgggaaagcttttaatcaccagagcagtttggcccgacatcacatcttgcacaccggcgagaaaccctataaatgcgaggaatgtgacaaggtgttctctcagaagtcaaccctggagaggcataagcgcattcacactggcgagaaaccatacaagtgcaaagtgtgtgataccgctttcacctgcaatagccaacttgccaggcacaggcgcatccataccggggagaagacctacaagtgtaatgagtgtcgcaaaacattcagtagacggtccagtctgttgtgccaccgccggttgcacagtggagagaagccatataagtgcaaccaatgcggaaatacctttcggcacagggccagcctagtataccatcggcgattgcacactctcgagaaaagctacaagtgcactgtgtgcaataaagtgtttatgcgcaacagtgtcctggccgtccacacaagaatccacactgctaaaaagccatataaatgcaacgagtgcggaaaggcctttaaccagcagtcgcacctctcgaggcaccgacggcttcacaccggggagaaaccgtacaagtgcgaagcctgcgacaaggtcttcgggcagaagtccgccttggagagtcacaagcggattcataccggcgagaagccttaccggtgccaggtgtgcgacaccgccttcacatggaatagccagctggccagacatactcggatccataccggagagaaaacctataagtgcaatgagtgtgggaagaccttctcttacaaaagtagtttggtatggcacaggcggctgcatggaggagagaaatcctataaatgcaaggtgtgtgataaggcctttgtctgccggtcatatgtcgctaaacacactcggattcattctggtatgaagccttataaatgcaatgaatgctcaaagaccttttcgaatcgctcctcactggtctgtcatcgtaggatacactccggcgaaaagccctataaatgctccgagtgctcgaagacttttagccagaaggcaactctgctgtgccatcgacggctgcattcgggagagaagccatataaatgtaatgattgtggaaacacgtttcgccactggagcagcctggtgtatcacaggcgactgcacaccggagaaaaaagctataaatgcacagtttgtgacaaggcttttgtccgcaacagctacttggcccggcatatccgaattcacactgccgagaaaccttacaagtgcaatgaatgcgggaaagcgttcaacgaacaaagccacctgtcccgacatcacagaatacatacaggagagaagccatacaagtgcgaagcctgtgataaggtgtttagccgaaaatcccatttgaaacggcaccggattatccacaccggcgagaagccttataagtgtaatgaatgcggcaaagcattcagcgatcgttcgaccctcatccaccatcaggccattcatggaatcggaaaattcgactag

SEQ ID NO: 22188 - DNA, 1854 bp, Artificial Sequence
  Description of Artificial Sequence: Synthetic coding sequence
atggccctgccccagggcctgctgaccttccgggacgtggccatcgaattctcccaggaagaatggaagtgtctggacccggcgcaaagaacactgtaccgggacgtgatgttagagaactaccgaaacttggttagtttggatattagctccaagtgcatgatgaaggaattctcatccacagcgcaaggaaatcgcgaagtaattcatacaggaaccctccagcgccatgagagccaccataccggtgatttcagatttcaagaaatcgataaagacatccacaatttagaatttcaatggcaggaagatgagcgtaacagtcacgaggctcccatgactgagataaaaaaactgaccggtagcgctgaccggtacgatcagagacacgcaggcaacaagccgatcaaagaccagctggggagcagttttcactctcatctgcctgaactgcatatgtttcagacacaggggaagatcggtaaccaagtggagaagtctatcaatgatgcctcctcaatctccacctctcaaaggatctcctgccgcccaaaaactcacatttcaaataactacggcaacaacttcaggaactcttccctgctgacccaaaagcaggaggtgcatatgagggaaaaaagctttcaatgtaacgagtcagggaaggccttcaactatagctccttactccgcaagcaccagatcatacatcttggggagaagcagtataagtgcgatgtgtgcggaaaggtattcaataggaaacgcaatctagtctgtcatcgaaggtgccatacaggcgagaagccttaccgctgtaatgagtgcggaaaaacattctctcagacatactccctgacctgtcatcgcagactccatactggtgagaagccttataaatgcgaggaatgtgacaaggcgtttagcttcaagtctaatctcaagcgacatagacgaatccatgccggggaaaagccgtataaatgtaacgagtgcgggaagacctttagtcagacctcatctctgacatgccataggcgcctgcatactggcgaaaaaccatttaagtgtaacgagtgcgggaaaaccttttcacggaagagttccctcacttgccatcaccgcttgcatacaggggagaagccatataaatgcaacgagtgcggcaaaacgtttagccaggagctgactctgaagtgtcacagacgtctgcatacaggagagaaaccatacaaatgcaacgagtgcggaaaggtgttcaacaagaaggctaacctcgctcgacaccaccggttacactccggcgaaaagccgtataaatgtacagagtgcgtgaagacatttagcagaaattccgcccttgttatccataaggccattcatattggggagaagcgatataagtgtaatgagtgtggcaaaacattctcgcgcattagtgctctggtgatccatacagcaatccatactggcgaaaaaccatacaagtgcaatgaatgtggcaaaggcttcaatcgcaaaacgcacctggcctgtcaccataggcttcatacaggtgaaaagccatacaaatgcaacgagtgcgggaaggtgttcaatcgtaagacacatctggctcaccaccaccgcctgcacacaggggataaaccgtacaagtgtaacgaatgcggcaaagtttttaatcagaaagcccatctggcccggcatcaccggttgcacaccggtgagaaaccatataaatgtaacgaatgtggtaaagtatttaaccaaaaggcaaatcttgcaaggcaccaccgattgcacacaggagaaaagccttacaagtttaatgaatgtggcaaagcctttaattag

SEQ ID NO: 22189 - DNA, 183 bp, Artificial Sequence
  Description of Artificial Sequence: Synthetic coding sequence
atggccctgccccagggcctgctgaccttccgggacgtggccatcgagttcagtcaggaagagtggaaatgcctggatcccgcacagcgtacgctttatagggatgtcatgctcgagaattacagaaacctggtgagtctggaactttctggggagtgcccactggcagcccccgcttcttag

SEQ ID NO: 22190 - DNA, 1956 bp, Artificial Sequence
  Description of Artificial Sequence: Synthetic coding sequence
atgctgcgggaggaggccaccaagaagagcaaggagaaggagcccggtatggctttaccgcagggccgtcttacattccgggatgtagcaattgaattttccctcgaagagtggaagtgcctgaatcccgcccaacgcgcactctatagggcagtgatgcttgagaattaccgcaatctggagtttgttgatagcagtctaaagtcaatgatggagttttcaagcacccggcatagtattacaggtgaggtgatccacacgggcaccctgcagcggcataaatctcaccatattggtgatttctgtttcccagagatgaaaaaagacattcatcattttgaatttcagtggcaggaagtggaaaggaacgggcacgaagcccctatgacaaaaatcaagaagctaacaggaagcaccgatagatcagaccaccgtcacgccgggaataaaccaattaaagatcaactgggcctgagttttcacagtcaccttcccgaattacacatgttccagactaagggcaaaatcagcaaccagcttgacaaaagtattggtgcctcatccgctagcgagagtcagaggatcagttgccgcttaaagacccacatatctaataagtatggcaaaaatttcctccactcttctttcacccagatccaagaaatctgcatgagagagaagccatgccagtccaacgaatgcggaaaggccttcaactactcgtcactgcttaggcggcatcatattacacactctagagagcgcgaatataagtgtgatgtgtgcggtaagattttcaaccaaaagcaatatatcgtttatcaccatagatgtcatactggtgagaaaacctacaagtgtaatgaatgtggtaagacatttactcagatgtcctcattagtgtgccaccggagactacatacaggggaaaaaccatataagtgtaatgagtgtggaaagacattcagtgaaaaatcctcactgagatgccatagacggctccacaccggagaaaagccatacaagtgtaacgagtgcggcaagactttcggcagaaacagcgcactggtgattcataaagcgattcatacaggagaaaagccatacaagtgcaatgagtgcggaaagacattctcgcagaagagctccttgcagtgccaccacatattacatacaggcgaaaagccatacaaatgcgaagaatgtgacaacgtctatatcagaagatcccatctggaacggcatcgaaaaatccacaccggagaaggaagttataaatgcaaagtctgcgacaaggtctttagaagcgatagctatctcgctgagcaccagagagtccacacgggcgaaaaaccctacaagtgcaataaatgtgggaggagcttctcacggaaatcttctcttcagtatcatcacaccctgcataccggagaaaaaccctacacatgtaacgaatgtgggaaagtcttctccaggagggaaaacctcgcccggcatcatcgactgcatgctggcgagaagccatacaaatgtgaagagtgcgacaaagtgttttcgaggagatcccacctagagcggcatcgtagaatacatactggagagaaaccgtataaatgcaaagtctgcgacaaggcctttaggtctgatagttgcctggccaatcacacaagggtgcataccggcgaaaaaccttacaagtgtaataaatgcgcgaaagtgttcaatcagaaaggcatcctggcccagcaccagcgggtgcacaccggtgaaaagccatataagtgcaacgagtgcgggaaggtattcaatcagaaggcctcactggcgaaacatcaacgagtccatacagccgaaaaaccgtataaatgcaacgagtgcggcaaggccttcaccggacagtccaccctcatccaccaccaagctatccacgggtgcagggagacactgcagatgtag

SEQ ID NO: 22191 - DNA, 702 bp, Artificial Sequence
  Description of Artificial Sequence: Synthetic coding sequence
atgctgcgggaggaggccaccaagaagagcaaggagaaggagcccggaatggctctcccccaggggcgcctgacattccgtgacgtagccattgagttctctctggaagaatggaagtgtctcaaccccgcacagcgagctctatatagagccgtgatgctggagaattacaggaatttggaattcgtggatatctcttctaagtgtatgatgaaagaattttcttccacagctcagggcaacaccgaagtcatacatacgggaactcttcagaggcacgaatcacatcacatccgcgatttctgcttccaagagatcgaaaaagacatccataacttcgagtttcagtggcaggaagaagagcggaacgggcatgaagctccaatgaccgaaattaaggagctgactgggagtaccgaccgacacgaccagcgccatgccggaaacaagccaatcaaggatcagcttgggtcttcctttcacagtcacctgccagaattgcacatttttcaacccgagtggaagatcggaaaccaggttgaaaaatctatcattaacgcttccttgatcctaacaagccagcgtatcagttgctcgccaaagacccgaatcagtaacaattacggcaataattcgctccacagcagccttcccatccaaaagctcggaagtacacacgagaggaaaatcttccccatgtag

SEQ ID NO: 22192 - DNA, 1956 bp, Artificial Sequence
  Description of Artificial Sequence: Synthetic coding sequence
atgctgcgggaggaggccaccaagaagagcaaggagaaggagcccggtatggcacttccacaaggaagactgacctttagggatgttgccatcgaattctctcttgaagaatggaaatgtctcaacccagcccagcgcgccctatacagggcagtcatgttggaaaattatagaaatttagaattcgtggatagtagtttgaagagcatgatggaattctcctctaccagacattcaattaccggagaagttatccacacggggaccctgcagaggcataaatcacatcacatcggggacttttgctttccagaaatgaaaaaagatatccatcactttgaattccagtggcaggaggttgagcgcaacggccatgaggcccctatgacaaagatcaagaaactgaccggatctaccgatagatccgatcacaggcatgccggcaataagccaataaaagaccagcttggtctctcattccactcacatctgcctgagttacatatgttccagacaaaaggtaagatatccaaccagctagataagtccattggcgcaagctctgcaagcgaatcccagcgcatttcatgcagattgaaaacacatattagtaacaaatacggcaagaatttcttgcactcgtcgttcactcagatccaggagatatgcatgcgggaaaaaccctgccaaagcaatgaatgtggcaaggctttcaattattctagtctgctgcgcaggcatcacattactcacagcagggaacgggaatataagtgtgatgtatgcgggaaaatcttcaaccaaaagcaatacattgtgtaccatcaccggtgccatacaggggagaagacatataaatgcaatgagtgtggcaaaacattcactcagatgtccagcttagtctgccaccggcggctccacacaggcgagaagccttataagtgtaacgagtgcggaaagactttcagcgaaaaatcttctctgcgttgccaccggagactgcacaccggcgaaaaaccatacaagtgcaacgagtgcggaaagaccttcgggcgcaattccgcactggtgatccataaggcaatccatacgggtgagaaaccgtataagtgtaatgagtgcggtaaaaccttttctcagaagtcttccctgcagtgtcatcacatcctgcacactggagagaagccctacaaatgtgaggaatgcgataacgtctatattcgtcggtcacacttggagaggcacagaaagatccacacaggcgaaggcagttacaaatgcaaggtgtgtgataaggtgtttcgttccgatagctacttagctgagcaccagcgggtacataccggagaaaagccttataaatgcaacaagtgcggacggagcttcagcaggaagtcttccctgcagtaccaccatactctccacaccggggaaaagccctacacttgtaacgaatgtggaaaggtgtttagtcgcagggagaatttggctagacatcaccgcctgcatgctggcgagaaaccatacaaatgcgaggaatgcgataaggtctttagcagacgatcccatttggagagacacaggaggatccatacaggcgaaaagccttataagtgcaaggtctgtgacaaggctttccgtagtgattcatgcttagctaatcacacccgggtgcacaccggagaaaagccctataaatgtaacaagtgtgcaaaggtgtttaatcagaagggtattctggcccagcaccagcgggttcatacgggcgaaaagccgtacaaatgtaatgaatgcgggaaggtcttcaatcaaaaggcttccctcgctaaacaccaaagagtgcataccgcagaaaagccgtacaaatgtaacgagtgcggcaaggcattcaccggccagagtacactgatccaccatcaagcaatccacggctgccgcgagaccctacagatgtag

SEQ ID NO: 22193 - DNA, 345 bp, Artificial Sequence
  Description of Artificial Sequence: Synthetic coding sequence
atgctgcgggaggaggccaccaagaagagcaaggagaaggagcccgggatggccctgccacaaggaagacttactttcagggacgtggctatcgagttttctctggaggagtggaaatgtttaaatcctgctcagcgcgccctctacagagcggtgatgctggagaactaccgcaatctggaattcgtggactctagtctcaagtcaatgatggagttctcaagcactaggcacagtataaccggcgaagtcatccacaccggcacattgcaaagacataaatcccaccatatcggcgacttctgctttccggagatgaagaaagatattcaccatttcgaatag

SEQ ID NO: 22194 - DNA, 495 bp, Artificial Sequence
  Description of Artificial Sequence: Synthetic coding sequence
atgatgaaggagttcagcagcaccgcccagggcaacaccgaggtgatccacactggtacactacagaggcacgaaagccatcacattcgagacttttgctttcaagagatcgagaaggacatccataattttgaattccagtggcaggaggaggagcgtaatggccacgaagccccaatgacagaaatcaaggagctcacgggctccaccgatcggcacgaccagaggcacgctggcaacaaacctatcaaagaccagttaggctccagctttcacagccacctgcctgagctgcacatcttccagcccgagtggaaaatcggcaatcaggtggagaaatctatcattaatgcctctttgattctgacctctcagcgcatcagctgctcccctaagactcgcatttcaaacaactatggaaacaactcactacatagcagtcttccgatccagaaattgggtagcactcatgagcgaaagatcttccctatgtag

SEQ ID NO: 22195 - DNA, 1599 bp, Artificial Sequence
  Description of Artificial Sequence: Synthetic coding sequence
atggccctgcggagcgtgatgttcagcgacgtgagcatcgacttcagccccgaagaatgggaatatctcgacctggaacaaaaggacctctatcgtgatgtgatgttggaaaactacagtaatctggtgtcgttgggatgcttcatctccaagccagacgtcatctcgtccctggaacagggtaaagaaccgtggaaggttgtcagaaaaggtcgcaggcagtaccccgatctcgagacaaaatacgaaacgaagaaactcagtctcgagaacgatatttatgagattaacctttcccagtggaagatcatggagcggattgagaatcatggtctcaaaggcctgatcctcaaaaatgactgggaaagcacaggcaagatcgaaggacaagagagaccccaggaggggtactttagttcagtgaagatgccctctgaaaaagtctctagttaccagaagagaacttcagtgaccccacatcagcggcttcacttcgtggataaaccttacgaatgtaaggaatgtggaaaagcatttcgcgtgaggcagcagttgacattccaccaccgcatccatacaggagaaaaaccatacgagtgcaaagagtgtggcatggcctttcgccaaactgcccacctcacgcggcaccagcgtttgcactccggcgaaaagctgtatgagtgcaaagagtgtggcgaagcattcatttgtggggcagacctccgggtgcaccagaagatgcacataggagagaaaccttatgaatgtaaggagtgtggtaaagctttccgtgtgaggggacagttgaccctgcaccaaaggattcacacaggtgaaaaaccttacgtctgtaaagaatgtggcaaggcgttccggcagtacgcgcacctgacccgccaccagaaactgaattccgcggatagactgtacgaatgcaaggagtgtgggaaagccttcctctgcggcagtggacttagggttcaccacaagttgcatacgggagaaaaaccttatgagtgtaaggaatgtgggaaagcctttagggtgaggcaacaactgaccctgcaccagaggatccataccggcgagaagccctacgagtgcaaagagtgcggcaaaaccttctccaggggttatcaccttatcctgcaccaccgcattcatactggggagaagccctatgagtgtaaagaatgttggaaagccttttctagatatagtcagttgatctctcatcagtccatccacatcggcgtgaaaccttacgattgtaaagagtgtggcaaagcattccgtcttttatcacagctcacccaacaccagtcgatccatatcggtgaaaaaccatacaagtgtaaggagtgtggcaaggccttccgcttacgccagaaactcacactgcaccagagtatccataccggggagaaacctttcgagtgcaaagagtgcaggaaggcatttcggttaaacagcagccttatacaacatctacggattcacagtggggagaagccttacgagtgtaaagaatgtaagaaggcctttcgccagcattcacatctgacacaccacctgaaaatccacaatgtgaaaatctag

SEQ ID NO: 22196 - DNA, 1599 bp, Artificial Sequence
  Description of Artificial Sequence: Synthetic coding sequence
atggccctgcggagcgtgatgttcagcgacgtgagcatcgacttctctcctgaggagtgggagtatctggatctcgaacagaaagatctgtatcgggacgtgatgctcgagaactacagcaacctggtgagcctaggcctgctgctgctgtctttcatatcaaccctggagatgttattgttgttggtgaaggagaattcaatgtgcctgctctcatgcttcatcctggaccttgaaaccaagtacgaaacaaagaaactatccctcgaaaacgacatttacgaaatcaacttgagccagtggaaaatcatggaacgtatagaaaaccacgggctgaaagggctcattctgaaaaacgattgggaaagtaccggcaagattgaaggacaagaaaggccacaggaagggtactttagtagtgtgaagatgccctctgagaaagtgagcagctatcaaaagcgtacctccgttacgccacaccaaagactgcacttcgtggacaaaccctacgagtgcaaagaatgtggcaaggcttttagagtgcggcagcaacttacttttcaccacagaatccacaccggcgagaaaccatatgaatgcaaagagtgcgggatggcctttagacagactgcccacctcacgaggcatcaacgcttacattctggagagaagctgtatgaatgcaaagaatgcggggaagcctttatatgtggagccgatttacgtgttcaccagaagatgcacatcggggagaaaccgtacgagtgcaaggagtgcgggaaggcatttagagtaagaggccagctgaccctgcaccaacgcattcataccggagaaaaaccctacgtttgcaaagagtgcggcaaagctttcaggcagtacgctcacctgaccaggcaccagaagctgaatagcgccgacaggctgtacgagtgtaaggaatgtggcaaagccttcctgtgcggatcggggttacgcgtgcatcataaattgcataccggagagaagccatatgaatgcaaggaatgtggaaaagccttccgcgtgcggcaacagctaaccctgcatcaacggatccacacgggcgaaaagccatacgaatgcaaggagtgcggcaagaccttctctcgcgggtaccacctgattctacatcaccggattcacacgggggaaaaaccctatgaatgtaaggagtgctggaaagcttttagcaggtactctcagcttattagtcaccaatccatacacatcggcgtgaaaccttacgactgcaaggaatgcggaaaggctttcagacttttatcacagttgacacagcaccagagtatccatatcggggagaagccctacaaatgcaaggagtgcggaaaggcgttcaggctgcgccaaaaattgacactgcaccagtcgatccacacgggggaaaaacctttcgagtgcaaagaatgcaggaaagccttccgactgaacagctcacttattcaacacctgcgtatccacagtggtgaaaagccctacgagtgcaaggagtgcaaaaaggcgtttaggcaacatagtcacctgactcatcaccttaagattcacaatgtgaaaatttag

SEQ ID NO: 22197 - DNA, 1833 bp, Artificial Sequence
  Description of Artificial Sequence: Synthetic coding sequence
atggacagcgtggccttcgaggacgtggccgtgaacttcacccaggaagaatgggcgctcctaggtccttcacaaaaatccctgtatcggaatgtgatgcaggaaactattcgcaatctcgattgtatcgagatgaaatgggaggatcaaaatatcggagaccaatgccagaatgcgaagcggaacctccgcagccacacgtgcgaaatcaaggacgacagtcagtgcggcgagacttttggccagatccccgacagcatcgtgaataagaacaccccaagagtgaacccatgcgatagtggcgaatgcggtgaagttgtgctgggccacagcagtctgaactgtaacattagagtcgatacaggacacaaatcgtgcgagcaccaggagtacggcgagaaaccttatactcataaacagcgaggtaaggcaatctcgcaccagcacagcttccagacccacgaaagaccgccgactggcaagaagccattcgattgtaaggaatgcgcgaaaacattttcctcgttggggaacctgagaagacacatggccgcccaccacggggacggcccttataagtgtaaattgtgtggcaaggcgtttgtgtggcctagcttatttcatctccacgagcgcactcataccggcgaaaagccctacgaatgtaaacagtgtagtaaggcattcccattctattctagttacctgcgacatgaacgcatccatacgggagaaaaagcctatgagtgcaaacaatgctccaaagcttttcccgactactctacgtacctcagacatgagcgtacccacacgggtgaaaaaccttacaagtgcacccagtgcgggaaggcttttagttgctattactatactcgactccatgagcgcactcacacaggtgaacagccctacgcgtgcaagcaatgcgggaagaccttttatcaccacacgtcctttcgacgacacatgatcaggcacacaggcgacggcccccataagtgtaaaatttgtggcaagggatttgactgtccaagtagcgtgagaaatcacgaaaccacacacaccggcgaaaaaccgtacgaatgcaagcagtgtgggaaagtcttgagtcactcctcaagcttcaggtctcatatgataacacatactggtgacgggccccaaaaatgcaaaatctgtggaaaagctttcggttgcccctcactctttcaacgccacgaacgtacccacacaggggagaagccatatcagtgcaaacagtgcggtaaagccttttccctggctggtagtctgcgccgtcacgaagccacacacactggggtgaagccatataaatgccagtgtggtaaagcattcagtgacctgagttccttccaaaaccacgagaccacccataccggcgaaaagccttatgagtgtaaagagtgtggaaaagcattctcatgttttaagtacctcagccagcataagagaacccacaccgtggagaagccttatgagtgtaagacttgcagaaaggcctttagccatttcagcaacctgaaggttcatgagcgcatacacagtggggaaaagccttatgaatgtaaagagtgcgggaaggctttttcttggctgacctgccttctgaggcatgaacggatccatacaggagagaaaccatacgagtgcttgcagtgtgggaaggcctttacacgctctcggttcttgcggggtcacgagaaaacccatactggagagaagctgtacgagtgcaaagagtgtggcaaggccttatctagcctgcgctcactgcatcggcacaagagaacccactggaaggacacgctttag

SEQ ID NO: 22198 - DNA, 1410 bp, Artificial Sequence
  Description of Artificial Sequence: Synthetic coding sequence
atgaagtgggaggaccagaacatcggcgaccagtgccagaacgccaaacgtaatctgcggagccacacttgcgagatcaaagacgacagtcagtgcggggagacctttggccaaatccccgattccattgtcaacaaaaatactccacgagttaatccctgcgacagtggcgaatgcggggaggtcgtgctggggcacagcagcctgaactgtaatatccgagtcgatactgggcacaaatcctgcgaacatcaggaatatggtgaaaaaccgtatacccacaaacagcgggggaaggcaatcagtcatcaacacagctttcagacgcacgagcgaccgcccactgggaaaaagccatttgactgtaaggagtgcgcgaaaacgttctcatccctgggtaatctacgcaggcacatggccgcccaccacggggatggcccatataagtgtaagctttgtggaaaggcgtttgtctggcctagcctcttccaccttcacgaaagaacccacaccggtgaaaaaccctacgaatgcaagcagtgctcaaaggctttcccattttactcctcatatttgcggcatgagcgtatacacaccggcgagaaagcctatgaatgtaaacagtgcagcaaagcctttcccgactattctacatatctgagacatgagagaacacatacaggcgagaagccatacaaatgcacccagtgcggtaaagcctttagctgctactattacacccgccttcacgaaagaacacatacgggcgagcagccttatgcctgtaaacagtgcggcaaaaccttttaccatcatacttccttcagacggcacatgattcggcacacaggagacgggccccataaatgtaaaatatgtgggaagggattcgattgtccgagttcagtgcggaatcatgaaaccactcataccggcgaaaagccctatgagtgtaaacagtgtggtaaagtcctgagtcattcctcttcctttcgttcccacatgattactcacaccggagacgggccacagaaatgcaaaatctgtggcaaagctttcggttgccccagcctctttcagagacatgagcgcactcacaccggagagaaaccctatcagtgcaaacagtgtggtaaggcattttctctcgcagggtcactgcgccggcatgaggccacccacaccggcgtcaagccctacaagtgtcagtgcggcaaggccttcagcgacttatcttcattccagaaccatgagaccactcacacaggcgagaaaccatacgaatgcaaagagtgtggaaaagcattttcttgttttaaatacttgagccagcataagcggacccacaccgtcgagaagccctatgagtgcaagacgtgcaggaaggccttttcccatttttccaactag

SEQ ID NO: 22199 - DNA, 1287 bp, Artificial Sequence
  Description of Artificial Sequence: Synthetic coding sequence
atggccgcccaccacggcgacggcccctacaagtgcaagctgtgcggaaaggcctttgtgtggccttcactgtttcacctgcatgagagaactcacactggtgagaagccctacgaatgtaagcagtgtagcaaagcctttcccttctattcatcttacctgagacatgagcgaatccacaccggtgaaaaggcttacgagtgcaagcagtgctccaaggcattccccgactattccacctacctcaggcacgagcgcactcacacgggagagaagccttacaagtgcactcaatgtgggaaggctttttcttgttattattatacacgattgcatgaacgaacccacacaggtgagcagccctacgcttgcaagcagtgcggcaaaactttctatcaccatacaagttttcggcggcacatgatccggcacaccggtgatgggcctcataagtgcaagatatgtggcaagggatttgactgcccgtctagcgtgcgcaatcatgagacgacccatacaggggagaaaccttacgagtgtaagcagtgcgggaaggtgctttctcacagtagttcttttcgatcccatatgataacacacacaggtgacggaccccagaaatgtaagatctgtggtaaagcctttggctgtccctccttatttcagaggcacgagcgcacacacacaggggagaagccatatcagtgcaaacagtgtggaaaggccttttctctcgcaggctcactcaggcggcatgaagccacccacacaggcgttaaaccgtataagtgtcagtgtgggaaagcctttagcgacctgtctagttttcagaaccacgaaacaacacatactggtgagaagccctatgaatgcaaagaatgcgggaaagccttcagttgctttaagtacctgtctcaacataaacggactcacacagtggagaaaccctacgaatgcaaaacatgtcgaaaggcattttctcactttagcaatctgaaagtgcacgagcgaattcacagcggagagaagccttacgagtgtaaagaatgcgggaaggcattctcttggctgacttgcctgctgcgccacgaacgtatccatactggcgagaagccttacgaatgcctgcagtgcggcaaagcttttacgcgctcgcgcttcctccgcgggcacgagaaaacccatacaggggagaaactgtatgagtgtaaggagtgtggcaaggcccttagctcacttcggtccctgcataggcacaagcggacccactggaaggacaccctgtag

SEQ ID NO: 22200 - DNA, 3243 bp, Artificial Sequence
  Description of Artificial Sequence: Synthetic coding sequence
cccagccggcagaagaagaagaagaagaagctgaccagcgacgtgagccggcaggaagaagcagagggcgaactgtcagagggcgagcattggtacggtaactccagtgaaaccccctctgaggcttcttacggagaggttcaggagaactacaagctctccctggaggaccggattcaggagcagtctacgagtccagacacaagcttagggagtactaccccaagtagccatacactggagttggttgccctcgacagtgaagtcctgagagatagcctgcagtgtcaggatcacttgtccccaggcgtttcctcactctgcgacgacgaccccggttcaaataagcctctgtcatccaacctccggagattgctcgaggcaggaagcctcaaattagatgctgccgccacagctaacggacgggtcgaatcacccgttaatgtgggctcaaatttatcgttctctcccccttctcaccacgcacagcagttgagcgtacttgcaagaaagctggccgagaagcaagagcagaatgatcaatatacgccaagtaaccgcttcatctggaaccaggggaaatggctccccaattcaaccactacttgttctctctcaccagactccgccatcctgaagctgaaggccgcagcaaatgcggtcttacaggacaagagcttaactaggacagaagaaacgatgcgctttgagtcgtttagttctcccttctcttcacagagcgcctctagcacactggcagccttgagcaaaaaggtttcggagcgctctctgactccaggacaggaacatcccccacccgcctcttcctttctctcgctggcttcaatgacaagtagcgcagcactgctcaaagaggtggccgctcgggctgccggctccctgctggcagaaaagtcgagtcttctaccagaggatcctctgcccccacccccaagcgagaaaaagcctgagaaagtgacacctccccccccacctccccccccaccccccccaccaccaccccctcagagcctcgaactgctactcctgcccgtgcccaagggccgggtttccaagccttcaaacagtgcctctgaggaggagtccggaaaaccttttcaatgcccaatttgtgggctggtgatcaagcgcaaaagctactggaaacgccacatggtgattcacacaggccttaaaagccatcagtgtcctctctgcccgttccgttgcgctagaaaagataatttgaagtcccacatgaaagtccaccagcaccaggacagaggggaaacattccagtgtcagctatgcccctttacgtcatcccggcatttctccctgaaactccatatgcggtgtcaccaacactttctgagaaccgaggccaaggtgaaagaagagatccccgaccctgatgtgaaagggagccctcacctgagcgactcagcatgtcttggtcagcagagagagggcggtggaaccgagctggtaggcaccatgatgacaagtaacacacctgaacgcacgagccagggaggtgccggggtctctcctctgttggtcaaggaggaacccaaggaggacaatggactacccacatccttcactctcaacgccgctgacagacctgccaaccatactaagctgaaagatccatctgaatatgttgccaattcagccagtgcactcttcagtcaggatattagcgtgaagatggcatctgactttctgatgaagttatccgcagctaaccagaaggagcctatgaatctgaactttaaggtaaaagaggagccaaaggagggagaatccctgtctacgaccctgccccggtcaagctacgttttttctccagaaagcgaggtctcggcaccaggcgtgtctgaagatgctctcaagcctcaggaggggaaaggcagcgttttacggcgggacgtgtcggttaaggcagcatcagagttgctcatgaaattgtccgccgagagctacaaggagactcagatggttaagattaaggaggagccaatggaagtggacattcaggactcccacgtctccattagcccctcccgaaatgttgggtattcaaccctgattgggagggaaaaaaccgagccgcttcaaaagatgccagaagggcgagtgccgccggagagaaatctgttctctcaggacattagtgtcaagatggcctctgaactgctattccagctgtcagagaaagtgtcaaaggagcacaatcatacaaaggagaataccatccggaccaccacttcaccttttttttcagaagatacttttagacagagccccttcacatctaatagcaaggaattgctgccgtcagattcagtgctgcatgggcgcatctccgcaccagagaccgaaaagatagtcctggaagccggaaacggcttaccctcgtggaaattcaacgatcagctgttcccatgcgatgtgtgcggcaaagttttcggcagacaacaaacactgtcacggcacctgtccttacacaccgaggagagaaagtacaaatgccacttgtgcccttacgccgcaaaatgcagagccaacttaaatcagcatttaactgtgcactcggtcaaactggtttccacagacaccgaggacatcgttagcgcagtcacatcagagggatctgacgggaagaaacacccttattactattcctgtcatgtgtgtgggtttgaaacagaactgaacgtccagttcgtatctcacatgagccttcacgtggacaaggaacaatggatgtttagcatctgctgcacagcctgtgacttcgtaacaatggaagaggccgaaatcaagacccacattgggacaaaacacactggcgaggatagaaaaactcccagtgaatccaacagtcccagctcttcatccctatccgccctatcagactctgctaacagtaaagatgactccgacgggagccagaagaataagggtgggaacaatcttcttgtaatctccgtgatgccaggatcacaaccgagcttgaactccgaagagaagcccgagaagggttttgaatgcgtattttgtaacttcgtatgtaagacgaaaaacatgtttgaacgccaccttcaaattcatctaattacaaggatgtttgagtgtgacgtctgccacaaattcatgaagactcccgagcaactcttggagcacaagaaatgtcatactgtgccgactgggggactaaactctggtcagtggtag

SEQ ID NO: 22201 - DNA, 2196 bp, Artificial Sequence
  Description of Artificial Sequence: Synthetic coding sequence
atgccccggcggaagcaggagcagcccaagcggctgcccagcccctcagaagaggagagcggtaaaccgttccagtgcccaatttgtggtcttgtcattaagaggaagagctactggaagcggcacatggtgatccacactggtctcaagagccaccaatgtcccctgtgtccctttaggtgcgccaggaaagacaatcttaaatcccatatgaaggtacaccagcatcaggatagaggcgagacttttcaatgccagctgtgcccatttacgagctcgagacatttttcgttgaagctgcatatgaggtgccaccagcactttctcaggactgaggccaaggtgaaggaggagatacccgaccctgatgttaagggttccccccatctcagcgatagcgcctgcctgggccagcagcgtgaggggggagggaccgagcttgtaggcacaatgatgacttccaacacacctgagcgtacaagccagggtggcgctggcgtgagcccgcttcttgtcaaggaagagcctaaagaggataatgggctgcctaccagctttacattgaacgccgcagaccgtcctgcgaaccataccaagctgaaggatccaagcgagtacgtggcaaatagcgctagcgccttgttctctcaggatatatcggtgaagatggccagcgacttcctgatgaaattgagtgccgccaaccagaaggagccgatgaaccttaactttaaagtcaaagaagaaccaaaggaaggagagagtctcagcaccaccctgcctcgtagctcctatgttttctctcccgagtctgaagtcagtgcccctggagtgtccgaagacgccctgaaacctcaggagggtaagggatccgtacttaggcgagatgtatccgtcaaagctgcttccgagctgctaatgaagctgagtgccgaatcgtacaaggagactcagatggtaaagatcaaggaggaaccaatggaagtggatatacaggatagccacgtgtccatatctccctctagaaatgtgggatacagtacactgattggccgcgagaaaaccgagcctctgcagaaaatgccggaggggcgtgtccctcctgagagaaatctgttctctcaggatatctccgtcaagatggcctccgagctgctgttccaactgagtgagaaggtgtccaaggaacacaatcatactaaggagaacaccattcgcaccaccaccagccccttcttcagcgaggatacatttcgccaaagcccattcacctctaatagcaaagaactgctgccaagcgacagcgttcttcatggaaggatatctgccccagaaacagagaagatcgtgttggaggcaggaaacggtctgcccagttggaagttcaacgatcaattatttccttgcgacgtatgtgggaaagtttttggcaggcagcagacactgagtagacatctgtctctccataccgaagagaggaagtacaagtgccatctatgcccctatgcagccaaatgcagggccaacttgaatcaacaccttacagtgcacagtgtcaagctggtgtctactgacacagaagacatcgtgagcgctgtgaccagcgaggggagcgatggtaagaaacatccatactactactcttgtcatgtttgtggattcgagacggagctgaatgtgcagtttgtcagccacatgagcctgcacgtcgataaggagcagtggatgttcagcatctgttgtaccgcctgtgactttgtgactatggaggaggcagaaattaagacacacatcggcaccaaacacacgggggaggaccggaagacccccagcgaatctaactctccttcttcttcgagtttatccgccctgagcgactccgccaatagcaaggacgatagcgatggctcacaaaaaaacaaagggggcaataacctcctcgtcatttcagtcatgccaggcagccagccatcactgaacagcgaagaaaagcctgaaaagggcttcgaatgtgtgttctgcaatttcgtgtgcaaaacaaagaacatgtttgagcgccatctgcaaatacatctgataaccagaatgtttgaatgcgacgtgtgccataaatttatgaaaacgcccgagcaactgctggagcacaagaagtgccatacggtacctactggcgggctgaagcggggcgcctggtag

SEQ ID NO: 22202 - DNA, 3246 bp, Artificial Sequence
  Description of Artificial Sequence: Synthetic coding sequence
atgccccggcggaagcaggagcagcccaagcggctgcccagccacgtctctcgccaggaagaggctgaaggggaattatctgaaggggaacattggtacggcaattctagcgagacaccatctgaggcatcgtatggagaggtgcaggagaattacaaattgagcctcgaggaccggatccaggaacagagtacaagtccagacacctctctgggtagtacaaccccaagttctcataccttggaattggtcgccctcgactccgaggttcttagggatagcttgcagtgccaggatcacctctctccaggcgtttcctccctgtgtgacgacgatcccgggtcaaacaaacctttatctagcaacctacggcgcctcctggaagcggggtcactgaaactggacgcagccgctaccgcaaatggaagggtggagagcccggtaaatgttggatctaacttgagtttctctcctccttcacaccacgcacaacagctgtcggtgctggctcgaaagctggctgagaagcaggagcagaatgatcagtacactccatcaaacagattcatatggaatcagggcaaatggctccccaacagcactacaacgtgtagtcttagccccgactcggctatcctgaaacttaaggccgcggccaatgcggttctgcaggacaaatccctaacacggactgaggaaactatgcgctttgagtcctttagctcaccattctcatcccagtctgccagcagcacactggcagcgctgagcaagaaggtgagcgagcggtcactcaccccagggcaggaacaccctcctcctgcatcatcctttctctctttggccagtatgacgagcagcgctgccttgttaaaggaggtggcggcacgggccgccggctcactgctggcagagaagtcctctctacttcctgaagacccattaccacccccaccatccgagaagaaacccgagaaggtcaccccaccacccccccctcccccgccccctccaccgccccccccaccgcagtccctggaactgcttctgctccctgtgccaaaaggccgggtgagtaaaccctccaactccgccagcgaagaagagagtgggaagccatttcagtgtccaatttgtggcctggtcattaagaggaagtcctactggaagcggcacatggtcattcacacaggtttaaagagccaccagtgccctctatgcccattccgctgcgctcgtaaggataatcttaagtcacacatgaaagttcatcaacatcaagaccgcggagaaacgttccagtgtcagctttgcccatttaccagtagtagacacttttcgctgaaattacacatgcggtgccatcaacacttcctgaggacagaggccaaggtgaaagaggaaatacctgatcctgacgtaaagggaagtccccacctgtctgacagcgcttgccttggtcaacagcgggaggggggtgggacagagttggtcggcacaatgatgacgtccaacacaccagagaggaccagccaagggggggccggcgtgagcccactattggtgaaagaggaaccaaaggaggataatggtctcccaacaagcttcaccctgaacgctgccgatcgcccagctaaccatacaaagctgaaagacccatccgaatacgtggcaaactctgctagtgcactgttcagtcaggacatttccgtgaagatggcctccgactttctcatgaaactctctgcagcaaatcagaaggaacctatgaacctcaatttcaaagtcaaggaggagcctaaggaaggggagtccctgtcgaccactctgccacggagtagctacgtattcagccccgagtcggaggtgtctgccccgggggtgtcagaagacgccctgaagccccaggagggcaaagggtcagtgctccgtcgagatgtttccgtgaaagctgccagcgaactgcttatgaaactgagtgcggaatcttataaggagacccagatggtaaagattaaggaagaaccaatggaggttgatattcaggatagccatgtatccattagcccctcccggaatgtcggctactcaaccctgatcggtcgggaaaaaacagagccactgcagaagatgccagaggggcgcgtccccccggagagaaacttattctcccaggacattagcgtgaagatggcaagtgaactgctctttcagctctccgaaaaggtttctaaggaacacaaccacaccaaagagaacaccatccgaactactactagtccatttttctcagaggataccttccgccaaagcccctttacctctaattctaaggagctcttgccatctgacagcgtcctgcatgggaggatttccgcgccggagaccgaaaaaatagtgctggaggcaggaaatggactgcctagctggaagtttaacgatcaactgtttccctgtgatgtttgtggaaaggtattcggaaggcagcaaactctctcacgacacctgagtctgcacaccgaagagcggaagtacaaatgtcatctgtgtccgtatgctgcgaagtgccgtgcaaacctcaatcaacatctcacagtacactccgtgaaactggtgagcaccgacacggaggatatcgtctccgccgttacatctgaggggtcagatggcaagaagcacccttattactacagttgccatgtctgtggatttgagacagagcttaatgtccaattcgtttctcacatgagtctgcatgtggataaggaacagtggatgttctccatctgctgtactgcctgtgatttcgtcactatggaggaagctgagattaagacccacattggaactaaacacacaggcgaggatcgaaaaacccccagtgagagcaacagcccctcatcctcctcgctcagcgccctatctgatagtgctaattccaaggacgatagtgatgggtcccaaaaaaacaaagggggtaataatcttctggtgatctctgtgatgccaggcagtcagcctagcctcaattccgaagagaagccagaaaagggatttgagtgcgtgttctgcaatttcgtttgcaagactaaaaacatgttcgagagacaccttcagatccatttaattacgcgcatgttcgaatgtgacgtatgtcacaagttcatgaaaaccccagagcagctccttgaacacaagaaatgtcatacagtaccaactggagggctgaattctgggcagtggtag

SEQ ID NO: 22203 - DNA, 2196 bp, Artificial Sequence
  Description of Artificial Sequence: Synthetic coding sequence
atgccccggcggaagcaggagcagcccaagcggctgcccagccccagtgaagaagagtctgggaagcccttccaatgtcccatatgcgggttggtcataaaacgaaaaagctattggaagcggcacatggttatccataccggactgaagagtcaccagtgccctctgtgccctttcagatgtgcacgcaaggacaatctcaaaagccatatgaaagttcaccagcaccaggatcgaggcgaaacctttcagtgccaactttgcccctttacatccagcaggcattttagtctgaaactacacatgaggtgccaccaacactttctccgcacagaggccaaggtgaaagaggagattcccgatccggacgtgaaaggctccccacacctaagcgactccgcatgccttggccagcagagagagggtggcggcacggagctggtcggtacaatgatgaccagtaacacccctgagcgtacctcacagggaggcgccggcgtgtctcctttgctggtgaaggaggaaccaaaggaagacaacggccttcccactagcttcacactgaatgctgcggatagaccggctaaccatactaagctaaaggatccctccgagtatgtagctaactcagcctctgctctcttctcccaggatatctccgtaaaaatggcctctgacttcctcatgaagttatccgcggccaaccagaaggagcccatgaacttgaacttcaaagtgaaagaggaacccaaagaaggcgagtccttgagcacaacacttcctcgatcctcttatgtattctcaccagagagcgaggttagcgcccctggagtgagcgaagacgctctgaagcctcaggagggaaaaggatcggtcctgcgtagggatgtgtctgtgaaggcagcaagcgagcttttgatgaagttgtccgcggagtcttataaggagacacagatggtcaaaatcaaggaggaaccgatggaggtggatattcaggactcccacgtcagtattagtccgagcaggaacgtgggttactcaacactgatcgggcgggagaagactgagcccctgcagaagatgccagaggggagagtccctcctgagcgaaatctattttcccaagacatatccgtgaagatggctagtgagcttctgttccagctcagcgagaaggtgtctaaggagcacaatcacactaaagaaaacaccatcagaaccaccacatccccctttttttctgaggacacatttcggcagagtccatttacctctaactccaaagaattgctcccctcagatagcgtgctacacggacgtatctcagctcctgagacggagaagatagtactcgaggccggcaacgggctgccaagctggaagttcaacgaccaactgttcccttgcgatgtttgcggcaaagttttcggcaggcaacagacactgagcagacatctgagccttcacacagaggagaggaaatataaatgtcatctgtgcccctatgctgctaagtgtcgggccaatctcaatcagcacttaacggtgcattctgtcaagcttgtgtccaccgacaccgaggacatagtaagtgcggtgacctcagaaggcagcgacggaaagaaacatccctattactacagttgccatgtgtgcggattcgagacagaattaaatgtacagtttgtgtcgcatatgtcactgcacgtcgacaaggagcaatggatgttttcaatctgttgtacagcctgcgacttcgtgacgatggaagaggccgagataaagacccatatcggaaccaaacataccggcgaagacagaaagacacctagcgaaagcaacagtccaagctcctcatcacttagtgcactctcagacagcgctaattctaaagacgactcagatggaagtcagaagaataagggcgggaataacctccttgttatttctgtgatgcccggctctcagccaagcctgaatagtgaggaaaaaccagagaagggcttcgaatgtgttttttgtaacttcgtttgcaaaaccaagaatatgttcgaaaggcacctgcaaattcatcttatcacacggatgttcgagtgcgacgtttgccataagttcatgaaaacacccgagcagctgcttgagcacaagaaatgtcacactgtgcccactggcggtctaaattccggacagtggtag

SEQ ID NO: 22204 - DNA, 3234 bp, Artificial Sequence
  Description of Artificial Sequence: Synthetic coding sequence
atgccccggcggaagcaggagcagcccaagcggctgcccagccacgttagccgacaggaagaggcagagggagagttgtctgaaggcgagcactggtacgggaacagctccgaaactcccagcgaagcctcctatggcgaggtgcaggaaaattacaagttgtctctggaagatcggattcaagaacaaagcacatcccccgatacttcattgggttctacaactccttctagtcacactctggagcttgtggcgctcgattcggaagtgctaagagactcactgcagtgccaggaccatctgtcccctggtgtgagctccctctgcgatgatgacccaggaagtaataaaccacttagttctaatctgcgacgactgttagaagcaggctctctgaaactcgacgctgcagcaacggccaatgggagggtggagtcacctgttaacgttggatccaatctgtccttttctccgccctctcatcacgctcagcaacttagtgtcctggcgaggaaactcgccgagaagcaggagcaaaatgatcagtacactccgagtaaccgattcatctggaatcaggggaagtggctgccaaatagcactactacatgtagcctcagtcctgactccgccatactgaagctgaaggctgcagcaaacgcggtccttcaggataaatcccttacccggactgaagagacgatgagatttgagagtttctcctctcccttttcatcccaatcagctagctcaaccctggcagcactttccaagaaagtgtctgagagatcactcacacccggccaagagcatcctccccctgcttccagctttttaagcttggcgagcatgaccagttcggcagctttactcaaagaagttgcggctagagcggctgggagcttactggctgagaagtcttctttgctcccagaagacccactgcccccccccccttccgaaaagaaacccgagaaggtgacaccaccaccacccccaccaccgccaccccccccgcccccccctcctcagtcactggagctgcttctccttcccgtgcccaagggtagggtctcaaaaccttctaattctgcatctgaggaggaatctgggaaaccatttcagtgtcccatctgtggtttggtgatcaagaggaagtcgtactggaagcgccatatggtcatacatactggcttaaagtcacaccagtgtcccttgtgtcctttccgctgcgctaggaaggataatctgaagtcgcatatgaaagttcaccaacaccaagacaggggcgagacgtttcaatgtcagctttgccccttcacctccagtaggcactttagtctgaagctgcacatgaggtgtcatcaacacttcttgaggactgaggcaaaagtgaaggaggaaatcccagacccggacgtgaagggttccccccacctgtctgattcagcttgtcttggccagcagagggagggaggtggtacagaactcgtgggcaccatgatgacaagtaacaccccagaacgtacgtcccaggggggcgcgggggtgtcaccccttctggtaaaagaggagcccaaggaagataacggcctgcctaccagcttcacactgaatgctgctgatcgccccgctaaccacacgaagcttaaggaccccagtgagtatgtagccaatagcgccagtgcactgttctcacaggatataagcgtcaaaatggctagtgactttcttatgaaactgagcgccgctaaccaaaaagagcccatgaaccttaacttcaaagtgaaagaggagcctaaggagggcgaatctctatccaccactctgcctaggtcctcctacgtgttttcacctgagagcgaagtttccgctcctggagtgtcagaagatgcgctgaaaccccaggaaggcaagggatcagtgctgagaagggacgtgtcagtgaaagcagcctctgagctgctgatgaagctctctgctgagtcctacaaggagacccagatggttaagataaaggaagagcctatggaggttgatatccaagacagccacgtaagtatttccccgagccgaaacgtgggctattccactctcataggccgcgaaaagacagagcctcttcagaagatgcccgaaggaagggtgccccccgaacgcaacctgtttagccaggatatctcagtgaagatggcgagtgagctgttattccagttaagtgaaaaggtcagcaaggagcataaccacacaaaggagaacacaatcaggacaacgacaagcccttttttctcggaggatactttccgacagagtccatttacatccaattctaaagaactgttgcccagcgactccgtcctgcacggtcgaatctccgcacccgaaaccgagaagatcgtgttggaggccggcaatggtttgccttcttggaagttcaacgaccagcttttcccctgcgatgtatgcgggaaagtgtttggccggcagcagaccctgtcacgtcacttatctttgcacacagaggaaagaaaatataaatgtcacttgtgcccttatgctgccaaatgtagagctaacttaaaccagcacctcacagtgcacagtgttaagcttgtttccactgatactgaggacattgtgtcagcggtcaccagcgaggggtctgatggcaagaagcatccttactattactcttgtcacgtgtgcggctttgaaaccgagctgaacgtgcagttcgtcagccacatgagcctccatgtggataaagagcagtggatgttttctatctgttgtactgcgtgcgatttcgtcacgatggaggaagctgagatcaaaacccacatagggactaagcatacaggggaggaccggaagaccccgagtgaatctaattcaccttcgtctagctcccttagtgcgctgagcgattcagctaactccaaagacgactcagatggtagccagaagaataagggaggcaacaatctgttggttatctccgtgatgccggggagtcagcctagcctgaactccgaggagaagccggagaagggctttgaatgcgtgttctgcaatttcgtctgtaaaactaaaaacatgttcgagagacacctccagatccatctgataacccggatgtttgagtgcgacgtgtgccacaagtttatgaagacccctgagcagctgctggaacacaaaaagtgtcatacagtccctacggggggcttgaagtag

SEQ ID NO: 22205 - DNA, 1299 bp, Artificial Sequence
  Description of Artificial Sequence: Synthetic coding sequence
atgccccacagccccctgatcagcatcccccacgtgtggtgccaccctgaggaagaggagcgaatgcacgatgaacttttacaggccgtaagcaaaggaccagtgatgtttcgagacgtaagcatcgacttttcccaagaggagtgggagtgcctggacgccgatcagatgaatctttacaaggaggtgatgctggaaaacttctctaatcttgtgagtgtgggtctttccaactcaaagcctgccgtcatcagtcttttggaacaggggaaggagccctggatggtggatagagagctgaccaggggtctgtgttctgatctagagtccatgtgcgaaaccaaaatcctgtccctcaaaaagagacattttagccaggtgataattactcgtgaagacatgtcaacttttatacagccaacattcctgatccccccccagaaaaccatgtccgaagagaagccttgggaatgcaagatctgcgggaagacatttaatcagaacagccagttcatccagcaccagcggatccatttcggagagaagcattacgagagcaaagaatacggaaagtcgttctctaggggatctctggtgacgcgacaccaacgtattcatactggtaagaaaccttatgaatgcaaggaatgtgggaaggctttttcatgtagttcgtacttttcacagcatcagcggattcataccggagaaaaaccctatgaatgcaaggagtgtggcaaagctttcaaatactgttcaaacctcaacgaccaccagaggattcacactggtgaaaaaccttacgaatgtaaagtttgtggtaaagcttttaccaaatcaagccagctgttcctgcacttacgtattcacacgggggaaaaaccctatgaatgtaaggagtgcgggaaggcatttacccagcacagccggctgatccagcatcaacgcatgcataccggcgaaaaaccttatgaatgcaaacagtgtggaaaagccttcaatagtgcttccactctaactaatcaccatagaattcatgccggagaaaaactgtatgaatgtgaggagtgccggaaagcattcatccagagcagtgaattgattcaacaccagcgaattcacaccgacgagaaaccatacgagtgtaacgaatgtggaaaagccttcaataaaggttcaaatctgacacgtcaccagaggatacataccggggagaaaccgtacgactgtaaggaatgcgggaaggcgttcggctcgagaagcgaccttatccgtcacgagggcatccacaccgggtag

SEQ ID NO: 22206 - DNA, 1299 bp, Artificial Sequence
  Description of Artificial Sequence: Synthetic coding sequence
atgccccacagccccctgatcagcatcccccacgtgtggtgccaccccgaggaagaggaaaggatgcacgatgaactgctgcaggccgtttcaaagggacccgtaatgttccgagacgtctctattgatttctctcaggaagagtgggagtgtttggatgccgatcagatgaatctttacaaggaggtgatgctggagaacttctctaacctcgtttccgtgggactgagcaattcaaagccggctgttatcagtcttctggagcaggggaaggaaccctggatggtcgaccgcgaattgaccagaggactctgttcggatttggagtccatgtgcgaaaccaagatcctctcccttaagaagcggcacttcagccaggtgatcatcaccagagaagacatgagcacgttcattcagcccacctttctgattccgccacagaagaccatgtctgaagagaaaccatgggagtgtaagatatgcggcaaaacttttaaccaaaatagccagtttatccaacatcagcggatccatttcggcgagaagcactatgagtctaaagaatacggcaaatcctttagcagggggagcctggttacccggcaccagaggatccataccggcaagaaaccatacgagtgcaaggagtgcgggaaagcattttcctgctcctcctacttttcgcaacatcagaggattcatacaggagaaaaaccatacgagtgcaaagaatgcggaaaagcattcaagtactgcagcaacctgaacgatcaccagaggatccacaccggtgaaaagccatacgaatgcaaagtttgcggtaaggctttcaccaagtccagccagctttttctacacctgaggatacatacaggtgagaagccatacgagtgcaaagagtgtggtaaggcatttacacaacactccaggctgatccaacaccagcgaatgcatacaggtgaaaaaccctacgaatgcaagcagtgcggaaaggcttttaatagtgcctcaacactcaccaatcaccaccgtatccatgccggcgagaaactatacgaatgtgaggaatgccgtaaggcgtttatccagtcctccgagctgatccagcaccagcggatacacaccgatgagaagccatacgaatgcaatgaatgtggcaaggcttttaataagggctcaaacctcacaagacaccagcgaatccacactggagaaaagccgtatgactgtaaggagtgcggaaaagccttcggctcgcgcagcgacctgatcaggcacgaaggtattcataccggttag

SEQ ID NO: 22207 - DNA, 2811 bp, Artificial Sequence
  Description of Artificial Sequence: Synthetic coding sequence
atggccctgacccagggccccctgaccttccgggacgtggccatcgagttttctcaagaagagtggaagtcattggacccagtgcagaaggctctgtactgggacgtgatgctagagaactatcgaaatctcgtgtttctgggcatcctgcctaagtgcatgacgaaagagctgcctcctattgggaattcaaacaccggcgaaaagtgtcagaccgtgaccctggagaggcacgagtgctacgacgtagaaaacttttacctgagagagatccaaaagaatttacaggatctcgagttccagtggaaggatggcgagattaattacaaggaagtccctatgacatataagaacaatctgaacggcaagagaggccagcacagccaggaggacgttgagaataagtgcatcgaaaatcaactgaccctgtcattccagagccgtttgaccgaactccaaaagtttcagaccgagggtaaaatctatgaatgtaaccagtctgaaaagacggtaaataatagttctctggtgtcgccattacaacgaatccttccatccgtgcagacaaatatctccaaaaaatacgagaacgagttcctacagttaagcttgcccacgcagctggagaagacacacattcgggaaaagccctacatgtgtaaaggctgtggtaaggcattccgggtctccagtagtctcattaaccatcaaatggtgcatactaccgagaagccttataaatgcaatgaatgcggaaaggcattccaccgaggctcactgttaacaatccatcaaattgttcacacacggggcaaaccgtatcagtgcggggtctgtggcaaaatcttccggcaaaattctgatctggttaatcaccggaggtcccatactggtgaaaagccatacaagtgtaatgagtgcgggaaatccttcagccaaagctataaccttgccattcatcaacgcatccatacaggcgaaaagccatacaaatgtaatgaatgcggcaaaacatttaaacagggctcgtgcctgacaacacatcagatcatccacaccggcgagaagccctaccagtgcgatatatgcggaaaggtctttcggcagaactccaaccttgtgaaccaccagcgtatccatacaggcgaaaagccttacaagtgcaacatttgcggaaagtcgttttcacagagctccaacttggccacgcaccagaccgttcatagtggaaacaaaccttataaatgcgacgagtgtggaaagacattcaagcgctcatccagccttacaactcaccaaatcattcacaccggcgaaaagccatacacttgcgacgtttgtgacaaggtgtttagccagaggagccagctggctcggcaccagaggagccacacaggagagaaaccatataagtgcaatgagtgtggaaaagtgttcagccagacctcccaccttgtaggccacagaagaatacatactggagagaaaccttataaatgtgacaaatgtggcaaggcatttaagcaagggagtttacttaccaggcacaaaatcatacacacacgggaaaaacgttatcagtgcggagagtgtggtaaggtattcagcgagaattcctgtctggtcagacaccttaggattcacactggggagcagccatacaagtgtaatgtgtgcggaaaggtgtttaactattctggaaacctgtcaatccataagagaattcacactggagagaaaccttttcaatgcaacgagtgcggaactgtgttcaggaattactcctgtctagcgagacatcttaggatccacactgggcagaaaccttacaaatgcaacgtctgtggtaaagtgtttaacgattccggtaatctgtctaaccataaacgcatccacacaggcgagaaaccttttcagtgcaacgagtgcggcaaagtgttttcatattactcctgtctagccagacacagaaaaatccacactggagagaaaccctataagtgcaacgactgcggaaaagcgtatacacaaagatccagtctgactaagcacctaatcatccataccggggaaaaaccttacaactgcaatgagtttggcggggcattcatccagtcctctaagcttgcccgctaccaccgtaatccaacaggggagaaaccgcacaagtgttcccactgtgggaggacattctcccacatcacaggattgacatatcaccaaaggcgtcacaccggcgagatgccctacaaatgcattgaatgtggtcaggtctttaattccacttcaaatctcgcccgacatcgccgcattcatacaggggagaagccatacaagtgcaatgaatgcggcaaggtgttcaggcaccagtctaccctcgccaggcacaggagtatccacaccggagaaaaaccatacgtatgcaatgagtgtggaaaggctttccgagtgcgctccatcctggtcaatcaccagaaaatgcacaccggcgataagccgtataagtgcaacgagtgcgggaaagcatttatcgaacgcagcaaactcgtttatcaccagcggaatcacacgggcgaaaagccatataaatgtatcgagtgcggtaaggcctttggaagattcagttgtctgaataaacatcagatgatacatagtggagagaaaccttataagtgcaatgaatgcggcaagtcatttatcagtcgctcaggactgaccaagcaccagaccaagcacacagctgaatcacttaaaaccaaattcaatgttgaaaagcccctggatgtcctgctgacctcagggtttaagtag

SEQ ID NO: 22208 - DNA, 534 bp, Artificial Sequence
  Description of Artificial Sequence: Synthetic coding sequence
agcctgcccacccagctggagaagacccacatccgggagaagccctatatgtgcaagggctgcggaaaggccttccgggtgtcctcatcgctcatcaaccatcaaatggttcacaccaccgagaaaccctataaatgcaatgagtgtggcaaggcatttcatcgggggtccttactgactatccatcagatagtgcacaccagaggaaaaccttatcagtgcggtgtttgcgggaagatcttcagacagaactcggacctggtcaatcacaggcgctcccacaccggcgaaaaaccttataagtgcaacgagtgcggtaaaagcttttctcagtcctataatcttgcgattcaccagagaatccacacaggagagcagccatacaaatgcaatgtctgtggtaaagtgtttaactatagcggcaacttatcaatccacaaacgcattcacaccggagagaaacctttccagtgtaatgagtgcggcaccgtgttcaggaactattcatgtttagctaggcatctgcgtatatag

SEQ ID NO: 22209 - DNA, 1596 bp, Artificial Sequence
  Description of Artificial Sequence: Synthetic coding sequence
atggaggcccccgcccagaaggccggccagggcggcctgcccaaggccgacgcacagggcgcaagcggggctcgtgaaaaacgccctgaagagcctcgtcctctcgaggaagatagggctggctctagaccgacacagaaaggagacctgcggggcgccgctggtggcaggactacaccaccgggagggggatcccggggttgttctctgggcgtcagtcccggacctggcactaggcactccgcaggaacacgcccgctcgtgcgcgagccttgtggacccacctcgtcacaaaatcccgagctagttatacctgagggactccaggctcgggaaggcccctgccgctcacctgctagagggggagattgcagtcggaacagctgcttggcctggcatcgcggggcccctgcaggagaaactccacccgtctgtgatccctgcccagagcgcatacaaaatcaccctcgaacccagctatgcgaggtccatacggactgctggccctgccagccagggacgggtgctcctacttgccccaggaccccgaagcctacgagccgcggaaggaatcccctggtcgagcagccacgtgcctgtgcctgcggggaggcatttgcttggagagccctgcggatccctcaggaacgcttacaggctaccgaggaaccgaggccatgcgcaaggtgcggaaaacggttcagacccaatcagcagcagcaggccggaaaaagtccacccgtgtgtcccgaatgcggacaaacgagtcgaccccggcccatagtccccgatccacctgcacagcgcctctacgcttgcgatgagtgcggtaaggccttcactcgtacgtctagcctgctccagcaccagcggatacacactggtgaaagaccatacgagtgcgccgaatgcggaaaggccttcgtaaggtgtagcggtctctatcgtcaccagaaaacccactcggcagagcggcaccgccgcgggcctgttttagcccggcgcgctttccggctgggctgcccaccatgtggggattactccgagcgaagtccccgtcggggctctggagcaggggaaaaaccatatgaatgtgccgactgcgccaaggcctttgggctattctcccatctggtggaacacagaagggtgcataccggcgaaaaaccgtacgcctgtccagagtgcgggaaggcgttcaatcagcggagcaacctgagcagacatcagcggactcacagcagtgccaagccatacgcatgtccgctgtgtgaaaaggccttcaaagggcgatccggcctcgtccagcaccagcgcgcccatacgggtgagagaccgtatgggtgctctgaatgcgggaagaccttccggggttgctccgaactgaggcaacatgagcgcctacactctggggaaaaaccttatatatgtcgggactgtggcaaggcatttgtccgcaattgcagtctggtcaggcacttgaggacgcatactggcgaacgcccatatgcctgcggcgattgtggacgggcattttctcagcgctctaacctcaacgagcataggaagcgccatgggggacgggccgctccttag

SEQ ID NO: 22210 - DNA, 1596 bp, Artificial Sequence
  Description of Artificial Sequence: Synthetic coding sequence
atggaggcccccgcccagaaggccggccagggcggcctgcccaaggccgacgcgcagggcgccagcggggcaagggagaaaaggcctgaggaacctcgacctctcgaggaggacagggctggttcgcgccccactcaaaagggggatctgaggggggccgcgggtgggagaaccacccccccaggcggggggagccgagggtgctcactgggcgtcagcccagggccgggtacacgtcatagcgccgggactaggcccctggtcagagaaccttgcggcccaactagttcacaaaacccagagctggtgatccctgaagggttacaggctcgcgagggcccctgccggagtccggcccgaggtggggattgtagccgcaactcctgcttagcctggcatcgtggagctcccgctggagagaccccccccgtctgtgacccttgccccgagcgcatccagaatcatccacggacccagctctgtgaggtgcataccgactgctggccctgccaacccggaaccggtgcgccgacctgccctaggaccccaaaaccgacaagccgcgggcggaaccccctggtagagcaacctcgcgcctgcgcctgtggagaggcttttgcttggagagccctgcgaatcccgcaagaaaggctacaagctacggaggaaccccgaccgtgcgcacggtgcggaaaaaggttccgtccaaaccagcagcagcaggcagggaagagtcccccagtgtgtcctgaatgcggccagacaagcagaccccgacctatcgttcccgacccaccggcgcaacgtctgtacgcatgtgacgagtgcggcaaggcgttcacacgaacctcctccctcctgcaacaccagaggatccacactggcgaaagaccctacgagtgcgcagagtgcggtaaggccttcgtaagatgctccggactatatcggcaccaaaaaactcattccgccgaaagacatcggagaggccccgttcttgcccgccgggctttcagactgggctgccccccatgtggcgactattcagagcgctcccctaggcgtgggtcgggggcgggcgaaaagccttacgagtgcgccgactgcgcgaaggcctttgggctctttagccacctggtggaacaccgccgcgtccatactggagaaaaaccatatgcatgcccagagtgcggtaaggccttcaaccagagatccaacctgtcacgccatcagcgtacccactcttcagccaaaccttacgcatgtcctctctgcgaaaaggcgttcaaaggacggagcggcctggtgcagcatcagagagcacatacaggagagaggccatacggatgctcagagtgcggaaaaacattccgggggtgtagcgagctccgccagcacgaacgccttcacagtggcgagaagccctatatttgccgggattgtgggaaagcctttgtcaggaactgtagcctcgtgcggcacctgcgcacacacaccggcgagcggccctatgcttgcggagactgcggccgcgctttcagccagcgctccaatttaaacgaacatcggaagaggcacggtggccgcgctgctccttag

SEQ ID NO: 22211 - DNA, 2217 bp, Artificial Sequence
  Description of Artificial Sequence: Synthetic coding sequence
atgaccatgctgcaggagagcttcagcttcgacgacctgagcgtggattttactcagaaagaatggcagttgctggacccttcacagaagaacctttataaagatgtgatgttggaaaactactcatcactggtgagcttagggtatgaagtaatgaagccagacgtgatttttaaattagagcagggcgaagagccgtgggtcggtgacggtgaaattccgtcttcggatagtcctgaagtgtggaaggttgatggcaatatgatgtggcaccaggacaatcaggataaactcaagattatcaagcgaggtcacgaatgtgatgccttcggcaagaacttcaacctcaatatgaacttcgttccattgagaaaaagcaacagcgagggcgatcttgatggcctaatcctgaaacatcatctggatctactgatccccaagggcgattacgggaaggctgaaagcgatgattttaacgtgtttgataatttctttcttcacagcaagcccgaggataccgatacttggctgaagtactatgactgcgataaatacaaagagagctacaaaaaaagccagataattatctaccaccgaaatcgcctgggtgagaagctttatgaatgtagcgagtgcagaaaacgcttctcaaagaagcccagtctgatcaagcaccagtcaaggcacatcagggatatcgccttcggatgcggaaattgtggaaaaaccttcccccaaaagtcccagtttatcacgcaccaccgtacacataccggggagaagccctataactgctctcagtgtggaaaagctttttcgcagaaatctcagctgacatctcaccaaagaacgcatactggtgagaaaccttacgaatgcggcgagtgcggcaaagccttctctagaaagtcccatttgatctcccattggcggactcacaccggagagaaaccgtatggctgtaacgaatgtggtcgggcattctccgaaaaatctaacctgattaaccatcagcggatacatacaggcgagaaacctttcgagtgcagagaatgtggcaaagctttcagtaggaaatctcagctggttactcaccacagaacccatacaggcacgaaaccttttggctgctctgattgccggaaggccttcttcgagaagagcgagctgatcaggcatcagaccattcatacgggggagaaaccatatgaatgctctgagtgccgaaaagcctttagagaacgctctagcctgataaaccaccagcgcacccatacaggagagaaaccgcatggttgcattcagtgtgggaaggccttcagccaaaaatctcacctcatatcgcatcagatgacacacacaggtgagaagccctttatctgttccaaatgcgggaaggccttctcccggaaatcacaactggttcggcatcagagaacgcacactggtgagaagccctacgagtgctctgagtgtggaaaggcgtttagtgagaaactctctctgaccaaccatcagagaattcatactggtgagaaaccctatgtttgttctgagtgtggtaaggccttttgtcaaaagtcgcacctgattagtcatcagagaactcacaccggcgagaagccctacgagtgttcagagtgcggaaaggcgtttggcgaaaagagtagcttggccacccaccagaggactcacactggcgaaaagccctatgaatgccgcgattgtgagaaggccttctctcaaaaatcccagctgaatacccatcagcgcattcatacaggcgaaaaaccctacgagtgctccctgtgccgcaaggctttcttcgagaagtcagaattaatcagacacctgcgaacccacacgggtgaaaagccatacgaatgcaacgagtgcaggaaggccttcagagaaaaaagttcactgattaaccaccagcgaattcacacaggtgagaagcctttcgaatgttccgagtgcggtaaggctttttctcgaaagagccacctgattccacatcagagaacacacacaggcgaaaaaccctacggctgctcagagtgcaggaaggcattcagccagaagtctcagctcgtgaatcaccaacggatacatactggggagaagccatatagatgtattgaatgtggtaaggccttcagtcagaaaagtcagcttatcaatcaccagagaacacataccgtcaaaaagtcttag

SEQ ID NO: 22212 - DNA, 2217 bp, Artificial Sequence
  Description of Artificial Sequence: Synthetic coding sequence
atgaccatgctgcaggagagcttcagcttcgacgacctgagcgtggacttcactcagaaggaatggcagctcctcgatccttcacagaagaacctttataaagacgtcatgctggagaactattctagtctggtgtctctcggctacgaagttatgaagccagacgttatcttcaagttagagcagggggaggaaccctgggttggagatggtgagattccctcaagcgatagcccggaagtgtggaaggtcgatggaaacatgatgtggcatcaggataaccaagacaagcttaaaattatcaagaggggtcatgaatgcgacgctttcgggaaaaattttaacctcaatatgaactttgtcccactgcgcaaaagtaattctgagggcgatctggacggcctaattctgaaacatcatctggaccttctcatacccaaaggcgactacgggaaggctgaatcagatgacttcaatgtttttgataatttcttcctgcactctaagccagaagacaccgacacttggctgaagtactatgactgtgataaatataaagagagctataagaaatcccaaattataatctatcaccgcaatcggctgggtgagaaattgtacgagtgttccgagtgtagaaaaagattctcgaaaaaacctagcttgattaaacaccagagccgccacatacgggatatagcctttgggtgtgggaattgtgggaaaacctttccacaaaagagccagtttatcacccaccacaggacccatacaggtgagaagccctataattgcagtcagtgcggtaaggccttctcacagaagtcacagcttacctcacaccagcgcactcatactggcgaaaagccctacgagtgcggagagtgcggaaaagctttcagtcgtaaatcacacctcatctcgcattggagaactcatacaggcgagaagccctacgggtgtaacgaatgcgggcgcgcgttctcggagaagtcaaatcttatcaatcaccagcggattcacacaggcgagaagcctttcgagtgcagagagtgcgggaaggccttttctcggaaatctcagctcgtaacccatcaccgtactcatactggaactaagccatttgggtgcagtgactgcagaaaggcattttttgagaagagtgaactcatcaggcatcagaccattcatactggcgagaagccatacgaatgttccgagtgtagaaaggcttttagggaacgctcatccctcattaatcatcagaggacgcatacgggagaaaagccccatggctgtattcaatgtggcaaagctttctctcagaagagtcaccttataagccatcagatgacccacaccggcgaaaaaccgttcatctgcagcaagtgtggcaaagccttttcccggaagagtcagttggtacggcaccagcgcacacacactggggaaaagccctatgaatgtagcgaatgcggcaaggctttttcagagaagctttctttaactaatcatcagaggattcacaccggcgagaagccatatgtctgcagcgaatgtggcaaggctttctgccagaagtctcacctcatctctcaccagcggacccataccggggaaaagccatacgagtgttctgaatgcgggaaggcgtttggcgagaagtcttcgctggcaacacaccagcgcacccatacaggtgaaaagccctacgagtgcagggattgcgagaaagctttttcccaaaagtcccagctgaatacacatcaacgtattcacacaggagaaaaaccctacgaatgcagcttgtgccgcaaagctttctttgagaagagtgaattgattagacatctgaggactcataccggtgaaaagccatacgaatgtaacgagtgtcgtaaggcgtttagggagaaatctagtctcattaatcatcagaggattcacactggcgagaaaccattcgagtgcagcgaatgcggcaaggccttcagtcggaagtcccatctcatcccccatcagaggacccatacaggagaaaaaccttacggttgctcggaatgccgcaaagccttctcccagaagagccagctggttaatcatcagcgaatccacactggggagaagccgtatcgctgcattgagtgtgggaaggccttctctcagaagagccagctgattaaccaccaacgcacacatacagtcaagaagagctag

SEQ ID NO: 22213 - DNA, 210 bp, Artificial Sequence
  Description of Artificial Sequence: Synthetic coding sequence
atgaccatgctgcaggagagcttcagcttcgacgacctgagcgtggattttactcagaaggagtggcagctgctggacccgtcgcagaaaaacctttacaaggatgttatgttagagaattactctagtctcgtgagcctcggatatgaggtcatgaagccagatgttatttttaaactcgaacagggtgaagaaccctgggtgggctag

SEQ ID NO: 22214 - DNA, 2217 bp, Artificial Sequence
  Description of Artificial Sequence: Synthetic coding sequence
atgaccatgctgcaggagagcttcagcttcgacgacctgagcgtggattttacgcaaaaggaatggcagctgctggacccctcacagaaaaacctgtacaaagacgtcatgctagagaactatagctctcttgtttccctgggatacgaagtcatgaagccagatgttatttttaagctggagcaaggcgaagagccctgggtgggtgacggcgaaattccttccagcgactcccctgaggtgtggaaagtggatggcaacatgatgtggcatcaggataatcaggacaagttgaaaatcatcaagcgggggcacgaatgcgatgctttcggaaagaacttcaacttgaatatgaactttgtccctctgaggaaaagtaattcagagggcgacctcgacgggctgatccttaagcatcacctggatcttctcatcccaaagggagattacggaaaggctgaatcggatgacttcaatgtgttcgataatttctttctgcattcaaaaccagaggacacagatacttggttgaaatattacgattgcgataaatacaaagaatcatacaaaaagtctcagataatcatctatcacagaaaccgcctcggagagaagctgtacgaatgcagcgagtgtaggaaaagattttctaaaaaacctagcctaataaagcatcaaagcaggcacatccgtgatattgccttcggctgtggcaactgtggtaagaccttcccccagaagtcccagttcatcacccaccaccgcacgcatacaggcgagaagccatataactgttctcaatgtggtaaagccttcagtcaaaagagccagctcacctctcatcaacgcacccacactggcgagaaaccctacgagtgtggcgagtgcgggaaggcattttcccggaaatcccacttgattagtcattggagaactcacactggtgagaaaccatacggttgtaacgagtgcggcagggccttctccgaaaaaagtaaccttatcaaccaccagcgcatacatactggagaaaaaccctttgagtgtcgggagtgcggcaaagccttttctaggaagagccaactagtgacacatcacaggactcacactggaaccaagcccttcgggtgtagtgattgcagaaaagccttttttgagaagagtgaactgatacgtcaccagaccattcatactggcgaaaagccatacgagtgcagcgagtgtcgcaaagccttcagagaaaggagctcattaatcaaccaccagcgcacacacactggggaaaagcctcatggatgtatccagtgtggaaaagctttttcccaaaaatctcatctaattagtcaccaaatgacgcacactggagagaagccattcatatgtagcaagtgtggcaaggctttttctcgcaagtctcagttggtgaggcaccagaggacccatacaggcgaaaaaccttatgaatgttccgagtgtggcaaggcctttagcgaaaaactgtctctcacgaaccatcaaagaatacataccggagagaagccttacgtgtgtagcgaatgtggtaaggcgttctgccagaagtcccacctcatctcgcaccaacgcacacataccggcgagaagccatacgaatgttcggaatgcgggaaggcattcggagaaaagtcctcacttgctacacaccagaggacccacactggcgagaaaccgtacgaatgcagagactgcgagaaggcgttcagccagaaaagtcagctgaacacacaccagaggattcacaccggggagaagccttatgagtgctccctgtgtcggaaggcgttttttgaaaaaagcgagctcataaggcacttaagaacacatactggcgaaaaaccctatgaatgtaatgaatgtcgcaaggccttccgtgaaaagagtagtttgatcaatcatcaacggattcacactggcgagaaaccattcgagtgcagcgaatgtgggaaggctttttcccgaaaaagtcacctgatcccgcatcaacggacccacactggcgaaaagccttacggatgctcagaatgtaggaaggcgttcagccagaaaagtcagctggtcaaccaccagcggatccacacaggagagaagccctacagatgcatcgaatgtgggaaggcattcagtcaaaaaagtcaactgatcaaccaccaaaggacccatacagttaagaagtcctag

SEQ ID NO: 22215 - DNA, 168 bp, Artificial Sequence
  Description of Artificial Sequence: Synthetic coding sequence
atgaccatgctgcaggagagcttcagcttcgacgacctgagcgtggacttcacacaaaaggagtggcagctcctggatccttcacaaaagaatttgtacaaagatgtgatgctggagaactacagttcattggtgtctctggggtatgaggtgatgaaaccagactag

SEQ ID NO: 22216 - DNA, 2217 bp, Artificial Sequence
  Description of Artificial Sequence: Synthetic coding sequence
atgaccatgctgcaggagagcttcagcttcgacgacctgagcgtggattttacacagaaagagtggcagctcttggacccttcccagaaaaacctgtataaagacgtcatgttagagaactactccagcctggtctccctaggttacgaagtgatgaagccagatgtaatcttcaagctggaacagggcgaagaaccatgggtcggtgatggggagattccgtcttccgacagcccagaggtgtggaaggtcgatgggaatatgatgtggcatcaggataaccaggataaacttaagattatcaagcgcgggcatgagtgtgacgcttttggtaagaatttcaatctgaacatgaacttcgttccactgcgcaaaagcaactcagagggggacctcgacggcctgatcctcaagcaccatctggacctgctcatacctaagggtgattatggcaaggctgaaagtgatgatttcaacgtttttgataatttctttttgcactctaaaccagaagacacggacacatggctgaaatattacgactgcgacaagtataaggaatcatacaagaaatctcaaatcattatctatcacaggaacaggctaggagaaaaactttacgaatgctcagagtgtagaaaaaggttctccaaaaaaccctccctgatcaaacatcagagcagacatatccgggatattgctttcgggtgcgggaattgtggaaagacctttccgcagaaatcgcaatttattacacaccaccgtacgcataccggggagaaaccatataactgctcacagtgtggaaaggccttctcacagaaatcccagcttacctcacaccagcgcacacatactggggagaaaccatacgaatgtggggagtgcgggaaggcattcagccggaagtctcacctgatctctcactggcgtacacatacgggagagaagccatacggctgcaacgaatgcggccgcgccttcagcgaaaagtccaatttgataaaccaccagaggattcataccggggagaagccttttgaatgccgggaatgcggcaaagcattctctcgtaaaagccagctcgtgacacaccaccgtactcacactgggactaagccgtttgggtgttcagattgcagaaaggctttcttcgaaaagtcagaactgatcaggcatcagaccattcataccggcgagaagccatacgaatgcagcgaatgtagaaaagcctttagggagaggtcctctctgatcaatcaccagcggacgcatacaggcgaaaagcctcacggctgtattcaatgcggtaaggccttttcacagaagtcccacctgatttcccaccagatgacccacaccggcgagaagcctttcatctgtagcaagtgtgggaaagcattttccaggaagagccaactcgtacgtcaccaacgaacccataccggagaaaagccatacgaatgctccgagtgcggcaaggctttcagcgaaaaactttctctgaccaaccaccaacgtatccatactggagaaaaaccatatgtgtgttccgagtgtggcaaggccttttgtcaaaagtctcatttgatcagccaccagcgcactcatactggggaaaaaccatacgaatgctccgaatgcggtaaagcgttcggggaaaagtcttcgttggccacgcaccagaggacgcacacaggagaaaagccctatgagtgcagagactgtgagaaagcattttcccagaaatctcagctcaatacccaccagcgtatccacactggtgaaaagccctacgaatgctctctgtgccgcaaggcatttttcgaaaagtcagagctcattcggcatttgaggactcatacgggagagaagccctatgagtgcaatgagtgtcgcaaagcattcagagaaaaaagcagcctcataaatcaccaacgcatccatactggtgaaaagcccttcgaatgctcagagtgcggaaaagcattctctagaaagtctcatctcatccctcaccaaaggacgcatacgggcgagaagccctatggctgcagcgaatgccggaaggcattctcccagaagagccagctggtgaaccaccaacgaatccacactggggagaagccctatcgctgtatcgaatgtgggaaagcctttagccaaaagtcgcaattgataaaccaccagcgaacacacacagtaaagaagtcttag

SEQ ID NO: 22217 - DNA, 711 bp, Artificial Sequence
  Description of Artificial Sequence: Synthetic coding sequence
atgaccatgctgcaggagagcttcagcttcgacgacctgagcgtggactttacgcagaaggaatggcagttgttggacccgtctcaaaaaaacctgtataaagacgtgatgctggagaactacagctccttggtgagtttgggatatgaggtaatgaagcctgatgtgatctttaagttggagcagggcgaggaaccctgggtgggcgacggagagattccttcctctgacagtccagaggtttggaaggtggatgggaatatgatgtggcatcaggataaccaagacaagctaaaaatcataaaaaggggccacgagtgtgacgccttcggtaagaactttaatctgaacatgaacttcgtacccctgcgcaagagcaattccgaaggggatttggatggcctgattcttaagcatcatcttgatctcctcatacctaagggcgactacgggaaagccgagagcgacgactttaacgtttttgacaatttttttttgcatagcaagcctgaggataccgacacttggctgaagtactacgattgcgataaatataaagaatcttataagaagagccagatcattatttatcaccgcaataggctaggcgaaaagctgtatgaatgctctgagtgtcggaaaaggttttctaagaaacccagcctgataaagcatcagagcaggcatatccgtgacatagcatttggatag

SEQ ID NO: 22218 - DNA, 204 bp, Artificial Sequence
  Description of Artificial Sequence: Synthetic coding sequence
atgaccatgctgcaggagagcttcagcttcgacgacctgagcgtggacttcacacagaaggaatggcagttactcgatccatcccaaaaaaacctgtataaggacgttatgcttgaaaactattcttctctggtttcgctcggatacgaggtgatgaaacccgacgtgatatttaagctcgaacagggagaagagccttggtag

SEQ ID NO: 22219 - DNA, 237 bp, Artificial Sequence
  Description of Artificial Sequence: Synthetic coding sequence
atgaccatgctgcaggagagcttcagcttcgacgacctgagcgtggactttacacagaaggagtggcagctccttgacccaagccagaaaaatctgtacaaagatgtgatgctcgaaaattactctagtctcgttagcttagggtacgaggtcatgaagcctgacgtgatctttaagctggagcagggcgaagaaccttgggtgggcgacggtgagattccttctagtgatagctag

SEQ ID NO: 22220 - DNA, 2214 bp, Artificial Sequence
  Description of Artificial Sequence: Synthetic coding sequence
atgaccatgctgcaggagagcttcagcttcgacgacctgagcgtggactttacgcagaaagaatggcagctgttggatccttcacagaaaaatctctacaaggacgtgatgcttgagaattactcatcactggtgtcacttggatatgaagtgatgaagcccgacgtaatctttaaactggagcagggcgaagaaccatgggtgggagacggggaaattcccagctcagattcccctgtgtggaaagtagacggtaacatgatgtggcaccaagataatcaagacaagctcaagattatcaaaaggggacacgaatgcgacgctttcgggaagaacttcaaccttaatatgaactttgttcccctccgcaaatcgaacagcgaaggggatctggatgggctgatactgaagcaccatttggacctccttattcccaagggcgactacggtaaagccgagtctgacgacttcaacgtcttcgataactttttcctgcactccaaaccagaagatacagacacatggctgaaatactacgattgcgacaaatacaaagaatcctacaagaaaagccaaattattatctatcataggaatagattgggagagaaactctacgaatgtagcgagtgcaggaaaaggttcagcaagaagccatctctcatcaaacaccagagtagacacattcgggacattgcgtttggctgcggtaactgcggaaagaccttcccacagaaatcccaatttattacccaccatcggactcacacaggagagaagccatataactgtagtcagtgtggaaaagctttcagtcaaaaaagccagttgacgtcccaccagaggacccacacaggagagaagccttacgaatgtggcgaatgcgggaaggctttctcccggaaatcccatctcatatctcactggcgaactcacacaggagagaagccctacggctgtaacgagtgtggtcgagcgttttcagagaaatccaacctcatcaaccatcagcgcatccacacgggagagaaaccctttgagtgccgggagtgcggaaaggcttttagtaggaagagccaattggtaacccaccatagaactcatactggaactaaaccttttggttgctccgactgccgtaaagcctttttcgaaaagagtgagctgatccgacatcagaccattcacacgggagaaaaaccatacgagtgctcggaatgtcgtaaagccttcagggagcggtcctccttgatcaaccatcagagaacccacacaggcgagaagccacatgggtgtatccagtgtggtaaggctttttcccagaagagccacctaatctcccatcagatgacacatacaggggaaaaacccttcatttgctcaaaatgcggcaaggcctttagcaggaaatctcagctagttcggcaccaaaggacccatactggagaaaaaccgtacgaatgtagcgagtgtggaaaggccttcagtgagaagctgagcctgactaatcaccagaggatccacactggagagaagccctatgtatgctcagaatgtggaaaggccttttgtcagaagagtcacctcatcagccaccagcggacccatacaggagagaagccttacgaatgttctgagtgcggcaaagcctttggggagaaatcctcactggcaacgcaccagaggacacacactggagaaaagccatacgaatgccgcgactgtgagaaggcgtttagtcagaagagccaactaaatacacaccaaaggatacatacaggagagaagccttacgagtgtagcctgtgccgtaaggcgttcttcgagaaatcggagctaataaggcatttgagaactcacacaggcgagaagccatacgaatgtaatgaatgtcggaaagccttccgagaaaagtcaagtctgattaatcatcaacgcatccacacaggagagaaaccttttgagtgtagcgagtgcgggaaggcatttagtcggaagagccacttaataccgcaccagcggactcataccggcgaaaaaccgtatggatgctcagaatgccgaaaggccttttctcaaaagtcacagctggtaaatcatcaaaggattcacactggggagaagccatacaggtgcattgaatgtggtaaagcattcagccagaagtcacaacttatcaaccatcagcggacccataccgtgaagaagtcctag

SEQ ID NO: 22221 - DNA, 21 bp, Artificial Sequence
  Description of Artificial Sequence: Synthetic coding sequence
atgaccatgctgcaggtgtag

SEQ ID NO: 22222 - DNA, 1503 bp, Artificial Sequence
  Description of Artificial Sequence: Synthetic coding sequence
atgctggagggccacgagagctacgacaccgagaacttctacttcagagaaatacgcaaaaatttgcaggaggtggatttccagtggaaggacggagagattaactacaaagagggccccatgacccataagaataatttgactggccaacgggtccggcattcccagggcgatgttgaaaacaagcatatggaaaaccagctgatccttaggttccagtctggtctgggggaacttcagaaattccagaccgctgaaaagatttacgggtgtaatcagatagagaggactgtaaataactgttttctcgcctcgcccttgcagcgtatttttcctggggtccagacgaacatttctaggaagtacgggaatgactttctccagcttagtctgccaacacaggatgaaaaaactcacattcgtgagaagccttacatcggtaatgagtgtggcaaagccttccgcgtgagcagcagcctgatcaaccatcaaatgattcatacaacagagaaaccttatagatgtaacgaaagcggcaaggccttccatcgaggttctctgctcacggtgcaccagatagtgcacaccagagggaagccatatcagtgcgacgtttgtggacgaatctttaggcaaaactcggacctcgttaatcatcggcgaagccatacaggagacaagccatacatctgcaacgagtgtggaaaatctttctccaagagttcccacctcgctgtgcaccagcggatccatacgggagagaagccctacaagtgcaatcgttgcggtaagtgcttcagccagtcctcatctctggccactcaccagacagtacacacaggggataagccatacaagtgcaacgagtgcggcaaaacattcaagcgcaacagcagcctgacagcacaccacataattcatgccggaaagaagccctacacctgtgatgtgtgcggcaaagtcttctatcagaacagtcagctggtgcgccaccaaatcatccacactggagaaaccccatataaatgcaatgagtgcggcaaagtcttcaggtaccggtctgggcttgctagacactggtccattcacaccggagagaagccttataaatgcaatgagtgcggcaaggccttccgtgtgcggagtatactcctgaatcaccaaatgatgcataccggtgagaaaccctataagtgtaacgaatgcgggaaggcctttatcgaacggagtaacctcgtgtaccaccagcggaatcacacaggcgagaaaccctataagtgcatggagtgtggcaaggctttcggaaggcgatcctgtctcaccaaacaccagagaattcattcttctgagaaaccttataaatgcaacgagtgtgggaaatcctatatttctcggagcgggctgacgaaacaccagatcaagcacgctggcgagaacctaaccaccaagctgaacgttgagcgccctctggatgtagtgctcacttcaggaatccctaagtag

SEQ ID NO: 22223 - DNA, 2775 bp, Artificial Sequence
  Description of Artificial Sequence: Synthetic coding sequence
atggccctgccccagggcagcctgaccttccgggacgtggccgtggaattcagccaagaagagtggaagtgtctcgacccggtgcagaaagctttgtacagggacgttatgttggagaattatcgaaatctggggtttctggggctctgtctccctgacctgaatataattagtatgttggaacaagggaaagagccctggactgttgtttcccaggttaagattgctcggaatcctaattgcggcgagtgcatgaagggcgtgatcacagggatatcccccaagtgtgtcatcaaagaactgccacctattcagaacagtaatactggagagaagtttcaggcagtcatgctcgagggtcatgagtcttacgataccgagaatttctattttcgtgagatcagaaaaaacctacaggaggtggacttccagtggaaggacggtgagataaactataaggagggtcccatgacccataaaaacaaccttacgggacagagagtaagacactcccaaggtgatgtggagaacaagcacatggagaaccaactgatactacggtttcagtccgggctgggtgagctacagaaattccagaccgcagaaaagatttatggttgtaatcaaatcgaaagaaccgtgaataactgctttctggccagtcctctgcaacggatttttccgggcgttcagacaaacatttctcgcaaatacggcaatgatttcctccagttaagccttccaacacaggatgagaagacccacattagagagaagccgtacataggtaacgaatgcggaaaagcatttagggtgagctccagcctgatcaaccatcagatgatccacactactgaaaagccctatcgatgtaatgagagcggaaaggcttttcatagaggctctctcctcaccgtacatcagatcgtgcacacaagaggaaagccctatcagtgcgatgtgtgcggacgcatctttcgccagaacagcgatctggtgaaccatagacgctctcataccggcgacaaaccttatatttgcaatgagtgtggaaaaagctttagtaagtctagccatctggcagttcaccaaagaatacacactggcgaaaagccgtacaagtgtaacagatgcggtaagtgcttctcccaaagttcatctcttgcaacccaccagaccgtgcacacaggtgacaaaccctataaatgcaatgagtgtggtaagacattcaaacgaaattctagcctgacggcacaccacattattcatgccggcaagaagccatatacttgcgatgtgtgtggtaaggtcttttaccaaaacagtcagctcgtccggcaccagatcattcacactggcgaaaccccatacaagtgcaatgagtgtggtaaggtcttcttccagcgcagtcgtttagccggacatcgccgaatacacaccggggaaaagccgtacaaatgtaatgagtgcgggaaagtgttctcacaacactctcacttagccgttcatcagcgcgtgcacacaggcgaaaagccttataagtgcaacgagtgtggcaaagcctttaattggggctcactcctgactgttcaccagaggattcacactggggagaaaccctacaagtgtaacgtctgcgggaaagtgttcaattacggcggttacctgagcgtacatatgaggtgccataccggcgaaaaaccccttcattgtaataaatgtggcatggtctttacgtactactcctgtctggcaaggcaccagaggatgcatacaggagaaaagccatataaatgcaacgtatgcggtaaagttttcatcgattccgggaacctgtctatccaccgaaggagccacacaggcgaaaaaccgtttcagtgtaacgagtgtggtaaagtcttctcatactattcttgtcttgcgaggcatcggaagatccacactggagagaagccttataaatgcaacgattgcgggaaggcatatacccaacggtccagtttgactaagcacctggttatacacacaggggagaatccatatcactgtaacgagtttggagaggcctttatccagagctcgaagcttgcccgctatcacaggaatcccaccggcgagaaaccccacaagtgtagtgagtgtggccgaacattcagccacaaaacctctctagtctatcatcaaaggcggcacaccggagagatgccttacaagtgtatcgagtgcggcaaagtgtttaacagtacgaccactctcgcccggcacagacggatccacacaggggagaagccctataaatgtaatgagtgtggcaaagtgttccgctatcgatcaggactggcaagacactggagcatccataccggtgagaagccgtacaagtgcaacgaatgcggtaaggcatttcgcgtcaggagtattcttctcaatcatcagatgatgcatacaggtgaaaagccttataagtgtaatgagtgtggcaaagccttcatcgaaaggtccaatctagtctatcaccagaggaaccacaccggtgaaaagccatataagtgcatggagtgtggcaaggctttcggtcgaaggagttgcctgaccaagcatcagcgtatccatagttcagagaagccctataagtgcaatgagtgcggcaaatcatacatcagtcgcagcggtctgactaaacatcaaataaagcacgccggagaaaatcttactaccaaacttaacgttgagagacccttggacgtggtgctcacatctggaatacccaaatag

SEQ ID NO: 22224 - DNA, 2427 bp, Artificial Sequence
  Description of Artificial Sequence: Synthetic coding sequence
atgctggagggccacgagagctacgacaccgagaacttctacttccgtgaaataaggaagaacctccaggaagtcgactttcagtggaaagatggcgagatcaactacaaggaggggccaatgactcacaaaaacaacctgactgggcagcgggtgcggcattcacagggcgacgtggagaacaagcatatggagaaccagctgatccttagattccagagcggcctgggagaactgcagaaattccagacagctgaaaagatttacggttgtaatcaaattgaaagaacagtgaataattgctttcttgcaagtccacttcagaggatcttccctggagtccagacaaacatatccagaaagtacggaaacgatttccttcaattgtctctgcctacgcaagacgagaagacacatattcgggagaagccgtatatcggcaacgaatgcgggaaagccttccgtgtgtccagctctctgatcaaccaccagatgatccataccacagaaaaaccgtacaggtgtaatgagagcggcaaagcttttcacaggggctccttactcaccgtccaccagatcgtccacaccagggggaagccttaccagtgcgatgtgtgtggacggatcttccggcagaacagtgacttggtcaaccatcggcgtagccacaccggagataagccatacatttgtaacgagtgcgggaagagtttctcaaagtcctcacacttggccgtccatcaacgcattcacacaggagagaaaccatataaatgcaacagatgcggaaaatgctttagccagtcgtctagcctcgcaacacaccagacggtccacaccggcgataagccgtataaatgtaatgagtgcggtaaaactttcaagagaaactcgtcccttactgcacatcacattatccatgccggaaagaaaccctatacgtgtgatgtgtgcggcaaagtgttctatcagaacagtcagctggtcagacatcagatcattcacaccggcgagactccctacaagtgcaatgagtgcggaaaagtctttttccagcggagtcgcctggccgggcaccggaggatccatactggtgagaagccatataagtgcaatgagtgcggtaaagtcttctcacagcacagtcacctggctgtacaccaaagagtgcataccggggagaaaccctacaagtgcaacgagtgcgggaaagcgttcaattgggggtccctccttaccgtgcaccagcggatccacacaggagaaaaaccctacaagtgcaacgtctgcggtaaggtgtttaactacgggggctatctgagcgttcatatgaggtgccacacgggtgaaaaaccactgcattgtaataagtgtggcatggttttcacttattactcctgcctagctcgtcatcagcggatgcatactggggagaagccatacaagtgtaacgtgtgtggtaaggtcttcattgacagtggcaatctgagcatccataggcgcagccacaccggtgaaaaaccgtttcagtgcaacgagtgcgggaaggtattttcttattactcgtgtctggctcgtcaccggaagattcacacaggagaaaaaccttacaagtgcaacgattgtgggaaggcctatacacagcggtcctcccttacaaaacatctcgtgatccacacaggggagaacccctaccactgtaacgaattcggagaagcctttatccagagttcaaagttagccaggtaccaccggaacccaacaggggaaaagccacataaatgcagcgaatgcggccgcacgttctcacataaaactagcttggtgtatcaccagcggcgccatacaggagagatgccttataaatgtatcgaatgtggcaaagtattcaattcaactactaccctcgcaagacaccgccgcatccatactggagaaaagccctataagtgtaatgaatgcgggaaggtgtttcggtaccggtctggcctggctagacattggtcaatacataccggggagaaaccctataagtgtaacgagtgtggtaaggcctttcgtgttagatcaattttgctcaatcaccaaatgatgcacacaggtgagaagccctataaatgtaacgagtgcgggaaagcatttatcgaaagaagcaacctcgtttatcatcagcgtaaccatacaggggagaagccatacaagtgcatggaatgtggaaaagctttcggccgccgaagttgcctgactaagcaccagcgaatccactcttctgaaaaaccctacaaatgcaatgagtgcggcaaatcttacatctctaggtccggtttgactaagcatcaaattaaacacgcaggtgaaaacttaacgaccaagctgaacgtggaacgccctctagacgttgtcttgaccagcggaattcctaagtag

SEQ ID NO: 22225 - DNA, 2001 bp, Artificial Sequence
  Description of Artificial Sequence: Synthetic coding sequence
atggacctggtggccttcgaggacgtggccgtgaacttcacccaggaggaatggtccctcctggatccatctcaaaagaatctttatcgcgaggtcatgcaggagaccctgaggaatctggcaagcatcggcgaaaaatggaaggaccagaacattgaggatcagtacaaaaatccgcggaacaacttgcgatcgctgttgggcgagcgggttgacgaaaacactgaagagaaccattgcggagagacttcctcacagattcctgacgacaccctcaacaagaagacctctccgggggtgaaatcatgcgagtccagtgtgtgtggggaggtgtttgtcgggcacagctcacttaacaggcatattcgcgccgacacagctcacaagccatctgagtatcaggaatacggtcaggagccctacaaatgtcagcagcgcaaaaaggcctttagatgtcacccgtccttccagatgcaggaaaaggctcatacaggcgagaaattatacgactgtaaggagtgcggcaagactttcatcagccacagttcgattcagaggcatatgattatgcacaacggcgatgggacgtacaaatgtaaattttgcgggaaggcctgtccatgtctgtctatttatctcatacatgagagagtgcacacgggagagaaaccatataagtgtaagcagtgtgggaaagccttctcctatagcacatcactgcagattcacgaaagaactcataccggggagaagccctacgaatgtaaagaatgtggtaaggcatttgggtctcccaactctctctacgagcacaggcggacccacactggggagaaaccttacgagtgcaaacagtgtgggaaggctttcaggtggtttcactctttccagattcatgaaagaacccacagcgaagaaaaggcctacgaatgtacaaaatgcggaaaagcatttaagtgcccttcttacctctgccgtcacgaggtcacgcacagcggcaaaaaaccttgcgagtgcaagcaatgcggtaaagcattgtcgtacctcaacttccaacggcatatgaaaatgcataccaggatgaggccgtataagtgcaagacagttgaaaagcccttgatactccctgtgcgctttgaggacatgaaggagctgaccttagagcggaatttaatgaacgcaagtaccgtcgttaaaccctccatcgtgcccgtcccctttacaatcatgaaggggctgactctggagcgaaaccccatgaacgtgtcctctgtggtgaaaccatcctttttgccgctcccttttgacatcatgaaaggtctgaccctggagcggaacagaatgtcagtgagtaacgttggcaagccctctgacctgccacatacattcaagtgcatggaggggttgacactgaagcgcaacccgatgaatgtttcctcggtggtcaagcccagtttcttccctttaccatttgatatcatgaaggggctgaccctggaacgcaaccctatgagcgtcagcaatgttgggaaaccctctcacctgccccacacatttaagtgtatgaaaggcttaacattggaaagtaattgcatgaacctgaacaatgttaagaagcctctggatctctccgagacatttaagttcatgaagcgccacactttggagagaaatcccattcggaatatggagaaacattccacaatctctctcccgtttaagtacatgcagcagtgtactgaggaccggatgcccatgaatgttaaaagcgtcaccaaacacagctaccttcctcgctcctttgaatatatgcaggaacacaccctagagaggaatcctatgaatgtccgaaacgccgagaagagaagtattatttttcttctttgtgtgtatactaagggctgcactttggagagaaaccatatcaacgtgaggattgtcggaaaacattctgtgtgtctagtgccatttgttgatattaaaggtctgactttagagtag

SEQ ID NO: 22226 - DNA, 1035 bp, Artificial Sequence
  Description of Artificial Sequence: Synthetic coding sequence
atggacctggtggccttcgaggacgtggccgtgaacttcacccaggaggaatggtccctcttagacccatcgcagaagaacctgtaccgggaagtgatgcaggagaccctccgtaatctagcaagtattggagaaaaatggaaggaccagaatatcgaagaccagtacaagaaccctcgtaataatctaagaagcctactcggtgagcgtgtggacgagaatacggaggagaaccactgtggcgagacctcgtctcagattccggatgataccctcaataagaagacaagccctggtgtgaagtcttgcgagtccagtgtatgtggtgaagtttttgtggggcattcttccctgaaccgacacattagggcagacacatgccacccttcttttcagatgcaggagaaagctcacacaggggaaaaactctacgactgcaaggagtgtggcaaaacgtttatctcccacagtagcatacagaggcacatgatcatgcacaatggagatgggacgtataagtgcaagttttgtggaaaagcctgtccttgtttgtctatatacctgatccacgaacgcgttcataccggagagaagccttacaagtgtaaacagtgcgggaaagcgttctcttattctacaagtcttcagatccacgaacggacgcacactggagaaaaaccatacgagtgcaaagagtgcggaaaagcctttggctccccgaacagcctgtacgagcaccggcgcacccacacaggggaaaaaccctacgaatgcaagcaatgcggaaaggcctttaggtggttccactcttttcagatccatgagagaacacattccgaagaaaaggcttacgaatgtacgaaatgtggcaaggccttcaaatgtccttcttatctttgcagacacgaagtgacacattccggcaaaaaaccatgcgagtgtaagcaatgcggcaaagctctgagctacctgaacttccaacggcacgaaagaacccacaccggcgagaaaccctatgaatgtaagcattgttag

SEQ ID NO: 22227 - DNA, 1578 bp, Artificial Sequence
  Description of Artificial Sequence: Synthetic coding sequence
atggacctggtggccttcgaggacgtggccgtgaacttcacccaggaagaatggtctctgctggacccgtcgcagaagaatctttaccgagaggtcatgcaagagaccctaaggaacctagcgtcaataggagagaaatggaaggaccaaaatatcgaagaccaatataagaacccccgcaacaacctgcgaagcctgctcggggaacgggtggacgaaaacaccgaagaaaatcattgcggggaaacatcttcgcagatacccgacgacacactgaataaaaagacgtcccccggagtcaagtcatgtgagagctccgtctgcggcgaagtttttgtggggcacagttctctcaaccgacacatccgggcagacactgcccataaacccagtgagtatcaagagtatgggcaggagccgtacaagtgccaacaaaggaagaaggccttcagatgtcatccgtctttccagatgcaggaaaaggcccacactggcgaaaagctgtacgactgcaaggagtgcggtaaaactttcatctcccactcttccatccagaggcacatgataatgcataatggagatggcacctataagtgcaaattctgtgggaaggcctgcccatgtctcagcatctaccttatccacgagcgcgtccatacgggggaaaagccttacaagtgtaaacagtgtggaaaagccttttcctactccaccagcctccagatccatgagcgaacccatacgggcgaaaagccctatgagtgtaaagaatgcggaaaagcgtttggaagtcccaattccttgtacgagcaccggcgcacacatactggtgaaaagccgtatgaatgcaaacaatgtggaaaggcttttcgctggttccatagctttcagatccacgaaagaacgcattctgaagaaaaagcctatgagtgcacaaaatgcggaaaagctttcaaatgtccatcttacctgtgccgtcacgaagtgacacatagcgggaagaaaccgtgcgaatgcaagcagtgcggcaaagctctaagttatcttaactttcaaaggcatatgaagatgcacacccgtatgcggccgtacaagtgcaagaccgtagagaaaccactgatcctgccggtgcgctttgaggacatgaaggagcttacactggagaggaacctgatgaacgcttccactgtggttaaacctagtattgtacccgttccctttacaattatgaagggtctgacgctcgaaagaaaccctatgaatgtctctagtgtcgtcaaacctagttttcttcctctacccttcgacataatgaagggcctcactctagagagaaaccgcatgagtgttagcaacgtgggtaagccctcagatctaccacacaccttcaagtgcatggagggcctcactctaaaacggaaccctatgaatgtgtccagtgtcgtcaagccgagttttttccccctccccttcgatattatgaagggattgaccctggagcggaaccctatgagtgtgagcaacgtgggtaaaccttcacacttaccgcataccttcaagtgtatgaaaggtcagtag

SEQ ID NO: 22228 - DNA, 183 bp, Artificial Sequence
  Description of Artificial Sequence: Synthetic coding sequence
ctgagcctgccccagggcctgctgaccttccgggacgtggccatcgaattttcacaagaagagtggaaatgtctggaccccgcacagagaacactatatcgcgatgtaatgttagaaaattacagaaacctggtgtccctgggcagttcagctgtgtgcgacttggggtctccccaaccctag

SEQ ID NO: 22229 - DNA, 2661 bp, Artificial Sequence
  Description of Artificial Sequence: Synthetic coding sequence
atggccctgagccagggcctgctgaccttccgggacgtggccatcgaattcagccaggaggagtggaaatgtctcgacccagcacagaggaccctatacagggatgtgatgttagaaaactatagaaacctggtgtcactggacattagctcaaaatgcatgatgaaggaattctcctcgaccgcacagggcaacaccgaggtaatccataccggcacactccagagacacgaacgtcaccacatcggagacttctgtttccaagagatggaaaaggatatccacgatttcgagttccaatggaaagaggatgaaaggaatagccatgaagctcccatgactgaaatcaagcagcttactggatctacaaatagacacgatcagaggcacgccggcaacaagcccatcaaagaccagttgggctcgtccttccatagccatctgccagagcttcacatgtttcagaccgaaggaaaaattggcaaccaggtggagaagagcattaacagcgcttcattggtcagcacctcccagcgaatcagctgcaggcctaagactcacattagcaaaaactacggcaacaatttcctgaatagttccttgttgacgcagaaacaggaggtgcacatgagggagaagtcattccagtgcaacgagagtggcaaggcctttaattatagctcagtgctcaggaagcaccagatcatccacctcggcgccaagcagtataaatgtgacgtgtgcggcaaggtcttcaatcagaaacggtatctcgcgtgccataggcggtgtcacaccggaaaaaagccttataagtgtaatgattgcgggaaaaccttttcacaagaactgaccttgacttgccaccatcgactccataccggcgaaaagcactacaagtgtagtgaatgcgggaagaccttctcaaggaatagtgctctggtgattcacaaagcgattcacacaggggagaagtcttacaagtgtaatgagtgtggtaagaccttttcccagacatcatacttggtctaccatagacgattgcataccggcgagaaaccctacaaatgcgaggaatgtgacaaagccttctcgtttaagtcaaatctcgagagacatagaaaaatccatactggagagaagccctataaatgtaacgaatgttcccgtaccttttcgcgaaaatcgagtctgacacgacatcgacggcttcacaccggtgagaagccttataagtgcaacgactgcggcaagactttttctcagatgtccagcctagtatatcatagaagacttcataccggcgaaaaaccctataagtgtgaagaatgtgatgaggcattctcgttcaagtccaacttggaacggcatcggcgcattcacactggtgaaaaaccgtacaagtgcaacgattgtggtaaaacattttcccagaccagtagcctcgtctatcatcggcgtctccacaccggggagaagccctataaatgcgaggagtgtgacgaggccttcagcttcaaaagtaacctcgaacggcaccgaattatccacaccggggaaaagctgtacaagtgtaacgaatgtggcaaaactttttccaggaaaagttccctcactcggcactgtcgcctgcacaccggcgagaagccctatcagtgcaacgagtgcggcaaagctttccgtgggcagtccgctctgatataccaccaggccatccatggcatcggtaaactatataagtgtaacgattgtcaccaggtgtttagtaatgccacaacaattgctaatcattggcgcatacacaacgaagagaggtcctataagtgcaatagatgcggcaagtttttccgacatcggtcatatctggcggtgcactggagaactcattcaggagaaaaaccatataagtgtgaagaatgcgatgaagccttttcgtttaagtctaacctgcagaggcataggcggatccacacaggcgagaagccttacaaatgtgaggaatgcgacaaagtgttcagccggaagtcgtctctggaaaagcaccgccggatccacacaggcgagaagccttataagtgtaaggtctgtgacaaggcgtttggtcgggatagccacttggcgcaacacacccgaattcacacaggcgagaaaccatacaagtgcaatgagtgtgggaaaaacttccggcacaactctgctttggtgattcataaggccatccactccggcgagaaaccctataaatgcaacgaatgtgggaaaactttcaggcacaactcagccttggagatccataaagccatccatacgggcgaaaaaccctacaaatgttccgaatgtgggaaggtcttcaaccgcaaggctaacctatccaggcatcatcgtttgcacactggagaaaagccatataagtgcaataaatgcggcaaggtgttcaaccaacaagcacacctggcatgtcatcacagaatccacaccggagaaaagccttataagtgcaacgagtgtggtaagacctttagacataactcagtcttggtgattcataaaacaatccatacaggtgaaaagccttacaagtgcaatgagtgcggaaaagtttttaaccgaaaggcaaaactagcgcgtcaccatcgcatccatacagggaagaagcactag

SEQ ID NO: 22230 - DNA, 2913 bp, Artificial Sequence
  Description of Artificial Sequence: Synthetic coding sequence
atggccctgagccagggcctgctgaccttccgggacgtggccatcgagttcagtcaagaggaatggaaatgtctcgatccagctcagaggacgctgtacagggatgtgatgctcgagaactaccggaatcttgtttctctggatatcagcagcaaatgcatgatgaaagaatttagcagcacggcccagggcaacaccgaggtgattcataccgggaccttacagagacacgaacggcatcacattggcgacttttgcttccaagagatggagaaagacattcacgacttcgagttccagtggaaggaggatgagaggaacagtcatgaggccccaatgaccgagatcaagcagctgacgggaagtaccaaccgtcatgaccagcgccacgccgggaacaagccgattaaggaccagctggggtcaagcttccacagtcacctccctgaactacacatgtttcagaccgaggggaaaatcggcaatcaggtcgagaagtcaattaatagtgcttccctggtgtccacatcacagcggatatcctgtcgtcccaaaacccatatcagcaagaattacggcaacaatttcctgaatagttccttgttaacacagaaacaggaggtgcacatgagagagaagagcttccaatgtaacgaatccggcaaagccttcaattactcctctgtcctgaggaagcaccagattatacatttgggcgctaagcagtacaagtgcgacgtctgtggcaaggtttttaaccaaaagcgctacttggcctgccacagacggtgccacaccggcaaaaagccatacaagtgtaacgactgtggcaagacgttcagccaggaactcacactgacatgtcaccatagattgcacaccggtgagaagcactataagtgttccgaatgtggaaagactttcagcaggaacagtgccctggtgatccacaaggccatccacacaggagagaagtcctacaaatgcaacgaatgtggaaagacattctcacagacaagttacctggtataccaccgccgtcttcacactggtgaaaagccctacaagtgcgaagagtgtgacaaagctttctcgtttaagagcaacttggaacggcaccgcaaaatccacacgggagagaagccttataaatgcaatgaatgcagccgcacgttctctaggaagagcagcctcacgcggcaccgacggctgcacactggagaaaaaccctacaaatgtaacgattgtgggaaaaccttctcgcagatgtcttccctggtttaccaccgtaggctccatactggggaaaagccttacaagtgtgaggagtgtgacgaggctttctcttttaagagtaatttagaaaggcacaggagaattcacacaggcgagaaaccatacaagtgtaacgattgtggcaagaccttttctcagaccagcagcctggtgtaccatcgcagactgcatacaggagaaaaaccctataaatgtgaggaatgcgacgaggccttctcctttaagtccaacctagagaggcatcgtattattcacacgggcgagaagctttacaaatgtaacgagtgcgggaaaactttcagcagaaaatcctcgctgacgaggcattgccgcctgcataccggtgaaaagccttatcagtgtaacgagtgtggcaaagcatttagaggccaatcagccctaatatatcaccaggctattcacgggatcggcaagttatataaatgtaatgattgccaccaggtattctcaaatgctactacgattgctaaccactggaggatccacaatgaagagcgatcctacaaatgcaaccgctgcggcaaattcttcaggcaccggtcttacttggctgtgcactggagaacccatagcggagaaaaaccttacaagtgcgaggagtgtgacgaggctttcagttttaagagcaatctccagaggcaccgaaggatccacacaggcgaaaaaccctacagatgcaatgaatgcgggaagacattcagtcggaagtcttatctcacctgccatcgtcgcttacacacaggcgaaaaaccctataagtgtaatgagtgcggaaagacttttggacggaattctgcactgatcatacacaaggccatccacaccggcgagaagccatataaatgcaacgagtgtggcaaagccttctcacagaaatccagtttaacgtgccatctaagactccacacgggagagaaaccttataaatgtgaggagtgtgacaaggtgttcagtcgcaaatcaagcctggagaaacatagacggattcataccggagagaagccctataagtgcaaggtgtgtgataaggcctttggaagagattctcacctggcccaacatactcggatacacactggagaaaaaccctacaagtgcaatgagtgcggcaaaaacttcaggcacaactccgcgcttgtcatccataaggccatccattccggcgagaaaccctacaaatgcaacgagtgtggtaaaacatttcggcacaactcagcattagagattcacaaggccatccacactggcgagaagccctacaaatgttcggagtgtggcaaagtatttaatcggaaggccaacctgagtagacaccatcggctccacacaggggaaaaaccttataagtgtaataagtgcggcaaggtctttaatcagcaggcacacctggcctgtcatcatcggattcacaccggcgagaaaccttacaagtgtaacgaatgcggtaaaacgttccgccataattcagtcctcgtcatacacaaaactattcataccggcgaaaaaccttataagtgtaacgagtgcggtaaagtatttaaccgtaaggccaagctcgcccgtcaccaccggatccacacagggaaaaaacattag

SEQ ID NO: 22231 - DNA, 1602 bp, Artificial Sequence
  Description of Artificial Sequence: Synthetic coding sequence
atggacagcagccagcacctggtgaccttcgaggacgtggccgtggattttacccaggaagaatggaccctgctggatcaggcgcagagggacctctaccgggacgttatgttagagaactataaaaacctcatcatcctcgccggcagtgaacttttcaagagaagcctgatgtctggacttgagcagatggaggagctgcgaactggggtgacgggagttcttcaggaattggacctccagctcaagacaaaggggtcacctctgcttcaggatataagtgcagaaaggtcccctaatggcgtgcagctcgagcgctcgaataccgccgagaagctgtatgactccaatcattctgggaaggtcttcaacgaacaccctttcctgatgactcatatgataacccatattggcgagaaaaccagcgaagacaaccagtcagggaaggctctccgaaaaaatttcccccacagtttctacaagaagagccacgccgagggcaagatgcctaaatgcgtaaagcatgagaaggccttcaaccagtttcccaaccttacgagacagaacaaaacacatacacaggagaaactctgcgagtgtaaggactgttggcgcacgttccttaaccaatcgtcgctgaaactgcatatccgcagccacaacggagataagcattacgtttgtaaggagtgcggcaaagccttcagtaattcctctcatctgataggccatgggcgcatacacagtggtgagaaaccttacgtttgcaaagagtgtggcaaagcattcacgcaaagtaccgggttgaaactgcatatcagaacacattcaggggaaaaaccctacaagtgtaaggaatgtggaaaagcttttactcactccagttacctaactgaccacacgcgcattcattctggtaagaaaccatatgtctgtatggagtgcgggaaagcctttacgagatcaaccggactaatactgcacatgcggattcatacgggagagaagccatacgagtgcaaggagtgcggtaaggcatttattcacagcagctacttgactaaacacgtccggatccattccggggagaagctgtacctatgtaaagcttgtggcaaggctttcactagatctagtggcctggtgctgcacatgcggacccacaccggggagaagccctatgagtgcaaggagtgcggaaaagcttttaataactccagcatgctgagccagcatgtgaggatccacacgggcgaaaagccttacgagtgtaaggaatgtgggaaggccttcacccagtctagcgggctttccactcacctgcgcacacacacaggcgaaaaggcttgtgagtgcaaggagtgtgggaaggcctttgcgcggagcacaaaccttaacatgcacatgcgcactcacacaggggagaagccttacgcttgcaaagagtgcggaaaggccttccggtattcgacctatctcaatgtgcatacgaggactcataccggggcgaagccatatgaatgcaaaaaatgtggaaaaaattttacccagagtagtgcgctggctaagcatcttcggacaaaggcctgtgaaaagacctag

SEQ ID NO: 22232 - DNA, 1899 bp, Artificial Sequence
  Description of Artificial Sequence: Synthetic coding sequence
atgctgcgggaggaggccgcccagaagcggaaggagaaggagcccggaatggccttgccccagggacacctgacattcagagatgtggccatagaattcagcctcgaggaatggaaatgcctggatccgacccagcgtgctttgtatcgcgccatgatgctggagaattatcggaaccttcacagcgtggacatcagctctaaatgtatgatgaaaaagttcagttccaccgcccaagggaacaccgaagtcgacacgggcacccttgagcggcatgaatcccaccacattggcgatttctgttttcagaagattggcaaggatattcacgacttcgagtttcagtggcaggaggataagcgcaacagccacgaggccaccatgacccaaattaaaaagctaaccggctcaacagaccggtatgaccggagacaccccggtaataagcccatcaaggatcagttggggctgtctttccattctcacttgcccgagttgcatatcttccaaacgaagggcaaggtcggaaaccaggtggagaaatcaatcaacgatgccagctctgtcctaacctcacagagaatttcctctcgtccaaaaatacacattagcaataactatgagaataacttcttccatagctctctattgaccctgaagcaagaggtccacatcagggagaaaagcttccagtgtaatgagagcggtaaggcatttaactgttcaagcttgttgaggaaacaccagattatatacctcggcggaaaacagtacaagtgcgatgtgtgtggaaaagtttttaatcaaaaacggtatctcgcatgccaccaccgctgtcacactggagagaaaccctacaaatgcaatgagtgcggcaaagttttcaaccagcagtccaacttggcatctcatcatcgcttgcatacaggcgagaagccctataaatgcgaagaatgcgacaaggtattcagccgcaaatccaacctcgagcgccaccgaagaatacataccggtgagaagccttataagtgtaaagtgtgcgagaaagccttcagacgagactctcatttgacacaacacactcggatccacaccggcgaaaaaccatacaagtgcaacgagtgtggtaaggccttcagcggtcagagtaccttgattcatcatcaggcaatacatggtattggtaaactctataagtgcaatgattgtcacaaagtttttagcaatgccaccactatagccaaccattggcggatacataatgaggaaagaagctataaatgtaataaatgcggcaagtttttccggagacgttcctatctcgttgtgcactggcgtacccatacaggcgaaaagccctacaaatgtaatgagtgcggaaaaacatttcatcacaatagcgccctggtgattcataaagccatacacaccggagaaaaaccctacaagtgcaatgaatgtggtaagacctttaggcacaattccgcacttgttatacataaagccatccataccggcgagaagccttacaagtgtaatgaatgtgggaaggtgtttaatcagcaggcaactcttgcaagacaccatcgtcttcatacaggcgaaaaaccatacaaatgcgaagaatgcgacacggtgttctccagaaaatcccaccatgagacccataagagaattcacacaggggaaaaaccctacaaatgcgatgactttgatgaggcttttagtcaagcctccagctacgccaaacagaggcgaatccacatgggtgagaagcaccataagtgtgacgactgcgggaaagcctttactagtcactcgcatcgtattcgacatcagcgtattcatactggccagaagagctacaagtgccacaaacggggcaaagtttttagttag

SEQ ID NO: 22233 - DNA, 1122 bp, Artificial Sequence
  Description of Artificial Sequence: Synthetic coding sequence
atgagcctgcggcggcacatcggcaaccccgagtacctgatgaagcggatcccccagaatccccgctaccaacacatcaaatctaggttggatactggaaacagcatgaccaaatacactgagaaactggaggagatcaagaaaaattatcgctataagaaggatgagctttttaagagattaaaggtgaccacctttgcacagctgatcatccaggtggccagtttaagcgatcagactcttgaagtaaccgcagaggaaatccagcgcctggaggataatgacagcgccgctagcgatccagatgccgagacgaccgctagaactaatgggaagggaaaccccggtgaacaatcaccatctcctgaacagttcatcaataacgcgggagctggggacagctcaaggagcacactccagtcagtcatttctggggtcggcgaattagacctggacaagggtcccgtgaagaaagctgagcctcataccaaggacaagccataccccgactgccctttcctgcttctggatgttagggatcgcgactcctatcagcaatgccacattgtcggcgcttatagctaccctatcgcaaccctctcaagaaccatgaacccgtacagcaacgatattctggagtataagaatgcccacggcaaaatcatcattctctacgacgatgacgagcggctggcgagccaagctgcaacaactatgtgcgagagaggtttcgaaaacttatttatgctgtctggggggctgaaggtcctggcccaaaagtttcctgaaggactcatcactggatccctgccggcgtcctgtcagcaggcgcttcctccaggctcagccaggaagcggtcttcacccaagggccctccgcttcccgccgaaaacaagtggagattcactcccgaagacctgaaaaaaattgaatactatctggaagaggagcaggggcccgccgatcacccaagcaggttaaatcaggcaaactcttcgggccgggaaagcaaagtacccggggctcgaagcgcccagaatctgccgggcggcggcccagcctcccactccaatccaagatcgctgagttctggccatcttcagggtaagccgtggaaatag

SEQ ID NO: 22234 - DNA, 1692 bp, Artificial Sequence
  Description of Artificial Sequence: Synthetic coding sequence
atggcccggcggctgctgcccgcccacgtgcaggagagcgtgacctttcgcgatgtggctgtcttcttttctcaagacgagtggctgcacctggatagtgcccagagagccctgtaccgggaagtgatgttagaaaactattctatactcgtgagccttggtatcctgtttagtaagcccaaggtaattagccagctggaacaaggcgaggacccatggatggttgaaagtggggtccctcagggggctcatctggggtgggaaagcctgtttggcaccattgtcagtaaagaggaaaaccaggaagtcatgaagaagctgataatcgatgggaccttcgatttcaagctcgagaaaacctatattaacgaggataagctggaaaaacagcagggcaagaagaatagactctttagcaaggtcctggttacaatcaaaaaagtgtatatgaaagaaagaagctttaaaggggtagagttcgggaagaacctcgggctcaagtcgagcctgatcaggaagccccgcattgtgagccgcgggaggcgcccccgctctcaacagtatagcgtgctgtttaagcagcttggagtcaataccgtgcgaaagtgctacaaatgcaacatatgtgggaagatttttcttcattcctccagcttaagcaagcaccagaggattcacactggcgagaaattgtataagtgcaaggagtgccgcaaagctttttctcagtcttcctcactgacccagcatctgcgggtacacacaggggaaaagccatacatctgtagcgagtgtggaaaagcatttagctttacgactagcttaatcgggcatcaaaggatgcacaccggtgaacgaccatacaaatgtaaggagtgcggaaaaacttttaagggttcctcaagcctaaacaatcatcaacgaatccacaccggcgaaaaaccatataagtgcaacgaatgcgggagagcctttagtcagtgttccagcctgattcagcatcaccggattcataccggggaaaagccatatgagtgtacacagtgtggaaaggcattcacgagcatatcgaggctcagccggcatcacaggatccacacgggtgaaaaaccgtttcattgcaatgaatgtggtaaggtgttttcataccattcggccctgatcattcaccagaggatccatacaggcgaaaaaccgtatgcctgcaaggaatgcggcaaggcattttcccagagctctgctttgatccagcaccaacgaatccatactggggaaaaaccatacaagtgcaacgagtgtggcaaagcattctcttggatcagcaggcttaatatccatcatagaatccatacaggagaaaagccgtataactgcaaggaatgcggcaaagcctttagctcacactccggcgtgaatacccatcgaaagattcatacaggcgaaaagccctataagtgtaacgactgtgaaaaggcattcaaccagtcatcagcgctgattcagcaccagagaatccatactggagagaagccgtataattgcaaagtatgtggcaaggctttccgccagtcatcttcccttatgacccacatgagaatccatactggagagaagccatataagtgcaaagagtgtggcaaggccttcagccagtcctcctcactgacgaaccaccagcgtacacataactag

SEQ ID NO: 22235 - DNA, 126 bp, Artificial Sequence
  Description of Artificial Sequence: Synthetic coding sequence
atggcccggcggctgctgcccgcccacgtgcaggagagcgtgacctttcgggacgtagccgtgttcttttcgcaggacgagtggttgcatctggattccgcccagagagcactttatcgagaatag

SEQ ID NO: 22236 - DNA, 405 bp, Artificial Sequence
  Description of Artificial Sequence: Synthetic coding sequence
atggcccggcggctgctgcccgcccacgtgcaggagagcgtgacctttagggatgtcgcagtcttcttttcccaggatgaatggttgcacctcgattctgctcagagggccctctacagagaagtgatgctggagaattactcaatactggtgtctcttggtattctgtttagtaagcccaaagtcatcagtcagttggaacaaggggaagacccatggatggttgagtcaggtgtgccacaaggcgcacacctggggtgggagtcactgttcgggacaatagtctcaaaagaagaaaaccaagaagtcatgaagaagctgattatcgacggtacctttgatttcaaacttgagaagacgtatataaacgaggacaagctggagaaacagcaggggaagaagtag

SEQ ID NO: 22237 - DNA, 1713 bp, Artificial Sequence
  Description of Artificial Sequence: Synthetic coding sequence
atgcccggcgagaccgaggagccccggccccccgagcagcaggaccaggaggggggtgaagccgcaaaagccgctccagaggaaccacagcagagaccgcctgaagcagtcgcagccgctccggcaggcacgacgagtagccgcgtgctccgcggagggagagatcgaggacgcgcagccgcagctgcagccgctgctgctgtgtctaggaggaggaaagctgagtacccccgaaggagacggtcaagcccaagcgcaagacctcctgatgtgcctggtcagcagccgcaggccgccaaaagtccctcacctgtccaaggcaagaaatcacctcgactcctgtgtattgaaaaggtcacaacggacaaggaccctaaggaggagaaggaggaagaggatgattcagcgcttccccaggaggtcagtatcgccgcttcacgcccatccagaggctggcgctcatcccggaccagtgtaagtcgccatagagacacggagaatactaggtcctcccggtcaaagactggctccctgcagttgatttgcaaaagcgaacccaataccgaccagcttgattacgatgtcggcgaggagcatcagagccccggcgggatttcttccgaagaggaggaagaggaagaggaggaaatgctgatcagcgaggaggagatccccttcaaagatgacccaagggatgaaacatataagccccatctcgaacgagagactcctaaaccccgccgcaagtcgggcaaggtgaaagaggagaaggaaaaaaaggagatcaaggtggaggtggaagtagaggtgaaagaggaagaaaacgaaatccgtgaggatgaagagcctccaaggaagcgggggcgacggcgcaaggacgacaagtcaccacggctacctaagagacgaaagaagccacctattcagtatgtgcgatgtgagatggagggctgtggtaccgtcctggctcatccaaggtacctgcagcaccacattaagtatcagcatcttcttaaaaaaaagtatgtgtgtcctcaccctagttgtggccggttatttaggctgcaaaagcaactgttgagacacgcaaaacaccacacggatcagagggattacatttgtgagtattgcgccagagccttcaagtcctcccataacttagccgtccaccggatgatacacaccggagaaaagccgctccagtgcgaaatttgcgggtttacatgccgtcagaaggcatctttaaactggcatatgaaaaaacacgacgcagacagcttctatcagttttcatgtaatatttgcggcaaaaagttcgaaaagaaagatagtgtcgtcgctcacaaagctaagagtcatccggaggtgctcatcgctgaggccctcgccgccaacgccggagcgctcataacatcaaccgatatccttgggacaaacccagaatccctgacacagccaagcgatggccagggactcccattacttcctgaacccctggggaattccacgtccggtgaatgccttctgctggaggcggagggcatgagcaagagctattgtagcgggacggagagggtgtcactgatggccgacgggaagatatttgtggggagcggatcttccggtggaacagaaggcctcgtgatgaatagcgatatcttgggtgccacgaccgaggtcctgattgaggacagtgattctgctgggccttag

SEQ ID NO: 22238 - DNA, 1590 bp, Artificial Sequence
  Description of Artificial Sequence: Synthetic coding sequence
atgcccggcgagaccgaggagccccggccccccgagcagcaggaccaagaagggggtgaagccgcaaaagcagccccggaggaaccgcagcagcggcctcctgaagccgttgctgctgcccccgccggaacgacctccagccgtgtacttcgtgggggacgggaccgcggtcgagcggcagctgcagccgctgctgcggccgtgtcgaggcgacggaaagccgaataccctaggcgtcggagatcatctcccagtgctcggccaccggacgtgcccgggcagcagccccaggcagccaagagcccatcacctgtacagggtaagaagtcccctagactgctgtgtatagaaaaggtgacgaccgacaaagatcctaaagaggagaaggaggaggaagacgacagtgcactcccacaggaagttagcatcgcagcatcaagaccctctcgtggttggcggtccagccgaacgagcgtgtcccgacaccgcgacaccgaaaacaccagatcatctcggtccaaaaccggctcgctgcaactaatctgcaagagtgagcccaatacggaccagctggactacgacgtgggcgaagaacaccagagccctggaggcatatcttcggaggaggaggaggaggaagaggaagagatgctcatttcagaagaagaaataccattcaaagatgacccgagagacgagacctataagcctcatcttgaaagggagactcctaaaccccggagaaaaagtggaaaggttaaggaagagaaagaaaaaaaggagatcaaggtggaggtcgaagtcgaagtgaaagaagaggagaacgagatccgggaggatgaggagcctccaaggaaaagaggccgacgccggaaggatgataagagtcccaggctgccgaagcgccgcaaaaagccccctattcagtatgtaaggtgcgagatggaggggtgcggcacggtgcttgcacacccacggtacctgcagcaccatatcaagtatcagcacctcctcaagaagaaatatgtgtgtccccatccctcttgcgggaggctatttagactccagaaacaattacttcgccacgcgaaacaccacaccgaccaacgtgattatatctgcgagtattgtgccagggccttcaaatctagccataacctggcagtgcacaggatgatccacaccggggagaagcccctgcagtgtgaaatctgcggcttcacgtgccgtcaaaaagcctctctcaactggcatatgaagaaacacgacgccgatagcttctatcagtttagctgtaatatttgtggaaagaaattcgaaaaaaaagatagcgtggtggcccataaggctaaaagccaccccgaggtccttattgcggaagcccttgctgcaaatgccggagcattaattacttctacagacatcctcggcaccaatcctgaaagcctgacgcagccttccgacggacaggggctccctttattacctgagcccttggggaactcaacctcaggagagtgtctgctcttggaagccgagggcatgagcaaatcctactgcagtgggacagagagagcaagacacagatag

SEQ ID NO: 22239 - DNA, 1464 bp, Artificial Sequence
  Description of Artificial Sequence: Synthetic coding sequence
atggccgccgccgccctgcgggcccccacccaggtgaccgtgagcccagaaactcacatggatttgacgaagggctgcgtcacatttgaagatatcgccatctacttttcacaagacgagtggggtcttctcgatgaagcacagcgtttactgtacttggaagtcatgctcgaaaactttgccctggtcgcgtcattagggtgtgggcacgggacggaagatgaggagacaccttccgatcagaatgtatctgtgggagtgtcccaaagtaaagccgggagctctactcagaaaacacaatcctgtgagatgtgcgtgcctgtgctgaaggacattctgcatttggcagatcttcctgggcagaaaccttatctggtaggggaatgcaccaatcatcaccagcatcagaagcatcactcagccaagaagtccctgaagagagatatggatcgagcctcctacgtgaagtgttgcctgttttgcatgtctctgaaaccttttaggaagtgggaggtggggaaggacctgccagcgatgcttcgactcctgaggtctctggtgtttccgggtggcaagaaacccggaacaatcacagaatgtggggaagacattaggagtcagaaaagtcactataaatctggtgaatgcggtaaggcgtctagacacaaacatacccccgtataccacccacgggtatacactggaaagaagctgtatgaatgctcgaagtgtgggaaggcctttcgcgggaagtactcgctggttcaacatcagagagttcacacaggtgagagaccctgggagtgtaacgaatgtgggaagtttttctcccaaacctcccacctgaacgaccatagacgaatccacacaggagagcgcccttatgaatgctctgaatgtggcaagttatttagacagaacagctcactggtggatcaccagaagatccacacaggcgcacggccctacgagtgtagccagtgtgggaagagcttcagccagaaggccacgctggtcaaacaccagagggtgcacacaggagaacgcccatacaaatgcggcgagtgcggcaactccttttctcagtccgcaattctgaatcagcaccgccggatccataccggagccaagccctacgagtgtggccaatgtggcaagagcttcagtcagaaggcaaccctaattaagcatcagagagtgcatacaggggagagaccttataaatgcggtgactgcggtaagtccttttcacaaagctccatcctgatccagcaccgccggatccacacaggcgctcgcccctacgagtgcggacagtgtggcaaatctttctctcagaaatccggactcattcagcatcaggtggtccacactggggagagaccgtacgagtgtaataagtgtggaaactcgttttcacagtgcagcagccttatccatcatcagaaatgtcacaacacttag

SEQ ID NO: 22240 - DNA, 1317 bp, Artificial Sequence
  Description of Artificial Sequence: Synthetic coding sequence
atggacctgaccaagggctgcgtgaccttcgaggacatcgccatctacttctcgcaggatgagtggggtctgctcgacgaggcacagagactgctttatctggaggtgatgctggaaaatttcgcgttggtcgcctccttaggatgtggacatggcactgaggacgaggagactccaagcgaccagaatgtaagcgttggcgtttctcaatccaaagccggttcttccacacagaaaactcagagttgtgagatgtgcgttcctgtgttgaaagacattttacacctagccgaccttcccgggcagaagccgtatctggttggcgagtgcaccaaccaccatcagcaccagaagcaccacagtgcaaagaagtctttgaaacgcgatatggaccgggccagctacgtgaaatgctgcctgttttgtatgtctctgaagccatttcggaaatgggaagttgggaaagatctgcctgccatgctccgacttttgcgctcactcgtgttccctggcggtaaaaaaccgggaaccattaccgaatgtggggaagacatacggtctcaaaagtcccactacaagagcggtgagtgcggtaaagcttctaggcataaacatactccagtgtatcacccgagggtgtatacaggcaaaaagttgtacgagtgctccaaatgcggaaaggcttttcgcggcaaatatagcctggtgcagcatcagagagttcatactggagagaggccttgggaatgcaatgaatgtggcaaattttttagccagacatcgcacctcaacgaccatagaagaatccacaccggtgagagaccctatgaatgcagtcaatgcggcaagagcttctctcaaaaggccaccctggtgaagcatcagcgagtacatacaggcgagcgcccttacaagtgtggtgagtgcggcaattccttctctcagagcgccatcctaaaccaacaccgcagaatccataccggagccaaaccctatgaatgtggccaatgtgggaagagcttcagccaaaaagccactttaattaagcatcaaagagtacacaccggcgaacggccctacaaatgtggcgattgcgggaagagcttctctcagagttccatactcattcaacaccgacggatccacacaggggctcggccctacgaatgcggtcagtgcggcaagtcattttctcagaaatccggactcatccagcaccaggtcgtccataccggtgagaggccatatgagtgtaacaaatgcggtaactccttttcacagtgttcctccttgatccaccaccaaaagtgccattag

SEQ ID NO: 22241 - DNA, 1425 bp, Artificial Sequence
  Description of Artificial Sequence: Synthetic coding sequence
atggccgccgccgccctgcgggcccccacccagggctgcgtgaccttcgaagacattgctatctatttctctcaagacgagtggggcctgctcgacgaggcccaaaggctgctctacctggaagtgatgctggagaatttcgccttggtcgcctctctcggctgcggccacggcacagaggacgaggaaacaccatccgatcagaacgtgtcagtgggggtttcccagtcgaaggcagggagctctacacagaaaacccaatcttgcgaaatgtgtgtgccagttctaaaagatatattgcacttggctgacttacccgggcagaagccgtacctggtgggcgaatgtacaaatcaccaccagcaccagaaacaccattcagccaagaagtccttaaagagggatatggacagggcctcctacgtgaagtgttgtctcttttgcatgtcacttaagccttttagaaagtgggaggtgggaaaagacctgcccgccatgctgaggttgctaagatctttggtttttcccggcggaaagaagcccggcacaataaccgagtgcggtgaggatatccgttcccagaagtcccattacaagagcggagagtgcgggaaggcttcaagacacaagcacacacccgtgtatcacccacgagtttatactggcaaaaagttgtatgagtgtagtaaatgcggcaaggcgttcagaggaaagtattccttagtacagcatcagcgggtccacacaggcgaacgcccgtgggagtgtaatgaatgtggaaagtttttcagtcaaacgtcccacctaaacgaccaccgtcggatccataccggcgagcggccctatgagtgttccgagtgtggcaagcttttcaggcagaactccagcctggtcgaccatcagaaaatccatactggagcacgcccttacgaatgctcccaatgtggcaagagttttagtcagaaggccacactcgtcaaacatcaacgagtacatactggcgaaagaccgtacaagtgtggcgaatgtggaaactccttctcgcagtcagctattttaaaccagcataggagaattcacacaggggctaaaccatatgagtgcggccagtgtggcaaaagcttcagccagaaggctaccttaatcaaacatcagagggtacacaccggcgagcgaccctataagtgcggagattgcgggaagtcattttcacaaagcagtatcctcattcagcaccgccgaattcatacaggtgcacggccatatgagtgcgggcaatgtggtaaatcattcagccagaaatctggtttgatccaacaccaagtagtgcacaccggagaacggccgtatgaatgcaacaagtgtggtaactccttctcccagtgttccagtctcatccatcaccagaagtgccataatacctag

SEQ ID NO: 22242 - DNA, 1464 bp, Artificial Sequence
  Description of Artificial Sequence: Synthetic coding sequence
atggccgccgccgccctgcgggcccccacccaggtgaccgtgagccccgagacgcatatggacctgacgaagggctgcgtcaccttcgaggacattgccatctacttctcgcaggacgagtggggcctgctggacgaggcacaaaggctgctgtatttggaagtcatgcttgagaattttgcactggttgcttcacttggatgcggccatggcactgaggatgaagagacccctagcgatcagaacgtgagcgtaggcgtgtcacaaagtaaggccggctcgtcaacacaaaaaacgcagtcttgcgagatgtgcgtgccagtcctcaaggatattcttcatttggcggacttgcctggccagaaaccatatctggtcggagagtgtacgaaccaccaccagcaccagaagcatcactcagctaagaagtcgctgaagcgagatatggatagagcttcttatgtgaagtgctgtctattctgtatgagtttaaagcctttcaggaaatgggaagtgggaaaggatctgcctgccatgctccgtttgcttaggtcacttgtttttcccggcggcaaaaaacctggcaccatcaccgaatgtggggaagacattagatcccagaaatctcactacaagagcggggagtgcggcaaagcctctcgccacaagcatacccctgtgtatcacccaagagtatatactggcaagaagctctatgaatgttccaaatgtggaaaggcctttcgggggaagtatagcctcgttcagcaccagcgcgttcataccggagagagaccttgggagtgcaacgagtgcgggaaattcttctctcagacctctcacttgaatgatcacaggcgcattcacacgggagaacgtccctacgaatgctctgaatgcggaaagctgttccgccagaactcttctttagtcgaccaccagaagattcataccggcgccaggccctacgagtgttcccagtgtggaaagtccttcagccagaaggccactctggtgaaacaccagagagttcataccggtgagagaccgtacaaatgtggagagtgcggcaattcatttagccagtctgccatcttgaatcagcaccggagaatccacaccggcgctaagccttatgagtgtgggcagtgtggcaaaagctttagtcagaaggccactctgatcaagcatcagcgagtccatactggtgagcgcccctataaatgtggggattgtggtaaaagttttagtcagagtagcatcctgattcagcacaggcggatccataccggcgcccggccatatgaatgtggtcagtgcgggaagagcttctctcagaagtcggggctcattcaacaccaagtggtccacaccggagagagaccatacgagtgcaataagtgtggcaactccttttcacagtgctctagcttgattcatcaccagaagtgccataatacatag

SEQ ID NO: 22243 - DNA, 1692 bp, Artificial Sequence
  Description of Artificial Sequence: Synthetic coding sequence
atgatgaccgccgagagccgggaggccaccggcctgagcccccaggcggcgcaagaaaaggacgggatcgtaattgtcaaagtcgaagaggaggacgaggaggaccacatgtggggccaagattcaacgctccaggatacaccaccaccagatcccgagatttttcgccagaggtttcggcgattctgctaccagaacacctttggacctagggaggctctctcccgattgaaagaactgtgccaccaatggctgagacccgagatcaacaccaaggagcagattctcgagctcctagtgctcgaacagttcctctccatattacccaaggaactgcaggtctggctccaggagtaccgaccggacagtggcgaggaggcggttacactcctggaggatttagagctagacctgtcaggccagcaggtgcccggccaggttcatggtccagaaatgttggctcgcggtatggttcccctagatcccgtgcaggaaagcagttcctttgaccttcatcacgaggctacccaatctcacttcaagcactctagcaggaaaccacggctgctacaatctcgcgctctgcccgccgcccacattcctgcccccccacacgagggctcccccagggaccaggctatggccagcgccctgtttactgccgacagtcaggcaatggtaaaaattgaggacatggcggtgtccttgatcctcgaggagtggggatgtcagaacctggccaggagaaatctaagcagggataatcggcaggagaattacggaagcgcatttcctcagggaggagaaaatcggaacgaaaatgaggaatctacctctaaggcagagacatcagaagactcagccagccgtggtgaaaccacaggcagatcccagaaagaatttggtgaaaagcgggatcaggaaggaaaaacaggcgaacggcagcagaaaaaccccgaagaaaaaactcggaaagaaaagcgggacagcggacctgctatcggaaaggacaaaaagaccatcaccggcgagcgtggccccagggagaaggggaagggcctagggcgatcatttagtctatcctcaaactttaccacccctgaggaagtacccaccgggacaaagtcccacagatgcgacgaatgcggcaaatgcttcacccgatcaagtagcctcatccggcataaaatcatccatacaggtgagaaaccgtatgagtgctctgaatgcgggaaagcgttcagtctgaatagtaacctggtgctacatcagcggatccacactggagagaagcctcatgaatgcaacgaatgtgggaaggcatttagccactctagtaacctgattctacaccagcgcattcattctggtgagaaaccttacgaatgtaacgaatgtggaaaggcattttcacagagtagtgacttgacaaagcaccagcgaatccacactggggagaagccttacgagtgctcagagtgtgggaaggcctttaaccgcaactcctacttaattctgcaccggcgcatccacacacgcgagaagccatataagtgtacgaaatgtggcaaggcatttacacggagctccacactcacccttcaccacaggatccacgcaagggaacgcgcaagcgaatacagcccagcgtctttagatgcgttcggcgcctttctcaaatcctgcgtctag

SEQ ID NO: 22244 - DNA, 1584 bp, Artificial Sequence
  Description of Artificial Sequence: Synthetic coding sequence
atgtggggccaggacagcaccctgcaggacacccccccccccgaccccgaaatatttagacagaggttcaggcggttttgctaccagaatacttttggcccgagagaggccctttctcgactgaaagaattatgtcaccagtggctgaggccagaaatcaatacaaaagagcagattctggagctcctggttcttgaacagttcctttcaatcctgccaaaggagctgcaagtgtggttgcaagagtacaggcctgactcgggtgaggaagcagtgacactccttgaagatttagagctagatctgtcggggcagcaggttcccgggcaggtgcacgggccagaaatgcttgccagaggcatggtgcccctggatccggtccaagaatcaagctcgtttgatctgcaccacgaagcgactcagtcacatttcaaacactcaagccgcaaaccgcgactcctgcagtcgcgagctctcccggccgcgcacatccccgcccctcctcatgagggatcacctcgcgaccaggccatggcctcggctttgttcactgctgacagtcaggccatggttaagattgaggatatggccgtctcactcatactggaggagtggggatgtcaaaatctggcacgccgcaatctctcgcgggataatcggcaggagaactatggctcggcattcccacagggaggcgagaaccgcaatgagaatgaggaatcaaccagtaaggccgagacgtctgaggacagtgcctcacgtggcgaaacaaccggccggtcccagaaggagtttggggaaaaacgagaccaggaggggaagacaggcgaaaggcaacagaagaaccccgaagagaagacccgcaaggagaagagggacagtgggcctgcaatcgggaaggacaagaaaactatcacaggcgagagaggaccccgcgagaagggaaaaggcctcggccgctccttttccctgagcagcaattttacgactcccgaggaggtacctacaggcactaagagccatcgttgcgatgaatgcggcaaatgctttacaagatcatccagtctcattcgtcataagatcatccacactggcgagaagccttatgaatgctcagaatgcggtaaggccttctcactgaactcaaacctggtgcttcaccagcgcattcacactggggaaaaaccccacgagtgtaacgaatgtggaaaggcctttagccactcttctaacttaatcttgcatcagcgcattcactccggggagaagccatacgagtgcaatgagtgcggcaaggcgtttagccagagcagcgaccttacaaagcatcagcgcatacataccggtgaaaaaccatacgagtgctcagagtgtggcaaagcgttcaaccgcaacagttacctcattctgcaccgacgtattcacaccagagaaaaaccgtacaaatgtaccaagtgcgggaaagctttcacacgaagtagcaccctaaccttgcaccatcgaattcatgccagggaaagggcatcggagtactcacccgcatcattagatgcatttggggcctttctgaaatcttgtgtgtag

SEQ ID NO: 22245 - DNA, 378 bp, Artificial Sequence
  Description of Artificial Sequence: Synthetic coding sequence
atgatgaccgccgagagccgggaggccaccggcctgagcccccaggctgctcaggagaaagatggaatagtcatagtgaaggtggaagaagaggatgaggaggaccacatgtggggacaagattcaacccttcaggatactccacctcctgatcccgaaattttccgccagaggtttcggagattctgttatcaaaatacgtttggacctcgggaggctttgtctcgactgaaagaactgtgtcatcaatggctgcggcccgagattaatactaaggaacagattctggaattactcgtcttagaacagtttctcagcatcctgcctaaggagctgcaggtgtggttacaggagtacaggccagattcgggagagtag

SEQ ID NO: 22246 - DNA, 1053 bp, Artificial Sequence
  Description of Artificial Sequence: Synthetic coding sequence
atggccagcgccctgttcaccgccgacagccaggccatggtgaagatagaagacatggccgtctctttaattctggaggagtggggatgtcaaaacctggcccgccggaatctttctagagacaacagacaagagaattatgggtctgcattcccgcagggaggcgaaaacagaaatgagaatgaggaatccacttccaaagccgaaacttcggaggactctgcaagcagaggcgaaacaaccggccgaagtcagaaggaattcggtgagaagcgagaccaggagggtaagaccggggagagacagcagaagaatccagaagagaaaacccgaaaagagaagagggattcaggacccgccattgggaaggataagaagacaattacaggggaacggggcccacgagaaaaggggaaaggactcggacggagcttctcactgagctcaaacttcaccacgcccgaggaggtacccacagggaccaagagccaccgttgtgatgaatgtggcaaatgtttcacgcgttccagttcactgatcaggcacaagatcatccatacaggcgaaaaaccctacgagtgtagtgagtgcggaaaagcatttagcctcaattctaacttggtgctgcaccaaagaattcacaccggggagaagccccacgaatgtaacgagtgtggcaaggcattctcacatagttctaatctcattctccaccagcgtatacatagcggcgaaaaaccttacgagtgcaacgaatgtggcaaagccttttcccagtcatcagatctgactaaacaccagagaattcataccggcgagaaaccctatgaatgctcagagtgcggcaaggcatttaaccgcaatagttatcttatcctgcaccgaaggatccatacacgtgagaagccttacaagtgtaccaagtgcggaaaggcctttacccgctcttctacacttaccctacatcaccgtattcatgcccgggaacgggccagcgaatatagccccgcaagtttagacgcctttggtgcctttctgaaaagctgtgtgtag

SEQ ID NO: 22247 - DNA, 2904 bp, Artificial Sequence
  Description of Artificial Sequence: Synthetic coding sequence
atggccgtggccctggacagccagatcgacgcccccctggaggtggagggttgcttgataatgaaggtagaaaaggacccagagtgggcctctgaacccattctcgagggttcggacagctctgaaaccttccggaagtgcttccggcagttctgctacgaggatgttacaggtccacacgaggccttctcaaaactatgggaactttgttgtcggtggctaaaaccagagatgaggagtaaagagcagatcctcgagctgctggtgatcgagcaatttctgaccatcctccctgagaaaattcaggcctgggcccaaaagcagtgtcctcagtcaggggaggaggccgttgcacttgtggtacatctcgagaaagagacaggcaggctaagacagcaggtatcctcacctgtacatcgggaaaagcacagcccactcggagccgcttgggaagtcgcggattttcaacccgaacaggttgagactcagccccgggccgtatctcgggaagagcccgggagtctgcactctggacaccaggagcagctcaaccgtaagcgcgaaagacgccctctcccaaagaacgccaggccttctccctgggtgcctgccctcgccgatgaatggaacacacttgatcaggaagtgaccaccactcgcctccctgccggttcccaggaaccggtcaaggacgtccacgtggcacggggattctcgtatcgcaaatcggttcaccagataccagctcagcgcgacctatatagagactttaggaaagagaatgttggcaatgtcgtatctcttggttctgctgtatccacatctaacaagattactcgtctggagcagcgaaaggaaccatggacgttaggccttcactcaagtaacaaaaggtccattctaagatccaactatgttaaggagaagtctgttcacgccatccaggttccagctcgctctgctggcaagacctggcgcgaacagcagcagtggggtcttgaggacgagaagatcgccggcgtccactggagttacgaggaaactaaaacttttctcgcaattctgaaggagtctaggttctacgagacccttcaggcctgcccaagaaacagccaagtctacggggccgttgcagagtggctgcgtgaatgcggcttcttgcggaccccggagcagtgcagaacaaagttcaagtctctgcagaagagctataggaaagttcgtaatgggcacatgctggagccgtgcgctttttttgaagatatggacgcactacttaatcctgccgcaagagcgccatcaactgataagcctaaggagatgatacccgtcccacgcttgaaacggatagcgatttctgctaaagagcatatctctctcgtagaggaggaagaggccgccgaagatagcgacgatgatgaaatcggaatagaattcatcagaaagtctgagatccatggggcccctgtgctgtttcaaaacctgtccggcgtccattggggttacgaagagaccaaaactttcctggacatcctgcgggaaacccggttctacgaggccctccaggcctgccatagaaagtcaaaattgtacggcgccgtggcagaacagctgcgggagtgtggatttctgaggacaccagagcagtgtcgcacaaaatttaagtctctgcaaaagagctataggaaggtcaagaacggtcatgtcctggaatcttgcgccttctacaaagaaatggatgctcttataaactcacgcgcctcagctccatctcccagcacaccagaggaagtcccttctcctagccgccaggaaaggggcggaatcgaagtggagccacaggagcccaccggttgggaacccgaggaaacctctcaggaagctgtgatcgaggatagttgctcagagcggatgtccgaggaggagattgtccaggaacctgagttccaggggccccccggactcctgcaatccccgaacgattttgaaattggaagctccataaaagaggatcccacccaaatcgtctataaagacatggaacaacaccgagctctgattgagaagtccaaaagagtggtgtctcaatcgaccgatcctagcaaataccgtaagcgcgaatgtatttcagggcggcagtgggagaacctccaagggatcagacaggggaaaccgatgagccagccaagagaccttggaaaggcggtggtacatcagaggccttttgtgggcaagcggccttaccgcctcctgaaatatggggagtcatttggcaggtcaacccgcctcatgtgccgcatgacacaccacaaggaaaacccctataagtgtggcgtgtgtgggaagtgcttcggcagatcccgaagccttatcaggcaccagaggatccacactggagaaaagccctttaagtgcctcgactgtggaaagagctttaacgattcttctaattttggcgctcatcaaagaattcatactggggaaaagccatatcgttgcggcgagtgcggaaaatgcttctcccagtcgtctagtctcattatccaccagcgcacacacaccggagaaaaaccttatcaatgcggagaatgtggcaaaagtttcacgaactcatcacatttcagcgctcaccgtagagttcacaccggggaaaacccctacaagtgcgtggattgcgagaagtcctttaacaactgcacccgtttccgggaacatagaaggatacacacgggcgaaaaaccgtacggctgcgcacagtgcggcaagcgcttcagcaaatctagtgtactaacaaagcaccgcgaagtgcatgtgcgtgagaagcccctcccgcatcctccctctctctactgtcctgagaatccccacaagggcaaaaccgatgaatttagaaaaacattctag

SEQ ID NO: 22248 - DNA, 2511 bp, Artificial Sequence
  Description of Artificial Sequence: Synthetic coding sequence
atggccgtggccctggacagccagatcgacgcccccctggaggtggaggggtgtctgatcatgaaggtagaaaaggacccagaatgggcctcggaaccgatattggagggcagcgacagttctgaaacctttagaaaatgtttccggcagttttgctacgaagacgtcacaggccctcatgaggccttttccaaattatgggagttgtgctgcaggtggctaaaaccagaaatgagatccaaagagcagattctggagcttctcgtcatcgaacagtttctgactatcctgcctgagaaaattcaagcctgggctcagaaacaatgtcctcaaagcggagaggaggctgttgccctcgtggtacatctcgagaaggaaactggaaggctccgacaacaggtatcaagtccggttcatagggagaaacatagcccccttggcgcagcgtgggaggtggcagacttccagccagaacaggtggaaacacagccacgagcagtgtcaagggaagagccaggtagccttcactccggccaccaagagcagctgaataggaagcgtgagcggcggcccctgccaaagaacgctagacctagcccctgggttcccgccctggctgacgagtggaacacactcgatcaagaagttaccaccacccggctgccagcgggtagccaagagcccgtgaaggatgttcacgtggccagagggtttagctatagaaaatcagtgcatcagatcccagctcaacgcgatctgtacagggacttccggaaagagaacgtagggaatgtcgtttctttggggtccgctgtctcgacttccaacaagataacgaggctggagcagagaaaggaaccttggaccctagggctgcattcaagtaataagcgctcaattttaagaagtaattacgtgaaggaaaagtctgtacacgccattcaagtgcctgctaggagtgctggtaagacttggagggaacagcagcagtgggggctggaggatgaaaagatcgccggcgtacactggagctacgaggaaacaaagactttcctggcgatacttaaggagagcaggttctacgaaaccctgcaagcatgccccagaaacagccaggtgtacggagccgtagctgaatggcttagggagtgcggcttcctgagaacgccagagcagtgtaggactaagtttaaatctctgcagaaatcttaccgcaaggtccgaaatggacatatgttggagccgtgcgctttcttcgaggatatggatgctctcctcaatccagcagcgcgtgccccatctaccgataaacctaaggaaatgattccagtgccacggttgaaaaggatcgcaataagcgcgaaggagcatattagcttagttgaggaggaggaagctgcagaggacagtgacgacgacgagatcggaatcgaattcattagaaagagcgagatacacggcgcacctgtgttgttccagaacctgagcggcgtgcattgggggtacgaagagaccaagacttttctggatatcctgagagagactagattctatgaagcactgcaggcctgtcacagaaaatcaaaactttacggcgcagttgctgagcagctgagggaatgtggatttttgaggaccccagagcagtgcagaactaaattcaaatctttgcagaaatcttaccgcaaagtaaaaaatggacacgtgctcgagagctgtgctttttataaggaaatggatgctctgatcaactctagggcatctgctccttcaccctccactccggaggaggttccatctccgagccgtcaggaacgaggaggcatcgaggtggaaccacaggaaccgacaggctgggagcctgaagaaacatctcaagaggcagtgatcgaggacagctgttcggaacgtatgagcgaggaagagatagtccaggaacccgaatttcagggtccccctggactgttacagtcccctaatgatttcgagataggctcatcaattaaggaggaccctactcagattgtatataaggacatggaacagcatcgggcattaatcgaaaagagtaagcgggtggtaagtcagtctacggacccaagcaagtaccgtaaacgggagtgtatatccggccggcagtgggagaatctgcaaggaataaggcagggcaaacccatgtcccagccccgcgatctcggcaaggccgttgtgcaccagaggccgttcgtgggaaagagaccctatagactcctgaagtacggtgagtccttcggacggagcactcgccttatgtgcaggatgacccatcataaagagaatccctataaatgcggagtttgcgggaaatgcttcgggcggtcccgatctctcataaggcatcagcggattcacaccggcgagaaaccctttaagtgccttgactgtgggaagtcctttaacgactcgtcgaattttggcgcgcatcaacggatccataccggggaaaaaccgtccatatccgtcctcccttag

SEQ ID NO: 22249 - DNA, 2520 bp, Artificial Sequence
  Description of Artificial Sequence: Synthetic coding sequence
atgatcatgaccgagagccgggaggtgatcgacctggacccccccgccgaaactagccaggaacaggaggacttatttatagtgaaggtggaagaggaggactgcacatggatgcaagagtacaaccctcccactttcgagaccttttatcagaggttccgccactttcagtatcatgaggcgagcgggccacgcgaagcacttagccagctgcgagtgctgtgctgcgaatggctcaggcccgagcttcataccaaggagcagatccttgagttgctggtactggagcaatttcttacaatcctacccgaggaattccagccatgggtcagagaacatcacccagagtctggggaggaggccgttgcggtgattgaaaacattcagagggaacttgaggagaggcgccaacagattgtggcctgccctgacgtgctgcctagaaaaatggccacgcctggagcagtacaagagagctgctccccccacccattaacggtcgacactcagcccgagcaggcccctcagaaacccagacttctggaggagaatgcactgcccgtgcttcaggtcccctccctccctctgaaagactcgcaggagctgacggcatccttgttaagcaccggatctcagaagctggtgaagattgaggaagttgctgatgtcgccgtctccttcatcttagaggaatggggccacctagaccaaagccagaaaagtctatatagggacgataggaaagaaaactatgggtcaatcacgtcaatgggatatgaatcaagggacaacatggagctcatagttaagcagatttccgatgattctgaatcccattgggtggcacctgagcacaccgaaaggtcagttccacaggaccctgactttgctgaggtcagtgatctgaaggggatggttcagaggtggcaggtgaacccaacggtaggcaaatccagacagaacccatcgcagaagcgcgatttggacgctatcacggacatttctcccaagcaatcaacccacggagaacgaggccacaggtgctccgactgtggaaagttctttctgcaggcgtcaaatttcatacagcacagaagaattcacactggggaaaagcccttcaagtgcggcgaatgcggcaagtcttacaatcagagagtgcacctgacccagcatcagcgcgtgcatacaggggagaaaccttataagtgccaggtctgtggaaaggccttcagagtgtcttctcacttggttcagcatcacagcgttcactctggtgagcgcccatacggatgtaatgaatgtggaaagaacttcggcagacactcacacctcatcgagcacctcaagcgacattttcgcgaaaagtctcagcgatgttccgacaaacggtcaaagaacaccaagctatctgtgaagaagaagatctcggagtactctgaggccgatatggagttgtccgggaagacgcaacgaaacgtgtcgcaggtgcaggatttcggtgagggatgcgagttccaaggtaagctggatagaaaacagggaatccctatgaaagaaattctggggcaacctagctctaagcggatgaattactctgaggtcccctacgtccacaaaaagtcctccaccggcgaacgtccccataaatgtaatgagtgtggcaaatccttcatccaaagtgcacacctgatacaacatcagcggattcataccggagagaagccatttcggtgtgaggagtgtggaaagagctacaaccaacgggttcatctgacacaacatcagcgggtgcatactggcgagaagccctacacgtgcccactctgtggtaaggcattcagagtgcggagtcaccttgtgcagcatcagtctgtgcattccggtgaaagaccattcaagtgcaacgaatgcggcaagggcttcgggcgtcgaagccatctggccggacacctccgactgcacagcagggagaagtcccatcagtgtagggagtgcggggagattttctttcaatatgtcagcctgatcgagcatcaagtcttgcatatggggcagaagaatgaaaagaacggtatctgcgaagaggcgtactcttggaatctgacagttatagaagacaagaagattgaactgcaggagcaaccctatcagtgcgatatctgtggcaaggcgtttggctacagctcagacctcattcaacattacagaacacacactgccgaaaaaccgtaccaatgtgatatctgtcgcgaaaacgttggtcagtgtagccacacaaagcagcatcagaagatttactcttctaccaaatctcaccagtgtcatgagtgtgggcgaggtttcactctgaaaagtcacctgaaccaacatcagcgtattcacacaggagaaaagccctttcagtgtaaagaatgcgggatgaacttttcctggtcttgcagcttgttcaaacacctcaggtcccacgaacgcacagaccccattaatacactatcagtggaaggctctttgctctag

SEQ ID NO: 22250 - DNA, 2520 bp, Artificial Sequence
  Description of Artificial Sequence: Synthetic coding sequence
atgatcatgaccgagagccgggaggtgatcgacctggacccccccgccgagacgagccaggagcaggaggacctattcatcgtgaaagtggaagaggaagattgcacttggatgcaggagtataatccgcctaccttcgagactttttatcagcggtttcggcatttccaataccacgaagcctcaggtccacgggaggcactctcacagctacgggtcttatgttgtgaatggctgcgaccagaactacataccaaggagcaaatcctcgagctgctcgtgctagagcagtttctgactatcctgccggaggagtttcagccttgggtccgggagcaccacccagaatctggagaagaagcggtagccgtgatcgagaacatccagagggaattagaagagcgacgacagcagattgtcgcctgtccggatgtgctgccccggaaaatggccactccaggagcagtgcaggaatcctgctctcctcatcccctgaccgtggatacacagcctgagcaagcacctcaaaagccacggctgctggaagagaacgctctgccagttctacaggtcccatccctcccattgaaagattctcaggaactgactgcctctctgctttccaccggctcccagaagctagtgaagatcgaggaggtggctgatgtggcggtgtcgttcatccttgaggagtggggccacctggaccaatcccagaagagcttgtaccgcgatgatcgaaaggaaaattacggtagtatcacaagcatggggtacgagagcagggataacatggagctaatcgtcaaacaaatctcagacgatagtgagagccactgggttgctcccgagcacacagaacggtccgttccccaggatcccgatttcgccgaggtttccgatctgaaggggatggtacagcgctggcaggtgaaccctactgtggggaagtcgcgccaaaatcccagccagaaacgggatctggacgctattaccgacatttcccccaagcagagcacacacggggagcggggacatcgctgttctgactgtggcaaattcttcctgcaggcttccaatttcatccaacacagacggatccacacgggggaaaagccttttaagtgtggcgaatgtggcaaatcttacaaccaaagagtgcacctgacccagcaccagagggtgcacacgggggaaaaaccctataagtgccaggtctgcggaaaagcattccgcgtgtcaagtcatctggtgcagcatcactctgtgcactctggtgaacggccgtatggttgcaacgagtgcggtaagaatttcggccgccactctcaccttatcgagcatcttaagcggcatttcagagagaaatcacaaaggtgctctgacaagcgatccaagaatacgaaactcagcgtgaaaaagaagatatcagagtactccgaagcagatatggagttatccgggaaaacacagcggaacgtaagtcaggtccaggactttggggaaggatgtgaattccaggggaagctggatagaaagcagggaatccccatgaaagagatccttggacagccaagcagcaaaagaatgaattattccgaagtgccatacgtccacaaaaagtcctccactggggaaaggccccacaaatgtaatgagtgtggaaaatcatttattcagtcagctcatctgattcagcaccagagaatccacaccggcgagaagccattcagatgtgaagagtgtggcaaatcatacaatcaaagggtccacctgacccaacatcagagagtgcatacaggagaaaaaccctatacctgccccctatgcggaaaagcttttcgtgtacggagccacctggtacagcatcaaagcgtgcatagtggtgaaagaccttttaagtgcaacgagtgcggaaagggatttggtcggcgatctcatcttgccggccacctgagactgcatagcagggagaagtctcatcagtgtcgcgagtgcggggagatttttttccagtatgtcagcttaatcgagcaccaggtgttgcacatgggccaaaaaaatgaaaaaaacggaatctgtgaggaggcttatagctggaacttgaccgtgatcgaggacaagaagatagagcttcaggaacagccctaccagtgtgatatttgcgggaaggcatttgggtattcctcggacctgattcagcattacaggacccacaccgcagagaagccgtaccagtgcgacatttgtcgcgaaaacgtggggcagtgttcccatacaaagcagcaccagaagatctatagctctactaaatcccaccagtgccacgaatgcggtagagggtttaccctaaaatcacacctcaaccagcatcaacgcatccacacaggagaaaagccgtttcagtgtaaagagtgcgggatgaactttagctggtcttgctcactgtttaaacacttaagatctcacgaaagaactgaccccatcaacaccctgtcagtagaagggtcactcttatag

SEQ ID NO: 22251 - DNA, 291 bp, Artificial Sequence
  Description of Artificial Sequence: Synthetic coding sequence
ttccggcacttccagtaccacgaggccagcggcccccgggaggccttgtcgcagctgcgcgtgctctgctgcgaatggctcagacccgagttgcacaccaaagagcagattctggagctactcgtgcttgaacaattccttaccatcttgccagaggagttccagccttgggtgagggagcatcacccagaaagcggagaagaagctgtggctgttattgaaaatatccagcgggaacttgaggagcggagacagcaggtgagccgtgctcaatggttgaccctggtctag

SEQ ID NO: 22252 - DNA, 2520 bp, Artificial Sequence
  Description of Artificial Sequence: Synthetic coding sequence
atgatcatgaccgagagccgggaggtgatcgacctggacccccccgccgaaaccagtcaagaacaggaggacttatttatcgtgaaggtcgaagaggaggattgtacctggatgcaggagtacaacccacccaccttcgagaccttttatcagcgttttcggcactttcagtaccatgaggcttccggtcctcgtgaggctttaagtcagctgagagttctgtgctgtgagtggctgaggcccgaactgcacacaaaagagcagatcctcgaactgctggtgcttgagcagtttctcaccattctgccagaggaatttcagccctgggtcagggaacatcacccagaatccggcgaggaagccgtggccgtcatagagaatatccaacgggaactggaggagaggaggcaacagatcgtggcttgtccagacgtgctgccacggaagatggctacgcccggggcagtgcaggagagttgttctccacaccctcttaccgtcgacacccaacctgagcaggcaccgcagaagccccggcttctggaagaaaatgccctgcccgtgctccaggttccttcactccctctaaaagacagtcaagagcttaccgcctccctgctgagcactggatctcagaaactggtgaaaattgaggaggtggcagacgtagccgtctcattcatattagaggagtggggccaccttgatcagagtcagaaatctctgtaccgcgatgacaggaaagagaactatggctccataaccagcatgggatatgagtcacgcgacaatatggagttgatcgtcaaacagattagcgacgacagtgaaagccactgggtcgctcctgaacacaccgaaagaagcgtgccacaagaccccgactttgcggaggtgagcgatctaaagggcatggtccaacgatggcaggtgaatcctacggtcggtaaaagcagacagaaccctagccaaaaacgcgacttagatgcaatcaccgacatcagccccaaacagtctacacatggcgaacgaggtcatcggtgctcagattgtggtaaattttttctccaggcctctaattttatacagcatcgcagaattcacaccggtgagaaaccattcaaatgtggagaatgcggtaagagttacaatcagcgtgtgcacctaactcaacaccagagagtgcatacaggcgaaaagccctataaatgccaggtgtgcgggaaggcctttcgagtgagcagtcacctagtgcagcatcattcggtacatagtggggaacgcccatatggttgcaacgagtgcggaaaaaatttcggaaggcattctcatcttattgagcatttaaaacggcactttcgggagaaaagccagaggtgtagtgacaagcggtccaagaacaccaagctctcagtcaagaagaagatatcggaatactctgaggccgatatggagctatctggcaaaacacagcgcaacgtatcccaagtacaagacttcggagaggggtgcgagttccaaggcaaactggacaggaagcagggaatcccgatgaaggaaattctcggtcagccctcctcgaagcggatgaactactcggaggtgccctacgtccataagaagagtagcaccggagaacgccctcataagtgcaatgagtgcggaaaaagttttattcagtccgctcatctgattcagcatcagcgcatccacaccggcgagaaaccttttagatgcgaagagtgcggcaagtcatacaaccagcgcgttcatctcactcagcaccagcgcgtacatactggtgagaagccttacacatgtccgctgtgcggcaaggcctttcgagtgcgatcccacctcgtgcagcatcagagcgttcattccggtgaaagaccctttaagtgtaatgaatgcggcaaaggctttggaaggaggagccatctggctgggcatctgcgtctgcactcacgggaaaagtcccatcaatgtagggagtgcggggaaattttcttccaatacgtcagcctcattgagcaccaggtgcttcatatgggccaaaagaacgaaaagaacgggatctgtgaggaggcttattcatggaatttgactgtaatagaagacaaaaaaattgagttgcaggagcagccttaccaatgtgacatttgtgggaaggcatttggatacagtagcgacttaatacagcactacagaactcacaccgccgaaaagccgtaccagtgtgacatctgtagggagaacgtgggtcaatgtagtcacactaaacagcaccagaaaatctacagtagcacaaagtcccatcaatgccatgaatgcgggcggggatttacactgaagtcccacctaaaccaacaccagcgcattcacactggagagaaaccattccaatgcaaggaatgtggtatgaatttttcttggtcctgctctctgtttaagcatttaagaagtcacgaacggacagacccaatcaacaccctgagcgttgaaggatcgctcctgtag

SEQ ID NO: 22253 - DNA, 2301 bp, Artificial Sequence
  Description of Artificial Sequence: Synthetic coding sequence
atgatcatgaccgagagccgggaggtgatcgacctggacccccccgcagaaacctctcaagagcaggaagacttatttatcgttaaggtagaggaggaggactgtacctggatgcaggagtataacccacccacttttgaaaccttctaccagaggttcaggcattttcaataccatgaggctagtggccccagggaggctctgtcacagctcagagtgctgtgttgtgagtggctgaggcctgagttgcataccaaagagcagatactggagctgcttgtgctcgagcagtttctgaccatccttcctgaggagtttcaaccctgggtacgcgagcaccatcccgaaagcggcgaagaagcagtggccgtgatcgaaaatatccagcgtgagctcgaggaaagacggcagcagatagtagcttgcccagacgttctgcctcgcaaaatggccactcctggagcagtacaggagagctgcagtcctcaccccctaacagtggacacacagcctgagcaggcccctcagaagcctaggctgctggaagagaatgccctgcccgtgcttcaggttccatcattgccactaaaagacagccaggagctgaccgcttcactgctctcaaccggcagtcagaagctcgtcaaaatcgaagaagtcgcagacgtcgcagtgtctttcattctcgaagaatggggccacctcgaccaatcccagaaaagcctgtatcgagacgacaggaaggagaactatggctcgatcaccagcatgggttacgaatcccgcgataacatggagcttattgtgaaacagattagtgatgactccgagtcccattgggttgcccctgaacacactgaaaggtccgtccctcaagaccccgacttcgctgaggtgtccgacctcaaaggaatggtgcagagatggcaggtcaaccctactgtggggaaatcacggcagaacccatcacagaaacgtgacctggacgctattactgacattagtcccaaacagtccacgcatggtgaacgtggacacagatgcagtgactgtggaaaattcttccttcaagcgagcaatttcatccagcatagaaggattcacaccggggagaagcccttcaagtgcggggaatgtggcaaatcctacaaccaacgcgtgcacctgactcaacatcagcgggtgcacaccggagaaaagccttacaagtgccaggtgtgcggcaaggcattccgcgtgtcttcccacctggttcagcatcatagtgttcactcaggagagagaccctacgggtgtaatgagtgcgggaagaacttcgggagacatagccacttgattgagcacctcaaaaggcattttagggagaagtcacagaggtgctctgacaagaggagcaagaatacaaagttatcagtgaagaagaagatatccgagtactcagaggcggatatggaattatctggaaagacccaacgcaatgtgagccaagtgcaggattttggcgaggggtgtgagtttcaaggaaaattggatagaaaacagggaatccccatgaaggaaatcctgggtcagccaagcagcaagcgtatgaattacagtgaagtgccttacgtgcataaaaagtctagcaccggggagcgcccacacaagtgcaacgaatgtggaaagtcgttcatccagagcgctcatctcatccagcaccaacggatccatactggagagaagcctttccggtgcgaagaatgtggaaaatcttacaaccagagggtgcatttgacacagcaccaacgtgttcacactggcgagaaaccgtatacgtgccccctttgcgggaaggctttccgcgttcggtcacacttagtacaacatcagtccgtgcactcaggggaaagaccctttaagtgcaatgagtgcgggaaaggctttgggagacggagccacctcgccggccacctacgtctgcattcccgggaaaaaagccaccagtgtcgggagtgcggcgagatcttcttccagtatgtcagtttgattgagcaccaagtcctgcacatgggacagaagaacgagaaaaacgggatctgcgaggaggcttattcatggaacttgaccgtcatcgaggataagaaaatcgaactccaggaacagccctatcagtgcgacatttgcgggaaagcgtttggatactcctccgatctgattcaacactacagaacacatacagccgagaaaccctatcaatgtgatatttgcagagttgttatctacaggatgtcatttagtcttcattgttcctgggactag

SEQ ID NO: 22254 - DNA, 1446 bp, Artificial Sequence
  Description of Artificial Sequence: Synthetic coding sequence
atgcggggcctgccccggaagcgggaggcctggacccagccccaccccctggaggccctgtacgaaagtctccgtgtcttggagaaagacacgagtgcgactagccagagcgttaacgggagtccccaggcggaacagccttcactggagtctacaagcaaggaggcttttttctccagggtcgagacctttagctcattgaagtgggccgggaaacctttcgagctgtcccctctggtttgcgcaaagtacgggtgggtcactgtggagtgcgacatgctcaaatgttcctcatgtcaggccttcctttgtgccagcctgcagccggccttcgattttgacagatacaagcagaggtgtgcggagctgaaaaaggccttgtgtacagctcacgagaaattctgcttctggccggatagcccgagccccgataggttcggcatgctgcctctcgatgaacccgcaattttggtgtccgagttcctagaccgcttccagagcctgtgccatctcgatttacagttgccttctctcaggccggaggaccttaaaactatgtgtcttactgaggacaagatctctttgcttcttcatcttctggaagatgaactggaccaccgcaccgatgaaaggaagactacaatcaagttaggaagcgacatacaagtgcatgtaacggcttgcattctgtctgtgtgtgggtgggcctgtagctcaagtctagagtcaatgcagctttcgctaattacttgctctcagtgtatgcggaaggtagggttgtgggggttccaacaaatcgaaagctccatgacagacctggacgcatcgtttggattaacctcttcccctatccctggcctcgagggaagacccgagcggttgcccttagttccagagagtcccagaagaatgatgactagatcccaggacgccacattctctccaggatctgagcaagcagagaagtcccctggacccatcgtctcgagaacgagatcttgggattcttcgtcccctgtagatagacctgaacccgaggccgcttctccgacgacacgcactagaccagttacgagaagtatgggcaccggagacacacctggactggaggtgcctagcagtcctttgcggaaggccaagagggccaggttatgtagttcaagttccagcgacactagttccaggagtttctttgatcctactagtcagcatcgtgattggtgcccatgggtcaatataaccctaggcaaggaatctcgtgagaacgggggaaccgagcctgatgcatccgcgccagccgagcctggctggaaggctgtgctcacaatcttgcttgcccacaaacagtcatctcagcccgccgaaacagatagcatgagtttgtctgagaagtcacggaaagtatttcgcatctttcggcagtgggagtctctgtgcagctgttag

SEQ ID NO: 22255 - DNA, 1509 bp, Artificial Sequence
  Description of Artificial Sequence: Synthetic coding sequence
atggccgccccctgcgagggccaggccttcgccgtgggcgtggagaagaactggggggctgttgtgagaagcccagaaggtaccccgcaaaagattcggcagttgattgacgagggaatcgcccctgaggagggcggggttgacgccaaggacaccagcgcaacatctcagtccgtcaatgggtctccccaggcggagcagccaagtctggagagtacctccaaggaggcctttttcagcagggtggaaacattttcatcactgaagtgggctggcaaacccttcgaactaagtcctctggtgtgcgccaagtacggttgggttactgtggaatgtgacatgctgaagtgttctagctgtcaagccttcttgtgtgctagtctccagcccgcctttgattttgaccggtataaacagcgctgcgccgagctgaaaaaagccctctgtacggctcatgaaaagttttgcttttggcctgacagcccctcacctgacaggtttggtatgctaccactggacgagccagccatcctcgtgagcgagttcctggatagattccaatctctttgccacctggatcttcagcttccatcactgagaccagaggatcttaagaccatgtgcctcacagaggacaagataagcctgctgttacacctgctcgaggacgagctggatcacagaactgacgagcgcaagactaccattaagctcggaagcgatatccaggtccatgttaccgcttgtatcctctctgtgtgtgggtgggcgtgttcctcctcactagaaagtatgcagctttcacttataacgtgttcccagtgcatgcgcaaggtgggtctttgggggtttcagcaaatcgagagctccatgaccgatctggacgccagcttcggactgacaagttcccctatccccggcttagagggaagaccggaaaggcttcccctggttcctgagtcacctcggagaatgatgacacgctcacaggatgccacatttagtccaggctccgagcaagcagaaaagtcccccggccctatcgtgtctagaactcggtcttgggactcttctagccctgtggaccggcccgagccagaagctgcttctcccacaacccgaactagacccgtgacacggtcaatgggcaccggcgatacccccggtttggaggtgccttcaagtccactgcgaaaagcaaagagggcccggctctgcagttcatcctccagcgacacctcaagtcggagtttttttgacccgacctcgcagcatagggattggtgcccctgggtaaatatcactttggggaaggagtcccgcgagaacggtggcacagaaccagacgcatcggcacctgcagagccaggctggaaggcggttctcacaatccttctcgcccacaagcaaagctctcaacctgcagagacagattctatgtcactaagcgaaaaatctcgcaaagtattccgcatttttcgtcagtgggaaagtctgtgctcctgctag

SEQ ID NO: 22256 - DNA, 1296 bp, Artificial Sequence
  Description of Artificial Sequence: Synthetic coding sequence
atggccgccccctgcgagggccaggccttcgccgtgggcgtggagaaaaattggggcgctgtcgttcgcagccccgagggaacgccacaaaaaatccggcagctgatagatgaaggaatcgcgcccgaggagggcggggtggatgcgaaagacacaagcgcgacctcccaaagcgtaaatggcagccctcaggcggagcagcctagcctggagtctacatccaaggaggcatttttttctagagtcgagacattcagcagtctgaagtgggctgggaaaccctttgagctgagtccactagtgtgtgctaagtatggctgggttactgtggagtgtgacatgctcaaatgctcatcctgccaggcctttctatgcgcatccctgcagccagccttcgattttgaccgctataaacagagatgcgccgagttgaaaaaagccctttgcaccgcccatgagaaattttgcttctggcccgatagtcctagcccagacagatttggcatgcttcctctcgatgagccagctatactggtttcagaattcctggatcgcttccaatccctctgtcacctggacttgcagttaccatcacttcgacctgaagacttgaaaacgatgtgcctcacagaggacaagatctccctgctcctccatctgctggaggacgaactcgaccacagaactgatgaacgcaagacaaccatcaaacttggttccgacattcaggtgcacgttaccgcctgcatcctgagcgtgtgtggatgggcttgctcaagttctcttgaaagcatgcagctctcgctgatcacctgttcccagtgcatgaggaaggtcgggctatggggttttcaacagattgagtcaagcatgactgacctggacgcctccttcggcctgactagttctcctatcccaggtctcgagggtcgcccggaaaggctgcctcttgtgccagagagtcctcgcaggatgatgactcgttcccaggacgccaccttcagccccgggtccgaacaagacacctcatctagaagttttttcgaccctacttcccagcaccgggattggtgcccctgggtgaatatcactctcggaaaagagtcaagggaaaatggaggcacagagcccgatgcttcagccccggccgaacctggttggaaagcagttctcactattttattagcccacaaacagagtagccaacctgccgagaccgattccatgtccttgagcgagaaatcacgcaaagtcttccggatttttcgacagtgggaatctctctgctcctgctag

SEQ ID NO: 22257 - DNA, 1596 bp, Artificial Sequence
  Description of Artificial Sequence: Synthetic coding sequence
atggacgaggagagcctggagagcgccctgcagacctaccgggcccagctgcagcaggtcgagctggctcttggcgcaggccttgacagtagcgaacaggcagatctgagacagctgcagggcgatctaaaagagctgattgagctgacggaggcgtcattggtgagtgtgaggaagagctctcttctggcggcacttgacgaggaacggcccggcaggcaggaagatgcagagtaccaggcatttcgagaagccatcaccgaagcagtggaggcacctgctgccgctaggggttctgggagtgagaccgtgcccaaggcagaagctggaccggagagcgctgcaggtggtcaagaggaggaagagggcgaggatgaagaagagctgagtgggaccaaagtttctgcaccttactattccagctggggtactctggaataccacaatgccatggtggtcggcactgaggaggcggaagacggtagcgctggcgtgcgcgtactctatctgtaccccacccacaaatcacttaaaccctgtcccttcttccttgagggtaagtgccgatttaaagaaaactgtcgctttagccacggccaggttgtgtcactggatgagctgagacctttccaagatcccgacctgtcgtccctgcaagccggttctgcttgccttgccaagcaccaggacgggttgtggcatgctgcgcggatcactgacgtggataatggctactacaccgtcaaatttgattcgttattactccgagaggcagtagtcgagggtgatgggattctccctcccctgcggaccgaggcaacagagtcggactccgatagcgatggtaccggcgactcgtcctacgcacgggtggtcggaagcgatgccgtggactcggctcagagcagtgcactctgcccaagtcttgccgtggtcgggtcagacgccgtggacagtgggacgtgctcttctgccttcgccggttgggaagttcacacaagaggcataggttccagactgctgaccaaaatgggatacgaatttggaaaagggctgggacgacacgccgaaggcagagtcgagccgatccacgccgttgtgctcccgcgggggaagagcttagaccagtgcgtcgagactctgcagaagcagactagagttggaaaagccggcacaaacaaacccccccgttgcaggggacgtggggctaggcctgggggtaggcctgccccaagaaacgtgtttgattttctcaacgagaaactacaaggccaagcgcctggagccctggaggcaggagctgcaccagctggacggagatctaaggacatgtaccacgcctctaagagtgccaaacgggctctcagcctgcgccttttccagaccgaggaaaaaattgaaaggacacagagggacataagatcaatccaggaggcccttgcacgcaatgcagggcggcacagcgttgcctccgctcagctccaagaaaagttagctggggctcaaagacagttaggtcagttgcgggctcaggaggccggactgcagcaggaacagcgtaaagctgatacgcacaaaaaaatgacggagttttag

SEQ ID NO: 22258 - DNA, 1536 bp, Artificial Sequence
  Description of Artificial Sequence: Synthetic coding sequence
atggacgaggagagcctggagagcgccctgcagacctaccgggcccaactgcagcaggttgaactggctctgggcgcaggtctcgatagttctgaacaggccgatctacgccagcttcaaggcgatctcaaggagcttattgaactcacagaggcctcactggtgagcgtgaggaaaagctctctgctcgctgcactggacgaggaacgacccggccggcaggaagatgccgaatatcaagcctttagggaggccataactgaggcagttgaggctccagccgctgcccgcggttccggtagcgaaacggtacctaaagccgaagccgggcctgagtcagccgccggcggtcaggaagaggaggagggtgaggacgaagaagagctgtcgggcacaaaggtaagtgcaccatactacagcagctggggaactctggagtatcataacgctatggtggtggggacagaggaagctgaagacggctccgctggagtacgggtcttgtacctgtatcccacccataaatctctgaagccatgcccatttttcctagaagggaagtgtagatttaaggaaaattgtagattttctcatggacaagtagtgtcattggatgaacttagaccttttcaggatccagatctatcttctctgcaagcagggagcgcatgcctcgccaaacaccaagacgggttgtggcatgcagcccgaattaccgacgtggacaacggctattacacagtcaaatttgactctctgctcttgcgcgaggctgtggttgagggggacgggattcttccccccctccggaccgaggctacagaatctgacagcgactctgacggcaccggtgactcatcttatgcccgtgtggtgggctcagacgccgtggatagtggaacttgcagctccgccttcgccgggtgggaagttcacactagagggataggctcgagactactcaccaagatgggatacgagttcggcaagggcctaggccggcacgcagaaggcagagtcgagccaattcacgcggtggtactgcctcgtggtaagagtctcgatcagtgtgtagagacattacagaaacagactcgcgtgggaaaggccgggactaacaaacccccacgatgccgcggccggggagcccgtccgggagggagacctgccccccgcaatgtttttgattttctaaatgaaaagttacagggacaggccccaggtgctctcgaggctggcgcagctcccgcaggccgccggtctaaagatatgtatcacgcatcgaaaagtgcaaagagagctcttagcctgaggctcttccagacagaggaaaaaattgaacgtacacagcgggatatccggagtatccaggaagccttggcccgaaatgctggacgacatagtgtggcctctgcacagctccaggaaaaactcgccggagctcagcggcagctgggccagttgcgggcgcaggaggcgggtctccagcaggagcagagaaaagccgatacccacaaaaagatgactgaattttag

SEQ ID NO: 22259 - DNA, 1509 bp, Artificial Sequence
  Description of Artificial Sequence: Synthetic coding sequence
atggacgaggagagcctggagagcgccctgcagacctaccgggcccaactgcagcaggtcgaacttgccctgggcgctggcctggatagttcggaacaagccgatctacgccagcttcagggtgacctgaaggagctgattgagttaaccgaggccagccttgtcagcgtgcgcaaatcctctctgctggcagcattagacgaagagagacctgggcgccaagaagatgcagagtaccaagcctttagggaggcaatcacagaggccgtcgaggcaccagccgcagctcgagggtctgggtcagaaactgttcctaaagctgaagccggtccggaatccgccgcaggcgggcaggaggaggaagaaggcgaggatgaggaggagttgtctggtactaaagtgagcgcaccatattattccagttggggaacgctggaataccacaatgcaatggttgtgggaactgaggaagcggaggatggttcagcaggtgtccgcgtactgtacctgtatcctacgcataaaagcttaaagccttgccccttttttctcgaagggaagtgccggttcaaggagaattgtcggttcagccatggccaggtggtttccctggatgagctgcgcccctttcaggaccctgatctctcatcactgcaggccggcagcgcgtgtctcgcaaaacaccaggatgggttatggcatgccgcgaggattaccgacgtggataacggatactatacagtcaaattcgactcattattactgagggaggcagttgtggagggtgacggaattcttcccccgctgcggaccgaggccaccgagtccgattctgacagcgatgtggtggggagcgacgctgttgacagcggcacttgctcctctgcatttgcaggctgggaggtgcataccagaggcatcggttccagacttcttacaaaaatggggtacgagttcggaaaaggcttaggtcgacatgctgagggcagagttgagcccatccatgccgtcgtcctgccacgcggtaagagtcttgaccagtgcgttgaaacattgcagaagcaaacacgagtcggcaaagcgggcactaacaagcctccccgttgtaggggcagaggagccaggccaggcgggcggccggcgcctaggaacgtctttgacttccttaatgaaaagttacagggccaggccccgggggcacttgaggctggcgcagctccagcagggagacggtccaaagatatgtatcacgccagcaaatcagcaaagagggctctgtccttacgcctgtttcagacagaggaaaaaattgagcggacacagcgagacatccgcagcatccaggaggcactggcccggaatgcgggacgccattccgtggcctcagctcagctgcaagagaaactcgccggcgctcagcgccagctcggccagctccgggcgcaagaggccggtttacaacaggagcagcggaaagccgacacccacaagaaaatgacggaattttag

SEQ ID NO: 22260 - DNA, 1536 bp, Artificial Sequence
  Description of Artificial Sequence: Synthetic coding sequence
atggacgaggagagcctggagagcgccctgcagacctaccgggcccagctgcagcaagtcgaacttgccctcggggctggcttggatagcagcgagcaggccgatttgcgccagttgcagggggatctgaaagagctgattgaattaactgaggcctccctcgtatctgtgcgcaaaagttcattgctcgcagccctggacgaggaacgtcccggcaggcaagaggacgccgagtaccaggcattcagagaagcaattacagaggccgtggaggcacctgcagcagcccgtgggagtggctctgagacagttccaaaagccgaagccgggcccgaatctgccgcaggaggtcaggaagaagaggagggggaggatgaagaagaactctctgggactaaggtctccgccccttactactcctcatggggcactttggagtaccacaacgccatggtcgttgggaccgaggaagctgaggatggctccgccggggtcagggtgttgtatctgtaccccacgcataagagcctgaagccttgtcccttttttctggaaggcaaatgcagatttaaagagaactgtagatttagtcacggacaagtggtgagcttggatgaattgcggcccttccaagaccctgacctatcttccctacaggcagggtcagcatgtttagccaagcaccaggatggcctgtggcacgccgcccgcatcactgatgtcgacaatggctattataccgtcaagttcgattccttactgctacgcgaagccgtcgttgaaggtgatggtatattgccccctctgcggaccgaggccactgaatccgactccgacagtgatggcacaggcgattcaagctacgcacgggtggttggcagcgatgctgtggatagtggcacttgctccagcgcattcgccgggtgggaagttcacactcgcgggattggatctcgattactgaccaagatggggtacgaatttggaaaagggctcggacgtcacgcagaaggccgagttgagcccatccacgcagttgtcctgccccgaggtaagagtctagaccagtgtgtcgaaacccttcaaaagcagaccagagtggggaaagccggaaccaataaaccccctagatgcagaggaagaggcgcccgacccggcgggcgtcccgccccacgtaacgtgttcgatttcctcaacgagaagctgcaaggccaggccccaggggccttagaagccggtgcggcccctgctggcagaagatcaaaggacatgtatcatgcatccaagagcgcgaagagggccctctccctgcggctgttccagaccgaggagaagatcgagagaacccagagggacattaggtcgatacaggaagctctggctcggaacgccggaagacactctgtcgcttcagctcagctgcaagagaagcttgccggggcacagaggcagctgggccagctgagagctcaggaggcgggtctccagcaggagcagcgtaaagccgatacacacaaaaagatgactgaattttag

SEQ ID NO: 22261 - DNA, 294 bp, Artificial Sequence
  Description of Artificial Sequence: Synthetic coding sequence
atggacgaggagagcctggagagcgccctgcagacctaccgggcccaactgcagcaagtggagctcgctctgggagccggcctggattcgtccgagcaagcggatttaagacaactacaaggggatctgaaagaattaatcgagctgactgaagcttcactcgtctctgtgaggaagagctctttattggctgccctggacgaagagcgcccggggcggcaggaagacgccgaataccaggcttttagggaggctatcacagaggccgtggaagctccggccgccgctcgttag

SEQ ID NO: 22262 - DNA, 1536 bp, Artificial Sequence
  Description of Artificial Sequence: Synthetic coding sequence
atggacgaggagagcctggagagcgccctgcagacctaccgggcccagttacaacaggtcgagctcgccctcggcgccggtctagacagtagcgagcaagcggacttaaggcaactccagggggacttgaaggaactgattgaattgacggaagcctctctcgtcagcgtgagaaagagtagcctgctcgcagcgctggacgaggagaggcccggccggcaagaagacgcagagtatcaggccttcagggaggctataaccgaagcggtcgaggctccagcagccgctcgggggagcgggagcgagacggtgccaaaggcagaagctggaccagagtccgcagcgggtggtcaggaggaagaggaaggcgaggatgaggaggagctgagtgggaccaaagtgtcagccccctattactccagctggggcacactggagtaccacaatgccatggtggtgggcactgaggaggccgaggacgggagcgctggagttcgcgtcctgtatttgtaccctactcataagtctcttaagccttgtcctttttttctggaaggcaaatgccgattcaaggagaactgccgattttcccacggccaagtagtttctctggacgagctgagaccttttcaagatcccgacttgtcttcactacaagctggcagcgcctgcctggctaagcatcaggacgggctctggcacgccgctagaatcacggacgtggacaacggctattatactgtgaaattcgactcattgctccttcgggaggccgtggttgagggcgacggcattcttcctcctctgaggaccgaagccacagaatctgattcagactccgacgggacgggcgattcctcttacgcccgggtagtaggatccgacgctgtagatagcgggacctgttcttcagctttcgcaggatgggaggtacatacacgcggaatcggttcgcgtttgctcaccaaaatgggctacgagttcgggaagggcctaggaaggcacgctgagggcagggtcgaacctatccacgccgttgtgttgcccaggggcaagagcctagatcagtgtgttgagactctgcagaagcagacaagggtcggaaaggccggcacaaacaaacctccacgctgtcgcggccgaggggcccgcccgggcggacgacctgcacctagaaacgtgttcgacttcttgaatgagaagctgcagggacaggctcctggtgccctggaggcaggcgccgcacccgctggacgccgctcgaaggatatgtaccacgcttccaaaagcgccaaacgagccctctctttgagactgttccagaccgaggagaaaatcgagcgcactcagcgagatatccgatctatccaggaagctctggccaggaacgcagggcggcattccgtcgcctctgcacagctgcaggagaagctggcaggagcacagagacagctgggacagcttcgtgcccaagaagccggcctacagcaggaacagcgaaaagcggatactcataagaagatgacggagttctag

SEQ ID NO: 22263 - DNA, 1419 bp, Artificial Sequence
  Description of Artificial Sequence: Synthetic coding sequence
atgaacaacagccagggccgggtgaccttcgaggacgtgaccgtgaatttcacacagggcgagtggcagcgtctcaaccccgagcagaggaatctttatcgagacgtcatgttggagaattattcaaatctcgtgtccgtgggccagggagaaaccactaagccggacgtgatactgcgactcgagcagggtaaggagccctggctggaggaggaagaagtgcttggatctggacgggcggaaaagaacggagacatcggggggcagatttggaagccaaaggacgtgaaagaatcgttagccagagaggtgccaagtatcaataaggaaacactgacgacacaaaagggcgtggagtgtgatggctctaaaaaaatcctgcctctcggcattgatgatgtttcaagcctccagcactatgtgcagaacaattcccacgatgacaacggataccgcaagctggtagggaataacccaagcaagttcgttggccaacagctgaagtgcaatgcctgtaggaaattgttctcgtcaaagagccgcctccagagccacctccggcggcacgcctgccagaagcctttcgagtgccacagctgcggccgggctttcggtgagaaatggaaactcgacaagcaccagaagactcacgctgaagagcgcccttataaatgcgagaactgtggaaatgcctataaacagaagtcaaacctttttcagcatcaaaagatgcataccaaggagaagccctaccagtgcaaaacttgtgggaaagcattctcctggaagtcttcttgtatcaatcatgagaaaattcacaacgccaagaaaagctatcagtgtaacgagtgtgaaaagtcttttcgccagaactcaaccctcattcagcacaagaaagtgcatacgggacagaaacccttccaatgtaccgattgcggcaaagcattcatatataaatcagatctagttaaacatcagaggattcacactggcgaaaagccctataagtgttctatttgtgagaaagccttcagtcagaaaagcaatgttatcgaccacgaaaagatccataccgggaagagggcgtacgaatgtgacctttgcgggaacacctttatccaaaaaaaaaatctgatacagcataaaaagattcacaccggcgagaagccttacgaatgcaaccggtgcgggaaggcctttttccagaagagcaacttgcacagccatcagaaaactcattccggtgagagaacatataggtgctcagagtgcggaaagacttttatcagaaaattgaacctctccttacacaagaagactcatacaggtcagaagccttatggatgttctgagtgcgggaaagcatttgcggatagaagctatctggtgaggcaccagaagaggatacactctaggtag

SEQ ID NO: 22264 - DNA, 1917 bp, Artificial Sequence
  Description of Artificial Sequence: Synthetic coding sequence
atggagagctgcagcgtgacccggctggagtgcagcggcgccatcagcgctcactgtagccttcaccttcctggatcaagcgattctcccgcatccgcgtcccagatagccggaacaaccgatgccatttggaatgaacaggagaaggcggagctgtttacagacaagttctgccaggtgtgcggagtgatgttgcagtttgagtctcagcgcatctcccattatgaaggcgaaaaacacgcccaaaacgtctcgttttacttccagatgcatggcgagcaaaacgaggtccccggcaagaaaatgaagatgcacgtcgagaattttcaggtccacaggtacgaaggcgtcgataagaataagttttgcgatctgtgcaatatgatgttcagtagcccactgatcgctcagtcccactatgtgggaaaagttcatgctaagaagctgaagcagctcatggaagagcatgatcaggctagtcccagcggtttccaacctgagatggctttcagtatgcggacatacgtgtgtcatatctgctcgatagcattcaccagtttagacatgttcaggtctcacatgcagggaagcgaacatcagattaaggagtccatcgtaatcaacctggtcaagaattcgcggaagacccaggacagctatcagaacgagtgtgcagattacatcaacgttcagaaggcgcgggggttggaagctaaaacctgcttcaggaaaatggaggaaagcagtctcgagacaaggcggtacagagaggtggtggactctcgacctcgccataggatgttcgagcagaggctaccttttgagacatttagaacttacgccgccccatataacataagccaggccatggagaaacagctgcctcactcgaaaaaaacatatgatagcttccaggacgagctggaggattacatcaaggtacagaaagcccgagggctggacccgaaaacgtgctttagaaaaatgagagaaaacagcgtggatactcacggatatagggaaatggttgatagtggacctcgaagccgcatgtgtgaacagcgcttctcacacgaagcaagccaaacctaccagagaccttatcacatttctcctgttgaatctcagctgccacaatggctgcctacacacagcaagaggacctacgattcgtttcaggacgagctggaggactatattaaggtgcagaaggcccgcggcttggagcctaagacttgtttcagaaaaattggcgatagttccgttgagacccacagaaaccgcgaaatggtggacgtgcggcctcgacacagaatgctggagcaaaagctgccttgcgaaaccttccagacttactccggaccctactcgatttctcaggtcgtcgaaaaccaactgccccactgtctacccgcccacgactcaaagcagagactcgactcaatctcttattgtcagcttacacgcgattgcttcccggagaagccggttccgctgtctctgaatcagcaggagaacaatagtgggagctacagcgtcgagtcagaagtttataagcatttgagttcagagaacaacactgcggatcatcaggccggtcataagcagaagcaccagaaaagaaagagacatttggaggagggcaaggagcggccagaaaaagagcagtccaaacataagaggaagaaatcttatgaggacactgatcttgacaaggacaaaagtattcgccagaggaagagagaagaagaccgcgttaaagtgagcagcggcaaattgaagcaccgtaagaagaagaaatcacacgatgttccctctgagaaggaggagcgcaaacacaggaaggagaaaaaaaagagcgtggaagagcgcactgaggaggagatgctgtgggacgagtccatcttaggcttttag

SEQ ID NO: 22265 - DNA, 1404 bp, Artificial Sequence
  Description of Artificial Sequence: Synthetic coding sequence
atgcggacctacgtgtgccacatctgcagcatcgccttcaccagcctggatatgttccgcagtcatatgcaaggtagtgagcaccagattaaggaatcaattgtgatcaatctagtgaaaaacagtcgcaagacgcaggactcttatcaaaatgagtgtgctgattacataaacgtccagaaggcgcggggcttagaggccaaaacatgtttcaggaagatggaagaatctagtttagagacacggcgctatcgcgaggtggtggattcccggcctagacaccgcatgtttgagcagcgactgccgtttgagactttcaggacatacgccgcgccttataatatctcacaggctatggaaaagcagcttccccatagcaagaagacctatgactcttttcaggacgagctggaagattatatcaaggtccagaaagcaaggggtctcgatccaaagacctgttttaggaaaatgagggaaaatagcgttgacacacacggctaccgagagatggtagacagcggaccaagatctagaatgtgcgagcagcgtttcagtcacgaagcctcccaaacctatcagagaccctaccatatttcccctgtggagtcacaactgcctcagtggttacctactcattcaaagcgtacatacgacagtttccaggatgaactggaggattacattaaagtgcaaaaggctcgcggcctcgagcccaaaacatgttttaggaagattggtgattcctccgttgagactcacaggaatcgcgagatggtggacgtacgaccccgacaccgcatgcttgagcagaagctaccatgtgagaccttccaaacctactctggtccctatagcatatcacaagtggtggaaaaccagcttcctcattgcctacctgcccatgactctaaacagcgcctcgacagcatatcatactgccagttgacaagggattgcttccctgaaaaacccgtgcctctgtctctgaatcagcaagagaataactccggctcctactcggtggagtccgaggtatataagcatctctctagtgaaaacaacacggcggaccatcaggcggggcacaaacaaaagcaccagaaacgcaagaggcatctggaggaagggaaggagcggccggaaaaggaacagtctaaacataagaggaaaaagtcttatgaagataccgacctggataaagataaatcaattaggcaacgcaaacgagaggaagatcgcgtgaaagtgagcagcggcaaactcaagcatcgcaagaaaaaaaagtcacatgacgtgcccagtgagaaggaagaaaggaagcacaggaaggaaaagaagaaatccgtcgaagagcgaacagaggaagagatgttgtgggacgaatccattttgggcttctag

SEQ ID NO: 22266 - DNA, 1917 bp, Artificial Sequence
  Description of Artificial Sequence: Synthetic coding sequence
atggagagctgcagcgtgacccggctggagtgcagcggcgccatcagcgcacattgctcactccacttgccaggcagctccgactcccctgcgtcagcaagccaaattgccgggactaccgacgccatttggaatgaacaggaaaaggccgagctgttcacagataaattctgccaagtctgtggggtcatgctgcagtttgagtcacagaggatctctcactacgagggagagaagcatgcccagaacgtgagtttttactttcagatgcacggtgagcaaaacgaagttccgggaaagaaaatgaaaatgcacgtcgagaatttccaggtccatcgttatgaaggtgtggacaagaacaagttctgtgatctgtgtaatatgatgtttagctcccctttaattgcgcaaagccactacgttggcaaagtccacgctaagaagttgaaacagctcatggaggagcacgatcaggcttctccatccggtttccaacccgaaatggcgtttagtatgcggacgtacgtgtgccacatttgttcaatcgcattcacatccctggacatgtttaggagccatatgcaagggtcagagcaccagatcaaggaatcaatcgtgataaacctggtgaagaatagtagaaagactcaggatagctaccaaaatgaatgcgcggactatatcaatgtgcagaaagcccgtggcctagaagcaaagacttgcttcaggaagatggaggaatcttctctcgaaaccaggagataccgagaagtagtggacagcaggccacggcatcgcatgtttgaacagcggctgccatttgagacttttcgcacctacgccgctccgtacaatatttctcaggccatggagaagcagctgcctcatagtaaaaaaacctatgattcgttccaggatgagcttgaggactacattaaggtgcagaaggctaggggtcttgaccccaagacatgcttcagaaagatgcgcgaaaattcagtggacacgcacggttaccgcgaaatggtcgatagcggcccacgttcaaggatgtgtgagcagcgcttcagccatgaggcgtctcagacataccagcgaccctaccacattagtcctgtcgagagtcagcttccccagtggctcccaacacattctaagagaacctacgatagcttccaggacgagctggaagactatatcaaggtgcagaaggcccgcggactcgagccaaagacctgctttcgtaagatcggagattccagcgtggaaacccacagaaaccgcgaaatggtggacgtgaggccacgtcatcggatgctagagcaaaagctgccttgtgagactttccaaacgtactcaggcccttactccattagccaggttgtggaaaaccaactgccccattgtttacccgcccatgatagcaagcagcgactagactcgatttcttactgtcagctgacgcgggattgtttccccgagaaacctgtcccattgtccctgaatcagcaggaaaataacagtggtagttacagcgttgaatctgaggtgtataaacatctgtcttccgagaacaacacagctgatcaccaggccgggcataagcaaaagcatcagaaacggaagcgtcatttggaggagggaaaagagagaccagagaaagaacagtcaaaacacaagaggaagaagtcctatgaggatactgatctcgacaaagacaagtccatcagacaacgtaaaagggaggaagatcgagtaaaagtgtctagcggaaagttgaagcataggaaaaaaaagaagtcacacgacgttccaagtgaaaaggaagagcgaaaacacaggaaagagaagaagaaaagcgttgaagaaaggactgaagaggagatgctttgggacgagtccatccttgggttttag

SEQ ID NO: 22267 - DNA, 600 bp, Artificial Sequence
  Description of Artificial Sequence: Synthetic coding sequence
atggccagcggcagcggcaccaagaacctggacttccggcggaagtgggacaaggatgaatacgagaagctggctgagaaacgcttgacagaagaacgtgaaaaaaaagacggaaagcctgtacaaccagtgaaacgcgaactcctacgacaccgagattataaagtggacctagagtcaaagctgggaaagactatcgttattacaaaaactaccccacaaagcgagatgggaggctattactgcaacgtttgtgattgcgtggtgaaggattccatcaactttctggatcacatcaacggaaagaagcaccagaggaacttgggcatgtctatgagagtcgagcgcagtaccctcgatcaggtcaagaagcgttttgaagtgaataagaaaaagatggaagagaaacaaaaggattatgatttcgaggagcgcatgaaggagttacgtgaagaggaagaaaaagctaaagcctacaaaaaggagaagcaaaaagagaagaagaggagagctgaggaagatctcaccttcgaggaggacgatgagatggcagctgtgatgggtttctccgggtttggttccacgaagaaaagttactag

SEQ ID NO: 22268 - DNA, 870 bp, Artificial Sequence
  Description of Artificial Sequence: Synthetic coding sequence
atgatcctgctgcagcacgccgtgctgcccccccccaagcagcccagcccgtctcccccaatgtcggtagccacccggtccacaggaaccctgcagctcccccctcagaagccttttggccaggaagcgtccttgcctctcgcgggcgaggaagagctgagcaaaggcggagagcaggattgcgcgctcgaggaactatgcaaacccctttattgcaagctttgcaacgtcactctgaacagcgcacaacaagctcaggcccattatcaggggaaaaaccacggcaagaaacttcgcaactattatgcagccaacagttgtccaccccctgctcgcatgagtaacgttgttgagcccgccgccactccagtggtgcccgtcccgccacagatgggatcctttaagcctgggggacgagtgattttggctaccgaaaatgactactgcaagctgtgtgatgcttctttcagtagcccggcggtggcccaagcccactaccaaggcaaaaaccacgcaaaaagacttcgattggccgaagcccagagtaactctttctctgagtcttccgagctaggacaaaggcgggctaggaaggagggaaacgaatttaagatgatgcctaaccgacgaaacatgtataccgtgcagaataatagcgccggtccgtactttaatccacggtccagacaaaggattccgcgcgacctggccatgtgtgtcactcctagtgggcagttttattgcagcatgtgcaatgttggcgcgggagaggaaatggagtttcggcaacaccttgaaagcaagcaacacaaatccaaggtcagcgaacagaggtaccgaaacgagatggagaatctggggtacgtctag

SEQ ID NO: 22269 - DNA, 447 bp, Artificial Sequence
  Description of Artificial Sequence: Synthetic coding sequence
atgatcctgctgcagcacgccgtgctgcccccccccaagcagccctccccttcccctcctatgtccgtggcaaccagatcaactggcaccttgcaactgcctccacaaaaacccttcggacaagaagccagtctgccgttggccggcgaggaggaactgtcaaaagggggcgagcaggattgcgccctcgaggagctttgcaaacctttatactgtaagctgtgtaatgtgaccttgaattccgcccagcaagcccaggcacactaccaaggtaagaaccacggaaagaagttgagaaactactacgcagccaatagttgcccacctcccgctcgcatgagcaatgtagtcgagccagctgcaactccagtggtcccagtcccgcctcagatgggttcattcaagccaggaggacgcgtgatccttgctacggaaaacgattactag

SEQ ID NO: 22270 - DNA, 867 bp, Artificial Sequence
  Description of Artificial Sequence: Synthetic coding sequence
atgatcctgctgcagcacgccgtgctgcccccccccaagcagcccagcccctcaccacctatgagcgtagccaccaggagcactggcacgctgcagctccctccccagaagccttttggtcaggaggctagtctccccttggccggagaggaggagttgagtaagggcggggagcaggactgcgcccttgaggaactatgcaaaccactgtactgcaaactatgtaatgtcacgctgaacagtgcccagcaggctcaggcccattatcagggcaaaaaccatggcaagaagttgcgtaattattatgccgccaacagctgcccacctcccgcacgtatgtcaaatgttgtggaacctgccgctactccagtagtgcctgtgccacctcagatgggatcattcaaacccggaggcagagtgatcctggccaccgagaacgattactgcaaattgtgtgatgcttcgtttagttcccctgccgtcgctcaggcacactaccagggcaaaaaccatgccaagagactccgcctagctgaggcgcagagtaactccttttccgaatcttcagaacttggacagaggagggcccgcaaagagggaaacgagttcaagatgatgcctaatagaagaaatatgtataccgtacagaacaattccggaccatactttaacccacggtcccgccagaggatccccagggatttagcaatgtgtgtcactccatccggacagttttattgttccatgtgtaacgtcggcgctggcgaagagatggaatttcgccagcatttggagtccaagcaacataaaagcaaggtgtctgaacaacgatatagaaacgagatggaaaacctgggttacgtatag

SEQ ID NO: 22271 - DNA, 690 bp, Artificial Sequence
  Description of Artificial Sequence: Synthetic coding sequence
atgaagagcagcgacatcgaccaggacctgttcaccgacagctactgtaaagtctgttccgcccaactgatttctgagtcccaaagagtcgcgcattatgagtcgcgcaagcacgcctccaaagtaaggctatattacatgttgcaccccagggatggcggctgtccagctaagagattgaggagcgaaaacgggtccgacgcagacatggtggataagaataaatgttgcaccctctgcaacatgtcttttacaagcgcagtcgttgctgattctcattatcagggcaagattcacgccaagcgattgaagttgcttttgggcgaaaagactcctctgaaaactactgctactccactgtcccctctgaaaccaccccggatggataccgctcctgttgtggcgagcccataccagaggagggatagcgatagatattgcggtctctgcgctgcctggttcaacaatcccctcatggcccagcagcattatgacggtaagaagcataagaagaatgctgcaagggttgctctgctggaacagcttggcaccactctagatatgggtgagctccggggcctgcgtcgcaactaccggtgtaccatatgcagcgtcagccttaattccatagaacaataccacgctcacctgaagggctccaagcaccagaccaatctcaagaataaatag

SEQ ID NO: 22272 - DNA, 462 bp, Artificial Sequence
  Description of Artificial Sequence: Synthetic coding sequence
atgaagagcagcgacatcgaccaggacctgttcaccgacagctactgcaaagtttgcagcgcacagctcatctccgaatcacagagagtggcccattacgagagccgtaagcacgcaagcaaggtgcgcttgtactacatgttgcatcctagagacggcggatgccccgccaagaggctcaggagcgagaacggtagcgacgctgatatggtcgacaagaataagtgttgcactctgtgcaacatgtctttcacatcggctgtagtggccgactcccattaccagggcaagatacatgcaaaaaggctaaaattactgctgggcgagaaaacgccattgaagacaaccggactgagaagaaattacaggtgtacaatttgttctgtcagcctcaacagtatcgaacagtaccatgctcacctgaagggttccaaacaccaaacaaacctgaagaacaagtag

SEQ ID NO: 22273 - DNA, 636 bp, Artificial Sequence
  Description of Artificial Sequence: Synthetic coding sequence
atgaagagcagcgacatcgaccaggacctgttcaccgacagctactgtaaagtctgctctgcccagcttatctccgagagtcagcgcgtggctcattatgagagtaggaagcacgctagcaaagtgcgactgtactacatgctccatcctagggatggtggctgcccggccaaaagactccgctctgagaatggttcagacgccgatatggtcgataaaaacaaatgttgtaccctgtgcaacatgtcatttacctcagccgttgtagcagacagccattatcagggaaaaatccacgccaagagactcaagctcctcctaggtgaaaagacccccctgaaaaccactgctacgcctttatcccctctaaaaccgccccgcatggatacggctcctgtagtcgcttcaccctaccagaggagggactccgaccggtattgcggtctctgtgcagcctggttcaataacccactcatggcacagcagcactacgacgggaagaagcacaaaaagaacgcagctagagtggctctactcgagcaactgggcacgacactagatatgggagaactgcgtggactgcgcaggaactacagatgtacaatctgtagcgtaagtctcaactcgattgagtag

SEQ ID NO: 22274 - DNA, 2685 bp, Artificial Sequence
  Description of Artificial Sequence: Synthetic coding sequence
atgaacagcatgaaccccatgaagcccgccctgccccccgccccccatggagatggatctttcgcctatgaaagcgtcccctggcagcaatctgctactcagccagctggatctctcagcgtcgtgacaactgtttggggagtgggcaatgcaacacaatctcaggtgttgggcaacccgatgggaccagccggttctcccagtggatcctccatgatgcccggtgtagccgggggcagctcagctctcacttctccacagtgccttggtcaacaggctttcgctgagggtggcgcaaacaaggggtatgtgcaacaaggagtttactcccgaggaggttacccaggcgctccagggttcacaacgggctacgcaggcgggcctggtgggctgggactcccctcccacgccgccagaccttccacggattttacgcaggctgcagctgccgccgctgtagcggccgcagccgcaacagctacagcgactgcaactgccacagtagcggctctgcaggaaaaacagagtcaggaactctcacagtacggagccatgggtgcaggccagtcttttaactcgcagtttcttcagcatggcggaccaagaggccctagcgttcctgccgggatgaacccaaccggaatcggtggagttatgggacccagcggcctgtcccctttagcgatgaacccaactagggctgccggaatgacacctctgtatgcaggacagaggttgcctcagcacggttaccccggccctccccaggctcagccactgccacgccagggcgttaagaggacctacagcgaggtgtatcctgggcagcagtacctgcaaggcggccagtacgccccttcaacggctcaatttgctccatctccagggcagcctccggcccctagcccgtcctatccagggcacagacttcccctacagcagggaatgacccaaagcctgtccgtgcctggcccgactggcctgcactataagccaacccgatcgatacctgggtatccctcatccccccttcctggcaaccctacccccccaatgacaccttctagtagtgttccttatatgtcgccaaatcaggaggtcaagagcccattcttgcctgaccttaagcctaaccttaattcactgcattcttccccctcaggcagtggcccttgcgacgagctgcgactcaccttcccagtcagagacggagttgtactcgagccttttcggctgcagcacaacctggcggtgtcaaaccacgtgttccagctgcgggattctgtttataagacattgatcatgagaccagacctggagctgcagttcaagtgttatcatcacgaggacaggcagatgaatactaactggcctgcaagtgtgcaggtgagcgtcaatgctaccccattgactattgaacgaggggacaataagacctctcacaaacctctgtatctgaaacacgtatgccagccgggccggaacactatccaaattactgtgacagcatgttgttgcagccacctgttcgtgttacagctggttcacagaccttctgtccgctctgtgcttcagggcctcctcaaaaagagattacttcccgcggaacactgcattacaaagatcaagcgtaatttcagttctggaactataccagggaccccaggccccaatggcgaggatggagttgaacaaaccgccatcaaagtgtcactgaagtgtccgatcaccttcagaaggattcaactgcctgctcggggccatgattgccgccacattcagtgcttcgatctcgaatcctaccttcagctcaattgtgagcggggcacttggcgttgtcccgtgtgtaataagaccgccttgcttgaggggctggaagtcgatcagtacatgttggggatccttatctacattcagaacagtgactatgaagagattaccatcgacccaacatgttcgtggaagcctgtgccggttaagcctgatatgcatattaaggaggagccagatgggcccgcgctgaaacggtgtcgaacagtctctccagctcacgtattaatgcccagtgttatggagatgattgccgccttgggcccaggtgctgccccttttgcccctttgcagccaccttctgttcccgcccccagtgattatcctggccagggctcctcctttctcggaccagggacctttcccgaaagcttcccacctaccaccccctcaacccctactttggctgagtttacacccggccccccacctatctcctatcagagtgacattccgagctccctcttgactagcgaaaaaagtaccgcctgccttccatcccagatggcaccagctgggcatctcgaccccacccataatccagggacaccagggttgcatacctcgaacttgggggcaccacctggtccccagctgcatcactccaacccccccccagcctctagacagtctctgggtcaggcttcacttggccccacgggtgagctggctttctctccagctactggtgtgatgggccctccaagcatgtccggagcaggagaggctcccgagcccgccctcgatctgctgcccgagctcactaacccggacgagctcctgtcctacctgggccctccggatctccccactaataacaatgacgacctattgtccctcttcgaaaataactag

SEQ ID NO: 22275 - DNA, 2763 bp, Artificial Sequence
  Description of Artificial Sequence: Synthetic coding sequence
atgaacagcatgaaccccatgaagcccgccctgccccccgccccccacggggatggatcattcgcctacgagtccgtgccctggcagcagtctgctacacagcccgccggcagtctcagcgtcgtgacaactgtatggggagttggtaacgccacgcagtcccaagtactaggtaacccaatgggcccagcaggctccccgtccggctcgtcaatgatgccaggagttgccggaggctcatctgcgctgacaagcccgcaatgcctcggccagcaggctttcgctgaggggggcgcaaacaaaggttacgtgcagcaaggcgtttactccaggggcggttatcctggggcccctggctttacaaccgggtacgctggcggtcctggcggcctcggcttaccatctcatgccgcacggccttctactgatttcacacaggctgccgccgctgctgccgtggcggccgccgcagctacggccaccgcaacagccactgccaccgtggcagccctgcaggagaagcagagtcaggagctctcccagtacggtgccatgggtgctggtcagtcatttaacagtcaatttctccagcatggaggtcctcggggtccctcagtgccagccgggatgaaccccacaggcattgggggtgtaatgggccctagcggactgtcccccctcgctatgaatccaacacgcgcagctggcatgacacccctgtacgctggtcaacgcttgccacagcacgggtaccctggacctcctcaggctcagccgttaccacgccagggcgtgaaacgaacctactcagaagtgtatcccggacagcagtaccttcaaggcgggcaatacgcccctagtacggctcagtttgctccgtcgccaggccagcccccagccccctccccatcctatcccggacatcgactgccgctgcagcagggtatgacgcagtctctgtccgtgccaggacctaccggcctccattacaagcccacagagcagtttaacggacagggcgccagcttcaatggcggttccgtgagctattcgcagccgggactctcaggtcccacacggagcattcccggttatccttcaagccctctgccagggaacccaaccccgccaatgactccatcctcttccgtgccctacatgtccccaaatcaggaagtaaaatcccctttccttcccgacctcaagcccaatctgaattccttgcattcatctccatccgggagtggaccctgcgatgaattacggttgactttcccagttagggacggcgttgtgctggaaccattccggctccaacataatctggcagtatctaatcacgtgtttcaattgcgggactccgtgtacaagaccctgattatgcgacctgatttggagctccagttcaaatgctatcatcacgaggacagacagatgaatacaaattggccagccagcgttcaggtttccgtaaatgccacacccctgacaatcgagaggggagataacaaaacaagccataagcccctgtacctcaaacacgtttgccaacctgggagaaataccatacaaatcactgttaccgcctgctgctgcagccatttgttcgtgctccaattggtacatagacccagcgttagaagtgtgctgcaggggctgcttaaaaagcggctcctgccggcagagcactgtatcactaagatcaagcggaacttctccagcggcacaattcccggcacccccggcccaaacggtgaggatggtgtggagcaaacggcgattaaagtttctttgaaatgtcctatcacgttccggagaattcaactcccagcacgcggacatgactgcaggcacattcagtgtttcgacctggagagctacttgcagctgaattgcgagcgcggaacgtggaggtgccccgtctgcaataagacggcgttacttgaggggctggaagtcgatcaatacatgctggggatccttatttatatccaaaacagtgattatgaggagatcacaatcgatcccacatgttcatggaaacctgttcctgtcaagccagacatgcacattaaagaggagcccgatggtccagctctgaaacgctgccgaactgtgtctcccgcccatgtcctgatgccctcggtgatggaaatgatagctgcccttggcccaggtgccgcccctttcgctccgctccaacctccctctgtaccagcaccatccgattatccaggacaggggagctccttcctcggccccggtacctttccggaaagctttccacctacaaccccctccaccccaacccttgctgagtttactcctggaccaccccctatcagctaccagtctgacattccctcctcactgctgacatccgaaaaaagcactgcatgccttccatcacagatggctccagccggccacctcgatcctacccataatcctgggacccccggtttacacaccagtaacttgggtgccccccccggcccacagcttcatcattctaatccaccccctgcctctaggcagagcttagggcaggcgtctcttggaccaacgggagagctggctttcagcccagccactggggtgatgggaccgccatctatgtccggggctggcgaggcacccgagcctgcacttgatctacttcctgagctcacaaaccctgatgaactactgtcatacttagggcctcctgatttgcctacgaataataacgacgacctgctttccctattcgaaaacaactag

SEQ ID NO: 22276 - DNA, 2772 bp, Artificial Sequence
  Description of Artificial Sequence: Synthetic coding sequence
atgaacagcatgaaccccatgaagcccgccctgccccccgccccccacggcgatgggtctttcgcatacgaatccgtgccttggcagcaatcagccacccaacccgcaggctcactgtccgtcgtgactaccgtgtggggagttggtaacgcaacccagagccaggtgctcgggaatccaatggggcccgcaggaagcccttccgggtcatccatgatgccaggcgttgccggcgggagctcagcactgacctcgccccaatgccttgggcaacaggctttcgcagagggaggagccaacaaaggttacgtccaacaaggagtgtactcaagagggggataccccggggcccccggttttacaacaggctacgcaggcggtcctggaggtctcggactccctagccatgcagcacgcccatcgaccgacttcacccaggctgcagcagccgccgccgtggccgccgccgccgctacagcaacggcaaccgccaccgccacagtggccgcactccaggaaaaacaatcacaggagttgtcccagtacggggccatgggggcagggcagtccttcaactctcagtttttgcagcatgggggccccagaggtccttcagtgccagccggcatgaaccccaccggaatcggcggcgtgatgggacctagtggactgtcgccactagccatgaacccaacaagggctgccggtatgacccctctttacgctgggcagcggctcccccaacatggttacccgggacccccccaggcccagcctcttccacggcagggagtgaaaaggacctattcagaggtttatccaggacagcaatatttgcaaggaggacagtacgcgccatcaaccgcccaattcgccccatcccctgggcagcctcccgcaccttccccatcttacccaggccatagattaccattacaacaaggaatgacacagagcttgtccgtaccaggcccaacggggcttcattacaagcccactgaacagtttaatggacagggtgcaagttttaacggaggcagcgtcagctattcacaacctggattaagtggacccacaaggtccatacccggctacccatccagtcccttgccagggaatccgacaccccccatgacccccagctctagcgtgccctatatgtctccaaatcaggaggtgaagagtccctttcttccagatctcaagcctaacctaaattcgcttcactccagtcctagcggatcaggtccatgtgacgagcttcgcctaacatttcccgtccgggatggcgtggtgctggagccctttcgcctccagcacaaccttgctgtgagtaatcacgttttccaactccgggattctgtgtataaaacactgatcatgcgacccgatctcgagctacagttcaagtgttaccaccatgaggatagacagatgaacaccaattggcccgccagtgtgcaggtgtccgtgaacgctactccactcacaatcgagagaggggacaataaaacttcccacaagccactgtacctgaagcacgtgtgcgcacgaccacagcatcaccctagcccttcccctcccgcggcagcttgcgttagctgcagccatctgtttgtgctccaattagttcatcggcctagcgtacggtctgtcctacagggactgctcaaaaagaggctgctgcctgctgagcattgcattactaaaattaaacggaacttttccagcggaaccatccccgggacacccggccctaatggagaagacggcgtggaacaaaccgctatcaaggtgagcctgaaatgtccgatcacattcagaagaatacagctgcctgctcgggggcatgattgcaggcacatccagtgtttcgatttagagagctatctgcagctgaactgcgaaagaggaacctggcgttgccctgtgtgcaacaagaccgcgctcctggagggacttgaggtggaccagtacatgctggggatcctcatatacattcaaaactcggattatgaggagatcactatcgaccctacgtgcagttggaagccggtgcctgtaaaacctgatatgcacatcaaggaagagccggacggccctgccctgaagcgatgcaggactgtctcaccggctcatgtgctgatgcccagtgtcatggaaatgatcgctgctcttggtcccggcgcagctccgtttgcccccctccaaccccctagtgttcccgcaccctccgactatcccggccaggggtcgtctttcttaggacccggcaccttcccagagagtttccctccaacaacaccttctacacccaccttggcagaatttacaccagggccccctccaattagctaccagtctgacattccatcctcactcctgacttctgaaaaatcgaccgcctgcctcccatcacagatggctcctgcaggacatttggaccccacacataaccctggcaccccaggattgcatacatcaaacctgggcgccccgccagggccacagctgcatcactctaacccacctcctgccagtagacagtccctgggtcaggcgtctttaggccctaccggagaattagccttttcgcctgctacaggagtgatgggaccaccctctatgtccggggccggcgaggcccctgagccagctctggatctgttacccgagctcacaaatcctgatgaacttctttcttacctgggaccaccagacctcccaaccaataataatgacgacttgctgtcactctttgaaaacaactag

SEQ ID NO: 22277 - DNA, 2763 bp, Artificial Sequence
  Description of Artificial Sequence: Synthetic coding sequence
atgaacagcatgaaccccatgaagcccgccctgccccccgccccccacggtgatggctcttttgcctacgaatccgtgccatggcagcagagtgccacgcagcccgccggcagcctctctgtggttaccactgtctggggggtaggcaacgctacacaatcccaggtcctgggaaatccaatgggtcccgcaggtagcccgagtggttcaagcatgatgccaggggttgctggggggtcctccgcattaacgtctcctcagtgcttaggtcagcaggcattcgcagaagggggggccaataaagggtatgtgcagcaaggcgtttactctcgcggggggtaccctggtgcacctgggtttaccacaggatacgcaggcggcccaggaggtttaggcctcccatctcatgcagccagaccatcaaccgatttcactcaagcagctgccgcagcagcggtggctgcggccgccgcgaccgcaactgctactgctacagccactgtggctgccctgcaggaaaagcagagccaggagctcagtcaatacggagccatgggtgccggtcagtcattcaattcccagtttttacagcacgggggccctaggggtccgtccgtgcccgccgggatgaaccctacaggaatcggcggcgtgatggggccctccggattgtctcccttggctatgaacccgacccgggcggctggaatgacacctctatacgcagggcaacgcctccctcagcatggatacccggggcccccccaggcccagcccctccccaggcagggtgtcaaacggacatattctgaagtctaccctggacagcagtatctccagggcgggcagtatgctcctagtactgcccaattcgctccaagccccggtcagccgcctgctcctagtccctcctaccccggacaccgactgcctctacagcaggggatgacacaatctctttccgttcccggaccaaccgggttgcattataagcccaccgaacaatttaacgggcagggagcctcattcaatgggggaagcgtgtcctactcccaacctggtctgtccggccccacaaggagcatccctgggtacccatcctctccactacctggcaaccccaccccccctatgacgcctagtagttcagttccatacatgtcacctaatcaggaagtgaagtcacctttcctgcctgatctgaaacccaacctgaactccctccattcaagtccgtcgggatcaggcccctgcgatgaactgcgactcacttttcctgtgcgcgacggagttgtactcgagccgtttagacttcagcacaacctggccgtgtccaaccatgtgtttcagctgcgcgacagcgtctacaagacacttataatgaggcctgacctggaactacaattcaagtgctatcaccacgaggatcggcagatgaatacaaattggcctgcaagcgtccaggtaagcgtgaatgcaactccacttacaatcgaaaggggggataacaaaacgtcccataagcctttgtatctcaagcacgtctgccagccaggcagaaacacgattcagataacagttactgcgtgttgctgttctcatctgtttgtgctgcagctagtgcacagacctagcgttagaagcgtccttcagggtctcctaaaaaaaagactgcttcctgcggaacactgtataactaaaataaaacgtaatttctcaagcggtacaatccctggaacccccggtcccaacggagaggacggcgtagagcagacagctattaaggtatcactgaaatgtccaatcacgttcagaagaatccaactgcccgctagagggcacgactgtcggcacatacagtgctttgacctcgaaagttatctgcagctcaactgtgagagaggcacttggaggtgccctgtttgcaacaaaacagcccttctcgaggggttagaagtcgatcagtacatgctgggaattcttatctacattcaaaatagcgattatgaggaaatcacaattgaccccacatgcagttggaagcccgttcctgttaagcccgacatgcacataaaggaagagcccgatggccctgcgcttaaacgatgccgcacagttagcccagcccacgtcctgatgccttcggtcatggagatgatagccgctctgggtccaggcgctgctcccttcgcacctttgcagcccccctcagtgcccgcaccctccgactaccctggccagggctcatcattcctcgggcctgggacctttcccgaaagctttcctccaaccaccccctctactcctacactggctgagtttacacccggcccacctccaatcagttaccagtcggacattccaagctcccttctaactagcgagaagtccacagcttgcctgccatcacagatggcacctgccgggcacttagaccccactcacaaccccgggactccggggttacatactagcaatctcggcgccccccccggtccgcagctgcaccactctaaccctcccccggcctccagacaaagcctggggcaggcatcactggggcccaccggtgagttagccttcagcccagcgaccggggtcatggggccaccgagtatgtctggggccggcgaagccccagagccagcacttgaccttctgccggagctgaccaacccggatgagctgctatcttatttgggccccccagatctaccaactaacaataacgatgatttgctgagtttgttcgaaaacaactag

SEQ ID NO: 22278 - DNA, 273 bp, Artificial Sequence
  Description of Artificial Sequence: Synthetic coding sequence
atgaacagcatgaaccccatgaagcccgccctgccccccgccccccacggagatggatcctttgcctatgagagcgtgccttggcagcagtcggccactcagcctgccggcagcttgtcggtggtgactacggtttggggggtgggcaatgccactcagtcccaggttctgggcaacccaatgggcccagctgggagcccctctggtagctccatgatgcccggcgtggcaggtggcagtagtgccctgacgtcacctcagtgtctggggtag

SEQ ID NO: 22279 - DNA, 3429 bp, Artificial Sequence
  Description of Artificial Sequence: Synthetic coding sequence
atgaaggagcccctgctgggcggcgagtgcgacaaggccgtggcctcacagctgggtcttcttgacgaaattaaaaccgaaccggacaacgcccaagagtactgccatcgacagcaatctagaacacaagagaacgaattgaaaattaatgctgtcttttcagagtccgctagtcagttgacagccggaatccagctctcccttgctagcagtggggtgaataagatgctaccgtccgtttcaaccaccgcaatccaggtaagctgcgcaggatgcaagaagatcctccagaagggccagactgcgtaccagagaaagggaagcgcccagttattttgctccataccatgcataactgagtacatctcctccgcatcatctcccgtgccaagtaaacgcacatgcagcaactgcagcaaagacattctgaaccccaaagatgtgatctcggtgcaactggaagacacaacatcttgcaagactttctgcagcctttcatgcctgagtagttatgaagaaaaacggaaacccttcgtcacaatttgcaccaactcgattttgacaaagtgttccatgtgccagaagacagccattatccaatacgaggtcaagtatcaaaacgtcaagcataatttgtgcagcaatgcgtgtcttagtaaatttcacagtgccaacaacttcatcatgaactgctgtgaaaattgtggcacctactgttacacaagctcctctctgagtcacatcttacagatggaaggccagtctcattattttaactcctcaaagagtattacagcgtataagcagaaaccagcaaagccactgatctctgtgccctgcaaacccctgaaaccatccgatgagatgattgaaacaacctctgatctcggaaagacagaactgttttgtagtatcaactgcttctctgcttactccaaagctaagatggagtcctcgtccgtgagcgtggtgtccgtggtgcacgatacttcaacagagctgctttcccctaagaaggatacaacacctgtgatctctaatatcgtgtctctggctgacactgacgtcgcactccccattatgaatacagacgttctgcaagatacggtatcttcggtcactgccactgcggacgtgatagtggacttgtcaaagtcctcgccgagcgaaccttctaacgccgttgcaagttcctcaacggaacagccaagtgtgtccccttcttcatccgtgttcagtcagcatgccatcggctcatctaccgaagtgcaaaaggacaacatgaagagtatgaagattagcgatgagctgtgccaccccaaatgtacctctaaggtccaaaaagtaaaaggcaaatccagatccatcaaaaaatcgtgctgcgccgactttgagtgcctggagaacagtaaaaaagatgtggccttttgttatagctgccagctattctgccagaaatacttttcctgtggaagggagtctttcgcaactcatggcacctcaaactggaaaaagactctggaaaaattcaggaaacacgagaagagcgaaatgcatctcaagtctctggaattctggagggaataccagttctgcgatggcgccgtttcggatgacttgtccatccatagtaaacagatcgagggtaataaaaaatatctcaagctaattattgagaacatcttgtttctgggcaaacagtgtctgccgttgcgggggaacgaccagtctgtcagctccgtgaacaaaggaaatttcttggagctgctggagatgagggccaaagacaaaggtgaggagacctttcgcctgatgaattcacaggtggacttttacaacagtacccagattcagagtgatatcatcgaaataataaagactgaaatgctgcaagatattgtcaatgagatcaatgattcctcagctttcagtattatctgtgacgaaacaattaactctgcaatgaaggagcagcttagcatctgcgttaggtatccacaaaagagttcgaaggccatcctgattaaggaacgcttcctcggttttgtagacacggaggaaatgacagggacccatcttcataggaccattaagacctacctccagcagatcggggtcgacatggacaaaatccacgggcaagcatacgacagtaccactaacctgaagatcaagtttaataagatcgccgctgaatttaaaaaagaagagccgagggcactttatatacactgttacgcacacttcctggacctgtctatcatacgtttctgtaaggaggttaaggaactgcggtcagctctgaaaaccctctcctctctattcaacacgatttgcatgagtggcgagatgcttgctaatttcagaaatatttaccgattaagccagaataagacctgcaagaagcatattagtcagtcttgttggacagtgcacgacagaactttgcttagtgtcattgattccctgcctgaaatcatcgaaactcttgaggtgatagcttcccactcttcgaatacctccttcgcagatgagctgagccacctgttaaccctcgtgtctaagttcgaatttgtcttttgtctgaagttcctctacagggtgctgagtgttactggcattttgagtaaggagctgcaaaataaaaccatagacattttcagtcttagctcaaaaatagaagccatactcgaatgtctatcgtcggaacggaatgacgtgtattttaaaacaatttgggacggaaccgaagaaatttgccagaaaattacatgcaaaggatttaaagtcgagaaaccgtctcttcagaagaggcgcaaaatacagaaatccgtcgatctgggcaacagcgataacatgttttttccgacttccactgaggagcagtataaaattaatatttattatcagggcttggacacaatactgcagaacctgaagctctgtttcagcgagttcgactactgtaaaatcaagcagatcagtgagctgctttttaaatggaacgaaccgttgaacgaaaccactgcaaagcatgttcaggagttctataaactcgacgaggacataatccctgaactccgtttttatcggcactatgcgaagcttaacttcgtcatagacgacagctgcatcaactttgtctctttagggtgtctgttcattcaacacggtcttcacagcaatataccatgtctgtcaaagttactttatatagccctgtcttggccaattacttcagcatccactgagaactcattcagcaccctccctcggcttaagacctatctgtgtaacactatgggtcaggagaagttgaccggccccgcactgatggctgtagagcaggaactcgtcaacaaacttatggaacccgagcgcctaaatgaaatcgtggaaaagttcattagtcagatgaaggagatttag

SEQ ID NO: 22280 - DNA, 3204 bp, Artificial Sequence
  Description of Artificial Sequence: Synthetic coding sequence
atgctgcccagcgtgagcaccaccgccatccaggtgagctgcgccggatgcaaaaaaatcttacagaagggccagaccgcttatcagcggaaggggtccgcccaactattttgtagcataccatgcattaccgagtacattagctccgccagttcccctgttcctagtaagcgcacttgctcaaactgttctaaggatatactgaaccctaaagacgtgatttccgtgcagctcgaggatacaacttcttgcaaaacattttgttccctgtcgtgcctctcttcatatgaggaaaagagaaaaccgttcgttacaatctgcacgaattcgatcctgacaaaatgctccatgtgccagaagactgcaattattcaatacgaagtgaaatatcagaatgtgaagcataacctctgttcgaatgcatgcctgagcaagttccatagcgctaataactttatcatgaactgttgcgagaactgtgggacgtactgttacacctctagttccctgtcgcatattctgcagatggaaggccagagtcactactttaacagctccaaatccattaccgcttataagcaaaaacctgccaaacctcttatttctgtcccatgtaaacctctgaaaccgagcgacgaaatgatcgagaccaccagtgatctcggtaaaacagaacttttctgctctattaactgtttctcagcttactctaaggccaagatggaaagctctagcgtgtccgtagtgtccgtggtccacgacaccagcacagagctgttatctccgaaaaaagataccacccccgtgataagtaatattgtatctttggccgacacagacgtcgccttgccaataatgaacacagacgtactacaggacactgtctcctcagtgacagccaccgcagacgtgatcgtcgatctgtcaaaatccagcccttctgaaccaagtaacgccgtggccagtagctccaccgagcagccttctgtgtccccatcatcgtcagtgttctcccaacacgctattggatcctccacagaagtgcagaaggacaacatgaagagcatgaagatctctgacgaactttgtcatcccaagtgcacgtcaaaagtgcagaaagtcaaaggaaagtctagatcaatcaaaaaatcttgctgcgctgatttcgagtgtctcgagaactccaaaaaagacgttgccttttgttactcatgtcagcttttctgtcagaaatacttctcttgcggccgggaatcattcgctacacacggtacaagcaactggaagaaaaccttagagaaattccgaaagcatgagaagtctgaaatgcacctgaaaagcctcgagttctggagggagtatcagttttgcgacggagcagtttccgatgacctgagtattcactcaaagcagatagagggaaacaagaaatacctgaaactcattatcgaaaatatactgttccttgggaagcagtgcctgccattgaggggcaatgaccagtcagtgtcgagtgtgaacaaagggaattttctggagttgctggaaatgcgcgcgaaagataagggggaggaaacttttcgactaatgaattcacaggtcgatttctacaattctactcagatccagagtgatatcatcgaaatcataaagacagagatgttgcaggacatcgtcaacgaaattaatgacagcagcgctttttccatcatctgcgatgagacaataaatagtgccatgaaagagcagttatccatctgcgttcggtacccacagaaaagtagtaaagccattctgattaaagaacggtttctgggattcgtcgataccgaggagatgaccggaacacacctgcatcggactataaagacctatctgcaacaaattggggtagatatggataagatccacggacaggcctatgacagcacaactaacctgaagatcaaatttaacaaaattgctgcagagttcaagaaggaagagccccgcgccctgtacatacactgctatgcacacttcctcgatttgagcataattaggttttgcaaagaagttaaggagctccggtcagcattgaagactctctccagcctgttcaacactatctgtatgagtggcgagatgctggccaacttccgaaacatatatagactaagtcagaacaagacgtgtaagaagcacattagccaaagctgttggacggtacatgaccgcacccttctgtctgtgatagactccctgcccgaaatcatcgaaaccctcgaggtgatcgcctcacactccagtaacacaagcttcgccgacgagttgtctcatttattgacactggtttctaaattcgaatttgtattctgccttaagtttctttaccgcgtgctgtccgtcacggggattctcagcaaagaattgcagaataaaactatcgacatctttagcctctcttccaaaattgaggcaattttagagtgcttgagttccgagcggaatgacgtctattttaagacaatttgggacggcaccgaagagatttgtcagaagataacgtgcaagggattcaaagtcgaaaaacccagcctccagaaaaggaggaagattcagaagagtgtggacctcgggaactctgacaacatgttttttccaacctccactgaagaacagtacaagatcaatatatactatcaggggttggacaccattctccaaaacctgaagctttgcttctccgaattcgactactgcaaaattaagcagatatccgaactgttgttcaaatggaatgaacctctgaatgagacaacagccaaacatgtgcaggaattctacaaactggacgaggatattatccccgagttaaggttttataggcactacgccaagctcaatttcgtcattgatgattcctgcataaattttgtctcactgggatgcctgttcattcagcacgggctgcacagcaacattccttgtctgtcgaagctgctgtatatagccttaagctggcccattaccagcgcaagcactgagaacagctttagcacgctgccaagattgaagacctatctgtgtaatacaatgggtcaggagaagctcaccggcccagccttgatggctgtcgaacaagagctggtcaacaaattaatggagcctgaacgactgaacgaaatagtagagaagtttatctcccaaatgaaggagatatag

SEQ ID NO: 22281 - DNA, 3429 bp, Artificial Sequence
  Description of Artificial Sequence: Synthetic coding sequence
atgaaggagcccctgctgggcggcgagtgcgacaaggccgtggcctctcagctgggcttgttagatgaaataaagaccgagcctgataatgcccaggagtattgtcatcgacagcagagccgtactcaggagaacgaattgaagattaacgccgttttttctgaatccgccagtcaactgacagctgggatccaattatccctagcctcctccggcgtcaacaaaatgttgcccagcgtctcaaccacagcaatccaagtctcttgcgccggctgtaagaaaatactccagaaagggcagactgcataccaacgcaaaggctctgcacagctcttctgcagcatcccatgtatcaccgaatatatctcctcggcctctagcccagtgccctccaaacggacctgctccaactgtagcaaggacattctgaaccctaaggacgtcatctcagtgcagttagaagacaccacatcttgtaagacattttgttcactgtcttgcctgtcaagctatgaagaaaaacggaaaccctttgtaacaatctgcaccaacagcatcctcaccaaatgctctatgtgtcagaaaacggctattattcagtatgaagtgaaataccagaatgttaagcacaatctctgttccaacgcttgtctgtcaaaatttcattccgccaataattttattatgaattgttgcgagaattgtgggacttattgctatacatcttcatctctctctcatatccttcagatggaggggcagtcccattattttaatagctcaaagagtataaccgcgtacaagcagaagcctgcaaaaccgttaatttccgtcccatgtaagcccctgaaaccatcagatgaaatgatcgaaactacctccgatttggggaaaacagaactgttctgtagcatcaactgtttcagcgcatatagcaaggcgaagatggagtcatcaagcgtgtcagtcgttagcgtagtgcatgacacatccaccgagctgctgagccctaaaaaggacacaactcccgtaatctccaacattgtcagccttgcagacactgacgtggccctgcctatcatgaatactgacgtacttcaggacacggttagctctgtcacggctacagcagacgtgatagtggatctatccaaaagctcacctagcgagccctccaatgctgtcgcttcttcatcgaccgaacagccctccgtcagtccttcatcatcagtattcagtcaacacgccatcggtagctccactgaggtacagaaggataacatgaagtcaatgaaaatcagtgacgagctgtgtcatcccaaatgtacatcaaaggtccaaaaggttaaaggcaagagcaggagtatcaaaaagtcttgttgcgcggattttgaatgtctggagaactcaaagaaggatgtcgccttttgctacagctgtcaattgttttgtcaaaaatatttctcttgcggccgagaatctttcgctacacatggcactagcaattggaagaagaccctggaaaaattcaggaagcatgagaaatctgagatgcatttaaaaagtctagagttctggcgtgagtaccagttctgcgatggcgctgtgtccgacgacttatccatacatagcaagcaaattgaagggaataagaagtacctcaaactcattatcgagaatattctattcctcggtaagcagtgcctgcccctcaggggaaacgaccagtctgtgagctccgtgaataaggggaactttcttgagctcttagaaatgagagcaaaggataaaggggaggagactttcagattaatgaacagccaggtggacttctacaacagcacccagatccagtctgacattattgagattatcaaaaccgaaatgcttcaggatatagtgaacgaaatcaacgacagcagtgccttctccatcatttgtgacgagacgattaacagtgccatgaaagaacagctgagtatctgcgtccggtaccctcagaagagctcaaaggccatccttatcaaagagcgttttttgggatttgtggacacggaggagatgacgggcacccatctgcaccggacaattaagacatatcttcaacagatcggcgtggatatggacaaaatccacggacaggcctatgattcaacaactaatctgaaaattaagttcaataagattgctgctgagttcaagaaagaggaacctcgagcactgtatattcactgttacgcacatttcttggatttatccattatacggttctgcaaggaagtgaaggagttgaggtcagcccttaagacactgtctagcctatttaacacaatatgtatgagcggcgagatgttggcgaactttcgcaatatctaccggctgtcccaaaataagacttgcaaaaaacacatttcccagtcctgctggacggtgcacgatcggaccctgctctctgtaatagattcactgcccgagattattgaaacactcgaggttatagccagccacagctctaacaccagctttgctgatgaactcagccaccttttaacccttgtgagtaaattcgagtttgtattttgcctgaaattcctgtatcgcgtcttgtcagtgactggtattctctcgaaggagctccaaaataagactatcgatatcttcagcttgtcttcaaagatagaggcaattcttgagtgtctcagctccgaacggaatgatgtttatttcaaaaccatttgggatggcacagaagaaatctgccagaagatcacctgcaaaggctttaaagttgagaaacccagtctgcaaaagcggaggaaaatacagaagtctgtcgatttggggaattctgacaacatgttctttcctacatcgaccgaggaacagtataaaattaatatctattatcaggggctcgacacaattttgcaaaaccttaaactgtgcttttcagaattcgactactgtaaaattaagcaaatttccgaattactgttcaagtggaatgaacctctgaacgaaactaccgctaagcacgtacaggaattttacaagctggacgaagatataattccagaactacggttctacagacactatgcaaagttgaacttcgtaatcgatgactcttgtattaactttgtctctctgggttgcctgttcattcaacatgggttacactcaaatatcccttgcctgtcaaagctactctatattgcactttcttggcccatcacttccgcgtctaccgaaaatagtttttcaactctgcccaggcttaagacttacctctgcaacacgatgggtcaggaaaagttgactggtccggcacttatggctgttgagcaggaacttgttaataagctgatggaacccgagagactaaatgagatagtcgaaaagtttataagtcaaatgaaggagatttag

SEQ ID NO: 22282 - DNA, 1389 bp, Artificial Sequence
  Description of Artificial Sequence: Synthetic coding sequence
atgaaggagcccctgctgggcggcgagtgcgacaaggccgtggcctcacagctgggcctgctggacgagatcaaaacagaacctgacaatgcccaggagtactgtcatagacagcaatctagaacccaggagaatgagcttaaaataaacgccgtttttagtgaatccgcttcacaactgaccgctggcattcagctgagcctggctagttctggtgtgaacaagatgctccctagcgtttcaactaccgcaattcaggtgtcttgcgctggctgcaagaagattctgcagaagggacagactgcttaccagcgaaaggggagcgcgcagctgttctgctccattccttgcattacagaatacatctcctcagctagttcacctgtacccagcaaacgcacatgctctaattgctctaaggatattttgaacccaaaggacgtcatctcagtgcagcttgaggatacaacatcgtgcaaaacgttttgctctctctcctgcctgagctcctacgaagaaaaacgcaagcctttcgtgaccatatgcaccaacagtatccttaccaaatgcagcatgtgtcagaagacggcaattattcagtatgaagttaagtaccaaaacgtgaagcacaacctgtgcagtaacgcctgtttgagcaagtttcattctgctaacaacttcataatgaactgctgcgagaactgcggtacttattgttatacttcgtcctccctgtcacatatactgcaaatggaaggccaaagccattattttaacagcagcaagtccatcacagcttacaaacagaagcccgccaaaccattaataagcgtgccttgtaaaccactcaagcccagcgacgagatgatagagaccaccagtgaccttggcaaaacagagttattttgcagtatcaattgttttagtgcctacagtaaggcaaaaatggagagcagttccgtctccgtggtgtctgttgtgcacgacacctcgaccgaactcctgtcccctaaaaaggacacaacgcctgtgatcagcaatatcgtgagtttagcagatactgacgtggcactcccaattatgaacacagacgtgttacaggatacagtttccagcgtgactgcaaccgccgacgtgatcgtcgatttaagcaagagctccccatccgagccctctaatgccgtcgcatcatccagcactgagcagccgtcagtgtcacccagctccagcgtgttttcacaacatgcgattggaagttctaccgaggtacagaaggacaatatgaaatcaatgaaaatatccgacgagctgtgtcaccccaaatgtaccagcaaggtgcagaaggtgaaaggaaaatctaggtcgattaagaaatcctgttgtgcatag

SEQ ID NO: 22283 - DNA, 2010 bp, Artificial Sequence
  Description of Artificial Sequence: Synthetic coding sequence
atggagaagtgcagcgtgggcggcctggagctgaccgagcagaccccagccctcttaggcaatatggcaatggccacgtcactaatggatataggcgactccttcgggcaccctgcctgccccctcgtctctagatcacgtaatagccctgtggaggatgacgacgatgacgacgatgtcgtgttcatcgaaagcatacaacccccatctatcagtgcccctgccattgccgatcaaaggaatttcatattcgcctcaagtaagaacgaaaagccgcaggggaattatagcgttattcctccctctagcagagatctggccagtcagaaagggaatatctctgaaaccatagtaatagacgatgaggaggatatcgagactaatgggggagccgagaagaaatccagctgtttcatagagtggggattaccaggtactaagaataagactaacgaccttgatttcagcactagctctctgagccgctcaaagactaaaactggtgtgcgccccttcaaccccggtcgtatgaacgtcgcaggtgacctgtttcagaatggtgagttcgctacacaccactctcccgatagttggataagccagtctgcgtcgtttccaagtaaccagaaacagcccggagtggactctctctccccagtagcgctgctcagaaagcagaattttcagcctacagctcagcagcagcttacgaagcccgcaaaaatcacttgcgctaattgcaagaagccgttacaaaagggacagactgcgtatcagaggaaagggtctgctcatttattttgtagcacaacatgcctgtcctccttctcccacaagcgaacgcagaatacacgctccattatatgtaagaaagatgcctctacaaagaaggcgaatgtcattctgccagtcgagtcatctaagagcttccaggagttttacagcacatcctgtctgagcccctgcgagaacaattggaacttgaaaaaaggggttttcaacaaaagcagatgcacaatctgttctaagctggcagagattcggcatgaagtctctgtcaataacgtgacgcataagctctgctcaaaccattgtttcaataagtatcggctggccaacggactaatcatgaattgttgcgagcattgcggcgaatacatgccttccaagtctactggcaacaacatcctggtcatcggcggacagcagaagcgattttgctgccaatcctgtataaacgagtataaacaaatgatggagaccaaatccaagaaacttactgcctctgaaaataggaagaggaatgcttttagggaagagaatgaaaagcaactctacgggagttcgaataccctgctcaaaaaaatcgagggtatcccggagaaaaaagaaaagacttcccagcttcagttgtccgtcgagtgcggaacagacacccttttgatccaggagaatgttaatcttcccccttcttccacctccactatcgccgatacatttcaggagcagctggaagagaagaacttcgaggacagtatcgtacctgtagtgctgagcgcagaccccggtacatggccccgcattctaaatattaagcagcgggacaccctcgtggagaatgtgcctccacaggttaggaattttaacttcccgaaagataataccggccgcaagttctcagagacctactatacccgcatcttgcccaatggagagaagaccacacggagctggttgctctattcaacatcaaaagattccgtgttctgcctgtattgtaagttgttcggtgaggggaaaaaccaactaaaaaatgagaacggctgtaaagactggcaacacctgtctcacattctctcaaaacacgaggaaagcgagatgcatgttaacaacagcgtcaagtatagtaaactgaagtccgacttgaaaaagaacaaggctatcgatgcagcagagcaccggctgtacgagaacgagaaaaacgacggcgtattactgttatatacctag

SEQ ID NO: 22284 - DNA, 1149 bp, Artificial Sequence
  Description of Artificial Sequence: Synthetic coding sequence
atggagaagtgcagcgtgggcggcctggagctgaccgagcagacccctgccctcttaggcaacatggctatggctacgtcactaatggatattggagattcctttgggcatccggcatgtcccttagtgagcagaagccgcaactcacccgtggaggatgacgacgacgacgacgatgtggttttcatcgagtccatccagccgccttctatctcagcccccgcgattgccgaccaacgcaacttcatcttcgcgtcaagtaagaacgagaagccccaaggaaattattcagtcattcctccttcgagcagagaccttgcttcccagaaggggaatatctccgagactattgtgattgatgatgaggaagacattgagaccaatggtggagcagagaagaaaagtagctgtttcatagaatggggactgccgggcacgaagaataagaccaatgacctggacttctcaacatcctctctctcccgttctaaaactaaaacaggggttcggccatttaatcctggccgcatgaatgtggctggcgacctctttcagaacggcgagttcgcgacccaccactctcctgacagctggatttcacagagcgcatctttccccagcaatcagaagcagcccggggtggactccctgagcccggtcgctctcctcagaaagcagaatttccagcccacggcacaacagcagctgaccaaacctgctaaaataacatgtgcgaactgcaagaaacccctacaaaaagggcagactgcttaccagcgcaagggttcagctcacctgttttgtagcaccacctgccttagctcattctctcataagcgtacacagaacacgcgtagtatcatatgtaaaaaggacgcctctactaagaaagcaaatgtgatccttccagttgagtcctccaaaagtttccaggagttttactcaacctcgtgtctgtccccttgcgaaaataactggaacctcaagaaaggcgttttcaacaagagcaggtgtactatctgctcaaagctcgccgaagtgtggatcttcatacctaagctgctgtttcgactgactgtcataatcctgaccttcaagtgctattatgtcctgttccaccttcacaacgcccgagtcctggacgtctag

SEQ ID NO: 22285 - DNA, 627 bp, Artificial Sequence
  Description of Artificial Sequence: Synthetic coding sequence
atggagaagtgcagcgtgggcggcctggagctgaccgagcagaccccagcattgctcggtaatatggctatggcaacatctctgatggatatcggggactcattcggccatcccgcttgtccactggtctcaaggtcccggaactcgccagtcgaagatgacgatgatgatgacgacgtagtgtttattgagagcattcagcctcccagcatttctgcgccggctatcgccgaccagcgaaactttatctttgcatcttcaaagaacgaaaagccacagggcaactactccgtgatccccccctcatcacgggacctcgccagccagaagggaaacatctctgaaaccatagtgatcgacgatgaagaagatattgaaactaatggtggagctgagaaaaagtcttcttgcttcattgagtgggggttgcctgggaccaagaataaaacaaatgacctggactttagcacctcctctctgtcacggagtaagacaaagaccggagtgcgtccatttaatccagggcgtatgaatgttgccggagaccttttccaaaatggcgaatttgcaacacaccactctcctgagatgcatctgcagaggcggttaatgtccttcttccagtag

SEQ ID NO: 22286 - DNA, 513 bp, Artificial Sequence
  Description of Artificial Sequence: Synthetic coding sequence
atgaaggagcccctggacggcgagtgcggcaaggccgtggtgccccagcaggaactcctggacaaaattaaggaggaaccagacaacgcacaggagtacggatgtgtccagcagccaaaaacccaggaatctaagttgaagatcggcggagtttcaagcgtaaacgaaaggccaatcgctcaacaacttaaccctggttttcagctctctttcgcctcctcagggccatccgttctgctacccagtgtgcccgccgtcgccattaaagtcttttgtagtggctgtaaaaagatgctgtataaaggacaaactgcatatcataaaaccggttcaactcaactgttttgctctaccaggtgtatcacacggcattcttcccctgcatgcttgccccctccacctaagaagacatgcactaactgtagcaagtacaagattctgaatatcccattctactttacattcttcctcgtctgcattttgtttagtagcaatattttgctgatcctgtag

SEQ ID NO: 22287 - DNA, 3978 bp, Artificial Sequence
  Description of Artificial Sequence: Synthetic coding sequence
atgaaggagcccctggacggcgagtgcggcaaggccgtggtgccccagcaggagctcctcgacaaaatcaaggaggaaccagataatgcgcaggaatatggctgcgttcagcagcctaagacccaggagtccaagcttaaaattggcggcgtctctagcgtgaacgagcggcctatcgctcagcaacttaaccctggcttccagttgtctttcgcctccagcggtccaagtgttctgcttccttcagtaccagccgtggctatcaaggtgttctgcagtggatgcaaaaaaatgttgtacaagggtcaaacagcttaccacaaaacaggctctacacagttgttttgctctactcgctgtattactcggcactcttctcccgcctgccttccccccccccctaagaagacttgcaccaattgctcaaaggacatcctgaatcctaaggatgtcatcacaacaaggtttgagaactcatatccttccaaagatttttgctctcagtcatgtctgtcttcttacgaactgaagaagaagcctgtcgtgactatttacacaaaatccatcagtacaaagtgcagtatgtgccagaagaatgcagacaccagattcgaagtgaagtaccagaacgtggtgcatggactttgtagcgatgcctgcttcagcaaattccatagcacaaacaatttgacgatgaactgctgtgagaattgcggttcatactgctacagctcgtcagggccgtgccagagccaaaaagttttttcttcgacctccgtgacagcatacaaacagaatagtgcccaaatcccaccctacgctctgggcaagagtctgaggcctagtgccgagatgatcgaaaccacaaatgactcagggaagactgaacttttttgttctatcaactgcctctctgcatatcgagttaagaccgtgacttcaagcggcgtgcaggtcagctgccattcgtgtaagacaagtgccataccccaataccatctggcaatgagcaatggaaccatttatagtttttgctcctcttcctgtgtggtggccttccaaaacgtattcagcaaacccaagggcaccaactccagtgctgttccactgtcccaaggccaagtggtcgtcagccctccatcctctaggtccgccgtgtcgattggcggcggcaatacttccgccgtgtctccttctagtatccggggcagcgccgcagctagtttgcagccacttgcggagcagagccagcaggttgctctcacccataccgtggtgaagttaaaatgtcagcactgtaatcatctgttcgctacaaagcccgaactgctgttctacaagggcaaaatgtttctgttttgcggcaaaaactgctccgatgaatataagaagaagaacaaggtggtcgcaatgtgcgattactgcaagctacagaaaattattaaggagactgtgaggttctcaggcgtcgacaaacccttctgctccgaagtgtgtaagtttttatctgctcgagatttcggagagcggtggggcaactactgcaagatgtgttcttactgctctcaaaccagtcccaatctggtcgagaacagactggagggtaagttggaagaattctgctgcgaagactgcatgtccaagttcacagtgcttttttaccagatggcgaagtgcgacggttgtaagcggcaaggtaagctgtctgaatccattaaatggcgcggcaatatcaaacacttctgcaacctgttctgcgtcctggaattctgtcaccagcagataatgaacgattgcttgccacagaataaagtgaacatctcgaaggcaaaaacggcggtgactgagttgcccagtgctcgcacggacaccactcctgttataacctcagtgatgtcactggcgaagatccctgccacattatccacaggaaataccaattccgtactgaagggcgccgtcacaaaagaggccgccaaaatcatccaggatgagtcgacgcaggaagatgccatgaagtttccctctagccagtcttcgcaacccagccgcttgctaaagaataagggtatttcctgtaaacctgtcacacagacaaaggcaacctcctgtaaaccacacacccagcacaaggaatgtcagactgatttgcccatgccaaacgaaaaaaatgatgcagagttagattcccccccaagcaaaaagaaacgcctcggattctttcagacatatgacaccgagtatctcaaggtaggtttcattatatgccccggatctaaagaaagctccccccggccccagtgcgtgatttgtggtgaaatactcagtagcgaaaacatgaaaccggccaatctgtctcaccacctgaaaacaaagcatagcgaattggagaataaaccggtggactttttcgagcagaagtccctagagatggagtgtcagaacagttccctaaaaaaatgtttactggttgagaaaagcctggtgaaagcatcttacctcattgcctttcagaccgcagcctctaagaaacctttcagtatagccgaggaactgatcaaaccatacctggtcgaaatgtgtagcgaggtactaggatcgtccgctggggataagatgaagacaattccactgagcaacgttacaattcagcataggatcgatgagctgtccgctgatatagaagatcagcttattcaaaaagtgagagagagcaaatggttcgcattacagatagacgagagcagcgagatcagtaacattacgcttctgttatgttacatccggtttattgactatgactgccgtgatgttaaggaggaactgttattttgcatcgaaatgcctacccagatcactggattcgagatcttcgagttgattaacaagtatatcgacagcaaaagcctcaactggaagcattgcgttgggctatgtaccgatggcgccgcctcgatgacaggaagatattcaggattaaaggcaaaaatccaggaagtggccatgaacaccgctgcattcacccactgcttcatccatcgcgaacgcctggtggcggaaaagctgtctccatgcctccacaagatcctgctgcagagcgcgcagatcttgagtttcatcaagtccaatgctctgaactcgagaatgctgactattctgtgcgaggagatggggtccgagcacgttagccttcccctgcacgccgaggtcaggtggatctcccgggggcgcatgctgaaaagactgtttgagttgaggcacgagattgaaatctttctctcccagaagcacagcgacctcgctaaatattttcacgatgaagagtgggtgggcaagctggcatacctgtctgatattttctccctcatcaatgagctgaacctgtctttgcaagggaccctcaccaccttcttcaatctctgcaataaaatcgatgtgtttaaacggaagcttaagatgtggcttaagcgtacccaggaaaatgactacgatatgtttccaagcttttctgaattctctaattcttccgggctcaacatgactgatataacccgtattatctttgagcatctggagggactgagtcaggtcttcagcgattgcttcccacccgaacaagatttgaggagcggcaacctatggatcattcatccttttatgaaccaccagaataataaccttacagactttgaggaagagaaactgactgagttgagttctgatcttggtctccaggctctctttaaaagtgtgagcgtgacacagttttggatcaatgcgaaaacctcatacccggaactgcatgagagggctatgaagtttctgttgcccttttccactgtttacctgtgcgatgctgcattttccgccctgaccgaatctaagcagaagaacctgctcgggtccggcccagccctcagactcgcagttactagcctcatccctcgaattgaaaagctcgtgaaagaaaaggagtag

SEQ ID NO: 22288 - DNA, 513 bp, Artificial Sequence
  Description of Artificial Sequence: Synthetic coding sequence
atgaaggagcccctggacggcgagtgcggcaaggccgtggtgccccaacaggaattgctggacaaaattaaagaagaacctgataatgctcaggagtacgggtgcgtgcagcaacccaaaacccaggaatccaagctgaagatcggcggagtatctagcgtgaacgaacgacctatagcacaacagctgaaccctgggtttcaactcagcttcgcgtcttcgggcccttcagtgctgctgccttccgtccccgcggtcgccatcaaagtcttttgttctggatgcaagaagatgctttacaaaggccagaccgcctaccacaaaacaggctctacccaattgttttgctcaacccggtgcataaccagacactcctccccggcttgcctgcccccacctcccaagaagacttgcacaaattgctccaagtataagattctgaatatcccattctattttaccttcttcctggtttgtatccttttctcctcgaacattctcttaatactgtag

SEQ ID NO: 22289 - DNA, 2172 bp, Artificial Sequence
  Description of Artificial Sequence: Synthetic coding sequence
atgaaggagcccctggacggcgagtgcggcaaggccgtggtgccccaacaggagctgcttgataaaataaaagaggagccagataacgctcaggagtatggatgcgttcaacaaccaaagacgcaggaaagcaagttgaagattgggggagtctccagcgttaatgagaggcctatcgcccagcagcttaaccccggattccagctgtcctttgcatcttctggaccgtccgtgctcttgccatccgtccccgcagtggctattaaggtcttctgcagtgggtgcaaaaagatgctttacaaaggccaaacagcttatcataagaccggttcaacgcaactgttttgctcaaccaggtgcatcacccgccacagctcacccgcatgtctcccccctcctccgaagaaaacatgcacaaactgctcaaaagacattctaaaccccaaagatgtgattacaacacgatttgagaactcttaccccagcaaggatttctgctcccagtcttgtctgagctcttacgaattaaaaaaaaaaccagtcgtgaccatttacacaaaaagcatctccaccaaatgctcgatgtgccagaagaatgccgacacgcgcttcgaggtcaagtaccagaatgttgtccacgggctgtgttctgatgcctgcttcagcaagtttcactccacgaacaacctgacaatgaattgctgcgagaactgtggatcatactgctactcttcatcaggaccctgccagtctcagaaagtattttctagcacctcagttaccgcttacaagcaaaattctgcccaaattccgccctatgccctgggtaagtctcttcggccctctgccgaaatgatagagaccacgaacgattcaggtaagaccgagctcttctgcagcattaattgtttgagcgcatatcgagtgaagacagtgacatctagcggcgtccaggtgtcctgccacagctgtaagacctcagccatccctcagtaccacctggccatgtccaatgggacaatctactccttctgttcctcaagctgtgttgttgccttccagaacgtgttttctaagccaaagggaaccaactccagtgccgtcccgctgagccaaggtcaagtcgtagtctcacccccctccagccgtagcgcggtaagtatcggcggtggtaatacctctgccgtctccccctcctctatccgagggtcagctgccgctagtctgcagcccttggcggaacagtcccagcaggtcgcacttactcacaccgtggtgaaactgaaatgtcaacattgcaatcacctgttcgctacaaaacccgagctgcttttttataaggggaagatgtttctcttttgtggaaaaaattgcagcgatgagtacaagaaaaaaaataaggttgtcgccatgtgtgattactgcaagctgcagaaaatcataaaggaaactgtcagattcagcggcgtggacaaacccttctgttcagaggtctgcaagtttctgtcagcccgcgattttggtgagcggtggggtaactactgcaaaatgtgctcttattgttctcagactagtcctaacctagtagaaaatcgcctggaaggaaaactggaagaattctgttgcgaggattgtatgtctaaattcacagtcctgttctatcaaatggcaaagtgcgatggctgtaagcggcaaggtaagctttctgaatctattaaatggcgcgggaacattaagcacttttgcaacctattctgcgtgctcgagttctgccatcaacaaatcatgaacgactgtttgccccagaataaggtcaacatttctaaagcaaagactgcagtgacggaactgcccagtgctaggacagacacaacgcctgtaatcacctctgtgatgagcttggcaaaaatacctgctaccctgtcaaccggtaatacgaactcagtgttaaagggtgccgtgaccaaagaagctgcaaagatcattcaggacgaaagtacccaagaagacgccatgaaatttcctagttcgcagtcaagccagccatccagactgctcaagaacaagggtataagctgcaagccagtgacccagacaaaggcgacctcttgcaaaccccacacccagcataaagaatgccagactgagtgccctgtgcgtgctgtttgctag

SEQ ID NO: 22290 - DNA, 627 bp, Artificial Sequence
  Description of Artificial Sequence: Synthetic coding sequence
atgaaggagcccctggacggcgagtgcggcaaggccgtggtgccccagcaggagctgctcgataagatcaaggaagagcctgacaacgcacaggaatacggttgcgttcagcagcctaaaactcaggagagtaagttgaagattggaggggtttcgagcgtgaatgagagacctattgcgcagcagctcaaccccgggtttcaactatcattcgcctccagcggcccaagtgttctgttgcccagcgtcccagccgttgctattaaggtattttgttccggatgtaagaaaatgctttacaagggacaaactgcatatcataagaccgggtcaacacagctgttttgttccaccagatgcattacacggcactcgagccctgcctgcctgcccccgccccctaagaaaacctgcaccaattgctctaaagacattttgaatcctaaagacgttattaccacccgtttcgagaacagctatccatccaaggacttttgttctcagtcctgtctgagttcttacgagctaaagaaaaagcctgtggtgaccatctacaccaagagcatctcaacaaaatgctctatgtgtcagaagaacgctgacactagattcgaggtcaaatactag

SEQ ID NO: 22291 - DNA, 1689 bp, Artificial Sequence
  Description of Artificial Sequence: Synthetic coding sequence
atgagccgggtgcacggcatgcaccccaaggagaccacccggcagctcagcctagccgtgaaagatgggctgatagtcgagaccctaaccgtgggatgcaaaggtagcaaggctgggatcgagcaggagggttattggctgcccggggacgagatcgactgggagacagaaaaccatgattggtattgttttgaatgccacctgccaggagaagtgctgatctgcgacttgtgctttagggtttaccactctaagtgtttgagcgatgaattcaggctccgggactcctctagcccctggcagtgtccggtgtgccgaagcatcaagaaaaaaaacacgaacaaacaggagatgggaacttacctacgattcattgtaagccgaatgaaggagagagccatcgaccttaataaaaagggcaaggataataagcacccgatgtatagaagactggtgcattccgcagtagacgtgcccacaattcaggagaaagtgaacgaaggtaagtatagatcatatgaagaatttaaagccgacgcacagctgctcctccataacactgtgattttctacggggcagattctgagcaggccgacatcgctcgcatgctttacaaggatacgtgtcacgagctggacgagttgcaattgtgtaagaattgcttctatctgtccaatgcccggcctgataactggttttgttacccgtgcatccccaatcatgagctagtctgggcaaagatgaagggatttggattttggcccgcaaaggtaatgcagaaggaagataaccaagtggatgtgcgatttttcggccatcaccaccaaagggcgtggatcccaagcgagaacattcaggatattactgtcaatattcacagactgcacgtgaagaggtccatggggtggaagaaggcatgcgacgagctggagttgcatcagcggtttctgcgggagggcagattttggaagtcaaaaaatgaagaccggggagaggaagaagctgaatctagcatctcatctaccagcaacgaacaactgaaggtgacgcaggagcccagagccaagaaaggaaggaggaaccagtcagtagagccgaagaaggaggagccagaacctgaaacagaagccgtgagcagctctcaggagatccctacaatgccccaacccattgaaaaggtgtcagtttccactcagacaaagaaattaagcgcatctagcccgcggatgcttcacaggtctacacaaacaacaaacgacggggtttgtcagtcaatgtgtcatgataagtacactaaaatctttaacgatttcaaggaccgcatgaaatccgaccataaacgagaaacggagcgtgtagtcagagaggcactcgagaagctgagaagcgaaatggaggaggagaaaaggcaggctgtgaacaaggccgtggccaacatgcaaggagaaatggatcgaaaatgcaaacaggttaaagaaaaatgtaaggaggaatttgtggaggagattaaaaaacttgccacacagcataagcaacttatatcacagacgaaaaagaagcagtggtgttacaattgcgaggaggaggctatgtatcactgctgctggaacacctcttattgttccatcaagtgccagcaggagcactggcacgccgagcataaaaggacctgtagacgcaagaggtag

SEQ ID NO: 22292 - DNA, 1758 bp, Artificial Sequence
  Description of Artificial Sequence: Synthetic coding sequence
atggtgatcttcaccagcctgcaccggtacgtgatcttcatcagctgtataatagtgatcaactggtacatgagcagagtacacggaatgcacccgaaggagaccactagacagctgagcctggcggttaaggacggattgatcgtggaaacactgaccgtgggatgtaagggctcgaaggctggcatcgagcaggaggggtactggttacccggtgacgaaatcgactgggagactgagaatcatgactggtactgcttcgaatgtcatcttccgggagaagtcctcatctgcgatctgtgtttcagagtatatcattccaagtgtcttagcgatgagtttaggctgagagattcttctagcccttggcagtgccctgtttgtaggagcatcaaaaagaaaaacaccaacaagcaggagatgggaacatacctgcggttcatcgtctctagaatgaaggaaagggccatcgatctcaacaaaaagggaaaagacaataagcaccccatgtaccggcggctcgttcacagcgctgtcgacgttccaactatccaggagaaagtcaacgaaggaaagtaccggagttacgaggagtttaaggctgacgctcagctgctgctacataacacggtcattttctacggggccgacagcgagcaggccgacatcgctcggatgctgtacaaggatacttgccatgaactggacgagctgcagctctgcaaaaactgcttctacctttctaacgccaggcctgacaattggttttgctacccctgcatccctaatcatgaattggtgtgggccaaaatgaagggctttggcttttggccagctaaggtcatgcagaaggaggacaatcaggtggatgttcgtttcttcgggcaccaccaccagcgggcttggattccgtcagaaaacatccaggatataacagtgaatatccatcgtcttcacgtgaagcgttcaatgggctggaaaaaggcttgtgacgaactagagcttcaccagagatttctccgcgagggcaggttttggaaaagtaagaatgaagaccggggggaggaagaggccgaaagtagcatcagtagtacaagcaatgagcaactcaaggttacccaagaaccccgagcaaaaaaaggcagaaggaatcagtccgtcgagcctaagaaggaagaacctgaaccagagacagaagccgtttcaagctcccaagagatccctacaatgccccaaccaatcgagaaggtctctgtgtcaacccagacaaaaaaactgagtgcgagttcacctcgtatgctgcaccgctcgacgcagaccactaatgatggcgtctgccagtctatgtgccacgacaagtataccaagatttttaacgactttaaggatagaatgaagtcagaccataagcgggaaaccgagcgagtggtgagggaggcactcgagaagctccgatctgagatggaggaagagaaacggcaggcggtcaataaggcagtggcaaatatgcaaggcgaaatggacagaaaatgcaagcaggtgaaagagaagtgcaaagaagaattcgtggaagagatcaaaaagctagccactcagcataagcagctgattagccaaactaagaaaaagcagtggtgctataactgcgaggaggaagctatgtaccattgttgttggaacaccagctactgcagcataaaatgtcagcaagaacactggcacgcagaacataagcgtacatgtcgtcgcaaacggtag

SEQ ID NO: 22293 - DNA, 1809 bp, Artificial Sequence
  Description of Artificial Sequence: Synthetic coding sequence
atggcccggctgaccaagcggcggcaggccgacaccaaggccatccagcatctgtgggctgctatcgagatcatcagaaatcaaaagcagatcgccaacattgacagaattacaaaatatatgtccagggtgcatgggatgcatcctaaggagactacccgacaattgtctttggcggtgaaagatggactgatcgtggagaccttaaccgtggggtgtaagggcagtaaagcaggtatcgaacaggaagggtactggcttcccggcgacgaaatagattgggagacagagaatcacgactggtattgtttcgagtgtcacctgcctggggaggtgcttatctgcgatctgtgcttcagggtataccattcaaagtgcctgtctgatgaattccgcctccgtgactcatccagcccatggcagtgtccagtatgtcgctccataaagaaaaagaacaccaataagcaagaaatggggacgtatctaagattcatagtgtcacgaatgaaagagagggcaatcgatttaaataaaaaaggaaaagacaataagcatccaatgtaccggaggctggtccacagcgcagtcgacgtacctactattcaagaaaaagtaaacgaggggaaatataggagttatgaggagttcaaggcagatgcacaattgctcctgcacaacacagtgatcttttatggggctgactccgaacaagcagacatagcccgaatgctatacaaggacacctgccacgagctcgatgagcttcaactgtgcaaaaattgcttctacctgagcaacgctcgaccggataactggttttgttacccttgcattccaaatcatgaactagtgtgggccaaaatgaaagggtttgggttttggcccgcaaaggtgatgcagaaagaagataaccaggtagacgtccgcttcttcgggcaccatcatcaaagggcctggatcccctccgaaaatatccaagatattactgtcaacattcatcggctgcacgtgaaacgcagcatgggatggaagaaggcgtgcgacgagctggagctacatcagagattcttgagagagggaagattttggaagtccaaaaacgaggaccgaggcgaggaggaggcagagtccagtatatcgtctacaagtaacgagcagttgaaggtgacccaggagcctcgggcaaaaaaggggcgacgaaatcagagtgtagaaccaaagaaggaggaacccgagcccgaaacggaggcagtctcatccagtcaggagattcctactatgcctcaaccgattgagaaggtctccgtgtccacacagacaaaaaagctctcagcctcatctccgcgaatgttacacagatcaacacaaactaccaacgacggagtttgtcagtcaatgtgtcacgataagtatacaaaaatctttaacgactttaaggatcgaatgaaatcagaccataagcgtgagacagagagggtggtccgggaagccttggaaaagctgagatcagagatggaagaagagaaaagacaggctgtcaacaaggccgtcgccaatatgcagggggaaatggaccgtaaatgcaagcaggtgaaagaaaaatgcaaagaggagttcgtcgaggagatcaagaagcttgctacacagcacaagcagctgatctctcagaccaagaaaaagcagtggtgctacaactgcgaggaagaggccatgtatcattgctgttggaacaccagttactgtagtatcaaatgccaacaggaacactggcatgcggaacataaacggacatgtcgacgaaagaggtag

SEQ ID NO: 22294 - DNA, 1587 bp, Artificial Sequence
  Description of Artificial Sequence: Synthetic coding sequence
atgagccgggtgcacggcatgcaccccaaggagaccacccggcagctgtctctggctgtcaaagacgggctgatcgttgagactctgacagtggggtgcaagggctctaaggctggcatcgagcaggaaggttattggttgcctggagatgagatagactgggagactgaaaaccacgattggtactgttttgagtgccatctaccgggtgaggtgctgatctgtgacctatgtttcagagtctaccactccaagtgcctgtcagatgagttccgactgcgtgacagctcctccccatggcagtgccccgtgtgtcggagcatcaagaagaagaatactaacaagcaggagatggggacgtacctgcgttttatcgtgagcaggatgaaagagcgagctattgatcttaataagaagggaaaggacaacaagcaccccatgtaccggcggctggtgcactccgccgtggacgtgcccacaatccaggagaaagtgaacgaaggcaaatatcgcagttatgaagagtttaaggccgatgctcaactgctcctgcataacaccgtgatcttctatggcgccgatagcgagcaggccgatatcgctaggatgctgtataaagatacttgccacgagctcgacgagctccaactatgtaaaaactgtttctatcttagcaatgccaggccagataactggttttgctacccctgcatacctaaccacgaactggtttgggcgaaaatgaaggggttcggcttttggccggctaaagtgatgcagaaagaggataaccaggtggatgttcggttcttcggccatcatcaccagcgagcttggatccctagcgagaacatccaagatatcacagtgaacatacatcggctccacgttaagcgctccatggggtggaaaaaggcatgtgacgaattagaactgcaccagcgcttcctccgtgaaggcaggttctggaagtctaagaatgaagatcgcggtgaagaagaggccgaatctagtatctcatccacctctaatgagcagttaaaagtcacccaggaaccacgagccaagaaagggagacgtaatcagagtgtggaacctaagaaagaagagccagaaccagagacagaagccgtttcctcatcacaggaaatccctaccatgccccagccgatcgaaaaagtttccgtcagcacccagaccaaaaaactgtccgcgagctcacctaggatgttgcaccgaagtacacagaccaccaacgacggcgtatgccaatctatgtgtcatgataagtacactaagattttcaatgattttaaggatagaatgaagagcgaccataaaagagagactgaaagggtcgtgagagaggctctggagaaacttagaagcgaaatggaagaggaaaagcgacaggcagtcaacaaagccgtcgccaacatgcagggagaaatggataggaaatgtaagcaagtgaaagaaaagtgcaaagaggagttcgtggaggaaatcaagaaactggccacacaacacaagcagctgatcagccagacgaagaagaaacaatgggtaaatacatcgttattttag

SEQ ID NO: 22295 - DNA, 1689 bp, Artificial Sequence
  Description of Artificial Sequence: Synthetic coding sequence
atgagccgggtgcacggcatgcaccccaaggagaccacccggcagctgtctctggccgtcaaggatgggctgatagtcgagaccctgactgtaggctgtaagggttcaaaggccggaattgaacaagaggggtattggctcccaggggatgagattgattgggaaaccgagaatcatgactggtactgctttgagtgccacctccctggcgaggtactgatatgcgacctttgctttagagtgtaccattctaagtgtctaagcgatgagttccggcttcgagacagctctagtccgtggcagtgcccagtgtgccggagcatcaagaagaaaaatactaacaaacaggagatggggacatatcttcgcttcattgtctcaaggatgaaggagagagctatcgatctaaataagaaaggcaaggataacaagcaccccatgtataggcgccttgtgcactctgccgtagacgtgcctactatacaggaaaaagttaatgagggaaaatacaggtcgtacgaggagtttaaagccgacgctcagctgttacttcataacacggtgattttctacggcgctgattcagagcaggctgatatcgcaagaatgctatataaggacacatgccacgaactggatgagcttcagctgtgtaagaactgtttttatttgagtaacgcacggcccgataattggttctgctatccatgcatcccaaatcatgaattggtttgggctaaaatgaaggggtttggtttctggcccgccaaagtaatgcagaaggaggacaatcaagtagatgtgcgtttctttggacatcaccaccagagggcttggatcccttccgagaatattcaggacatcaccgtcaacattcatcgcttgcacgtgaagcggtctatggggtggaagaaagcctgcgacgagctggaattgcaccaaaggtttctgagggagggacgattttggaagagcaaaaatgaggaccgcggcgaggaggaggctgaatcctccataagcagtacttcaaacgagcaactgaaagtcacgcaggaaccgagggctaaaaaagggagaagaaaccagtcagtggaacccaaaaaggaggagccagaacccgagaccgaagctgtgtcgtccagccaggagattcctacaatgccacaacctattgaaaaggtttcagtttccacacagactaagaaactctccgcttccagtccaaggatgctacacagaagtacgcagaccactaatgatggtgtatgtcagagcatgtgtcatgacaagtacaccaagatcttcaatgactttaaagatcgcatgaaaagcgatcataaaagggagacagagagagtcgtgagagaagcgttggaaaagttacggagcgagatggaagaggaaaaacgtcaggccgtcaataaggccgtcgccaatatgcaaggggagatggatcggaaatgcaagcaggtgaaagagaagtgcaaagaggaattcgttgaggagattaagaagctcgccactcagcataaacagctgattagtcagacaaagaagaagcagtggtgttataactgtgaagaggaggcgatgtaccattgctgctggaatacctcttattgctcaatcaaatgtcagcaggagcattggcacgcagaacacaagcgcacatgccggcggaagcgatag

SEQ ID NO: 22296 - DNA, 1527 bp, Artificial Sequence
  Description of Artificial Sequence: Synthetic coding sequence
atgagccgggtgcacggcatgcaccccaaggagaccacccggcagctaagtctggctgtgaaggacggccttattgtggaaacactgacagtcgggtgcaaggggtccaaggccggcatcgaacaagagggttactggctacctggagatgagatcagcatcaaaaaaaaaaacacaaataagcaggagatgggcacctaccttaggtttattgtgagtagaatgaaagaaagggcgattgatctgaacaagaagggcaaagacaataagcatcctatgtatcgaaggctcgtgcatagcgctgtagacgttccaacaatccaggaaaaagttaacgaaggtaaatacaggtcctacgaggaatttaaagctgatgcacagctcctgctgcacaacactgtcattttttacggcgccgattctgagcaagcggacattgctcgcatgctctacaaggacacctgccatgaactggatgaattgcagctgtgtaaaaactgtttctatttgtcgaacgcccgtcccgacaactggttttgttacccttgcatcccaaaccacgagctggtctgggctaagatgaaggggtttggattttggcccgccaaagttatgcagaaagaggacaaccaagtggatgtgagattctttggacatcatcaccaaagggcttggattccaagcgagaacatccaggacatcacagtcaatattcatcggctgcatgtcaaaagatctatgggctggaagaaggcttgtgatgaactggaactacatcagcgattcctcagagagggccgcttctggaagtctaagaacgaggaccgcggagaggaagaggccgaatcgagcatatctagtacaagtaacgagcagctgaaggtgacgcaggaaccgcgggccaaaaagggcagaagaaaccagagcgtggagccaaagaaggaggagccagagcccgaaactgaagcagtgtcttcttcccaggagattcccaccatgcctcaacctattgaaaaggtgtcggtatctactcaaacgaagaagctttcagccagctcgcctcggatgctacatcgaagcacacaaaccacaaacgacggcgtgtgtcagagcatgtgccacgataagtacacaaagatattcaatgactttaaagaccgcatgaagtctgaccacaagagggaaaccgagcgagtggtaagagaagccctcgagaaactgcgttccgagatggaggaagagaagcgtcaagcagtaaacaaagcggtcgccaatatgcagggtgaaatggatcggaaatgtaaacaggtgaaggagaaatgtaaagaggaattcgtggaagagatcaaaaaattggcgacacaacacaagcagttaatttctcaaaccaagaaaaaacagtggtgttataactgtgaggaagaagctatgtaccactgctgctggaatacatcctactgcagcataaagtgtcagcaggagcattggcacgcagagcataagcgcacatgccggagaaaacggtag

SEQ ID NO: 22297 - DNA, 1554 bp, Artificial Sequence
  Description of Artificial Sequence: Synthetic coding sequence
atggcccggctgaccaagcggcggcaggccgacaccaaggccatccaacacttatgggcagcgatcgaaatcattaggaatcagaagcagattgcaaacattgatcgtatcacgaagtacatgagcagagttcacgggatgcaccccaaggagacaacacgtcagttaagcttggctgtcaaagatggactgattgtggaaacgcttactgttgggtgtaaggggtcgaaggcaggaatagagcaggaaggatactggctgccgggagacgagattagtattaaaaaaaagaatactaataagcaggagatggggacgtacctcagattcatcgtgtccagaatgaaagagcgaaaggtcaatgagggcaaatatcggagctatgaggagtttaaagcggacgcccaactgctgttacacaatactgtgatcttttacggggcagatagcgagcaggccgacatagcccggatgctgtataaagacacttgtcatgaactagacgagctccagctctgcaagaactgtttctaccttagtaacgcccgcccagacaactggttctgctatccatgtatccctaaccatgaactggtttgggctaaaatgaaaggattcggcttttggcctgcaaaggtcatgcagaaagaggacaaccaggtggatgtgcggttctttgggcaccaccatcaacgggcctggatcccgtctgagaacattcaggatattactgtgaacatccaccggctgcacgtaaagcggtccatgggatggaagaaagcttgtgatgaactggaactccaccagcgcttcctcagggaaggacgattttggaaaagcaaaaacgaagatcgcggcgaggaggaggccgaatcttcaattagctcaacatccaacgagcagttgaaagttacccaagaacctcgggccaagaaaggtcgtagaaatcagtcagtggaacccaagaaggaagagcctgaacccgaaaccgaggctgtgagctcaagccaggagattccaacgatgccgcaaccgatcgaaaaggtgtcagttagcacccagaccaaaaagctgagcgcgagctcgccccggatgctccatcggagtacccagactacaaacgatggtgtgtgccaaagcatgtgtcatgataagtacactaaaatctttaacgactttaaagaccggatgaaaagcgatcacaagcgggagacggagagggtagtccgtgaggccctggagaaattacgatcagaaatggaagaggagaagcgccaggcagtgaataaagctgtggcaaatatgcagggagagatggacagaaaatgcaagcaggttaaggagaagtgtaaggaggaattcgtagaggagataaaaaagctggctacgcaacacaagcagctgattagtcagactaagaagaaacagtggtgttataattgcgaggaggaagcgatgtaccactgctgctggaatacaagctattgctctatcaaatgccagcaggagcactggcacgcggagcacaaaagaacctgtcgacggaaaagatag

SEQ ID NO: 22298 - DNA, 1809 bp, Artificial Sequence
  Description of Artificial Sequence: Synthetic coding sequence
atggcccggctgaccaagcggcggcaggccgacaccaaggccatccagcacctgtgggctgcaatcgagataatccggaatcagaagcagatcgccaatatcgatcggataaccaaatacatgagccgagtgcacggtatgcaccccaaggagactaccaggcagttgtcgctcgccgtgaaggacggtctgattgttgaaaccttgactgtgggctgcaaaggatccaaggccggcatcgagcaggaagggtattggctacctggcgacgagattgattgggaaacagaaaatcacgactggtactgttttgaatgccacctgcccggggaagtgttgatatgcgatctgtgtttccgcgtataccattccaaatgcctatctgatgagtttaggctgcgggatagcagctccccatggcagtgtccggtctgccggtccattaagaagaaaaataccaataagcaggaaatgggaacttacctgcgctttattgtatcaaggatgaaggagcgcgcaatagacttgaataaaaagggcaaggacaacaagcacccaatgtacagaagactcgttcatagtgccgtggatgtgccaactatacaggagaaggttaacgagggcaagtatcggtcctacgaggagttcaaagccgatgcacaattactgctccataataccgtgattttttacggtgcggattcagaacaggcggatattgcccgaatgttgtataaagatacatgccacgagctggatgagctgcaactatgtaagaactgcttttacttgtccaatgctcgccccgataattggttttgttacccctgtattccgaatcacgagcttgtgtgggccaaaatgaaaggcttcggtttctggcccgctaaagtgatgcagaaagaagataatcaggtcgatgtgcggttctttggccaccatcaccaacgcgcctggataccttctgagaacattcaggatattaccgttaatattcatcgcctgcacgtgaagaggtccatgggatggaaaaaagcctgtgatgagttagaattacaccagaggtttctgcgcgaggggcgtttctggaagtccaaaaacgaagatcgaggggaagaagaggccgagtcttctattagttcaacctcaaatgaacagctgaaggtgacccaggagcccagggccaaaaagggacgtcggaaccagagtgtggagccaaagaaagaggagcctgaacctgaaaccgaggccgtatcgagttcacaggaaatccctaccatgcctcagcccatagagaaagtgtccgtgtctactcagaccaaaaagctgtctgcatccagcccccggatgttacaccgttctactcagacaacaaatgacggagtgtgtcagtctatgtgtcatgataaatatacgaaaattttcaatgatttcaaggacagaatgaagagtgaccataagagagaaaccgaacgcgtggtcagagaggcccttgaaaagttgagaagcgaaatggaagaagaaaaaagacaagctgttaataaggctgtcgctaacatgcagggcgaaatggacagaaagtgcaaacaagtcaaggaaaagtgcaaggaggaattcgtggaggagatcaaaaagctcgctactcaacacaagcaactaatctctcagactaagaaaaaacagtggtgctataattgtgaggaggaggctatgtaccattgttgctggaatacctcatactgtagcatcaagtgccagcaggaacattggcatgccgagcacaaacgaacatgccgtcgcaaacgctag

SEQ ID NO: 22299 - DNA, 1569 bp, Artificial Sequence
  Description of Artificial Sequence: Synthetic coding sequence
atggcccggctgaccaagcggcggcaggccgacaccaaggccatccagcatctatgggcggcaattgagatcattcgaaatcaaaagcaaattgccaatatcgataggatcaccaagtacatgtctagagtgcatgggatgcaccctaaggagacgacccggcaattgtctcttgcagtcaaggacggcctgatcgtcgaaaccctgacggtcgggtgcaaaggcagtaaagccggcatcgagcaggaagggtactggcttccgggagatgagatttcgataaagaagaagaacacgaacaagcaggagatgggaacttaccttcgattcattgtttcaaggatgaaagaacgggccattgacttaaataaaaaggggaaagacaacaaacatccaatgtaccgacgcctggtgcacagcgcagtggacgtgcccaccatacaggagaaggttaatgaaggcaagtaccggtcttacgaagagtttaaggccgacgcacagctgctcttacacaacacagtcatattctacggggctgactctgagcaggccgatatcgcccggatgctgtacaaggatacctgccacgagattccaaatcacgaactagtgtgggccaaaatgaagggattcggattctggcccgccaaggtcatgcagaaggaagacaaccaagtcgacgtaagattttttggtcaccaccaccagcgcgcatggattccctccgagaacatccaagacatcacggtgaatatacatagactacacgtaaagcgctccatggggtggaaaaaagcatgtgacgaattggagttacaccaacgtttcttacgcgaggggaggttttggaaatcgaagaatgaggacaggggggaagaagaagccgaatcgagcatatccagtacatcaaacgagcagctaaaagtcacccaggaaccccgggcgaaaaagggacggaggaaccagtccgtggaacctaaaaaggaggagcccgagcccgagactgaagccgtgagcagctctcaggagatccctaccatgccccagccaatcgaaaaagtgtctgtttctactcagacaaagaagctcagtgccagcagcccccgaatgctgcacaggtcaactcagaccacaaacgatggcgtgtgccagtccatgtgccatgacaagtatacgaaaatcttcaatgatttcaaagatcgcatgaagagtgatcataagagggagaccgagcgggtggtcagggaagccctggaaaaacttaggtctgagatggaagaagagaagcgtcaagctgtaaacaaggctgtggcaaacatgcagggcgagatggatcgcaagtgcaaacaagtcaaagaaaagtgcaaggaggaatttgtggaggaaatcaagaaattagcaactcagcataagcagctcatatctcaaaccaaaaaaaaacagtggtgttacaactgcgaagaagaagccatgtatcattgctgctggaacacaagttactgctcaatcaagtgccagcaggaacactggcacgccgagcataaaaggacatgtcggaggaagagatag

SEQ ID NO: 22300 - DNA, 1704 bp, Artificial Sequence
  Description of Artificial Sequence: Synthetic coding sequence
atggcccggctgaccaagcggcggcaggccgacaccaaggccatccagcatctctgggccgctatcgagatcatcagaaaccagaagcagattgcaaatattgatagaattacaaagtatatgtcgagggtccatgggatgcacccaaaggaaactactcggcaattgtcactggccgtgaaagacgggctgatagtagaaacactcaccgtgggctgcaagggcagtaaagcaggaatcgagcaagaggggtactggctgccgggcgatgaaatcgattgggaaaccgaaaaccacgattggtactgctttgagtgccacctgccaggcgaagtgctcatatgtgacctctgttttagggtatatcatagcaagtgcctctcagatgaatttcggctgcgggactcatcatccccgtggcagtgccctgtgtgtaggtctatcaagaaaaagaatactaataaacaggaaatgggaacctaccttaggttcattgtaagccgtatgaaagagagagccatagatttgaataaaaaaggcaaagataacaagcacccaatgtaccgcagactcgtacacagcgccgtggatgtacccacaatccaggaaaaagttaatgaggggaaataccggtcctatgaagagtttaaagcagatgcccagctgctcctgcataatacagtgatcttctatggagatagtgaacaggccgacattgccagaatgctgtacaaagacacctgtcatgaactggatgagctgcagctctgtaaaaattgtttctatctctcaaacgcccggccagataattggttctgttacccttgcatacctaaccacgagcttgtctgggccaaaatgaaggggtttggtttttggcctgcaaaggtgatgcagaaggaagataaccaggtggacgtgaggttcttcgggcaccatcaccaaagggcttggatcccatctgaaaacatccaggatatcaccgtcaacatccaccggttgcatgttaaacgctcaatgggatggaaaaaggcctgtgacgaactggagctgcatcaacgtttcttacgggagggaagattttggaagtcaaaaaatgaggaccgcggcgaagaagaggccgagtctagcatctcttcaactagcaacgagcagctgaaggttacccaggaacctcgcgccaagaaaggacggaggaaccagagcgtggagccaaagaaggaggaacctgagcccgaaacagaagccgtgtcttcgtcccaggagatacccactatgccacagccaatcgagaaggtttcagtgtctactcagacaaagaagctaagcgctagttcccctcgaatgttgcaccgctccacccagacgacaaacgatggcgtgtgccaaagcatgtgtcacgacaaatacacaaagatcttcaatgatttcaaagaccgaatgaagtccgaccataagcgggagacagagagagtagttcgcgaagccttggagaagcttcgttctgaaatggaagaagaaaagagacaggccgtcaacaaggccgtcgctaatatgcagggcgagatggatcggaagtgcaaacaagtgaaggaaaaatgcaaagaggagttcgtagaagagattaagaaattggcaacacaacataaacaactgataagccagaccaagaagaaacaatgggtcaatacttcattattctag

SEQ ID NO: 22301 - DNA, 1194 bp, Artificial Sequence
  Description of Artificial Sequence: Synthetic coding sequence
atgggcacctacctgcggttcatcgtgagccggatgaaggagcgggctatcgatctgaacaaaaagggcaaggacaacaaacaccccatgtaccgccgacttgtgcacagtgctgtggatgtgccaaccatacaggagcttgacgagctccaactctgtaaaaactgcttctatctgagcaatgctcgcccagataattggttctgttatccctgtatccctaaccatgagttggtgtgggctaagatgaaggggttcgggttttggcccgcgaaggtcatgcagaaagaagacaaccaggtggacgtccgtttctttggccatcaccaccaaagggcctggatccctagcgagaacatacaagacattacggtgaacatacacaggctccatgtgaagcggtccatggggtggaagaaagcgtgcgacgaactcgaactgcatcagagattcctgagagaggggaggttctggaagtccaagaacgaagatagaggcgaggaggaagccgagagtagcattagctccacgtctaatgaacagttgaaagttacccaggagccacgggccaagaaggggaggaggaaccagtccgtcgagcctaagaaggaggaacccgaaccagagaccgaagcagtctcctcctcccaagagatcccaactatgccacaacccatcgaaaaggtctctgtctctacacaaactaaaaagctgtctgcttcttcccctagaatgcttcacagaagtacacagaccaccaacgatggagtgtgccagtccatgtgtcacgacaagtacactaagattttcaatgacttcaaggacagaatgaaaagcgatcataaacgagagaccgaacgtgtcgtgcgagaagctctcgagaaacttcggtccgaaatggaggaagagaagagacaggccgtgaataaagccgtcgcaaatatgcagggtgaaatggaccgaaaatgtaaacaggtcaaggaaaagtgtaaagaagagttcgtcgaagaaattaaaaaacttgctactcagcataagcagctgatctcacagactaaaaaaaagcagtggtgctacaattgtgaagaagaggccatgtatcactgctgctggaatacctcatactgttccatcaaatgtcagcaggaacactggcacgccgaacacaagcggacttgcagacgcaaaaggtag

SEQ ID NO: 22302 - DNA, 1449 bp, Artificial Sequence
  Description of Artificial Sequence: Synthetic coding sequence
atgagccgggtgcacggcatgcaccccaaggagaccacccggcagctgtccttggccgtgaaagacggacttatcgtggaaactctgacagttgggtgtaaggggagtaaggctgggatcgagcaggagggttattggctgccaggggatgaaatttcaatcaagaagaaaaataccaataaacaggagatgggaacctatttgcgtttcattgtgtcccgtatgaaggaaagggccatcgacctgaataagaaggggaaggacaataaacaccctatgtacagacgcctggtgcacagcgccgtggacgtgcccacaattcaggagaaagttaacgaaggtaaatacagatcttacgaagaattcaaagccgatgcccagttgttgctccacaacaccgtaattttttacggggccgattccgaacaggctgacatcgcccggatgctatataaggacacatgtcacgagattcccaaccacgaattggtgtgggcaaagatgaaaggttttgggttctggcccgctaaggtgatgcagaaagaggataaccaagtggacgtgaggttcttcgggcatcatcaccaaagagcatggatcccttctgaaaatattcaggacatcacagtgaatattcacaggcttcacgtaaaacgatcaatggggtggaagaaggcttgcgatgagctcgaactgcaccagcgcttcctgcgcgagggccgattttggaagtcgaagaacgaagatagaggagaagaggaagctgagagctctattagcagcacatccaacgagcaacttaaggtgactcaggagcccagggccaaaaaagggcgcagaaatcaatctgtggagcctaaaaaggaggaaccggagcctgagacagaagccgtgtcctccagtcaggaaatccccacaatgccacagcctatagaaaaggtgtccgtatccacccaaaccaaaaaactttccgccagcagcccaaggatgctgcatagatcaacacagacaactaatgacggcgtctgccaatctatgtgccacgacaagtacactaagatcttcaatgatttcaaggaccggatgaaatccgaccataagcgagaaaccgaaagagtcgtcagggaagccctcgaaaaactccggtcagagatggaggaggagaaacgacaggcggtgaacaaagcagtcgcaaatatgcagggggaaatggacaggaaatgtaaacaggtcaaagagaaatgcaaagaggaattcgtggaggaaatcaagaaacttgctactcagcataagcagttaattagccaaacaaagaaaaaacagtggtgctataattgcgaggaggaggccatgtaccactgctgctggaacacttcatattgctcaattaagtgccagcaagaacactggcacgctgaacataagcggacgtgccgcagaaagcgatag

SEQ ID NO: 22303 - DNA, 3510 bp, Artificial Sequence
  Description of Artificial Sequence: Synthetic coding sequence
atggacatcagcacccggagcaaggaccccggcagcgccgagcggaccgcccaaaaacgtaaattcccgtcccccccccatagcagtaacggacatagtccacaggacaccagcaccagcccgatcaagaaaaaaaagaaacctgggctgctcaatagcaataataaggaacagtctgagctgagacacggtcctttctactatatgaagcagccgctcacgacagatcccgtggacgtcgtccctcaggacggcaggaatgacttttattgctgggtgtgtcaccgcgaaggccaggtgctgtgttgcgagctctgccccagggtgtatcacgcaaagtgcctgaggctgactagtgaaccggagggcgattggttctgccctgaatgtgaaaagataactgtagctgagtgcatcgagacgcagtcaaaggctatgactatgctcaccatcgaacagctcagttacctgcttaaattcgccatccagaaaatgaagcagcctggaaccgatgctttccagaagcctgtgcccctggaacaacaccctgactacgctgagtacatctttcaccctatggacctgtgtaccctggaaaaaaatgccaagaaaaagatgtacggttgtactgaggctttcctggccgatgccaaatggattctacacaactgcatcatctacaacggcggcaatcacaagctcacacagatcgccaaagtagtcattaaaatttgcgagcacgaaatgaacgagattgaagtatgtcccgagtgctacctggccgcatgccagaagcgcgataattggttctgcgaaccttgctccaatccacaccccctggtgtgggccaaactaaagggatttccattctggcccgctaaggccctgagagacaaagacggacaagtagacgcccggttcttcggccagcatgacagagcttgggtccctatcaataattgttaccttatgagcaaggaaatccctttcagtgtcaagaaaacaaaaagcatttttaacagcgcaatgcaggagatggaggtgtacgttgaaaacatccgaagaaaattcggcgtctttaattactctccgtttaggactccttatactcctaactctcagtatcagatgttactcgaccctacgaaccccagtgcaggcactgcaaagatcgacaaacaggagaaagttaagttgaatttcgatatgaccgcctctcctaaaattttaatgtccaaaccagtactcagcggcggcacagggagacgaatctcactctctgatatgccacggtcccctatgtccaccaactccagcgttcacacggggtcagacgtcgagcaagatgccgagaagaaggccacatcatcccattttagtgctagtgaagaaagcatggatttcctcgataaatccacagcgtctcctgcttccaccaaaacggggcaagctgggtctctttctggctccccgaagcccttctctccccagttgtcagccccgataacaaccaagactgataagacaagtaccaccggctctatccttaacttaaacctcggccatcgttccaaagctgaaatggatttgaaggagttatcggaatccgttcagcagcagtctacacccgtccctctgatctcgccaaaacgccagatccgatcgcgcttccagctcaacctcgataagaccatagaatcttgcaaagcgcaactcggcatcaatgaaatttctgaggacgtctatacagcagttgaacattccgatagtgaagacagcgaaaagagcgattcttctgacagcgagtacatttccgacgatgagcagaagagcaagaatgagcctgaagacaccgaggataaggagggctgccagatggataaggagccttcagcagtgaaaaagaaacctaagccaactaatccagtcgaaatcaaagaagagcttaaaagcacatctccagcatctgagaaagcagatccaggcgccgtgaaggacaaggccagcccagaaccagaaaaagatttttccgagaaggccaaaccatccccccatcctatcaaggacaagctgaagggcaaggatgagactgattccccgaccgtgcacctcggactggactccgattcagaatccgaattagttattgacctgggagaggatcatagcggccgtgaagggcgcaagaataagaaggagccaaaagaaccaagcccaaaacaggacgtggttggcaagactccgccatccactacagtcgggtcccactcccctccggagacacctgtacttaccaggtcctcagcccagacatcagccgccggcgctaccgccactacaagcaccagcagtactgtgacagttactgcgccagctcctgcagcaacaggaagcccggtgaagaaacaacggcccctgctcccaaaggaaaccgcccctgcggttcagcgggtagtgtggaattcctccacagtccagcagaaagagattactcagtctcccagcacttctacaataacccttgttacatccacacagtcctcaccactcgtaacctccagcggtagtatgagtacgttggtgagttcggttaatgccgatctgcctatcgctactgcaagcgccgacgtggcggctgacatcgccaagtacacttcgaaaatgatggacgctattaagggtactatgactgagatctataacgacttgagtaaaaacacaacaggaagcaccattgccgagatccgacggttgcgcatagagattgagaaactccagtggctccaccagcaagaactgtctgaaatgaaacacaacctggaattgactatggcagagatgcggcagtctctggaacaggagagggacagactgatagccgaggtgaagaaacaactcgaacttgaaaagcagcaagctgtggacgaaacaaagaaaaagcagtggtgcgctaactgcaagaaggaggcgatcttttattgctgctggaatacgagctattgcgattatccctgccagcaggcccactggccggagcacatgaagagttgtacgcagtctgccacagctccccagcaggaagccgacgcggaggtcaataccgaaacccttaacaagtctagtcagggaagttctagcagtacacagagcgctccttccgaaactgcaagtgcctccaaggagaaagaaacatcagccgagaagtctaaggaaagcgggtcgaccctagacttaagcgggtcccgtgaaactcctagttccattttacttggatcgaatcagggatcagtatccaaacggtgcgataaacagcccgcctacgcaccaactacaacggatcaccagccccaccctaactaccctgctcaaaaatatcattcgcgtagcaacaaatcctcttggtcttcctccgacgaaaagcgaggcagcacacggtctgatcacaacaccagcacctccacaaaatctctgctccccaaggagagcagactggacactttctgggactag

SEQ ID NO: 22304 - DNA, 3561 bp, Artificial Sequence
  Description of Artificial Sequence: Synthetic coding sequence
atggacatcagcacccggagcaaggaccccggcagcgccgagcggaccgcccaaaagaggaagttccccagcccgccccacagctccaacggacacagtcctcaagacaccagcacctccccaatcaagaaaaagaaaaaaccgggtctcctgaattcaaacaacaaagagcagagtgaattgagacacgggccgttttactacatgaagcaaccactgactacggaccctgtggacgttgtgccccaggacggacgaaatgacttctattgctgggtgtgccaccgggaaggtcaagttctctgttgcgaactgtgcccacgagtgtaccatgctaaatgcctaagactaaccagcgaacccgagggggactggttttgcccagagtgcgagaagatcacagtggcagagtgtattgagacacagagcaaagcaatgaccatgttgactatcgagcagctgtcctatctactcaagtttgccatccaaaaaatgaaacagcccggaactgatgcttttcagaagccagtgccactggaacagcatccggactacgcagaatacatattccacccgatggacctgtgtacactggagaagaatgccaaaaagaagatgtacggctgtaccgaggcgtttctggcagatgccaaatggatccttcacaattgcataatctacaacggaggcaatcacaaactgacacagattgctaaagtggtgatcaagatctgcgaacacgaaatgaacgaaattgaggtatgtcctgagtgttatcttgctgcctgccaaaaaagagataactggttctgtgaaccgtgctccaaccctcacccccttgtgtgggccaaactcaagggatttcccttttggcctgctaaagctcttcgagacaaagacggacaggtcgacgcccggttctttgggcagcatgatagagcctgggtgcccattaacaattgttatttgatgtccaaggaaatccctttcagcgtcaaaaagaccaagtctatattcaattcagccatgcaagaaatggaggtttatgtggagaatattcggcgtaaattcggggtgttcaactattctccttttcgcactccctacacaccgaattcccagtatcaaatgctcttagatcccacgaatccatctgcaggcacagcaaaaatcgacaagcaggagaaggtaaaactcaattttgatatgactgcctcacccaagatcctgatgagtaagccagtgctgagtggaggcacagggcggcgaatttcactgtccgatatgcctcggtcacctatgtccaccaattccagcgtacacacaggaagcgacgtggagcaggacgctgagaaaaaagctacttcttcgcatttctccgccagcgaggaatctatggactttctggacaagtcaaccgcttctcctgcgtccacgaaaactgggcaggctggtagcctttcaggatcaccgaagcccttttccccgcagttatccgctcccatcactactaaaactgataagacctctacgacaggctcgatacttaacctcaacctggaccgctccaaggcagaaatggacctgaaagagctgtctgagtcggtgcagcaacagtctacaccggtccccttgatcagccccaaacgacagatcagatctcgcttccagcttaatttggacaagacgattgagagctgcaaggcacaattgggaatcaacgaaatctctgaggatgtgtatacagcagtcgagcattctgactctgaggattccgaaaaatcagactcctctgatagcgaatatataagtgacgatgaacagaagtcaaagaacgagcctgaggacactgaagataaggaaggatgccaaatggataaggagccttccgctgtgaaaaagaaaccaaagccgacaaacccggttgagatcaaagaggagctgaagagtacttcccccgcctccgagaaggcggaccccggagcagtgaaggataaagcgagtcccgaaccggagaaggacttctccgaaaaggcgaaaccttcccctcacccaatcaaagataagctgaaagggaaggacgagacagattctccgaccgtacacctgggcctggatagcgattccgagagcgagttggtcattgatctaggcgaagatcactcaggacgggagggaaggaaaaataagaaggagcctaaggaaccaagccccaagcaggatgtcgtgggcaaaaccccaccgtccaccaccgtcggaagtcattcgcccccggagacacccgtactgaccagatcatctgctcagactagtgccgctggcgctacggccacgacctctacttccagtaccgttacagtcactgccccagcaccggccgccactggctcacctgtgaagaagcaacgtcctttactgcctaaggagaccgccccagccgtgcagagggtcgtatggaattcctcaagcaagttccaaaccagctcccagaaatggcacatgcagaagatgcagcggcagcagcaacaacaacagcagcagaaccagcagcagcagcctcagagttctcagggtacccgataccagacccgccaggcagtgaaggccgtccagcaaaaggagatcacgcagtctccatccaccagtactattaccctggttacatcaacacagtcgagcccattggtgacttccagcggctcaatgtccaccctggtgtcctccgtaaacgccgaccttcctatcgccacggcctccgcagacgtggctgcagacattgcaaaatataccagtaaaatgatggatgcaattaaaggcacgatgaccgagatttataatgacctgtccaagaataccactggtagtacaatcgctgagattagaagactgcgcattgagatcgaaaaattgcagtggctacaccagcaggagctgagcgaaatgaagcataatttagaactgaccatggccgagatgcggcaaagtcttgaacaggagagggaccgcttgattgccgaggtcaaaaaacaattggagcttgagaagcaacaagcggtagatgagaccaaaaaaaaacagtggtgtgcgaactgcaaaaaggaggctatcttttattgctgttggaataccagctattgtgactatccatgccagcaggctcattggccagagcacatgaagagttgcacacagagcgctaccgcacctcagcaggaggctgacgccgaagtaaacacagagacactcaataagagtagccagggttcttctagctccacccagagtgccccttctgaaaccgcttctgcaagcaaagagaaggaaacctctgcagaaaagtcaaaagagtcagggtccaccttggatctgtccggaagtcgtgaaacaccctcctcgatcctgctagggtcaaatcagggaagcgaccattcccgcagcaacaagtcgagttggagcagctccgatgaaaagcgcggaagcacaaggtcagaccataacacttcgacaagcacgaaaagtttgctccctaaggagtctaggctggacaccttctgggactag

SEQ ID NO: 22305 - DNA, 3483 bp, Artificial Sequence
  Description of Artificial Sequence: Synthetic coding sequence
atgcacccccagagcctggccgaggaggagatcaagaccgagcaggaagtggttgaaggaatggacatttctaccaggtctaaagatcccggctcggcagagcgtactgcccagaaacgtaaattccctagtccaccgcattcctcgaatggccactcaccccaggacaccagtacttcacctattaaaaagaaaaagaagcctggtctactgaattctaacaataaggaacaaagtgagctgcggcacggcccattttattacatgaaacaaccccttaccacagaccccgtggacgtggttccccaggatgggcggaacgacttctactgttgggtttgccaccgcgaagggcaggttctttgctgtgaactgtgccctagggtctatcacgcaaagtgcttgcgcctcacaagtgagccggagggggactggttctgtccggaatgtgaaaaaattacggtggccgagtgcatcgagacacagtcaaaggcgatgacgatgttaactatcgaacagctgtcgtatctcctgaaattcgctatccaaaaaatgaagcagcccggcactgatgcattccagaaacctgtgccactggaacagcatcccgattatgccgagtatatctttcatcctatggacctttgcacacttgaaaagaatgcgaaaaaaaaaatgtatggatgcaccgaggccttcttggcggacgccaagtggatactccacaactgcatcatctataacgggggcaatcataagctgacccagatcgccaaggtggtgatcaaaatatgtgaacacgagatgaacgagattgaagtctgccctgagtgttacctggctgcttgccagaaacgcgacaattggttctgcgagccctgcagcaatcctcatcctctagtctgggcgaagctgaaaggttttccattctggcccgccaaggcactgagggataaagacgggcaggttgacgcacgcttcttcggccagcatgatagagcatgggttccgataaacaactgttatcttatgagcaaggaaatccccttcagcgtgaagaaaacgaagagcatattcaattcagctatgcaggaaatggaggtgtatgtggagaacatacggagaaagtttggggtgttcaactattccccgttccgaaccccctacactccaaattcccagtatcagatgcttctcgatccaactaatccatctgctggaactgcaaagatcgataaacaggaaaaagtcaaactgaattttgacatgaccgcttctcccaaaattctgatgtccaaacccgtgctatccggaggaactgggcgtaggatatcgctgagcgacatgccccggtcccccatgagtaccaactctagcgttcatacggggtcagacgtggaacaagatgccgaaaagaaagccactagtagccatttctctgcttctgaggaaagcatggattttctggacaagagcaccgcgtcaccggccagcaccaagactggacaagccggctcactgtccgggtccccgaagccattctcccctcagctgtccgctccaatcacaactaaaaccgataaaactagtactactgggtcaatcttgaacttgaacctggaccgttcaaaagccgagatggacttaaaggaactgagtgaaagtgtgcagcagcagtccacccccgtccctcttatctcgccaaagaggcagattcgtagcaggtttcagctaaatctcgataagaccatcgaatcctgtaaggctcagctgggcatcaacgaaatatcggaagacgtgtatactgctgtagagcacagtgacagcgaagattccgaaaagtccgactcttcagacagcgagtacatttcagacgatgagcagaagtcaaagaatgaaccagaggatactgaggataaagagggttgccagatggacaaagaaccatcggccgtcaagaagaagcctaaacccaccaatcctgtggaaatcaaagaagagctgaaaagtacttcacccgccagcgaaaaggcagacccaggcgcagtcaaggacaaggcctctccagagccagagaaagacttctccgaaaaagccaaaccatcacctcatcccattaaggataagttgaagggtaaggatgagacggacagcccaactgtccacttagggttagactctgacagcgaaagcgagcttgtaattgacttaggagaggaccactctggacgagagggccgaaaaaacaaaaaagaaccaaaggagccctccccaaaacaggatgtggtcgggaagacgcctccatctaccaccgtgggatcacatagccctcccgagacgcccgtcctgactcggtccagcgcacagacctcggcggccggagctaccgcgacaacatccacctcttctaccgtgacagtcaccgcacctgcccccgcagctacaggctccccggtaaagaaacagcgtccactcctccccaaggagaccgctcccgctgtccagagagtggtgtggaacagctccaccgtgcagcaaaaggagatcacccagagtccttcaacatccaccatcactctggttacctccacgcaatcctcccctctggtcactagcagtgggagcatgagtaccttggtgagtagcgtaaacgccgacttgcctattgcgaccgcatctgcagacgtcgcagcagatatcgccaaatacacaagcaaaatgatggatgcaatcaagggcaccatgaccgaaatttataacgacctgtccaaaaatacaaccgggagtaccatcgcagagatcaggcgcttgagaattgaaatagagaaattacaatggctgcaccaacaggaattgagtgaaatgaagcacaacttagaactgacaatggccgaaatgcgtcagtccctggagcaggagagggatcggctgatcgccgaagtgaagaaacagcttgagcttgagaaacaacaggccgtggatgagacaaaaaagaaacagtggtgtgccaattgcaagaaggaagctatcttttactgttgttggaatacttcctactgcgattatccatgccagcaggcccactggccagagcacatgaaatcctgtacgcagtccgcaactgcccctcagcaagaggccgacgctgaagtgaatactgaaaccctgaataaaagcagtcagggatcatcttcctcgacccagtcggccccgagcgagaccgccagcgcatccaaggaaaaggaaacttccgccgaaaaaagcaaagagagtggttccactcttgatcttagtggctcccgggaaacaccctcctctatcctgctgggttctaatcaagggtccgatcattctaggtccaacaagagttcttggtcctccagcgacgagaaaagagggtcaacccgctccgatcacaatacatctaccagcactaagtccctgctccccaaagaaagcaggcttgacacattctgggactag

SEQ ID NO: 22306 - DNA, 3645 bp, Artificial Sequence
  Description of Artificial Sequence: Synthetic coding sequence
atggacatcagcacccggagcaaggaccccggcagcgccgagcggaccgcccaaaagagaaagtttccgtccccaccacatagctcgaatgggcattcacctcaagacacaagcacctctccaatcaaaaagaagaagaagcctgggctgctgaacagcaacaataaggagcagagcgagctgcgccatgggcccttctattatatgaagcaacctcttaccacagaccccgttgacgtggtgccccaggatgggagaaatgatttctactgttgggtctgccatcgtgagggccaggtgctttgctgtgagctgtgtccgcgagtttaccacgctaagtgtctgcgcttgaccagcgagcccgagggggactggttctgtcctgaatgcgagaagattaccgttgctgagtgtattgagacacagagtaaggccatgacgatgctgacaattgaacagctgagctacctgctcaaatttgccatccagaagatgaagcagccaggtacagacgcttttcaaaagcccgtaccgttggaacaacatcctgactatgccgaatatatctttcacccaatggatctttgtacgctggaaaagaatgcaaaaaagaagatgtatggatgtactgaagcctttctggccgatgccaaatggattctgcataactgtatcatttataatggcggaaatcataagcttactcagattgcaaaggtggtcatcaagatctgcgagcacgagatgaatgaaatcgaagtctgtcccgaatgttacttggccgcttgtcagaagagggataattggttctgtgagccttgctccaacccccatccactcgtgtgggcaaagctcaaagggtttccattctggcccgccaaagcactcagagataaggacggacaagtggatgcgagattctttgggcaacatgatagggcttgggtgccaataaacaattgctatctgatgtcaaaggagatcccgtttagcgtgaaaaagacaaagtcaattttcaactcagctatgcaggaaatggaggtatacgtagaaaatatccgcagaaagtttggcgtgttcaactacagtccattcagaacaccttacacccccaacagccagtatcagatgttgctggatcccactaaccctagtgcaggaacagctaaaattgataaacaggagaaggtgaaacttaattttgatatgacagcttcgcccaaaatattgatgtctaaaccagtgttgtctggtggtaccgggaggaggatttccctgtcggacatgccgaggtctcccatgagcacaaattcgagtgtgcacacgggctctgacgtggaacaggatgccgaaaagaaggctacctcttcgcattttagtgcgtctgaagaatccatggatttccttgataagtccactgcatctcccgcaagtacaaagaccggccaggcaggatctctatctggaagtccaaaacccttctcaccgcagctatctgcaccaatcacaacgaaaacagacaaaacgtccacaaccggttccatcctgaatttgaatctcgacagatcgaaggccgagatggatctaaaggagcttagcgaatcagtacagcaacagtctaccccagtacctctgatctcccccaaaagacagatacgcagtcgcttccagttgaaccttgataaaacgattgagtcctgcaaagcacaactcgggattaatgagataagcgaggacgtttacaccgccgtggagcattccgatagcgaggatagcgaaaaatccgactctagcgactcagaatacatctcggacgacgagcaaaagtccaaaaacgaacctgaggacacagaagacaaagaggggtgccagatggacaaagagccctccgcagtcaaaaaaaaacctaaaccgaccaacccggtcgaaatcaaagaggaactgaagtcgacaagtcctgccagcgaaaaggccgatcctggcgcagtgaaggataaagcaagccccgaaccagaaaaagacttctcggagaaggcgaaaccttccccacacccaatcaaagataaactaaagggcaaggatgagactgactcaccaaccgtccatctgggcctggactctgactccgaatctgaactcgtgatcgacctgggggaggatcactctggcagagagggccgcaagaataaaaaggagcccaaagaaccctcacctaagcaggacgtcgtgggaaaaacacctcccagcactaccgtgggcagccattctccacccgagacccccgtgctcaccaggtcttctgcccaaacctctgcagccggagcaactgccaccacatcgacgagcagcaccgtgaccgtgaccgctcccgccccagcagcaacagggtcccccgtgaagaaacagagacccctgctgccaaaggagactgcacccgccgtgcagcgcgtggtgtggaattcctcgagcaaatttcagacatcctcacagaagtggcacatgcaaaagatgcagcgccaacaacagcagcagcagcagcagaaccagcagcagcagccccagagctctcaaggaactcggtaccagacccgccaggcggttaaggccgtacagcaaaaggagatcacgcagagcccttctacttcaacaataacactggtgacctctacacaatcaagccctctcgtgacctccagcgggagtatgtctacactagtttcaagcgtgaatgccgacctgcccattgctaccgcgtccgctgatgtggccgcggacatcgccaaatatacatccaagatgatggacgccatcaaaggcacaatgactgaaatttataatgacctgtctaagaacactacgggctcaactattgccgaaattaggagactccgcattgagattgaaaagctgcagtggctgcatcaacaggagctctccgaaatgaaacataacctcgagctgacaatggccgaaatgagacagtcattagagcaggaacgagacagactcatcgctgaagtgaaaaagcagttggaattggagaaacaacaggccgtggacgagactaaaaaaaagcagtggtgcgctaactgtaaaaaggaggctattttctattgctgctggaacacatcttactgtgattacccatgccagcaggcgcactggccagaacacatgaagagctgtacacaatcagcaactgcccctcagcaggaggcagatgcagaggtaaacaccgagaccttgaacaagtcatcacaaggttcctcttcaagtacccagtcagcaccctccgaaaccgcttctgcatccaaggagaaagaaacttctgccgagaagtctaaggagtctgggagcacactggatctgtccggaagccgggagactccatccagcatcttgctgggttctaaccagggcagcgttagcaagaggtgcgacaagcagcctgcatatgctccaacaactacggaccatcagccgcatcctaactaccctgctcaaaaataccattctcggagcaacaagtcatcttggtcgagtagcgacgaaaagcgtggaagtacccgtagcgatcacaacacatccacgtctacaaaatcactgctgccgaaggagagtaggctggacaccttctgggattag

SEQ ID NO: 22307 - DNA, 3408 bp, Artificial Sequence
  Description of Artificial Sequence: Synthetic coding sequence
atgcacccccagagcctggccgaggaggagatcaagaccgagcaggaggtggtcgagggcatggatatttccacacgcagtaaagatccgggatctgccgaacgcaccgcacagaaacggaagttcccatctcccccacattcctctaacggccatagcccacaggatacatctacatctccgattaaaaagaaaaagaagcctggcttgctcaactcgaacaacaaggaacaggatggccggaacgacttttactgttgggtgtgccatagagaagggcaggtcctctgttgcgaactgtgccctcgcgtataccacgctaaatgcctgagactgacatctgaaccagagggagattggttctgtccagagtgcgagaaaatcaccgtcgctgagtgtattgaaactcaaagtaaagctatgacgatgctgactatcgaacagttatcctatctactgaagttcgcaatacagaagatgaagcaaccaggaactgacgcctttcagaaacccgttccgctcgagcagcatcctgactacgccgagtacattttccaccccatggacctgtgcactttggagaagaatgcaaagaagaagatgtatggctgtaccgaggcattcctggctgatgccaagtggatacttcacaactgtataatttacaacggagggaatcataaattgacgcagatcgctaaggtcgtgatcaaaatttgcgagcatgagatgaatgagatcgaggtgtgccctgagtgctacctggccgcctgccagaaacgcgataattggttttgtgagccgtgttcaaatccccatcccttggtttgggcaaagctgaaaggtttccccttctggccagcaaaagccctcagggacaaagacgggcaggttgatgctaggtttttcggccaacatgaccgtgcctgggtgcccatcaacaattgctatctcatgtccaaggagattccattctccgtgaaaaagaccaaatctatcttcaactctgctatgcaggaaatggaagtctatgtggaaaacattcgacgcaaattcggagtcttcaattactcgccctttaggactccttacacccccaattcccagtaccaaatgctacttgaccctaccaacccttctgctggtacggccaaaatcgataagcaggaaaaagtgaaactaaattttgatatgacagccagcccgaagattctgatgagcaaacccgtgctgtccggtggaaccgggcgaagaatcagtctcagtgacatgccaagaagcccaatgtcaacaaactcgtcggtacataccggttcagacgtggaacaggatgccgagaaaaaggccacatccagtcacttttctgcttccgaagagtctatggactttctggataagagcactgcatcccccgccagcactaaaactgggcaggctggtagtttgtcaggatctcctaagcctttctcacctcagctgagcgctcctattactactaagaccgataaaaccagcactactggctccatcctcaatcttaacctcgatcggagcaaagccgagatggatctgaaggaattatcagaatccgtccaacagcagagcacacctgttccattgatatcaccgaagaggcagattagaagccggtttcagctgaacttagataaaacgatcgaatcatgcaaggcccagctgggtatcaacgagatcagcgaagacgtgtacaccgctgtcgagcactccgactccgaggactcagagaagagcgacagttccgacagtgaatacatctctgatgacgagcaaaaatccaagaacgagcctgaagacacagaggataaggaaggttgtcagatggacaaagagccttctgcagttaagaaaaaacctaagcctacgaatcccgtcgagatcaaagaagagcttaaatcgacctcgccagccagtgaaaaggcagatccaggcgcagtgaaggataaagccagccctgagccggagaaggattttagcgagaaagcaaagccctcaccacaccctataaaggacaaattaaaggggaaggatgaaacagatagtccgacagttcatcttggccttgactcagattcagagagtgaactcgtgatcgacctgggtgaagaccatagcggcagagagggacgtaaaaacaagaaagagccaaaggagccctctccaaagcaggatgtggtaggtaaaacccctccttcaaccaccgtgggatcccatagtcccccggaaacacccgttctgactaggagtagcgctcaaaccagcgcagctggagcaactgcgacgacgtccacatctagtacagtgaccgttaccgcacctgccccagcagccacaggatcccctgtgaagaagcagagaccactactaccaaaggagaccgctccagccgtacaacgagtggtctggaactctagcacagtccagcaaaaggaaatcacacagtctccatccacttccacgattactttggtcacttcaacacaatcttcccctctggtaacatcatctgggtcgatgtcaacccttgtttcttccgtcaatgccgatctgcctattgccaccgcaagcgcggatgtggccgccgatatcgctaaatatacgagtaagatgatggatgccattaaggggaccatgactgagatctataacgacctatcaaaaaataccacagggtcaacaattgccgaaatcagacgtttgagaatcgagatagaaaaactccagtggctccatcagcaagagttatcagaaatgaagcataatttagaattaactatggcagagatgcgtcagagcctggagcaggaaagggatcgactgatcgctgaggtcaagaagcagttagagctggagaagcaacaagccgtcgacgagaccaagaaaaaacagtggtgtgcgaattgcaaaaaggaggccatcttctactgctgttggaatacgagctactgtgattacccctgccagcaagcccactggcctgaacacatgaaaagttgtacccaaagcgccaccgcgcctcaacaagaggccgacgcggaggtaaacaccgagactctcaacaaatcatctcagggcagctctagcagcacccagtctgccccctctgagaccgcgtctgcaagtaaggagaaagagacatccgccgagaaatcaaaggaatcaggcagcacactagacctatctggttctagggagaccccgtcatccattttgctgggctctaatcaggggagcgaccatagccgttcaaacaaatccagttggagcagcagtgatgaaaagagaggttctacacggtcagaccataatacatccacttcaaccaagagccttcttccgaaagagtcacgtttggacactttttgggattag

SEQ ID NO: 22308 - DNA, 3411 bp, Artificial Sequence
  Description of Artificial Sequence: Synthetic coding sequence
atgcacccccagagcctggccgaggaggagatcaagaccgagcaggaggtggtggaggggatggacatctccacgagaagtaaagatccaggtagcgccgagaggacagcgcagaaacgcaaatttccttcgccaccacattcttctaacggccatagtccacaagacacctcaacatcaccgattaagaaaaaaaagaagcccggcctgcttaacagcaacaacaaagagcaagacggaaggaatgacttttattgctgggtttgtcaccgggagggacaggtactctgttgcgaactgtgcccgagagtgtaccatgctaaatgcctgagactgacctctgaaccagagggtgactggttttgtccggaatgtgagaagatcactgttgcagagtgcatcgaaacacagtcaaaggcaatgactatgcttacaatcgagcagttgtcatatcttctgaagtttgcaattcagaagatgaagcagcctggaaccgatgctttccagaagcccgtcccgttggaacagcatcccgattatgctgagtacatctttcaccccatggatctttgcactttagaaaaaaacgccaaaaagaaaatgtatgggtgcacagaagctttcctcgctgacgcgaaatggattctccacaactgcattatatacaatggtggcaatcacaaattaactcagattgctaaggtggtcatcaagatatgcgagcatgaaatgaacgagatcgaggtctgtcccgaatgttaccttgcagcctgtcagaaacgggacaattggttttgtgaaccgtgctccaacccccaccctttggtctgggcgaaactgaaggggttcccgttttggccagctaaagctcttcgggataaggatggccaggtggacgcgagattcttcgggcagcatgaccgggcctgggttccaataaacaattgctacctcatgtccaaggagattccgttctctgtgaagaaaaccaagagtatttttaatagtgctatgcaggagatggaagtttatgtcgaaaacatccggcgcaagttcggtgtgtttaattattctccatttaggactccctatacaccaaactcgcaatatcaaatgctcttagatcctaccaatccctcagcgggcacagcaaaaatcgataagcaggagaaggtcaagctgaacttcgacatgaccgcatcaccgaagatcctgatgagcaagcccgtgcttagcggaggtaccggcaggaggatttccctgagcgatatgccaaggtctcctatgagcactaattcttccgtccacaccggcagcgacgtggagcaagatgctgagaaaaaagcgacgtcctcacacttcagcgcatcagaggagtctatggacttcctggacaagagcaccgcatctccggcgtcaaccaagaccgggcaggctggctctctgtcaggttctccaaagccattctccccccagctgtccgcacccattaccacaaagaccgacaaaacctctaccactgggagcattctgaatctgaacctggatagatcaaaagcggagatggacttgaaagaactatctgaaagtgtacagcagcagtcaacgcctgtgccacttatctcaccgaagcggcagattcgatctcgatttcagctcaacctcgataagacaatcgagtcttgtaaggcgcagctcgggataaatgagatcagcgaggatgtatacaccgccgtggagcatagcgacagcgaggatagcgaaaagagtgactcctcagattccgagtacatatctgatgatgaacagaagtccaaaaacgaaccagaggacacagaagacaaggaggggtgtcagatggacaaggagccaagcgccgtcaaaaagaaaccaaagcctaccaatcccgtagagattaaagaggagctaaaaagcacctctccagcttccgaaaaggcagatccaggtgcagtgaaggacaaggcctcaccagaacctgaaaaggacttctcggagaaggcaaagccatcccctcatcccatcaaggataaactgaaaggcaaagacgagaccgactctcccacagtccacctgggcttagactccgatagcgaatctgaactggtcatcgacctcggagaggatcacagcggcagggagggtaggaagaataaaaaagagcctaaagaacctagccccaaacaagatgtagtcgggaaaacgccaccttccactaccgtgggctcacatagtcctcctgagacccctgttctgactcggtctagtgcacagacatcagctgcgggggcgactgctactacctccacctcttctacagtcacggtaaccgcccctgcccccgccgccacaggatcccccgtgaagaagcagagaccacttctcccaaaagagaccgccccagcagtgcagcgcgtggtgtggaactccagtactgtgcaacagaaggagatcacccaaagtcctagtactagcacaatcacgctcgtgacgtcaacccaatccagccctctcgtcactagtagcggctctatgtctactttggtaagttcagtcaatgctgacttgcccatcgccaccgcatcggccgatgtagccgcagacatcgcgaagtatacaagtaaaatacggaggctcagaatcgaaatcgaaaagctgcagtggctgcaccagcaagagctctctgagatgaagcacaacctcgagctcacaatggcggagatgagacagtctctggagcaggagagggatcgcctgatcgcggaagtcaaaaagcagctcgagctggagaaacagcaggctgtggacgagaccaaaaaaaagcagtggtgtgccaattgcaagaaagaggccatattttactgctgctggaacacctcctactgtgactatccctgccagcaggcccattggcccgagcacatgaaatcctgcacgcagtcagctaccgcaccacagcaggaagccgacgctgaggtgaacaccgagactcttaataaaagcagccaaggctcaagcagcagcacacaatcagccccgagtgaaaccgcgtcagcctccaaggaaaaggagacctcagcagaaaaatccaaggagtctgggtctactctggatctctccggctcacgcgagacgccctcttctatcctcctaggaagcaaccagggcagcgtgtccaagcgatgcgataagcagcccgcttacgcacctaccactacagatcaccagccacaccctaactaccctgctcaaaaatatcatagccgatcaaataaatcctcctggagttctagcgatgaaaagcgagggtcaacccggagcgatcataacactagtacctctaccaaaagcctcctccccaaagaatcacggcttgacaccttctgggattag

SEQ ID NO: 22309 - DNA, 3561 bp, Artificial Sequence
  Description of Artificial Sequence: Synthetic coding sequence
atgttcagcagcctgcagaagagcttcaacctggccgaggaggagatcaaaacagagcaggaggtcgtggaagggatggacatctctaccaggtccaaggatccaggctctgccgaacgaaccgctcaaaaacggaagtttccatctccgccccatagttccaatgggcattccccgcaggacacatcaacctctcccattaaaaaaaagaagaagcctggactcctgaactctaataataaggagcaggacggacgcaatgacttttactgttgggtgtgccaccgcgaggggcaggtgctgtgttgtgaactgtgccctagggtctaccacgccaagtgtctgaggctcacctccgagccagaaggtgactggttttgcccggaatgtgagaagatcactgtggcagaatgcatcgagacccaatccaaggctatgaccatgctcacaatcgaacaacttagttatcttcttaagtttgcaatccagaagatgaaacagccaggcacagatgccttccagaaacctgtgccccttgaacaacacccagattatgcagaatatatcttccatcccatggatttatgcaccttggaaaaaaacgcaaaaaaaaaaatgtatggctgcacagaagcttttttggctgacgctaaatggatcctgcacaactgcattatatacaacgggggcaatcacaaactgactcagatcgctaaagtggtaataaagatttgtgagcacgagatgaacgagattgaagtctgtcctgaatgttatctggccgcatgtcagaaacgggacaattggttttgcgaaccttgctctaacccccaccccctggtatgggccaagctcaaagggtttcctttttggccagctaaggccttgcgcgacaaggatgggcaagtcgacgcaagattcttcgggcagcatgaccgggcgtgggtgcctatcaacaattgctacctgatgtccaaggagattcctttttctgttaaaaagaccaagagcatttttaacagcgcgatgcaagagatggaagtttacgtcgagaacattaggcggaagttcggggtgttcaactattccccattccgtaccccctacacccctaactctcaatatcaaatgctcctcgatccaacaaatccctccgctggcacggctaaaatcgacaaacaggaaaaagttaagttgaattttgacatgaccgctagcccaaagattttgatgagcaaacccgtactcagcggcgggaccggaagaaggatctctctgtcggacatgccccgttccccaatgagcaccaattcttcagttcacacggggtccgacgttgagcaagacgctgagaaaaaggcgaccagcagtcacttctctgcctctgaggaatcgatggattttttggataagagcaccgcctctcctgcttcaacaaagaccggccaagctggctcactgagtggctcacctaaacctttctctccccagctctccgcccctattactacaaaaaccgacaagacctctacaactggcagcatcctgaacttgaaccttgatagaagtaaagcagaaatggatctgaaggagctcagcgagagcgtccagcaacagagtacccccgtacccctcatctcaccaaaaaggcagatccgttcccggtttcagctgaatctggacaaaactatagagtcctgtaaggctcagctgggaattaacgagatttccgaagacgtatacaccgccgtggagcactctgactccgaagactccgagaaatccgatagctcagatagcgaatatatttctgacgacgagcagaagagcaaaaacgagccagaggataccgaggataaggagggttgccaaatggacaaggagccctccgctgtcaaaaagaaaccaaaaccaacgaatccagttgagatcaaagaagaactcaagagcacaagtccggcatcagagaaagccgatcccggggccgtgaaggacaaggcaagccccgaacctgagaaagactttagtgaaaaggccaagccaagtccacaccctatcaaggacaaactaaagggcaaagacgaaacagactctcccacagtccacttgggattggacagtgactccgagtcagaactagtcatagatctgggggaggatcactcaggaagagaaggtagaaagaataaaaaagaaccgaaggaaccctcccctaagcaggatgtcgtcggcaagacacccccaagtacaaccgtgggcagccactctcctccagagacccccgtgctgacacggagctctgctcagacgtcggcagccggcgccaccgccacaacctctacctcctccacagtgaccgtaacagcacctgcccccgccgccaccgggagcccagtgaaaaaacagaggccattgttgcctaaagagaccgcacctgccgtgcagagagtggtctggaactcctccagcaagttccagactagttcccagaagtggcatatgcagaagatgcagcggcagcagcaacagcagcaacagcagaatcagcagcagcagcctcaaagcagccaaggcaccaggtaccagactagacaagcggtaaaagccgtccagcagaaggagatcactcaatcacccagcaccagtacaatcacactggtgacatccactcaaagcagcccactggtgacctcttccgggagtatgtcaacgctggtcagttctgtgaatgcggaccttcctattgccaccgcaagtgctgatgtggctgcggatattgcgaaatacacatcgaaaatgatggacgccataaagggaacaatgacagagatctacaacgatttatctaaaaacaccacagggagcacaattgctgaaatccgaagactccgcattgagattgagaagttgcagtggctgcaccagcaggagctcagcgaaatgaagcataatctagaattaacaatggctgagatgcgccagtccttagaacaggaaagggacaggctcatcgccgaagtaaaaaaacaactggaacttgagaagcagcaggcagttgacgaaaccaagaaaaagcagtggtgcgctaactgtaaaaaggaagcgatcttttattgttgctggaacacttcttactgtgactatccttgccaacaggcgcactggccagagcacatgaaatcttgcacacagtctgctaccgctccccagcaagaagccgatgccgaagttaacactgagaccctgaacaaaagcagtcaaggttcgtcctcttctacccagtccgcgccatctgagaccgcaagtgcaagcaaagaaaaggagacttcggccgaaaagtccaaggagagcgggagtactcttgatcttagtggcagtagggagaccccctcgagtatattgctggggtcaaaccaaggaagtgaccacagccggtcaaacaagtcatcctggagctcgtccgacgaaaagcgcggctccacccgctctgatcataacacatctacatccaccaaatcattgttaccaaaggagagccggttggacacattttgggactag

SEQ ID NO: 22310 - DNA, 75 bp, Artificial Sequence
  Description of Artificial Sequence: Synthetic coding sequence
atggacatcagcacccggagcaaggaccccggcagcgccgagcggaccgctcagaagcgaaagtttccgtcctag

SEQ ID NO: 22311 - DNA, 129 bp, Artificial Sequence
  Description of Artificial Sequence: Synthetic coding sequence
atggacatcagcacccggagcaaggaccccggcagcgccgagcggacggcccagaaacgcaaatttccgtctcctccccattcaagcaatggccacagcccacaggacacaagcacttcccccatctag

SEQ ID NO: 22312 - DNA, 3318 bp, Artificial Sequence
  Description of Artificial Sequence: Synthetic coding sequence
atggacatcagcacccggagcaaggaccccggcagcgccgagcggacagctcagaaacgcaaattccccagcccccctcactcctcaaacggccacagtccccaggatacgtccacatcgcccataaagaagaagaaaaagcccggactcctgaacagtaataataaggaacaagatggccgcaacgacttctactgttgggtatgtcatagggaaggacaggtcctgtgctgtgagctgtgcccacgggtttaccatgctaaatgcctgcggctgacctcagaacccgagggagactggttttgtccggaatgtgaaacagacgcttttcagaaacccgtgcccttggagcagcaccccgactacgccgaatacatctttcaccccatggacctctgcactttagaaaagaatgccaagaagaaaatgtacggctgtacggaagccttcctcgcggacgctaaatggatccttcacaactgcattatatacaacggcgggaatcacaaactaacacaaatcgccaaggttgtgattaagatctgcgagcatgaaatgaatgaaatcgaggtctgccctgagtgctacctcgccgcctgccaaaagcgcgacaattggttctgtgagccctgcagcaatccccatcccctggtgtgggcgaaactaaagggctttcctttctggcctgcgaaagctttgcgggacaaagatggccaggtggatgccaggttctttgggcaacacgatcgggcttgggtgccaattaacaattgctacctcatgtcaaaagagatccccttttccgtcaagaagacaaagagtatttttaattcagcgatgcaggaaatggaggtgtacgtcgagaatatcaggcggaagtttggtgtcttcaactactcaccttttcgtacaccttacactcctaatagccagtatcagatgctgctggaccctacaaatccatcggctgggaccgcaaaaatcgataaacaggagaaggtaaagctcaacttcgacatgacagccagtcccaagatcctcatgtctaagcctgtactctctggcgggactggcaggagaatcagcttgtcggatatgcccagatctcctatgtctacgaatagctccgtgcacactgggtctgatgtggaacaggacgccgagaagaaggctacgagcagccacttctcagcctccgaagaaagcatggattttctggacaaatctaccgcatcgccagcctcaacaaagacaggacaagcgggctctcttagcggtagtcccaaaccattctcaccgcagctctccgccccaataactacgaaaacagacaaaacgtccaccaccggctccatccttaacctcaacttggacagaagtaaagcagaaatggacctcaaagagctctccgagtcggtgcagcagcagagcacacccgtgccccttatatcccccaaacggcaaatcaggagtcgattccagctgaacctggacaagactattgagtcctgtaaagctcagcttggaatcaatgaaatttccgaggacgtgtataccgcagttgaacactctgacagcgaagactctgaaaaaagcgactcaagcgattctgagtatatctccgatgatgaacaaaaatccaagaacgaaccagaggacaccgaggataaagagggctgtcaaatggataaggagccatctgctgttaagaagaagcctaagccgacaaatccagttgaaattaaagaggaactcaagagcacatcccccgcttctgagaaggcagaccctggtgctgtgaaagataaagcttcacctgaacctgagaaggattttagtgaaaaggctaagccttccccacacccaatcaaagataagctgaagggaaaggacgaaacagattctccaacagtgcatctaggcttggactcagattccgaatccgaactcgtcatagacctgggggaagaccatagcgggagagagggaagaaagaataagaaagaaccaaaagagccatctccaaaacaggacgtggtgggaaaaacccctccttcaacaaccgttggcagtcatagccctccagagacgcctgtattgacccggagtagcgcacaaacatctgccgccggggctaccgcgaccacctccaccagcagcactgtgactgtgacagccccagcacccgctgccaccggctctcctgttaaaaaacaacgaccgctgctgccgaaagaaaccgcccccgctgttcagagagtggtgtggaactcgagcacggtccagcagaaagagatcacccagtccccttcaaccagcaccataacgctggtgaccagcactcaaagctcgcctctggtgacctcctcgggttcaatgagcaccctcgtaagcagtgtgaatgccgatctgcccatcgctaccgcttccgcagacgtagcggccgatattgcaaaatatacttctaaaatgatggatgctattaagggcacaatgacagaaatttacaatgatcttagcaaaaacaccacaggatccaccattgccgagattaggcggttgagaattgagatcgagaagctgcagtggctgcaccagcaagagctctctgagatgaaacataatctggagctgaccatggcagagatgcggcaatccctcgagcaggagcgcgaccgacttatcgctgaggtaaagaagcagctggagctcgaaaaacagcaagccgttgatgagaccaaaaagaagcagtggtgcgccaactgtaaaaaggaggctatcttttattgctgctggaacacttcctactgcgactacccatgccagcaggcccattggccagaacatatgaaatcctgcacacagagcgctaccgcccctcaacaggaagctgacgcagaggtgaacacagaaacgctgaataagagctcacaggggagctccagtagcacccagtccgccccctcagaaacggcgagcgcttctaaggaaaaggaaaccagcgctgagaaaagcaaggagtcgggctcgacactagacctgagcggatcaagggaaactccctcctcaattttattaggcagtaaccagggaagtgtgtcaaagcggtgcgacaagcaacccgcgtacgcccccaccactacagaccaccagccacaccccaactaccctgcccaaaagtaccactcacggtcaaacaagtcatcttggagctctagcgatgaaaaaagaggatccacccggtcggatcataacacatccacaagtaccaagtcacttctcccaaaggagagtcggctcgatacgttctgggactag

SEQ ID NO: 22313 - DNA, 3567 bp, Artificial Sequence
  Description of Artificial Sequence: Synthetic coding sequence
atgcacccccagagcctggccgaggaggagatcaagaccgagcaggaggtggtggagggcatggacatcagtacccgaagtaaagatccagggtccgcggaacgcacagcccagaaacgcaaatttccgagtccccctcatagtagcaatggccattctccccaggacaccagtacctcccctattaagaaaaagaaaaaacccgggctcttgaactcgaacaataaggagcagtccgaactgaggcatggtccattttactatatgaagcagcccctgacaacagacccggtggatgtcgtgccccaggatggtagaaacgatttctactgttgggtgtgtcatcgcgagggacaggtactgtgttgcgagctctgtccccgcgtgtaccacgcaaagtgtctccgacttactagcgagcccgagggcgactggttctgcccagagtgcgagaagatcacagtggccgaatgtattgagacccaatccaaagcgatgaccatgctaacaattgagcagctatcttacctcctgaaattcgccatccaaaagatgaaacagcccggcaccgatgccttccagaagcccgtacccctggaacaacaccccgattatgcagagtatatcttccatcccatggatctgtgtacgctggaaaagaacgcaaaaaaaaagatgtacggctgtacagaggccttcctagccgatgccaaatggattctgcataactgcataatttacaacggaggcaaccacaaactgacccagatcgcaaaggtggtgattaaaatttgtgaacatgagatgaacgaaatagaggtctgtcccgaatgctatcttgccgcttgccaaaagagagacaactggttttgcgaaccctgttcaaacccccaccctctggtgtgggctaaactaaaagggttccccttctggcccgccaaggcgctcagggacaaagatggacaagttgacgcgagattcttcggtcagcacgacagagcatgggtacccataaacaactgctacttaatgagcaaagaaatcccattctcagttaagaagaccaagtcaatttttaatagcgcaatgcaggagatggaagtttacgtcgagaatatccggagaaagtttggggttttcaactattcaccttttcgcactccttacactcccaacagccaataccagatgctgctcgaccctacgaacccctcagccggaacggccaaaatagacaaacaggaaaaggtgaaactcaatttcgatatgactgcatcccccaagatactgatgagtaagcctgttctctccggagggactgggcggcggataagcctgtccgatatgccacgctccccgatgagcaccaattcatcagtgcacacaggttctgacgttgagcaggacgccgagaagaaggccactagttcccacttttcagcctccgaggaaagcatggattttttggacaaatccactgcctctcctgctagcacaaagaccggtcaggctggctctctgtcaggctcccccaagcccttttccccccagctgagcgcccctattaccaccaagaccgacaagacaagtaccactggtagcattctcaacttgaacctggatagaagcaaggctgagatggatctgaaagagttgtcagaatcggtacagcagcaaagcacccctgtgccattaataagtcctaaaaggcagatcagatctcgctttcagctgaatctggataagactatcgagtcttgcaaggcccaactggggattaacgagattagtgaggacgtatacactgctgtagagcattctgacagcgaagacagcgagaagtccgacagtagcgatagcgagtatatcagcgacgatgaacagaagagcaagaatgagcccgaagatacagaagacaaagagggttgccaaatggataaagagccatcagctgttaaaaagaagccgaagcctaccaaccctgtcgagattaaggaggaactcaaatctacatctccggcttcggagaaggctgaccccggggccgtcaaggacaaagcatctcctgagcctgagaaggatttcagtgagaaggccaagccaagcccacaccctataaaagataaactgaagggtaaagacgagacagacagccctaccgtgcacctggggctagacagtgactcggaaagtgagctggtcatagaccttggcgaggaccacagcgggcgcgaaggacggaagaataaaaaagagcccaaggagccaagccccaagcaggacgtggtggggaagaccccaccttcaaccacagtcggttctcacagccctcccgagacacccgtcttgacccggtcttctgcacagacctctgctgccggcgccacggctacgacatcaacctccagtaccgtcaccgtcacggcccctgcacccgctgccacaggatccccagtgaagaagcaacggcccctgctccccaaagagaccgctcccgcggtgcaacgggtggtctggaattccagtacagtgcagcagaaggaaatcacccagtcaccatccacctccactattactctcgtgacatctactcagtcaagccccctcgtgacgtcgagcggttccatgtccactttggttagtagtgttaatgccgacttaccgatcgccactgcgagcgcggatgtcgctgcagacattgctaaatacacgagcaaaatgatggatgcaattaaaggcacaatgacggaaatctataacgatctctccaaaaatacaacagggtcgacgatcgctgagataagacgtttgaggatcgaaatcgagaagctgcagtggctgcatcaacaggagcttagcgagatgaagcacaatctggagttaacgatggccgaaatgcggcagtctttggagcaagagagggatcgactcattgcggaggttaagaagcagctggaactagaaaaacaacaggctgttgatgagacaaagaagaaacagtggtgcgctaactgcaaaaaggaggccatcttctactgttgttggaatacttcttactgcgattacccctgtcagcaggcacattggcccgagcatatgaagagctgtacccaatctgcaaccgccccacagcaggaagctgacgcggaagtgaataccgagacactaaataagtcatcacagggctcctcttcatctactcagtcagccccttccgaaaccgcttccgcatctaaggaaaaggaaacatccgctgagaaaagcaaagagtccggctctacactggacctgagcggaagtcgggaaacaccctcaagtattctgctaggatccaatcagggaagtgtttccaagcggtgcgataagcagccggcttacgctcctactacgacagatcaccaaccacatccaaattacccagcccagaaatatcattctaggtccaacaaatccagctggtccagctccgatgagaagagagggagcacccgtagcgaccacaacaccagcaccagcaccaagtcactgctcccaaaagagagtaggttggacaccttttgggattag

SEQ ID NO: 22314 - DNA, 3291 bp, Artificial Sequence
  Description of Artificial Sequence: Synthetic coding sequence
tgaaccgaccccgtggacgtggtgccccaggacggccggaacgacttttattgttgggtgtgccaccgcgaagggcaggtcctctgctgcgaactgtgtcctagggtttatcacgctaaatgtctacgcctgactagcgaacctgagggggactggttctgccccgaatgcgagaaaatcaccgtggcagaatgtattgaaactcagagcaaggccatgacaatgctgaccattgagcagctctcataccttttgaaattcgcaattcagaagatgaaacagcccggaactgacgccttccagaaacccgtccccttggagcagcaccccgactatgctgaatatatctttcatcctatggatctctgcacactagaaaagaacgccaagaaaaagatgtatggatgtaccgaggcttttcttgccgacgcaaagtggatcctccacaactgcattatctacaatggaggcaaccataagctgactcagatagcgaaagtagttatcaaaatctgcgagcacgaaatgaacgagatagaggtctgtccggaatgctatcttgctgcgtgtcaaaagcgagataattggttctgtgagccatgcagcaaccctcacccccttgtctgggctaaactgaaaggtttccccttctggccggctaaggccctgcgggataaggatggtcaagtcgatgctcgattcttcggacaacatgaccgcgcatgggtccctatcaataattgctatttaatgtcgaaggagattccattcagcgtaaagaagactaagagcattttcaattctgctatgcaagaaatggaggtttacgttgagaacatccgcagaaagttcggcgtgttcaattacagtcccttccggactccatatacccccaacagtcaataccagatgctgctggacccaacgaacccctcagccggaaccgccaagatcgacaaacaggaaaaggtaaagctgaattttgatatgaccgcctcaccaaaaatcctgatgtccaaaccggtgctgtctggaggaactggcaggcgaatttcactcagtgatatgcctcgctcaccaatgtccactaactcttcagtccatactggtagcgacgtggagcaggacgccgaaaagaaagctacctccagccacttcagcgcctcagaagagagcatggacttcttggataagtctaccgcgagtcccgccagcaccaaaaccggtcaagcgggctctctaagcggtagcccaaagcctttttcacctcagctgagcgccccgattaccacaaagacggacaagacaagcaccactggtagcatcctcaatcttaacctgggtcacagaagcaaagccgagatggacctgaaggaactatcagagagcgtccagcagcagtccacacccgtgcccctcatctccccaaagagacagatccggtcgcggttccagttgaatttggacaaaaccatagaatcttgtaaagctcaacttggaatcaacgagatcagcgaggatgtgtatacagcggtagagcactccgactcagaggactccgaaaagtccgattccagtgactcagaatatataagtgacgacgaacagaagtcaaagaatgagcccgaagacacagaagataaagagggctgtcagatggataaggaacctagcgccgtgaaaaaaaaacctaaaccaaccaacccggtcgaaatcaaggaagagctcaagtctacctcccccgcaagtgaaaaggcagatccgggagctgtaaaggataaggcttcacccgagccagagaaggatttctctgaaaaggccaagccatcgccacatcctatcaaagacaaattgaaaggcaaggacgaaaccgattcccctacagtccacctggggttggactcggatagtgagagcgagctggtcattgatctgggtgaggatcactccggtagagagggtcgaaaaaataagaaggaacctaaggaaccatctcccaaacaggacgtggttggtaaaaccccccctagcactacagtgggtagccattccccgcctgaaacaccagtgctaacaagaagctccgcccagacatctgctgcaggggccaccgctacaacctcaaccagctcaaccgttacagtcacagcaccagcaccagcggccacaggtagtccagttaaaaaacagagaccactgttgcccaaagagaccgcccccgcggtccagcgtgtcgtgtggaactcatcgacagtacagcagaaggagatcactcagagcccgtccacctctacaatcacactggtgaccagcactcaatcttcgccactagtgacttctagcgggtccatgagtaccctcgtatcgtcagtcaatgctgacctccctatcgccaccgccagtgcagatgtagctgcggacatagccaaatatacttccaaaatgatggacgcaattaagggcaccatgactgagatctataatgatctgtccaaaaataccaccgggagtacgattgctgagattcgccggcttcggattgaaatcgagaaactgcagtggctgcaccagcaggaattgtctgagatgaagcacaatctggagttgacaatggccgaaatgcgacagtccctggaacaagaaagggaccgccttattgcggaagtcaagaagcaactggagctggagaaacagcaggccgtggacgagacaaagaagaagcaatggtgcgccaattgtaagaaggaagctatcttttattgttgctggaatacaagctactgcgactacccatgccaacaggcgcattggcctgaacacatgaagtcttgcacacaatccgccacagcccctcagcaggaagccgacgcggaggtgaatactgagaccctgaacaagagtagccagggaagttcttccagcacccagtcagcgccctccgaaacagcctctgcctctaaggaaaaagagacctctgccgaaaaaagcaaggagagcggatcgacgctggacctgtctggctctagagagaccccatccagcattctgctgggctcgaaccagggcagtgtttctaagaggtgcgacaaacagcccgcctacgcccccactacaaccgatcaccaacctcatcccaattatcctgcccagaagtaccactctcgcagcaacaaatccagctggagttctagcgacgagaagcgcggcagtacccggtctgaccataatacttcgacctctacaaagagcttactccctaaagaatccagattggacaccttctgggactag

SEQ ID NO: 22315 - DNA, 3726 bp, Artificial Sequence
  Description of Artificial Sequence: Synthetic coding sequence
atggtgttcctggaggagttcgaggcccggagctgcctggccgaggaggaaatcaagaccgaacaggaggtcgtcgaaggcatggatattagcacacgctctaaggatcccggcagtgctgagagaactgcccagaagagaaaatttccgtccccccctcattcatccaatggacatagccctcaggatacctctacaagtcccataaaaaagaagaaaaaaccagggttgctcaattcaaataataaggaacagtcggagctccgccacggaccgttctattatatgaaacagcctctcactaccgatcccgttgacgtggttccccaggatggccgaaatgatttctattgttgggtgtgtcatcgggaggggcaagtgctttgctgtgagctgtgtccccgtgtttatcatgctaagtgcctcagactaactagtgagcctgaaggcgactggttttgtccggagtgcgagaaaattactgtggctgagtgtatcgaaacacagtctaaagctatgaccatgcttactattgaacagctgtcctacctattgaagttcgcgatccagaagatgaagcagcccggtacagatgcgttccagaaacctgtgccgcttgaacaacatcctgactacgccgaatatatcttccatcccatggacctctgtacactggagaagaatgcaaagaagaaaatgtacggatgcacggaagcctttctggcagacgctaagtggatcctccacaactgcattatatataatggcggaaatcataaactgacccagatcgcgaaggtggtgatcaaaatctgcgagcacgagatgaatgagatagaagtatgccccgaatgctacctcgcagcatgccagaagcgggataactggttctgcgagccttgcagcaaccctcaccctctcgtctgggccaaactcaaaggatttcctttctggcccgccaaggctctgagggacaaggatggtcaggttgatgcccgattttttggccagcatgacagggcttgggtgcctatcaataactgctatttaatgagcaaagagatccctttttccgttaagaaaaccaagtcaatttttaatagtgctatgcaggaaatggaggtgtatgtagaaaacatccgtcgaaagtttggggtgttcaactattcgccattccgcaccccatacacgcccaatagccagtaccagatgctcctcgaccctactaacccgtccgccgggaccgcaaaaatcgacaagcaggagaaagttaagctcaacttcgacatgacggcttcgcccaaaatcctgatgtcaaaaccagtactgagtggcggaacagggagacggatcagcttgtccgacatgccacgtagcccaatgtcaactaatagcagcgtgcacaccggctctgacgttgagcaggatgccgaaaaaaaagctacatcgtcgcacttcagcgcaagtgaagaatcaatggatttcctggataagagcacagcctcccccgcttctacaaagacagggcaggcagggagcctgagcggttctcccaagccgttctctcctcagctgagcgcaccaataacgaccaagactgacaagacctctactacaggctccatcctaaatctgaatctggataggtccaaggcagagatggacctgaaagaattgtccgagtcagttcagcagcagtctacccccgtcccactgatttctcccaaaaggcagatacgtagtcgcttccagctaaacctcgataagacgatagagtcatgtaaagcccagctgggtattaatgagatctccgaagatgtctatacagcagtcgagcacagtgattctgaagactccgaaaaaagtgactcaagcgatagcgaatatattagcgatgacgaacagaagtcaaagaatgaaccagaagatacggaggacaaagaggggtgccagatggataaagagccctcagccgtgaagaaaaagcccaagccaaccaaccccgttgagatcaaagaggagctgaagagcaccagcccggcctcggagaaggctgatcctggggctgttaaggataaagcaagtcccgagcctgagaaggacttctctgaaaaggcaaagcccagtccccatcccatcaaagacaagctgaaaggcaaggatgaaacagattcgccaaccgtacatctcggacttgacagtgattcggagtctgagttagttattgacctaggtgaagaccactcggggcgggagggcaggaagaacaaaaaggagcccaaggagccatcacctaaacaggacgttgtgggaaagaccccccccagcacaactgtgggttcacattctcctcccgaaacacctgttttgacccggtcaagcgctcagaccagcgccgcaggagccaccgctacaacaagtacaagtagcacagtcaccgtcacagcccctgccccggcagcaaccggatcccccgtgaagaagcagaggccactgctccctaaagaaaccgctcccgctgtgcagcgggtggtctggaacagcagtagcaagttccagacaagctcccagaaatggcacatgcaaaaaatgcaaagacagcagcaacagcagcagcaacaaaatcagcagcagcagccgcagtcgtctcagggtacgcggtatcaaacaaggcaggctgtcaaggccgtgcagcaaaaggagattacacagagcccctctacttctactattacactcgtgacttctactcagtccagcccgctggtgacatcctcggggagtatgagtactctcgttagttctgtgaatgcagatcttccgattgctaccgcgagcgcagacgtggcggcagatatcgcgaaatatacgtcaaaaatgatggacgccattaagggcacgatgaccgagatatacaatgacctgagtaaaaacacaacagggtccaccatcgcagaaatccgcagattgagaatcgagattgaaaaactgcagtggctgcatcagcaggagttgagcgagatgaaacacaatctggagctcacaatggctgagatgcgccagagcctagaacaggaaagagatagactgatagccgaggtcaagaagcagttagagctcgagaaacagcaggccgtggatgaaaccaagaaaaagcagtggtgcgctaattgcaagaaggaagctatcttctattgctgttggaacacctcctactgtgactatccctgccagcaggcacactggccagagcatatgaagtcttgtacccagagcgctaccgctcctcagcaggaagcggatgctgaagtgaatactgagactctaaataaatcaagtcagggtagttccagtagtacccagagcgctcccagtgagacagcctccgcaagcaaagaaaaagagactagtgctgagaagagtaaagaatcgggctccactctcgacctgtcgggcagtagagagactcctagttccatcctacttggcagcaaccagggtagcgttagcaagagatgcgataagcagcctgcatacgcgccgactacaactgatcaccagccacacccaaattatcccgcccagaagtaccactcccgcagtaataagtcctcatggtcgtctagcgacgagaaacgagggtcaactcggagtgatcacaacacatccacgtctacaaagagtctgctgcccaaagagtctcgcctggatacattttgggactag

SEQ ID NO: 22316 - DNA, 3405 bp, Artificial Sequence
  Description of Artificial Sequence: Synthetic coding sequence
atgcacccccagagcctggccgaggaggagatcaagaccgagcaggaggtggtcgagggaatggacatttcgacacgcagtaaggaccccggaagtgccgaacgtactgcccaaaagcgtaagtttccatcacctccgcacagttctaacggccactcaccccaggacacttctacatccccaatcaaaaagaagaagaagccagggcttcttaattccaacaataaggagcaggatggtaggaacgacttctactgttgggtgtgccacagagaagggcaggtgctctgctgtgagttatgccccagagtgtaccatgccaagtgcctccgccttacttccgaacccgagggcgattggttttgccccgaatgtgagaaaatcacggttgctgaatgcatagagactcagtcgaaagccatgaccatgctcacgattgagcagttaagctatctgctgaagttcgccatccagaagatgaaacagcccggcacagatgcattccagaagcccgttcccctcgaacagcaccctgattatgccgagtatatatttcatcccatggacttgtgtaccctggagaaaaacgcaaaaaagaaaatgtacggctgtacggaggcttttctggccgacgcaaagtggatactgcataattgcatcatctataatggaggaaaccacaagctgacccaaattgcaaaagtggttatcaaaatttgcgagcacgagatgaacgagatcgaggtctgccccgaatgctaccttgccgcctgccaaaagcgcgataactggttctgcgagccttgcagcaatccccacccgctggtttgggcaaaactgaaaggctttcctttctggcccgctaaggcgctgagagacaaagacggacaggtcgacgctcgcttctttgggcaacacgatcgggcgtgggtccctattaataattgctatctcatgtcaaaggagattccttttagcgtgaagaagactaagagcatctttaactccgccatgcaggagatggaggtctatgttgagaatatacgtcgaaagtttggcgttttcaactattcgccattccgcactccctacacaccgaattcccagtaccaaatgctgcttgacccgaccaatccctctgcggggactgccaagatagataagcaagagaaggtgaagctgaactttgacatgacagctagccctaagatcctcatgtccaaacccgtgcttagtggcgggaccggccggcggatatccctgtcagatatgcccaggagccctatgtcgacgaattcaagcgtccacacggggtccgacgtggaacaggacgccgaaaaaaaggcgaccagttctcatttctccgccagtgaggagtctatggattttctggacaagtccacggacaggagcaaggctgagatggacctgaaagaattaagtgaaagtgtacagcaacagtcaacaccggtgccattaatctcgcccaagcgtcagattaggagtcgatttcagctgaaccttgataagactattgagagttgcaaagcccagctcgggataaacgaaatttcagaagatgtttacactgctgttgaacattcagacagtgaagattccgagaaatctgacagctcagactcagagtatatctcggacgatgaacagaagtccaaaaatgagcccgaggatacagaagacaaggagggttgccagatggacaaagaaccatcggctgttaagaagaaacccaagcccaccaatcccgtcgagattaaagaggagctcaaatccacgagtcctgcatccgagaaggcagaccccggtgctgtaaaagacaaagcctctccggaacccgagaaagactttagcgagaaggcgaagccttctccacaccctattaaagacaaactgaaaggaaaggatgagacagattcccccaccgtgcacctgggccttgatagcgactccgagtcggagctggttatcgatttaggggaagaccactccggccgagaggggcgcaaaaataagaaagaacctaaggagccttcacccaaacaagacgtggtggggaagaccccccctagtactacagttggatcccactccccccccgagacccccgttcttacgaggtcatccgcccagacaagcgccgccggtgcaaccgctacaacatcgactagctccacagtgactgtaaccgcacctgccccggcagccaccggctcccccgtcaagaagcagaggcctctactgccaaaggagaccgcccccgccgtccaaagagtggtgtggaatagtagtagcaaattccaaacgagctctcagaaatggcacatgcagaagatgcaacgccagcaacagcaacagcagcaacagaaccagcagcagcagccccagtcctctcaaggaaccagataccagactcgccaggcagtcaaggcagtacagcagaaggaaatcacacagtctccatccacatccactattactctggtcacatccacgcagagctccccactggtgacctcaagcggctccatgtctaccctggtgagttcagttaatgccgatctgcctatcgctaccgccagtgcggatgtcgcagctgacatcgcgaaatacacatcaaagatgatggatgcaataaaagggaccatgactgagatctacaacgatctgagcaagaataccaccgggagcacaatcgccgaaatacggagactcagaatcgagatcgagaagctgcaatggttgcatcagcaggagctcagtgagatgaagcataatttggagctgacaatggccgaaatgcgacaaagtctcgagcaagaaagggacagacttatcgccgaggttaaaaaacagctggaactagaaaaacagcaggccgtggatgagacaaagaaaaaacagtggtgtgcaaattgcaagaaagaagccatcttctactgttgctggaacacaagctactgtgactatccgtgtcagcaggcccactggccagagcatatgaagagctgtacgcagagcgccaccgctccccaacaagaggcagacgcagaggttaatactgagacgctgaacaaaagttcccaggggtcaagcagctccactcaatccgccccttctgaaaccgctagtgcttcaaaggagaaagagacttcggccgagaaaagcaaggaatctggctcgacgctcgatctgagcgggtcccgggagaccccatcatcgattctgctgggcagcaatcaggggtcagaccatagtcggagtaacaagtcatcctggtctagtagtgacgagaaacggggctcaactaggtctgaccataacacctccaccagcaccaagtctctgctcccgaaagaatcaagattggacaccttctgggattag

SEQ ID NO: 22317 - DNA, 2805 bp, Artificial Sequence
  Description of Artificial Sequence: Synthetic coding sequence
atggaggagcggcggccccacctggacgcccggccccggaacagccatactaaccaccggggacccgtggatggtgaactaccgccgagggctcgaaatcaagccaacaacccacccgcgaacgctctgagaggtggagctagccaccctggacggcatccaagggcaaataatcatcccgctgcatattggcagcgcgaagagcgcttccgggctatgggacgcaatccccaccaggggcgccggaaccaagaaggccatgcttcagatgaggcgcgggatcagagacacgatcaggaaaatgataccaggtggaggaacggcaaccaggactgtagaaatagaaggcctccatggagcaacgacaatttccagcagtggcgaacaccacaccagaaaccaacagagcagccacagcaggccaagaagctgggctacaagttccttgaaagtctgctgcaaaaagaccctagcgaagttgtaattactctggccacatctctgggtttgaaggagctgctgagccactcgagcatgaaatccaactttttagaactgatttgtcaggtgctgagaaaggcatgttcctcaaagatggataggcagagcgtgctgcacgtactgggcattttgaagaatagcaaatttctaaaggtgtgcttgcctgcatacgtggtcggcatgattactgaacctattccagatattcggaaccagtatccagaacatatttccaatatcatcagcctgttacaggacttggttagcgtgtttcctgcatctagcgttcaggagacttctatgctggtgagccttctgcctacatcactcaatgcactgcgagccagcggcgtggatattgaggaggagacggagaagaacttagagaaagttcaaacaattatcgagcatttgcaggagaagagacgcgaaggcaccctgagggtggacacctataccctggtgcagccggaggcagaggaccacgtcgaatcctacagaaccatgccgatctaccccacctataatgaagtgcacctggacgaacgtccgtttctgcgccccaacatcatttccgggaaatacgactcaacagctatttatctggatactcactttcggctgctacgagaggatttcgtgaggcccctgcgagaaggaatcctggaattgctgcagtcgtttgaggaccaggggctgcgcaaacggaagtttgacgatattcgtatctacttcgatactaggatcattactccgatgtgttcttctagcgggatcgtgtacaaggtgcagttcgataccaagcctctgaagttcgtgcgctggcaaaattccaaaaggctgctgtacggttccctggtttgtatgtcgaaagacaacttcgagacgttcttgtttgccacagtgagtaaccgcgaacaggaggacctgtgtcgcggaattgtacagctgtgttttaacgagcaaagccaacagcttctggccgaggtgcaaccttctgacagctttttgatggtggagaccaccgcctattttgaggcatacagacacgtcctggagggcttgcaggaggtgcaggaagaggacgtgccttttcagcgcaacatcgtggagtgcaacagccatgtaaaggagccaaggtaccttctcatgggtggtcggtatgacttcacgcccctgattgagaacccttcagctaccggcgaattcctgcgtaacgtggagggactgaggcacccacgcatcaatgtgcttgacccaggccagtggccgagtaaggaagccttgaagctggacgattcccagatggaagccctccagtttgccctcacacgggaattagctataatacagggtccacctggcactggtaagacctacgtggggctcaaaattgttcaggccttgttaacgaacgaatctgtgtggcagatcagcttacaaaagtttcccatcctggttgtctgctacacaaaccacgcccttgaccagttcctggaaggtatctacaattgtcagaagacatccattgtgagagtggggggccgatccaattctgagattctgaaacagtttactcttcgtgagctgcgcaacaaacgcgagtttcggcgcaacttgccaatgcatttaaggcgggcatacatgtccataatgacccagatgaaagagagcgagcaggagctgcatgagggggccaagacattggagtgcactatgaggggagtccttcgagaacagtacctgcagaaatacatctctccgcaacactgggagtcactcatgaatgggccagtgcaggattccgaatggatatgcttccagcattggaagcatagtatgatgttggagtggctcggacttggcgtggggagtttcacccaatcagtgtctcccgcgggaccagagaacaccgcacaggcagaaggagatgaagaagaagaaggagaggaagaatcctcattgattgaaattgctgaggaggccgacttaattcaggctgatcgagtgatcgaggaggaggaggtggtccgccctcagcgccgcaaaaaagaggaatctggagccgaccaggaactagctaagatgcttctggctatgcgtctggaccattgtggaaccggaacagccgcaggtcaggaacaagccacgggcgaatggcaaacacagagaaaccagaagaagaagatgaagaaaagagtaaaggacgagttgagaaaattgaatactatgactgctgccgaggctaacgagattgaggacgtctggcagctggatctgagttcccgctggcaactttactag

SEQ ID NO: 22318 - DNA, 5757 bp, Artificial Sequence
  Description of Artificial Sequence: Synthetic coding sequence
atggaggagcggcggccccacctggacgcccggccccggaacagccataccaaccataggggaccagtcgacggcgaactgccccctagggcgcgaaaccaggccaataatccgcccgcaaatgctttacgcgggggcgcgtctcacccgggtagacaccctcgggccaacaatcaccccgctgcatactggcaacgtgaggagcggtttagggctatgggccggaatcctcatcaggggaggaggaaccaggaaggccacgctagcgacgaggcaagggatcaaagacacgaccaggagaacgatactaggtggagaaatggaaatcaagactgccgcaataggaggccaccctggagcaacgataattttcagcaatggcgcaccccgcatcagaaacctactgagcagccacaacaggccaagaaactgggctacaaatttcttgaatcccttctgcaaaaagacccgtccgaggtggtcattaccctcgccaccagcctaggccttaaggaacttctgtcacactcctccatgaaaagcaatttccttgagctgatctgtcaggtactgaggaaagcatgcagctccaaaatggaccgacagtccgtgttgcatgtgcttggcatccttaaaaatagcaagttcctgaaggtgtgtttgcctgcctacgtagtgggaatgattacagaaccaatacctgatataaggaatcaataccctgagcatataagcaatattatatctctactgcaggacctagtttccgtctttcctgctagcagtgtgcaagaaacgtccatgcttgtaagtctccttcccaccagcttaaatgctctgagagcttctggcgtcgatattgaggaggagaccgagaaaaatctggaaaaggttcaaaccatcatcgaacatctacaagagaagcgaagggaaggtaccttgcgggtcgacacatatactttggttcaacctgaggccgaagaccacgtcgagtcatacaggaccatgccaatttatccgacttataacgaagtccaccttgacgagaggccttttttacggccaaacattatttccggcaagtacgacagtaccgctatttatcttgatacccacttcagactgttacgggaggacttcgtgaggcctctaagagagggaatcttggagctcctgcagtcctttgaggaccagggcctgaggaagaggaagtttgatgacatccgcatttactttgacacgcgaatcattaccccgatgtgctcttccagtggtattgtttacaaggtccagtttgacacaaagcctctgaagttcgtgaggtggcagaactcaaagcgactattgtatggctctctggtatgtatgtccaaggacaatttcgaaacgttcttgttcgccacagtgtctaaccgggaacaagaagacttatgccgcggcattgtccagctgtgcttcaacgaacaatcccaacagcttctggcagaagtccagcctagcgatagtttcctcatggttgagaccactgcctattttgaggcatatcgacatgtcctggagggactccaggaggtgcaggaggaagatgtgcccttccaacggaacatcgtggagtgcaattctcacgtcaaggaacccaggtacctcctgatgggcggtagatatgacttcacaccattaatcgagaatccttcagcaactggggagttcctccgcaacgtagaaggactgagacacccgaggatcaatgtgcttgaccctggccagtggccctccaaagaagccctgaaacttgacgactcgcagatggaagcactacagttcgccctcactcgggagctcgccatcatccagggtccccctggaactggtaaaacctatgtgggccttaaaattgtacaagctctgctgaccaatgagtcggtctggcagatctccctccaaaagttccccattcttgtagtgtgttacaccaatcacgcgttagatcagtttctggaaggcatttataactgtcagaagacctctattgtccgcgtgggaggtagaagcaactccgagatcctcaagcagttcacactgagggagctgcggaacaagcgggagtttagaaggaacctgcccatgcatctgaggcgcgcctatatgagtatcatgacgcagatgaaggagtccgaacaggaattacacgagggagccaagaccctggagtgtactatgaggggagtcctgagggaacagtatctgcagaagtacataagtccacaacattgggaaagcctgatgaatgggccagttcaggacagtgagtggatctgctttcagcactggaaacattcgatgatgctcgaatggcttggacttggtgtgggatcctttacacagtccgtctcgcctgcggggcccgaaaacaccgcccaggccgagggagacgaagaagaagaaggagaggaggagagctcattgatcgagattgcagaagaggcagacctcattcaggctgatagagtgatcgaggaggaagaagtcgttcggccccagagacgaaagaaagaggagtctggcgcagatcaggaactggctaagatgctgctcgctatgagacttgaccactgcggaaccggaactgccgctggccaggaacaggctacaggcgagtggcagactcaacgtaatcagaagaaaaaaatgaaaaaaagagtgaaggatgaactgaggaagctgaacacaatgactgccgccgaggcgaacgagatagaggacgtatggcagctggatttaagcagcagatggcagctgtaccgattgtggctgcaactgtaccaggccgataccagaagaaaaatcctgagttatgagcggcaatatcgaacttctgcagaacggatggccgaactgcgccttcaagaggatctgcatatcctgaaagatgcccaggtagttggcatgaccacaactggggccgccaagtaccggcaaatcctgcagaaagtagagccacggattgtcatcgtcgaggaagccgctgaggtgcttgaagcccatacgatcgccactctaagtaaagcctgccaacacctgatacttataggggatcaccaacagcttagaccatccgccaatgtatatgatctggcaaaaaatttcaatctggaggtgagcctgttcgaaaggctggttaaggtgaacatcccctttgtccggctgaattaccagcatagaatgtgcccggaaattgccagattactcaccccacatatctaccaggacctggaaaatcacccttccgtgctgaagtacgagaaaattaaaggcgtgtcgagtaacttgttttttgttgaacacaactttcctgaacaggagatccaggaaggcaagagccaccaaaaccagcacgaggcccactttgtcgtagaactgtgcaaatacttcctctgccaggaatatctaccaagtcagatcactattctgacgacatacactgggcagctcttttgtttgagaaaactgatgccagctaaaaccttcgcaggcgttagggtgcatgtcgtggacaagtatcaaggggaggaaaacgacattattctgctttcccttgtgcgatcaaaccaagagggaaaggtgggctttctgcagatctccaatagaatctgcgtagctctcagccgcgctaaaaaaggcatgtactgcataggaaacatgcaaatgctggccaaagttcctctatggagtaagatcatacacactttgagggagaacaaccagattggaccaatgctcagactttgttgtcaaaatcaccctgaaactcacacactggttagcaaggcctccgatttccaaaaagtgccggaaggagggtgcagtttgccatgcgaatttaggttgggatgcgggcacgtgtgtacaagggcctgtcacccttatgattcctcccacaaagagtttcagtgcatgaaaccttgccagaaagtgatctgccaggaagggcatcgttgtcccctggtatgttttcaggaatgccagccctgtcaggtgaaagtgcccaagacaattccccgctgcgggcacgaacagatggtgccctgttctgtacccgaaagcgacttttgctgccaagagccgtgctctaagtcattaaggtgcgggcatcgctgttcccacccttgtggggaagactgtgtgcaactgtgcagcgagatggtgaccataaagctgaagtgtgggcattcacagcccgtgaaatgtggacacgtggaggggctgctgtatggaggattactggtgaaatgcaccacgaaatgcggcactattctggactgtggtcatccttgccccgggtcatgtcattcatgctttgagggtagattccacgaacgttgtcaacaaccatgcaaacgcctgctaatttgcagtcacaaatgccaggaaccttgtattggtgagtgcccaccttgccaacgtacctgccaaaatcggtgcgtacacagccaatgcaaaaagaaatgcggcgagctgtgttccccctgtgtggagccgtgcgtatggaggtgtcagcattaccagtgtaccaagctatgctcagagccatgcaatcgccctccctgctacgtaccatgcacaaaacttttggtttgtggccatccctgtataggcctctgtggggaaccatgtccgaagaagtgcagaatctgtcacatggatgaggtcacccagatttttttcgggttcgaggacgaacccgacgcgcggtttgtgcagctcgaggactgtagtcatatttttgaggtgcaggcactggatagatacatgaacgaacagaaagatgatgaggttgctattaggctgaaggtttgccccatctgccaggtgcctatccgtaagaatcttcgctatggcacttctataaaacagcgtttagaagaaatcgaaataatcaaggagaagatacaggggagcgcaggggagattgccacatcccaggagaggctaaaagctctgttggaaagaaaatcactgctccaccagttgcttcccgaggattttctgatgctgaaggaaaagctcgctcagaagaacctgagcgtcaaagatcttggactcgttgagaattatattagtttctacgaccatttggcttccctgtgggattcactgaagaagatgcacgttctagaggagaaaagagtccggacccggctggagcaggtacacgaatggttagcgaagaagaggctttctttcacatctcaggagctttccgatcttcgctcagagatacagcggctcacttacctcgtcaacctgcttacacggtacaagatcgctgaaaagaaagtcaaagattccattgccgtagaggtgtactccgtgcagaacattttagagaaaacctgcaagttcacacaggaggacgagcagctggtgcaagaaaagatggaagcactcaaagccaccctcccctgttcaggtctgggtatcagcgaggaagaaagagtacagatcgtcagcgccatcggatatcccagaggacactggtttaagtgtcgcaacggccacatttatgtgatcggcgattgtggtggggcaatggagcgcggcacttgccctgactgtaaggaggtcatcgggggtacaaaccatactctggagaggagcaatcagctggccagtgagatggacggtgcacagcatgctgcttggagcgatacggcaaataatcttatgaactttgaggaaatccaaggtatgatgtag

SEQ ID NO: 22319 - DNA, 3813 bp, Artificial Sequence
  Description of Artificial Sequence: Synthetic coding sequence
atggaggagcggcggccccacctggacgcccggccccggaacagccatacaaaccatcggggccctgttgacggcgagctgcctcctagggcgaggaaccaagccaataatccacccgccaatgctctacgtggtggcgcatcacaccctggacggcacccacgcgcaaacaatcaccctgcagcatactggcaaagagaagagcggttccgagccatgggccggaaccctcatcagggcaggaggaaccaggaaggacatgcctcagacgaagcaagagatcaacggcacgatcaggaaaatgatacccggtggcggaatggaaaccaggactgcagaaaccgccgtcccccctggtctaacgataacttccagcagtggaggaccccgcaccaaaagcccacggagcagcctcagcaagcaaagaagctggggtataaattcctggaaagcctgctgcaaaaagacccatccgaggtggtgatcaccctggctaccagtctgggtttgaaagaattactttcccatagctccatgaaatccaactttctggagctgatctgtcaggtgttacgtaaggcttgttcaagcaagatggataggcagtccgtactacacgtcctcggtatattaaagaactccaaatttctgaaggtatgcttgcctgcttatgtggttgggatgattacggagccgatcccagatattcgtaaccagtatcccgagcacatcagtaatatcatttctctcctgcaggatttggtgtctgtttttccggcatcatcagtacaagagacatcaatgcttgtctctctactgccaacaagtctcaacgcgttgcgggcttccggcgtggacatcgaggaagagacggaaaaaaacctggagaaagtccagacaataatagagcacttgcaggagaaacggcgggaggggaccctccgcgtggacacctacaccttggtgcagccagaagccgaagaccatgttgaaagttaccggactatgcctatttatcctacttacaacgaagtgcatctggacgagagaccgttccttcggcctaatattatatccggcaaatacgacagtactgcgatctacctcgacacacacttcaggctgctccgagaagacttcgtgcgcccactacgggagggtattctggagttgcttcagtcttttgaagatcaggggctgcgtaagagaaagtttgacgacatcaggatttactttgacactcgaatcatcacgccgatgtgttctagcagtggcatcgtgtacaaagtgcagttcgatactaagcccctaaagtttgtaaggtggcaaaattccaagcgccttctgtacggttccctagtatgtatgtctaaagataatttcgaaacatttctgttcgcaaccgtcagcaaccgtgagcaggaggatctttgtagaggaattgtgcaattgtgcttcaatgaacagtcccagcagctgctggctgaggtgcagccttctgactctttcctgatggtggagaccaccgcatacttcgaagcctacagacacgtgctcgagggtctgcaggaggtgcaggaagaagacgtgccattccagcgaaacatcgtagaatgtaactcccatgtgaaggaacctcgctacctacttatggggggaaggtatgacttcactcctctgatagaaaatccatccgccaccggagagttcctgaggaatgtggagggtctacgccatccaaggattaacgtgcttgaccccggccaatggcccagcaaggaagcactgaaactggacgattcacagatggaagcgctacagttcgcactgacccgagagctggcaattattcaaggtcctccaggaactgggaaaacgtacgtcggtctcaaaatcgtgcaggcgctgcttacaaatgaatctgtttggcagatctccttacagaaatttccaattctggttgtttgctacacaaatcacgcgctggatcagttcctagagggtatttacaactgtcagaagaccagtattgtcagagttggggggagatcaaatagcgaaattctgaagcagttcacactgagggaactgagaaataagagagagtttcggcgcaatcttccgatgcatctccgtcgcgcctacatgagcatcatgacccaaatgaaagagtctgaacaggagctccatgagggtgcaaaaacactggagtgcactatgagaggcgtgttgcgggagcagtatctgcagaagtatatctcaccacaacactgggaaagccttatgaatggtccagtgcaagactccgagtggatctgttttcagcactggaagcactcaatgatgctggagtggcttggcttgggagttggaagcttcacccagagcgtcagtccagccggccctgagaacactgctcaggctgaaggtgacgaggaggaagaaggcgaagaggagagttctctgatcgaaatcgccgaggaagccgatctcattcaggccgaccgcgtcatcgaagaggaagaagtcgtcaggccacagcgccggaagaaagaagagagcggcgccgatcaggagcttgcaaaaatgctcctcgcgatgcgtctagatcactgcggcacaggaactgccgccggtcaagagcaggcaaccggggagtggcagactcagaggaaccagaaaaaaaagatgaagaagcgcgttaaagatgagttgcgcaaactcaacaccatgacagcagccgaagccaatgaaattgaagatgtgtggcagcttgacctgtctagccgctggcaactgtataggctgtggttgcaactttatcaggccgacacccggcgtaaaatcctcagttatgagcggcaataccgaacctccgcagaacgtatggcggagctgcgtctgcaggaggatcttcatatactgaaggatgctcaggtggttgggatgaccacaacaggcgcagccaagtatcgccagattctccagaaggtggagccaagaattgtcattgtggaggaggctgccgaagttctggaggctcatacgatcgccacgctgtcgaaagcctgccagcatctgatcctgatcggcgatcaccagcagctccggccatccgccaacgtatatgacttggccaagaattttaaccttgaggtgtcactgtttgaacggcttgtgaaggtcaacatcccatttgtgagattgaactaccaacatcggatgtgtcccgagatcgcccggcttctaacaccccacatctatcaggatttggaaaaccacccatctgtcttaaagtacgaaaagatcaaagccaagagcaactcatgccgggcgcttgctacaggcatgcgtaggaaacacaagatttctggcatgattctgtcattctttaagctgactatccgctctgcccggtttcagctgttgctgagcggatcttggacaactgccagctttcctttttctagaagtagatttgctgtgctgatctgtcgcgacaacaaacggatgcccgctgtgaagcccgtgtccacgaatactgggtctcatgggcttcagatgccaggagctctcatgggggagacttttcaaaaaggtagtacatcacgggacgccgctgcatgcctgctcagcagcctggttaataagataccaccccgcagtttgacgtgggcctctgactgctgcattagcttctccagtgcatcctcatgccgcacagcttacaccagcttttccatcttttcaattctttctagaaatttaaggatgacctctcagtgggaaaagataaagcgtatctacaaatag

SEQ ID NO: 22320 - DNA, 5757 bp, Artificial Sequence
  Description of Artificial Sequence: Synthetic coding sequence
atggaggagcggcggccccacctggacgcccggccccggaacagccatacgaaccataggggacccgtcgatggagaactgcctccccgtgccaggaaccaggcaaacaaccctccggccaacgcgctccgaggcggcgccagccatccgggcaggcaccctcgcgccaacaaccatcccgccgcctattggcagcgagaagaacggtttagggctatgggccggaatccccaccagggccgacgcaaccaggaaggacacgcgtcagatgaagcgcgtgaccagcgccacgaccaggaaaacgacacccgatggcgcaacggcaatcaggattgccgtaacagacggcccccctggtcaaatgataattttcaacagtggcgcaccccccaccagaagcccacagagcaaccacagcaggcaaagaaattgggctacaagttcctcgagtccctgctgcagaaggatccttccgaggtggtgatcactcttgcaacaagtcttggcctaaaagagctgctctcacactcatccatgaagagcaatttcctggaactgatttgtcaagtgttgcggaaggcctgctccagcaaaatggacaggcagagcgtcttgcatgtgttggggatactcaagaacagcaaattcctaaaggtctgtctcccagcatacgtcgtcggaatgatcaccgagcctattcccgatatccggaaccagtaccctgagcacattagcaacattatcagtctgttgcaagatctggtgagcgtcttcccagcttcctccgttcaggaaacatccatgctggtgagcttgctgccaacctccctgaatgcccttagagcatctggggttgatatcgaggaggagactgagaagaatcttgagaaggttcagactatcattgagcacctccaagagaagagaagagagggcaccttaagggttgacacctataccctggtgcaacctgaagcggaggaccacgtggagagctaccgtacgatgccaatctacccgacttacaacgaagtacacctggacgaaaggccgtttctgaggcccaatatcatatctggcaagtacgacagtacagccatttatttggatacccacttccgcttactccgtgaagactttgtccggccactcagagagggtatcttggagctgttgcagtcctttgaggaccagggactgagaaaaaggaaatttgatgatatcaggatttacttcgacacacgaatcatcacaccgatgtgctcttcatcaggcattgtgtataaagttcagtttgacactaaaccactcaagttcgtgcgttggcagaacagcaaaagactcctgtacggatcccttgtttgtatgagcaaggataactttgagaccttcctcttcgcaaccgtgtccaatagggagcaggaggatctatgccggggcattgtgcagctgtgctttaatgagcagtcccagcaactcctggccgaagtgcagccctctgactcattcctcatggtagaaactacagcctacttcgaggcctacaggcacgtgctggaagggctccaagaggtacaggaggaagatgttcctttccaacgtaacattgtagaatgcaactcccacgtaaaggaaccacgatatctcctgatgggaggacgttacgatttcactccgctgatcgagaacccctccgccacaggcgaatttttacgcaatgtcgaagggctgcggcatccacgtattaacgtactggatcccggccagtggccttctaaggaggctctcaaactagacgacagccaaatggaggcccttcaatttgctctaacccgcgaacttgcaataatacagggacctcccggaaccggaaagacttacgtgggactcaaaattgtccaggccttgctcactaatgaaagtgtatggcagatctccctgcaaaagtttcctatcctggtcgtttgttacactaatcacgcattggaccagttcctggaaggaatttacaattgtcagaagacctcaatcgtgagggttggcggaaggtccaattccgaaatacttaagcagtttaccctgagagagctgcgtaacaaaagagagtttaggcgcaacctgccaatgcatctgagaagggcatacatgagtatcatgacccagatgaaggagagcgagcaggagctgcacgagggagccaagacacttgaatgtacaatgagaggtgtgctcagagaacagtatctccagaagtatatcagcccgcagcactgggaatccttaatgaacggccctgtccaggattcggagtggatctgctttcagcactggaagcactccatgatgttagaatggctggggctgggcgttgggtcattcacccagagcgtgtcacccgccgggcctgagaatacagctcaggcagaaggcgatgaagaagaggagggcgaagaggaatcctcattaatcgagatcgcggaggaggctgacctgattcaggcggatagggtaatcgaggaggaggaggttgttcggccccagaggcgcaagaaagaagagagcggggccgaccaggaattggccaagatgctgttggccatgcggctagaccattgtggaaccggcacggctgcggggcaagagcaagctacgggcgagtggcagacacagcggaatcaaaagaagaaaatgaagaagcgggtgaaggacgagttgcggaagttgaacactatgacagcagcggaggcaaatgagatagaagacgtctggcaactagacctttccagtcgatggcagctctataggctgtggctacaactgtatcaggctgatacacggcggaaaatcctgtcctacgaacggcagtataggacgagtgccgaacggatggccgagctgcggctgcaggaagacctgcacatcttgaaggacgctcaggtggttggaatgactaccacaggcgccgctaagtatagacagatcttacagaaggttgaaccgaggatcgtgatcgtcgaagaagctgccgaagtgctggaggcccataccatagcgactctctcgaaggcatgtcagcacctgatcttgatcggagatcaccagcagttgcggccctccgcaaatgtgtatgacctcgcaaagaattttaatcttgaggtcagcctattcgaacgactcgtgaaagtgaacatcccctttgtgcgtctgaattaccagcaccggatgtgccctgaaatcgcacggctgctaacccctcatatttaccaggatctggaaaaccaccctagtgtactcaagtacgagaaaatcaaaggtgtatcaagcaatctgttttttgttgagcacaactttcccgagcaggaaattcaggagggcaaatcccatcaaaatcagcacgaagcccatttcgttgtcgagctatgtaaatattttctttgtcaagaatacctccctagccaaattactattctcactacttacacaggccagctcttctgcctacggaaacttatgcctgctaagaccttcgccggcgtccgtgtacacgtggtggacaagtaccagggggaagaaaacgacatcatactccttagtctagtgcgatcaaatcaggaagggaaagttggtttcctacagatttccaaccggatctgtgtcgcattaagtagggctaagaaaggcatgtattgcatagggaatatgcagatgctcgcgaaagtgcccctttggtcaaagatcatacacaccttacgagaaaacaaccagatcggccccatgctgagattgtgctgtcaaaaccatcctgagactcacacgttggtgtccaaagcgtcagattttcagaaggttccagaaggcggctgcagcctgccatgcgagtttagactgggatgtgggcacgtttgcactcgtgcatgccacccttacgatagtagccataaggagttccagtgcatgaagccatgtcagaaggtgatttgccaagaggggcacaggtgccccctcgtgtgttttcaagagtgtcagccctgtcaagtcaaggtgccaaagacgatcccacgatgcggtcatgagcagatggtgccgtgctcagttcctgagagcgatttctgttgtcaggagccctgctccaaaagtctgagatgtggccaccgttgcagccatccatgtggtgaagactgtgtgcagctgtgttctgagatggtaaccatcaagctaaagtgtggtcatagccaacctgtaaaatgcggacacgtggagggtctgctgtacggtggactgctcgtaaaatgtacaacgaagtgcggcaccattttagactgtggccacccttgtcccgggtcgtgtcactcttgctttgaaggaaggttccacgaacggtgccagcagccctgcaagaggcttctgatctgctctcataagtgccaggagccctgtataggggaatgcccaccttgccagcgcacctgccagaacaggtgcgtgcactcccagtgcaaaaagaagtgcggggaactgtgttcaccatgcgtggaaccttgcgtctggaggtgccagcattatcagtgcacaaaattgtgctccgaaccttgcaacagacccccctgctacgtgccctgtaccaagctgctcgtatgcgggcacccttgtatcggcctttgcggcgaaccttgtcccaagaaatgcagaatatgccatatggacgaggtcactcagatattttttggctttgaagacgaacctgatgcccgcttcgtgcagcttgaggactgtagccacatcttcgaggtccaagcactggaccggtacatgaatgagcagaaggacgatgaagtcgctatccggttgaaggtctgccctatctgccaagtgccgattagaaagaacttgcgctacggcacctccataaaacagagactcgaggaaattgagattataaaagaaaagattcaagggtctgccggtgagatcgcaacaagccaggagaggctcaaggccttgttagagcgtaaatcgttactgcaccaactacttcctgaggactttttaatgctgaaggagaaactcgcgcagaagaatctgagcgtcaaggacctgggactggtcgagaattatatctcgttttacgaccacttagcctcactctgggattctttaaaaaagatgcatgtcttggaggagaaaagagtccggaccaggttggaacaggtgcatgaatggcttgccaaaaaacgactctcctttacttcccaagagctgtctgatttaagaagtgagatccagcgactgacctatctggtcaatcttctcacacgctacaaaatcgcagaaaagaaagtgaaggacagtatcgcagtcgaggtttattccgtgcagaacatcctggaaaaaacgtgcaaatttacgcaggaggacgaacagctggtccaggaaaagatggaagctttgaaggcaactctgccctgcagtggactgggaatcagtgaggaggagcgggttcaaatcgtgagtgctattggatacccaagggggcattggtttaaatgtcggaacggccacatttacgtgatcggggactgtggcggcgctatggagcggggtacttgccccgactgcaaggaagtcatcggaggaactaaccacacactggagagaagcaaccaattagcctccgagatggacggagcccagcatgccgcttggtcggacacagccaataatctgatgaacttcgaggagatccaggggatgatgtag

SEQ ID NO: 22321 - DNA, 2748 bp, Artificial Sequence
  Description of Artificial Sequence: Synthetic coding sequence
atggaggagcggcggccccacctggacgcccggccccggaacagccacaccaatcaccgagggcctgtcgacggagaactgccgccacgcgccagaaatcaggctaacaaccccccagctaatgcacttaggggcggagctagccacccaggacggcatcctcgagccaacaatcacccagctgcgtactggcaaagagaggagcggttcagggccatgggccgcaatccgcaccagggccggagaaatcaagaggggcatgcctctgatgaggcaagggatcagcggcatgaccaggagaatgatacacggtggaggaacgggaaccaggactgcagaaataggagacccccctggtcaaatgataacttccagcagtggagaacgcctcaccagaaacctacagagcaaccccagcaggccaaaaaactgggatacaaattcctggaatctcttctgcagaaggacccaagcgaggtggtgatcacactcgctaccagcctgggccttaaggagctgttaagccatagttctatgaaatcgaatttcctggaacttatctgccaggttctgaggaaggcttgcagcagcaagatggaccgccagtccgttctgcatgtgcttggcattcttaaaaactctaaattcctgaaggtttgcctgcccgcttacgtggttggaatgattacagagcctataccagacattaggaaccagtatcctgagcacatatccaacatcatctctcttctgcaggatctcgtttcagtattccctgcttcttctgtccaggagacaagtatgttagtgtctctgctgccgactagcttgaatgctctgcgggcctcaggcgtagacatcgaagaagaaacagagaagaatttggaaaaggtacagacaattatcgagcaccttcaggagaagagacgtgaaggaactttgcgggtagacacctataccctcgtccagccggaagccgaggaccatgtggagtcataccggaccatgcccatctaccccacatacaatgaagtgcatctggacgaacgcccctttctccgaccaaacattatttccggtaagtacgactccaccgctatctatcttgacacacacttccgcctccttagggaagactttgtaagaccactaagggaaggcattctagagctcctgcaaagctttgaagatcagggtcttaggaagaggaaatttgacgatatccggatttatttcgatacccgtatcattacacccatgtgctcctcttcaggcattgtgtataaggtgcagtttgacacgaaacctctgaaatttgtacggtggcagaatagtaagcggctgttgtacggaagcctggtgtgcatgtcaaaggacaacttcgagacttttctgttcgcaacagtgtctaatcgggagcaggaagacctctgccggggtatagtccagctgtgcttcaatgagcagtcgcagcagctgctcgccgaggtccagccttctgattcctttctgatggttgagacaaccgcttatttcgaagcttacagacatgtattagaaggactccaggaagtgcaagaagaagatgtaccttttcaaaggaacattgtggaatgcaactctcatgtcaaagagcccagatacctgttgatgggagggcgatacgattttaccccccttatcgaaaatccttccgccaccggtgaattccttcgaaatgtggaagggctccggcatccgagaattaatgtcctcgatcccgggcagtggcctagtaaggaggctcttaagttggatgacagccagatggaggctctgcagttcgccctcactagagagctggctattatacagggaccccccggaaccggtaagacatacgtaggcctgaaaattgtgcaggctctgctgaccaacgagtccgtatggcaaatttccctgcaaaagttccctatcctcgtcgtttgctataccaatcatgcactggatcagtttctagagggaatctacaactgccaaaaaacttctatcgtaagagtcggagggcgtagtaactccgagattctaaagcagttcacgttaagagagcttcgtaacaaacgagaatttcgcaggaatcttcctatgcacctgcgtagggcttacatgtcgataatgacccagatgaaggaaagcgagcaggagcttcacgagggagccaaaactttagagtgcacgatgaggggtgtcctgcgtgaacagtatcttcagaaatacatcagtccccaacactgggagtcgcttatgaacgggccagtgcaggactctgagtggatctgtttccaacattggaaacatagtatgatgttagagtggctcggcctcggtgtaggcagctttacccagtctgtgagccccgctgggcctgaaaatactgcgcaagctgagggagatgaggaggaggaaggagaagaagaaagtagtctgatagagatagcagaggaggcggatctcattcaggcagatagggtaatcgaggaggaagaagttgtaaggcctcagagaaggaaaaaagaagaaagcggggccgatcaggagctcgccaaaatgctgttggctatgaggttggaccactgtggaacaggcaccgccgccggccaggagcaggcaactggagaatggcagacgcagcggaaccaaaaaaagaaaatgaagaagcgcgaaaaggaggagaaaaaagagagagagaaacgccggaaaaagaaatag

SEQ ID NO: 22322 - DNA, 2124 bp, Artificial Sequence
  Description of Artificial Sequence: Synthetic coding sequence
agcaagatggaccggcagagcgtgctgcacgtgctgggcatcctgaaaaactctaaattcctgaaggtctgcctccctgcttatgtggtgggaatgatcacagaaccaatccccgacatcaggaaccaataccccgagcacatcagtaatattataagtttgctccaggatctggtcagcgtgtttcctgcgagtagtgtgcaggaaaccagtatgttggtcagtctcctgcctacctcactgaatgcattacgagcaagcggagtcgatatcgaggaagagaccgagaagaacctggagaaagtccaaacaattatcgagcacctgcaggagaaacggcgggaggggaccctaagggtcgacacctacaccttggtacagcctgaagccgaggaccacgtcgagagttatcgaacgatgccaatttaccccacatataatgaggtccacctggatgaaagaccctttctgcgaccaaatattataagcggtaagtacgactcaacagccatttacttggacacacacttcaggcttttgagagaagatttcgtgagacccttgcgtgaaggaatcctggagctgcttcaatcgttcgaggatcagggcctgcggaaacgaaagtttgacgacattaggatctactttgataccaggatcattacaccaatgtgcagctcttcaggcatcgtgtacaaagtccagtttgacacaaagccacttaagtttgtccggtggcaaaactctaaacggctcctgtacggttctcttgtctgtatgtctaaagacaattttgagacttttctgttcgcaactgtctccaatagggagcaggaggatctgtgtcggggcattgttcaactctgcttcaatgaacagtcgcagcagctcttagctgaagtgcagccatccgattctttcttgatggtggagacaaccgcgtactttgaagcttacaggcacgtgttagagggactccaggaggtgcaggaagaggacgtgccatttcagcggaacattgttgagtgcaactctcacgtgaaggagcctagatacctcctgatggggggtaggtacgatttcacgcctctgatcgagaacccctccgccacaggggagttccttcggaatgtcgaaggcctgcgccatccacgcattaacgtcttggaccccggccagtggccatccaaggaagcactgaagctcgacgattcgcagatggaggcactgcaatttgctcttacccgggaacttgcaattatccaggggccccctggcactggtaagacatacgttggactgaaaatcgtccaggcccttctgacaaatgagtctgtctggcagatctcactgcaaaagttccctattctagtggtatgctatactaaccacgcgctggaccagttccttgagggcatctacaactgtcaaaagacatcaatagtgagagtgggaggaaggtccaactctgagatccttaagcagttcacactcagagagttgaggaataaacgagagttccgaaggaaccttccaatgcacctgcgccgggcctacatgtccatcatgacccagatgaaggaatccgaacaagaattgcatgagggcgcaaagactctggagtgcactatgcgaggggtccttagagagcagtatctgcaaaagtacatcagcccccagcattgggagtctctcatgaacggaccagtgcaggatagcgagtggatctgtttccagcactggaaacactcaatgatgctggaatggcttgggctgggcgtaggatcattcacgcagtcagtgtctcccgcgggccctgagaacacagcccaggccgaaggtgatgaggaggaggaaggggaagaagagagttcgctgatagagattgctgaagaggctgatctcattcaagcagatcgtgttatcgaggaggaggaagttgtccggccccagagaagaaagaaagaagaaagtggtgctgaccaggagcttgccaagatgcttctggccatgagactggaccactgcggcaccggaacggcagcagggcaagagcaggccacaggcgaatggcagaccgtgccctgcctggtattgatgagcgctgacccagcacagccctag

SEQ ID NO: 22323 - DNA, 186 bp, Artificial Sequence
  Description of Artificial Sequence: Synthetic coding sequence
atggaggagcggcggccccacctggacgcccggccccggaacagccacaccaaccataggggccccgtggacggtgagctccctccgagggctgagatcatgcccctgcacagctccctgggtgaccggtccaagaccctttcccagaaaaagaagagtttcttcctggtcctggcccctacttag

SEQ ID NO: 22324 - DNA, 963 bp, Artificial Sequence
  Description of Artificial Sequence: Synthetic coding sequence
atgagcaccaagaacttccgggtgagcgacggcgactggatctgccccgataagaaatgcggtaatgtgaacttcgcccggaggaccagctgcaatcggtgcggccgggagaaaactaccgaggcaaaaatgatgaaggcgggggggacggagatcggcaagacgctggcagaaaaaagcagaggcttgttttctgcaaatgattggcagtgtaagacatgttctaatgttaattgggcgagacgcagtgagtgcaatatgtgtaacacacctaagtacgctaagttggaggagcggacgggctacggcggaggcttcaacgagcgtgagaatgttgagtatattgaaagagaggagtcagatggtgagtatgacgaattcggaaggaagaagaaaaagtatagggggaaggccgtcggacccgcatctatcttgaaggaagttgaggataaggagtcggagggtgaggaggaggacgaagatgaggatttgtcaaaatacaaactggatgaggatgaggacgaggatgacgcagatctgagcaagtataacttggatgcatcagaggaggaagattccaataagaaaaagagcaacagacgcagtcggtccaagtctcgctcttcccactctagatccagcagtcgatccagttctccttccagttcaaggagccgatctcgttctcggagcaggtcatcttcgtcatcacagagcaggtcacggtcctctagccgcgagagaagccggtcccggggttcaaagagcagatcgagctccagaagccacaggggtagctcttccccaagaaaacgaagctattcaagctccagttcatcacccgagaggaatcgtaaacgtagtcggtcccggtctagttccagcggagaccgaaagaaacgcaggactagaagcaggtcaccggagtcccaggtcatcggggagaataccaagcagccctag

SEQ ID NO: 22325 - DNA, 993 bp, Artificial Sequence
  Description of Artificial Sequence: Synthetic coding sequence
atgagcaccaagaacttccgggtgagcgacggcgactggatctgcccagacaaaaagtgcggcaatgtgaattttgcaagacggactagctgcaaccggtgcggaagagagaagactacagaagccaaaatgatgaaggcaggcgggactgaaattggcaagacactcgccgaaaagtcccgcgggttgttctccgcaaatgactggcagtgcaaaacttgctctaacgtcaactgggcgaggaggtcagagtgcaacatgtgcaacacacctaaatatgcaaagctagaggagaggaccgggtatggaggaggtttcaacgaacgagaaaacgtggagtacattgagcgagaagaaagtgatggagaatatgacgagtttggaagaaagaagaaaaaatatcgaggaaaggcagtggggcctgcttcaatactgaaagaggtggaagacaaagagagcgagggcgaggaagaggatgaggatgaggatctgtcgaaatacaagctagacgaggatgaggatgaggatgatgcagatttgtcaaagtataatctagacgctagcgaggaggaggactccaataaaaagaaaagcaacagaaggtcacgttcaaagagcaggagctcacactcccggagctcatccaggagttccagccccagctcctcacggagtcgaagccgctcgcggagccgcagctcctcaagcagtcagtctagatcgagaagcagttccagggagcggtccagatcacggggatccaagagcaggagttcttcgagaagccaccgagggagtagctccccccgaaagcgctcatacagtagttccagcagctcgcccgagaggaaccggaagcggtctagatcccggtcaagtagttcgggagaccgaaaaaagcggcgaacgcgatcaaggagtccggagcgacgtcaccgctcttcttccgggagctcacatagcggttccagatcctcgtcgaagaagaagtag

SEQ ID NO: 22326 - DNA, 1458 bp, Artificial Sequence
  Description of Artificial Sequence: Synthetic coding sequence
atgctggagcggctgaaggccccctggagcgccgccctgcagcggaagtattttgaccttggcatatggactgctcccatcagccccatggccctcaccatgctgaacggactgttgattaaggactcctcccctcccatgctgctccaccaggttaataaaacggcccagctggacacctttaattaccagtcatgcttcatgcagtccgtttttgaccattttccagagattttgttcattcacagaacatacaacccgcggggaaaggtgctgtacacctttctggtggacggcccaagagtgcagctggagggacacctggcccgggctgtttatttcgcaatccccgctaaggaggataccgagggactagcccagatgtttcaggtgttcaagaagttcaaccccgcctgggaaagggtttgcacaattctggttgacccccactttctgccgctgccaatcctggcaatggagttcccaaccgcagaagtactcctgtccgcatttcatatttgtaagtttctgcaggcaaagttttatcagctttcattggagaggccagtggagaggttactcttgacatctctgcagagcactatgtgtagcgccaccgcaggaaatctacgaaaactgtacaccttgctgagcaactgtatcccgccagctaaactgcctgagttgcactcccattggcttttaaacgatcggatttggttggcccatcggtggaggtctcgcgcggagtcgagccactatttccaatccctggaagtaaccactcacatcttgagccagttctttggtactacaccctcagaaaagcaaggcatggcatctctcttccgttatatgcagcagaattcagctgacaaagctaacttcaaccaaggactctgtgcccagaacaatcatgcacctagcgacacaatcccagagagcccaaagctggagcagctcgtggagtcccacatccagcattctctgaacgccatctgtacgggccccgcagcccagttatgcctgggcgagctggctgttgtgcagaagtcgactcacttgattgggagtggttcagaaaagatgaacattcaaatcctggaggatacgcacaaagtccagcctcagcctcctgcgagttgttcttgttactttaaccaggcgtttcatctgccctgcagacacatcctcgccatgctgtctgcaagaagacaggtccttcagcctgatatgctcccagctcagtggaccgctgggtgtgccacctctctcgacagcatcctcggcagcaaatggagtgaaacactggataagcatttagccgtaactcatttgactgaagaagtgggacagctgttacagcactgcactaaggaggaatttgaacggcgatacagcactctgagagaactcgccgatagctggattgggccctacgagcaggtccagctctag

SEQ ID NO: 22327 - DNA, 1458 bp, Artificial Sequence
  Description of Artificial Sequence: Synthetic coding sequence
atgctggagcggctgaaggccccctggagcgccgccctgcagcggaagtacttcgatcttggcatttggacggctcctatctctccaatggccctcacaatgctcaacggcctgcttatcaaagattcaagcccccccatgcttctccaccaggtgaacaagaccgctcagctcgacacctttaattatcagagttgtttcatgcagagcgttttcgatcacttccctgagatcctctttatccaccggacctacaatcctcgcggcaaggtcttatacacgtttttggtcgacggtcctcgtgtgcagctggaaggacatctggccagagccgtgtattttgccatcccggccaaagaggacaccgaaggtcttgcacagatgtttcaagtgttcaagaagttcaatccagcctgggaaagggtgtgtaccatcttagttgaccctcattttctgccactgcccatccttgctatggagttccctacagctgaggtactactcagcgcatttcatatttgcaagttccttcaggcaaaattctaccagctgtccctcgagaggcctgtcgaacgactattgcttacaagtctgcagtccaccatgtgcagcgcgactgccggaaatctgcgaaagctgtatacgctgctctccaactgcattcctccagcaaaattaccagaactccatagtcattggctgctgaatgacagaatctggctggcccaccggtggaggagtcgagctgagtccagtcactatttccagtcactggaggtgacaacgcatatcctgagccaatttttcggcaccacaccctcagagaaacaggggatggccagcctgttccggtatatgcagcaaaacagtgccgacaaggcgaacttcaaccaggggctgtgcgcacaaaataatcacgcaccttcagacacaatacccgaatctcccaagcttgaacagttggttgaatctcacattcaacatagcctgaacgctatatgcacgggccctgccgcccagctctgcctaggagagctggccgtggtgcaaaaatctacacacttgatcggatcaggttctgaaaagatgaacatacaaatcttagaagatacacacaaggtgcagccacaacctccagcctcctgttcctgctatttcaatcaagcgttccacttgccatgccgacacatcctcgctatgctctctgctagaaggcaagtgcttcagcctgacatgctcccagctcagtggaccgctggatgtgcgacttctttagactccatactgggctccaaatggagcgagaccctcgataaacatttagcagtgacccacttaaccgaagaggttgggcagcttctccagcattgcacaaaggaagaatttgagagacgatacagtaccctgcgcgagcttgcagactcttggatcggcccctatgagcaggttcagctatag

SEQ ID NO: 22328 - DNA, 423 bp, Artificial Sequence
  Description of Artificial Sequence: Synthetic coding sequence
atggccgtggtgctgcccgccgtggtggaggagctgctgagcgagatggccgccgctgtgcaggaatcagctagaataccagatgagtatctgctttcattgaagtttcttttcgggtctagtgctacccaggccttggatttggtggatcggcaaagtattaccctgatctcctctccaagcggaagacgtgtgtaccaagtgctgggctcatcatctaagacatacacctgcttggctagttgtcactactgctcatgccctgctttcgcattcagtgtactccggaagagtgattctattctgtgcaagcacttacttgctgtctacctgtctcaggtgatgcggacctgccaacagctttcggtttcagacaaacagctcaccgatatcctgcttatggagaagaaacaggaagcctag

SEQ ID NO: 22329 - DNA, 423 bp, Artificial Sequence
  Description of Artificial Sequence: Synthetic coding sequence
atggccgtggtgctgcccgccgtggtggaggagctgctgagcgagatggccgccgccgtgcaagagagcgccagaattccagacgaatacttgctttcactgaagttcctgtttggaagctcagctactcaggcactcgacctagtggataggcagagcatcactctgatatcctcccccagcgggcgcagggtttaccaggtcctgggcagctcttctaagacctatacttgcttggccagttgtcattattgtagttgccctgcattcgccttctcggtgctccgcaaatctgacagcattctctgcaagcacctgttggcagtatacctgagccaggtcatgcgcacatgccagcagctgagtgtgagtgacaagcagctgactgacattctgctcatggagaagaaacaggaagcttag

SEQ ID NO: 22330 - DNA, 1230 bp, Artificial Sequence
  Description of Artificial Sequence: Synthetic coding sequence
atgatcgacctgtggctgtacagctaccagcggctgctgcagaccatcgcagtcctggaggctcagagaagccaagccgtccaggatctagagagtctcggcagacaccagcgggaggcactcaagaaccctattgggtttgtggaaaaactgcagaagaaagcagacattggtttaccataccctcagcgcgtagttcagctccccgaaatcgtctgggaccagtacactcattctttggggaacttcgaaagagagttcaagaaccggaaacgacatactcgccgtgttaagctagtgttcgataaggttggtcttcctgctaggccaaagagtcccctggaccccaaaaaagacggtgagtccctctcctattcaatgcttccactgtcagacggcccagagggttcctccagcagaccccagatgatccgaggaaggctttgcgatgatactaagcccgagaccttcaatcagctgtggaccgtggaagaacaaaaaaagctcgagcaactgctgataaagtatcctcctgaagaggtcgagtcaaggcgatggcaaaagatcgcagatgagctggggaataggacagccaaacaggtggcctcaagggtgcagaaatattttattaagctgacaaaagctggaatcccagtgccggggcgcacccccaacctgtatatatattcaaaaaagagcagcacatcaagaaggcagcatcctctcaataaacatctctttaagccttctacattcatgacttctcatgagccgcccgtctacatggatgaggacgatgatcggtcctgctttcactctcatatgaacacagccgtcgaggatgcatcagacgacgaatctattcccatcatgtatcgcaatctccctgagtacaaagagctcctgcagttcaaaaagttgaagaagcaaaagctgcagcagatgcaggctgaaagcgggtttgttcagcacgtgggtttcaagtgcgacaactgcgggatcgagcctattcagggggtacggtggcattgccaagattgcccccccgagatgtccttggatttttgcgatagctgctcggattgcttgcacgagactgacatacacaaagaggatcaccagctggagccaatctaccggagcgagacattcttagatagggactactgcgtaagccaagggacgagctacaattacctggatcctaactattttcccgctaatcgctag

SEQ ID NO: 22331 - DNA, 2712 bp, Artificial Sequence
  Description of Artificial Sequence: Synthetic coding sequence
atggccgccagccggagcacccgggtgacccggagcaccgtgggcttaaatggtttggatgaatctttctgcggcagaaccctgagaaacaggagtatagcccaccctgaggagatcagctccaatagccaagtaaggtcccgcagccccaagaaaagaccagaacccgtgccaatacaaaaggggaacaacaacggcagaacaactgatctgaagcaacagagcacaagagagagttgggtgtctccaaggaaaagggggctgtcatccagcgaaaaagataatatagaacggcaagccattgagaactgtgagcgtagacagactgaaccagtgtcgccagtgttgaagcgcattaagcgatgcttacgctccgaggcacccaacagcagcgaggaggactcccctatcaaaagcgacaaggagagcgttgagcagcgttccacagtggttgataacgacgccgattttcaaggcacaaagcgggcctgtaggtgcctcatcctcgacgactgtgaaaagagagagattaaaaaggtcaacgtgagtgaagaaggaccgctgaacagtgcagtggttgaggagatcactggctacctagccgtcaatggggtcgacgatagtgattcagccgtgattaactgcgacgattgccagcccgatgggaacacgaaacagaattccatcgggtcttacgtactccaggaaaagagtgtggccgagaacggagacacagatacgcagactagtatgtttctggatagtagaaaggaggatagctatatcgaccacaaagttccctgtacagatagccaagtgcaggtcaagctggaagaccacaagattgtcacagcctgcctccccgttgagcacgttaaccagcttactactgagccagctacaggaccgttttccgaaactcagtcttcactccgcgactccgaggaagaggtggacgtcgtgggcgactcatccgccagtaaagagcagtgtaaggaaaataccaacaatgaactcgatacgtctctggaatctatgcccgcctcaggggaacctgaaccaagtcccgttttggactgtgtgagcgctcagatgatgagcctgtctgaaccacaagaacatcgctataccctcagaacatctccgaggagagccgccccaaccagaggctccccgactaagaactctagtccttaccgggagaacggccaattcgaagagaataatctgtcccctaacgaaacaaacgctactgtgagcgacaacgtcagccagagtcctacaaatcctggggagatttcccaaaacgagaaaggaatctgttgtgacagccaaaataacggcagcgaaggggttagcaaacccccctccgaggcgcggctcaatataggacacctcccatcagccaaagagtccgctagccagcatattactgaagaggaggacgacgatccagatgtgtactacttcgagtcagaccacgtagccctgaagcacaataaggactaccagagattacttcagacaatcgcagttctggaggcacagaggtctcaagctgtccaggacttagagtctttgggcagacatcaacgtgaagccctcaagaatcctataggcttcgttgagaaactgcagaagaaagccgacatcggactgccctatccacaaagagtcgtgcagctgcccgagattgtgtgggatcagtatacgcattccctcgggaatttcgagcgggaattcaaaaacagaaaaagacacacgcgtcgcgtgaagctggtgtttgataaagttggcctccccgctagacctaagtccccacttgatccgaaaaaagatggcgagtccctgagctatagtatgttgccactaagcgacggccccgagggctcgagtagtcggccacagatgattcgtgggcgcttgtgcgacgatacaaaacccgaaacatttaaccagctgtggactgttgaggaacaaaaaaagctggagcagctccttatcaagtacccacccgaagaggtcgagagccggaggtggcagaagattgcagacgagctgggcaaccgtactgctaagcaggtggccagcagggtgcaaaaatatttcataaaactgactaaggcgggcataccagtccctgggcgcacgcccaacttatacatctactcaaaaaaatcctctactagccgaagacagcatcccctgaataaacatttatttaagccctccaccttcatgacatcacatgaacctcctgtgtatatggatgaggacgatgatcgaagctgtttccacagccacatgaacacggccgtcgaagacgccagcgatgacgagtccataccaatcatgtaccgtaacttacctgagtacaaggaactgctgcagtttaaaaagttaaaaaagcagaaactccagcagatgcaagccgagtctggcttcgttcagcacgtcgggttcaagtgtgataactgcgggatagaaccgatccagggggtccggtggcattgccaggactgtcctcccgagatgtccctggacttttgcgattcctgttccgattgtctccatgaaaccgatatccataaggaggaccatcagctggaacccatctatcgtagtgaaaccttccttgacagggattattgcgtgtcacagggaacgtcatataactacctggaccctaattatttccctgcaaaccggtag

SEQ ID NO: 22332 - DNA, 111 bp, Artificial Sequence
  Description of Artificial Sequence: Synthetic coding sequence
atggccgccagccggagcacccgggtgacccggagcaccgtgggcttaaatggactagacgaaagtttctgcgggaggacactgcgaaatagatcgattgcccacccttag

SEQ ID NO: 22333 - DNA, 177 bp, Artificial Sequence
  Description of Artificial Sequence: Synthetic coding sequence
atggccgccagccggagcacccgggtgacccggagcaccgtgggcttgaatggcctcgatgaatccttctgcgggagaactttgagaaatcgatccatcgcccaccccgaggagatttcatcaaatagccaagtgaggtcaagaagccctaagaagcgcccagagcctgtgccgtag

SEQ ID NO: 22334 - DNA, 381 bp, Artificial Sequence
  Description of Artificial Sequence: Synthetic coding sequence
atgagcgtgatggacctggccaacacctgcagcagcttccagagcgatctcgacttctgcagcgactgcgggtctgtacttcccctgccaggtgcccaggacacagttacctgcatccgttgtggtttcaacatcaatgtccgcgactttgagggcaaagtagtgaagacaagtgtggtttttcaccaactgggtacagctatgccgatgtcagtggaagaaggacccgagtgccagggtccggtagttgacagaaggtgcccacgctgtggacatgagggcatggcctaccacactcgccagatgcgctcagcagatgaagggcagactgtcttttacacgtgcacgaattgcaagtttcaggagaaggaagattcttag

SEQ ID NO: 22335 - DNA, 381 bp, Artificial Sequence
  Description of Artificial Sequence: Synthetic coding sequence
atgagcgtgatggacctggccaacacctgcagcagcttccagagcgatttggatttctgttctgattgcgggtctgtgcttccactccccggagcccaggatacagtgacctgcatcaggtgcgggttcaacataaatgtcagagactttgaaggaaaagtggtgaagacatccgtggtgttccaccagttaggcacagctatgccaatgtcagtcgaggagggtcctgaatgccagggtccagtggtggacagacgatgccctaggtgcggccacgaggggatggcctatcacacaagacagatgcgttccgcagatgagggacaaacagtgttttatacctgtaccaattgcaaatttcaggagaaggaggattcttag

SEQ ID NO: 22336 - DNA, 381 bp, Artificial Sequence
  Description of Artificial Sequence: Synthetic coding sequence
atgagcgtgatggacctggccaacacctgcagcagcttccagagcgacctggacttttgctcagattgcggttctgtgctgcccctcccaggtgcgcaggataccgtcacgtgtatcagatgcgggttcaacatcaatgttcgagattttgaagggaaagtggtgaagacctctgtcgtgttccatcagctcggaacagctatgccaatgtctgtggaggaaggccccgaatgccagggaccggtagtcgacagaaggtgtcctcggtgtggccatgaaggtatggcctatcacacacgtcagatgaggtccgctgatgaggggcagaccgtgttctatacctgcacaaattgtaaatttcaagaaaaagaggattcctag

SEQ ID NO: 22337 - DNA, 381 bp, Artificial Sequence
  Description of Artificial Sequence: Synthetic coding sequence
atgagcgtgatggacctggccaacacctgcagcagcttccagagcgatctggacttctgttctgattgcgggtctgtgctccctctgccaggcgcacaggacactgtaacctgtattagatgcggattcaacatcaatgtgagagacttcgagggaaaggtagttaaaacaagtgtggttttccaccagctcggaaccgctatgcctatgagtgtagaagaagggccagaatgtcaaggcccagttgtggacaggaggtgcccccgatgcgggcatgagggcatggcctaccacactcgccagatgcgctccgcagacgaagggcaaacagttttctatacttgcaccaactgtaagttccaggaaaaggaagactcatag

SEQ ID NO: 22338 - DNA, 381 bp, Artificial Sequence
  Description of Artificial Sequence: Synthetic coding sequence
atgagcgtgatggacctggccaacacctgcagcagcttccagagcgatcttgatttctgctccgattgcgggtcagtactgccactgcctggggcccaggataccgtcacgtgcattcggtgtggcttcaacattaacgtgagagactttgagggcaaggtggtaaagacttccgtcgttttccatcagcttggaacagctatgcctatgtccgtcgaggaaggccccgaatgtcagggacccgtggtcgacagacgttgtccccggtgtggtcacgaagggatggcctaccatacaaggcagatgcggtccgccgatgaaggccagacagttttctacacctgcactaattgcaagttccaggagaaggaagactcatag

SEQ ID NO: 22339 - DNA, 381 bp, Artificial Sequence
  Description of Artificial Sequence: Synthetic coding sequence
atgagcgtgatggacctggccaacacctgcagcagcttccagagcgacctggacttctgctctgattgcggttccgtgcttcccttaccaggagcacaggatactgtcacctgtattagatgtggtttcaacatcaatgtgagagacttcgagggcaaggtggtgaagacttccgtcgtttttcatcagctggggacggctatgcccatgtctgttgaggagggcccggagtgccagggtcctgtggttgatcgccgctgcccccgatgtggacatgagggaatggcttaccatacccggcagatgcgcagtgcagatgaaggacaaacggtattctatacctgtaccaactgcaagttccaggagaaggaagattcctag

SEQ ID NO: 22340 - DNA, 381 bp, Artificial Sequence
  Description of Artificial Sequence: Synthetic coding sequence
atgagcgtgatggacctggccaacacctgcagcagcttccagagcgacctcgatttctgctctgattgtggcagtgtccttcccttacccggcgcacaggatacagtgacttgcatcaggtgtggattcaacatcaacgtgagggattttgagggaaaggttgtaaagacttccgttgtgtttcaccagctgggcacagctatgccaatgagcgtcgaagagggccccgaatgccaggggcctgtggttgatcggagatgccctaggtgcgggcacgaaggaatggcgtaccacacacggcaaatgagatcggcggatgaaggccaaacagtgttttacacgtgcacaaattgcaaatttcaggagaaggaggattcctag

SEQ ID NO: 22341 - DNA, 381 bp, Artificial Sequence
  Description of Artificial Sequence: Synthetic coding sequence
atgagcgtgatggacctggccaacacctgcagcagcttccagagcgatctcgacttctgcagcgattgtggttctgttctcccgctccccggggcccaggatacggtcacctgcatccgctgcggcttcaatattaatgtgcgggactttgaaggtaaggtcgttaaaacgtcagtggtattccatcaactagggacggcaatgcctatgagtgtggaagagggaccagagtgtcaaggccccgtagtcgatcggcggtgccctagatgcgggcatgaggggatggcgtaccatacacggcagatgagatccgccgacgaggggcagacagtgttttatacctgcaccaactgcaaatttcaagagaaggaagattcttag

SEQ ID NO: 22342 - DNA, 381 bp, Artificial Sequence
  Description of Artificial Sequence: Synthetic coding sequence
atgagcgtgatggacctggccaacacctgcagcagcttccagagcgatctggatttctgctcagattgcggctcagtattgcctctcccgggcgcccaggacacagtaacctgcataagatgcggctttaacataaacgtcagagacttcgaaggcaaagtcgtgaaaactagtgtggtatttcaccagctaggtaccgccatgccaatgtctgtagaggaaggaccagaatgccagggccccgttgttgacagaaggtgccctcgatgtgggcatgagggtatggcataccacaccaggcagatgcgctcggcagatgaaggtcagacagtgttctacacttgcactaactgcaagtttcaggagaaggaggatagctag

SEQ ID NO: 22343 - DNA, 381 bp, Artificial Sequence
  Description of Artificial Sequence: Synthetic coding sequence
atgagcgtgatggacctggccaacacctgcagcagcttccagagcgatctggatttctgtagcgattgtggttcagttctgcccctacccggggcacaggataccgtcacctgtattagatgcggattcaatattaacgtgcgagacttcgaaggcaaagtcgttaaaacaagtgtggtctttcatcagcttgggacggccatgccgatgtctgttgaggaggggcccgagtgtcaaggcccggtggttgatagacggtgccccagatgtggtcatgaagggatggcctaccatacgcggcaaatgcggagcgccgatgaggggcagactgtcttttatacatgtacgaattgcaaatttcaagaaaaggaggatagctag

SEQ ID NO: 22344 - DNA, 381 bp, Artificial Sequence
  Description of Artificial Sequence: Synthetic coding sequence
atgagcgtgatggacctggccaacacctgcagcagcttccagagcgatctcgacttctgcagcgactgcggatccgtactgccgcttcctggcgcccaggacaccgtcacctgtatcagatgtggctttaacattaacgtgagagactttgaaggtaaggtggtcaagacttctgtggtatttcaccagctggggactgcaatgcccatgtctgtcgaggagggaccggagtgccaggggccagtggtggacaggcgatgccccagatgtgggcatgagggcatggcttaccatacccgccagatgcggtctgccgatgagggtcagaccgtgttttacacttgcaccaattgtaagtttcaggagaaggaggactcctag

SEQ ID NO: 22345 - DNA, 381 bp, Artificial Sequence
  Description of Artificial Sequence: Synthetic coding sequence
atgagcgtgatggacctggccaacacctgcagcagcttccagagcgacctggatttctgcagcgattgcgggagtgtgctcccacttcccggagcacaggacactgtgacttgcattaggtgcggtttcaacataaatgtcagagactttgaagggaaagtagtaaaaacctctgtcgtgttccaccagctggggactgcgatgcctatgagcgtggaagaggggcctgaatgccagggacccgtggtagatcggagatgccccaggtgtgggcatgaagggatggcataccataccaggcagatgcgcagcgcagacgaaggccagactgtattctacacatgcacgaactgcaaatttcaagaaaaggaggactcatag

SEQ ID NO: 22346 - DNA, 381 bp, Artificial Sequence
  Description of Artificial Sequence: Synthetic coding sequence
atgagcgtgatggacctggccaacacctgcagcagcttccagagcgacctggatttctgtagcgactgcggttccgtgctccctttgcccggcgcacaagacactgtgacctgcatcaggtgcggatttaacatcaatgtcagagactttgaaggcaaggtggtgaaaactagcgtagtgtttcaccagctggggaccgctatgccgatgtccgtcgaagaaggcccagagtgtcagggccctgtggtggatcgccgctgcccccgatgtgggcatgaaggcatggcctatcatacaaggcaaatgcgctcagcggatgaagggcagacagtgttctacacctgtaccaactgcaagttccaggagaaggaggattcatag

SEQ ID NO: 22347 - DNA, 381 bp, Artificial Sequence
  Description of Artificial Sequence: Synthetic coding sequence
atgagcgtgatggacctggccaacacctgcagcagcttccagagcgacttggatttttgttccgattgcggctcagtgttgcccctgccaggggcacaggacacagtgacctgtattcgatgcggcttcaatattaacgtgagggactttgagggcaaggtggtgaagacatctgtcgtcttccaccaattggggaccgctatgccaatgtccgtagaggagggtccagagtgtcaggggcccgtcgtcgaccgccgatgtccccgttgcggccacgagggcatggcctatcatacccgccagatgcggtccgccgacgaaggccagacggtgttttatacgtgcaccaactgcaaatttcaggagaaggaagacagctag

SEQ ID NO: 22348 - DNA, 381 bp, Artificial Sequence
  Description of Artificial Sequence: Synthetic coding sequence
atgagcgtgatggacctggccaacacctgcagcagcttccagagcgacttggacttttgttccgattgcggctctgtccttcctctgcctggggcgcaggatactgtgacatgcatcaggtgcggctttaacatcaacgttagagacttcgaaggcaaggttgttaagacaagcgtggtattccaccagctggggacagccatgccaatgtctgtcgaagagggtcctgaatgccagggccccgtcgtagatcggcggtgcccgagatgcggtcacgaaggcatggcatatcacactcgacagatgaggagcgccgacgagggccagacggtattctacacatgtacgaattgtaaattccaggagaaggaggactcgtag

SEQ ID NO: 22349 - DNA, 381 bp, Artificial Sequence
  Description of Artificial Sequence: Synthetic coding sequence
atgagcgtgatggacctggccaacacctgcagcagcttccagagcgatctagatttctgcagcgattgtggctccgtcctgccactgccgggcgcccaggataccgtgacgtgcatcagatgcggattcaacattaacgtccgcgacttcgaggggaaggtcgtgaagacctctgtcgttttccaccagcttggcacagctatgccaatgtccgtagaggagggtcccgagtgtcaggggcccgtggtggatagaagatgtccacgctgtggacatgaggggatggcgtatcatactcgacagatgaggagcgctgatgagggccaaacggtcttttatacctgcaccaactgcaagtttcaggagaaggaggatagttag

SEQ ID NO: 22350 - DNA, 381 bp, Artificial Sequence
  Description of Artificial Sequence: Synthetic coding sequence
atgagcgtgatggacctggccaacacctgcagcagcttccagagcgatctggacttttgcagcgattgcggcagcgttttgcccctgcctggcgcccaggacacagtgacctgcattagatgtggattcaatattaatgtcagagatttcgaggggaaggtggtgaaaactagcgtagtgtttcatcagttaggtaccgccatgcccatgagcgtcgaggagggacccgagtgccagggtcccgtcgtcgaccgcaggtgtcctcgatgtggccacgagggaatggcctatcacacgcgtcagatgcgttctgcagacgagggacagactgtgttttacacctgtaccaactgcaagttccaggaaaaggaggattcctag

SEQ ID NO: 22351 - DNA, 381 bp, Artificial Sequence
  Description of Artificial Sequence: Synthetic coding sequence
atgagcgtgatggacctggccaacacctgcagcagcttccagagcgatctggacttctgctccgactgcggcagtgtgctgcccctccctggagcgcaggataccgtcacctgcatccggtgtggtttcaacatcaacgtgcgagactttgaagggaaagtggtgaagacatcagtggtttttcatcagctgggcacagccatgccaatgagcgtggaggaaggccctgaatgtcagggaccagttgtggacaggaggtgtccacgctgcggccacgaaggaatggcctatcatacgcggcagatgaggagtgcagatgaagggcaaacagtcttctatacctgcacaaattgcaaattccaggagaaggaggactcttag

SEQ ID NO: 22352 - DNA, 381 bp, Artificial Sequence
  Description of Artificial Sequence: Synthetic coding sequence
atgagcgtgatggacctggccaacacctgcagcagcttccagagcgatctagacttctgtagcgattgtggcagcgtgcttcctctccctggggcacaggacacagtaacatgcatccgatgcggattcaatatcaacgtgagagattttgagggtaaagtggttaagactagcgttgtgtttcaccagctgggaacagctatgcctatgtctgttgaggagggccctgagtgtcagggaccggtagtcgatagaaggtgtcctcgatgcggtcacgaaggcatggcataccacacaagacagatgcgctccgcagatgagggacagaccgttttttatacatgtaccaactgcaagtttcaggagaaggaggactcgtag

SEQ ID NO: 22353 - DNA, 381 bp, Artificial Sequence
  Description of Artificial Sequence: Synthetic coding sequence
atgagcgtgatggacctggccaacacctgcagcagcttccagagcgacttggacttctgctcagattgtgggagcgtcctcccactccccggggctcaggacacggtcacatgcatccgctgcgggttcaacatcaacgtcagggattttgaaggcaaagtggtgaaaacttctgtggtttttcatcagctaggcactgccatgcccatgagtgtagaagagggccctgagtgtcagggcccagtggttgacaggagatgtcccaggtgcggtcacgaaggaatggcataccataccaggcaaatgcgcagcgccgacgaaggccaaaccgtattttacacctgtacaaactgcaagttccaggaaaaggaggatagctag

SEQ ID NO: 22354 - DNA, 381 bp, Artificial Sequence
  Description of Artificial Sequence: Synthetic coding sequence
atgagcgtgatggacctggccaacacctgcagcagcttccagagcgacctggacttctgttccgattgcggatctgtgctgccccttcctggggcccaggataccgtgacctgcattagatgtgggttcaatattaatgtgcgcgactttgagggaaaggtggtaaagacctccgtggttttccaccagttggggacggctatgcctatgtctgtagaggaggggccggagtgccaaggtccagttgtggatcggcgctgccctaggtgcggacacgaaggcatggcctatcatacacgacagatgcgaagtgccgacgaaggccagactgtgttttacacctgcacaaactgcaaatttcaggagaaggaggactcatag

SEQ ID NO: 22355 - DNA, 381 bp, Artificial Sequence
  Description of Artificial Sequence: Synthetic coding sequence
atgagcgtgatggacctggccaacacctgcagcagcttccagagcgaccttgacttttgctctgattgcggaagtgtccttcctctgcccggagcccaggatacggttacctgtatccggtgcggtttcaatataaacgtgcgagactttgagggcaaggtggtgaaaacttccgtcgtgtttcatcagctgggtaccgcaatgccaatgtcagttgaggaaggccctgagtgccagggtcccgtcgtggatcgccgctgcccaaggtgtgggcacgaaggcatggcatatcatactcgtcagatgagaagtgccgacgaaggacagaccgtgttttacacctgcaccaactgcaaatttcaggagaaagaagactcttag

SEQ ID NO: 22356 - DNA, 381 bp, Artificial Sequence
  Description of Artificial Sequence: Synthetic coding sequence
atgagcgtgatggacctggccaacacctgcagcagcttccagagcgacttggacttttgttccgactgtgggtccgtcttgcccttgccgggggcacaagacacagtaacttgtatcaggtgcgggttcaacatcaacgtgcgagactttgaagggaaggtcgtcaaaacttctgtagtgtttcatcaactcgggactgccatgcccatgtctgtggaggaggggccagagtgccaggggcccgttgtcgaccggaggtgtccacgttgcggccacgagggaatggcatatcatacaaggcagatgcggtcagccgatgaggggcagaccgtcttttatacttgcacaaattgcaaatttcaggaaaaagaggacagttag

SEQ ID NO: 22357 - DNA, 381 bp, Artificial Sequence
  Description of Artificial Sequence: Synthetic coding sequence
atgagcgtgatggacctggccaacacctgcagcagcttccagagcgacctcgacttttgctcagactgtgggtccgtcctgcccttgccaggcgctcaggacaccgtcacatgcatcagatgcgggtttaacattaatgtgcgggatttcgaagggaaggtggtcaaaacgtccgttgtgtttcaccagctgggaactgctatgccaatgtctgtggaagaaggaccagaatgtcagggccctgtggtcgacagaaggtgcccacgatgcgggcatgagggtatggcctaccacacaagacagatgcgcagcgctgatgaaggccagacagtcttctatacatgtacaaactgtaagttccaggagaaggaggattcctag

SEQ ID NO: 22358 - DNA, 381 bp, Artificial Sequence
  Description of Artificial Sequence: Synthetic coding sequence
atgagcgtgatggacctggccaacacctgcagcagcttccagagcgacctcgacttttgctctgattgcggttcagtgctgccattgcccggagcgcaggacactgtgacttgtattcgttgtgggtttaacattaacgtccgtgactttgagggtaaggtggtcaaaactagcgtggtgtttcaccagcttgggactgccatgcctatgtccgtggaagaaggtccagaatgccaggggcccgtagtagataggaggtgtcccaggtgcggccatgagggtatggcataccacaccagacagatgcgatccgcagacgaaggccagacagtgttttatacatgtactaactgcaagttccaggaaaaagaggactcttag

SEQ ID NO: 22359 - DNA, 381 bp, Artificial Sequence
  Description of Artificial Sequence: Synthetic coding sequence
atgagcgtgatggacctggccaacacctgcagcagcttccagagcgatctggatttctgctctgattgcggctccgtgctccctttacccggcgcccaggatacagtgacttgtattagatgtggcttcaacattaatgtgagggacttcgagggaaaagtggtcaagacttcagtagtttttcaccaattaggaactgctatgcctatgagcgtagaagaaggccctgaatgtcagggcccagtcgtcgatcgacggtgtccccgctgcggccacgagggcatggcatatcacacacgacaaatgaggtcagccgatgaagggcagactgtcttttacacgtgtaccaactgcaaattccaggaaaaggaagacagttag

SEQ ID NO: 22360 - DNA, 381 bp, Artificial Sequence
  Description of Artificial Sequence: Synthetic coding sequence
atgagcgtgatggacctggccaacacctgcagcagcttccagagcgacctggacttctgctcagactgtggatctgtcctgccacttccgggggcgcaggacacagtcacctgcatccgatgtggatttaatattaatgtgcgtgattttgagggcaaggtcgtgaaaacaagcgtggtatttcaccaacttgggacggccatgcctatgtccgtggaagaggggcctgagtgtcagggcccagttgtggacaggaggtgccccaggtgtggacacgaaggaatggcataccacacccggcaaatgaggtcagctgatgagggacaaacagtgttctacacctgtacaaactgcaagtttcaggagaaggaagactcctag

SEQ ID NO: 22361 - DNA, 381 bp, Artificial Sequence
  Description of Artificial Sequence: Synthetic coding sequence
atgagcgtgatggacctggccaacacctgcagcagcttccagagcgatctggatttctgcagcgactgtgggagtgtccttccccttcctggagctcaggacacagtcacttgtataaggtgtgggttcaatattaatgtgagagatttcgagggtaaagtcgtgaagacttccgtggtgttccatcaactgggcaccgcaatgcccatgtcagttgaagagggtccggagtgccagggcccagtagtggataggagatgtcctcgctgcggccacgaaggcatggcttaccatacccggcagatgcgctcagcggacgaaggacagaccgtcttttatacatgtacgaattgtaagtttcaagagaaagaagacagctag

SEQ ID NO: 22362 - DNA, 381 bp, Artificial Sequence
  Description of Artificial Sequence: Synthetic coding sequence
atgagcgtgatggacctggccaacacctgcagcagcttccagagcgacctcgatttctgctctgattgtggatccgtcctccctcttccaggggctcaagacacggtgacgtgtatcagatgtggcttcaatatcaatgtgagggacttcgaagggaaggtagtgaagaccagcgtcgtttttcaccagttgggaaccgcaatgccaatgtccgtcgaggaggggcccgagtgccagggcccagtagtggaccgtagatgcccaagatgtggtcacgagggtatggcctaccatactcgtcagatgaggtccgccgatgaggggcagactgtgttttacacttgcaccaattgcaagttccaagagaaagaagatagctag

SEQ ID NO: 22363 - DNA, 381 bp, Artificial Sequence
  Description of Artificial Sequence: Synthetic coding sequence
atgagcgtgatggacctggccaacacctgcagcagcttccagagcgacctcgatttctgctctgattgcggatcagtacttcctctgcccggggcccaggataccgtgacatgtatcaggtgcggattcaacattaatgttcgagactttgagggcaaagtggtcaagacctcagtggtcttccatcaacttggcaccgccatgccgatgagtgtggaggaaggccctgagtgccaaggccccgttgtggacagaaggtgtccacgatgtggccatgaggggatggcctaccacacccggcagatgaggagtgctgacgagggtcagacggtgttctatacctgtacgaactgtaagttccaggaaaaggaagacagctag

SEQ ID NO: 22364 - DNA, 381 bp, Artificial Sequence
  Description of Artificial Sequence: Synthetic coding sequence
atgagcgtgatggacctggccaacacctgcagcagcttccagagcgatttagacttttgttccgattgtggcagtgtgcttcctctgccaggcgcacaggatactgtgacttgtatccggtgcggatttaacatcaatgttagggactttgagggcaaggtggtcaaaacctctgtggtatttcaccagctcggaacagccatgcccatgtcggtggaagagggacccgaatgccagggcccggtcgtggacagaaggtgccctcggtgcgggcacgaaggcatggcatatcatacaagacagatgcggtcggctgacgaaggccagacagtgttttacacatgtaccaattgcaagttccaggagaaggaggacagctag

SEQ ID NO: 22365 - DNA, 381 bp, Artificial Sequence
  Description of Artificial Sequence: Synthetic coding sequence
atgagcgtgatggacctggccaacacctgcagcagcttccagagcgacctggatttctgtagtgattgcgggtccgtactcccgttgccaggcgcgcaagatacagtcacctgtatcagatgtggattcaatattaatgtgagagacttcgagggcaaagtcgtgaaaacctctgtcgtctttcatcaattagggacagcaatgccgatgagtgtggaggagggccccgagtgtcagggtccagtggtagaccgcagatgtccacgctgcggacacgaaggcatggcatatcatacaaggcagatgcggagtgccgacgaaggccagaccgtgttctacacttgtaccaactgcaaattccaggagaaagaagatagctag

SEQ ID NO: 22366 - DNA, 2133 bp, Artificial Sequence
  Description of Artificial Sequence: Synthetic coding sequence
atggacctgcccgccctgctgcccgcccccaccgcccggggcggccagcacggcggggggcctgggccacttcggagggctcctgcccccctcggagcaagcccggcgaggagacggcttctgctggtgcgcggcccagaagatggaggaccgggcgccaggcctggcgaagcttccgggcccagcccgccccccgccgaagatgactctgacggagattcattcctcgttctgctagaggtccctcacgggggggcagccgccgaagcagctgggtcccaggaagcggaaccaggttcacgggttaatctggcttcccgccccgaacagggaccatctggccctgccgccccccccgggccaggcgtcgcgcccgcaggtgcagtcacaatcagcagccaggatctgctagtccgactcgaccgaggggtgttggccctcagcgcccctccaggcccagccaccgcaggagctgcggctccccgcagggctcctcaggctagcggcccatccacccccggctaccgatgccctgaacctcagtgtgctctcgcgttcgcaaagaagcatcaactcaaagtccacctactcacacacggcgggggccagggccggagaccttttaaatgcccacttgagggttgcgggtgggcattcactacttcatataaactgaaacgccacctgcagtcccacgataagctcagaccattcggatgcccggttgggggctgtggtaagaagtttaccaccgtctacaacctaaaggcacacatgaaaggccatgagcaggagtcactcttcaagtgcgaggtgtgtgcagagcgtttcccaacacacgcaaaactgtcatcccaccaacgcagtcacttcgaacccgagagaccctataaatgtgactttcccggctgcgaaaaaacctttattactgtctccgctttgttcagtcacaaccgagctcactttcgcgaacaggagctcttctcctgctcattccctgggtgttcgaaacagtatgataaagcttgcaggctgaagatccacctgcgcagccacacaggcgaaaggccgttcatctgcgatagtgactcatgtggatggacatttacgtccatgagtaagctgttgcggcatcggcgcaaacacgacgacgacaggcgtttcacctgccctgtagaggggtgcggcaaatcctttacacgggcagagcatctcaaaggacattccatcacgcatctgggaactaagcccttcgagtgtcccgtggaaggatgttgcgcacgcttctcagctcgttcctcgctctatatacattcgaaaaagcacgttcaagacgtcggtgcccctaagagtcgatgcccagtgtccacctgtaatagactcttcacctccaagcacagtatgaaagcccatatggtgagacaacacagccgtcgtcaggatctccttccccagctcgaggccccctccagccttaccccctcctccgagctctccagtcctggccagagcgaactgactaacatggacctagctgcccttttctctgatacacccgctaatgcgtctggaagcgccggcggctcagatgaggcgttaaatagtggcattctcaccatcgatgttacaagtgtttcatcttccctcggcggaaatttgcccgccaacaactcgtcactagggccaatggagccactggtgctcgttgcacacagtgacatccccccctctctcgatagccccctggtgctcggcactgccgctactgttctccagcagggctccttttcagtggacgatgtgcagaccgtgtccgcgggcgcactgggctgcctggtggccttgccgatgaagaacctctcagacgacccccttgcactcaccagcaacagtaatctggctgcacatatcacgacacccaccagctctagcacgcctagggagaatgcctcagttccagaactcctggcgccaatcaaggtggagcccgatagcccttcgagacctggagcagtgggacaacaggagggaagtcacggcctgccacagtccacccttccaagtccagcagagcagcatggtgcacaggacacggagctgagcgccggcactggcaacttttatctggtgtag

SEQ ID NO: 22367 - DNA, 2577 bp, Artificial Sequence
  Description of Artificial Sequence: Synthetic coding sequence
atggacctgcccgccctgctgcccgcccccaccgcccggggcggccaacatggggggggccctggccccctgcggcgcgccccggcacccctcggagcaagtccagccaggcgtcggctgctcctggtcaggggtccagaggacggcggtccaggtgccaggccaggcgaagcctcaggtcccagccccccccccgcagaagacgattcggatggcgattcattcctggtcctgttggaggtgccccatggcggagccgccgcggaggcggctggctcacaagaagcagaaccgggtagtagggtcaatctcgccagtcggcccgagcaaggcccatctgggcccgccgcccctccgggaccaggtgttgctcccgctggagcagttaccatctcatctcaagatctgcttgtgagattggacaggggagtgctggccctttcagctcccccaggaccagctacagccggcgctgctgctcccaggagagcaccacaggcgtccggcccaagcacccctggctaccgatgcccagaaccccagtgtgctctggctttcgctaagaagcaccagctcaaggtacacttattgacacatggcggcggccaggggagacgaccattcaagtgtcctctagagggttgtggctgggcgtttaccactagctacaagctgaaacgacatctgcagtctcatgataaactgcgccccttcggatgtccagtgggaggctgcggcaagaaatttaccacagtgtacaatctgaaggctcatatgaagggccacgaacaggaatcacttttcaaatgcgaagtgtgcgccgagaggttcccaacacacgcaaagcttagctcgcaccagaggagtcacttcgaaccggaacgtccttataaatgtgactttcccggatgtgagaagacattcatcacggtgtctgccttgtttagccataaccgggcccactttcgcgagcaagaactgtttagctgctcctttcccgggtgctcgaagcaatatgataaggcttgccgactgaagatccatctgagaagccataccggcgagcgccccttcatatgtgattccgacagttgtggctggacctttacttcgatgtcgaaactcctcaggcaccgtcgcaaacacgacgacgatagaaggtttacgtgcccagtagagggatgcgggaaaagtttcacacgcgccgagcacttgaagggccatagtataactcatctcggcacaaaacctttcgagtgtcctgtggagggttgctgcgcccgcttctctgctagatcatcactgtacattcacagcaagaaacatgttcaggacgtgggggctcccaaaagtcggtgtccagtatctacctgcaatagactgtttacctctaaacactccatgaaggcgcatatggtccgccagcactctcgtcgccaagatctactaccccagctggaggccccttcatctctgacccccagcagcgaactgtctagtcccggccagtctgaactcactaacatggatctggcggcgctgttcagcgatacccctgctaatgcctctggtagcgctggaggctctgatgaagccctcaactccggcattctgacgattgatgtcacatccgtctccagtagcctgggcggcaacctacccgctaacaacagctctttgggcccaatggagccacttgttctggtggctcatagtgacattcctccatctctcgactccccactcgttttaggcactgccgctaccgtgctgcagcaggggtctttctccgtggatgatgttcagacagtttcggctggggctctgggttgcctggttgccctccctatgaaaaacctcagcgacgaccctttggccctgactagcaactcaaacttagcagcacatatcacaactccaacttcgagcagcacgcctcgggaaaatgcttccgtgcccgaattgctggctcccattaaggttgaacccgacagtccctctcgtcctggggcagtcggacagcaagaaggctctcatggactgcctcagtccacactgccctcgcccgcagagcagcacggagctcaggacactgagctgtcagctggtaccggaaatttttatctggagagtgggggctccgctcgcacggattatcgcgccattcagctggctaaggaaaagaagcagcgtggagccggatcgaatgctggggcttcccagtcgactcagcgcaagataaaagagggaaaaatgtcccccccccactttcacgcaagtcagaatagttggctttgcgggagccttgttgtgccttccggaggcagacccgggcccgcgcctgcagctggcgtacaatgcggtgcacaaggagtgcaggtgcagctggtgcaggacgacccttcaggggagggggtcttgccaagcgcccgaggccccgctacattcctgccctttttgacagtcgacttgccagtatacgtgctccaggaggtgctaccctcatccggtgggccggcaggacctgaggctactcagtttccaggatcaacaatcaatttgcaggatctgcaatag

SEQ ID NO: 22368 - DNA, 546 bp, Artificial Sequence
  Description of Artificial Sequence: Synthetic coding sequence
atgatggacaatcgcggtaactccagcctgccagacaagttaccaatattccctgattcagctcggctccctctgactcgctctttctatctcgagcctatggttacctttcacgtccacccagaagctcctgtgtcttctccttattctgaagagctgccccgtcttccttttccgtctgattctttgattctgggaaactattccgaaccatgccccttttctttccccatgccatatccaaactataggggttgtgaatactcttacggccctgctttcaccaggaagcggaacgaaagagagcgccagcgcgtcaaatgcgttaacgagggatacgcccagctgcgacaccacctacctgaagaatatttggaaaagcgattgtctaaggtggagaccctcagggcagctatcaaatacattaactatctgcagtctctcctgtatcctgacaaagccgagactaaaaacaaccccggtaaagtctcctcaatgattgccaccacatctcaccatgccgaccctatgtttaggatcgtgtag

SEQ ID NO: 22369 - DNA, 546 bp, Artificial Sequence
  Description of Artificial Sequence: Synthetic coding sequence
atgatggacaaccggggaaattccagcctgcctgataagttacctatctttccagactccgcacggctgccgttgacccggtccttttatttagagccaatggtgacctttcatgtgcaccccgaagcacctgtctcctccccgtacagtgaagaattacccagactccccttccccagcgattcccttatcttaggcaattacagcgagccttgccccttttcgttcccaatgccatatccaaattaccgagggtgcgagtatagctatggcccagcgtttacacggaagagaaatgaaagagaaaggcagcgggtcaagtgtgtgaatgaaggatatgcccagctgcgccatcatctccccgaggaatacttagaaaaaagactgtctaaagtggagactctgcgcgcagcaatcaagtatataaactatctacagagccttctttaccctgataaggccgaaaccaaaaataaccctggcaaggtgagcagcatgatagccacaacgagccaccatgctgaccccatgtttagaattgtctag

SEQ ID NO: 22370 - DNA, 522 bp, Artificial Sequence
  Description of Artificial Sequence: Synthetic coding sequence
atgatggagactcgtaaacctgcagaaaggcttgcattaccatattctctacgcacggctccactcggggttcctggaacactgcccggactcccacggcgagaccccctgcgggtcgctttaaggttggatgctgcctgttgggagtgggctaggtcaggttgcgcgcgaggctggcaatatctacccgtcccattggacagcgctttcgagcccgcatttcttcgcaaacgcaatgagagggaaagacagcgagtgagatgtgttaacgaggggtacgcccgactgcgcgaccatctgcctcgggagcttgccgataagagactgagcaaagttgaaaccctccgggctgcgatcgactatatcaaacacctgcaggaactgctcgaaagacaagcgtgggggcttgagggcgctgcaggcgctgttccacagagacgagccgagtgtaactcagatggagaatctaaagcgtcgtcagcaccatcccctagcagcgaacctgaggagggcggttcctag

SEQ ID NO: 22371 - DNA, 819 bp, Artificial Sequence
  Description of Artificial Sequence: Synthetic coding sequence
atggaggccgaagaaagtgagaaagcagctaccgaacaggagcctcttgagggcacggaacagactctcgatgccgaggaggaacaggaggagtccgaggaggccgcttgtgggagcaagaaacgggtggtgcctggaattgtctacttggggcacatccccccacgctttaggccactgcatgtgcgcaatctcctgtccgcctatggtgaagtggggcgagtgttttttcaagcggaggaccgttttgtgagaagaaagaaaaaagctgctgcagcagcaggtggcaagaagaggtcctacactaaggactataccgagggatgggtggagtttcgggataagcgaattgctaagcgggtggcagcgagccttcacaacacaccaatgggagccagacgacggtctccatttcggtatgacctctggaatttgaaatatcttcacaggttcacttggtcccatctttctgaacatctcgcatttgagcgccaggtccgcaggcagcggctccgcgcagaagtggcccaggcaaaacgtgagaccgatttttacttacagtcagtggaacggggacagagattcttggctgcagatggagatcccgctaggcctgacggtagctggacgtttgctcagaggcccacagaacaggagctcagggcaagaaaagcggcacggccaggcggacgggagcgggcacgattggccaccgcacaggacaaagccaggtctaacaaaggtctcctagctcgcatctttggggcaccccctccctccgagtcaatggagggtccttctctggtaagggacagctag

SEQ ID NO: 22372 - DNA, 3396 bp, Artificial Sequence
  Description of Artificial Sequence: Synthetic coding sequence
atgtttcagattcccgtggaaaacctggataatataaggaaagtgcgaaagaaggtgaaagggattcttgttgacatcggcctcgatagctgcaaggaactgcttaaggatcttaaagggttcgatccaggggagaagtactttcacaacacctcctggggggacgtctcactctgggagccaagcgggaaaaaggtgagatatcgcactaagccatactgctgcggcttgtgcaaatacagcaccaaagtgctgacttcattcaagaaccacctgcacaggtatcacgaagatgagattgatcaggaattagtcatcccctgtccaaactgcgtgttcgctagccagccaaaggtggtaggacgccatttccgaatgttccacgctcccgtccgaaaagtgcagaattacacggtgaacattttgggagagactaagtcttctcgttccgacgttatctctttcacgtgcctgaaatgcaatttttcaaacaccctgtattatagcatgaaaaagcacgtgctggtcgcccactttcattacctcatcaattcctacttcggactgagaacagaagaaatgggtgagcagccaaaaacaaacgacaccgttagcatcgaaaagattccacccccagataagtactactgcaaaaagtgcaacgccaatgccagctcacaagacgctctgatgtaccacatactgacatctgacatccacagggatctggagaacaagttgcgcagcgtaatctcagagcacattaagcgcacggggctcttaaaacagactcacatagctcccaaaccagccgctcaccttgcagctcccgctaacggaagtgctccgtccgccccagctcagccgccttgcttccacctggctttaccgcaaaactctccaagccctgctgcaggtcagccagtcacggtggcccagggagcccctggaagcctgacgcattcccctccagcagctggccagtcccacatgaccttggtgtctagtccgctccctgtgggacaaaattccctgactctccaacctccggctccccagcccgtgttccttagtcatggcgtgcctttacaccaatccgtgaatcctccagtgctgcccctcagccagcccgtcggccctgtgaataagagcgttggaacgtctgtcctcccgataaatcagaccgtgaggccgggtgtcctgcctttgacccagcctgtcggcccaataaaccgccctgtgggccctggcgtgttgcctgtgtccccttcagtgacgcccggagtgttgcaggccgtctccccgggtgttctgtccgtatccagggcagtaccttcgggagtgctgccagctgggcagatgacccccgctggacaaatgacccccgctggcgtgatacctggacagaccgccacttctggcgtgctgcctacaggacaaatggttcagagcggggtgctcccagtgggccaaacagctcccagcagggtgttgccgcctgggcagacagcacccctgcgggtaatctcggccggacaggtcgtacccagcggcctcttgtcacctaaccagaccgtaagctccagtgccgtggtgccagtgaatcagggcgttaattcaggtgtgctgcagctcagccaacccgttgtgagcggcgtgttaccagtgggacagcctgtgcggccaggcgtgttacagcttaatcagaccgtcggaaccaatattctgcccgtgaatcagcctgttagaccaggtgcctcccagaataccaccttcttgacaagcgggtccattctgaggcagctgatacccactggcaagcaggttaacggtatcccaacttacacattagcgcctgtgtcggtgacattgccagtgcccccagggggtttagctaccgtggcgcctcctcagatgccaattcagcttcttccctccggggcagccgcaccaatggccggttctatgccgggaatgccatcacctcctgttcttgtgaacgctgctcaatccgtgttcgtgcaggcctcgtcatcagcagcagacacaaaccaggtgctgaaacaggccaagcagtggaaaacctgtcccgtgtgtaatgaactgttcccttcaaacgtgtatcaggtgcacatggaggtggcccataagcattctgaaagtaagagtggagaaaagctggagcctgagaagttggccgcatgcgcaccgtttctaaaatggatgcgcgaaaagactgtccggtgtctgagctgtaagtgcctggtgtctgaagaggagctgattcaccacctccttatgcacggcctgggttgcctcttctgcccctgcacctttcatgacatcaagggcctctccgaacactccagaaacaggcacttgggcaaaaaaaaattgcctatggattattccaacagaggtttccaactcgatgtggatgctaatgggaatcttttgtttccacatctggatttcatcactattcttcccaaagagaagctaggtgagcgggaagtatatttggctatactcgctggcatacatagcaagagcctcgtgccggtgtatgtcaaggtcaggcctcaggcggaagggacacccggaagcacaggaaaacgcgtgagcacctgcccattctgttttggaccatttgtgacaaccgaagcctacgagctgcacctgaaagaaagacaccacatcatgccaacagtacacacagtacttaagagccctgccttcaagtgtatccactgctgcggcgtttacactgggaatatgaccctcgctgctatagcagtccatttagtgagatgcagatctgctccaaaggactcctcttcagatttacaagcacagcctgggttcattcacaattccgagcttctgctggtctcaggagaagtgatgcacgattcatccttctccgtaaaacggaagttacccgacggccacctgggcgctgaagatcagcgtcacggagaggaacagcctcctattctcaacgccgatgcagctcccggtccagagaaggtgacaagcgtggtccccttcaagaggcaaaggaacgagtctagaacagagggacctatagtgaaggatgaggctctgcaaatcctggccttggacccgaagaagtacgaggggagaagttacgaagagaagaaacaatttttgaaagactatttccataaaaagccctaccccagtaaaaaggaaatcgaactcctctcctccctgttctgggtgtggaaaatagacgttgccagcttctttggcaagcggagatacatctgtatgaaagctatcaagaatcataaaccctccgtgcttctgggtttcgacatgtccgagttgaaaaacgtcaaacaccgcctgaacttcgagtatgagccatag

SEQ ID NO: 22373 - DNA, 516 bp, Artificial Sequence
  Description of Artificial Sequence: Synthetic coding sequence
atgtttcaaataccagtcgagaatctcgataacatccggaaggtgagaaagaaggtaaagggcattctggtggacatagggctcgatagttgcaaagagctcctcaaggacctcaaggggtttgatcccggagagaagtactttcataacacttcatggggggacgtgagcctctgggaaccatcgggaaagaaggtgagataccggacgaaaccttattgctgcgggctgtgcaaatactctaccaaagtgttgacgtcattcaaaaatcatttacatcgctatcatgaggatgagatcgatcaggagcttgttattccatgccctaactgcgtgttcgcgtctcagcccaaggtggtgggaagacattttcgcatgtttcatgctcccgtgcggaaagtccagaattacaccgtcaacatcctgggagagactaagagcagccgaagcgacgtgatttctttcacctgtcttaaatgtaacttctcgaataccttgtactactcaatgaagtag

SEQ ID NO: 22374 - DNA, 1512 bp, Artificial Sequence
  Description of Artificial Sequence: Synthetic coding sequence
atggcggcagctataactgacatggcagatcttgaggagctgtcgcggcttagcccgctgccaccaggttcaccgggaagtgcggcaagggggagggcagagcccccagaagaggaggaagaggaagaggaggaagaggaggaggcagaggctgaggcggtggcagccctgctgctgaacgggggaagcggaggcggaggagggggaggtggcggaggggttgggggtggcgaagccgagaccatgtccgagccgtccccagaatctgcctctcaggccggagaagatgaggacgaggaggaggacgacgaagaagaagaggacgaaagtagcagtagcggaggcggagaagaggagtcgtctgccgagtccctggttggcagctctgggggatcgagttccgatgaaacccgttctctctctcccggtgccgcttcttcaagcagtggtgacggggacggcaaggaggggttagaggagccgaaggggcctaggggctcccagggtggcggaggtggcggatcttcctcttccagcgtggtatcctctggaggcgacgaggggtacggaaccggcggagggggttcatccgccaccagtggaggtagacgcggaagtctggaaatgtcttcggatggggagccactgagcaggatggatagcgaggattccatcagcagcactattatggacgttgactctaccatctctagtggtcgatcaactccagccatgatgaatggtcagggctctaccacctcttcatccaaaaatatcgcttacaactgctgttgggatcagtgccaggcctgttttaattcaagccccgacctcgcagaccacatccggtccattcatgtggacgggcagcgtggcggtgtgttcgtgtgcctttggaaaggctgcaaagtctacaacactccttctacctcccagagctggctgcagagacatatgttgacccatagcggggacaagccttttaagtgcgtagtggggggatgcaatgctagctttgcaagccaagggggactggcaaggcacgtaccaacccatttcagtcagcagaattcttctaaggtatccagccaacccaaagcaaaggaggaatccccatctaaagctggaatgaataagcgaaggaaactgaagaacaagcgtagaaggagccttcctaggccacacgatttctttgatgcccagaccctggatgcaatacgccatagagccatatgttttaacctgagtgcccatatcgaatccctgggtaaggggcactcagtggttttccacagcacagtcattgctaaacggaaagaagattctgggaagataaaactgctgctccattggatgcctgaggatatcctgccggacgtgtgggttaacgaatctgaacgacaccagctgaaaacaaaagttgtccatctgtccaaactgcccaaagacactgccctgctgctggaccctaacatttacagaaccatgccacagaagcggcttaaaagatag

SEQ ID NO: 22375 - DNA, 906 bp, Artificial Sequence
  Description of Artificial Sequence: Synthetic coding sequence
atgtatacccgaagatactcctccattagctccacaataatggatgtggatagtacaatcagtagcggtaggtcaaccccggcaatgatgaatggacagggatccactactagtagttccaagaacattgcatataattgctgctgggaccaatgccaggcgtgttttaacagtagtccggacctcgctgatcacattagaagcatccatgtggatgggcaaagaggaggcgtgttcgtatgtctttggaaaggatgcaaggtgtacaacactcccagtacaagtcaatcctggttgcaacgtcatatgctaacacactcaggcgataagcccttcaagtgcgtcgtgggtggctgtaacgctagcttcgccagccaagggggactggcacgccatgtacccacacatttcagtcagcagaattccagtaaggtgagctcccagcccaaggcaaaggaggaatcgcccagtaaagcaggcatgaacaagaggcgtaagctaaagaacaagcgcaggcgctccctgccaaggccacacgacttcttcgatgcccagacactggatgctatccgacacagggccatctgtttcaacctgagtgctcatatcgaatcactgggtaaggggcactccgtagtgttccacagtaccgtgatagccaagcgcaaagaagatagcggcaagattaaattgctattacattggatgccagaggatatcctccccgatgtctgggtgaatgaatcggagcgacaccaattgaagacaaaggtggttcacctgtccaagcttcctaaagataccgcactcctgctagaccccaacatctatcgaacgatgccacagaaacggctgaaaaggactctcatcaggaaagtcttcaacctgtacctcagcaaacagtag

SEQ ID NO: 22376 - DNA, 1554 bp, Artificial Sequence
  Description of Artificial Sequence: Synthetic coding sequence
atggccgctgccataacagacatggcagatctggaagaactatcacgcctgtcaccgctgccgcctggcagtcccggttctgcggcaagagggcgagctgagcctccggaggaggaagaggaagaagaggaggaggaagaagaggcagaagccgaggccgtggcagcgctgctgctgaatggagggtctgggggtgggggtggtggcggtggcggtggcgtcggagggggagaggcagaaacaatgagcgaacctagccctgaaagtgctagtcaggccggagaagacgaggatgaagaagaggatgacgaggaggaagaggatgaatcgtcttcatcgggtgggggagaagaagaaagttctgcagaatctctggtgggatctagtgggggttcatcttctgacgagacacgttctctctcacctggagcggcatcaagttcatcaggggatggcgatggaaaggagggccttgaggagccaaaaggccctaggggcagccagggaggaggtggcggaggctcctcaagtagcagtgtggtctcatcaggcggtgacgagggctatggaaccgggggtggcggaagctctgccacctctggcggtaggcggggatccctcgaaatgtcctccgatggagagcccctgagtaggatggactcagaagatagtatctccagcaccattatggacgttgactccaccatcagtagtgggagatctactcccgctatgatgaatgggcagggatctaccactagcagtagcaaaaatatcgcatacaattgttgttgggatcaatgtcaggcttgtttcaatagcagcccagatctggccgaccacattaggtccattcatgtcgacggacagcgcggaggcgtatttgtctgcctctggaagggatgcaaagtatacaatacacctagcaccagtcaatcttggttacaaagacatatgctaacccactctggagataagccgtttaagtgcgtggtgggaggatgcaacgcttcctttgcaagtcagggaggtcttgcgcgtcacgtcccgactcatttctctcaacaaaactccagcaaggtgagctctcagcccaaagccaaagaggagtcccccagcaaggccggaatgaataagcgaagaaagttaaagaacaaacgtaggaggtctttgccgagaccccatgactttttcgacgcacagaccttggacgcaatacggcaccgtgccatatgtttcaatctatcggctcacattgagtcgttgggtaaagggcactccgtcgtttttcacagcacagtcatcgctaagcggaaggaggattccggtaaaattaagctgttgctgcattggatgccagaggacatcctcccagacgtctgggtcaatgagagtgaacggcatcagctgaaaaccaaagtcgtccatttgagcaaattgcccaaagacacagcactgttactggacccaaatatctataggactatgcctcagaagaggctcaagaggacgctcatccgcaaggtgttcaatttgtacttaagcaaacagtag

SEQ ID NO: 22377 - DNA, 1314 bp, Artificial Sequence
  Description of Artificial Sequence: Synthetic coding sequence
atggcggcagcgattactgacatggccgatctggaagaactgagcagactttctccgcttccacccggatcaccaggctctgcagccaggggcagagctgagcctccggaagaggaggaagaggacgaatccagttccagcggtggaggcgaggaggaatctagcgcggagtctctcgttggatcaagcgggggatcgagctccgatgagacccgctccctctcccctggtgcggcatcatcttcctctggagacggcgacggcaaagaaggcctcgaggaacctaaggggcctaggggttcgcagggcggtggcggtggaggtagttcatccagtagcgtcgtgtcgagcggaggagatgagggctatggaacaggtggaggaggatcctcagccacaagtgggggtagacgcggttctttggagatgagttctgatggggaaccccttagtcgtatggattccgaagactccattagcagtacaatcatggatgttgactcgacaatttcatccggaaggtcaacgccggcaatgatgaacggacagggctccaccaccagcagttccaagaacatcgcctataactgttgctgggaccagtgtcaggcgtgtttcaattcgagcccagacctagcagatcacatacgttctattcatgtggacggccaaagaggcggagtgttcgtctgcctgtggaagggatgtaaagtttataataccccctctacatctcaaagttggcttcagcgccacatgttgacccatagcggggataaaccttttaagtgcgtcgtcggcggttgtaatgctagctttgcctcacaggggggtcttgctagacatgtccctacacacttctcacagcaaaatagttccaaggtgtcttctcaacctaaagctaaagaggagtctccatctaaggccggtatgaacaagcggcgaaagctaaagaacaagcggagaagatcactccccagaccacacgacttcttcgacgcgcaaacgctcgacgccataaggcaccgcgcaatctgttttaatctgagcgcgcacatcgagtcattaggcaaaggccacagtgtagtgttccactctacagttattgccaagaggaaggaggactctgggaaaattaagctactgttgcattggatgcccgaggacatcttgcctgatgtttgggtcaacgaatctgaacgtcaccagctaaaaacaaaggtggtgcatttgtcgaagctgcccaaggacacagccctgttgctggacccaaacatctacagaacaatgccacaaaaaaggctgaagaggtag

SEQ ID NO: 22378 - DNA, 3681 bp, Artificial Sequence
  Description of Artificial Sequence: Synthetic coding sequence
atggattccttcgacctcgcgctcttacaagaatgggatctggaaagtctatgtgtgtatgaacccgatcggaacgctttgcgcaggaaggagcgagaaagacgaaaccaggagacgcagcaagacgatgggacctttaattcaagctattcattgttttccgaaccatataaaactaacaagggtgatgaactctccaacagaatccagaatactttgggcaactacgacgagatgaaagacttcctcactgatcggagcaaccagtcccacctggttggtgtccccaaaccaggagtgcctcagacccccgttaataagattgatgaacactttgttgccgatagccgggctcaaaatcaaccgagttctatatgtagcacaaccacttcaacccctgctgctgtgcctgtgcagcagtccaaaaggggtaccatggggtggcagaaggcaggtcaccccccttccgatggacagcagagagcaactcagcagggtagcctgagaactctgttgggggacggagtggggcgacaacagccccgtgccaagcaggtgtgcaacgtcgaagtgggcttacagacccaggaacgccctcccgctatggcagcaaagcactcctcttccggacactgtgtgcagaacttcccaccatccctggcttctaagcctagtctggtccagcagaagcccacagcatatgttcgccctatggatggacaggaccaagcacccgacgagtcaccaaagctcaagtcatcaagtgagactagcgtccactgcacgtcttaccgaggtgtgcccgctagtaagcctgagccagccagagccaaagccaaactgtctaagttctccatacccaagcagggcgaagaatcccggagcggtgaaaccaactcctgcgtcgaagagatcatacgggaaatgacttggttacctcccctgagcgctattcaagcacccggaaaagttgagcctactaagtttccctttccaaacaaagactcccagctggttagttcaggtcacaataatccaaagaagggggatgccgagcccgaaagtccagattcagggaccagcaacaccagcatgctcgaggacgacctgaagctgtcatccgacgaggaggagaatgagcaacaggcagcacagaggacagctctccgcgctctctccgattcagctgtcgttcaacagccaaattgcagaactagcgtcccatctagcaaggggtcaagctcatctagctccagcggcagctcatccagcagcagcgacagcgagtcatcttctggatcggacagcgagactgaatcgtccagctctgagtccgagggctctaagccaccccattttagttctcccgaagcagagcctgcttccagtaataaatggcaactggataagtggctcaacaaagtgaacccccataagccccctatactcatccagaatgagagtcacgggtcagagtctaaccagtactacaatccagtaaaggaggatgttcaagactgtggaaaggtgcctgatgtgtgccagccttcattgagggagaaagagattaaaagcacctgcaaggaagaacagcggccacgcactgctaacaaggccccaggcagcaagggcgtgaagcagaaaagccctcccgctgccgtggccgtcgccgtaagcgctgctgctccccctcctgccgtcccttgcgcccctgccgaaaacgccccagccccagctcggagaagcgcagggaagaagcctaccaggcgtaccgaacgcacctctgcaggggatggagccaattgtcatcgcccagaagagcctgcagctgcagacgcgttaggtaccagtgtcgttgttccaccggagccaacaaaaacacgcccatgcggtaacaacagagccagtcatagaaaagaactgcggagcagtgtgacgtgtgaaaaaaggcggacacggggattatccaggattgttcctaagtcgaaggaatttattgaaaccgagtcaagctcgagcagcagtagctcggacagcgatctggagtctgaacaagaggagtacccgctgtccaaggcccagacagtggccgcttctgccagtagtggaaacgaccagcgactgaaggaggcagctgccaatgggggatccggaccaagggcaccagtcggatcaattaacgcgagaacaacgagcgacatcgccaaagagctggaggaacagttttatacacttgtccctttcggtcgcaacgaactgctgtcgcccctgaaagattccgacgagatacggagtctctgggtcaagatcgacctcaccctgctctcccggatccctgagcacttgccccaggagccgggagtgctgagcgctcccgctacgaaggactcggagtcagcgccacccagccatacaagcgacacacccgcagagaaggccctgcccaagtccaaaaggaagaggaagtgtgataacgaggacgactatcgtgagatcaagaagtctcagggagaaaaagatagtagcagtcgcttagcaacctccaccagcaacacactgtcggccaatcactgcaatatgaacatcaatagtgtggccattccaatcaacaaaaatgaaaaaatgctgaggtccccaatatccccgttatccgacgccagcaaacataaatatactagcgaagatctaacaagctcctcccggccaaatgggaactccttgttcacatcagcttcgagcagtaaaaagccgaaagctgattctcagctccagccgcacggaggcgacctaacaaaggcagcacacaacaatagcgaaaacatcccgctccataaatctagaccgcagaccaagccttggtcgccaggaagtaacggccaccgggattgcaaacggcagaaattggtgtttgatgacatgccccgatccgccgattacttcatgcaggaagccaagaggatgaaacataaagcagatgccatggtggagaagttcgggaaagcactcaattacgcagaagctgctctctcctttatagagtgcggcaatgctatggaacaaggtccaatggagtctaaaagtccatacactatgtacagcgaaacggtagagctgatccgctatgccatgcggcttaaaacgcactctggcccaaacgccaccccggaagacaaacagctcgccgctctttgttatagatgtttggccctgctctactggcgaatgttccggctcaagagggaccacgctgttaagtactctaaggccctaatagactatttcaagaattcatctaaggccgctcaggccccatccccctggggagcctccgggaaatcaaccgggacaccttctccaatgtcgcccaatccgtctcccgcatccagcgtgggatcacaagggagcctcagtaatgcttctgctttatccccatccacgatcgtgtcgatcccacagcgcatccatcaaatggccgcaaatcacgtttccattacaaactccatcttacactcctatgattattgggaaatggccgacaatctggccaaggagaatcgggagtttttcaatgatctggatctgctgatgggaccggtgaccctccatagtagtatggaacatctcgttcaatactcacaacaaggcttgcactggttaaggaatagcgcccatttatcctag

SEQ ID NO: 22379 - DNA, 3756 bp, Artificial Sequence
  Description of Artificial Sequence: Synthetic coding sequence
atggacagttttgatctggcgctgttacaagagtgggacttggagtctctctggggggaggatattttgaaccagcgcaatgactctctggtcgtggagttccagtcatctgcaagcagatgtagaagcgtttatgagcccgacagaaatgcactgcggaggaaggaacgcgaaaggcgcaatcaagaaacccagcaggatgacggcacattcaacagcagctattcactgtttagcgaaccctacaaaactaacaaaggagatgaactttccaacagaattcagaatactctcggcaattacgacgagatgaaggactttttgacggaccggtctaaccagtcccaccttgtgggcgtacccaaacctggggtgccccaaacacccgtgaacaaaattgatgaacactttgtcgcggactcgcgggctcagaatcagccgagctctatctgttcaaccactacctccacaccagctgccgtgcccgtccagcagtctaaacggggaaccatggggtggcaaaaagctggccatcccccatcagatggccagcagcgggctacccagcagggatctctaaggaccttgctcggtgatggcgtgggtcgtcaacagccccgagcaaagcaggtgtgtaatgttgaagtcgggctccaaactcaggaaagaccacccgcaatggccgctaaacattcttcctctggacattgcgtccagaattttcctccatctctggcgagtaagccaagtctggttcaacagaagccaacagcgtacgttcgtcccatggatgggcaggaccaggctcccgatgagtccccgaaactcaagagctcctcagagacaagcgtacattgcacctcctaccgaggtgtgccagccagcaagcctgagccagcgagagccaaagctaaactgagcaaattctcgatccccaaacagggggaggagtcccgctctggagagacgaacagttgtgttgaggagatcatccgcgagatgacttggctgccccctcttagtgccattcaggcacctggaaaggtcgaaccaactaagttcccttttccaaataaagactcccagttggtttcctcagggcacaacaatcctaagaagggcgatgccgagcctgagtctccggactcagggacgtccaatacatcaatgcttgaagatgacctaaagcttagcagcgatgaggaggaaaatgaacaacaagccgcacaaaggacagcactgagggccctttcagacagtgctgtggtgcagcaacctaactgcaggacctccgtcccaagtagcaagggaagctcttctagctcatctagtggctcttccagctccagctccgattccgaaagctcctctggatcagacagcgaaaccgaatctagttcttctgagagtgagggcagcaaaccacctcatttcagctctccagaagccgaacccgcttcctctaacaagtggcaattagataagtggctgaacaaagtaaaccctcacaagcctcccattctgatacagaatgagtcacatgggagcgagtccaaccagtattacaaccccgttaaagaggatgtgcaagattgtggcaaggtcccagacgtttgccagccatctctgcgcgagaaggagattaagtccacctgcaaagaagagcagcgccctcgaaccgctaacaaggctccgggtagcaagggtgttaagcagaagagcccccctgctgctgtagcagtcgccgtgtccgccgctgctccacctccggctgtcccgtgtgcgccagccgaaaatgctccagcacccgctcgccgttccgcgggtaaaaagccgactcgccgtactgaaagaacatctgctggggacggggcaaattgccatcggcctgaagagccagccgctgctgatgccctaggcacctccgtggtagtgcccccagagccgaccaagacacgaccttgcgggaataatagggctagccatagaaaggagctccgaagcagtgtgacttgcgagaaacgtagaacgaggggactgagtcgaatcgtcccaaagtctaaagaattcatcgagacagagtcctctagcagctcttccagctctgacagcgatttagaatcggaacaggaagaataccctctttccaaggcacagacagtagcagcttcggcctcgtcaggtaacgatcagagacttaaggaagctgctgcgaatggcggaagcggtcctcgggctccagtcgggagtatcaatgcgagaaccacgagcgatattgccaaggagttagaagaacagttctataccttggtaccattcgggcgtaatgagctactcagccctctgaaggacagcgacgagataagatccctgtgggtcaaaattgatttgaccctcctgtccagaatcccagagcacttaccccaggaaccaggagtgttatctgcccctgccaccaaagacagcgaaagtgcaccaccatcgcatacaagcgacacacctgcagagaaagccttacctaagtctaaacggaaacgaaaatgcgacaacgaggatgattatcgtgagatcaagaagtcgcagggtgagaaggattccagcagccgattggctaccagcacatctaataccctttcagccaaccactgtaatatgaatatcaacagtgtggcaatccctatcaacaagaacgaaaagatgctgcgcagccccatctcaccactgtccgatgccagcaagcataagtatacgtcagaggacttaacctcttcctcgcggcctaatggcaattcgctgttcacttccgcatctagcagtaaaaaacccaaagctgatagccagctgcaaccacatggaggggacctcactaaggccgcacacaacaattcggagaatatacccctccataaatctaggccccagaccaaaccttggtcacccggttcaaacggccaccgtgattgcaaacggcagaaacttgtgttcgatgacatgcccagatcagctgattatttcatgcaggaggctaagagaatgaagcacaaggctgacgccatggtggagaagttcggcaaagcccttaattatgctgaggccgctctgagttttattgaatgcggcaatgcaatggaacaggggccaatggaatctaagtccccctacacaatgtattccgagacagtggagttgatcaggtatgccatgagacttaagacccacagtggcccaaatgcgaccccagaagataaacaactggcagccctatgctatcgctgcctggccctgctctattggagaatgttccgattaaaaagggatcacgccgtgaaatattccaaggctctgatagactatttcaagaattcctctaaggctgcccaggccccttcaccctggggcgcttccggtaagtccactggcacaccaagccctatgagccccaatccctcacccgcatccagcgttggtagtcagggatctctttccaacgctagcgcgctgagtccctccacaatcgttagcattccccagcggatccatcagatggccgctaatcatgtctccataacaaattccatcctgcacagctacgactactgggagatggccgataatttggctaaggagaacagagagttttttaacgatctggacctccttatgggccctgtcacgctgcactcttccatggaacatttggtgcagtactcacagcagggccttcactggttgaggaatagcgcccacctgtcgtag

SEQ ID NO: 22380 - DNA, 3681 bp, Artificial Sequence
  Description of Artificial Sequence: Synthetic coding sequence
atggacagttttgacctcgctctgctccaggaatgggacttagaatccctctgtgtttacgagcctgacaggaatgctctgcgtcgcaaggagagagagcgaaggaatcaggagacacagcaggacgatgggaccttcaattccagctatagcctgttttcagaaccttacaagaccaacaagggagatgagctaagtaaccggatacaaaatactctcggcaactatgatgaaatgaaggactttctcacagatagaagtaaccaatcccacctggttggggtgcctaagccaggagtaccacagacaccagtgaataagatcgatgaacacttcgtggccgattcccgagcccagaatcagccaagctctatttgctccactaccacgtccacacccgctgcggtcccagtgcagcagtctaaacgcggaaccatgggctggcagaaagctggccaccctcccagcgacggtcagcagagggcaactcagcagggaagtcttagaacactgctgggcgatggcgtggggcgtcagcaacctcgggctaagcaagtttgtaacgtggaagtcggcctgcagacacaagagcgacccccagcaatggctgctaaacacagctcttccggccactgcgttcaaaatttccccccttccctggcctccaaaccttctttggtgcaacagaagcccacagcttacgtccgcccaatggatggtcaggaccaggcccctgatgagtctcctaagttgaagtcctcaagcgaaacatctgtgcactgtacatcatatagaggggtgccagccagtaagcccgaaccagcaagggcaaaggccaagctgtctaagttcagcataccgaagcagggtgaagagtctcgctcaggggagacaaactcgtgtgttgaagagatcatccgggaaatgacctggctccctccactgtctgcaattcaagcaccgggaaaagtcgagcccactaagttcccatttccaaacaaggattctcaactggtaagctctggccacaataatcccaaaaaaggcgacgctgagcctgaatcacccgatagcggaacatctaacacgtccatgctcgaggacgacttgaagttgtcatcggacgaggaagaaaatgaacagcaggctgcacaacgcactgcactgcgtgcactgtctgacagcgctgtcgtgcagcagcccaactgtcggacctccgtgccatcaagcaagggaagttcttctagttcctccagtgggagcagctcctcgagtagcgattctgaatcttcaagcgggagcgactccgaaactgagtcctcttcatctgagtcagagggatcgaaacctccacacttcagctccccagaggccgagcccgcttcctcaaacaagtggcagctcgacaagtggctcaataaagtcaatccacacaaaccacccattttgattcagaatgagtcccacggaagcgagagcaaccagtattataaccccgtcaaagaggatgtgcaggactgcggaaaagtacctgacgtttgccagcctagtctgagggagaaggagatcaaaagcacgtgtaaagaggagcaacgcccaaggacagcaaataaggctcccggaagtaagggagtgaaacagaagtccccaccagccgcagtggccgtcgccgtaagcgccgcagcacctccacctgccgtgccatgcgccccagccgaaaatgcacctgctccggctaggaggagcgctgggaagaaaccaaccagacgtacggagagaaccagcgcgggtgacggagcgaattgtcataggcctgaagagccagccgcagcagatgccctcggaaccagtgtggttgtccctccggaaccaacgaagacccgtccgtgtggcaacaatcgcgcatcccacaggaaagaactcaggagctccgttacatgcgaaaagagacggacgcgcggactttctcgaatcgtcccaaaatcgaaagagttcatcgaaaccgaatcctcatcttccagcagttcaagcgatagcgatttggagagcgagcaggaggagtatcctctgtctaaagctcagactgtggcggcatcagcgtccagcggaaatgaccaacgcctgaaggaagcggctgctaatggcggatccgggccacgtgctccagtgggatctatcaatgccaggaccacaagcgacattgccaaagagctggaggagcagttttacactttggtcccttttggcagaaatgagctgctctccccgctgaaggatagcgacgaaattcgcagtctttgggttaagatcgacctgaccctgctgtccaggattccggaacatttgcctcaggagccaggcgttctttctgctccagccacgaaagacagcgagagcgcaccaccctctcatacttcggacactcccgcagagaaagccttacctaaaagtaagagaaaacgcaaatgtgataacgaggatgattaccgggagatcaaaaaaagccaaggagagaaggactccagttctaggctggccacttccacttctaatactctgtcagctaaccattgtaatatgaatatcaacagtgtggcaatcccaatcaacaaaaacgaaaaaatgttgcggtctcctatctcccctttatctgatgccagtaagcacaaatacacctccgaggacttgacaagcagctccaggcctaacggtaattcactgtttacctctgcctctagcagtaagaagccaaaagccgactctcagctccaaccacatgggggagacctgactaaggcggctcacaataatagtgagaatattcctctacataagagtagacctcagactaagccatggagcccgggttctaatggacatagggattgcaagcggcagaaactagtcttcgatgacatgccacgctcagctgattatttcatgcaggaggccaagcgaatgaagcataaggccgatgctatggtggaaaaattcggcaaagctctgaattacgccgaggcggctctgagctttatcgaatgtggcaacgcaatggaacaggggcctatggagtccaaaagtccatatactatgtattccgaaaccgtggagctgatcaggtatgctatgaggttaaagacccatagcggcccaaatgcaacacctgaagataagcaacttgctgcactctgttatagatgcctagccctcctttactggcgcatgttccgtctcaaaagagaccatgccgtcaaatattcaaaagccctgatagactactttaagaatagttcaaaggccgcacaagccccaagcccctggggggcatccggcaaaagtaccggcacaccgtccccaatgtccccaaacccgtcccctgcaagcagtgtcggttcgcaaggttctttgtccaacgcaagtgccctgagtccatcaacgatcgtgagcattccgcaacgtattcaccagatggctgccaaccacgtttctataacaaattccattctacattcatatgactattgggaaatggctgacaacttagccaaagaaaatagggagttttttaacgatctcgacctcctcatggggccagtcacgcttcacagtagcatggagcacctggtgcagtattctcagcaaggcctacattggctgcgaaactctgcccatctctcctag

SEQ ID NO: 22381 - DNA, 300 bp, Artificial Sequence
  Description of Artificial Sequence: Synthetic coding sequence
atggatagttttgacttagccctattacaggaatgggatctggagagtttatgtgtttacgagccagaccgaaacgccctgagacgaaaggagcgcgagaggcggaaccaggagacacagcaggacgacgggacctttaattcttcttactctcttttcagcgagccatataagaccaataagggtgatgaactctcgaaccgcatccagaataccttgggtaactacgatgaaatgaaagactttctcaccgatcgtagcaatcagtctcatctggtgggtgtgcccaagcctggctag

SEQ ID NO: 22382 - DNA, 468 bp, Artificial Sequence
  Description of Artificial Sequence: Synthetic coding sequence
atggactctttcgatcttgctttgctgcaggaatgggacttagagagtctgtgtgtgtatgaacctgacagaaatgccctacgacgcaaagagagggagaggaggaaccaagagacccagcaagacgacggaacctttaacagttcttactccctctttagtgagccttacaaaaccaacaagggggacgaactttccaataggatccagaataccttaggcaattatgatgaaatgaaggacttcctgacagaccgcagcaatcagtcccaccttgtgggagtacccaaaccaggggtaccacagaccccagttaacaagatcgacgaacatttcgtggccgactctagggcccaaaaccagcccagttccatctgcagtacgacaacttctacccccgctgccgtcccagtgcagcaatctaagcgcggtacaatgggatggcagaaagcgggacaccctccctag

SEQ ID NO: 22383 - DNA, 345 bp, Artificial Sequence
  Description of Artificial Sequence: Synthetic coding sequence
atggatagcttcgaccttgcacttctgcaagagtgggatctcgagtccttatgcgtctacgagccggacagaaacgctctccgcaggaaagaacgggagcgacgaaaccaggaaacacagcaggacgacgggacgttcaattcttcctactctttattctcagaaccatataagacaaataaaggagatgagcttagcaacagaatccaaaacaccctgggcaattacgatgagatgaaagatttcctgacagatcggtctaaccagtcccacttggtcggggttcctaagccgggagttccacaaacacccgtgaacaagatagacgaacattttgtcgcttag

SEQ ID NO: 22384 - DNA, 54 bp, Artificial Sequence
  Description of Artificial Sequence: Synthetic coding sequence
atggactctttcgatttggccctacttcaagagtgggatctggaatcactatag

SEQ ID NO: 22385 - DNA, 486 bp, Artificial Sequence
  Description of Artificial Sequence: Synthetic coding sequence
atggactcatttgatctggccctactgcaggagtgggacctggagagtctctgtgtgtacgaaccagatcgcaatgcgctccggcgaaaagagcgggaacggagaaaccaggaaacccagcaggatgacgggacatttaactcctcgtactccttgttctcagagccatataagacgaacaagggcgatgagctcagcaatcgcattcagaatactctcggaaactatgacgaaatgaaggattttctgacagatcgctccaatcaaagccacctggtgggcgttcctaagcctggggtgcctcagacgcccgtcaacaaaattgacgaacattttgtcgccgatagtagagctcagaatcagccttcctctatttgctccacaaccacctccacgccagcagccgtccccgtgcagcagagcaaacgcggtacgatgggttggcagaaggccggtcatcctccctctgatggccagcagcgttag

SEQ ID NO: 22386 - DNA, 2346 bp, Artificial Sequence
  Description of Artificial Sequence: Synthetic coding sequence
atggattccttcgacctggcgctgttgcaggaatgggacctggagtcattatggggagaagatattctgaaccagcgaaacgattcgctggtcgttgagtttcagtccagcgcctctagatgtcggtctgtatacgaacccgatagaaacgcgcttcggcgtaaagaaagagagcgaagaaaccaggaaactcagcaagacgatgggacattcaatagttcctacagccttttctctgaaccatacaaaaccaacaagggagatgagctgtccaatcgcatacagaacactctgggcaattacgatgaaatgaaggattttcttacagatcggtctaatcagtcgcacttagtaggggtccctaaaccaggcgtaccacaaaccccagtgaacaagatagatgagcactttgtggccgattccagagcacagaatcagccaagttcaatctgctccactactacgagcacacctgccgcagttcctgtgcagcaaagcaagaggggaacaatgggctggcagaaggcaggccatccgccatcagacgggcagcagcgagccacccagcaaggatccctgaggaccctgcttggggacggggtcggacggcaacagcctagggcgaaacaggtgtgcaatgtagaagtcgggctgcaaacacaagagcgcccacctgctatggcagccaagcactctagctctggtcattgcgttcagaatttccccccatccctggcctcgaagccttctctcgtgcagcagaagccaacagcttatgtgaggccaatggatggacaggaccaggcaccagacgagtcgcctaagctgaagtcatctagtgagacatccgtacattgcacatcatatcggggtgtgccagccagtaaaccagaaccagcccgtgccaaagcaaagctgtccaaattctcaatccccaagcagggagaagaatctcggtctggagaaacgaattcctgtgtcgaggagatcatccgcgagatgacatggctgcctcccttgtccgccattcaggcccctgggaaagtggagcccacaaaattcccatttcctaacaaggacagccagttggtgtcctcaggacacaataaccccaagaaaggcgacgcggagcctgaaagccccgactctggcacatcgaacactagcatgctggaggacgaccttaagctgtcaagcgacgaggaggagaatgaacaacaggctgcccagcggacggccctgagggcccttagcgatagcgcagttgttcaacagccgaattgtcgcacctcagtgccaagcagcaaaggtagttcatcctcttcctcttccgggtcgagctcttccagctctgactcggaatcaagcagtggatccgatagcgagacagaatcatctagcagcgagagtgaggggtcaaagccgccacacttctctagcccagaggccgagcccgcaagcagtaataaatggcaactggataaatggcttaacaaggtcaacccacacaaacctcccattctcattcaaaatgagtcccacggatctgagtctaatcaatactataatcctgtcaaagaggacgtgcaggactgtggaaaagtgccggacgtgtgccagcccagcttgcgggaaaaagagattaaatccacttgcaaagaggagcagcgccctagaactgccaataaagccccaggatcaaagggagttaaacagaaatcaccacctgcagcagtggctgtcgctgtgtccgctgcggcaccaccgcctgccgtgccttgcgcgccagctgaaaacgcacccgctccggctcggaggtccgcaggaaaaaagcccacccgcagaaccgagagaacttccgccggagatggagccaattgtcatcgaccggaagagccggcagcggcagatgccctgggcaccagtgtggttgtgccccctgagcccacaaagacaaggccttgcgggaataatcgcgcatcccaccgtaaagaactgcggtcgtccgtcacctgtgaaaagcgcagaacccgaggactctcgcgtatagtgcccaagagcaaggaatttatcgagaccgaatcatcaagcagcagtagtagtagtgactctgacctggagtcagaacaagaggaatatcccctaagtaaagcccagaccgtcgccgcttcggcttcctccgggaatgaccagagacttaaggaggcagccgctaatggaggatctgggccaagagcacctgtcggttctatcaacgcccgaaccacaagcgacattgccaaggagctcgaagaacaattttacacattagtcccactcgcaggcactaacttctcgccattatag

SEQ ID NO: 22387 - DNA, 2610 bp, Artificial Sequence
  Description of Artificial Sequence: Synthetic coding sequence
atggacagcttcgatctggccctactgcaggagtgggatttggaaagcctttgtgtgtacgagcccgatcgcaacgctttgagaagaaaagaacgcgagcggcgtaaccaggaaacacagcaggacgacgggacattcaatagcagttattcattgttttcagaaccctacaaaaccaataagggtgacgagctgtccaacagaattcagaatacattgggcaattacgacgagatgaaagactttttgaccgacagatccaaccagtcacacctggtgggcgtccccaagccaggagtgccccagacacctgttaacaaaatcgacgaacactttgtcgcagattctcgcgcacagaaccagccgtcttccatctgttccaccaccacctctacacctgccgctgttcccgtccagcaaagcaaacgcggaaccatgggatggcagaaagctggacaccctccttcagacggtcagcagcgggctacccagcaagggtctctccgcacgttgctgggagacggagtgggcaggcagcagccaagagccaaacaagtgtgcaacgtagaggttggactgcagacccaggagcgccctccagccatggccgcaaagcatagttctagtgggcactgtgtgcagaacttccctccttcactggcttctaagccatcccttgtacagcaaaaacctactgcgtatgtcaggcccatggatggccaagatcaggcccctgacgagagtcccaaactcaagtcatccagcgagacgtcagttcactgcacatcttaccggggagtccctgccagtaaacccgaacctgcacgcgctaaagccaaactgtcaaagtttagcattccaaaacaaggcgaagagagtagaagcggcgagaccaactcctgtgtggaggagattatcagagaaatgacttggctccctcctctttctgccattcaggctcctggaaaggttgaacctactaagttcccttttcccaacaaggacagccagctggtatcatcgggccacaacaatccaaagaagggggatgccgagcccgaatcccctgattcaggaactagcaacacttccatgcttgaggacgatctcaaattgtcgagcgatgaagaggagaacgagcagcaggccgctcagcgcaccgctctgagagccctgtcggactcggccgtcgtgcagcagcctaattgtcgcacaagcgtccccagtagcaaggggagctccagttcaagttctagtggatcatctagcagtagcagcgactccgagagcagttctgggtcagacagtgagaccgagagctccagctccgaaagcgagggaagtaagccgcctcatttttctagccccgaagctgaacctgccagctcaaacaagtggcagctggacaagtggttgaacaaagtaaatcctcacaagcccccaattctcattcagaacgaatcccatgggtctgagagcaatcaatattacaaccctgtcaaagaggatgtgcaggactgcgggaaggtgccagacgtgtgtcaacccagtctgcgggagaaggaaataaagagcacctgcaaggaggaacagcgacccagaaccgccaacaaggctcccggatctaagggagtgaagcaaaaaagtcccccagctgctgtggcagtcgccgtgtccgctgctgctccacccccagccgtgccatgcgccccagccgaaaacgcccctgctcccgctagacgatccgctgggaagaaaccaacccgccgaacggagagaaccagcgctggggatggtgcaaattgccatcgccctgaagaacccgctgcagccgacgccctggggacctctgttgtcgtcccgccagaaccaactaaaacccggccttgcggtaacaatcgcgcttcccaccgcaaagagcttcggagttcagtgacttgtgagaagcgaagaactagggggctgtcccgtatagtgcctaagtcaaaagagtttatcgaaaccgaatcctcaagcagctcaagtagctcagatagtgacctggagtctgaacaggaggagtaccccttgtccaaagcacagacagtggctgcaagtgcttcttcaggcaacgatcagcgcttaaaggaagccgctgcaaacggagggtcaggccctcgggcacctgtgggtagtatcaatgctagaaccacgagtgacattgcgaaagagctggaggaacaattctacacccttgtgccctttggccgtaacgaattgctgtcgcccctgaaagacagtgatgagataaggagtctgtgggtgaaaatcgacctgacacttctgtctcgtataccggagcaccttccacaggagcccggagtcctttccgccccagccaccaaagatagtgaatcggccccaccttctcacacatccgatactcccgcagagaaggccctgcccaaatccaagcgcaagcgcaaatgtgataatgaggacgattacagggaaattaagaaatcgcagggcgagaaggattcttccagtagattggcaacctccacttccaacacgctgtccgcgaaccactgcaacatgaatataaacagtatgcagctacccatatag

SEQ ID NO: 22388 - DNA, 390 bp, Artificial Sequence
  Description of Artificial Sequence: Synthetic coding sequence
atggacagctttgacctcgccctgctacaggagtgggacctggaatcattgtgcgtgtatgaacccgatcggaacgctctccgtcgcaaagaacgtgaacggagaaaccaggagacacagcaggacgatggaacgttcaatagcagttattcactgtttagcgagccatataaaacgaacaagggtgatgagttatccaatagaatccagaatactctcggcaattatgatgagatgaaggacttcttgactgatcgctcaaatcagtctcatttagtcggagtgcctaaaccaggggtcccacaaactcccgtgaacaaaatcgacgagcattttgttgccgattccagagctcaaaatcagcccagctccatatgtagtaccacctag

SEQ ID NO: 22389 - DNA, 3066 bp, Artificial Sequence
  Description of Artificial Sequence: Synthetic coding sequence
atgaccctgaggcttgatgcaggcggaattccgagtctggcaccacgcgtttatatttccggttctccctctcaacgctttctgccgcgaaagcgcaacaaaggagagtcggcgggtcgggattccctgctggcaggtagtgcccgatttggttcccggggagaggcccaactgcagggtagcgaactgttgagccgcaattctggcgagtctttagttagaattcggagctgcgggcaggaactgatcacatgcctgtctcgccctgagacagggggaaaattcgaggtcgatactcagcggcctgtttgtccaccatcaagagcaagagccgctcgagcatccgcggcagccgtagctgctgcagctactctcacccccccaaccatggattcattcgatctagcactgctgcaggaatgggacctcgaaagtctgtggggggaagacattcttaatcagagaaacgatagcctggtagttgagttccagtcttctgccagccgatgtaggtccgtatacgaacccgatcgcaatgcactgagacggaaggaacgggaacggaggaaccaagagacgcagcaagacgatggtactttcaactcaagctattctctcttttccgagccctacaagacaaataaaggtgacgaacttagtaatagaattcagaacacactaggaaattatgacgaaatgaaggactttctgacagataggtctaatcagtcgcatttagtgggcgttcccaaacccggagttccccagacccctgtcaacaaaattgatgagcacttcgttgctgatagcagagcacagaaccagccatcttcaatctgctctacaactacatctacacccgctgccgtgccggtacagcagagcaaaagaggcaccatgggttggcaaaaagcaggtcaccctccctcagacggacagcagagagccactcagcaggggagtttaagaacactccttggcgacggcgtgggccgacagcagccacgtgccaaacaggtttgcaacgtggaggttgggctgcagacccaggaaaggccgcctgccatggcggcaaaacattcaagttccggtcattgtgtgcagaatttccccccttctctggcttctaaaccaagcctcgtacaacagaagccaacggcttacgtgcgccctatggacggccaggatcaagctcccgatgagagtcccaagctgaaatccagctcagaaacatctgtgcactgtaccagctatcggggtgttcctgcatcaaaacctgagcccgcaagggccaaagccaagctctctaagttttcaattcctaagcaaggcgaggaatcgcgctcaggggagacaaacagttgcgtcgaagaaataatacgggagatgacttggctgcccccattgagtgctattcaggcccctggtaaagtggaacctaccaagttcccatttccaaataaggactctcagcttgtctcatccgggcataacaatcccaagaaaggggacgctgaaccagagagcccagactcagggactagtaatacatcaatgctggaggatgacttgaagctaagttctgacgaggaggagaacgagcaggcagcccagaggactgctctcagggctctgtccgactcagctgtggtgcagcagccaaattgtcgcacgtcagtgccgtcgtctaaagggtccagcagtagctcatccagcgggtctagtagcagcagcagtgactctgaaagcagtagcgggtcggatagcgaaacagagtcatcaagtagcgaatctgagggaagtaagccccctcacttctcgagccccgaagccgagcccgctagctctaacaagtggcaactcgacaagtggctcaataaagtgaatccgcacaagccacccatcctgatccaaaatgagtcccacgggtccgaaagcaaccaatactacaacccagtcaaagaggatgtgcaggactgtggcaaagtgcctgatgtgtgccaaccaagcctcagggagaaagagattaagagcacctgtaaggaggaacagcgaccaaggaccgccaacaaggcccctgggtcgaagggcgtcaaacagaaatcccctcccgcagccgtagcagtagccgtgtccgccgcagcccctccccctgcagtgccgtgtgcccctgcggagaacgcccctgctcccgcaagacgcagcgccggtaaaaagcctacccgacggacggaaaggacaagtgcaggagatggtgcaaactgccatagaccagaggaaccagcagctgcagatgcattaggcacatcagtcgtggtgccccctgagccaacaaagacaaggccatgtgggaacaaccgcgcttcacatcgcaaagagcttagatcctccgttacctgtgaaaaacgcagaacacgcggtctgtcacggatcgtgccaaagtcaaaggagttcatcgaaacagaaagctcctcaagcagcagttcctcagactccgatctggaatcagaacaggaagaatatcccttgtctaaggcgcagactgtggctgcaagtgcatcctcaggcaatgaccagcgcctcaaggaggccgctgcaaatggtggaagcgggccacgcgctcctgtgggaagcatcaatgccagaactacctctgatatagccaaggagctggaagaacagttttacacgttggttccattcgggcgtaatgaactgctgagtcctctgaaagattcagacgaaatcagatccttgtgggtaaagattgacctgacattattgtctagaattcccgaacatctgccacaggagccgggagtccttagcgcaccagcaactaaggattcagagtccgcaccaccatcccacacctcagacacgccggctgagaaagccttgccaaaaagcaaaagaaagcgtaagtgcgacaatgaggacgactacagagagatcaagaaaagccagggggagaaggacagttcttcaaggttggccaccagcacatctaatacattgagcgcgaaccattgtaatatgaatataaattccctgtcacttccttag

SEQ ID NO: 22390 - DNA, 17387 bp, Artificial Sequence
  Description of Artificial Sequence: Synthetic coding sequence
atgtgcgactgttttcacatggtgctgcctacttggcccggtacgcccggatcagtgtcaggcagacagttgcagcccggtgaacctggtgccgaaaccgaggatgatcattctgtgacggaggggccagccgacgagggcatccgcccacgccctcagggctcatcaccagtgtacgagtatactactgaggcagccgattttggacttcaggaggacgctcccggacggcaaggctccgccggacggaggcggagttggtggaagagagacagcggggactctcggacctttttccgcatgtccaggcccgaagccgtacaggaagctacagaggtgactctgaaaacagaagtggaggctggggcaagtgggtatagcgtcaccggcggtggcgatcagggcatttttgtcaagcaagtgttgaaggatagttcagcggctaaactgttcaacctacgtgagggtgaccagctgctatcaaccaccgttttctttgagaatataaagtatgaagacgctctgaaaattctccagtatagtgagccgtacaaggttcagtttaagataagaagacagctgccggcacctcaggatgaggagtgggcctcttcagacgcccagcatggaccacaaggcaaagaaaaagaagacaccgatgttgcggacggttgccgcgaaacccctacaaaaaccctagagggggacggtgaccaggagcgactcatatctaaacctcgggttggacgcggaagacaaagtcagcgcgagcggctgtcctggccaaagtttcagtcaatcaagtccaagagaggccctgggccacaaagaagccatagctcatcggaagcttacgagcccagggacgcacacgacgtgagcccaactagtacagacactgaggcccagcttactgtggagagacaagagcagaaagctggtccaggttcccaacgccgaagaaagttcttgaatctgcggtttcgcacaggatctggacagggaccctcatctacaggacagcccggtcgcggatttcagagtggggtcgggagggcaggtgttctggaggaacttggcccttggggagacagcctagaggaaaccggagcagcaaccggctctcgacgcgaggagcgggcagagcaggacagggaggttatgccagctcaatctatgcctctacctaccgaactgggtgatccaaggctgtgtgagggcaccccccaggagggcggactgagggctgcacgcctccatggcaagacactggaaggccaggcccaagagacagcagtggctcagcgcaaacccagggcacagcccacaccgggaatgagtcgcgagggagagggtgaaggcttacagtcactcgaaattggaatcgcacggctgtcgctgcgagacactaccgagggagggacccagatagggccaccagaaatccgggtgcgggtgcacgatctgaagacgccaaagttcgccttttcgaccgagaaagaacctgagcgcgaaagaaggcttagcaccccccaacggggtaagaggcaggatgcttcaagcaaggctggcaccggtctgaagggagaggaggtggagggcgcaggatggatgccgggtcgggaaccaacaacccacgcggaggcacaaggggacgagggagacggtgaagaagggcttcaaagaacccgaataacggaggagcaggataaggggcgtgaagacaccgagggtcagatccgcatgcccaagtttaagataccttcactgggttggagtccatccaagcatactaagaccggacgggagaaagctactgaggacactgagcagggaagggaaggagaggctacagccactgcggaccgcagggagcagcgccgaacagaggagggcctgaaggataaggaagacagcgattctatgaccaacacaacgaaaatccagctgatccatgacgagaaaagattaaagaaagaacagatcctgactgagaaggaggtggccacaaaagatagcaagtttaagatgccgaaatttaagatgccactgttcggtgcgtcagccccaggaaagtctatggaagcatctgtggacgtctccgctccaaaagtagaagcagacgtctctctcctatctatgcagggggaccttaaaaccacagacctgtcggtgcaaaccccatctgccgacctcgaagttcaggatggacaggtggacgtgaaactgccagaagggcctctgcctgagggcgcaagcctcaaagggcacctcccaaaagtccagcggccaagccttaaaatgccaaaggtggacctgaaagggccaaaacttgacttaaaaggcccaaaggctgaagtgaccgcacccgatgtgaaaatgtcattatcctccatggaagtcgacgtgcaagctcccagagccaagttggacggagccagactagaaggggacctgtcactggccgataaggaggtaacagccaaagattcaaagttcaagatgcctaagttcaaaatgcccagcttcggcgtctcagccccaggcaaaagcatggaggactcagtggacgtgagtgcgccaaaagtggaagccgacgtctccctgagttccatgcagggagatttgaaagctacagacctgtcaatccagcccccttcggcagatttggaggtccaggccggacaggtggacgtcaagctgcctgagggccctgtaccagagggcgcaggaccgaaggtgcaccttcccaaagtggaaatgccctctttcaagatgccgaaggtcgaccttaaaggccctcagattgacgttaagggacctaagcttgatctgaaaggccctaaagccgaggtgactgcaccagacggtgaggtgagcctacccagtatggaagtggacgtgcaggcccaaaaagctaaactggatggagcttggcttgagggggatctttccctggctgacaaagatgttaccgccaaagatagcaagtttaagatgccaaagtttaagatgccaagtttcggggtctctgctcccggaaaatcgataaaagccctggttgacgtgtccgctcctaaagtggaagctgatctctcactcccaagcatgcagggagacctgaaaactactgatctgtccatacaaccagcttccaccgatctgaaggtccaagccgaccaagtcgatgtcaaacttccagagggacatcttcctgaaggggctggtttaaaaggccatttgccaaaggtagagatgccctccttcaagatgcccaaggtggcactgaaaggtccccaggtggacgtaaagggcccaaagctggacctcaaatctcccaaggccgaggtgactgcacctgatgtggaagtatccctcccctcagtggaagtagatgttgaagcccctggtgccaagctggattccgcaaggctggagggagaactttcccttgctgacaaagatgtcacagcaaaagattccaggttcaaaatgccgaagtttaagatgccgtcatttggagcaagtgcacccggtaagtccattgaagctagtgtcgacgtcagtgccccaaaggtcgaggcagatgtaagcctgccgtctatgcagggtgacctgaaaaccacagatcttagtatccagccgccatccgctgacctggaagtgcatgcaggccaagtggatgtcaagttgctggagggccatgtgccagagggcgctggtttcaaaggtcatctgccaaaagtccagatgccttcgctcaagatgccgaaagttgacctgaaggggccacaggtagaggttcggggtcccaagctggacttgaaaggacacaaggcagaggtcacagctcatgaggttgccgtatccctgccttccgtggaggtcgatatgcaagctcctggggctaagctggacggggctcagctggacggggatctcagtttagcagataaagacgtgactgctaaagacagtaagtttaagatgccgaaatttaagatgccttcatttggtgtatctgctcctggtaagtcgattgaagcctccgttgatctgagcgctccaaaggtcgaagctgacatgagtctccccagcatgcaaggggatttgaaaacaaccgacttatcgatccagcccccaagcacagatctggagctgcaagccggacagctcgacgttaagttacctgagggcccagtgcccgaaggagccggtctaaagggacacttgcctaagctgcaaatgcctagcttcaaagtgccaaaggtggacttaaaagggcctgagatagacataaaaggccctaagttagacctgaaagatcctaaagttgaagtgaccgcacccgacgtggaagtctcgctcccaagtgtcgaggtggacgtagaagcccctggagccaaacttgacgggggacgtctggaggaggatatgtcactggctgacaaagaccttacaacaaaggactcaaaattcaagatgcccaaattcaagatgcccagttttggcgtgtcagccccaggaaaatccatcgaggctagtgtagatgtcagtgccccaaaggtggaggccgatgtttctcttccttcaatgcagggcgacttgaaggcaaccgatctgagcatccagcctccatctgccgacctggaagtgcaggccggacaagtggacgtaaagctgcctgaaggtcccgtctccgagggagcaggcctaaagggacacctcccgaaagtccagatgccctccttcaagatgccaaaggtggatctgaagggaccccaaatcgacgttaaaggtcctaaactcgacctgaagggcccaaaggttgaggttaccgctccagacgttaaaatgtccttatccagcatggaagtcgacgtccaagccccaagagcaaaacttgacggcgcacagttagagggtgacctctcattggcggataaggcggttaccgcgaaggattctaaatttaaaatgcctaagttcaaaatgccttcctttggtgtgtctgcacccggaaagagcatcgaggcgtctgtggacgtctccgagcccaaggttgaagcggatgttagtttaccttctatgcaaggcgacctgaagaccaccgacctttcaatccagtctcctagcgccgatctggaggtccaggccggtcaggtcaatgtgaaactccctgagggaccactgcccgagggtgctggtttcaaaggtcatctcccaaaagtacagatgccctccttgaaaatgcccaaagtagccttgaaaggtccccagatggacgttaagggccctaaactggacctcaagggacctaaggccgaggttatggcccctgatgtggaagttagcctgccttccgtggaggtcgacgttgaagctccaggagccaagctcgatagtgtgcggctggaaggcgacttgtctttggctgataaagatgtgaccgccaaagattccaagttcaagatgcctaagtttaagatgcccagtttcggggtcagtgcgcctggaaagtccattgaggcatccgtggatgtgtctgctccgaaagtggaagctgaggtcagcctgccttccatgcagggtgacctcaagacgacggacctttgtattccattgccgagcgctgatttggttgtacaagctggacaggtggacatgaagttacctgagggtcaggtaccggagggggctggcctgaagggccacctgcctaaggtggacatgccgagcttcaagatgccaaaagttgatctcaagggcccacagacagacgttaaaggagctaaactggatttaaagggacccaaggccgaagtaacagcaccagacgtcgaagtatccctgcccagtatggaagttgacgttcaggctcagaaggccaagctggatggagctaggctggaaggcgacctcagcttggctgacaaagatatgaccgccaaagatagcaaatttaagatgcctaagtttaaaatgcccagctttggtgtatccgctcccggtcgtagcattgaagcctctgtggatgtacctgcccctaaagtggaggcggacgttagcttgcccagcatgcaaggggatctgaaaacaactgacctctccattcagccaccgtctgcagacctgaaggtgcagactggacaggtcgatgtgaagctgccggagggccatgtgcctgagggagccggactgaaaggccacttgcctaaggtcgagatgccgtctctgaaaatgcctaaggtagacctgaagggaccacaggtggatattaaaggcccaaagctggaccttaaggaccctaaagtcgagatgagggtgcccgatgttgaggtgtctctgccctccatggaagtcgatgttcaagcgccacgagccaaattagatagcgcccacctccagggggatctgaccctggcaaataaggatctgacaaccaaggactctaaattcaaaatgccaaagtttaagatgccctccttcggggtgtcagcgccaggaaagtctattgaagcttcggtagacgtgagtcccccaaaagtcgaggcagatatgagtctgccatcaatgcaaggtgatctcaaaactactgatctctccattcagcctctaagcgcggacgtcaaggtccaggccggacaggtggatgtgaaactcctggaaggccctgtacccgaggaagtggggctgaaggggcaccttcccaagttgcaaatgccaagttttaaggtccctaaggtagacctgaagggtcctgaaattgatatcaaaggacctaaattggacctcaaggatcccaaggtggaggtgaccgcacctgacgtggaggtgtctttaccttccgtcgaggtggacgtcaaagctcctggcgctaagctggacggagcccgtttggagggcgatatgtctttggcggataaagacgtgaccgccaaagacagtaagtttaagatgccgaagttcaagatgttgagttttggcgtgtctgccctaggtaagtcgatcgaagcctcggcagatgttagcgctctgaaggtcgaggctgatgtgtccctgccttcaatgcagggtgatctgaaaactaccgatctaagcgtgcagccgccatctgcagacctggaggtgcaggccggacaggtcgacgtcaaactgcctgagggccctgtccccgagggcgcaggcctgaagggtcatctgccaaagctccagatgccatcattcaaaatgcccaaagtcgacttgaagggtcctcagatagacgtgaaaggacctaagctcgatctaaagggtccaaagaccgacgtcatggccccagacgtcgaggtgtcccagccctcagtagaggtcgacgttgaggccccaggagcaaagctggacggtgcatggttagagggggatctttcggtcgcagataaggatgtgacaacaaaggattcaaggtttaaaattcctaaatttaaaatgccctccttcggagtgtctgcacctggaaagtctattgaagcgagcgtagacgtaagtgctcccaaagtggaagcggatgggtcgctaagcagtatgcaaggcgacttgaaggccacggacttgtccattcagcccccttcagcagatctcgaagtacaggcgggacaggtagacgtgaagctaccagaggggcctgttccagaaggcgctggactgaaaggacacctacccaaagttcagatgcctagttttaaaatgccggagatggatctgaagggaccacaactggacgttaaagggccaaaacttgaccttaaaggaccaaaggctgaggtgaccgctccagacgttgaaatgtccttaagcagtatggaggtcgatgttcaggcacccagggccaagctcgacggcgcacgtctggagggggacctgagtctggctgacaagggagtgacagctaaggactccaaattcaaaatgcctaaattcaaaatgccctcttttagggtcagtgcccctggagagtcgatcgaggccttggtcgatgtgtctgaactgaaggttgaagcagacatgtctttgccatcaatgcagggtgatctcaagacaaccgatataagcattcaaccaccatcagcccagttggaggttcaggctggtcaggtggacgtcaaacttcctgagggccacgtgccagaaggtgcaggccttaaaggccacctgcccaagctccagatgcctagcttcaagatgccagaagttgatctcaagggaccccagatcgacgtcaagggcccaaatgtcgatttgaaaggacctaaagcagaggttacagcaccagacgtaaagatgtctctttcgagcatggaagtcgacgtgcaggcaccacgcgcaaaactggacggcgcacgattagaaggggacctatccttggccgacaaggggatgaccgccaaagacagtaaatttaagatgccgaaatttaaaatgccctccttcggcgttagcgccccaggcaaaagcatcgaggcttcggtcgatgtgtcggaactgaaagtggaagcagatggttccttcccatctatgcagggcgacctgaaaaccacagatatacggatacagccaccctcagcacagttagaagtgcaggcaggccaagttgacgttaagcttccagagggtcatgttcccgagggggctgggctgaaagggcatctacccaaagtgcagatgccatcttttaaaatgcctaaggtggatctgaagggccctcaaatagacgttaagggtccaaaacttgacctgaaaggcccaaaagcagaggtcactgcccctgacgtggaggtctccctcccaagcgttgaagtagacgtggaggctccacgcgctaaactggatggcgcacggcttgagggtgatctttcattagccgacaaggatgtgaccgctaaggactctaagttcaaaatgcccaagtttaaaatgccatcatttggggtgtccgcacctggcaaatccattgaagtgtccgtggatgtaagcgctcctaaagtggaggctgaggtgtccttgccctctatgcagggagacttaaaaactactgatatctctattgagccaccctctgcccaactggaggttcaggctggacaagtggacctcaaactgcccgagggccacgtgccggagggagcgggtttaaaaggtcacctgccaaaactacagatgccctctttcaaaatgccaaaagtcgataggaagggaccccagattgacgtgaagggaccaaagctggacctgaagggaccaaagaccgatgtgaccgccccagatgtcgaagtgtcccagcccggaatggaagtggatgttgaagctccaggggcaaagttggacggcgcacgattggagggggatctaagcttggctgacaaagacgtaaccgccaaagacagtaagtttaagatgcccaagttcaagatgcccagcttcggcgtgtccgctccgggaaagtcaatcgaagtgctggtcgatgtatccgctcctaaagttgaagccgatctttccctgccgtctatgcagggtgacctgaagaataccgatatatcaattgagccacccagcgctcaactggaagtgcaggctggccaggtcgatgtgaagcttcctgaaggccatgtcctggaaggcgcaggtctgaagggacatcttcccaagcttcaaatgcctagctttaaaatgcctaaggttgatcgcaagggaccacagatagacatcaagggcccaaaactagacctgaaaggtcctaaaatggatgttaccgcaccagacgtggaggtcagccagcctagcatggaggttgatgttgaggcccctggcgctaagctggatggcgctaggctggaaggggatctgagcctggccgataaggacgtcacggcaaaagactctaagttcaaaatgcccaaatttaagatgcccagttatagggcctccgcgccaggcaaaagcatccaagcttctgtggatgtctctgccccaaaggctgaggctgacgtttcattgccgagcatgcaaggggacctaaagacaacagacttgtcgattcagctgccttccgtggatctggaagtccaagcagggcaggtggacgttaagttgccggaaggccatgtgccggagggggctgggctaaaggggcacctgcccaaagttgagatgccgtcattcaaaatgccgaaagttgacctgaaatcgccgcaggtggacattaaggggcctaaactggacctgaaagtgcccaaggctgaggtgaccgtgcctgatgttgaggtctcgcttccttcggtggaggtggacgtgcaggctcccagggcaaagcttgacggggcacggctagagggcgatctgtctctggctgagaaagacgtgactgccaaagattcaaaatttaagatgcccaagttcaagatgccctcttttggggtgtcagccccaggtcggtctatcgaagccagtctggacgtctccgcgcctaaagtggaggcagatgtgtccttatctagcatgcagggcgatttgaaagctactgatcttagtattcaaccgcctagcgccgacttggaggtgcaggcagtgcaggtggacgtggagttgctggaaggaccggttccagaaggggcaggcttgaaggggcacctacctaaggttgagatgccctcactgaagacacccaaagtggacctgaaaggcccacagatcgacgtgaaagggcctaaactggatcttaaaggcccaaaggcagaggtgagggtgcccgatgtggaagtgagcctgcctagcgtcgaagttgatgtccaggctccaaaagcaaaactcgacgcaggcaggctggaaggcgacttgagcctggcggataaagacgtgacagcgaaagacagcaaattcaagatgcccaagttcaagatgcctagcttccgcgtgtctgccccaggcaagagcatggaagctagcgtggacgttagcgccccaaaagtagaggctgatgtgtcactcccctctatgcagggagatctgaagactactgacctgtccatccagcctccaagcgcagacctcaaggtgcaggctggacagatggacgtcaagttgcccgagggccaggttccagaaggagcaggtctgaaggagcatctgcccaaggttgagatgccttccctgaagatgcccaaggttgatctcaaggggcctcaggttgacattaaagggcctaaactggatcttaaggtctcaaaggccgaagtgactgcacctgacgtcgaggtctctcttccttccgtggaggtggatgtacaggcccctagggccaagcttgacagtgcacagcttgaaggcgacctctctctggcggacaaggacgtgactgccaaagattctaaattcaaaatgccaaaattcaagatgccaagcttcggcgtgtctgcacccggtaaaagcatagaagcttccgtgcatgttagcgcacctaaagtagaagctgatgtgagcctgccatccatgcagggcgatcttaagaccaccgatttgtctatacagcctcactctgcggatctgactgttcaggcccgacaagtggacatgaagctccttgaagggcacgttccagaagaagccggactcaagggacacctgccaaaggtacaaatgccatcctttaaaatgccaaaggtggatttgaaaggtccagagatcgacataaaaggcccaaagcttgacctgaaagaccctaaggtcgaagtgaccgcaccagacgtcgaagtgtcacttcccagcgtggaggtcgatgtggaagcacccggagctaagctcgacggcgctaggttggaaggcgatcttagcctggccgacaaagatatgactgcaaaggattcgaaatttaagatgccaaagtttaagatgccttctttcggggttagtgctcctggcaaatccatggaggcttctgtggacgtaacagcacccaaggtggaggcggatgtttctctacccagcatgcaaggggatctgaaggccactgacctttccgtgcaaccaccatctgcggacctcgaagtgcaagctggccaggtcgacgtgaagctgcccgagggacctgttccagaaggagcgagcctgaaggggcatttacccaaggtccagatgccgtctttcaaaatgcccaaagttgatttgaaaggccctcagattgacgttaagggccctaagctcgacctcaagggcccaaaagccgaggttaccgcaccggacgttaagatgagcctgtcctcgatggaagtcgacgtccaagctcccagggcaaagctagacggagtgcaacttgagggcgatctcagcctggctgataaggatgtcaccgcaaaggacagtaagttcaaaatgcccaaattcaagatgccgtctttcggagtgagcgctcctggcaaaagcatggaggcctccgttgatgtgagtgaactcaaggcaaaagctgacgtcagcctgccaagcatgcagggcgacctgaagaccactgacctgagtattcagtctccctcagccgatctagaagtgcaagcgggtcaggtcgatgtcaagctgcccgagggaccactgcccaagggtgcagggctgaagggacacctcccgaaggttcaaatgccatgtctcaagatgcctaaggtggcactgaaagggccacaagtcgacgtgaaaggcccaaagttggatctcaagggcccaaaagccgatgtcatgactcccgtagtggaggtatcccttccaagcatggaagtggatgtcgaagcgccaggggctaagttggacagcgtccggttggaaggtgacctgagtttggccgacaaagacatgacggctaaagactctaagttcaagatgcctaagttcaagatgccatcttttggagtctcagcacccggaaagtccatagaggcctccctggacgtgagcgccttgaaagtggaagcggatgtctccttaccttccatgcagggcgacttgaaaacaactcacctgtcgatccagcccccatctgcagatctagaggtacaggccggtcaagaagatgtaaaactacctgaaggaccagtgcacgagggggcaggcctcaagggccacctgcctaagttgcaaatgccttccttcaaagtccctaaggtggaccttaaggggcctcaaatagacgttaacgtcccgaagctggacctcaaggggcctaaagtggaggtcacaagtcctaatctcgatgtgagccttccttccatggaagtggatatacaggctcctggagcaaaactggattctacaaggctagaaggagatttatcgttagccgataaggacgtgacagcgaaagactccaaattcaagatgcccaagttcaaaatgccaagttttgggatgctcagtccaggcaagagtatcgaggttagcgtggatgtgtctgctccaaagatggaggccgacatgagtattccatcgatgcagggagatctgaagacgaccgatctgagaattcaggccccaagtgccgacctcgaagtccaggctggccaggtggacctcaaactccctgaaggccacatgccagaggttgctggattgaaaggccatctgcccaaggtagagatgcccagcttcaaaatgcctaaggtagatctcaagggccctcaggtggatgtcaagggccctaaactcgacctaaagggacccaaggcagaggttatggcacccgatgtggaggtcagtctgccctctgtggaaacagacgtgcaagcgccaggctccatgctcgacggtgcccgattggagggcgacctctctctggcccatgaagatgtggcaggcaaggattcgaagtttcagggtcccaaactaagcacgtccggctttgagtggtcgagtaagaaggtgagtatgagcagctccgaaatagaagggaatgtgacctttcatgaaaagaccagtacattcccaatagtggagagtgtggtccacgagggagatttgcacgatcctagccgagacggcaatctggggctagccgtgggcgaggtaggaatggactcaaaatttaagaaactgcattttaaggtccccaaggtgagcttttcctctactaagacacctaaagactcactagtccccggagcaaagtcttcaattggtctgagcacaatccccctgtcctcgtcagagtgctcaagtttcgagttgcagcaggtgtccgcctgctccgaaccaagtatgcagatgcctaaggtcgggttcgctggctttccttcatcgcgccttgatttgactggtccacatttcgagagcagcattctttcaccctgcgaggacgttacactaacaaaataccaggttaccgtgccgagggccgctctcgcacccgaactggcgttggaaattcctagcggatcccaggcagatatacctctgccgaaaaccgagtgcagcaccgaccttcagccacctgagggcgtacctacttcacaagcggagtcacattctggacctctgaattccatgataccagtctccctgggacaagtaagctttcctaagttttataagccgaaattcgtgttttccgttccgcagatggccgtcccagaaggcgatttacatgccgcagtcggggcaccagtgatgagccctttgagccccggagagcgcgtgcagtgtccactgcctagcacgcagctgccgtcccctgggacctgcgtgtctcaaggccctgaagagctcgtcgcgagtttgcaaacaagcgttgtggcacctggtgaggccccttcagaggatgccgaccatgagggtaagggctctcccctgaaaatgcccaagattaaactgccttcttttcgatggtccccgaaaaaggagaccggcccaaaggtggatcccgaatgctcagtcgaggactctaagctctccctggtgctggataaagatgaggtcgcccctcagtcagcgatccatatggacctgcctcctgagagggatggggaaaagggcagatcaactaagcctgggtttgcaatgcctaaactcgccctaccaaaaatgaaggcgtcgaagagcggcgtctcactcccacagagggacgtggacccctcactgagctctgcaaccgcgggtgggagctttcaagacactgagaaggcaagctctgatgggggtagagggggactcggcgctactgcgtcggcaacgggctctgaaggcgtgaacttacatcgacctcaagtgcatatcccctctctcggttttgccaagccagatctgaggagtagtaaagccaaagtagaggtgagccagccagaagccgaccttcctttacctaagcacgacctcagcaccgagggggacagccgcggttgtggcctgggtgatgtccctgttagccagccctgtggagaggggattgccccaactcccgaggaccccctccagccgagttgccggaagccggatgctgaggtcctgacggtagaatcgccagaggaggaggcaatgacaaagtacagccaagagagctggtttaaaatgccaaagtttcgtatgcctagtctgcgtagatcatttcgggaccggggtggcgctggcaagctggaagtagcacagactcaggccccagctgcaaccgggggtgaagccgcagctaaagttaaagaatttttggttagcggttccaatgtggaagctgctatgagcctccaactccctgaggcagacgccgaagtgaccgccagcgagtctaagagctctacggatattctgcggtgcgatctcgatagcacgggcttaaaactgcacttaagcacggccggaatgactggtgacgaactcagtaccagtgaagtacggattcatccctcgaagggccctctgccattccagatgccgggtatgagactccctgaaacacaagttctgcccggagagatcgatgagacaccacttagcaagccaggccatgatctggccagcatggaagataagacggaaaagtggagctctcaacctgaaggtcccctgaagctcaaggcttcgagtacagacatgccatcccaaatttccgttgtgaatgtggaccagctgtgggaggacagcgttctgacagtgaagtttcctaagctcatggtacccagattctccttccccgctccttcttccgaggatgatgtgtttattccaactgtacgggaagtacagtgtcccgaagctaatatcgacaccgccctctgcaaagagtctcctggactatggggtgcttccatcctgaaggccggagccggagtgccgggtgaacaaccagtggaccttaacctacccctggaagctcccccaataagtaaagtacgggtacatatacagggggctcaagtcgaaagccaagaagtcactatacactccattgttacacctgaatttgtcgatctgagcgtgccccgaactttttccactcagattgttcgcgaatctgagatccccacgtctgaaatccaaaccccctcttatggtttttcgctgctgaaggttaagatccctgagcctcacacgcaggcacgggtgtatactacaatgacccagcactctcggactcaagagggaaccgaagaagcaccgattcaggccactccaggggtcgacagcatcagcggcgacctccagccggacactggcgagccgtttgaaatgatctcttcctccgtgaatgtgttggggcagcagaccctcacctttgaggtcccatcaggacatcaattagccgacagctgcagcgatgaagaacctgccgagatcctagaattcccaccagacgactcacaagaagcaaccactcctctggccgatgaagggagggcccctaaggacaagcctgaatctaagaaaagcgggcttctgtggttctggctgcccaacatcgggttctcttccagcgtcgacgagacgggcgtagactcgaagaatgatgtgcagagatccgcccctattcagactcaaccagaagcccgaccggaggctgagttgcccaagaaacaggagaaagcaggctggtttcgcttcccaaaacttggtttctcctcttccccgaccaagaagtcaaagtccactgaggatggcgctgagttggaagagcagaaacttcaggaggagacgatcacattcttcgatgctcgcgagtcattttcccctgaagagaaagaggagggggaactgatcggacccgtgggaactgggctcgatagcagggttatggtgacctccgccgcaaggacagagcttatactgcctgaacaagatcgtaaggccgacgacgagtctaagggttcaggtttgggaccaaacgagggata

SEQ ID NO: 22391 - DNA, 237 bp, Artificial Sequence
  Description of Artificial Sequence: Synthetic coding sequence
atgggtcagggccagcaagcaatgtgccatgaagcactgagccacatttgggttccatttgatctcaaacgatggctgttgtacacattttgcaactggtttgacgtaacatttcagcttcagctctgtatcctccgaaccctaaagagattctgtcgatcaattctctataaccttaaggacagaaagacattctggctgcctcaggcatacctatcttttctgctcattcaatag

SEQ ID NO: 22392 - DNA, 579 bp, Artificial Sequence
  Description of Artificial Sequence: Synthetic coding sequence
atggcctgcggagcaactctgaagcgccctatggagttcgaggccgctcttctttctcctggaagcccaaagagacgaaggtgtgcccctctccccggaccaactcccggactgcgccctcccgatgccgagccgccaccaccctttcagacgcagactccgcctcagtcgctgcaacagcctgcaccccctggcagcgaacggaggctccccacacccgagcagatcttccaaaatatcaagcaagagtactctcgctaccagcgctggagacacctggaggttgtcttaaatcagtccgaagcttgcgccagcgaatctcagccccattccagcgctctcactgccccatcgagccccggttcctcctggatgaagaaggatcagcctacatttacattacggcaggtgggcatcatatgcgagcgccttcttaaagattacgaagataagattagggaggagtatgagcaaatactgaacacaaaattggctgaacaatacgagtctttcgtcaagttcacccatgaccagattatgcgcagatacggcacccgacccactagctatgtgtcttag

SEQ ID NO: 22393 - DNA, 444 bp, Artificial Sequence
  Description of Artificial Sequence: Synthetic coding sequence
atggcatgtggagccactctgaaaagaccaatggagttcgaagcggcactgctcagccccggttctcccaagcgtagacggtgtgcaccccttcctggccctacacccggactacggccaccggacgcagagcctcccccacctttccagactcaaactccacctcagtccctacagcagccggctccacctggttccgagcggaggctccctacacctgagcagatctttcagaacattaagcaagagtatagccgttatcagcgctggcgccacctggaagtggtgctcaatcagagcgaggcatgcgcttcagaatcacaaccacactcatctgcactgaccgccccttcgtctccagaacagtacgagtcatttgtgaagttcacacatgatcagattatgcggagatacggcacaagacccacctcctatgtgtcctag

SEQ ID NO: 22394 - DNA, 612 bp, Artificial Sequence
  Description of Artificial Sequence: Synthetic coding sequence
atggcatgtggggcaacgctgaaaagaaccctggattttgacccactgctgtcaccggcatccccaaagcgaaggagatgcgcacctctttccgcaccaacctcggctgctgcctcccccctgtcggccgctgccgcaaccgcagctagctttagtgcagcagccgcaagcccacagaagtacttgagaatggaaccctcaccatttggcgacgtgtccagcagactcaccactgagcaaatactgtacaatatcaagcaggaatataaaagaatgcaaaaacgtaggcatctcgaaacctcttttcagcaaacggacccatgttgcactagcgacgcgcagccgcacgccttcctgttgagcggacctgcctctcctggtacctctagtgcggcttcatctcccctgaaaaaggaacagcccctttttacccttagacaagtgggtatgatatgtgagcgcctcctcaaagagcgcgaagagaaggtgagagaagaatacgaggagattctgaacacgaaattggcagaacagtacgacgcctttgtcaaattcactcacgatcagatcatgagacggtatggtgagcaaccagcatcgtacgtcagctag

SEQ ID NO: 22395 - DNA, 5724 bp, Artificial Sequence
  Description of Artificial Sequence: Synthetic coding sequence
atggaagtcgcctggctggtatacgtgctgggacagcagccgctggctaggcagggtgaaggacagtcaaggctggtgccagggagagggttagtgctatggctgccaggcctgccgaggagttcaccgtcctggcccgcagtcgatttggctcccttggccccagccagacccaggggacctctgatttgccacactggccacgagcaggccggtcgcgagcccggtcctggctcctctaccaaaggacctgtcctccacgatcaggatactagatgtgcgtttctacccagaccaccagggccactacaaaccagacggtactgtcgacaccagggtcggcagggatctggtttaggtgctggcccaggcgcaggcacatgggcaccagccccacccggtgtgagcaagcctagatgcccaggaagggcacgtccaggcgagggacagcagcaggtaacaaccgcgagaccccctgccatcaacagaggggctcgccagccacgtgcaggagctgcagcagccggacgaggccctggggctggggcatggaggaccggagaagctgccgctagcgccggacccgctgtcggagagggcggtgcaatggggtctagaagagcaccgagccgtgggtggggtgctgggggacgctcaggggctggcggtgacggcgaagacgacgggccagtctggatccctagcccagcatctcgcagctacctcctcagtgtcagacctgaaaccagcttgagtagtaacagactatctcaccctagtagtggaagaagcactttctgttccattatagctcaactgaccgaggagactcaaccactctttgagacaacattaaaatccagatcagtatcagaggacagtgacgtaaggtttacttgcatcgtcacaggatacccggaaccggaagttacatggtataaggacgataccgagctcgaccggtactgtggactgccaaagtatgaaattacacaccaggggaacagacatacactacagttgtatcgctgtagggaggaagacgctgcaatctatcaagcctcagctcagaattcaaaaggcatcgtctcttgttcaggcgtgcttgaagtgggcactatgaccgagtacaaaatccaccagcggtggttcgctaagttgaaaagaaaggccgcagccaagttaagggagatcgaacaaagttggaagcatgagaaagccgtcccaggtgaggtggacacactgcgtaaactcagtcctgatcgtttccaacggaagaggaggctgtccggtgcccaagccccaggcccttctgtgccgactcgggagcctgaggggggtacactggccgcttggcaagagggcgagacggaaaccgcgcagcacagtggtttgggacttatcaattccttcgcgtcaggggaggtgactacgaatggcgaagctgctcctgagaatggcgaagatggagagcatggcctgctcacatacatttgtgatgccatggagttggggcctcagcgcgcactcaaggaagagagtggggctaaaaaaaaaaagaaagatgaagagtctaaacagggattgagaaagcctgaactcgagaaggctgcccaatctcgacgcagttcggaaaattgcatcccttcatccgacgaacctgactcttgcgggacccagggtcccgtgggtgtggagcaggtccaaactcaacctcgcggacgcgctgctagaggccctggctcttccgggacagattcgactcggaaacccgcatcagcagttggcacgccagacaaagcccaaaaggccccaggcccaggcccaggccaggaagtgtacttttctcttaaggacatgtacctcgaaaatactcaggcagtccgccctctcggagaggaaggccctcagactttgagtgtccgtgccccaggagaatctcctaagggcaaggccccattacgcgctaggtccgagggggtgcccggtgcaccaggacagccaacacacagcctcaccccccaacctactagaccattcaaccgaaaacgtttcgctcctcccaaacccaaaggggaggctacaacggatagcaagccaatcagctctctatctcaggcgccagagtgcggggctcagagtcttgggaaagcccctccccaggcctctgtacaggtcccaacgcctcccgctcgacgcagacatggcacaagggacagcaccctccagggtcaggcgggacatagaaccccaggggaagtgctagagtgtcaaaccaccaccgcgcctaccatgtcagcctccagttctagcgatgttgcatcgattggcgtatccacatctgggtctcagggaattatcgagcccatggacatggagacccaggaggatggcaggacaagtgcgaatcaaaggacaggctcaaaaaaaaacgtgcaagcggacggcaaaattcaggtggacggtaggacgcggggagacgggacccagaccgcacagcggactcgggcagaccggaaaactcaggtcgatgcgggaacacaggagtcaaagagacctcaatcagatcgttccgcccagaagggtatgatgacccaggggagggccgaaactcagttggaaactactcaggcgggagaaaagatccaggaagatcgcaaggcccaggccgacaaggggacccaggaggaccggaggatgcaaggggaaaaggggatgcaaggggagaaaggaacgcagtctgaggggtcagcccctacagcaatggaaggccaatctgaacaggaagttgcgactagcctcggccctccgtctagaactccaaaactcccccctaccgccggaccaagggcccctttgaacatcgagtgctttgtccagaccccagagggcagttgttttccaaaaaagcctgggtgtctgcctcgtagtgaggaggcggtggtgaccgcatcgcggaatcacgaacaaacggtactggggccactgtcaggtaacttaatgctgccagcccaacctccccatgaaggctcggttgaacaggtagggggagagcgttgccgtgggcctcagagcagtggccctgtcgaggcaaagcaggaagattccccatttcagtgccccaaggaggagcggcctggaggcgtaccatgtatggaccagggagggtgcccattggcagggctttctcaggaagtgcccaccatgcctagcctcccgggtactgggctcaccgcgagccctaaagcagggccatgttcaacaccaaccagtcagcacggctcaaccgccactttccttccatccgaagaccaggtgctcatgagctctgctcctacgttacacctggggctgggcactcccacccagagccaccctcctgagaccatggcaacgagttctgaaggggcatgtgctcaggtgcctgacgtggaaggcaggacgccaggccctcgttcttgcgatcctggtcttatcgatagcctgaagaactaccttttactgctgcttaagttatcaagtactgagactagcggtgccggaggtgaaagtcaggtcggggctgctacaggcggtctggtgccttctgccaccctgactcctaccgtagaagtagccggtctgagtccgagaacctccaggaggatcctggaacgcgtagaaaataatcacctggtgcagtctgctcagactctgctgctctcgccctgcacatccaggcgattgaccgggctacttgatcgagaagtccaagctggccgacaagctctggcggcagccaggggctcatggggcccaggaccttctagtctcacagtcccagctattgtggttgatgaagaggatcccggacttgcatctgaaggggcttccgaaggagagggagaagtctcgccggaaggcccagggctcctgggggcatcccaggaaagttcaatggctggcaggttgggcgaagccggaggccaggctgcacccggtcaggggcctagtgccgaatctatagcacaggaaccgtcacaagaggagaaattccctggcgaggcgctgactggtcttccggcagctactccggaggagctggccctgggagcgagacggaagcgctttttacccaaggtgcgcgctgcgggagacggggaggcaaccacaccggaagagcgcgaatccccaacggttagtcctcggggacctcgcaaaagcctcgtccctggaagcccagggacaccaggccgagaacgccgaagtcccacgcagggcaggaaagcttccatgttggaggttccgagggcagaggaagagttagctgctggagatcttgggccttctcccaaagcaggcggactggatactgaggtggccctggacgaaggaaagcaggagactctggctaagcccaggaaggcgaaggatctcctgaaggcaccacaggtgatacggaaaatccgggtggagcaatttcccgatgccagcggttccttaaaactgtggtgtcaattctttaatatcctgtcagattcagtgttgacatgggccaaggaccaaagacctgttggtgaggtaggacggagcgcaggagatgagggtcccgcagctttggccatcgtgcaggccagccccgtcgactgtggagtgtataggtgcactatacacaatgagcacggatccgcttccacagatttttgtctcagccctgaagttttgtcgggattcatctcaagagaggaaggcgaagtcggagaagaaatcgagatgacacccatggtattcgctaaagggcttgctgattcagggtgttggggtgataaactgttcgggcgtctggtctcagaggagttgcggggtggaggttatggctgtggactacggaaagcttctcaggcaaaggttatttatggcttagaaccaatcttcgagtcaggcagaacctgtattataaaagtcagttccttactggtctttgggccttcttctgagacaagcctggtaggcaggaactatgacgtaacgattcagggatgtaaaatacaaaacatgagccgggaatattgcaagatttttgcagcggaggccagggccgcacctggctttggggaagtaccagagattattccattatacctgatttatcggccagccaataacatcccgtatgctactctagaagaggatcttgggaagcccctggaatcatactgcagccgggagtggggatgcgccgaggcccctacagcctccggctctagtgaggccatgcaaaaatgccaaacattccagcattggctttaccagtggactaacggctcctttctggtgacagacttagccggtgtagattggaagatgacggacgtgcagatcgccacgaagctgcgtggctaccaggggcttaaggagtcctgtttcccagctctgctggaccggtttgctagcagccaccagtgtaacgcctattgcgaacttctcggattgacccctctgaagggacctgaggctgcacacccgcaagctaaggcaaaaggcagcaagtcgccctccgccggtaggaaaggaagccaattatctccacaacctcagaaaaagggactccctagcccccaggggactagaaaatcagccccatcatccaaggccacccctcaggcaagtgaacctgtgacaactcaattgctgggccagccacccactcaggaagaaggctctaaagcccaaggaatgagatac

SEQ ID NO: 22396 - DNA, 225 bp, Artificial Sequence
  Description of Artificial Sequence: Synthetic coding sequence
atggatagtgaggtccagagagatggcaggatattagatctgatcgacgatgcttggagggaagataagttaccttacgaggatgtcgccatccctcttaacgaactgccggaaccagagcaggataatgggggaactacagaaagcgtgaaggagcaggaaatgaagtggaccgacctcgccctgcagtacctgcacgagaacgtgcctccaataggaaattag

SEQ ID NO: 22397 - DNA, 225 bp, Artificial Sequence
  Description of Artificial Sequence: Synthetic coding sequence
atggacagcgaagtgcagcgcgacggacgcattcttgatctgattgacgatgcttggcgtgaggacaagctgccatatgaggacgtagctatcccgctcaatgagctgcctgaaccggaacaagataacgggggaaccaccgaaagcgtcaaagagcaagagatgaagtggactgatctggcgctccaataccttcacgaaaatgtgccccctatcgggaattag

SEQ ID NO: 22398 - DNA, 225 bp, Artificial Sequence
  Description of Artificial Sequence: Synthetic coding sequence
atggacagtgaggtgcagcgggacggacgcattctggacctcattgacgatgcttggcgagaggacaagctcccctatgaggatgttgcaataccccttaatgagctgcccgagccagagcaggacaacggcggtacgactgagtctgtgaaggaacaagaaatgaagtggacagacctggccctccaatatttgcacgagaacgtgcctcctatcggcaattag

SEQ ID NO: 22399 - DNA, 225 bp, Artificial Sequence
  Description of Artificial Sequence: Synthetic coding sequence
atggatagtgaggtgcagagagacggaagaatactcgacctcattgacgatgcatggagggaagacaaattaccttacgaagatgtggccattcccctcaacgaactgccagagcccgagcaggacaatgggggtaccacagagtctgttaaagagcaagagatgaagtggaccgacttagccttacagtatttgcatgagaacgttccccctattggtaactag

SEQ ID NO: 22400 - DNA, 1848 bp, Artificial Sequence
  Description of Artificial Sequence: Synthetic coding sequence
atgtgttctgaagcacgcctcgctaggagactgagagacgccctgagagaagaagaaccgtgggcggtggaagagctgctacgctgcggagcggacccgaaccttgtattggaagatggcgcagcagccgtacacctggccgcaggtgcccgacaccctcggggtctgagatgcctgggtgctttactgcgccagggtggcgatccaaacgctcgatctgtcgaggctcttacccctttacatgtggcagccgcttggggctgcaggcgaggcttagagctgttactgtctcagggagcagacccagctttgagggaccaggacggtctgaggccactcgatctggccctgcaacaaggtcaccttgagtgcgccagggtactgcaagacctagataccagaacgcgcacacgcactagaataggtgctgaaactcaggagcccgagcccgctcccggtacccccggtctctcaggcccaacagacgaaacactggactccatcgctctgcagaaacagccttgtagaggcgacaacagagatattggtttggaggccgacccagggccaccatccctgcccgtgccactggagactgtggataaacacggatcctccgccagcccccctggccactgggactactcatccgacgcatcgttcgtcacggccgttgaggtgtctggagcagaggatcctgcatctgacacccctccctgggctggctcactaccacccaccagacagggtctcctacatgtcgtgcacgccaatcagcgtgtgcctagaagtcagggtacggaggctgagctgaatgcacgcttgcaagcactgacactgactccccctaatgcagcgggatttcagagtagcccatctagcatgcccctgcttgaccggtcccctgcacattcacctcctagaactccaactccaggcgcaagcgactgtcactgtttgtgggaacatcagacttcaattgattccgacatggccaccctgtggttgacagaggatgaagcaagcagtactgggggtagagaacctgttggaccctgccgacacctcccagtgagcaccgtcagtgatttagaactgctcaagggcttgagggctctgggcgaaaatcctcaccctatcactcccttcacaaggcaactctaccaccagcagctggaagaggcacagatcgctcctggcccagagttttccggccactcccttgagcttgccgctgcccttcggacaggttgcattcccgatgtgcaggcggatgaggacgctctggcccaacaatttgagcagcccgaccccgcacgccgatggcgcgagggggtggtgaagagtagcttcacttatctgttgcttgacccccgagagacccaggatctgccagcccgagccttttctctcacgccagccgaaagattgcagaccttcatccgggctatattctatgtgggcaagggaactagggccagaccctatgtgcatctgtgggaagctctaggtcaccatggtaggagcaggaaacagccccatcaagcttgcccaaaggtaaggcagatcctggacatctgggcttcaggctgtggagtcgtatctcttcattgtttccagcacgtggtggctgtggaggcctataccagggaagcttgtattgtcgaggccctgggcattcagaccctaaccaaccagaagcagggtcattgctacggcgttgtagcgggttggccccctgcccgaaggaggagactgggcgtgcatctgctgcatcgcgctctgctggtgttcctggcggaaggagaacgacaactgcacccacaagatattcaggctcgcggatag

SEQ ID NO: 22401 - DNA, 1320 bp, Artificial Sequence
  Description of Artificial Sequence: Synthetic coding sequence
atgtggacccccgtacgtcgcggagccgcatggctgggaaccctgctcgggccaggcgagggtcctccagagccaagaggcggtgcggctcacgcccacaaaccgccagccggatctcgcaaaagcaccgatcaagctgttagatttggtccctcccagggtatgtgctcggaggcaaggcttgcccgacgcctgcgggacgctctccgggaagaggagccctgggcagtggaggaactgctgagatgtggggcagatcctaacctcgtgctcgaggacggcgcagcagccgtgcatcttgctgcaggggcacggcaccccagaggtctacggtgcctcggcgcactactccggcagggcggtgatcccaacgcgcgttctgtggaggctctcaccccccttcatgtggccgcagcatgggggtgtcgacgcggtctcgaactgctgcttagccagggcgctgatcccgcactgagggatcaggacggtctgcgaccactggaccttgcgttgcaacagggccatctcgaatgcgccagagtgctgcaggacctggacaccaggacgcggacgcgaaccagaattggagctgagactcaggagccagaaccagctccagggacacccggactgtccggtcctactgacgagactctagacagtattgcattgcaaaagcaaccctgccgcggtgataatcgggatatcggacttgaggccgatcccggtcctccaagcctgcccgtgcctctggaaacagtggataaacacggctcatcagcttcgcctccaggtcactgggattattcatcagatgcttcctttgtgacagccgtggaagtgagcggtgctgaagaccctgcctccgacactccaccttgggcagggtcattacctccaacacgccaggggctccttcacgtagtgcatgccaatcagcgagtcccccgaagtcaggggactgaagctgaattaaacgcaagacttcaagccctgacccttacaccaccaaatgctgcaggatttcaatcgtccccttcatcaatgccgctcctagacaggagcccggctcactctcctcccaggacacctactccaggcgcttccgactgtcactgcctgtgggagcaccagaccagcattgattccgacatggccacactctggttgaccgaagatgaagccagtagcaccgggggacgagaacccgttggtccttgtaggcacttgcccgttagcactgtgtctgacctggaattgctcaaaggtctcagggctctcggcagactccggacctgccagcccgaacccagccactag

SEQ ID NO: 22402 - DNA, 1821 bp, Artificial Sequence
  Description of Artificial Sequence: Synthetic coding sequence
atgtgctccgaggccaggctggcccgacgcttgcgcgacgcattgagagaggaggagccctgggccgtcgaagaactgttaagatgcggagctgaccctaaccttgttctggaggatggcgcagccgctgttcacttagccgcaggagcaagacacccgagaggcctgagatgtctgggagccctgcttaggcagggcggagatcccaatgcaaggagtgttgaggcactcacgcccctacatgtggcggctgcatgggggtgccgcagagggctggagctgcttctaagccagggcgctgacccagctttgcgggaccaagacgggctccggccactcgacttggccctccaacagggacacctggaatgtgccagggtgctgcaggaccttgacacaagaacaaggaccagaactcggattggagctgagacacaggagcccgaacccgctcctggaacaccgggtctctcaggccctaccgatgaaactctggactccattgctctccagaaacagccttgccggggagataaccgggacatcgggctggaggccgaccccggtccaccatcattgcccgtcccgttggagacagtggataagcacgggtcttctgctagtccacccggacactgggactactccagtgacgccagtttcgtcaccgccgtggaggtatcaggagccgaggacccggcatctgacacaccaccatgggcaggaagcttgccccctacccggcagggtttgctccatgtggtgcacgccaatcaaagggtaccccgttcccaggggactgaggccgaactaaacgcccgattgcaggcgctgactctgacccctcccaatgcagccggattccagagttccccttccagtatgcccctgctagatcgatctcccgcacactcgcctccacgcaccccgaccccaggagccagcgattgccactgcctctgggagcaccagacatcaattgattccgacatggccaccttatggcttaccgaggatgaagcctcctcaacagggggtcgcgagccggtcgggccttgcaggcacctgccagtgtccaccgtctcggacctggagctgctcaagggcctcagagccctaggacccgaatttagtggccattccctggagttggccgcagcgcttagaaccggctgtatcccagatgtgcaggccgacgaagacgccctcgcccagcagtttgaacaaccagaccccgctcggcgatggcgggaaggagtggtcaaatcttctttcacctatcttctgctggatcctcgagagacacaagatctgccagcacgcgcattttccctcactccagctgagagactgcagacatttataagggccatattttacgtggggaagggcactcgggcacggccatacgtacacctgtgggaagccctaggccaccacggccgaagtcggaaacaaggatcccggaggtccccaacccgaagcaagggtacggcaatggaatggtggcaagctggacatctacttgtggcaggagcctggggctgtacctgttgtacagttccatcactttcatcctggttgaaggcctccgatagcttcattcctcgcaccagcaggccaggggcagagtgttggggggtcggacaccctgcctggggagagatgttcgagtgcagttcatgcccgatgctcactgctgcaccaatctcaggctttcgtaggggggtgtgcgtgtgcgtgtgtgtgtgcgtatgtgtctgcgtgtgcgtctgcgtgtgtgtgtgcagagagcaccccggtcggtcccccccaggctag

SEQ ID NO: 22403 - DNA, 1848 bp, Artificial Sequence
  Description of Artificial Sequence: Synthetic coding sequence
atgtgctcggaagccaggctggcaagacggctcagggatgccctccgggaagaagagccttgggctgtggaggaactgcttaggtgtggggcagatcccaatctggtgctcgaggacggtgccgctgcagtccatctggccgcaggagcacgtcacccaaggggacttagatgcctcggtgctctccttcgacagggcggtgaccccaacgctcgcagcgtggaagctctcacaccactacacgtggcggctgcctggggctgccgcagaggcctagagctgctgctaagtcagggggctgaccccgcattgagagaccaggacgggttgcggccactcgatctggccctgcaacaaggacacttggaatgtgcaagagtcctgcaggatctggacacccgaacacggactcggactagaattggtgcagaaacacaggagcctgagccagcgccaggaacgccagggctgtctggtcccaccgatgaaacacttgactctatcgcgctgcagaaacagccttgcagaggggataatagagacataggactggaggcagacccgggacctccgtctctccccgttcccctggagacagttgacaagcacggatccagtgctagccctcccggacattgggattatagctctgatgcctctttcgtgacagcagtcgaagtgtcaggcgcagaagatcctgcttcagatactcctccctgggccggttcactgcccccaacacggcaagggctgctgcatgtggtccatgccaatcaacgagttcctagatctcaggggactgaagctgaattaaacgctcggctccaagccctgacattgaccccgcctaacgcagctggcttccagagttcaccatcatccatgcctttgttggaccggtctccagctcacagtccaccacgcactcctactcctggcgcttcagactgccactgtctgtgggaacatcaaacttccatcgattctgacatggccacgctgtggcttacggaggatgaagcttccagtacggggggtcgagagcccgttggcccttgccgacacctcccagtttctaccgtgtctgacctggagttgcttaaaggccttcgcgctcttggggagaacccccacccgataactccttttaccaggcaactttatcatcaacaactagaggaggcccaaattgccccaggaccggaattttccgggcacagccttgaactagcggcagcccttcgtacaggatgcattccagatgttcaagcagacgaggatgcccttgcccagcagtttgagcagcccgatccggctcggaggtggcgtgagggagttgttaagtcatcatttacgtatctgctactcgatccacgagaaactcaggacctgccagcaagggcgttttctctgacccctgcggagaggcttcaaacatttatccgcgctatcttctatgtgggaaaagggacccgcgctaggccatacgtgcacttgtgggaggccctgggccatcacgggaggtctagaaaacagccccatcaggcttgtccaaaagtacgtcagattctggacatctgggcctcaggatgcggcgtcgtcagcctccattgcttccagcatgtggtcgctgtcgaagcgtacacacgggaggcctgcatcgtggaggctctgggaattcagacactaacaaaccagaagcagggacactgttatggcgtggtcgcaggttggccacccgctcggaggcgaaggcttggggttcacctgttacaccgggcactgctcgtctttctcgcagaaggagagagacaactccacccccaggacattcaggccagaggatag

SEQ ID NO: 22404 - DNA, 720 bp, Artificial Sequence
  Description of Artificial Sequence: Synthetic coding sequence
atggagaaggaaaaaggaaacgacgatgggataccagaccaggaaaactcccttgacttttccgagcacttcaaccaactggagctcctggagacacatggccacctgatccctaccggaactcagtccctctgggtcggcaacagcgatgaagatgaggaacaggatgacaaaaatgaggaatggtatcgcctccaagagaaaaaaatggagaaagaccccagccggttacttctatgggctgccgaaaagaaccgcctgaccacagtcaggcgactcctgtccgaaaaggccacccatgtgaatacccgagacgaggacgaatacacccccctacacagggccgcatattcgggacacttggacatcgtccaggagctcatcgcacaaggggctgacgtgcatgccgttaccgtcgacgggtggacacctctgcacagcgcctgcaagtggaataatacacgagtggcctcattcctcctccagcatgacgcggacatcaacgcccagaccaaaggccttctgaccccactccatctggctgccggtaacagggatagcaaagataccttggaattactgttgatgaatagatacgtgaaacctggacttaaaaacaatcttgaggagacggcctttgacattgctcgacgaactagcatctatcactacctcttcgagatagtagaaggctgcacaaatagctcaccgcagagctag

SEQ ID NO: 22405 - DNA, 720 bp, Artificial Sequence
  Description of Artificial Sequence: Synthetic coding sequence
atggaaaaggaaaaaggaaacgacgatgggattccagatcaggagaattcgctggatttctccgagcacttcaaccaactggaactcctggagacccatggccatctgattccaacaggcacccagtccctttgggtggggaactccgatgaagacgaggagcaggatgacaagaatgaggaatggtaccggcttcaggaaaagaagatggaaaaggacccttcccggttgctcttgtgggctgcggagaagaatcggctaacaaccgtccgcagactactgagcgagaaggcaactcatgtcaacacacgtgatgaggacgagtatacccctctacacagagctgcctattctggccacctggatatagtgcaggaactcatcgcccagggggcagatgttcacgcagttacagtagatggatggacaccgcttcactccgcatgcaagtggaataatacccgcgtagcctccttccttctgcagcacgacgccgatatcaatgcgcagacaaaagggcttttgactccactccacctggcagccggaaaccgagattcaaaagataccctagaactcctgctcatgaacaggtacgtgaagccgggacttaagaataacctggaagagaccgctttcgacatagcacggcgaacctccatttaccactatctgttcgaaatcgtagagggttgcaccaattcctctcctcaatcctag

SEQ ID NO: 22406 - DNA, 4458 bp, Artificial Sequence
  Description of Artificial Sequence: Synthetic coding sequence
atggcggcacctgcacagccgaagaagattgtcgccccaacagtgtcccagattaacgcagagtttgttacacagcttgcgtgcaagtattgggcccctcacatcaagaaaaaaagcccattcgatatcaaggttatagaagatatatatgagaaagaaattgtcaagtctaggtttgccattaggaaaataatgttactcgagtttagtcaatatctggaaaattatttgtggatgaactacagtccggaggtgtcctcaaaggcctatctaatgtctatctgctgtatggtgaacgaaaagttcagggagaacgtgcccgcttgggagatatttaaaaagaagcccgaccactttcctttcttttttaaacacatcctgaaagcagcgctggctgagaccgacggtgagttttccctccacgagcagacagtactactgttgtttctagatcactgttttaatagtctggaggtggacctgatcaggagccaggtgcagcaattgatcagccttcccatgtggatgggtttacagctggctcggctcgaattggaactgaagaagacaccaaagctgcggaaattctggaatctgatcaagaaaaacgacgaaaagatggaccccgaagccagagaacaggcgtatcaggagcggaggtttctcagtcagctcattcaaaagttcatttctgtgctcaagtcagttccactgagtgaacctgtcacgatggataaagtccattattgtgaaagattcatcgaactgatgattgatttagaggccctgctccccaccagaaggtggttcaacacgattcttgatgattcccatctgcttgtgcattgctatctcagtaacttggttaggagagaagaggacggacatctttttagccagctgctggacatgctaaaattctataccggcttcgagatcaatgaccagaccggcaacgctctgacagagaatgaaatgactactattcattatgaccgcatcacgagcctgcagagggcagcctttgcccactttccggaactctatgactttgccctttccaatgtggcagaggttgatacgagagaatctctggttaaatttttcggacccctgagctccaacactctgcatcaagtagctagctacctctgtctattgccgacactcccgaaaaatgaagacactaccttcgataaggaattcttgctggagctgctggtgtcacgacatgaacggagaatctcccaaatccagcaattaaaccagatgcctttataccccactgaaaaaatcatctgggatgaaaacatagtgcccaccgagtattatagtggcgagggatgtctcgccttacctaagctcaacctgcaattcctgacgttgcacgactacttgcttcgcaattttaatctgtttagactggagtcaacttacgaaatccgacaagacattgaagactcagtgtctcgtatgaagccttggcagagcgagtacggtggcgtagtgtttggcggatgggctagaatggcccagcctatcgttgcattcacagtcgtggaagttgcaaaaccaaatataggcgaaaattggcccacccgagtccgagctgatgttactattaatctgaatgttcgggaccatattaaagatgagtgggagggtctgcgcaaacacgatgtgtgcttcctgatcactgtcagaccaaccaagccttatggcacaaaatttgaccgtaggagaccttttattgaacaggtaggcttagtatacgttcgtggttgcgaaatccagggcatgttggatgataaggggagagttattgaggacgggccagaaccacgccctaacctcaggggggagagccggactttccgggtgttcctggacccaaaccagtaccagcaggatatgactaacaccatccaaaatggggctgaggacgtgtatgaaacattcaacattattatgcgaaggaagcctaaggagaataatttcaaggccgtgctggaaactattcgcaacctcatgaacaccgactgcgtggtcccagattggctccacgacattatcctcggctacggggatccctccagtgcacactattctaagatgcccaaccagatagccaccctggacttcaacgataccttcctgtcaattgaacacctgaaggcctctttccctgggcataatgtcaaagtgacagtggaggacccagcactacaaataccccctttccggattacctttcctgtgagaagcggaaaagggaaaaagcgaaaagatgccgatgtagaggacgaggatactgaagaggccaaaacactgattgtggaaccgcatgtgatcccgaaccgcggaccgtacccttacaatcagcctaagcgcaacaccatccagtttacccacacccagatagaagctatacgagccggaatgcagcccggtctgactatggtggtcggaccccctgggaccggaaagaccgacgtggctgtccaaataatcagcaacatctaccacaatttccccgaacaaagaacgctcatcgtgacacacagcaatcaggcactcaaccagctctttgagaagattatggctttagacattgacgagcgccatctgcttcggttaggacatggggaagaagaactggaaactgagaaggacttctcacggtatggtcgggtgaattacgtcctagcacgtagaatcgagctgctggaagaggtgaagagacttcagaagtccctgggggtgcccggagatgctagctacacctgcgagaccgcgggatactttttcctgtaccaggtaatgagcagatgggaggaatatatttcaaaagtgaagaataaaggctctacactgcctgatgtgacagaagtgagcaccttctttcccttccacgaatattttgcaaacgccccacagccaatcttcaagggcagaagctacgaagaggacatggagattgctgagggctgcttccggcacatcaaaaaaatctttactcagctggaggagtttagagccagcgaattgctcagatcaggtctcgataggagcaagtatctacttgtgaaggaagctaaaataattgctatgacctgcacgcacgcagcattgaagaggcacgatctggttaagctcggtttcaagtatgacaatatattgatggaggaggctgcccaaatcctggaaattgaaacttttattccgctgcttctccaaaatccccaggatggctttagcaggctgaagcgatggatcatgatcggtgatcaccaccaactgcccccagtgatcaagaatatggcttttcagaaatatagcaacatggaacagtcgctgtttactcgttttgtgagagttggagttcctactgttgatctggatgcacagggtcgggcacgtgcaagcttgtgtaatctctacaactggcgatacaagaatctcgggaatcttccacatgtgcagctgctgccagaattttccacagcaaacgcgggtctgctctacgactttcagctgatcaacgtggaggattttcagggagtaggggagtctgagcccaatccatatttttaccagaatctcggtgaggcagagtacgtggttgcattgtttatgtacatgtgcctgctgggttaccccgctgataagatatctatcttaaccacttacaatggccagaagcacctgattcgagacatcatcaacaggcgatgcgggaataatcctctgattgggcgaccaaataaggtcaccacagtggaccggttccaggggcaacaaaacgattacattcttttgtccctggtgagaacccgagcagtgggccatcttcgggacgtccggagattagtggtcgccatgtcacgggctagactgggcctgtatatcttcgccagggtgtccctgtttcagaactgtttcgaactcacgcctgcatttagccagctgaccgctcgcccacttcacctgcatatcatccccaccgaacccttcccaacaacgcggaagaatggggagagacctagtcacgaggtgcagatcatcaaaaatatgccccagatggcaaattttgtgtataacatgtacatgcacctgattcagactacccatcactatcaccagacactgttgcagctgcctccagctatggtggaggagggagaagaggttcaaaatcaggagactgaactggagacagaggaagaggccatgaccgtacaagcagacatcatccccagccccactgatacctcgtgcagacaggagactcctgcattccagaccgacacgactccatccgaaacaggagccacttcaaccccggaggcaatccccgcactgagcgagacgacccccacggtagtgggcgcagttagcgccccagccgaggccaacaccccccaggatgcgacttctgcccctgaagagaccaagtag

SEQ ID NO: 22407 - DNA, 1083 bp, Artificial Sequence
  Description of Artificial Sequence: Synthetic coding sequence
atgcagatcatcagacattcggagcagacccttaagaccgctctgatatcaaagaaccccgtcttggtctcccagtacgaaaaactcaacgccggagagcagcgtctcatgaacgaggcctttcagccagcatctgacctatttggacctatcacactgcactcccctagcgattggatcacctcgcaccctgaggctccccaggacttcgagcagtttttctcggatccttaccgaaaaacgccatccccaaataaacggtccatttacatccagagtattggcagtcttggcaatacccggatcatttccgaagaatacattaaatggctgactggctattgtaaggcatatttttatggcctgcgggtgaaactgcttgaacccgttcctgtgtctgttaccagatgcagttttcgggtcaatgagaacacgcataacctgcagattcacgctggagatatcctgaagttcctgaaaaagaaaaagcccgaggacgcattttgtgtggtggggattaccatgatcgatctgtaccccagagattcctggaactttgttttcgggcaggcgagcttaactgacggcgtgggcatctttagcttcgctcgctacggcagcgatttctatagcatgcattacaaaggcaaagtgaaaaagctcaagaaaacgtcctcctctgattacagcatctttgacaactactacattccagagatcacctctgtgctgctgctgagatcctgtaaaacgctaacccacgagattgggcacatattcggcctgcgacactgccagtggctggcttgtctcatgcagggcagcaaccacctcgaggaggctgacagacgcccactcaacctgtgtccgatatgtctgcataagctccagtgcgctgtaggtttctccattgtggaaaggtataaagccttggtccgttggatagacgacgaatcaagcgacacaccgggagctacccccgagcactcccatgaagataacgggaaccttccaaagccagtcgaggcttttaaagaatggaaagagtggataatcaaatgcctggctgttcttcagaaatag

SEQ ID NO: 22408 - DNA, 2172 bp, Artificial Sequence
  Description of Artificial Sequence: Synthetic coding sequence
atggctgagtatacccggcttcataatgctctagctttgatcaggctgcgaaaccctcctgtcaatgccatttctaccactttgctgagggacatcaaggaggggttacagaaagctgtgattgaccacactattaaagcaatcgtaatttgtggagccgaaggaaagttcagcgctggcgctgacatcagagggttctctgccccacggacttttggtctgacactgggccacgtggtggacgaaatccagcggaatgagaagcccgtcgtggcggcaatccagggaatggcgtttggagggggtttggaactggctcttggttgtcattatcgcattgcacacgcagaagcgcaagtggggctgccagaggtgacgctcgggttgctgcctggcgctagaggcacccagcttctgcccagactcacaggagtgccagcagcactggacctaattacttcagggaggagaattctcgccgatgaagccctcaagcttggtatcctggataaggtcgttaacagcgatcctgtggaagaagccattaggttcgcccaacgcgtatctgatcaaccacttgagtccagacgcttgtgcaacaaacccattcagtctctgccaaatatggacagtattttctctgaggcactgcttaagatgcgcaggcagcacccgggttgcctggcgcaggaagcatgtgtgagggctgtgcaggctgcggtccagtacccttatgaggtaggcatcaaaaaagaggaggagcttttcctctatttacttcaatcaggacaagcacgcgctctgcagtacgcattctttgccgagcgcaaggcgaacaaatggtctacaccgtctggcgcatcctggaaaactgcttcagccaggcctgtgtcaagtgtgggcgtcgtgggattgggtactatgggaagggggatcgtgatttcctttgccagggcaagaatacccgtcatcgctgtggactccgacaagaaccagttggccacggcgaacaaaatgattaccagtgttctcgaaaaggaggccagcaaaatgcagcaaagcggccacccctggagcggtccgaagccacgactgaccagctcagtgaaggagctgggtggggtggacctggtgatcgaggcagtttttgaggaaatgagtctcaaaaaacaagtattcgccgaactctcggcggtctgtaaaccagaagccttcctgtgtactaacacctccgcgctggatgtggatgagattgcctcttctactgaccggccacatctggtgatcggcacccattttttcagtcctgcacacgtcatgaagttgctggaagtgattccatcgcagtacagctctcctacaacaattgctaccgtgatgaacctctcaaagaagatcaaaaagatcggtgtcgtggttggaaactgcttcggcttcgtaggtaacagaatgctgaacccctattataatcaggcctactttttgttagaagaaggttcaaagcccgaggaggtcgaccaagtgctggaggagtttggatttaagatgggcccattccgcgtgagcgatctcgccggactagacgttggctggaagtccagaaaagggcagggcctgaccggacccacactgctacctggaacccccgctcggaagcggggaaatagacggtactgtcctatcccggacgtgctttgcgaactaggtaggttcggccagaaaaccggcaagggctggtaccagtacgacaaacctctcggacgcattcacaagcctgatccatggctctcaaaattcctgagtcgataccggaaaacgcatcatattgagccacgcacaatttcgcaagacgaaattctggaacggtgtctatacagcctcatcaacgaggcttttagaatcttaggcgaggggatagccgcatccccagagcacattgatgttgtgtatctgcacgggtatggatggcctagacacaagggtggacccatgttctacgcctctaccgtggggctacccactgttcttgagaaactccagaaatactacagacagaaccccgacatccctcaactagagcctagcgattacctcaaaaaattagcctcccagggcaacccaccactgaaagagtggcaaagtctggcaggtagcccctcttctaagctgtag

SEQ ID NO: 22409 - DNA, 1875 bp, Artificial Sequence
  Description of Artificial Sequence: Synthetic coding sequence
atgactcaggccgagaaaggagatacggagaatggaaaggagaaagggggagagaaagaaaaggagcagcgaggggtcaagcggcctatagtgcctgcgcttgtgcctgaaagccttcaggagcagatccaaagcaattttatcatcgtcatccatccagggagcactactcttaggatcgggagggcaactgataccctcccggcaagcataccccacgtgattgccagaagacataagcagcagggacagcccctctacaaggacagctggctgttaagagaaggcttaaacaagccggagagtaacgagcagaggcagaacggtctgaaaatggtcgaccaggccatctggtccaagaagatgtctaacggaacgagaagaatccccgtgagtccagagcaggccaggtcctacaataagcaaatgcgaccagccattttggaccactgcagtggcaacaaatggacaaatacttctcatcatcccgagtatctcgttggcgaggaggcgctatacgttaaccctctggactgctacaacatccactggcccatccggcgtgggcagctaaatattcatcctggaccaggcggaagtctcaccgctgttctggctgacatcgaggtcatttggtctcacgcgatccaaaaatatctggagattccactgaaagatctcaaatactaccggtgcatccttcttatcccagatatctacaacaaacagcacgtgaaggaactggttaatatgatattaatgaaaatgggtttcagcgggatcgtagtgcaccaggaatcagtgtgtgccacctatggaagcggattgtcaagcacctgcatagttgatgttggcgaccaaaagacaagtgtgtgctgcgtcgaggatggtgtgtcacacagaaatactaggttatgcttggcatacgggggaagcgacgtcagcaggtgcttctattggctaatgcagagagccggtttcccataccgagaatgtcagctcacaaacaaaatggattgcctgctactgcagcatttgaaggagacattttgccacctggatcaggatatcagtggactgcaggatcatgaatttcagatccgccaccccgattccccagctttgctgtaccagtttaggttaggagacgaaaagctgcaagctcctatggccctgttttatcctgctaccttcgggattgtagggcagaaaatgaccacattgcagcaccggagccaaggcgatccagaagacccccatgacgagcactacctactagcaacccagagcaagcaggagcagagcgcaaaggcgacggcagatcgcaagtcagcttctaagccaatcggctttgaaggcgacctcagaggccagtcaagcgaccttcctgaaaggctgcattcccaggaagtggatcttggcagcgcccagggcgatggacttatggccggaaacgatagcgaagaagcgttgaccgccttgatgagccggaagacagctattagcttatttgaagggaaagctctaggattggataaagcaattctgcatagtatcgattgttgttcctccgatgacacgaaaaaaaagatgtacagcagtatccttgttgtcggagggggtttaatgttccacaaggcccaggaattcctacaacaccgaatcttaaacaagatgccacccagtttccggaggatcatcgagaatgtggatgttatcacaagaccaaaggacatggatcctcgtctcatagcctggaaagggggagccgttctcgcttgtttagacacgacccaggaattgtggatttaccagcgtgagtggcaacggttcggtgtgaggatgctgcgggaacgggcagcttttgtgtggtag

SEQ ID NO: 22410 - DNA, 2364 bp, Artificial Sequence
  Description of Artificial Sequence: Synthetic coding sequence
atggcagccactactgccaatcctgagatgacctcagacgtcccgtctttaggaccagccatcgcgagtggcaactctggacctgggatccagggaggaggggcaatcgtccagagagccataaagagaaggcccggattggacttcgatgatgacggggagggaaatagcaagtttttgcgatgtgacgacgatcagatgagcaacgataaagagagattcgcaagatcagatgatgagcagtcttccgccgacaaggagcgcttggccagagaaaaccactcagagatcgaacgacggaggaggaataagatgaccgcatacattacggaactgtccgatatggtgccaacatgctctgccctcgctcgcaaacccgataaattgactatcctgaggatggcagtttctcacatgaagagtcttcgaggcacgggcaacaccagtacagacgggagctataaaccatctttcctgactgatcaggaattgaagcacctcattctcgaggcagcagacggttttctattcattgtgtcatgcgagacaggacgcgtcgtatacgtcagcgatagcgtcacgcctgtgctcaaccagccccagtccgagtggttcggtagtaccctgtacgatcaagttcacccagacgacgttgataaactgagggagcagctttccacctcagagaacgcattaaccggccgtatactagatctgaaaacaggcactgtgaagaaggaagggcagcagagcagcatgcggatgtgtatgggcagtagacgctcattcatctgccgtatgaggtgtggaagtagcagcgttgacccggtctcagtgaatagactgtcttttgtcaggaaccgttgcagaaatggtctcggctcagtgaaggatggcgagccccactttgtggtggtgcactgtactgggtatatcaaggcttggccgcctgctggggtgtctctaccagacgatgaccctgaagctggccaggggagcaagttttgcttagtcgcaatcggcagactgcaagtaactagctcacctaactgtacagacatgtccaacgtgtgccagcccacggagtttatttcccggcataacattgaaggtatttttacgttcgtggatcataggtgtgtggccacagtaggctatcagcctcaggagctcctcgggaagaatatcgtggagttctgccacccggaggaccagcagctgctacgggatagttttcaacaggtggtaaagttaaaaggccaggtgctgtcagtcatgttcaggtttcgttcaaagaatcaggaatggttgtggatgagaacttcaagttttacatttcaaaacccatacagtgacgagatcgagtacattatttgcactaatactaacgtaaaaaattcttcccaagagccacgtcccactctaagcaacaccattcaaaggccccagcttgggccaactgctaacttgcccttagaaatgggctcaggacagttggctcccaggcagcagcagcagcagaccgagctggatatggtgcctggtcgcgacggcctggcttcatacaatcactctcaagtggtccagcccgtgactactactggtcccgagcattccaagcccctggagaagtcagatgggctgttcgcccaggatagagaccctaggttctctgaaatctatcacaacatcaatgcagatcaatccaagggtatttcttcctccactgtgcccgcaactcaacagctgttctcccaaggtaatacctttccccctacaccacgcccagccgaaaacttttcggggctggctccacccgtcaccattgtgcagcccagcgcatctgctggacagatgctggcccaaatcagtcgccatagcaatccaacacagggggctacgcctacctggacacctactaccagatccggcttctcagcccaacaggtggcaacacaggctaccgccaaaacaagaacgagccagttcggtgtcggaagctttcaaacaccctctagctttagtagtatgtcgctccccggagcgccaaccgcgagtcctggcgctgcagcctacccgagtctgacaaatcgaggcagtaattttgccccagaaactgggcaaaccgctggccaattccagacgcgcaccgctgaaggggtgggagtctggcctcagtggcagggccaacaacctcaccatcggtccagttcctcagaacaacatgtgcagcagccccctgcccaacagccgggacaacctgaggtgtttcaagagatgcttagtatgttgggggaccaaagcaattcttataacaatgaggaatttcccgacttaactatgttcccccctttttctgagtag

SEQ ID NO: 22411 - DNA, 2370 bp, Artificial Sequence
  Description of Artificial Sequence: Synthetic coding sequence
atggctgcgaccaccgctaatcctgagatgacgagcgacgtgcctagtcttgggccagccattgcctccgggaactcagggccaggaattcagggcggtggggctatcgttcagagagcaattaaacgaaggcctgggctggactttgacgatgacggagagggaaattccaagttcctaaggtgcgatgacgatcagatgtctaacgacaaagagcggttcgccaggagtgacgatgagcagagcagcgccgacaaggagaggctggctagggagaaccactccgaaatcgaaagaagaaggagaaacaaaatgaccgcctacattacagagctgtcagatatggtgcctacctgctcagccttggccaggaagcctgataaactcactattctccgcatggccgtctctcacatgaaaagtcttcgtggcaccggcaacacctccactgacggatcctataaaccttcctttctgaccgatcaagaactaaagcacctcatcctcgaagcagccgacggatttttgttcatcgtgtcatgtgagaccggcagggtagtgtacgtttccgactccgttactcccgtactgaaccaaccgcaaagcgagtggttcgggagtaccctgtatgatcaagtgcaccccgacgatgttgacaaactgagggagcagctcagcacctctgagaatgcacttaccgggaggattctggatcttaagaccggcactgtcaaaaaggaaggtcagcagagttccatgaggatgtgcatgggttctcggaggtcctttatttgtaggatgcgctgcgggagctcatcagtcgatcccgtgagcgtcaatcgtctgagcttcgttagaaatcgatgtcgtaatggcttgggtagcgtgaaggacggcgagccacatttcgtggtcgtgcattgtacaggatacattaaagcgtggccacctgctggtgtgtcactgcctgatgatgacccagaggccggacagggtagcaaattttgcctggtggccataggaaggctgcaggtgaccagttccccgaattgtacagatatgagtaacgtatgtcagcccacagagttcatcagtcgccacaacatcgaggggattttcacttttgttgaccatcgctgcgtagccactgtgggataccagcctcaggagctccttggcaaaaacatcgtggaattctgccatcccgaggatcagcagctgttgagggacagcttccagcaggtggtcaagctaaagggacaggtgttgtcagtcatgttccggttccgctccaaaaatcaggagtggctatggatgaggacatctagcttcacgttccagaatccatacagcgatgagattgagtacatcatttgtaccaacaccaacgttaaaaatagttcccaagaacctcggccaacgctctcaaacactatacagcggccacagctgggtccgactgcaaatctgcccctggaaatgggttccgggcagttagcccctcggcagcagcagcagcagaccgaacttgatatggttcccggacgtgacggtttagccagctacaatcactcccaggtggtacagcccgtgactactaccggtcctgagcatagtaagccactcgaaaaatccgatggactgttcgcacaggatagagaccctaggttcagtgagatctatcacaacatcaacgctgaccagtctaaagggatatctagctctaccgtgccagccacgcagcaattgttttcacagggaaacacgttcccacccacccctcgaccagccgagaatttccggaactccggattagcaccaccagttactatagtgcaacctagcgcctccgcaggtcaaatgttagcccagattagtagacattccaaccccacgcagggagccacacctacctggactcccactactagatctggctttagcgcacagcaggtcgctactcaggccactgcaaaaacaaggacttctcagttcggcgttggttctttccagacaccatcctcgttctcaagcatgtctctgcccggagcccctaccgcgagccccggtgcagccgcatacccatccctgaccaacagagggtccaatttcgctcccgaaactgggcaaacagccggacagttccagacgcgcacagccgagggagtcggcgtgtggccacagtggcaaggccagcagccacaccatcgttccagcagcagcgagcagcacgtgcagcagcctccagctcagcagcccggacagcctgaggtgttccaggagatgctcagtatgctcggggaccagtccaattcctacaataatgaagaattccccgacctcacaatgtttccgccttttagcgagtag

SEQ ID NO: 22412 - DNA, 1767 bp, Artificial Sequence
  Description of Artificial Sequence: Synthetic coding sequence
atggccgcagaagaggaggctgccgctggcggaaaggtgctgcgagaagagaaccaatgtattgcccctgtcgtgtctagccgggtcagcccgggtacccgaccaaccgctatggggtctttcagttcacatatgaccgagtttccgagaaagagaaaaggaagcgacagtgacccttcccaagaagcacacagccagactgaaaagagacgtcgggacaagatgaacaacctgatagaggagctctctgcaatgattccccagtgcaatcccatggcacggaagttggacaagctaacagtattaaggatggccgtacagcacctccgctcactgaaaggactcacaaatagttatgtgggatccaattaccgcccttcatttctgcaggacaacgagctacggcacctgatactgaaaactgccgagggcttcctgttcgttgtcggttgcgaaagaggcaaaatcctgtttgtaagcaaatcagtctccaagatactaaactacgatcaggcatcactaaccggccagtccctcttcgacttcctgcacccaaaggatgtcgccaaagtgaaggagcagttaagttctttcgacatcagtccccgagagaaactaatcgatgccaagacaggtctccaggtgcattcaaacctacatgccggaagaacccgcgtgtatagtggcagtcggaggagcttcttttgcaggatcaagtcctgtaaaatctctgtaaaagaggaacatggatgccttccgaactctaagaagaaggaacaccgcaaattttataccatccattgcaccgggtatctgcgctcttggcctcccaacatcgtcggtatggaagaggagagaaactcaaaaaaggacaatagtaactttacctgcctggtggccatcggtcgcctgcagccatatattgtgccacagaattctggtgaaattaatgtgaagccaacagagttcataacaagatttgcagttaatgggaagtttgtgtatgttgaccagcgagcaacagccatcctgggatacctaccacaggaacttctgggcacctcctgctacgagtacttccaccaagacgatcataataatctgacagataaacacaaagctgtactccagagtaaggaaaagatactgaccgattcctacaagttccgtgccaaggatgggagttttgtcactctgaagagtcagtggttcagcttcactaatccctggactaaggagttggagtacatcgtgtctgtcaataccctggtgcttggccactccgaacccggtgaagcttccttcctcccctgttcttcacaatcctcagaggaatcctctcgacagtcctgtatgtccgtgccaggaatgtccaccggcaccgtcctcggagccggaagcattggcaccgacattgccaatgagattctggatcttcaaaggctgcagtcttcatcctatttggacgattcaagtcccacaggactgatgaaggatacccatacggtcaattgccggtcgatgtcgaataaggaactcttcccaccttccccgtctgagatgggcgaactggaggctacgcgtcagaaccagtccaccgtcgctgtccattcccatgagcctctgttgtctgacggagcacagctggattttgatgctctgtgtgacaacgatgacaccgctatggctgcttttatgaactatcttgaggcggaggggggactgggggatccaggggacttctccgacattcagtggaccctgtag

SEQ ID NO: 22413 - DNA, 1911 bp, Artificial Sequence
  Description of Artificial Sequence: Synthetic coding sequence
atggccgctgaggaagaagcagctgccggtggcaaggtgctgagggaagagaatcagtgcatagcacccgtggtcagttcgcgggtgtcgccagggactcgcccaaccgccatgggttctttctcaagccacatgactgaatttcctcgcaagaggaaaggctctgattctgaccccagccagtctgggatcatgacagagaaagttgtggagaaactgagccagaatcctctaacctacctcttaagcaccaggattgaaatttcagcgagctccgggtcacgcgtcgaggatggagaacaccaggtaaagatgaaggcattcagagaggcccactcccaaactgaaaagaggcggagggacaagatgaataatttgatcgaggagctgtccgctatgatccctcaatgcaaccctatggctcggaaactggataagctgacagtgctacggatggcagtgcagcacctgcgatctctcaagggcttaactaattcatatgtggggagcaactaccgcccaagctttctgcaagacaacgagttgcggcacctcatcctcaagacggctgagggatttcttttcgtggtcggctgtgaacgtggcaaaatactcttcgtatcaaagagcgtttcaaagatcttgaattacgaccaggcctccctgaccgggcagtcactctttgatttcctccaccctaaggacgtggctaaggtcaaggaacagttgagttcctttgacatcagcccacgggaaaagctgatagatgccaagaccggattgcaagtgcattctaacctacacgctggacgcacgagggtctactctggcagtcgacgttccttcttttgtcggattaagtcctgcaaaatttcagtaaaggaggaacacgggtgtctgccgaatagtaaaaagaaggagcacaggaagttctacaccatccattgcaccggatatctgcgatcatggcctcccaacatagtgggcatggaagaagagagaaacagcaagaaggacaattctaactttacctgcctcgtggccatcggtaggcttcagccctacattgtgccgcagaactccggtgagatcaacgtcaagccgacggaattcatcaccaggttcgctgtgaacggcaagttcgtttacgtggaccagagggctaccgcaatcctcggatacctccctcaggagctgctcgggacctcctgctacgagtactttcatcaagatgaccacaacaacttgaccgacaaacacaaggcagtgctccaatctaaggagaagatcctgaccgattcatacaaatttagggcaaaagatggctcttttgtcaccctaaaaagccagtggttttcctttacaaacccatggacaaaagagttggaatacatcgtatctgttaatactctcgtcctgggacattccgaacccggagaggcgtcctttctcccctgcagctctcagtcaagcgaagagagcagcagacagtcctgtatgagtgtgccaggcatgtccacaggcactgttttaggcgctggaagcattgggacagatatcgccaatgagattctagatctgcagcgattacaatcaagctcatacctggacgacagctctcccaccggcctcatgaaggacacccacacggtgaattgcaggtccatgagcaacaaggagctcttccctccctcacctagtgaaatgggagagcttgaagctacgcgtcaaaatcagtccactgtggctgtgcattctcatgaaccccttctcagtgatggcgcacagctggacttcgatgcgctgtgcgacaacgacgatacagccatggcggcatttatgaattacctggaggccgaggggggtctgggggacccaggagacttctcggacatccagtggaccctatag

SEQ ID NO: 22414 - DNA, 1869 bp, Artificial Sequence
  Description of Artificial Sequence: Synthetic coding sequence
atggctgccgaagaagaggcggcagcaggtggaaaggtcctccgagaagaaaaccagtgcatagcacctgtcgtgagctcaagagtgtcaccaggcacacgcccaaccgcaatgggctctttctcctcccatatgaccgagttccctcgtaaacgaaaggggtcagattcagatccgagtcaaagtggcataatgacagaaaaggtggttgagaagttgagccaaaaccctctgacttacctcctctcgacgcgcattgaaatcagtgctagctcagggagccgggaggctcactcccaaactgagaagcgcaggagggataaaatgaataacttgattgaagagttgtcagctatgatcccacagtgtaatccaatggccaggaaactagacaaactgacagtcttaagaatggcagtacagcaccttagatcgctcaaagggttgacgaattcctatgtgggatccaactacagaccgtctttcctacaagacaacgaactccggcacttgatcttaaagacagcagaggggttcttgttcgttgtggggtgtgagagaggcaaaatactgtttgtttcgaagtcagtgtccaaaattctcaactacgatcaggccagcctcacaggtcagtccctcttcgacttcctgcacccaaaagacgtcgctaaggtgaaggagcagctgtcctctttcgatatcagccccagggagaagctcatagatgccaaaaccgggcttcaagtacacagcaacctgcatgctggtcgcacgagggtgtactcgggttctcgaaggtcttttttctgccggattaaatcttgcaaaatctctgtcaaggaagagcatgggtgtctgcccaactccaaaaagaaggagcatcgtaaattctacacaattcattgtactggttacttaagaagttggcccccaaacatcgtagggatggaagaagaacgaaattccaaaaaagacaattctaacttcacctgtcttgtggccatagggagactgcagccttatatagtgccccagaatagtggcgagatcaacgtcaaacccactgaatttatcacacgcttcgccgtgaacggcaagttcgtgtacgtggatcagagagcgacggccatcctcggttatctgccccaggaactcttgggtacaagttgctatgaatatttccaccaggatgatcacaataatctgactgacaaacataaagctgtcttacagagtaaggagaagattctcaccgacagctataagttccgagcaaaagacggttcattcgtaactttgaagtcccagtggttctcatttaccaatccttggactaaagaacttgaatacatcgtgtcggtgaataccctggtgctgggccacagtgaacccggtgaagcaagctttctgccttgttctagtcagagctccgaggaatcctcccgccaatcttgcatgtcagtgcctggcatgagcaccggcacagtcctgggggcagggtctatcgggaccgacatcgcaaacgaaatactggatctgcaacgtctgcagtcgtcgtcatatctggacgacagcagtcctaccggcctgatgaaggacacccataccgtgaattgtcggagtatgtcaaacaaggagctctttccgccttccccgagtgaaatgggagagcttgaggcgacccgacagaatcagagcacggtggccgtccattctcatgaaccccttctgagcgacggcgctcagcttgacttcgatgcgctatgtgataatgacgacactgcaatggccgcttttatgaattacctggaggccgaagggggtcttggtgacccaggagacttcagtgacattcagtggaccctgtag

SEQ ID NO: 22415 - DNA, 1800 bp, Artificial Sequence
  Description of Artificial Sequence: Synthetic coding sequence
atggctgccgaggaagaagccgctgccggtggcgaggtcgccggaggggaggccaccgcacctggtaaggtattgagggaggaaaatcaatgtatagcacccgttgtgtcgagcagggtcagcccaggcactagaccaaccgcaatgggttcctttagttcgcacatgacagagtttccgagaaaacgcaagggatccgacagcgatcccagccaggaggcccatagccagacagagaagcggcgacgcgataagatgaataacttgattgaagaactcagtgccatgataccccagtgtaatcctatggcgaggaagcttgacaaactgacagtattacgcatggctgtccaacacttgcgctctcttaaaggtctcaccaatagttatgtgggctccaactacaggccttccttcttgcaagacaacgaattacgtcaccttattcttaaaaccgcagagggcttcctttttgtggtgggatgtgaacgcggtaaaattcttttcgtgtccaaatctgtgtcaaaaattcttaactacgaccaagcgtcattaactggccagagtctatttgactttctccacccgaaggacgtcgcaaaggtcaaagagcagctctcttctttcgacattagccctagagagaaactgatcgacgccaagaccggactccaggtgcacagcaaccttcacgctggccgaacccgtgtttattcaggctctaggcgctctttcttttgtcggattaagagttgcaaaatttccgtgaaagaggagcacggctgccttcctaactctaagaagaaagagcatcgcaaattctacaccatacactgcactgggtacctgcggtcgtggccgccaaacatcgtgggcatggaggaagaaagaaactcgaaaaaggacaacagcaacttcacatgcctggttgctatcggaagacttcagccttacattgtgccacagaattccggtgagataaacgtcaagcctacagagtttattacaagattcgccgtcaatggcaagttcgtatacgtcgaccagcgggctaccgccattctgggttatttgccacaggaactgctcgggactagctgttatgagtatttccaccaagatgaccacaacaatctgacggacaaacacaaagccgtcctgcagtctaaagagaagatactcactgatagctacaagttccgggcaaaagatggctcatttgtgacacttaaaagccagtggttttctttcaccaacccctggacaaaggagttggagtacattgtcagtgttaacacactcgttcttgggcatagcgagcccggtgaagcttcctttcttccgtgctcatcccagtcaagcgaagagagcagtaggcagagctgcatgagcgttcctggcatgagcactggaacagtactgggagctggatctattggaacagacattgccaacgaaatcctcgacctgcagcgtctgcagtcatcatcttacctagacgactcctcacccactgggttgatgaaagatacacatactgtgaattgccggtcaatgtctaataaggagttattccctccgagcccaagcgagatgggcgaactcgaagccacgcgacagaaccagtccaccgtcgcggtgcactcccatgagccccttctcagtgacggtgcccagctcgacttcgatgccctgtgcgacaatgacgataccgccatggcggcttttatgaactatctggaggccgagggaggcctaggcgatcccggagactttagcgacattcagtggaccttgtag

SEQ ID NO: 22416 - DNA, 1656 bp, Artificial Sequence
  Description of Artificial Sequence: Synthetic coding sequence
atggggtcgttttcgtcacacatgaccgagttcccccgtaagcgcaaagggtccgatagtgacccaagccaggaggctcacagtcagacagaaaaacggcgacgcgataagatgaacaatcttattgaagagttgtccgctatgatcccacagtgcaacccaatggcacgtaagctcgataagctcaccgtactcagaatggcagtgcagcaccttcgttctcttaagggcctcaccaactcatacgtcggcagcaactaccggccatcatttctgcaggacaacgagcttcgtcatttgatcctgaagaccgccgagggattcctctttgtggtgggctgcgagcggggtaaaatcctcttcgtaagcaaatccgtgagtaaaatcttaaactatgaccaggctagcttgaccgggcagagtctgttcgactttctgcacccaaaagacgttgccaaggttaaggagcagctctccagctttgatatcagtcctcgcgagaagttaatcgatgcaaagactggcctacaggtccactcaaacttacatgcaggcaggacaagggtctatagcggctcccgcaggtccttcttttgccgcataaaatcttgcaaaatcagtgtgaaggaagagcatggttgtctgcctaatagtaaaaaaaaggagcaccggaaattttatacaatccactgcacgggctacttgagaagttggcctcctaatatagtcgggatggaagaggaaaggaattcgaagaaggataattcgaactttacctgcttggttgctattggcaggttgcagccttatattgtgcctcagaatagtggtgagattaacgttaaaccaacagagttcatcaccaggttcgccgtaaacggaaagtttgtctatgtagatcaacgagcaaccgctatcctaggctacctgcctcaagaactcctgggtacatcttgctacgagtactttcatcaggacgaccataacaacctcacagataagcacaaggccgtgctgcaaagcaaggagaagattctgacagactcatacaagttccgagcgaaagacggatcttttgttacgctaaagtcccagtggttctccttcactaatccatggaccaaggagttggagtacatagtgagtgttaacacgctggtgctgggccatagtgagccaggggaagcgagtttcttgccctgctcgtcacagtcttccgaggagagctcccggcagagttgcatgagcgtgcccggtatgagcaccgggacagtcctcggcgctggcagcattgggaccgatatcgcgaatgagatactggatctccagagactgcagagctctagttatttagatgattcctctccaactggcctcatgaaggatacgcacacggtgaattgtcggtccatgagcaacaaagaactgttccccccatccccaagcgaaatgggagaacttgaggccactcggcagaaccaaagcaccgttgcagtgcacagtcatgagcccttgctgagcgatggagcccagctggatttcgatgctctgtgcgacaatgatgacaccgccatggcagcattcatgaattaccttgaggccgaaggcggtcttggtgatccaggcgacttcagcgacattcagtggacgttgtag

SEQ ID NO: 22417 - DNA, 1809 bp, Artificial Sequence
  Description of Artificial Sequence: Synthetic coding sequence
atggctgccgaagaagaggctgcggcaggtgggaaggttcttcgcgaagaaaaccaatgcatcgcgccagtcgtgtcttctcgcgtcagcccaggaacccgcccaaccgcaatgggatccttttccagccatatgaccgaatttccacggaagcgaaaaggtagcgacagcgacccatcgcaggtggaagacggggagcatcaggtgaaaatgaaagccttccgggaggcacactcacagaccgaaaaacggaggcgcgataaaatgaataatctgatcgaggagctgtcagccatgataccccagtgtaacccgatggccaggaagctggacaaactcacggtcctgcggatggcagtccagcatcttaggtctctgaagggtctaactaattcgtacgtgggcagcaactatcggccttcctttctgcaagacaacgaacttcggcacctgattctgaaaacagccgaggggttcttattcgtggtgggctgcgaacgcggaaagatactgttcgtgagtaagtccgtctccaaaattctgaactatgaccaagcctccttgacagggcagtctttgtttgacttcttgcaccccaaagatgtcgccaaagtgaaggaacagctctcgtcatttgacatatccccgagggagaaactgatcgacgctaagaccgggttgcaggttcacagtaacttgcatgcgggtaggacacgtgtgtacagtggctcccgtagaagcttcttttgccgcataaagtcctgtaagatatcggtgaaagaggaacacggctgtctgcccaactctaagaagaaagagcaccgtaaattctatacaatccattgcacgggatacttaagatcatggcctccaaatattgtgggcatggaggaagagaggaattctaagaaagacaactctaattttacctgcttagttgccatcggcaggttgcagccttatatcgtgccccaaaatagcggcgaaatcaatgtcaaacccaccgagtttattaccaggtttgccgtgaacggcaaattcgtgtatgtggatcagagagcaaccgccattctgggctacctgccccaggagttgctgggtacatcatgctacgagtactttcaccaggacgatcataataatctgactgacaagcacaaagctgtcttacagtcaaaggaaaagattctgactgatagctacaagtttcgagcaaaagacgggtccttcgtgaccttaaagagccaatggttcagctttacaaacccttggaccaaggagctggagtacatcgtgtctgtcaacacattagtattaggccactctgaacctggcgaggcatcatttctgccctgctcatctcaatccagtgaagagtcaagtagacagagctgtatgagcgtaccgggaatgtcaaccgggactgtccttggagccggttcaatcggtacagatattgccaacgaaatcctggacctccagcgactgcaaagcagcagttatcttgatgattccagcccaacgggactgatgaaggacacccatacagttaactgtcgctctatgtctaacaaagagttatttcccccttcccccagcgagatgggcgaactggaagccacacgtcagaaccagagcacagtagctgtccattcccatgagcctcttctctccgacggtgctcagctcgattttgatgctctctgcgacaatgatgatactgctatggctgctttcatgaattatctggaggcagagggcggattaggagaccctggggattttagcgacatacagtggacactgtag

SEQ ID NO: 22418 - DNA, 6857 bp, Artificial Sequence
  Description of Artificial Sequence: Synthetic coding sequence
atggcggctcaggtggcccctgccgcagcttctagcttgggcaatccgccaccgccacctcccagcgagcttaaaaaagcggaacagcagcagcgagaagaagcgggaggtgaggccgcagcagcagcagctgccgagcgcggagaaatgaaggctgcagcagggcaggaatccgaaggccctgcggtgggcccaccacaaccgctcggaaaagagttgcaagatggggcagagtctaatggagggggaggcggagggggagctggcagcggtggcggacctggagctgagcccgaccttaaaaactctaacgggaacgccggtccgaggccagccctcaacaataatctgaccgagcctccaggcggtgggggtggtggttcttcagacggtgtgggggcaccgcctcattctgccgctgccgctttgcccccacctgcctacggctttgggcaaccatacggtcggtcacccagtgctgtggcagcagccgcagccgcagtgttccaccagcagcatggaggtcagcagtctcctggactggctgctttacagtccggcggagggggtgggttggagccatacgccggacctcagcagaacagtcatgaccatgggttccctaaccatcagtataatagctattaccccaataggtccgcctacccccctcccgctccagcttatgctctgtccagccccagaggagggacccctgggtctggggcagctgccgcagctggatctaaaccgccaccatcctctagtgcctccgcatcctccagtagcagttcatttgctcagcagcgcttcggagccatgggtggtggcggacctagcgcagccggaggcggtacacctcagcccacggccactccaacgctgaatcagcttcttacatctccatcgagtgccagaggctatcagggataccctggcggagattacagcggaggtccacaagatggtggagccggaaaggggccagccgacatggccagccagtgctggggagcggcagcggcagctgcagctgccgctgcagcatcaggtggggcacagcagagatcccaccatgcccctatgtcacccggatcatctggcggagggggacagcccctggcacgaactccgcagcctagtagccccatggaccaaatgggaaagatgaggcctcagccgtacgggggaactaacccatacagccagcaacagggccctcccagcggtccccagcagggccatggttaccctggtcagccttacggctcacagaccccccagcggtaccccatgactatgcaagggcgtgcacagagtgccatgggcggtctctcctacactcagcagatcccaccttatggacagcagggaccttctggctacgggcagcaaggccagactccatattataaccagcagagtccgcatccacagcaacagcagcccccttattcacagcagcccccttcccagactccccatgcccagccaagctatcaacagcagccgcagtcccagcctcctcagttgcagagcagccagcctccttacagccagcagcccagccagccaccccaccagcaatcacctgcaccctatccgtcccaacagtcaaccactcagcagcatcctcagagccaaccgccttactctcagccacaggcccagagcccctatcagcagcagcagccccagcagccagctccaagtactctgagtcagcaagccgcttaccctcagccacagagccagcagtctcagcagaccgcgtatagtcagcaacggttccctccccctcaagagctgagccaggactcatttggctcgcaggctagctcagccccatccatgacatcctcgaagggagggcaggaggacatgaatctctcccttcagtcccggccatcctcgcttcctgacctgtctggcagcattgatgatctgccaatgggcacagaaggtgccttgtcacctggagtgagcactagcggcatctcctccagtcaaggagagcaatctaaccccgcacagtcccccttttcacctcacacatccccccatctgcccggaattagaggcccaagcccctcaccagtcggttctcctgcatccgtcgcccaaagccggtctggaccactgagccctgccgctgttccaggaaatcagatgcctcccaggcctcccagcggccagtccgatagcatcatgcacccctccatgaaccagtcctctattgcacaggatagaggctatatgcaaaggaatcctcagatgcctcagtacagctccccgcagcccggatccgcactttcaccgcgtcaaccctccgggggtcagatccacactggaatgggcagctatcaacagaattcaatgggctcttatggccctcaaggagggcagtacggccctcaaggaggctatcctcgccagcccaactataatgccttgcccaacgctaactatccctctgcagggatggccggagggatcaatcctatgggagctggcggacaaatgcatggtcaacccggtattccgccttacgggaccttgccccctggtcgtatgtcccacgccagtatggggaacagaccttatggacctaacatggccaatatgcctccacaggtgggttccggtatgtgccctcccccaggcggaatgaaccgcaaaacccaggagactgccgtcgcaatgcatgtggccgcaaattccatacagaatagacccccaggctatcccaacatgaaccaggggggaatgatgggcactggcccaccgtacggtcagggcatcaactcaatggctggcatgatcaacccacagggacctccttactctatgggtggaaccatggccaataatagcgccggaatggctgcgtcacctgagatgatgggactgggggatgtcaagctcacacctgcgactaaaatgaacaataaggccgatggtaccccaaaaaccgagtcaaaatctaaaaaatcctccagtagtaccacaacaaacgagaaaatcaccaaactgtatgaactagggggtgaacccgagaggaagatgtgggtggaccgatatcttgcatttacagaggaaaaggcaatgggtatgactaatctgcccgcagtaggacgcaaaccgctggatctgtatcgcctctatgtgtccgttaaggaaataggaggactgactcaggtaaacaagaataagaaatggcgagaactagccacaaatctgaacgtggggacatccagtagcgccgctagctctctcaaaaagcaatatatacaatgtttgtatgcgttcgagtgtaaaatcgagagaggcgaggaccctccgcctgatatatttgctgctgctgacagcaaaaaatcccagcccaaaatccagcctccttctcccgcagggagcggctctatgcagggaccccagacccctcaatctacctcctcctccatggctgagggtggtgacttgaaaccccctacaccagctagcactccacattcccagatccccccactccctggaatgagtaggtcaaatagcgtcggcattcaggatgccttcaacgatgggtctgatagtaccttccagaaaagaaacagcatgacacctaaccctggataccagccctcaatgaatacatcagacatgatgggtcgaatgtcatatgagccaaacaaggatccttacggatctatgcggaaggcacctggttccgatcctttcatgtcctcggggcagggccctaatggaggcatgggtgacccttacagccgagccgcaggaccagggctgggcaacgtggcaatgggacccagacagcattatccgtacggcggtccctatgatagggtgaggactgagcccggaattggaccagaaggaaacatgtcaacgggggcaccccagcccaatctaatgccttccaatcctgactccggcatgtactcaccatcccgatatccacctcaacagcaacagcaacagcaacaaagacacgactcctacgggaatcagttttccacacagggcactccatccggctctccgtttccctcccagcagacaacaatgtatcagcaacagcagcagaattacaagaggcctatggatggcacgtacggccctccagccaaacgtcatgaaggtgagatgtattctgttccttactctactggtcaaggtcaaccacagcagcagcagctgccccctgcccaaccccagcctgcaagccaacagcaagccgcacaaccaagtccgcagcaggacgtgtataatcaatatggcaacgcctacccagctactgcaaccgccgcaacagaacgccgtccagctggagggccacagaaccaatttccattccagtttggccgtgacagggtgagtgcacccccagggacgaatgcccagcagaatatgcctccacagatgatgggcggaccaattcaagcctctgccgaagttgcccagcagggtactatgtggcagggacggaacgatatgacatacaactatgctaatcggcagtcgaccgggagcgcccctcagggccctgcctaccatggagtgaaccgaacagacgaaatgctccacacagaccagagagccaatcacgaagggtcatggccctcccacgggacccgccagccaccatacggcccttctgccccagtgcccccaatgacaaggcctccaccctcaaattatcagcccccaccaagcatgcagaaccatattccacaagtatctagccctgctcctctacctcgtcccatggaaaatcggactagccccagcaaaagcccattcttgcactcaggtatgaagatgcaaaaagctggcccacccgttccagctagtcacatcgcacccgcacctgtgcagcctcccatgattaggcgggatataacctttcccccaggatccgtggaggctacccaacccgttctgaagcaacggagacgacttacaatgaaggacattgggacccctgaggcttggcgagtgatgatgtccctgaagtcagggttgttggctgagagtacttgggcattagacaccatcaacattctgctgtacgacgacaattcaattatgacctttaatctgagccagcttcctggtctgctggagctgctggtcgagtatttcagaaggtgtctcatagaaatattcggtatcctgaaggagtacgaggtcggcgatccagggcagcgcactctactagatcctggaaggttctcaaaagtgtccagccccgctcctatggagggcggagaagaggaggaagaactgttgggtcctaagctggaggaggaggaagaggaggaggttgtagagaacgatgaggagatcgcattctcagggaaggataagcctgcttctgagaactcagaagaaaagcttattagcaagtttgacaagctcccagtaaagatcgtgcaaaaaaatgacccctttgttgtggattgctctgacaagcttggcagagtccaggaatttgactccggactactccattggagaataggaggaggagacactacagaacacatccaaacccacttcgagagtaagacagaattgctgccatcaagacctcatgctccttgccctcctgcacccaggaaacatgtgacgaccgcagaagggacgcccggaactaccgatcaggagggcccacctcccgatggacccccagaaaaacggattacagcgacaatggacgatatgctgtctactaggagttcaacactcacagaggacggagccaagtcttcagaggctattaaagaatccagtaaattcccattcggcatcagccccgcacagagccatcggaacattaaaattctcgaggatgaaccacacagcaaggacgaaactcctctgtgcacgctgctcgactggcaggatagcctggctaagcggtgcgtgtgtgtgagtaacaccattcgtagcctttcgttcgttcccggaaatgactttgaaatgtctaaacatcctggattgttgctgattcttggaaagctgatcctcctgcatcataagcatcccgaaaggaagcaagccccactgacatatgagaaggaggaggagcaggaccagggcgtctcctgtaataaggtagaatggtggtgggactgtttagaaatgctcagggagaatactctcgttacactggccaatattagtggccaattggacctgtctccgtatcctgaatctatctgcctacccgtgctggacggcttgttgcactgggctgtgtgccctagtgcagaagctcaagacccgtttagcaccctggggcctaacgctgtactcagcccccaaaggctggttctcgaaacattgagcaagctctctattcaggacaacaatgtagacctgatactcgcgacaccaccattttctcggctggaaaaactgtatagtaccatggtgcggtttctcagcgatcgcaagaatcccgtctgtagagaaatggccgtggtacttctggcgaatctcgctcagggcgattcccttgctgccagagccatcgccgtacagaagggctccatcggcaatctgctcggtttcttagaggactcgctggccgcaacacagtttcagcagtcccaggcttcgctgctccacatgcagaaccccccttttgagccaacgtccgtggatatgatgcggagagctgccagggccctattggctctggctaaagtcgatgagaatcactcagagttcaccctctacgagtccagattattagacatcagtgtatctccgctgatgaacagcttggtatctcaggttatctgcgacgtgttgttccttatcggacagtctta

SEQ ID NO: 22419 - DNA, 5708 bp, Artificial Sequence
  Description of Artificial Sequence: Synthetic coding sequence
atggaccagatggggaaaatgagacctcagccgtacggcggaacgaacccttactcccagcagcaagggccaccatcggggcctcagcagggtcatggatacccaggccaaccatacggatctcagacgccgcagaggtacccaatgacgatgcaggggcgtgcgcaaagtgcaatgggaggcctgagctacactcaacagatccctccatacgggcagcaggggccatcgggttacggacagcagggccagactccctactataaccagcagagcccacacccacagcagcagcagccaccgtactcacagcagcccccatctcagactcctcacgcacagccaagctatcagcagcagccccagtcgcaacccccacaactccagtcctcgcagcctccgtacagccagcagccaagccagcctccacatcagcagagcccagcgccttacccttcccaacagtctactactcagcagcacccccagtctcaacctccgtattcccagccccaagcccagagtccataccagcagcagcagccacagcagcctgccccatccacactgagccagcaggcagcctacccccagcctcagtcacagcagagtcagcagacagcctattctcagcagaggtttcctcctccccaggagctctcccaagactcatttgggtcacaggcctcttcggcaccctctatgacctcatccaaaggaggtcaggaggatatgaacctaagcttgcaatcgcgaccatcatctctacccgatttatctggaagcattgacgacctgcccatggggactgaaggagcactttctccaggagtttccacatccggcatttcttcctcacagggtgaacagagcaaccctgcacaatcaccgtttagtccacatacttcaccccacctccccggaatccggggacctagcccaagccctgtgggatccccagcctccgtggcccagtcacgctctgggccactgtctccagcagcggtcccaggaaatcaaatgcccccacgaccaccttccggccagtccgattccattatgcacccaagcatgaatcagtccagcatagctcaagacaggggctatatgcagcgtaaccctcaaatgcctcaatattcctccccacagcccggaagcgccctcagcccccgacagccttctgggggacaaatccacacagggatggggtcgtatcagcaaaactcaatgggctcgtacgggcctcagggcggacagtatggcccacaggggggatacccaagacagcctaactacaacgccctccctaatgctaattaccccagcgctggcatggcaggtggtataaaccccatgggcgctgggggacagatgcacgggcagccgggaatcccaccctatggtaccctgcctccaggaagaatgtcacacgcttctatgggcaacaggccatacggaccaaacatggctaacatgcctccacaggtgggctcaggaatgtgccccccaccgggtgggatgaatcgaaaaacgcaggaaaccgcagtagctatgcacgtggcagcaaattcaatacagaaccgtccgccaggttaccccaacatgaaccaaggcggaatgatgggtaccgggcctccttacggtcagggaattaacagtatggcaggaatgatcaatcctcaaggaccaccttatagcatgggtggtaccatggccaataattcggctggcatggctgcatccccggagatgatgggtttgggtgatgttaaactcacccctgccactaaaatgaataataaggcagatggcaccccaaagaccgaatcaaaaagtaagaaaagtagttcatccactactactaacgagaagattactaagctatatgagctgggcggagagcccgaaagaaagatgtgggtggaccgttacctggctttcacagaggagaaggccatgggcatgacgaacctccccgcagttggcagaaaaccacttgacctatacaggttgtatgtttctgtaaaggaaattggcggtctgacccaggtgaataagaataagaagtggagagagctggccactaatctaaacgttggaactagcagcagcgctgctagctctctgaagaagcagtacatccaatgcctgtatgcctttgagtgcaagatcgaacggggtgaggaccctcctccagacattttcgcagccgctgattcaaaaaagtcccagcctaagatacaaccaccaagtcccgcagggtcagggagcatgcaagggcctcagacgccacagtctacctcttcaagtatggccgagggtggcgatcttaagcctccaaccccagcatctaccccacacagccagatcccccctctgcctgggatgtcaagatccaactctgtaggcatacaggacgcatttaacgacgggtcagattcaaccttccagaagcgtaacagcatgacacctaatcccggatatcagccaagtatgaacacatctgacatgatgggcaggatgtcatatgagccaaacaaagatccctacgggtccatgaggaaagctcccggttctgaccccttcatgtcttccggacagggacctaatggagggatgggagatccgtattccagggcagcgggacctggccttggaaatgttgcgatgggacctagacagcactatccctatggcggtccatacgatcgcgtgagaaccgaacccggtattgggcctgagggcaacatgagcacaggcgctccccaaccgaacttgatgccatcaaaccctgactctggtatgtattctccctcccgatatccaccccagcagcagcaacagcagcagcagagacatgattcttacgggaaccagttttcaacgcagggcaccccttccggcagtccgtttcctagtcagcagactacaatgtaccagcagcagcagcaaaactacaaacgtccaatggatgggacatatggtcctccagcaaagcgccacgagggcgaaatgtacagcgtgccatattctacagggcagggccagcctcagcagcaacagctgcctccagcccagccccagccggcatcccagcagcaagccgcacaacctagccctcagcaggatgtttacaatcagtatggcaacgcttacccagccaccgccaccgccgcaacagagagaaggccagccggtggccctcagaaccaatttcctttccaatttggcagagacagggtgtccgcaccaccaggaacaaacgcgcagcagaatatgccccctcagatgatgggcggtccgatacaagcgtccgcagaggtggctcagcagggcactatgtggcaggggaggaatgacatgacctacaattacgcaaaccgacagagtaccggctctgcccctcagggacctgcgtaccatggcgtaaaccgtaccgacgaaatgctccacactgaccagcgcgctaatcatgaaggctcttggccgtcgcatggtacccgtcagcctccctatggccctagcgccccagttccccctatgacccggccacccccatctaattaccagcccccaccatccatgcagaaccacattccccaggtgtcatctcctgcacccctgcctcggcctatggagaaccgcacgtccccctcaaaatctcctttcctccactccggcatgaaaatgcagaaggctggacctcccgtgccagcgagccacatagcgcctgcccctgttcaacctcccatgatccgtagagatatcactttcccccctgggtccgtggaagccacacagccagttctgaaacagcgtcgaaggctgaccatgaaagacatcggcactccggaagcctggcgtgttatgatgtccttaaaatctggcctgctggctgagtcgacatgggcactagacacaatcaacattctcctttacgatgacaatagtattatgaccttcaacctgtcacagcttcccggactattagagttgctggttgaatactttcggagatgcctgatagaaatttttggaatccttaaagaatatgaggtcggtgatcctgggcagcgaaccctgctcgaccctggccgatttagcaaggtttcaagccctgcacctatggagggaggggaagaggaggaagagctgcttgggcctaagttggaggaagaggaggaggaggaagtggtggagaatgatgaagagatcgccttttctggaaaagacaagccagcgagtgagaactcagaggaaaaattgatctcaaagttcgataagttacccgtcaagattgtccagaaaaatgatccttttgtggtagactgttcagataagttgggcagggttcaggagttcgattctggacttttacattggagaatcggcggaggcgataccacagagcacattcagactcactttgaatcaaaaacagaactgctgccttctcggcctcatgcgccttgccctcccgcacctagaaagcacgtaaccacagccgaggggacacctggtacaacggaccaggaaggcccacctccagacggcccaccagagaaaaggatcacagccactatggacgacatgctgagcactagatcatctaccttgacggaggacggagcaaagtcttccgaggccattaaggaatcaagcaaatttccattcggcatctcaccagcacagagccacaggaatattaaaatattagaggacgagccccatagtaaggacgagactcctttatgtaccctactcgactggcaggattcgcttgccaaaagatgcgtatgcgttagtaacaccattcgcagtctgtcattcgtgccagggaatgacttcgagatgtctaagcatccgggactgctgttgattcttggtaagctgatcctgctgcatcacaagcatcctgaacgcaaacaagctccgctgacgtatgagaaagaagaagaacaggatcagggcgtgagctgtaataaagttgaatggtggtgggattgtctcgaaatgttaagggaaaacactctggtgacactggcgaatatctccggacaactggatctgtctccgtacccggaaagtatctgcctgccagttttagatgggctgctgcattgggctgtttgccctagcgctgaagctcaggatccctttagcactctgggcccaaatgcagtgctttcgccgcaaagacttgtgttggaaacactctctaagttaagtattcaagataataacgtcgatctgatcctggcgaccccccctttttcaaggctggaaaaactttattccacaatggtgcggttcctctccgatcgcaaaaaccctgtatgtcgtgaaatggctgtcgtcttactcgccaatctagctcagggggacagcctagctgcgcgtgccatcgcagtgcaaaaagggagcatagggaatctgctggggtttctcgaggatagtcttgctgcaacccagtttcagcaaagccaagcctccctgttacatatgcagaaccctccattcgagccaacatcggtagacatgatgcgcagagctgccagggcccttctggcactcgccaaggtggacgaaaaccatagcgaattcacgttatatgaaagccgcctcctcgacataagtgtgtctccccttatgaacagcctagtgtctcaagtgatctgcgacgttctgtttctaatcggccagtctta

SEQ ID NO: 22420 - DNA, 6206 bp, Artificial Sequence
  Description of Artificial Sequence: Synthetic coding sequence
atggccgcacaagtcgccccagccgcagcgagttcactgggaaaccccccacctccacccccttccgagttgaagaaagccgagcaacaacaaagagaggaagcgggaggcgaggcagccgctgcagccgctgccgaacggggagagatgaaggctgccgcaggacaagagagcgaaggcccagctgttgggcctcctcagcctcttgggaaggagctacaggatggagccgagtccaacggaggtggtgggggaggtggggcaggctctggtggtggccctggagctgagcctgatcttaagaattcgaatggaaacgccggaccaagacctgcactcaacaataacttaactgagccacccggtggaggaggcggtggttcctcggacggcgttggagcccctccccattcagctgccgctgctttgcctcctcccgcatacggctttggacagccctatggcagatctcctagtgccgtggctgccgctgccgcagcagtgtttcaccagcaacacggagggcaacagtctcccggactggcggctctacagtccggaggaggaggaggcctcgagccttatgccggtcctcagcagaatagccacgatcacggatttcctaaccaccagtacaacagctactaccccaaccggagtgcatacccccctcccgcaccggcatatgcgcttagtagcccccgagggggtacgcctggttctggagctgccgctgccgctggtagcaaacctccgcctagttcttctgcctccgcgtcctcctcgagcagctcttttgcccagcagcgctttggtgccatgggcggaggcggacccagtgcagccggaggcggaactccccaaccgactgccacccccaccttaaaccaactcctgaccagcccgtcatctgcgagaggctatcagggctatcctgggggagattacagcggaggccctcaggacggaggagctggcaagggacctgctgatatggcctcccagtgttggggtgccgctgccgcagccgcagcagcagccgcagcctcaggcggtgcccaacagagatcacatcatgccccaatgtcgcctggtagttccgggggagggggacagcctcttgctagaacaccacagcctagttcccctatggaccagatgggtaagatgcgccctcaaccatatggaggcaccaacccatatagtcagcagcaaggccctccatcgggtccacagcagggccacggatatccgggacaaccttacgggagtcagactcctcagcgataccctatgacgatgcaggggagggcccaaagcgcaatgggaggcctgagctacacccagcagattcccccatatggccagcaagggccaagtggatacgggcagcagggtcagaccccatactataaccagcagtccccgcacccccagcagcaacagcctccctactcccaacaaccccctagccagaccccccacgcacaaccgagctaccagcaacagcctcagagccagccccctcaacttcagtcgtcacaacctccgtatagccagcagcccagccagcctccccaccagcaatccccagctccgtatccctcccagcagtcaactacgcaacagcacccccagagtcagcccccatacagtcagcctcaggctcagtcaccataccagcagcagcagccccagcagcctgccccatccacactgtcccagcaagcagcctatccacaaccccagtcacagcagagtcagcagaccgcctattcccagcagcggttcccaccgccacaggagctatcacaggacagcttcggatcacaggccagctctgctcctagcatgacttcttccaagggcggtcaagaggatatgaatctctctctgcaatctcggcctagctccctgcccgatctgtctggctctatagacgacctgcccatgggtactgagggagccctctccccgggagtttccacatccgggatatcgagcagccagggcgagcagtccaacccagcgcaaagtcccttctctccccacacttcaccacacctgcccggtatccgcggtccatccccctcgccggtcggctccccggcaagcgtggctcagagcagatccggtcctttgagccctgctgcagtgccaggcaaccagatgccgccaaggccccctagtggacaatctgattcaattatgcatccttccatgaaccaaagctctattgcacaagatcgcggttacatgcagaggaacccacagatgccgcagtacagcagcccccagcccggttcggctttatctccacggcagcccagcggtggacagatacacacaggtatgggttcttatcaacagaacagcatggggtcttatggcccacaaggtggacagtacgggcctcaaggaggttacccccgacagccgaactacaatgcgctacctaacgctaactatcccagcgccggaatggcaggcggtatcaacccaatgggtgccggaggtcagatgcacgggcaaccaggcatccccccatatggcacgctccctcccggacgaatgtctcacgcttcaatgggcaacagaccatatggacctaacatggcaaacatgcctcctcaggtgggaagcggtatgtgccctcctcctggcggtatgaatagaaaaacccaggagaccgcggtcgctatgcacgttgccgcaaattccattcagaatcgccctccaggataccccaatatgaatcaggggggtatgatgggaactggccctccatacggacagggaattaattcaatggccggaatgatcaacccacaagggcctccctacagcatggggggaacaatggcgaataactcagctggtatggcagccagtccggagatgatgggtctcggggacgtcaagcttacacctgccaccaagatgaataacaaggctgatgggactccaaagaccgagtcaaaaagcaagaagagttcctcctctaccactaccaacgagaaaatcactaaactttatgaattggggggagagccagaacgtaagatgtgggtagatcggtacctggccttcaccgaagagaaggcaatgggcatgacaaacctgcccgcagtcggccgtaagcctctagatctataccggttgtatgtcagtgtgaaggaaattggcggactgacccaggtcaataaaaacaagaagtggagagagctcgccacgaacctgaatgtgggaactagttcctccgccgcaagttctcttaaaaaacaatatattcagtgtttatatgccttcgaatgtaaaattgagcgaggagaggatccacccccagacattttcgcagctgctgatagcaagaagagtcagccgaaaattcagcctccaagcccagccggaagtggaagcatgcagggaccacagactccccagagcacatcctcttccatggcggaaggaggagaccttaaacctcccacaccagcctccacaccacacagccagatcccccctctgcctggcatgtctcgaagcaatagcgttggtatccaggacgccttcaatgacggctctgactctacctttcagaaaaggaacagtatgaccccgaaccctggctaccaacccagcatgaacacttccgacatgatggggcgtatgagttacgaaccaaacaaggacccttacgggagcatgcgcaaggccccaggaagtgaccccttcatgtcaagtgggcagggtcccaacggcggtatgggtgatccatacagccgtgctgcaggccctggcctcggaaacgtggccatggggccacgccagcattacccctatggaggcccatatgatagagttaggacagaaccagggataggacccgagggtaatatgagcacaggggctccacagccaaacttaatgccttcaaatcccgattccggcatgtacagtccaagtcgctatcctccacagcagcagcagcagcagcagcagcgccacgactcatacggcaaccagttttcaacacagggaactccaagtggttcaccgtttccttcccagcaaactactatgtaccagcaacagcagcaggtgtcttcacctgctccactgcccagacccatggagaaccgtacaagcccgtccaaatccccatttctgcactccggtatgaaaatgcagaaggcagggcctcccgtgcccgctagccatatcgccccagcgcctgtacagcctcccatgatccgtcgagacattacctttcctcccggtagcgtggaagccactcaacctgtcttaaagcaacgtcggagacttaccatgaaggatattggaactccagaagcctggagagtgatgatgagcctgaaatccgggctgttggcggagtctacatgggccctggatactattaacattctactgtacgacgataattcaataatgacattcaacttgtcgcagctcccgggactcctggagctcctggtagagtatttcaggcgttgtctgatcgagatctttggaatcctcaaagaatacgaagtaggtgatcctggacagcgcacattgctggaccctgggcgttttagcaaagtatcaagccctgcgcctatggaagggggtgaggaagaggaagagcttcttggcccaaaacttgaggaggaggaggaagaggaggtggtcgaaaacgatgaggagattgccttctccgggaaggataaacctgcttccgaaaacagcgaggagaagctaatatcaaaattcgataaactacccgtaaagatcgtgcagaagaatgatccattcgtggtggactgctctgacaaattagggagagtacaggaatttgactccggtctcctccactggcgaataggcggaggtgacaccaccgaacatattcagacccacttcgagtctaagaccgagctgcttccaagccgaccccacgctccctgtccccctgctccaagaaagcatgtgaccactgcagagggcactcccggaactacagaccaggaaggccctcctccagacgggcctcccgagaagagaattaccgcgactatggatgacatgttaagcacccggtcttctacactcacagaagatggagccaagtctagcgaagcgataaaggaaagctccaaatttccatttggaatcagtcccgcacagagtcaccgtaacatcaaaatcctggaagacgagccccacagcaaggatgaaactcctctgtgtactctgttagattggcaggactcgctggcaaaaagatgcgtgtgtgtatcaaacaccataagatcactttcatttgttccgggaaacgactttgaaatgtccaaacatcctggcctactgttaatcctcggtaaactgatccttctgcaccataaacacccagaacgcaagcaggctccactgacttatgaaaaagaagaggaacaggatcagggagtcagttgtaacaaggtggagtggtggtgggattgtctggagatgttgagggagaacactttagtcacactcgctaatatcagcggccagttggatctaagtccctacccagaatctatatgcctccccgtcttggatggcctcctgcactgggcagtatgtccgtctgccgaggcccaggatcccttctctacactgggaccaaacgctgtgctgagcccccaacgcttggtgctggagacactttccaagctgagcattcaggacaataacgtagacttaatcctcgctacaccccctttttcccggttggagaagctgtattcaactatggtgaggttcctgtccgataggaaaaaccctgtgtgcagagagatggctgttgtactgctggcgaacctggcccagggcgatagccttgcagcaagagccattgccgtccaaaagggaagtatcggcaatcttctaggcttcctggaagattctctggccgctacacaatttcagcagtcccaggcatcgctcctgcacatgcagaatccaccatttgagcctacctctgtggatatgatgaggagagctgcccgtgcacttctagccttagccaaggtggatgaaaaccattctgaatttacattgtacgaaagtcggctcctggatatttccgtgtcccccttgatgaattcactggtatcacaggttatttgcgacgtgctcttcctcatcggacaatctta

SEQ ID NO: 22421 - DNA, 1842 bp, Artificial Sequence
  Description of Artificial Sequence: Synthetic coding sequence
atgatgtctctgaaaagtggcctgctagcagagagcacatgggcgctggacacaatcaatattctgctgtacgacgacaactctattatgacatttaacctgtctcagctgcctggattgttggagctcttggtggaatattttcgcaggtgtctcatagagatctttggtattctgaaggagtatgaagtgggagacccaggccagcggactttgttggacccgggaagattcagcaaggttagcagccccgctcccatggaagggggagaggaggaagaagaattacttggacccaaattagaggaggaagaggaggaggaagtcgtcgaaaatgatgaagaaatagcattctcggggaaggacaaaccagccagtgaaaattctgaggagaagctaattagcaagtttgacaagttacccgtaaagatagtgcagaagaatgacccctttgtcgtagactgttctgacaaactgggacgcgtacaggagtttgattctgggttactgcactggcggattggaggtggtgatactactgaacacatccagacacactttgaaagtaagacagagctgctgcctagtagacctcacgcaccatgtccacccgctcccaggaagcacgtgaccactgccgaaggaacgccaggcaccacagaccaggaaggcccaccacccgatgggcctcccgaaaaacggattaccgctaccatggacgacatgttatcgaccagaagcagcactttgaccgaagacggagcgaagtcaagtgaagccataaaagagtcttccaaattccctttcggcatatcaccggcacagtcgcatcgcaacatcaaaattctggaggacgaaccccactctaaggatgagactcccctctgtactctgttagattggcaggactcactagcgaagcgctgcgtttgtgtgtcaaataccattcgaagcttgagtttcgtgcccggaaatgacttcgaaatgagtaaacaccctggacttcttctcatcctgggaaagcttatcctcctgcaccacaagcatccggagagaaagcaggcccctctcacttacgaaaaagaggaggagcaggatcagggggtgagctgcaataaggtggaatggtggtgggattgcctagagatgcttcgcgagaacactctggtgacactagccaatatcagtggccagctagatttatccccatatccagagtctatctgcttaccggtgttggacggactgctgcattgggcagtgtgtcccagtgccgaggcccaggatcccttttccactcttggccctaatgccgtcctgagccctcagcggctggtccttgaaacacttagcaaactcagcatacaggacaacaatgtggatctgatcctggctactccacctttcagtcgcctcgaaaaattgtacagcactatggtgcgcttcctgagtgatcgcaagaatcctgtctgccgagaaatggctgtcgtcctcctggctaatttagctcaaggagatagcttggccgctcgagccatcgcagtgcaaaagggatcaatcggcaaccttctgggatttttggaggattctctggcagccacgcagtttcagcagtcgcaggcctctctgctccacatgcagaacccacctttcgagcccacaagcgtcgacatgatgcgaagggccgctcgcgctcttctggccctggccaaggtggacgagaaccactcagagttcactctgtatgaatcccgtcttctagacataagcgttagccccctgatgaacagcttggtcagtcaggttatttgcgacgtgctcttccttatcggccagtcctag

SEQ ID NO: 22422 - DNA, 6696 bp, Artificial Sequence
  Description of Artificial Sequence: Synthetic coding sequence
atggaaaccggcctgttgcctaatcacaaattaaagacagtgggcgaagcccctgcggctcctcctcaccagcagcatcaccatcaccaccacgcccatcaccaccaccaccacgcccaccacctgcaccatcaccacgccctacaacagcaattgaaccagttccaacagcagcagcagcagcagcaacagcagcagcaacagcagcagcagcagcagcatccgatctccaataacaactccctggggggagcaggcggaggagctccacagcctggcccagacatggagcagccgcagcatggtggcgctaaggatagcgctgctggcggtcaggcggatccacccggtcccccactgctgtccaagcccggtgacgaggatgacgctcctcccaaaatgggagaacctgcagggggacgctacgagcatccgggactgggtgccttggggacccagcagccccctgtggccgttcctgggggtgggggaggcccagccgcagtgcctgagtttaacaactactatgggtccgccgctcccgcttctgggggaccaggcggaagagcaggaccttgcttcgaccagcatggaggacagcagtcacctggcatgggcatgatgcattcggcaagtgctgctgccgctggcgcacctgggtccatggatccactgcagaacagccacgagggctacccgaatagtcagtgtaatcactatcccggttattccaggcctggtgcgggaggcggaggcggaggcggagggggtggcggtggcggttccggtggcggagggggtggaggcggtgctggagctggcggtgccggagcaggtgccgtggccgctgccgctgctgccgcagccgctgctgctggagggggaggcggtgggggatacggaggctcatcggctggttacggagtcctctcctccccacgacaacaggggggagggatgatgatgggaccaggagggggtggggcagccagcttgtcaaaggccgcagccggaagcgccgctgggggattccaacgctttgccggacaaaaccagcatccgtcgggtgctaccccaacccttaaccagctgctgaccagccctagccctatgatgagatcctatggagggagttaccccgagtatagcagcccgtcggcccctcctccaccaccttcccaaccccaaagccaggccgctgccgctggtgccgcagccggaggccagcaggccgctgccggaatgggcctgggcaaggacatgggtgcgcaatatgctgctgccagtccggcatgggcagctgctcagcagcggtctcaccctgcaatgagccccggaactcctgggccaacaatgggccgaagtcaaggctcccctatggatcccatggtgatgaagaggccccaactgtacggaatgggatcgaaccctcatagccagccacagcagtctagcccctatccaggcggatcctacggcccaccaggtccgcaacggtacccaatcggtatccaaggtcgcacccccggtgcaatggccggtatgcagtatccccagcaacagatgccaccccaatacggccagcaaggggtatccggttactgccagcagggccagcaaccctattactctcagcagccacagccccctcatctcccccctcaggcccagtatctaccatctcagtcgcagcagcggtaccaacctcagcaggatatgtctcaagagggctacggcactcgaagtcagccgcctctggctcctggtaagcctaatcacgaggatcttaacctcatccaacaggagagacccagctccctgcctgacctgtctggctctattgatgatctccccactgggacggaggccactctgagctccgctgttagcgcttccggctcgacaagctcacaaggagaccagtcgaatcccgcacagagccctttctcacctcatgcctctccacatcttagtagcatccccggaggccctagcccaagtcctgtgggcagcccggtgggcagcaatcagtcacgtagcgggcctatcagtccagcatctatcccaggcagccagatgccgcctcagcctcctggttcccagtcagaatcctccagccacccagccctttcccaaagcccaatgcctcaagagagggggttcatggcgggaacccagagaaaccctcagatggctcaatatggacctcagcagacgggtcctagtatgagccctcacccttctcctggaggacagatgcatgctggcataagcagtttccaacagtctaatagtagcgggacatatggaccacaaatgagtcagtatggtccccaagggaattactctcgaccaccagcctacagcggggtgccttccgcctcttattctgggccagggcctggtatgggcatttcagccaataaccagatgcatggacaggggcctagccagccgtgtggggctgtgccgctaggaagaatgccaagcgccggaatgcagaaccgacccttccccggaaacatgtcatctatgacccccagtagccctggcatgtctcagcaaggaggacccggtatgggccctcctatgcctactgtgaacagaaaagcccaggaggctgctgcggctgttatgcaggctgctgctaactccgctcaatctaggcaggggagtttccccggtatgaaccagtccggcctgatggcaagctcgtctccatacagtcagcctatgaacaatagttcctcattgatgaacacacaggcccctccttactcgatggcccctgctatggtaaatagttccgccgctagcgtcgggctcgcagacatgatgtcccctggagaaagtaagctgcccttacccttaaaggcagacggaaaagaagaaggaacgccccagcccgagtctaaatccaaggactcgtactcatctcaaggtattagccaacctccaaccccagggaacctccctgtgccaagtcccatgagcccatctagcgcctcaatatcgagttttcatggggacgaaagcgatagtatatcaagtcctggatggcccaaaacaccaagtagccctaaaagctcaagctcgactacgaccggggagaaaatcactaaggtgtacgaactgggaaatgagcccgagcgtaaattgtgggtcgatcggtatctgacattcatggaggaaaggggttctcccgtgagttctttaccagccgttggtaaaaagcctctggatctgtttaggctctacgtatgtgtaaaggagattggaggattagcccaggtaaacaaaaacaaaaaatggagggaattagctaccaatctcaatgtgggaaccagctcatctgcagcttcatccctgaaaaagcagtatatccagtacttattcgcgttcgaatgcaagattgagaggggcgaagagcccccaccagaggtgttttctaccggcgatactaaaaaacagccgaaattgcagccaccgtccccagcaaacagcgggagtctgcaagggcctcagaccccccagagcaccggcagtaactcgatggccgaggttccgggtgatctgaagcctcccacacctgcttctacaccacacggacagatgacccctatgcagggcggaagatcctccaccatttccgttcatgacccttttagtgacgtctctgactcttccttcccgaaaagaaacagcatgaccccaaacgccccttatcaacaaggaatgagcatgccagacgttatggggcgaatgccctacgagcctaacaaggaccccttcggcggaatgcgcaaggtgccaggctcctcagagccatttatgacgcagggacagatgcctaatagcagcatgcaggacatgtataatcagtctccatcaggcgcaatgtccaacctgggcatggggcagagacagcagtttccgtatggcgcaagctacgatcgcagacatgaaccgtatgggcagcagtatcctggacagggcccaccaagcgggcagcccccatatggtggccaccagcctgggctttacccacagcaaccaaattacaagcgccacatggatggcatgtacggccctccggctaaaagacacgagggtgacatgtataacatgcagtactctagtcaacagcaggaaatgtataaccaatatgggggaagttattctggacccgatcgacggccaatccagggtcagtatccatacccttacagtagagagagaatgcagggccctggccaaattcagactcatggaattccccctcagatgatgggcggaccgcttcagtcaagtagttcggaaggacctcagcaaaacatgtgggccgcacgcaacgatatgccctacccttatcagaataggcagggtcctggcggaccaactcaggcaccgccttatcctggcatgaatagaacggatgacatgatggtgcctgaccagcgtatcaaccatgagtcacagtggccatctcatgtgagccagaggcagccttacatgtcctcctctgcttccatgcagccaattacacgacctcctcagccttcataccagaccccaccttccttgccaaaccacatcagcagggcaccatcacctgccagcttccaaagatcgctggaaaaccgaatgtcaccctctaagtctccgtttctgccgagcatgaaaatgcaaaaggttatgcctacagttcctacgtcacaagtgaccggtccaccgccacagccccctcccatccggagggaaatcacttttcctcctggaagcgttgaggctagccagccagttctgaagcagagaagaaaaattacaagtaaggatattgtgacaccggaggcctggagagtgatgatgagcctaaaatccggactgctcgctgaaagcacttgggctcttgacacaatcaatatactgttgtatgatgacagcacagtggctactttcaacctcagccagctgtccgggttcctggagcttctagtcgagtactttaggaaatgtctcatagatattttcggaatcctgatggagtacgaggtgggggacccatcccagaaggcactggaccacaatgctgccagaaaggatgactcccagagcctcgccgatgacagtgggaaagaagaggaggatgcagagtgcattgacgacgatgaagaggacgaggaggacgaggaagaggattccgagaaaacggaatccgacgaaaagagttccatcgccctgacagcccctgatgccgctgccgatcccaaggaaaagccaaaacaggcttccaaatttgacaagttgccaattaagattgtaaaaaagaataatttgtttgtggtcgatcggagcgacaagttgggacgcgtgcaggaattcaattcaggcctgttgcactggcaattaggcggtggcgacacgactgaacacatacagacccacttcgaaagtaaaatggagatcccacccaggcgcaggccccctccaccactgtccagcgctggtaggaaaaaggaacaggaggggaaaggtgacagcgaggagcagcaagaaaagtctataattgccacgattgacgacgtgctgagtgcacgacctggagcccttcccgaggatgccaacccaggtcctcagactgaatcctctaagttcccatttgggatccagcaggcaaagagccaccgaaatattaaattgctggaggacgaaccaaggagtagggacgaaacacccctctgcacgatagcccattggcaagattccctggctaagagatgtatctgtgtgagtaatatcgtgaggtccctgtccttcgtgcctggcaacgatgccgaaatgagtaagcacccaggcctggtcttaatactaggaaagctcatattactgcatcacgagcaccctgagcgcaagagggcgcctcagacatacgaaaaggaagaggacgaagataagggcgtcgcttgctctaaggatgagtggtggtgggattgcctggaggtgctccgagataacactctggtaacgctggctaacatctcaggccagttggacctgtctgcctacactgaaagtatttgcttgcccatcctggatggtctcttacattggatggtgtgtccctccgccgaggctcaggatcccttcccgacagtcggccctaacagtgtcttgagccctcagcggctggtgcttgagactctctgcaaattgagtatccaggataataatgtcgatctgattctcgctacacctcctttcagccgccaggagaagttctacgccacactggtgcgatacgtgggcgacagaaagaatccagtatgcagagaaatgtctatggcactgctctcgaatctcgcccaaggggacgcactcgccgcacgggctattgcagtgcagaaagggagcattggaaatctgatttcgttcctggaagacggcgtaacaatggcacagtatcagcagtctcaacacaacctgatgcacatgcagcccccaccactggaaccaccttctgttgacatgatgtgtagggccgctaaagccctactggcaatggccagagtggatgagaacaggtcagagttcctactccatgaaggccgactactggacattagcatctcggctgtgctgaactctctggtcgcaagtgtaatctgcgacgtgctgttccagattggtcagttatac

SEQ ID NO: 22423 - DNA, 6749 bp, Artificial Sequence
  Description of Artificial Sequence: Synthetic coding sequence
atggcacataatgctggagcagcagccgctgccggaactcacagtgcaaagagcggtgggagcgaggccgctttaaaggagggtggcagcgcagccgctcttagctcatccagctcttcttccgcagcagccgcagctgcctcatccagctcctcatccgggcctggtagtgcgatggagactggacttttgcctaaccacaagctgaagactgttggcgaggctcctgctgcccctccacatcagcagcatcatcatcaccaccatgctcatcaccatcaccatcacgctcatcacctccaccaccatcacgctttacagcagcagcttaatcagttccagcagcagcagcagcagcagcagcaacagcagcagcagcaacagcagcagcagcacccgatatctaacaataattccctggggggtgctggaggcggagcacctcagcctggacctgatatggagcaaccacagcatggaggcgcaaaagactcagccgctgggggacaggccgaccccccaggccctccgttactttccaagcccggtgatgaagacgatgctccccctaagatgggggaaccagcagggggtcgctacgagcatcctggtctgggtgctttaggcacacaacagccacctgtggccgtaccaggaggaggtggtggtcctgccgcagtcccagagtttaataattattacgggtccgcggcaccagccagcgggggacccggaggtagggctggtccctgtttcgatcaacatgggggtcagcagagtcccggtatggggatgatgcactcagcctccgcagcagctgccggagcccctggttccatggacccactgcaaaattctcatgaaggctacccaaattctcagtgcaaccattaccccggatacagtaggccgggagctgggggtggaggcggaggcggaggcggaggcggaggcggatctggcggaggcggtggcggtgggggagccggagccggtggtgccggagcgggagccgttgccgctgcagccgcagctgccgcagccgctgctggaggcggaggtggcggaggctacggtggatctagtgcaggctacggagtcctatcatccccacgtcagcagggaggaggcatgatgatggggcctgggggtgggggtgccgcttccctgtcaaaagcggctgccggatctgccgctggcggttttcagaggttcgccggacaaaatcagcatccatccggcgctaccccaactctgaatcagcttctcactagccctagcccgatgatgcgctcctacggcggttcctacccagaatactcatcacccagcgcccctcccccaccccctagtcaaccccagtcacaggccgctgcagctggcgctgccgctggcggacagcaggctgctgccggaatgggattgggcaaggacatgggtgcccagtatgctgctgcttcccccgcatgggcagccgcacagcagcgaagccacccagcgatgagtcccggaacacctggtccaacgatgggacggtcccagggttcgcccatggaccccatggtgatgaaacggcctcagctgtacggcatgggcagcaacccacattcccagccacagcagtcttccccttacccaggcggttcctatggcccacccggtcctcaaagatacccaatcggaattcagggccgtacacccggtgccatggccggaatgcagtaccctcagcaacaggactccggcgacgctacttggaaagaaaccttctggctgatgcccccacagtacgggcagcaaggagtcagtgggtattgccagcagggccagcaaccgtattattcccagcaacctcagccccctcacctacctcctcaggcccaatatctcccctcacagtctcagcagagatatcaaccacaacaggatatgagtcaagagggttacggcacacggtcacagcctcccctcgcacctggaaaacccaatcatgaagatctgaacttaattcagcaagagaggcccagttcactgccagaccttagtgggagcatcgatgacctgcctactggcaccgaggcgaccctcagttccgccgtgagcgcaagcggctccacaagctcacagggcgaccagagcaatcctgcccagagcccgttttccccccacgcctccccccatttatcgagtataccagggggaccatctccttcccctgtggggtctcccgtcggctccaaccagtctaggagcggtccaatttcacccgctagcattccgggtagccaaatgcctccacagccaccaggatcacagagcgagtcatcaagccacccagccctttcacagtcccctatgcctcaagagcgtggatttatggccggaacacagagaaatcctcagatggcccagtacggaccccaacaaacgggaccctctatgagcccacacccgtcacccggagggcagatgcatgcaggcatttccagcttccaacaaagtaatagctctggaacgtatggtcctcagatgtcccagtacggaccccaggggaactactccagaccacccgcatacagcggggtaccaagtgcctcgtattcaggcccaggccctggtatggggatctccgcgaacaatcagatgcatgggcaaggtcccagtcaaccctgcggcgctgtgccattggggcgaatgccatccgctggaatgcagaaccggccattccctggaaacatgtctagtatgaccccaagctcacccggtatgtcccaacaagggggtccaggaatgggtcctcctatgccgaccgtgaatcggaaggctcaggaggcagcagcggcagtcatgcaggctgccgcaaactccgctcagagtaggcaaggatcattccctggaatgaaccagtccggcctgatggccagttcctctccctactcccaacccatgaacaactccagttccttaatgaacacccaagcacctccttacagcatggccccagcgatggtaaattccagtgcagcctctgttggcctggccgatatgatgtccccaggcgaatccaagctcccactacctctcaaggctgacggcaaggaggagggtactccacagcctgagtccaagtccaaaaagagctccagctccacaactacgggcgagaaaattacaaaggtctacgaactgggtaatgagcctgagcgaaagctctgggttgatcggtacctgactttcatggaggaacggggatcacccgttagctctttaccagccgtgggcaaaaaacctctggatctctttcggctgtacgtgtgcgtgaaggaaatcgggggactggcacaggtaaacaaaaataaaaagtggagggaactggccacaaacctaaatgttggcactagctcctccgccgcaagcagcctgaagaagcaatacattcagtatctcttcgcattcgagtgtaaaatagaaaggggtgaagaacccccaccagaagtgttttccactggtgacaccaagaagcagccaaaactgcagccaccctctcctgccaacagtggatctctgcagggacctcagaccccacagagcaccggtagtaattccatggcggaggtacccggtgaccttaaaccacccactcccgctagcaccccacacggccagatgacaccaatgcagggcggtcgatcttcaacgatttctgtccatgaccctttctcggatgtttcagacagcagtttccccaaaagaaatagtatgacgcctaacgcaccataccagcagggaatgtctatgcctgacgtaatggggagaatgccttacgaacccaacaaagacccatttggcggtatgcgcaaggtgcctggctcatccgagcccttcatgacccagggccagatgcccaacagctctatgcaggacatgtataaccagagcccctctggagcaatgtccaatctgggcatggggcaacggcaacagttcccttatggggcaagctacgaccggcgtcacgagccatacggtcagcagtatcccggacaaggccctcccagtggacaacctccttacgggggacaccagcccggactatatccccagcagcccaattataaaaggcatatggatggaatgtacggaccacccgcaaagcggcatgaaggtgatatgtacaacatgcaatactcctcccagcagcaggagatgtataaccagtatggaggcagctatagcggacccgatcgcaggcccatccaggggcagtatccctacccttactctcgggagcgcatgcaggggccagggcaaatacagacccacgggatacctccacagatgatggggggaccacttcagagctcctctagtgaaggccctcagcagaacatgtgggccgctcggaatgatatgccctacccctatcaaaatcggcaggggcctggcggtccaacgcaagccccaccataccctgggatgaataggaccgatgacatgatggtgcccgatcagcgaatcaatcacgaaagccagtggccatcccacgtgtctcagcgccagccatacatgagttcaagcgcgtcaatgcagcctatcacccggcctcctcagccatcctaccagacgccgccttccctgcctaaccatataagtagggccccttctcccgcttctttccagagaagcctagagaatcgtatgagccctagtaagtcacccttcttaccatctatgaaaatgcagaaggtcatgccgactgtgccaacctctcaggtgaccgggccacctccacagcctcctccaattcgaagagagattacattccccccaggttcagtcgaagccagtcaaccggtgctcaaacagaggaggaagataactagtaaagacatcgtgactcccgaggcatggcgggtcatgatgagccttaaatccggtcttctcgccgaatctacttgggctctggacacaatcaatatattactgtacgatgactccactgttgcaacttttaatttgagccagctgtctggtttccttgaactgctcgtggagtacttccgcaagtgcctgatagacatatttggcatcctcatggaatatgaggtgggcgatcctagccagaaagctctggatcataatgccgcacgcaaagacgactctcagagcctggccgatgacagtggcaaagaggaggaagatgctgaatgtattgacgatgacgaagaggacgaagaagacgaggaggaagatagtgagaaaaccgaaagtgacgagaagagctctatcgcactgactgcgcctgatgctgcagccgaccctaaggaaaaacctaaacaagcctcaaagtttgataagctacctattaagatcgtgaaaaagaacaacttattcgtggtggatcgctctgataagctcggaagggtgcaagagtttaactctggactgctgcattggcagctgggtgggggtgacaccaccgaacacatccagacccacttcgaatcaaagatggaaatacctccgaggagaaggcctccacccccattaagcagtgccggtcgtaagaaagaacaagagggaaaaggggattctgaggaacagcaggagaagtccatcatcgccactattgacgacgtcctttccgccaggccaggagcccttccggaagatgcgaacccagggccacagacagagtccagcaagttcccattcggtattcagcaggccaaatcccatcgcaatataaaactcctggaggatgagcccagatctagggatgagaccccattgtgcaccatcgcccactggcaggactctctcgctaagagatgcatctgcgtctcaaatatcgtcagatcgctgtcattcgttcccggaaacgatgccgagatgagcaagcaccccggactggtgctgatcctaggcaaattgattctactgcatcacgagcatcctgagcgaaaaagagccccacaaacctatgagaaagaggaagacgaggataagggagtagcatgctcaaaagatgaatggtggtgggactgtctcgaagtgcttagagacaacaccctggttactctggccaacatctccggccagttggacttgtcggcctatacagagtcaatttgcctcccaattctcgatgggttactacattggatggtttgcccctccgctgaagctcaagacccattcccaacagttggtcccaactccgtgctctctccacagcgactcgtactggaaacactgtgcaagctcagtatacaggataacaatgtagatctcatactggcaacgcctcccttctcaaggcaggagaagttttacgctaccctggtgcggtatgtgggtgaccggaagaacccagtttgcagagagatgagcatggcattgctctctaatcttgcccaaggggatgccctggcagctagagcaattgccgtgcaaaaaggatcaatcgggaacctcatcagttttttggaggacggcgttacgatggcccaataccagcagtcccaacacaatctcatgcacatgcagccaccaccgctggagcctccgagcgtagacatgatgtgccgtgctgctaaagcattgctcgccatggcaagagtagatgagaacagaagtgaatttctgctccatgaagggaggctcctggacataagtatttctgccgtgctaaatagcttggtggccagtgtgatctgtgacgtgctcttccagatagggcagttata

SEQ ID NO: 22424 - DNA, 6710 bp, Artificial Sequence
  Description of Artificial Sequence: Synthetic coding sequence
atggctcataatgcaggggcagcggctgctgcaggcactcatagcgccaaaagcggcggtagcgaggccgctctgaaagaaggcggaagtgcggcagccctctcatcgagctcttcatcctcagccgcagctgcggcagcatcctctagttccagttccggcccagggtctgctatggaaaccggtctgttaccaaaccacaaacttaagacagtaggagaggcccctgctgcacctccccaccaacagcatcaccatcatcaccatgctcatcatcatcatcatcacgcccatcatttacaccatcatcacgcgctgcagcagcagctaaatcagtttcaacagcagcagcaacagcagcaacaacagcagcagcagcagcagcagcagcagcaccctatttcgaacaacaattccctgggcggagcgggaggaggtgccccacagccgggaccagacatggaacagccacaacacggcggagcgaaggactcggccgctggtgggcaggcggatcccccaggccctcctctcctcagcaagccaggggatgaggatgacgcccctccaaaaatgggagaacccgctggaggcaggtatgaacatcccggtttgggggcactgggtacgcagcagccgcctgtcgccgtcccgggtggaggcggtggtcccgcagccgtgcccgagtttaacaattattatggatcagctgcaccggcatcggggggaccgggtggccgtgctggcccatgcttcgatcaacacggaggtcaacagagcccaggcatggggatgatgcacagcgcctccgccgctgcagcaggcgcacccggttcaatggaccccctgcagaattcccatgaagggtacccaaactcacagtgtaaccactatcctgggtacagcaggcccggagcaggaggcggaggaggtggcggaggaggcggtggtggagggagcggtggaggcggtggcggaggcggtgccggagcaggtggtgcaggtgccggtgctgtcgccgctgctgccgctgctgcagctgccgctgccggtgggggtggtggcggaggctacggtggatcaagcgccggatacggtgtcctgtcttctcctcgacagcaggggggaggcatgatgatggggcctggtggtggtggagcagcatctctgagtaaggcagccgcaggatcagcagccggaggcttccaaagatttgccggacagaaccagcatccttcgggagccactcctactctcaatcagctcctcacctcgccgagccctatgatgaggtcttacggtgggtcttatcctgaatattcctctccttccgctccgccaccacccccaagtcagccacagagtcaggctgccgcagctggagctgcggctggcggtcagcaagccgcagctggtatgggtctagggaaggacatgggtgcacagtacgccgctgcatctccagcatgggccgcagctcaacagcggagccatcctgctatgtctcccggtacacctgggcctactatggggcgatcacaaggatcgcccatggatccaatggttatgaaacgcccacagctttacggaatggggagtaacccccacagccagccgcagcagagttccccgtaccccggaggaagctatgggcctcctgggccacagaggtatcctattgggatccagggaagaaccccaggggctatggccggtatgcagtatccccagcaacagatgccaccgcagtatggccagcaaggagtaagtggctactgccagcagggtcagcagccgtattatagtcagcagcctcagcccccacacctcccccctcaggcccaatacctccctagccaatctcagcagcgctaccagccccaacaggacatgagccaggaagggtatggaaccaggagccagcccccactcgctccaggcaagcctaatcacgaagacctgaatctgatccagcaggaaagaccttctagtctgcctgacctttccggcagcattgatgatctgcccacaggaacggaggctactcttagcagcgctgtgtctgcctcaggcagcacctcctctcagggcgaccagagcaatccagctcaatcaccattctctccccacgcatctccccacttatctagtatccccggtggcccaagtccaagccccgtgggatctcctgtggggtctaaccaatctcgcagcggacctatttctccggcttctatcccaggaagccagatgccacctcagcctcctggtagtcaatccgagagctcctcccatccagccctgtcccagagcccaatgcctcaagagcgtggatttatggccggaacccagcggaatccacagatggcgcagtacgggcctcaacagaccggtccgtccatgtcccctcaccctagtccagggggacagatgcatgccggtatctcctcgttccagcaatcaaactcctccggtacatacggtccccagatgagtcagtacggcccacaggggaattatagccggcctcctgcctatagtggcgtgccctccgcctcttattctggtcccggaccagggatgggtataagtgctaataaccagatgcacggacaaggcccttcccagccctgtggagccgtgcccctgggcagaatgcccagcgcgggaatgcaaaatcgtcccttccccggaaacatgagcagcatgactccatcctcccctggaatgtcacagcagggtggccctggcatgggtccaccgatgcccactgtaaacaggaaagcccaagaagctgcagccgcagtgatgcaggctgccgctaactctgcgcaaagtaggcagggcagtttccccggaatgaaccagagcggcctgatggcttcatcatctccctacagccagcctatgaacaacagctcgtcactgatgaatactcaagccccaccctactccatggcaccggcaatggtaaactcttccgcagctagcgtcggactcgcagacatgatgtcccctggagagtcgaaactacccttacccctgaaagcggacgggaaggaggaaggcactcctcaaccagagtctaaatcaaagaagtcatcatcttcaactaccaccggcgagaagattactaaagtttatgagttgggaaatgaaccggaacgcaagctgtgggtcgacagatatctgacattcatggaagaaagaggatctcccgtgtccagtctccctgccgtcggtaagaaaccactggatttgtttcggctctacgtctgtgtgaaagaaatcggtgggctggcccaggtgaataagaacaaaaagtggagggaactagctactaaccttaatgtgggtacgagcagttcagcagcatcgtccttaaaaaaacagtatattcaatatttatttgccttcgaatgcaaaatagagaggggggaggaacccccaccagaggtcttctctaccggcgatacaaaaaagcagccaaaactgcagcctcccagcccagctaactctgggagtcttcagggtccacagacacctcagtcaaccggcagtaattccatggctgaggtgcctggggatctgaagcccccaacccctgcctccacaccccacgggcagatgacccccatgcagggcggtaggtcctctacaatctctgttcatgatccgtttagcgacgtgtccgactcttccttccccaagcggaattctatgacgcctaacgccccataccagcaggggatgtcaatgccagacgtcatgggcaggatgccttacgagccaaacaaggacccttttggcggaatgcggaaagtgccaggctcctctgaaccattcatgacccagggccagatgcccaacagttcaatgcaggacatgtataaccaatctccaagtggcgctatgagcaacctcgggatgggtcagcgacagcagttcccctatggcgcatcttacgatcgacgccacgagccctacggtcagcagtatcctggccagggccctcccagcgggcagcctccatacggcggacatcagcctggcttatatccccagcagccgaactataaaaggcatatggatggaatgtacggtcctcccgcaaagcggcacgaaggcgatatgtacaatatgcagtactctagtcaacaacaggagatgtataaccaatatggcggatcctatagcggtccagacaggcgtcccattcaaggtcagtacccttatccttattcaagggagcgcatgcaaggcccaggccagattcagactcatggcatcccccctcaaatgatgggcggtcctctccagagctctagttctgagggcccacagcagaatatgtgggcagccaggaatgacatgccctacccatatcagaatcggcaagggcctggcggtccaacacaagcacccccataccctgggatgaacaggactgacgacatgatggttcctgaccagcgaatcaatcatgaaagccagtggccctcccatgtgagccagcgacagccctacatgagcagttccgcctcaatgcagccaatcacaagaccccctcaacccagctatcagaccccgccatcccttccaaatcatatcagccgggctccttccccagcctcgtttcagcggtctctggagaataggatgagccccagtaagagcccatttctgccatcaatgaagatgcaaaaggtcatgccaacagtccccaccagtcaggtaacaggaccacctccccagcctcccccaattagacgtgagataacatttcccccagggtccgttgaggctagtcagccagtgctgaaacagagacgcaagattacgagtaaagatattgtaacccctgaagcatggcgcgtaatgatgtcgctgaagtccggtctcctggctgaaagtacttgggcccttgacacaattaacatcctcctgtacgacgactcaacagtcgccacattcaaccttagtcagctgtcaggcttcctcgaactgcttgtggagtacttccgcaagtgtctgatagatattttcggaattctgatggaatatgaagttggggatccatctcagaaggcgttggaccacaacgccgctaggaaggacgattctcagagcctggcggacgattctggtaaggaagaggaggatgctgagtgtatcgacgacgatgaagaggatgaagaggacgaggaagaggattcagagaaaaccgagtctgatgagaaaagctcaattgccctcacggctccagacgcagctgcagatcctaaagagaagcctaagcaggcatctaagtttgacaaactacctattaagattgtgaagaagaataacctcttcgtggtggatcggagcgacaagctaggcagggtccaagagttcaactccggactgctgcattggcaactgggcggaggtgacacaacagagcatattcagactcactttgagtccaagatggagatcccgccaagacggaggccgccacctccccttagctccgccggtaggaaaaaagaacaggaaggcaagggagactctgaagagcagcaagagaagagcatcatcgcgacgatcgatgatgtattgtctgccagacccggagcgctccccgaggatgccaatccagggccacagacagagtcatctaagttcccttttggtattcaacaagccaagtcccatagaaacatcaagctgttagaagacgagcccagaagtcgggacgagactccactttgcactatagcccactggcaggacagtctggccaaaaggtgcatctgcgtctcaaatatcgtgagatctctctcatttgtgccaggaaacgacgccgaaatgtctaagcaccccggactggtccttatcctgggaaagttaattttgcttcatcatgagcaccctgaaaggaaaagggccccacagacttatgaaaaagaggaggatgaagacaagggggtggcttgtagcaaagatgaatggtggtgggattgtctggaggtcctgagagacaataccctagtcactctcgcgaacatctctggtcagctggatctctcggcatacacggagtcaatctgtctgccaatcttagacgggcttcttcattggatggtgtgtccatctgctgaagctcaggacccctttcctactgtcggtccaaattccgtactttccccacagaggcttgtgttggaaactctgtgcaaactctccattcaggacaataacgttgaccttattctggcaacaccaccgttcagccggcaagaaaagttttacgctaccctggtgagatatgtcggcgataggaaaaaccctgtgtgcagggaaatgtcaatggcactgttaagtaacctggcccaaggggacgcactcgcagcaagagctatagcagtccaaaaaggcagcataggcaacctgatctcttttctggaagacggtgttaccatggctcagtaccaacaatctcagcacaatctgatgcacatgcaaccgccaccgttagagcccccatcagtcgacatgatgtgcagagccgcaaaggcactcctggccatggcgagggtggacgaaaatcgcagcgagtttctcctgcacgaggggaggttgctcgacatcagcatctcagcggtgctaaatagcctcgttgcaagtgtaatttgcgacgtgctgtttcagatcggacagctcta

SEQ ID NO: 22425 - DNA, 2172 bp, Artificial Sequence
  Description of Artificial Sequence: Synthetic coding sequence
atgccaccccagtacggacagcagggcgtgtcgggttactgtcagcaaggccagcagccgtactattcacagcagcctcaaccaccccacctaccaccgcaagcacagtacctcccgtcccagtcccaacagagatatcagcctcaacaggatatgagccaggagggatatggtacccgttctcagccgccattagcacctggaaaacccaaccacgaggatctcaatctgatccagcaggaacggccaagcagtctgccagacctgtccggctccatagatgacttgcctaccggcactgaagcaaccctgagcagcgctgtctctgcatcaggctccacatcatcacaaggagatcagtccaatcctgctcaatcacctttcagcccgcacgctagtccacacctgtcatctatccccggaggcccaagcccctcgcccgtcggcagtcctgtgggctccaatcagagtcggagcggccctattagtcccgcttccattcccggatcacagatgcctcctcagccccctgggagccagtctgaatcaagttcccatccagctctcagccagagccccatgccgcaagaaagaggtacgcagcggaacccgcagatggcacagtacggcccacagcagactgggccatccatgtcaccacatcctagtccaggaggacagatgcacgctggaatcagtagttttcaacagtcaaatagcagcgggacctacggccctcagatgtcccagtacggccctcaaggcaattacagtagaccccctgcctatagcggagtccctagtgccagttacagcggccctgggcctggtatgggcatcagtgctaataatcaaatgcacgggcagggacctagtcagccttgtggggctgttccccttggacgcatgccctccgctggaatgcagaaccggccattccccggaaatatgtcttctatgactccttcatcaccaggcatgagccagcaggggggtcctggaatggggccacctatgcccaccgtcaataggaaggcccaagaggccgcagccgcagttatgcaggctgcggctaattccgcccagagtagacaggggtcatttcccggaatgaaccagagcgggttgatggcctccagttcaccttattctcagcccatgaacaacagttccagcctgatgaatacacaggcgcctccttatagcatggcccctgcaatggtcaactcctccgctgccagcgtgggtctggctgatatgatgtccccaggggagagtaaactgcctctcccactgaaggcagacgggaaggaggaagggacaccacagccagaatccaagagtaaagacagctattcctctcaggggatctcgcagccacctacacccggaaacctgccagtgccaagtcctatgtcaccttccagcgcgagcatctccagcttccacggagatgaatccgattccatctcctctccaggatggcctaagaccccatcttcgcctaagtcatcatcctccacaactacaggcgaaaagattacaaaggtatacgagctagggaatgagcccgagcgaaaactttgggtggatcgctacttgaccttcatggaggagaggggctctcccgtgtcttcgctgcccgcagtgggcaaaaaaccactggatcttttcaggctttatgtctgcgtgaaagaaatcggaggcctggcacaagtgaacaaaaataagaagtggagagagctggctaccaacctcaatgtgggaacctcctcgagtgcagcctctagcctcaagaagcagtatatacagtacctgtttgctttcgaatgtaagattgagagaggcgaagaacctccaccagaagttttttcaaccggggatacaaagaaacaacccaaacttcaacctccgtcacccgttgtgcaaatggagcccagggcctgtgacactggtgggagcggacgcaaggcaagctggagccgacctgccccacgggctagagcgggtgggtcacgccacacacaggcttccggcggaagaaggcagcgacacccaggtctccagaaaccgctcgacagtcttccgccaacacagcaggtggcttcacccatccctgtgccttcactcggaaaggttagcgggaatatcttcgtggttaaaggtaaatag

SEQ ID NO: 22426 - DNA, 6869 bp, Artificial Sequence
  Description of Artificial Sequence: Synthetic coding sequence
atggcccataatgccggagccgcagccgcagcgggtacgcattccgcaaaatcaggaggcagtgaggctgccctgaaagaagggggttcagccgcagcactgtccagttcaagctcctcctctgccgcagccgcagccgcttcatccagctcctcttctggccctggatccgctatggaaacgggtctgctgccaaaccacaaactcaagacagtgggcgaagccccagccgctcccccacaccagcagcatcatcatcaccaccacgcacaccaccaccaccatcatgcacaccacctgcatcaccaccatgctcttcaacagcaactcaatcaatttcagcagcagcagcaacagcaacagcagcagcagcagcaacagcaacagcagcagcaccctatttccaacaataactccctcgggggagctgggggaggagctccccagcccggaccagacatggagcagccccagcacgggggagcgaaggacagcgcagccggagggcaggctgacccccctggtcctcctctgctatctaagcccggagacgaggatgacgctccacctaaaatgggggaacccgctggaggcaggtatgagcatccaggcctgggcgctctcggcactcaacagccccctgtggctgtgccgggagggggaggtggcccagctgcagtgcccgaattcaacaactactacggctctgcagctccagcatcaggaggacccggaggtcgtgccggtccgtgctttgatcaacacggcggtcaacagagtccaggaatgggcatgatgcactcagcctccgcggctgccgcaggtgcgccagggtccatggaccccctgcagaattcccacgagggttatcccaactctcaatgcaatcattatccaggctattcgaggcctggggctggaggcggagggggaggaggcggaggcggaggaggtgggagtgggggaggaggcggtggaggcggtgccggagctgggggagcgggagccggagcagtggccgctgcggcagctgccgcagcggctgccgctgggggtgggggtggcggaggatacggaggatcatcagcgggttacggcgtcctcagctcacctcgccaacagggaggtgggatgatgatgggacctgggggaggaggtgcggcttcactgtcgaaggcagcagccggatctgctgcaggaggtttccagcgttttgcagggcagaaccagcacccctctggcgcaacccctacacttaatcaattgctgactagccctagccctatgatgagatcttacggtgggtcctacccagagtattcctcgccaagtgctcctcctccacccccatcccagcctcagtcacaggctgccgcagcgggtgccgcagccggtggccagcaagccgcagcaggcatggggctggggaaagatatgggagcacagtatgcagcagccagcccagcatgggcggcagcccagcagcgatcgcaccctgcaatgtcccccggaacaccaggaccaaccatggggcgatcccagggcagcccgatggacccaatggttatgaagagaccccagctgtacgggatggggagcaacccacactcccagccccagcaaagttctccctatcccggagggtcttacggaccccctggaccacagcgttacccgatcggcatccagggaagaacacccggagcgatggccggaatgcaataccctcagcagcagatgccaccgcagtacggtcagcaaggtgtcagtggttattgccagcagggccagcagccctactattcccagcagccccagcctccgcatctgccccctcaagcccagtacctgccatctcaatctcagcagagataccagcctcagcaagatatgtcgcaggagggatacggaactcggtcccaacctcccttggctcctgggaagccgaatcacgaagaccttaatctaatacagcaggaaaggccttctagtttaccggacctctcaggatcaatcgacgatcttcccacaggcactgaggcaaccctgagttctgccgtatcagcatccgggtcaacgtcatcgcagggcgatcagtcaaatccggctcagagcccctttagccctcacgcctcccctcatctgtcctccattcccggaggcccaagcccttccccagtgggctctcctgtcggctcgaatcagtcaagatcgggacctatctctcctgcatctatccccggttctcagatgccgccacaaccacctgggtcacaaagcgaaagcagttcgcatccagcgttgtcgcagagccctatgccccaagagcgaggctttatggcaggcactcagcggaatccccagatggcccagtatgggcctcagcaaacaggcccttctatgtcaccccacccctccccgggaggacagatgcatgcaggcatctcctcctttcagcaatctaattcaagcggtacgtatgggccacaaatgtcccagtacgggcctcagggtaattattccagacctcccgcatattccggcgtaccttcagcttcttattctggccctggccctgggatgggcatcagcgccaacaatcagatgcacggccaggggccttcccagccatgtggagctgtgcctttaggcaggatgcccagtgctggaatgcagaacaggccctttcccggaaatatgagctctatgacccccagctctccaggtatgtctcagcagggtggccctggaatgggaccgccaatgccaaccgttaataggaaggcacaggaagcagccgctgctgtgatgcaggccgctgccaactcagcccaatctcgacagggcagcttccctgggatgaaccagtccggcttaatggcatcttcctccccctattcccagcctatgaacaatagctcatcactcatgaacacccaggcaccgccatattctatggcccctgccatggtcaattcctccgcagcatccgtcggactagctgacatgatgagtcctggggagtcaaagctccccctgcccctgaaagcggatggcaaggaggagggcacccctcagcctgagtccaagtcaaaagacagttactccagtcagggaatctctcaaccaccaactccgggaaatctcccagttcctagcccaatgagccctagttctgcctcaatctcgtcttttcacggagatgagtcggattccatatcctctcccggatggccaaagactccaagttctccaaaatcatcatccagtaccacaacgggcgaaaaaattacgaaagtttacgagctgggaaatgaaccggagaggaagctctgggttgatcggtatctaactttcatggaggaaaggggtagccccgtaagctccctgcccgctgtgggcaaaaagcccctcgacttgtttaggctgtacgtctgcgtaaaagagattggcggtctggctcaggtgaacaagaataagaaatggcgcgaacttgccactaacctcaacgtgggcacaagttcttctgctgcgagcagccttaaaaagcagtatatccagtatctttttgcctttgaatgcaaaatcgagaggggggaggaaccaccgcctgaggtttttagcaccggagacaccaaaaagcaacctaagctgcagcctccctccccggctaattccgggtcgctacaggggcctcagactcctcagtctacaggatccaactctatggcagaggtgccgggagacttgaagccgcctacgccagcaagcacacctcacggtcaaatgacacccatgcagggtggtcggtccagcaccattagcgtgcacgaccctttcagcgatgtcagcgatagctcctttcccaaacgtaattcaatgactcccaacgctccttatcagcagggaatgtctatgcctgacgtgatgggtaggatgccttacgaaccaaacaaggaccctttcgggggaatgcggaaggtccctgggtctagcgaaccttttatgactcaggggcagatgcccaattcctcaatgcaggatatgtacaaccagtctccatccggagctatgtccaatctgggcatgggtcaaaggcagcaattcccctacggcgcatcttatgaccggagacacgagccgtatggacagcagtaccccggtcagggccctccctctggccagcctccgtatgggggacaccaaccagggctgtatccccagcagcccaattataaacgccacatggatggtatgtatgggccaccagccaaaagacacgagggagacatgtataacatgcagtacagtagccagcagcaggagatgtacaaccagtatggagggagctattccgggcctgatcgcaggcctatccagggacagtatccgtatccatactcccgggaacggatgcagggccctggccagatacagacccatggtattcctcctcagatgatgggaggccctctgcagagcagctcctcggagggaccacagcaaaatatgtgggctgcacgcaacgatatgccatatccttaccaaaacaggcaggggcctggcggtccaacccaagccccaccatatcctggaatgaatagaacggatgacatgatggttcccgaccaacgcattaaccatgagagccagtggccctcacatgtatcacagagacagccttacatgagtagttctgccagcatgcagcccatcaccaggccgccacagcccagttaccagacacctccaagcctgcctaatcacatctctagggcgcctagccctgcgtccttccagagatcgctggagaataggatgtcaccgtcaaagtccccctttctgccttccatgaaaatgcagaaagtcatgcctacagtgccgacgtcacaggttacaggccctccaccgcaacctcccccaattcggagagagatcacttttcctcccggatcagttgaggcaagtcagccagtgttgaagcagcggagaaaaataacttccaaagacattgtgactcccgaggcttggcgggtgatgatgtcactgaaaagcgggttgttggcagaatcaacttgggcgttggatacaattaacatcctcctctacgacgattcgaccgttgctacgttcaacttatcacagctgagcgggtttttggaattgcttgtggagtactttagaaagtgcctaattgacatcttcggcatcctgatggaatatgaagtaggagatcccagccagaaagccctggatcacaatgctgccaggaaggacgattcacagtcccttgctgatgactcaggaaaggaggaggaagatgcagagtgcatcgacgatgatgaggaggatgaggaagatgaggaggaagactctgagaagaccgagagcgatgaaaaatcttctatcgccctgacggccccagatgccgcagctgatcctaaggaaaagcccaagcaggcctctaagtttgacaaattgcctattaagattgtgaaaaaaaacaacctgttcgtggtggacaggtctgacaaattagggcgagtgcaggaattcaattctggcttgttgcactggcagctcggcggtggcgacacaaccgagcacatccagacacacttcgagtctaagatggagatcccaccccgacgtagacctccccctccactcagtagcgctggcagaaaaaaagaacaagaagggaagggggattccgaggagcaacaagaaaagtcgattatcgctacaatcgacgatgtattgtcagccagacctggcgctcttcctgaggacgctaaccctgggccacaaacagagtcatccaaattcccatttggcattcaacaagctaagtcacatcgtaatatcaagctcctcgaggatgagccccgttctagggatgagacacccctctgcactattgctcactggcaggactcattagcgaagcgatgtatatgcgtgtctaatatcgttcgctccctatcttttgtgccaggcaacgacgccgagatgagtaagcaccctgggctcgtattgattctgggtaaactcattctcttgcatcatgaacacccagagcgaaagagggctccacagacatacgaaaaagaggaagatgaggataagggtgtggcctgctccaaggatgagtggtggtgggactgtctcgaggtgctcagggataataccctagtgaccctcgccaatatctctggacaactcgacctgagcgcgtacacggagtctatttgcctgcccattctcgacggcctgctgcattggatggtctgtcccagtgccgaggctcaagacccgttccctaccgtaggacctaacagtgtattgtccccccaacggttggttcttgaaaccctctgtaagttgtctattcaggataacaacgtagatctcatactggccacccctcccttcagccgccaggagaagttttacgccactttggtccgctacgtgggcgatcgaaagaacccagtttgccgggaaatgagcatggctcttctgagcaaccttgctcagggtgacgctctggcagccagggccattgccgtgcagaaaggaagtatcggaaacctaatttcctttctggaggacggtgtcaccatggcccagtatcagcaatcgcaacataatttgatgcatatgcaaccacccccactggaacctccttctgtggatatgatgtgcagagctgctaaggcccttctagcgatggccagggtcgacgaaaatagatccgaatttttgcttcacgagggcagactgctcgacatttctattagtgccgttttaaattctttagttgcaagcgtgatctgtgacgtattattccaaattggccaacttta

SEQ ID NO: 22427 - DNA, 822 bp, Artificial Sequence
  Description of Artificial Sequence: Synthetic coding sequence
gccgctgttatgcaggcggcagcgaactcagcacagtcccgccaggggagttttcccggaatgaatcaatcagggctgatggccagttctagcccgtacagccagcccatgaataatagctcatcattgatgaacacccaagcaccgccatactctatggcccctgcgatggttaatagtagcgccgcttccgtgggcctcgccgatatgatgtcccctggggaatcgaaattaccactgcctcttaaagctgatgggaaggaggagggtacccctcagccagaatcaaagtccaaaaagagcagttccagcaccacaacgggtgagaagatcacgaaggtctacgagttggggaatgaaccggagcgcaagctgtgggttgatcgctaccttaccttcatggaggaacggggaagcccagttagctctctccctgccgttggcaagaagcctctagaccttttccgtctgtatgtatgcgtgaaagagatcggaggtctcgcccaggtgaataaaaacaaaaagtggagggaactcgccacaaacctgaatgtcgggacttcctcatctgctgcctcctccttgaagaaacaatacatccagtatctcttcgcattcgagtgcaagatagagcgcggtgaagagccaccccctgaagttttctccacaggcgacaccaaaaagcaacctaagttgcaacctccttccccagggaaatggagacgctgcagtcactggccgagaaaagctcaggctccagggcttggaggctcgggaaaggtggtgtcgcaaagcggtcagcagggaacctgggacttttag

SEQ ID NO: 22428 - DNA, 1053 bp, Artificial Sequence
  Description of Artificial Sequence: Synthetic coding sequence
atgtctcaggagggctacggcacccgatctcaacccccacttgctccagggaaacctaaccatgaggatctgaacctcattcagcaggaacgccctagttctttgcccgttgaggtcctcgcgtcggaagacgcagcatttggactgaaggatttatcggggtctattgatgatctgcctaccggcactgaagcaaccttgagctccgccgtttccgcctccggctctacaagcagccagggcgaccaaagcaatcctgcacagtcaccattcagtcctcacgcctccccgcatctttccagcatccccggtgggcctagtccttcacccgttggcagcccggtggggtccaaccagtcgaggagcggcccaatctcacccgcatcaatacctgggtcccagatgcccccacagcctcctgggagccaatcagagtcttcctctcaccctgcgctgagtcagagtcctatgccccaggaaaggggatttatggcgggaactcaacgtaatccccaaatggcgcagtatggccctcagcagaccggaccctctatgagccctcaccctagtcccggaggccaaatgcacgccggtatctctagtttccaacaaagtaactccagcggtacctatggaccacaaatgagtcagtacggaccacagggaaactacagccgtccacccgcttactcaggcgtgcctagcgcctcttactccgggcctgggcctggaatgggtattagtgcgaataaccagatgcacggccaggggccatcccagccgtgcggagctgttcccttgggaagaatgccttctgcaggaatgcagaatcgcccatttcctggcaacatgtcttcaatgacaccctcaagcccgggtatgagccagcaaggcggtcctgggatgggtcctccaatgcctaccgtgaacagaaaggcccaggaggctgcagctgctgttatgcaagccgcagccaacagcgctcagagtcgctacgcgactcaggaacatgccccaggcagatatgcagtgtgcctgcctgtgacaacctag

SEQ ID NO: 22429 - DNA, 5507 bp, Artificial Sequence
  Description of Artificial Sequence: Synthetic coding sequence
atggccaattctacaggcaaggctccccctgacgagaggaggaaaggattggcgttcctggatgagttacgccagtttcaccattcacgcggatcgccattcaaaaagatacctgctgtggggggtaaggagctggacctacatggattgtatacccgagttactacactcggcggattcgcaaaggtctctgagaagaatcagtggggcgaaattgttgaggaattcaatttccctcgctcctgctctaacgccgcatttgcgctcaaacagtactacctccggtatttagaaaaatatgagaaagttcaccatttcggcgaagacgacgatgaggtgccacctggcaaccctaagcctcagttgcctattggcgcaatcccaagttcctataactaccaacagcatagtgtgtctgactacttgcggcaaagttacggtttgtccatggactttaacagtccgaacgattacaacaagcttgttctatcattactctccggcctgccgaacgaggtagactttgcaatcaatgtgtgtacattgctcagcaacgaaagcaaacacgttatgcaactcgaaaaagaccccaagattattaccctcctgctggcaaacgccggagtcttcgacgacacgttaggatccttttcaacagtgtttggggaggaatggaaagaaaaaaccgatcgagatttcgtgaagttttggaaagatattgtcgacgacaacgaagttcgcgacctaattagcgatcggaacaagtctcacgaaggcacgtccggggaatggatttgggagtctttattccatccgccaaggaagcttgggattaacgatatagagggccagagggtgttacagatcgccgtgattctcaggaatctgtcattcgaagagggcaacgtaaaactgctcgccgcaaacaggacttgcctgcggtttctactgctcagtgcacacagccacttcatcagccttcgtcagttaggcctggacacccttggtaatatagcggctgagcttctgcttgatccagtggattttaagacaacacacctgatgttccacaccgtcaccaagtgcttgatgtcgcgagatcgtttcctgaaaatgagaggtatggaaatcctgggcaatctgtgcaaagccgaagacaacggagtgctgatctgtgaatacgttgaccaggactcttatagagagattatctgccacctgacgctgcctgatgtcctgctggtgatcagtactttggaggtgctctacatgcttacagaaatgggcgatgtcgcctgtaccaagatcgccaaagtggagaaatccatcgacatgttggtatgtctggtgtccatggatatccagatgtttggtccagacgcccttgctgctgtgaagctaatcgagcacccctctagctcccaccagatgctgagcgaaatacgaccccaagcaattgagcaggtgcagacacagactcatgtagctagcgctccagcttctcgtgcagtggtcgcccaacatgtggctccaccacccggtatcgttgagattgatagtgagaagtttgcctgtcagtggctcaacgcccattttgaggtcaaccccgactgtagtgtgtctagggccgaaatgtattccgagtacctttcaacttgctccaagctggcacgtggcggtatcctcacatccacgggattttacaagtgtctccggactgtgtttcccaaccacaccgtgaaaagagtcgaggattcaagctccaacggacaggcacacatccacgtcgtgggagtgaaacgcagggccatccccctgcccattcagatgtactatcaacagcagcccgtgagtacctccgtggtgcgggtggattcagtgcccgatgtctccccagcgcctagccctgctggcatcccgcatggatcacagaccataggaaatcacttccagcgtacaccagtggccaaccagagctcaaatctgactgcaacccagatgtcattcccagtgcaaggggtccatacggtggcccagacagtatctaggatccctcaaaatccctctccccatactcaccagcagcagaatgcaccagtgaccgtcatacagtccaaggcccctatcccatgtgaggtggtaaaggctacagtgatacagaactctatcccgcaaactggagtacctgtcagtattgctgtcggcggaggacctccccagtccagtgtcgttcagaatcactccacgggccctcagccagtcactgtagttaatagtcagacattgttgcatcatccttccgtgatcccacaacagagcccactgcacaccgtcgtgcccggtcagattcccagcggtactcccgtgaccgtaatccagcaggctgtgccccagtcccacatgttcggaagagtgcaaaatatccctgcttgtacatcgactgtgtcgcagggccagcagctgattaccacctccccccagcccgtgcagacgagcagccagcagacgtccgccggatcgcagagccaggatacagtgattattgcgcctcctcagtacgtaacaactagcgcaagcaatattgtgtcagctacatccgtccagaacttccaggtggcaaccggtcagatggtcacaattgctggggtgccctctcctcaggctagccgcgtcggatttcagaatatagccccaaagcctctgccatcccaacaggtgagctcgaccgtcgtgcagcagcctattcagcagcctcagcaacccacacagcaaagcgtggtgatcgtcagtcaacctgcgcagcaggggcagacatatgcgcctgcaattcaccagatagtgctcgctaatcccgcagctctcccggctgggcagacagtgcagctgaccgggcagcctaatatcactccgtcctccagtccttcacctgtaccggcaaccaataaccaggtgcctaccgcgatgtcctcatctagcaccccacaaagccagggcccaccaccaacagtaagccagatgctaagtgtcaagcgccagcagcaacaacagcactcacccgctccgcctccgcaacaagtacaggtacaggtacaacaaccacaacaagtgcaaatgcaagttcagcctcagcagtcgaacgctggcgttggacagccggcatccggcgagtccagtcttatcaaacaattactgctgcccaagcgcggaccgtccacaccaggaggaaaactaatactgcccgctcctcaaattcctccaccaaacaatgcacgagccccttcccctcaggtggtttatcaggtggccagtaatcaggctgccggattcggagtccagggccagacacccgctcagcagctgttagtcggtcagcagaacgttcaactggtaccgagcgcaatgcccccatccgggggagtacagacggttccgatttcaaacttgcagattctgcccggtcctctcatctctaactcacccgctacaatcttccagggaacatccggcaatcaggttactattactgtagtaccaaacacgtccttcgcaccagccacggtctctcagggaaacgcaacacaactcatcgcgccagcaggtataacaatgtcaggtacgcagacgggagttggcctgccagtgcagaccttacccgctacccaggcttccccagccggacagagttcgtgcactacagccacgcctccttttaaaggcgacaagataatttgccagaaagaagaagaggcaaaggaagccacagggttgcacgtacatgaaaggaagatagaagtgatggagaatccatcctgcaggagaggtgcaaccaacacctcaaacggtgatacaaaagagaatgaaatgcacgtcggcagcctgctgaatgggagaaagtactctgacagtagcctgcctccatcaaattcaggaaagattcaaagtgaaacgaatcagtgtagcctgatcagcaatggtcctagcctcgagctcggggagaacggagcatctggcaagcagaatagcgaacagattgatatgcaggatatcaagagtgacctgcggaagcccctggtgaatggcatttgcgatttcgacaagggtgacggctcacacctctccaagaatatcccaaaccataagacaagcaaccatgtggggaatggtgaaatttcacccatggagccacaggggaccctggatattacacagcaggacactgctaagggtgatcagcttgagcggattagcaatggaccggtgttgacactcgggggttcatcagtcagctcaatccaggaggccagcaatgccgcaacacagcagttttctggcactgatctgctgaatgggccactagccagtagcttgaacagcgacgtgcctcagcaacgaccgagtgtcgtggtgagccctcattcgactactagcgtgatccaagggcaccagatcattgccgtgccagactccggctccaaagtttcacacagccctgccctgtccagcgatgtgagatcgacgaatgggaccgctgaatgtaaaacggttaaaagaccagcggaggatacagatcgagagacggtcgctgggatccccaataaggtgggagtgagaatagtgacgatctccgatcccaacaatgcaggttgcagtgcgacgatggtcgccgtgcctgctggggctgatcccagtaccgtggcaaaggtggccattgaaagcgcggtgcaacaaaagcagcagcacccgccaacctacgtccagaatgtggtcccccaaaatacacctatgcctccctcgccagcagtgcaggtgcaggggcaacccaactcttctcagccaagcccctttagcggctcatcacagcccggagaccccatgcgcaagccaggccagaactttatgtgtctctggcaaagttgtaaaaagtggttccagacaccctcccaggttttctaccatgccgcaactgagcacggcggtaaggatgtgtacccgggacagtgtctatgggaaggctgcgaaccttttcagaggcaacggttcagttttatcacgcacctgcaggataagcactgtagtaaagatgcccttctggcagggctcaaacaggatgaacctggccaggctgggtctcaaaaatccagcactaaacagccaaccgtcggaggaacatcctccacgcctagagcgcagaaggccatcgtcaatcacccgagcgcagcccttatggcacttaggcgtggtagtcgtaatctcgtgttccgggactttacagacgagaaagagggcccaattaccaagcacataagactaacggcggcactcatcctgaaaaacataggaaagtattctgagtgcggcagacggctcctgaagcggcacgagaacaatctgtcggtccttgccataagtaatatggaggcttcttccacattggcaaaatgcctatacgaacttaactttacagttcagtctaaggagcaggagaaggactccgaaatgttacaata

SEQ ID NO: 22430 - DNA, 2859 bp, Artificial Sequence
  Description of Artificial Sequence: Synthetic coding sequence
atgatgatgcgctaccaccaagctattcagagtcactcattcctgctcgtgcagttccaccttccgaccatcacatcgaacaccgtttgcagaatcatctgtgtcaaggtcatgggctgcccgtggacattaatcagacaaatgatcataattaattggtgttttcattgttatttggattcgcagatgaagtggacccttttgctcacttacgctctcagctaccagatgaaggcctctacctcttgcaatctgaaaaagatacttaagagcagtccagtgcctgccaccaacaatcaggttcctacagctatgtcctcaagttctaccccccaatctcagggtcctcccccaaccgtttctcagatgttatccgttaagcgacaacagcagcaacagcattcccctgcccctccgccacagcaggtgcaggtgcaagtgcaacaaccgcagcaggtgcagatgcaggtccagccccagcagtcaaacgccggagtaggtcagcccgcttcgggagaatcgtcactcatcaagcaacttctactgcctaagcgcggaccctcaacccctggcggaaagctcattcttccagctccgcagatccctcccccaaataatgcacgagctcccagcccgcaggtcgtgtaccaagttgcttccaaccaagcggcagggtttggcgtccagggccaaacgcccgctcagcaattgctcgtaggccagcagaatgttcagctggtcccatccgctatgcccccttctggcggtgtgcagaccgtgcccatttctaatctacaaatactcccgggtcctttgataagcaattcccccgctaccattttccaggggacctcaggcaatcaagtcactattacagtcgtccccaacacctcctttgcgcctgccacggtctcacagggaaacgctactcagctgatagccccagccggaattacaatgtctggcacccagaccggcgtcggactgcccgttcagactcttccagccacccaggcgtcccctgctggtcaaagctcttgcaccacagctaccccaccatttaaaggtgacaaaattatttgtcaaaaagaagaagaggccaaggaggcgacaggacttcatgttcacgaaaggaagattgaggttatggaaaatccttcctgccggagaggggctactaataccagtaatggggacacaaaggaaaacgagatgcatgttggttctctgctcaatggtcgcaagtattctgattcttctcttcccccaagcaactccggcaagatccagagcgagaccaatcaatgctctctgattagcaatggtccgagcctggaactgggggaaaacggagcctctggaaaacagaactctgagcagattgatatgcaggatattaagagtgatctaagaaaaccgctggtgaacggtatttgcgattttgataaaggtgacggcagtcatctgagtaaaaacatacctaaccacaaaacttctaaccacgtgggaaacggtgagatcagtcctatggaaccgcaaggaactctggacatcacacaacaagacacggccaagggcgaccagctcgaaagaatcagtaatggccctgtgttgacattggggggatcctctgtatccagcatacaggaagcctccaatgccgctacacagcagttctccggcaccgacctcctcaacggtccactggcatcatccctgaatagcgatgtgccacagcagcgccctagcgtagtcgtttcgccgcacagcaccacatcagtgatccagggccatcagatcatcgcggtgcctgatagcggaagcaaggtcagccattcccccgctctgtcatcggatgtgagatctacaaatggcaccgccgagtgcaagacagtgaaacggcctgccgaggacaccgatcgggaaactgtggccggaatcccaaacaaggtgggggtgaggatcgtgactatttctgacccaaataatgcaggctgtagcgccaccatggtcgccgtccctgctggagccgaccctagtacagtcgcaaaggtggccatcgaatcagccgtccagcagaagcagcagcatccaccgacatacgtgcaaaacgtggtgccccagaacacgcctatgcccccatcaccagctgtgcaggtgcaaggccagcccaactcctcacagccttctccgttctctgggtcctcgcagcctggtgatcccatgaggaagccagggcaaaacttcatgtgcctgtggcaatcatgcaaaaagtggttccagacgccatcgcaagtgttttaccacgccgctaccgagcacggcggaaaggatgtgtaccccggacagtgtctgtgggaagggtgcgagccgtttcaacggcagaggttttcctttatcacccacctacaagacaaacattgtagcaaagatgccttattagctggcctgaagcaagatgagcccggtcaggctgggagccagaagagcagcactaagcagccaacggtaggcggaacaagcagtaccccaagagcccagaaggccatagtgaaccatccctctgctgctctgatggcactgagaaggggaagtcgcaatctcgtgttccgagattttacggacgaaaaggaaggtcccatcactaagcacattcgattgacagctgctcttattctgaaaaacatcggcaaatactctgagtgtgggaggaggctcttgaagaggcatgagaacaatctctccgtcctagccataagcaatatggaggccagtagcaccttagccaagtgcctgtacgaacttaactttaccgtgcagtccaaggaacaagagaaggactctgaaatgctacagtag

SEQ ID NO: 22431 - DNA, 4338 bp, Artificial Sequence
  Description of Artificial Sequence: Synthetic coding sequence
atgagggggatggaaatcctcgggaatctctgtaaggcggaggacaatggagtgttgatctgcgagtatgtggaccaggacagttacagagagataatatgtcacctgacgctgccggatgtgctgttggtgataagcacactagaggtgctgtacatgctcacagagatgggtgacgtggcatgtaccaaaattgcgaaggtggagaagtcaatcgccgctgttaagttaatcgaacatccgtcctccagtcaccagatgctgagtgagattcggccacaggcaattgagcaggtccagacacaaacccacgtcgccagcgcaccagcctccagggctgtcgtggcccagcacgtagccccaccgcctgggatcgtggaaatcgatagcgagaaatttgcatgccagtggttaaatgcccatttcgaagtcaaccctgactgtagcgtttcaagggcagagatgtatagtgagtatctctcaacttgtagtaagctggccaggggcggaattcttacatccacggggttttacaaatgcctgcggactgtgtttccaaaccacaccgtcaagcgcgtggaggactcgagctcaaatggtcaggcccatattcacgtcgtcggagttaaacggagagccattcccctgcccattcagatgtactaccagcagcaaccagtgagtaccagtgtggtgcgtgtagattctgttcccgatgtgtcgccagccccatctccagccggtatcccacacggttcccagaccataggaaaccacttccagaggacaccagtggcaaatcagagcagtaacctgacagcaacacagatgtccttccctgtgcagggggtgcacaccgtcgcacagaccgtgagccgcatacctcagaatccttcacctcacactcaccagcaacaaaatgcgccagttacagtcatccagtctaaggccccaattccttgtgaagtggtcaaggcaaccgtgattcagaattctatccctcaaaccggagtccccgtctcaatagcagtcggcggtggccctcctcagtcgtcggtggtgcaaaatcactccacaggccctcaacccgtgactgtggtcaatagtcaaaccttgctgcaccacccctctgtgatcccccaacaatctccactgcatacagtggtcccgggacagatcccctctgggacccctgtgactgtaatccaacaggcggtccctcaatcacatatgtttggcagagtgcagaacataccagcctgcaccagtacggtttcgcagggacagcagctgataaccacatcacctcaacccgttcaaacctcttcccagcagacgtctgccggttcccagtcccaggatacagttatcatagctcctccgcagtatgtgacaacatcagcaagtaatatcgtaagcgccactagcgtacagaactttcaggtggcaacagggcaaatggtgaccattgcgggtgtgccaagcccacaagcttcgagagtgggattccagaacattgctccaaaacccctgcccagccagcaggttagtagcaccgtggttcagcagcctatccaacagccccagcagccgacacagcagtccgttgtgattgtgtcccaacctgcccagcaaggccagacctacgcaccggctatccaccagatcgtgctggctaatcccgctgccctccctgcaggacagaccgttcagctcactgggcagcctaacatcacccctagttcctctccatcccccgtgccagccacaaataaccaggtgcctactgcaatgtctagttccagtacaccccagtcgcagggccctccacccacagtgagtcagatgctgtctgtcaagaggcagcagcaacagcagcactctccagctcctcctcctcagcaggtccaggttcaagtacagcagcctcagcaggtccagatgcaggtgcagcctcagcaatccaacgcgggagtgggccaacccgcaagtggggagtcctcattaattaagcaactcttgttgccaaagagaggcccttctactcccggaggcaaactgatattgcccgcaccccaaattccacctccaaacaacgcccgagcaccctcaccccaggtagtatatcaagtggcgagcaaccaagctgcaggttttggggtgcaagggcagactcccgcacaacagctgttggtcggacaacaaaacgttcagttagtgccttctgctatgccaccttcaggaggagtgcagactgtacccatcagcaacttgcaaattttgcccggacccctaatttccaatagccccgcaacgattttccagggtaccagcggaaatcaggttaccattacagtcgtgcccaacacaagcttcgcccctgccaccgtgtctcagggaaacgcaacacaactaatcgcaccggctggcattaccatgtccggaacccagacgggggtcggtttacccgtacagaccctgcccgctacccaagccagtcccgcagggcagtcatcttgtaccacagcaacaccccctttcaagggggataaaatcatatgccaaaaagaggaggaagccaaagaagcaactggtctgcacgttcacgaaagaaagatcgaggtcatggaaaacccttcatgtcggcgtggtgccacaaacacgagcaatggggacaccaaggagaacgagatgcacgtgggaagccttcttaatggaaggaagtactcagactccagtctgcctccttctaactctggaaagatccagagtgagacaaaccagtgttcgctcattagcaatggtccatctttggaactgggtgaaaatggggctagtggaaagcagaatagcgaacagatagatatgcaagatattaagtctgatttaagaaagccactcgtgaatggaatctgtgacttcgacaaaggcgacggctctcacttgagcaaaaacatcccgaaccataagacgagcaaccatgtcggcaatggcgagatctcccccatggagccccagggaacattggacattacccagcaggataccgctaaaggagatcagctcgaacgcatcagcaatggccctgttctgacactgggagggagttctgtgtcatccatccaggaggcaagcaacgccgcaacacagcaattttctgggactgacttgttaaatggtccactggcatcaagtctgaactccgacgtgccccagcagcgcccttccgtcgtagtaagtcctcacagcactacttccgttatccaaggacatcagatcattgcggtgccagactccggttcaaaggtatcacattctcccgcattgtcatccgacgtgaggagtactaacggtacagctgaatgcaaaacagttaaacgacctgccgaggacaccgaccgcgaaactgttgccggaatcccaaataaagtgggcgtgcggatcgtcacaatctccgatcctaataatgcaggctgctcagccaccatggttgcggtgcccgcaggggctgatccgtccaccgttgctaaggtggcaatcgagtcggccgtccaacagaaacagcagcaccctcccacttacgtccagaatgtcgttccccaaaatacgcccatgcctccatccccagccgtccaggtacagggccagcctaatagttctcagccgagccctttttccgggtctagccagcctggggatccaatgcggaagcctgggcagaactttatgtgtctgtggcagtcatgcaagaagtggttccaaacgccatcccaggtgttttaccatgcggctaccgaacacggcggaaaggacgtttatcccggacagtgcttgtgggaaggctgtgaaccattccagagacagcggttctcctttatcacacaccttcaggacaagcattgctcgaaggatgctctgctggcaggactcaagcaggacgagcctggccaggctggtagtcagaagtcatctactaagcagcctacagtcggaggaacctcttccactccgagggcccagaaggcgatcgtgaatcacccctccgctgccctgatggcattgcgccgtggctcacgaaatctcgtattccgcgactttaccgatgagaaagaggggcctatcaccaagcacattcgccttacagccgcattgatcctgaagaacatcggaaagtactctgagtgcggaagaagactcttaaagcgacacgaaaataacctgtctgttctggcaatctctaacatggaggcctcctctacccttgcaaagtgtttgtacgagttgaacttcactgtgcagtctaaggagcaggagaaggactctgagatgctacagtag

SEQ ID NO: 22432 - DNA, 2859 bp, Artificial Sequence
  Description of Artificial Sequence: Synthetic coding sequence
atgatgatgcggtatcatcaggccatccagagtcactctttcttgcttgtgcagtttcatctgcctaccatcacctcaaacacagtgtgccgaatcatctgcgttaaggtgatggggtgcccgtggaccttaattaggcagatgatcatcatcaactggtgctttcactgctatctggattcacagatgaagtggacactgctactgacgtacgcgctgtcctaccagatgaaggcctcaacaagctgcaacttgaaaaagattctaaaatcttctcctgtcccagcaactaacaaccaagtgcccaccgccatgtcctcttcatccaccccacaatcacaggggccacctcctactgtgagccagatgctgtctgtgaagcgtcagcagcaacaacagcacagtcccgctccccctccccagcaggtgcaagtccaggtgcaacagccccagcaagtgcagatgcaggtgcagcctcagcagtcaaatgctggcgtagggcagcccgcatcaggagaatcaagcctgattaaacagcttctgttaccaaagagaggaccaagcactcctggtgggaagctgattctccccgcacctcagattcccccacctaataacgcccgagcaccctcccctcaggtggtttatcaggtagcatctaaccaggcagctgggtttggtgtgcaggggcagacaccagctcagcaactgttggtcggccagcagaacgtccagctggtcccgagcgcaatgcccccttcgggcggtgtacagacagtgccaatttccaatttgcagattttgcccggacctttgataagcaattctccagctaccatcttccaggggacctcaggtaaccaggtcacgattaccgtcgtgccaaacaccagtttcgcgcctgcgactgtgtcacaggggaacgccacccagcttatcgctcccgcaggcatcaccatgtctggcacccagaccggagttgggctacctgtccagaccttgccagccactcaggcttctccggcaggacagtcttcttgtaccactgcaaccccaccatttaaaggcgacaagattatttgccaaaaggaggaagaagccaaggaagccactgggctccatgtccacgagagaaagatcgaggtgatggagaaccctagttgccggaggggcgcaaccaatacttccaatggtgacacaaaagaaaatgaaatgcacgtgggctccctgttgaatggacgtaagtattccgacagcagtttaccaccatctaactccggaaaaattcagagcgagacaaaccagtgctctttgatcagtaacgggccatctcttgaattaggggaaaacggcgcaagtggaaagcaaaacagtgagcaaattgacatgcaggatatcaagtccgacttgcgcaagccccttgtcaacggtatttgcgatttcgacaagggagacggtagtcatctgtccaagaatattcccaatcacaagacaagtaatcacgtgggcaatggcgagatcagcccaatggaaccccaggggacactagatatcacgcagcaagacaccgccaagggcgatcagctggaaagaataagcaatggccctgtgttgaccctcggtggcagtagtgtctccagcatccaggaggcttccaacgcagctacacagcaattctcaggcaccgatttactgaacggacccctcgcatcttcactcaactcagatgtgccgcagcaacgcccttcagtggtagtcagtccacatagcaccacctccgtcatacaggggcaccagatcatcgcagtcccggatagcgggtccaaagtctcccatagtcccgcactcagttctgatgtcagaagcactaatgggaccgcagaatgtaagacagtgaagaggcctgccgaagacacagatagagaaactgtagcaggaatccctaataaggtgggggtgcggatcgttacaatctcagatcctaataacgctgggtgttctgccaccatggtcgctgtgcctgcaggcgctgatcctagcactgtagctaaggttgccattgagtctgctgttcagcagaagcagcagcacccccctacttacgtccaaaacgtagttccacagaatacacctatgccaccttcacctgccgtgcaggtccaaggccagcctaactcttcccagcctagtccctttagcggctcctcacagcccggagaccccatgaggaaacccggacaaaactttatgtgcttatggcagagttgtaaaaagtggtttcaaaccccatcccaggtgttttatcatgcagcaaccgagcatggagggaaagatgtgtatcccggtcaatgtctgtgggagggctgtgagccctttcaaaggcagagattcagctttattactcatctgcaggacaagcactgtagtaaggatgccctgcttgccggtttgaagcaagacgagccgggacaggcagggagccagaagagctctactaagcagccaacagtggggggaacctcgagcactcctagggcacaaaaagcaatcgtaaatcacccttccgcggcactcatggcattgcgacgcggttccaggaatcttgtgttccgcgactttaccgacgagaaggagggaccaataacgaagcatattcggctcactgctgccctgattctgaaaaatataggcaagtattccgaatgtgggagacggctattgaagcggcacgagaacaatctctctgtgttggcgatatccaacatggaagcctcctccaccctggccaagtgcctatacgagctgaacttcaccgtgcagtctaaggagcaagagaaggatagcgaaatgctgcagtag

SEQ ID NO: 22433 - DNA, 1044 bp, Artificial Sequence
  Description of Artificial Sequence: Synthetic coding sequence
atgaagatggaagagatgtcactgagcggtctggataacagtaagctagaggccatcgctcaggagatctacgccgatctcgtggaggattcttgtctcggattctgcttcgaggtgcatagggccgttaagtgcggatacttttttctggacgacactgatcccgattcgatgaaagactttgaaatcgtagatcagcctggactggatatttttggccaggttttcaatcagtggaaatccaaggaatgtgtctgtcccaattgctcaaggagtatagccgcttcgaggtttgccccacacctggagaaatgtctgggaatgggccgtaattcctcgcgcatcgccaaccggcgaattgccaacagtaacaacatgaataaaagtgaatcggaccaggaagacaatgatgatatcaacgataacgactggagctacgggtcggagaaaaaggccaagaagaggaagtcagacaagaaccccaacagcccaagacgttccaagtccttgaagcacaaaaatggtgaactcagtaacagcgatccttttaagtacaacaatagtaccggaatatcctatgaaacccttggcccagaggagctgcgctccctgctgactacccagtgtggggtgataagcgagcacacaaaaaaaatgtgtacccgcagcttgcggtgcccacaacatacagatgagcaacggaggacagtaaggatttactttctcggcccttctgcagtactcccagaggtggaatctagtctggacaacgattcctttgacatgaccgattcccaggctctaatctctaggcttcaatgggatggaagttctgacctcagccctagcgacagcggcagcagcaagacatccgaaaatcagggttgggggttaggaacaaacagcagtgagagccgaaagacaaaaaagaagaaaagtcacctctccctcgtgggaactgcctccggacttggcagtaataagaagaagaaacccaagccgccagcaccaccgaccccaagtatctatgacgacatcaattag

SEQ ID NO: 22434 - DNA, 1065 bp, Artificial Sequence
  Description of Artificial Sequence: Synthetic coding sequence
atgaagatggaggagatgtccctgtccggcctcgacaattctaagttagaagcaattgcccaggagatttacgccgatcttgtggaagacagctgtctaggcttctgtttcgaagtacacagagctgttaagtgcggctacttcttcttagatgacactgatccagatagtatgaaggactttgagatcgttgatcaacccggtctcgacattttcggtcaggttttcaatcaatggaagtccaaggagtgtgtgtgtccgaactgctcaaggtccatcgccgcttcccggtttgctccacacttggagaaatgtctgggcatgggtaggaacagtagcagaatcgccaacaggcgcatcgctaatagcaataatatgaacaagtccgaatcagaccaggaggacaacgacgatattaacgacaatgactggagttacggctctgaaaaaaaagccaagaaacggaagagcgataaactgtggtacctccccttccagaaccctaattccccaaggcggagtaagtcactgaagcacaagaatggcgagttgagtaactccgacccttttaagtataataactccaccggaatcagttacgagactctgggccctgaagagctgagatcgcttcttaccactcagtgcggcgtgataagcgagcacacgaagaagatgtgcacacggagcctgaggtgcccccagcacactgatgagcagcgcagaacagtgaggatttattttcttggaccaagcgctgtgctgcctgaggtcgaatcatcactggacaatgactctttcgatatgactgacagccaggccctgataagccggcttcagtgggacggatcttcagatttgtcaccatctgatagcggcagcagtaagacttcagaaaaccagggatgggggttgggcacgaactctagcgagtcccgaaagaccaaaaagaaaaaatcccacctgtcgctggtcggtacggcatcaggacttggtagcaacaaaaagaagaagcccaaaccaccagctccccctaccccttctatttatgatgacatcaactag

SEQ ID NO: 22435 - DNA, 390 bp, Artificial Sequence
  Description of Artificial Sequence: Synthetic coding sequence
atgtgcacccgctccttaagatgccctcaacatacggacgaacaaagacgcacagtgagaatttacttcctcggcccaagtgccgttttgccggaggtcgagtcaagtctggacaacgactcatttgatatgaccgacagccaggccttgatttcgcggcttcagtgggatgggtcgagcgacctgtctccctctgactccgggagcagtaaaactagcgaaaaccagggatggggtctgggcaccaactcaagcgagagtagaaagacgaaaaaaaaaaaaagccatctctcattggtcggaaccgcatccggccttggatctaataagaagaaaaagcccaaacctcccgcaccacccaccccaagcatttatgacgatatcaactag

SEQ ID NO: 22436 - DNA, 5031 bp, Artificial Sequence
  Description of Artificial Sequence: Synthetic coding sequence
atggggttactggggattttatgtttcctcatatttctggggaaaacttggggccaggagcagacctatgttatctcagctccaaagattttcagagttggagcaagtgagaatattgtgatccaggtctatggttacacggaagcttttgacgctactatttccatcaagagctatccggacaagaaattctcttactcatcaggccatgtacacctttcctctgagaacaaattccagaactctgctattcttaccattcaacctaagcagctccccggtggacagaaccccgtttcgtatgtgtatctcgaagttgtgagcaaacacttcagcaagtcaaaaagaatgcccattacttacgataatggatttctgtttattcacacagataaacctgtctacactcctgatcagagcgtgaaagtgagagtctactccctgaacgatgacctcaagcccgctaagagagagaccgtcctgacctttatcgacccagagggcagcgaggtggacatggtcgaagaaatcgaccatattggcataatctcgttcccggatttcaagataccctctaatcccaggtatggaatgtggacaattaaggccaaatacaaggaggatttttccaccactggaactgcatactttgaagtcaaagagtacgtactcccacacttcagcgtctccattgagcctgagtacaatttcataggttacaagaactttaaaaatttcgagatcaccataaaggcgcgatacttctacaacaaggtagttactgaagcagacgtgtacattacattcggcattcgggaagacctgaaagatgatcagaaagagatgatgcaaaccgccatgcagaacaccatgctgataaatggaattgcccaggtgacttttgactccgaaaccgctgtcaaagaactctcttattattcactggaggacctgaataataagtatctctatatcgccgtgacagtgatcgagtcaactggtggtttctcggaagaggcagagattccagggatcaaatatgttctgagcccctataagctgaacttagtggcaactcccctgttcctgaagcctggcatcccttatcctattaaggtccaagtgaaggattccctggaccagctggtggggggagtcccagttactcttaatgcacagactatagatgtgaaccaagagacctcggacctcgacccaagcaagagtgttaccagggtggatgatggtgtggcatcatttgtacttaatctaccatccggcgtgacagtccttgagttcaatgtgaaaaccgacgccccagacctgccagaggagaaccaggccagagaaggttatcgggctatcgcttactcctcactgtcacagagctacttgtatatcgactggactgataaccataaagccctcctcgtaggcgagcacctaaatatcatcgtcacacctaagagtccctatatagataaaataacacattacaattatctcattctctccaaaggcaagatcatccacttcggcacaagagagaaattttctgacgcctcatatcagagcataaatatccccgtgacgcagaacatggttccttcgtcccgactgctcgtgtattatatcgtgacaggagaacagaccgctgagctggtaagcgactccgtttggctgaacatcgaggaaaagtgtggcaatcagttgcaggttcacttgagtccggatgcagacgcatactctcccggacaaactgttagcctcaacatggccacgggaatggactcatgggtcgccctggctgcggtagattctgccgtgtatggagtacaaagaggtgccaagaagccccttgaaagggtgtttcaatttctggaaaagtctgacttaggatgcggggcaggcggtggtttgaacaacgccaacgtctttcacctggcaggacttacatttctgaccaatgctaacgccgacgacagtcaagaaaacgacgagccctgtaaggagattctcagaccaagaagaaccctacagaagaaaattgaggaaatagcggctaaatataagcattcggtggtcaaaaaatgttgctacgatggcgcttgtgttaataatgacgagacctgcgaacagcgtgccgcaaggatctcactggggcctcggtgtattaaagcattcacagaatgctgtgtagttgccagtcagcttcgagccaacatctcacacaaggacatgcagctcggtaggctgcacatgaaaaccctactgccagtgagtaagccggagattcgctcctactttccagagagctggctatgggaagttcaccttgtgccacgcagaaagcaactgcagttcgcactgcctgattcactcaccacttgggaaatccagggagtgggcataagcaataccgggatctgcgtggctgataccgttaaggcgaaggtgtttaaagatgtgttcctggagatgaatatcccctacagcgtggtacgcggtgagcaaatacagctcaaagggacagtttacaattacagaacaagcggaatgcagttctgcgtcaagatgtccgcggttgaaggcatttgtacttcggagagccccgtgattgatcatcagggaaccaagtcgtcgaaatgcgtccgccagaaggtggaaggttcctcttcccacctcgtaacgttcaccgtacttcccctggaaattggtctgcataacatcaacttcagtctggaaacttggttcggaaaggagattttagtgaaaaccttacgggtcgtgccagaaggggttaaacgggaatcatactctggagttacactcgatccacgagggatttacggcactatcagtaggaggaaagaatttccttaccgaatccctcttgacttggtgcccaaaacggagataaaacggattctgtcagtaaaggggttgctcgtgggggagattttgtcggctgttctctcgcaggaggggatcaatattctcactcaccttccaaagggcagcgccgaggcagaactcatgtcggtggtgccggtattttacgtctttcactacctggaaaccggtaaccactggaacatctttcattctgaccctctcatcgagaagcagaagctgaaaaaaaagcttaaagagggcatgctgtcgataatgtcctatcggaatgccgattacagctacagcgtgtggaagggaggcagcgctagtacctggctcaccgctttcgccttacgggtgctgggccaggtcaacaaatatgttgaacagaaccagaactctatctgcaatagtttattgtggctcgtggaaaattaccaattggacaatggctcgtttaaggaaaattcccagtatcaaccaattaaacttcaaggtacccttccagtggaagcacgggaaaattccttgtacctgacagcattcaccgttattgggatacgcaaagcatttgacatatgcccattagtaaagattgataccgccctgattaaggctgataacttcctacttgaaaacaccctgcctgcccaatccaccttcacactcgcaattagcgcctacgctctctctctgggcgacaaaactcacccacagtttcgcagcatcgtgtccgctttgaaacgcgaagcacttgtgaaaggcaacccaccaatctatcgcttctggaaagacaacctgcaacataaagattcgagtgtgcccaataccggtactgccaggatggttgaaacgactgcatacgcccttttgactagtctcaatttaaaggatataaattacgtcaatcccgtcattaagtggcttagcgaggagcagcgctatggcggtgggttctacagcactcaggacactatcaatgctatcgagggactcactgaatactccttgctcgtcaaacagctcagactgtccatggacatcgatgtatcctacaagcacaaaggagctcttcataattataagatgaccgataaaaatttcctggggagaccggtcgaagtgctgcttaacgatgatttaattgtgagtaccgggttcggcagtggcttagccacagtccacgttaccacagtagtgcacaaaacgtccacttctgaagaggtatgttctttttatcttaaaattgatacccaggacatcgaagcctcccactatcgaggctacggaaacagcgattacaaaagaattgtagcctgtgcctcatacaagccatcacgggaagaatcgagtagcggatcatcgcacgccgtgatggatatcagtctaccaacaggcatcagcgcgaacgaagaagacctcaaggctctagtcgagggcgtcgatcagctgttcaccgactaccagattaaagacgggcatgttatcctgcagcttaatagtatcccctccagtgatttcttgtgcgtgaggttccgcatctttgagttgttcgaggtgggtttcctctctcccgcaactttcaccgtttatgagtatcatcgccctgacaagcagtgcaccatgttctattctaccagcaacataaaaattcaaaaggtgtgcgagggcgcagcctgtaagtgcgtcgaagctgactgtggccagatgcaggaagaattggacctgacaatctccgctgagaccaggaagcaaaccgcttgcaagccggagatcgcgtacgcctataaagtgagcattacctcaattactgttgaaaacgtgtttgtcaaatataaagccaccttactagacatttacaagactggtgaagcggttgccgaaaaggacagcgagatcacctttattaaaaaggtgacttgcactaatgctgaactggtgaagggcaggcagtatctgatcatgggaaaggaggccctacagattaagtataatttctctttccggtacatttatcctttagattcactgacctggatcgagtactggccacgcgacaccacttgtagcagttgtcaggccttcctggcgaatttggatgagttcgcggaagatatctttctgaatggctgttag

SEQ ID NO: 22437 - DNA, 4320 bp, Artificial Sequence
  Description of Artificial Sequence: Synthetic coding sequence
atggcctcatcggaaactgagatccgatgggccgaacctggtttgggcaagggtccccaacgcaggcggtgggcctgggctgaggacaaacgagacgtcgacagatctagctctcagagttgggaggaagaaaggctcttccccaacgccacaagccccgaactcctggaagatttccgacttgcccagcagcatctgcccccattggaatgggatccgcatcctcaaccagatggtcatcaggactctgagtcaggagaaacctcaggagaggaagctgaagcagaagatgttgactcccctgcctctagtcacgagccgttggcctggctccctcagcagggcaggcagctggatatgaccgaggaggaacccgatggtacgttaggatcgctagaggtggaggaggccggagagagttcctctcggctcggctatgaagctggcttatccctggaaggacatggcaacaccagtcccatggccctggggcacggccaggctaggggctgggtggcttctggagaacaggcctcgggagataagctgtccgaacacagcgaagtgaaccctagcgtcgaactgtcccccgctagaagctggtcgtctggtacagtgtccctggatcacccctcggattcactcgatagcacatgggagggggaaacagatggaccacagcctacggcgctggctgagaccctgccggagggacctagtcatcatctgctaagtccagatggcagaactggaggaagcgtcgctcgggctacaccgatggagtttcaagacagcagcgctccgcctgcccaaagccctcaacatgcgacggacagatggcgtagagagactactagattcttctgtcctcaacctaaagagcacatctggaaacagacaaagacttcccccaagcctcttccatctagattcatcgggagcataagtcctttgaacccacagcctcggccaacaaggcaggggagaccacttccaagacagggcgctacactggccggacgctcatcatccaatgcacccaaatacgggcgaggacagctgaactaccccttacccgacttctctaaagtgggaccccgtgtgagatttccaaaagacgagagttataggcctcctaagtcaagaagtcataatcgaaaaccacaggccccagccagaccgctgatctttaagagccctgctgaaatagtgcaggaagtgctcctgtccagtggcgaggccgcactggccaaggatacaccacccgctcaccctatcactagggttccacaagagtttcaaacaccagaacaggcaaccgaactggtacaccagttacaagaggattaccataggctcctgactaagtatgctgaggccgaaaacaccattgaccaactccggctcggcgctaaggtaaacttgttctccgatccccctcagcctaaccactccatacacacggggatggtcccacagggtactaaggtcctcagttttaccattccccagccccgttcggctgaatggtggccaggcccagccgaggatcctcaagcctctgcagcctcagggtggccttctgcacgaggagatctgtccccctcttccctcacttcaatgccaacacttggatggctgcccgagaaccgcgatatctcagaagatcagtcgtctgccgaacagacacaggcgctggcatctcaggccagccaatttctagcaaaggtggagtcatttgaacggcttatccaggccggacgccttatgccccaggatcaagtgaaaggtttccagcgcctcaaggcagcccacgcagcattggaggaagagtatctgaaagcgtgtagagaacaacaccctgcccagcctctggctggctccaaaggaaccccagggaggttcgaccctcgtcgcgaattagaagcggagatttaccgactcggttcctgcttagaagaactgaaggagcatatcgatcaaacccagcaggagcctgagcctccgggatcagattccgccctggactcaacacctgcgttaccgtgcttgcatcagccaactcatctccccgcaccttcaggccaagcaccaatgcctgccattaagaccagctgtcccgaacctgcaactacgaccgcggcagcatccacaggcccatgtcccctgcacgtgaatgtggaggttagctccggtaactccgaggtggaggataggcctcaggatcctctggcacgactgagacacaaggaattgcagatggagcaagtgtatcacgggctgatggaacggtacctgagtgtaaagtctctgccagaggccatgagaatggaagaggaagaggaaggagaggaagaagaagaggaagaagggggtggtgacagcctggaggtggacggcgtcgcagccacccctgggaaggccgaggcgacaagagtcctgccgaggcagtgccccgtccaggctgagaagagtcacggagcgccactggaggaggccactgaaaagatggtgtcaatgaaacctcccggttttcaggctagcctggcccgtgacggccatatgagcggactgggaaaagcagaagccgctccaccgggaccaggtgttccaccgcaccctcccggaaccaaaagcgctgcctcacaccaatcaagtatgacttcactcgaggggagcgggatcagcgaacggctcccacaaaagcctctgcaccggggtgggggaccccacctggaagaaacctggatggcttcacctgagacggatagtggctttgtaggatctgagacttcccgggtctcccccctgacccagacccctgagcatcgattgtcccacatcagtaccgctgggactctcgcccagcctttcgctgcgtcggttccccgagatggcgcttcatatccaaaggctcgaggctcactgattcctagacgtgctaccgaaccttcaacccccagatcacaagctcaaaggtatctgtctagtccgtctggacctcttagacagagagccccaaacttttcacttgagaggacgttggccgcagagatggctgtgcccggaagtgagtttgaggggcataaacgaatcagtgagcaaccccttcccaataagactatcagtccacccccagctccagctcccgctgccgctccactgccttgtggacccacggagactatcccaagttttctgcttactcgcgcaggacgagatcaagctatctgtgaacttcaggaagaggtgtctcggttgaggctgcgcctagaggacagtctgcaccagcctcttcagggcagtcctacaagacccgcttccgcgtttgacaggcccgcacgcacaaggggtaggcctgctgattctccggcaacttggggatctcactacgggagtaagagtacagaaagactgcccggtgaaccccgtggagaggagcagatagtaccaccaggacggcaacgcgcaaggtccagtagcgtgcctcgcgaggtgctgagattatctctgagttcggagagcgagttgccatcgttacctctctttagcgaaaagagcaagacgaccaaggactccccccaggccgcacgtgacggcaaacgcggtgtaggaagtgctggatggccagatcgggtcactttccgaggacaatacactgggcacgagtaccacgtcttgagccctaaggctgtgcccaagggcaacgggaccgtgtcttgtccacactgtaggcccattagaacacaggatgccggtggcgctgtgacgggtgatccacttggcccaccgccagcagacacgctgcagtgcccactttgtggacaggtgggctctccacctgaggcagatgggccaggctctgctacatctggcgcagaaaaggcgacaaccagaagaaaggccagctccaccccgagcccaaagcagcgatccaaacaggcaggaagttcccctagaccccctcccggactttggtatctcgcaacagctccacccgcacctgcgcctcctgcctttgcttacatttcatccgttcctataatgccttatccacccgcagcagtgtactacgcgccagctggccctacaagcgctcagcccgctgcaaaatggccgcctacggccagtcctccccctgcccgaaggcaccgacactcaattcagctggacctgggggacttggaagaactcaacaaagccctcagtcgagccgtgcaggcagccgaaagcgtgcgatctacaacgcggcagatgcgcagttccctgagtgctgacctccggcaggcccactctctccgcggaagttgtcttttttag

SEQ ID NO: 22438 - DNA, 2496 bp, Artificial Sequence
  Description of Artificial Sequence: Synthetic coding sequence
atggcgtctagtgaaactgagatcaggtgggccgagcccggtctgggtaaggggccacagcgaaggcggtgggcctgggctgaagacaagcgcgacgtcgatcggagcagcagtcagtcgtgggaggaagagcgccttttccccaacgctaccagtcccgagcttctggaagacttcaggctggcacagcagcatctgcctcctctcgaatgggacccccacccacaacccgacgggcatcaggatagcgagtcaggcgagacttctggcgaggaagccgaggccgaagacgtcgactccccagcatcaagtcacgaaccccttgcctggctgccccagcagggacggcagctggatatgacagaggaggaacccgacggcacactgggttcgctcgaggtggaagaagcgggtgagagctcctctcgccttggatatgaggctggactgtccctggaaggtcatggaaacacctctcccatggccttaggccatgggcaggctcggggatgggtggccagcggcgagcaagccagtggtgacaaactatcagaacatagtgaggtaaacccaagtgttgagctgtcgcctgccagatcttggtctagtgggactgtgtcattggatcacccatccgattcactggatagcacttgggaaggagagactgatggtccacagccaactgccttggcagaaacgctacccgaggggccatctcaccacttgctctcacctgatgggaggacaggtggctctgtagctcgagcgaccccaatggagttccaagattcaagcgcgccacccgcacaaagcccccagcatgcaacagatcggtggcggagagaaactacacgatttttctgcccccagcctaaggaacatatttggaagcaaactaaaacctccccgaagccactgcctagcaggtttatcggaagtattagccctctaaacccacagcccaggccgacccggcaggggagacccctgccacggcagggcgcaacccttgcagggaggtccagttcaaatgcaccgaaatatggcagggggcagctcaactaccctctaccagactttagtaaggtaggtccgagggtcagattccccaaagatgagagttacagaccccctaagtcacggtcacacaatagaaagccacaggctccagccaggcccctcattttcaagtcaccagccgaaatcgttcaagaggttctgctgtctagcggtgaggccgctctcgctaaggatacgccgcctgcgcatcccatcaccagggtgcctcaggaattccagacacccgagcaagctaccgaactggtgcaccagctccaagaggactatcataggctgctcacaaaatatgcggaggctgagaatactatcgatcagttacgattaggggctaaagtgaacctcttctcggatcctcctcagcctaaccactcaattcacactgggatggtgcctcagggcaccaaggttctatctttcacgatccctcagccaaggtcagcggagtggtggcccggacccgcagaagacccgcaagctagcgccgcttcaggttggccttccgcaagaggcgatctgagcccatcctctctgaccagcatgccaacgctgggctggctgcccgagaaccgagacatcagcgaggatcagagctccgcagaacagacgcaagcgctcgcctcccaggcctctcagtttctggctaaggttgagtcttttgaaaggctgatccaggctggtcgcctgatgcctcaggaccaagtgaaagggttccaaagactgaaggcagcccacgcagctctggaggaggagtaccttaaagcctgccgggaacagcatcctgctcagcctttagctggttcaaagggtactccaggtaggttcgaccctcgccgagagttagaggctgaaatctacaggctgggctcttgcctggaagaattaaaagagcatatcgatcagacacaacaagagcccgagcctcctggcagcgattcagctctcgattctactccagctttgccatgcttgcaccagcccactcatctccccgcaccttccggtcaggctccaatgcccgcaataaaaacgtcctgccctgagccggctaccaccacagctgccgctagcacggggccttgcccgctgcacgtgaacgttgaggtgagcagtggtaatagtgaagtagaagatcggcctcaagatcccctggctcgcctgcgccataaggagctgcagatggagcaggtgtatcacggattgatggagcgatacctgagtgtaaagtcgttaccagaggctatgagaatggaggaggaggaggaaggcgaggaggaagaggaggaggagggcggaggggatagcttggaagtggacggagtggcggcaacccccggaaaggcggaggctacgagggtattgcctcggcagtgcccagtgcaggcggaaaaaagtcatggcgctccgctggaatag

SEQ ID NO: 22439 - DNA, 1218 bp, Artificial Sequence
  Description of Artificial Sequence: Synthetic coding sequence
ctgaacctatgtctctccatttttctcaccccggcatgttatcaccactgtcgtcgacaacactggccgctccctatcgccaggaaatgcggtgccgttccgggaagtgagttcgaaggacacaaaagaatcagcgagcaaccacttcctaacaagacaattagccctcccccagcgccagcccctgcagccgcacctctgccctgtggtcctactgaaacaatcccttccttcctgttgacgagagcgggtcgggaccaggcaatttgtgaactgcaggaagaggtcagtaggttgagattgagactcgaagacagcctgcatcagccgctgcaggggagcccaactcgccctgcgagtgctttcgaccggccagcacgcacgcgaggcaggcccgctgactcccctgccacgtggggctctcactacggctctaagtcaaccgagaggctgcccggtgaacctcggggagaggaacagatcgttcccccaggcaggcaaagagccagatcttcatctgtgcccagagaagtgttacgcctttcattatcatccgagagtgaacttccctcacttccactcttcagcgagaagagtaaaactaccaaagatagccctcaggctgctcgggacggcaaaagaggagtgggttcggctggatggccagaccgggttaccttccgtggtcagtatacaggacatgagtatcatgtccttctgcgtcggtcacagaaggcaatggcccagagcccagtgcctaccgccggaccactaggtcctcgtatgcgtgtggtgctgtcacaggggacccactgggatcgtctgccccttattccgttctcagtcccttgcgtggttaagctcgggctgccacaaagacagatggtgcaggcccagccccctttgggtcagcggaggccccctagaggcgagaagcacttacagttgcccgctcccagtcgcggtgcctcccgccgtggccgacgtcatgcgcatccgcctgactgcggaatctggcagcagaggccacagcaccaacccttgcagcctttgcccacatccccgagatttccaagttgcctcatccaccttcccctgtgcacaatgcgcctgcaggatctaccgcaaccgaatcagttgccttccggtagaccccagccactcccacatcagccaggagacaccggaacccctagttcgagtacttgggctacatag

SEQ ID NO: 22440 - DNA, 4077 bp, Artificial Sequence
  Description of Artificial Sequence: Synthetic coding sequence
atgcttaggtccgagtggccagtgtttcctgaggcggaggcagaggacgtggactccccagcttcttcgcacgaacctcttgcatggctccctcagcaaggacggcagctggatatgacagaagaggagccagatggcaccttaggttccttggaggtcgaggaagccggtgaatccagcagtcgactgggctacgaagctggcctgtcactggaaggacatggcaacaccagtccaatggcactcggacatggacaagctcgtggctgggttgcgtcgggggagcaggccagtggtgacaagttatctgagcactctgaagtcaaccccagtgtggaactatctccagctagaagttggtcttcagggacagtcagcctcgatcacccgtcagactcgttggattcgacatgggagggcgagacagacggtccacaaccaacggcactcgcagaaacacttccggaaggaccatcacaccaccttctgtctccggacgggaggacgggaggtagcgttgcaagggcgactcccatggagtttcaggactcttccgcacctcccgctcaatctccgcagcacgcaaccgacagatggcgacgggaaacaactcggtttttttgccctcaacctaaggaacacatatggaaacagaccaagacatcccctaaaccactgccctcccgatttatcgggagcatctcacctctgaacccacagccacggcctacccggcaggggagaccactgccgcgacagggtgcaaccctggccggaaggtcatcgtctaatgcgcctaaatacggtagaggtcagctgaattaccccctgccggatttctcaaaggttggccctcgggttcgctttcctaaggacgagtcctacaggcctcccaaatcccgtagtcacaatagaaaaccccaggccccagctcggccactcatcttcaagtctcccgcagaaattgtgcaggaagtcttacttagctcgggtgaggcagctcttgccaaagatacgccacctgctcatcccataacacgtgtcccccaggagtttcagacgccagagcaggccactgaactggtccatcagctccaagaggattatcaccgcctgctgacaaaatatgccgaggccgaaaatacaatcgaccagttacgattaggtgcgaaagttaatcttttcagcgacccacctcagcccaatcattcaatccacactggtatggtgccacagggcacgaaggtcctcagcttcactataccccagcctagaagcgccgagtggtggccgggtcctgccgaggacccgcaggccagcgctgcctctggctggccttccgcacgtggcgatttgtccccgtcttctctgaccagtatgcccactctgggctggctgccggagaatagagacattagcgaggaccagtcctccgctgagcagacccaggccctcgctagccaggcctcacagtttctggcaaaggtagagagcttcgagaggctgatccaggccggaagattaatgcctcaggaccaagtaaagggcttccagcggcttaaggctgcccacgcggctctggaggaagagtacctcaaggcttgtagggaacagcaccccgctcaacctttggccggaagcaaaggcacccccggtcgatttgaccctcgccgagagctcgaagcagagatataccgccttggatcctgccttgaggagctgaaggagcacatagaccaaacgcagcaggagccggagcctcccggaagcgacagcgctttagattctaccccagcacttccttgtctgcatcagcctacgcatctgcctgccccaagtggacaggcccctatgcccgcaatcaagacctcatgccccgagccagccactaccacggcggcagcaagcacagggccatgcccacttcacgtcaacgtggaagttagttcggggaattctgaagtggaggaccgccctcaggaccccctagcgagattgcgccacaaagaattacaaatggaacaagtgtaccacgggctgatggaacgttacctgtctgtcaaatccctgccggaagctatgcgtatggaagaagaggaagaaggagaagaagaggaggaggaagagggaggaggggacagcttggaagtagacggagtagctgcaacccctggcaaggctgaggctactcgggtcctgcctcgccagtgccctgtgcaggccgagaaaagtcacggggctcctcttgaggaggctaccgagaagatggtgtctatgaagccgccaggcttccaggcctctctcgccagagatggccatatgagcggcctgggcaaagccgaggcagccccacctgggccaggcgtcccaccgcatcccccagggaccaagtcagcagccagtcaccagagctccatgacctccttggagggttctggcatctcagagagactgcctcagaagcccctccatcgcggaggcggaccacatctggaggaaacttggatggcctcccccgagaccgactctggcttcgtggggagtgagactagtagggtctctcctctgacccagacgcccgaacatagactctcacacatttctaccgccggaacgctcgctcagcctttcgccgcttctgttccgcgtgatggagccagctatcccaaggcgaggggcagtctcatcccaaggcgggctacggaaccctccaccccgaggagtcaggcccaacgctacctgtccagcccctccggacccctgagacagagagcacccaatttcagtctggaaaggactttggctgccgaaatggccgtcccagggtcagaatttgagggtcacaagcgaatctcagagcagccgctgccgaacaagacaatttccccacccccagctccagcccctgccgcagccccactgccctgtggccctaccgaaaccattcccagctttctcttgacccgcgcaggcagagaccaagccatttgcgagctgcaggaggaagttagtcgacttcggctgagattggaggatagcctccatcagcccctccaaggttctccaacaagacctgcctctgcctttgacaggcctgccaggaccaggggacgcccagcagacagcccggctacatgggggtcccactacgggtccaagtccacagagagactgcctggcgagccacggggtgaagaacagatcgtgccccctggtagacagagggcacgctcctcatccgttcccagggaggtgttacggctgagcctgagtagcgagtcggagctgccatccctacccctgtttagcgagaaaagcaaaactaccaaagactcacctcaggccgcaagggacgggaaaagaggtgtgggatctgccggatggcctgacagagtgacgtttcgaggacagtatactggccatgagtaccacgttctgagccctaaggccgtaccaaaaggcaatggaactgtctcctgtccacactgccggccaatccggacccaggatgctggtggtgccgtcacgggcgatccactagggcctcctcccgctgacactctgcaatgtcccttgtgtgggcaggtgggttccccgcctgaagctgacggacccggttctgccacctctggtgccgagaaagcgacaacgcggagaaaagcatcctccacaccttctcccaaacaacggtctaagcaggcgggtagctcaccacgaccaccaccgggactgtggtatctggcaacggcccctcccgctcctgccccacctgccttcgcctacatttcatctgtgcctattatgccataccctcccgcagctgtgtactacgctcctgccggacctactagtgcgcaacctgccgctaagtggccacccacggcaagcccgcctccggctagaaggcatcggcactctatccaacttgatctgggcgatctggaggagctgaacaaagccttgtcacgcgctgtgcaagcagccgagtcagtgcgaagcacaacacgccagatgaggagctccctgtccgctgacctgagacaagcacactccctgagaggaagttgtctgttctag

SEQ ID NO: 22441 - DNA, 1155 bp, Artificial Sequence
  Description of Artificial Sequence: Synthetic coding sequence
atgtctgcaggcggtgggacccgcggttactctcccagaagccccggtgctacgtcccaggcaatctgcgagctgcaggaggaagtgtcgcgactaaggctgaggctcgaagattccttgcaccagccactgcaggggtctcctacacggccagcttcagcctttgatcgccctgccagaactcgtggacggcctgccgactcacctgcaacatggggctcccactacggatctaagagcactgagcgtctaccaggtgaaccaagaggagaggaacagatcgtccccccagggagacaaagggccagaagctccagcgtgccgagggaggtgctccgcctctccttgtcgtcagagagtgagctgccatcattaccgctgttttccgaaaagtcaaagaccaccaaagattcgccccaggctgctcgggatggtaaacgcggagttggcagcgccggatggcccgaccgggtcactttccgcggtcagtatacaggacatgaataccatgtgctgagtcctaaggcagtacccaagggcaacgggactgtgagttgtcctcactgtagacccatacgcacccaggatgcagggggtgccgttacaggcgatcccctcggcccacccccagccgacacactacaatgtcccctttgtgggcaggtgggctcacctcctgaagcggacggtcccggaagcgcaacttcaggcgctgagaaagctaccactagacgtaaggcctcttccactccgagcccaaagcagcgatcaaaacaggcaggcagtagccccagacctcccccaggactctggtaccttgccacagcgcctcccgctcccgcacctcctgcttttgcctacatctcctctgtgccaattatgccttacccgcctgccgctgtctactacgcccctgccggaccaacttcggctcaacctgcggctaaatggccgccaactgctagcccccctccagctcgtcggcatagacactctattcagctggacctgggagacctggaggaactgaacaaagcccttagcagagcggtgcaggccgctgagtccgtgcgctcgaccacacgtcaaatgcgatcaagcctcagcgcagacttgagacaagcccacagcctcagggggtcatgcttgttctag

SEQ ID NO: 22442 - DNA, 4320 bp, Artificial Sequence
  Description of Artificial Sequence: Synthetic coding sequence
atggcttcctccgaaacagagatacgctgggccgagcctggcctaggcaaaggcccacagcgccgtcgctgggcctgggccgaagacaagcgtgatgtggatcgatctagctcacaatcatgggaggaagagcgactgtttccaaatgccacctcaccggaactgctggaagattttagactggctcagcagcacctgccacctttggaatgggacccccacccccagccggacggacaccaggattccgagagcggggagacttctggggaagaggcagaggccgaagacgttgatagccccgcttcctctcatgagcccctggcatggttgcctcagcaaggacgtcagctggacatgactgaggaagagccagatggaacgttgggaagcctggaagtggaagaggccggagagagtagttcaagactgggctacgaggccggtctctccttggaggggcatggcaacacctcgccgatggcactcggtcatggacaagcgcgtggctgggtggcatctggcgagcaagcctccggagacaaattatcagaacattccgaggttaatccttcagtcgagctgtctcccgctagatcatggtcgtcaggcacagttagtctggatcacccgtctgatagcttggactccacttgggagggagagacggacggacctcagcccaccgcactcgcagaaaccctcccagagggcccttcgcaccacctgctctccccggatggtagaacaggcggatccgtggccagggctacgcccatggagtttcaggactcgagcgccccacctgcccagtcaccccagcatgccactgatcgatggagacgagagactacaagattcttttgcccacagccaaaggagcatatctggaagcagacaaaaacctcacctaagccccttccttccagattcattggtagtatctctccactgaaccctcaaccaagacctactcgacagggacgacctcttcctcggcaaggtgccacgctggcaggacggagcagctcaaatgctccaaagtatggcagagggcagttgaactatcccctccccgacttttctaaagttgggccacgggtgcggtttccaaaggatgaaagctaccgtccacccaagtcacgctcacacaatagaaagcctcaagctccagcccgaccactgatcttcaagtctcctgccgagattgttcaggaagtgctcttgtcgagtggggaggctgccctggcgaaggatacacctcccgcacatccgatcacaagagtgccacaggagttccagacacccgagcaggcaacagaactggtgcaccagctgcaggaggactaccaccgtctgctaacaaaatacgccgaggctgaaaacactatcgaccagttacgccttggggcaaaagttaacctgttttccgaccctccacagcctaatcattcaatacacaccggtatggtcccacaggggaccaaggtgttaagctttacaattccacagcctcgttcagctgaatggtggcctggtcccgcagaggacccacaagctagcgctgcctcgggctggccctcagcgcgtggcgacctaagtccttcgtcattaactagcatgcccacccttggatggctgcccgagaaccgcgacatctctgaagatcagagttccgccgaacagacccaggctttggcgtcccaagccagtcaatttctggctaaggtggaaagctttgagaggctgatacaggctgggagactaatgccacaagatcaggttaaggggttccaacgtttgaaagcggcacacgcggctctggaagaagaatatctgaaagcttgccgagaacagcaccctgcacagcctcttgccggatccaaagggactccaggtaggtttgatccgagaagggagttggaggccgaaatatataggttgggctcctgtctggaggagctgaaagagcacatagatcagacccaacaggaaccagaaccgccaggaagtgacagtgctttagacagcaccccagcattgccttgtcttcatcagccaactcacctgcctgcaccctcaggtcaggcccctatgccggctatcaagacgtcttgccccgagcccgctacaacaacagctgccgcaagcactggtccctgccctttacacgtgaacgttgaggtttctagcggtaactctgaagtggaagacagaccccaggatccacttgcgaggctccgacacaaggaattgcagatggaacaggtttaccacgggcttatggagaggtacctgagcgtcaaatctctgcctgaggctatgcggatggaggaagaagaggaaggagaggaagaggaagaagaagagggaggcggtgattctctggaagtcgacggcgtggccgctacccctggaaaagccgaagcaacaagagttctgcccaggcaatgccctgtgcaggccgagaagtctcatggcgcaccccttgaggaggcgacagagaaaatggtgagtatgaagcccccagggtttcaagcaagcctagctcgagatggacacatgagtggtctcggaaaagctgaagccgctccgcctggacctggagtgccacctcaccctcctggcaccaaatccgcggcttcacaccaaagcagcatgacatcgctggaaggtagcggaattagtgaacgcttaccacaaaaacctctgcaccggggtgggggaccccatctggaggaaacttggatggcgagtccagaaaccgattccggatttgtcggctctgagacgagcagggtcagcccactgacccagactcccgagcatcgactgtcccacatttccacagcaggcactctcgcccagcctttcgccgcaagcgtgcccagagatggtgcatcctaccctaaggccaggggtagccttatcccgaggagagcgaccgagccctcaacccctcgctcccaggcacaacgctatctaagcagcccctcaggtccactgaggcagagagcacctaacttctcacttgagagaaccctggcagccgagatggccgtgcccggaagcgagttcgaaggccacaagcgaatctctgaacaacctttacctaataagaccataagtcctccgccagccccagcccctgctgctgctcccctgccctgcggacccacagaaacaatcccttcattcctgctgacccgggctggccgagatcaggcgatttgtgagttgcaggaggaggtgtcccgcctgagacttcgcctggaggactccctgcatcagcccctgcaggggtcacccacccggccagcctccgcatttgacagaccggcaagaactcgaggcaggcccgctgactcgcctgccacatggggcagccattacggatccaaatcaaccgagcgcctcccaggggagccacgcggagaagagcagatagttccaccgggaagacaaagggcaagaagtagttccgtgccaagggaggtcctaaggctgtccctttcctcagagtctgaactaccctcactgccacttttttctgagaagagcaagaccaccaaagacagcccacaagccgcaagagatggcaagcggggagttggctcagccggatggccagatagagtcactttccggggacagtacaccgggcatgaatatcatgtgctgtcaccaaaagcagtgcccaagggtaacggcactgtgagctgccctcattgccggccaatccgtacccaggatgcgggaggagcagttaccggagatccacttggaccaccaccggcagacacccttcaatgtccgctttgcggccaggttggatccccacccgaagccgacgggcctggctcagcgacatctggcgctgaaaaagcaaccacacgtcggaaggcctcctctaccccatcccccaaacagaggtctaagcaggctgggagctccccaaggccccctcctggcctgtggtaccttgccactgcaccccctgcgcctgcccctcccgcattcgcttatatcagtagcgtgcctataatgccatatccacccgcagccgtctactacgccccagctgggccaaccagtgctcaaccagcagcaaagtggccccctaccgcctcccctccccctgccaggcggcatagacatagcatacagttggatcttggcgacctggaggaactgaacaaagccttgagccgggcagtgcaggcagcagagtcagtgcggagcactacgaggcaaatgaggtcttccctctctgccgacctccggcaggcccacagcttgcggggaagttgtctgttttag

SEQ ID NO: 22443 - DNA, 1719 bp, Artificial Sequence
  Description of Artificial Sequence: Synthetic coding sequence
atggcgtcatctgagaccgaaatccgctgggccgaaccagggctggggaaaggccctcagaggcggagatgggcttgggcagaggacaagcgggacgtggaccgcagttcatcccagtcctgggaggaggaaaggttattcccgaacgctacgtctcctgagttattggaggactttagattggctcagcagcacctgccccctctagagtgggacccacatcctcagcccgacgggcaccaggattccgagagtggcgaaactagcggtgaagaggcagaggcagaggacgtagatagcccagcttctagccatgagcctctggcatggctgccccagcagggtcggcaactagacatgacggaggaggaacctgatggaaccttaggtagtctggaggtggaggaggccggagaatcatccagccggctcgggtacgaggcgggactctctctggaaggccatggcaatacaagtccaatggcgcttgggcatggacaggcaagaggttgggttgcaagcggggaacaggcttctggcgacaaactttctgaacattccgaggttaaccctagcgttgagctgagcccggctagaagctggtcctccgggaccgtctccctcgaccacccatctgacagtttggactctacatgggaaggagagacagatgggccacagcctacagcgcttgccgagaccctcccggaaggaccatcccatcaccttctatctcctgacgggaggaccggcggatccgtcgctagggcaactcctatggaattccaagacagctcagcccctcccgcacagagcccacaacatgcaactgaccggtggagaagagagaccactcgctttttttgcccccaaccaaaagaacacatttggaaacagaccaagacctcgcccaagcccctgcctagcagattcatcgggagcatctcgccactaaatccccagccccgaccaacaagacagggaaggcctctccctcgtcagggagcaaccctggccggacggtcctcttcaaatgcccctaaatacggcagaggacagttgaactatcctctgcccgacttttccaaagtcggcccaagggtgcgctttcccaaggatgagagttaccggcctccgaaaagtcgctcacacaatcggaagccacaggccccagcacgccctttgatatttaagtcccccgcagaaatcgtacaggaggtgctgctgagttctggcgaagccgctctggccaaagataccccgccagcacaccctatcacacgggtgccccaggagtttcaaaccccagaacaagcaactgagctggtccatcagttgcaggtctccggcacacacggatgcggttgtgttaccaaagcgcctgtgggtttagggtggcggctgataggggtcggtagacccggtgtagaagcaggctggggtggtgaagcttgggatcgcgcttggctggggtgggaggcgctcggacgcaggttagtgggctggggcggactcgggtggaggctggcacgtgtgggtagccctgggatggaagccagcggcgtgggacgacctggggttgggagccccggagtagagcctggcggagtggggcgacccggtgttgaagccggttggggtagaaagccttgggacaggggttggtggggaggtgaagcctggggtgggggttggctgggtcaagaagcactcgggtag

SEQ ID NO: 22444 - DNA, 2016 bp, Artificial Sequence
  Description of Artificial Sequence: Synthetic coding sequence
ccaggattcggaaccaaaaattctcaggccggtcccttgaaactgggaagacaggatggaggaggggcaagggagcgtgccgctcaaggggacgttgaccgtagtagcagtcaatcctgggaggaggaacgtctttttcccaacgcaacaagtcctgaacttctcgaagatttccggggaccagcagcacccgctgcgcctggtgtcggccctacaccagctgctcggtgggcctcaggattccgtgtgcggagagatttcggacgtagaaccggtggcagtgtcgcacgggctaccccgatggagtttcaagattcatctgctccccctgcgcagtccccgcagcacgcaaccgacaggtggcggcgagagaccacacgcttcttctgtccccagcctaaagagcatatttggaagcagacaaagacttcgccaaaacctcttccttcaaggtttataggcagtataagcccattaaatccacagcccagacccactaggcaaggtcgcccacttcctcggcaaggagccacactggcagggagatcatcctcaaacgcccctaaatatggcagggggcaattaaactaccccctgcccgatttttccaaggtaggcccacgggtgcgtttccccaaagacgaatcctaccgacccccaaagtcacggagccacaatcgcaaaccgcaggcccctgcgcgtcctctgatcttcaaatccccagcagagatagtgcaagaggttctgttaagctctggcgaggcagccctcgccaaggacacacctcccgcacacccaattactagagttcctcaggagttccaaaccccagagcaggctacagagctggtccatcagctgcaagaggattaccataggctgcttacgaaatatgctgaggctgaaaataccatcgatcagctccgactaggcgcaaaggtcaacctgttttcagatccaccacagccaaaccatagcatccacaccggtatggtgcctcaggggactaaagtcctgtccttcaccattccacaacctagatccgccgagtggtggccgggaccggctgaggatccgcaagcaagcgccgctagcggctggccctccgccagaggcgatctctctccttcttccctcacaagtatgcctaccctggggtggttacctgagaacagagatattagtgaagaccagtcttccgctgagcagacccaggccctggcctctcaggcaagccagtttctggccaaggttgagagcttcgaaagactgatccaggccggaaggctaatgccacaggatcaggttaaagggttccagagactgaaagcagctcatgctgctctggaggaggaatacctcaaggcctgccgggaacagcaccccgctcagcctcttgccggaagcaagggaacaccaggacggtttgaccctaggcgagagctggaggccgaaatatacagactcggctcttgcctggaagagctgaaagaacacattgatcaaacccaacaagaacccgaacctccaggatccgactccgcactggacagcacacctgctctgccttgtctgcatcagcccactcacctgcccgctccctctggccaggcccctatgcccgctattaagacgtcttgcccagagcctgccaccacaacagctgcagcaagtacaggaccctgtccactccacgttaacgtcgaggtttcatctggcaattctgaggtagaagaccgacctcaggaccctctcgcacggttgcgtcacaaagagctgcagatggaacaggtataccacggacttatggagcggtacctctccgtgaagtctctgcccgaggcgatgaggatggaagaggaagaagagggcgaggaagaagaagaagaggagggcggaggcgactctcttgaggtggacggagttgccgcaacaccgggtaaagctgaggctacccgcgtgttgccaagacagtgtcccgttcaggccgagaagtcccatggagctccattgtag

SEQ ID NO: 22445 - DNA, 2472 bp, Artificial Sequence
  Description of Artificial Sequence: Synthetic coding sequence
atggccgcttctgaggccgctgcggctgccggttcagccgcacttgccgctggcgctcgggctgttcccgcagccacaacaggtgccgctgccgcagcctctggaccatgggtgccgccaggaccaaggcttcgtgggagccgaccacggccagctggagccacgcaacagcccgctgtgcctgcgccaccagctggagaactgatccagccctccgtctctgagttatcaagggccgtgcggaccaatatcttgtgcactgtaagagggtgcggcaagatccttcctaactctcccgctctgaatatgcacctggtaaagtcccacagactgcaagacggcattgtgaaccctactatcagaaaggatctgaaaaccggaccaaaattctattgttgtcccattgagggttgccctcggggtcccgagaggcctttctcgcagttttcccttgtcaaacagcatttcatgaaaatgcatgcagagaagaaacacaagtgttcgaaatgcagcaatagctatgggacggagtgggatctcaagcgccatgcggaggattgcggaaagacctttagatgtacttgcgggtgcccctatgcaagcaggacggctctacagtctcacatctataggaccggacatgagattcccgcagaacatagggatccaccctctaaaaaacggaaaatggagaactgcgctcagaaccagaaactctccaacaagaccatagagtcacttaacaatcaacctatccccaggcccgatacacaggaactcgaggcatctgaaattaaactggagccctcttttgaagattcttgcggatcaaacacagataaacagacgctgacgactcctcctaggtaccctcagaaactgctgttgcccaagcccaaggtggcactcgtgaagctcccggttatgcagttctctgttatgccagtgttcgttcccaccgccgacagttcggcccagcctgtcgtgctgggcgttgatcagggaagtgccaccggcgcagtgcacctcatgcctctgagtgtggggacactaattctgggattagactctgaagcctgtagcctgaaagagagcctgccccttttcaagattgccaatcccatcgccggagagccaatctccactggagtacaggtcaattttgggaaatcccccagcaacccgctgcaggaattggggaacacatgccagaagaactctatttccagtattaatgtgcagacggaccttagctacgctagccagaacttcattccttccgctcaatgggcgacagctgattcaagcgtcagctcctgtagtcaaacagacctctccttcgattctcaggtcagtctcccaatcagtgtccacacacagaccttcctaccttcctccaaggttacaagctccattgctgcccagactgatgcattcatggatacgtgttttcagtcaggaggagtgagtagggaaacacagacctctgggatcgaatcccccactgatgatcatgtgcagatggaccaggccggaatgtgcggtgatatttttgagtccgtacacagctcatataatgtagccacggggaacattatctctaacagccttgttgctgagaccgttacacattccctgctcccccagaatgagcccaagactcttaaccaggatatagagaagtcggctccgataatcaacttctcagcccagaactcaatgttgcctagtcagaatatgacggataatcagactcaaacaatcgatttactaagtgatctcgagaatatcctctcttcgaatctgccggctcaaacactagaccaccggtccctgctgtcggacaccaatcccggtccagacacccagctgcccagtggccctgcccagaatccaggcattgactttgacattgaagagtttttctccgcatctaacattcagactcaaacggaggaatcagaactgagtaccatgacaaccgagcctgtcctggaatctctggacattgaaactcagaccgactttctgctggccgatacaagtgcacagtcatacggttgcaggggtaactccaattttctcgggctggagatgtttgacactcagacccagacagacttaaacttctttcttgactcaagcccccacctgccactggggtcaatcctcaaacactcatctttcagtgtgagtacagactcatcggatactgagacgcaaacggaaggtgttagtacagccaagaatattcctgcccttgaaagcaaggtccagctgaacagcacagaaactcaaaccatgtccagcggctttgaaaccctggggagtctgttcttcacctccaatgagactcagactgctatggatgacttcctgctggccgacctggcttggaatactatggagagtcagttttctagtgttgagacacagacctccgcagaacctcacacagttagtaacttctag

SEQ ID NO: 22446 - DNA, 1785 bp, Artificial Sequence
  Description of Artificial Sequence: Synthetic coding sequence
atggagaactgcgcccagaatcagaagctgagcaacaagacaattgaatcactgaacaatcagccaatccctagacccgatacccaggagctcgaggctagcgagattaagctggaaccctctttcgaagattcctgcggttctaatactgataagcaaaccctgaccacaccacctcgctacccacagaaactgttgctacccaaaccaaaggtggcactggttaaactacccgtcatgcagttcagcgtcatgcctgtcttcgttccgactgctgacagcagtgcccaaccggtggttctgggggtggatcagggatccgctacgggtgcagtgcacctgatgcctctgagtgtcgggacgctgattctggggctggattcagaggcctgtagcctgaaggagtctctgcccttatttaaaattgcaaatcctattgctggtgagcccatcagtaccggggttcaggtcaatttcgggaagtcaccctccaaccccctccaggagttgggaaacacttgtcaaaaaaattctatttcaagtattaacgtgcaaacagatctcagctacgcctcgcagaactttattccatcagcccagtgggcaacagctgatagttcggtttcctcctgcagtcagacagatctcagctttgactctcaggtgtcgttgccaatcagcgtccacacacaaacatttctgccatcgtctaaagtgacctcctcaattgccgctcagaccgatgcgttcatggatacctgttttcagtcagggggtgtttccagggaaacccaaacctccggcattgagtccccgactgacgatcacgtacaaatggaccaagcaggcatgtgcggcgatattttcgaaagtgttcatagttcatataacgtggccaccggcaacattatctcaaattctttggtggctgaaaccgttacacatagcctgttgccccaaaatgagccgaaaaccttgaaccaggatatcgaaaagtcagcgccaattatcaacttctcggcgcaaaattctatgttgccttcccagaatatgaccgacaatcagactcagaccatcgatttgctaagcgatctcgaaaacattctgtcatctaatcttcctgcccagaccctggaccataggagtcttttgtctgacacgaaccccggacccgacacacaactgccatccggtcccgctcagaaccccggaattgactttgacatagaagagtttttctcagcgtccaacatacaaactcaaacagaggaatctgaattgagcactatgactactgagcctgtgcttgaatcactcgatatcgagacccagacagatttcctgctcgcggacacctccgctcaatcatacgggtgccgcggaaattccaatttcttaggcctggaaatgtttgacacccagacccagactgatctgaatttctttttggacagctcaccccaccttccactcggctcaattctcaagcattcatcattctccgtttctactgacagtagtgacaccgagacccagaccgagggtgtgagcaccgctaagaatattcccgctcttgagagcaaggtccaactgaactccactgagacccaaactatgagttccggcttcgaaacactgggctccctcttcttcactagcaacgaaacacagaccgctatggacgactttctactggcagacctggcttggaatactatggaatcccagttcagctcagtggaaactcaaacatctgccgagcctcacaccgtgagcaacttttag

SEQ ID NO: 22447 - DNA, 966 bp, Artificial Sequence
  Description of Artificial Sequence: Synthetic coding sequence
atgaagcatattcccgtactggaggatggaccttggaaaaccgtttgtgtcaaggagcttaacggactgaaaaaattgaaacgcaaaggcaaggagccagccaggcgggctaacggttacaagacgtttcgcttggatttagaagcccctgagccaagagcagttgcaacaaatgggctaagagacagaacccacagacttcaaccagtgcctgtgcctgtccccgtacctgtgcccgtcgcccctgccgtgcctccacgcggaggcactgacacagcgggagagagaggtgggtctagggctccagaggtgtccgacgcgagaaaacgctgctttgccttaggcgctgtgggacctggcttgcccactcctcctcccccacccccaccggctcctcagtcacaggctccagggggacccgaggctcaaccgtttagggaaccaggactcagaccccgtattctcctctgtgctcctcccgctagacctgctccctctgcacccccagccccaccagctcctcccgagagtaccgttcgtcccgcaccgcctactaggcccggagaaagttcctatagctctattagccacgtgatctataataaccatcaggattccagtgcgagcccccgaaagaggcctggagaggccacagctgctagcagcgagattaaagccttacaacagaccagaaggctgttggccaacgccagagagcgcactcgagtgcataccattagcgccgctttcgaggcgctgagaaagcaggttccctgttattcctacgggcagaaactatcgaagctggcaatcctgaggatcgcttgcaattacattctctctttagcacggttggcagacctcgattattcagcagatcacagcaacctgagtttcagcgaatgtgtgcagagatgcacgaggactttacaggccgaaggtcgggcaaagaagcggaaagagtag

SEQ ID NO: 22448 - DNA, 1164 bp, Artificial Sequence
  Description of Artificial Sequence: Synthetic coding sequence
atgaccatggagggcgcatcaggaagctctttcgggatagacacaattctgtcctccgcctcctcaggaagtccgggaatgatgaatggggactttagacctctgggggaggctagaactgccgattttaggtcccaggctacaccttcaccgtgctctgagattgacaccgtgggaactgcaccctcaagccctatctctgttaccatggaaccccctgaaccccacctggtcgctgatgccacgcagcaccaccaccacctccatcattcccagcagccacccccacccgcagcagcgccaactcagagtctgcagccccttccacagcaacagcagccactccccccacagcagccccctcccccacccccacaacagttgggatcggccgctagtgcgccacgcaccagcaccagcagtttcttaattaaggacattctaggggacagtaagcccctggcagcgtgcgcaccatatagcactagcgtgtccagtcctcaccatacacctaagcaggagtctaacgccgtccatgaatcgtttcggccaaagcttgaacaagaggattctaaaacaaaattagataagcgggaggattctcaaagtgatatcaaatgtcatggcacgaaggaggaaggcgaccgcgagatcacaagcagcagggagagccccccagtgcgagctaagaagcctcgcaaggccagaacggccttctctgatcaccagttaaatcaactcgagcggagctttgagcgccagaaatatctttccgtccaagaccggatggacttggccgcagccctcaacctcaccgatacccaggtgaaaacctggtatcagaatcgccgtacgaaatggaagcgccagactgcggtgggcttggaacttctggcagaagccggaaattatagtgccctccagcggatgtttccttccccttacttttatcacccctccctgttaggatctatggactccacgactgctgccgcagcggcagctgccatgtatagctcgatgtatcggacacctcctgccccacatcctcaactgcagcgaccacttgtgcctagggtcctgatacacggtttggggcctggtggtcagcccgcactcaatccacttagcagccccattcccggtaccccacatcctcgatag

SEQ ID NO: 22449 - DNA, 321 bp, Artificial Sequence
  Description of Artificial Sequence: Synthetic coding sequence
atgatgacacttgttccaagagccagaacgagggcgggtcaggaccactattcacatccatgtccacgcttttcgcaggtactgctgacagagggaattatgacctattgcctgaccaagaacttgtcagatgtgaatatccttcataggctcctaaagaacggcaatgtcaggaacactctgctgcaaagcaaggtgggcctgctgacctattacgtgaaactctatccgggagaggtaacactcctcacacgcccaagtatacaaatgagactgtgctgcattactggcagcgtatctcggccacgcagtcagaagtag

SEQ ID NO: 22450 - DNA, 321 bp, Artificial Sequence
  Description of Artificial Sequence: Synthetic coding sequence
atgatgacacttgtcccaagggctcggacccgcgctgggcaagaccattactcccatccctgtcccaggttctcccaggtgttactgaccgagggcatcatgacatattgcctgacgaagaatttgagcgacgttaatatccttcaccgactgctaaagaacggtaacgtgagaaacaccctgctgcaatccaaagtcggcctcttgacgtactacgtgaagctataccccggagaagttaccttattgacaagaccaagcattcaaatgagattgtgctgtattacggggtccgtcagccgccctaggtcccagaagtag

SEQ ID NO: 22451 - DNA, 570 bp, Artificial Sequence
  Description of Artificial Sequence: Synthetic coding sequence
atgaagaccaaaaacagaccgccacgccgtagggcccctgttcaagacactgaagcaacccctggggagggcaccccagatgggtccctgcccaacccaggccctgaaccagccaaagggctgaggtcacggccagccagagccgcagcacgtgccccaggagaagggagacgtagacggccaggaccttccgggccaggcggaagaagggactcaagcatccagcgtagactggagagtaatgaacgtgaaagacagcggatgcataagctgaacaatgccttccaagcacttagagaagtgataccacatgtcagggccgacaagaagttgagtaaaatcgaaacgctcaccctggccaaaaactatatcaaaagcctcactgctactattctgaccatgagctcaagtaggctgcccggattggaagggcctggtcccaagctgtaccagcattaccagcagcagcagcaggtagccggaggtgctctgggcgctacagaggcacagccccaaggccacctgcagcgatactccacacagatccattccttccgagaaggtacctag

SEQ ID NO: 22452 - DNA, 708 bp, Artificial Sequence
  Description of Artificial Sequence: Synthetic coding sequence
atgctaagaggtgcgcctggccttggactgactgctcgaaaaggggctgaagattctgcagaagatctcgggggaccctgccctgagccgggaggcgacagcggcgtgttaggagccaacggagcctcctgttcccgtggcgaagccgaggaaccagcaggccgacggagggcgagaccagtgcggagcaaggcccgtcggatggcggcaaatgtgagagaacgcaagcggattttggactacaatgaggccttcaatgctcttcgcagggcccttcgacacgacctcggaggaaaacgcctttctaagatagctactctgcggcgagctatccaccgaattgccgctctctctttagtgctccgggcatcacctgcgccaagaggaccctgtggacatctcgagtgtcacgggccagccgctcgaggagacaccggcgacaccggcgcatcccctcctcctcctgctggccctagcctggcacggcctgacgccgctaggccgagtgtgccttctgccccaagatgcgccagctgtccgccacatgccccactggcaagaccctccgctgttgccgagggacctggtctagcgcaagcttccggtggctcttggagacgctgcccaggggcatccagtgcgggtccacctccatggcctcgagggtacctgaggtcagctcccggtatggggcatcctagatcgtag

SEQ ID NO: 22453 - DNA, 825 bp, Artificial Sequence
  Description of Artificial Sequence: Synthetic coding sequence
atgcacctgtgtgggggtaacggtctgctgacccagacggatcccaaggaacagcagaggcagctcaagaaacagaagaatagggccgctgcacagcggtctcgacaaaagcacaccgataaagccgacgccctccaccagcagcatgagtccctcgaaaaggacaacctggctctgcggaaggagatccagagcctgcaagcagagctggcttggtggagcaggaccctccacgttcacgagcggctgtgtccaatggactgtgcctcttgtagcgccccagggctcttgggctgttgggatcaggccgagggcctgctggggcctggaccccagggccagcacggatgccgcgaacagcttgagctgttccagactcctggctcctgttacccagctcagccactgagccccggaccccagccacacgattcccccagcctgctgcagtgcccactgccctcattgagcttagggcctgcagtggtcgctgaaccaccagtgcagttgagtcccagcccactgctgttcgcctcccataccgggtccagcctgcagggctcctccagcaagctgagcgccctgcagcctagtttgactgcacaaacagcccctcctcagccgttggagctagaacaccctacccgcggaaagctcggctcttctcccgataatccctccagtgcattgggactcgctcggctgcagagtcgagagcacaagcccgcactgagcgcggctacctggcaaggactggtggtggacccctcgccacacccactgctagctttcccgctactgagctccgcccaggtccacttctag

SEQ ID NO: 22454 - DNA, 2031 bp, Artificial Sequence
  Description of Artificial Sequence: Synthetic coding sequence
atgaaaaaattctctagaatgccgaagtccgaaggaggcagcggcggaggcgctgcaggcggtggggcaggaggtgccggtgccggtgcaggatgtggatcggggggttcctcagttggtgttagggtgtttgcagttggtagacaccaggtcacccttgaagagagtctagcagaaggtgggttttccactgtattcttggtaaggacacatggcggaatcaggtgcgccctgaagaggatgtacgttaataatatgcctgacctaaacgtctgtaaacgagagatcaccattatgaaggagttatcagggcataaaaacatcgtcggatacctcgattgcgccgttaattcgatctctgataatgtttgggaggtcctgatcttgatggaatactgccgggctggtcaagtggttaatcagatgaacaagaagcttcagaccggctttaccgagcccgaggtactccagatcttctgcgatacctgtgaggccgtcgcacgcttacatcagtgcaaaacgccaattatacacagggacttgaaagtcgaaaacattcttctgaacgacggcggaaactacgtgttatgcgacttcggctctgcgactaataagttcctgaaccctcagaaggacggcgtcaacgtggtggaggaggagatcaagaaatacaccacattatcctatagagcccctgagatgatcaatctgtatggtgggaaaccaattacaacaaaggcagacatatgggcccttggatgtttattgtacaagttgtgtttctttacactacccttcggtgagagccaggtggccatatgtgatgggaattttaccatccccgataactccaggtactcccgaaatatccactgcctcattagatttatgctggagcctgatccggagcatcgccctgatattttccaggtttcatacttcgcatttaagttcgcaaaaaaggattgtcctgtaagtaacatcaataaatgttgcaaacagctgctgagacacggagcactcctgactgagattctgcttttcctgcagctgttcctgaacatgactgcctctgaggccgcagcacgcaaaagccaaatcaaggcccgaatcaccgataccattggtcccaccgaaacatccatcgctcccaggcagagacctaaggctaatagcgccactacggccacccccagtgttctgactatccaaagtagtgctacacctgtgaaggtgcttgcccctggagaattcgggaaccaccgtccaaaaggtgcattgcgcccaggaaacggccctgaaattctgctcggacaggggcctccccagcagcctccccagcagcaccgggtgcttcagcagctgcaacagggggattggagactccagcaactgcacctgcaacaccggcatccccaccagcagcaacagcaacagcagcagcaacaacagcagcagcagcaacagcagcaacagcaacagcagcagcaacaacaacagcatcaccaccatcaccaccaccacctcttgcaagatgcttatatgcagcagtaccaacacgcaacacaacagcagcaaatgttgcaacagcagtttttgatgcactcagtgtatcaaccgcagccttccgcttctcaatatcccaccatgatgcctcagtaccagcaggcgttcttccagcagcagatgcttgctcagcatcagccttcccagcagcaggcttcccccgagtacctcacatcccctcaggagtttagccccgctctcgtttcttacaccagcagtcttcctgcccaagtgggcacaataatggattcgtcgtactccgctaatcgttcagtggccgacaaagaggccattgccaacttcacaaaccaaaaaaacatctcaaaccctcccgatatgagtggctggaacccgtttggggaagataacttctcaaaattgaccgaggaagagcttcttgatcgggaatttgacctgctccggtcatcaaaggggcatctgaaagcttacttcgcaagccagtag

SEQ ID NO: 22455 - DNA, 3486 bp, Artificial Sequence
  Description of Artificial Sequence: Synthetic coding sequence
atgaaaaaattcagcagaatgcccaaatcggaggggggttcagggggaggagctgccggtgggggagctggcggtgccggagcaggcgctggctgcgggagcggcggaagcagtgtcggcgtgcgtgttttcgccgtgggccgacatcaggtgacccttgaagagtccctggccgagggcggattttctaccgttttcctggtacggacacacggcggtattcgctgtgccctaaagcgtatgtacgtcaataacatgcctgatctgaacgtgtgtaaacgggaaattaccatcatgaaggaacttagtgggcacaagaacattgtcgggtaccttgactgcgccgtaaacagtatttccgataatgtctgggaagtgctgatattaatggaatattgtagagcagggcaggtagttaaccagatgaataagaagctccaaactggattcaccgaaccagaagttctgcagatattctgcgacacgtgcgaggccgtggctcgcctgcaccagtgcaagacgccgataatccaccgggatcttaaggtggagaacatcctgctgaatgatggaggaaactacgtgctatgcgacttcgggtctgccactaacaagtttcttaatccccagaaggacggcgtcaacgtggtggaagaagagattaagaaatacactactctttcataccgcgctccagaaatgatcaatctctacggaggaaagcctatcactacgaaggctgacatatgggctctcggttgtctcctatataagctttgtttctttacactgccctttggagagagtcaagttgcaatttgcgatggaaattttacaatcccggataattcaagatatagccgcaacatccactgcctgattcgttttatgttagaacctgacccagaacacaggcccgacatttttcaagtttcttactttgcttttaagtttgccaaaaaggactgccctgtgtcaaatatcaacaattcctccatccccagtgcactgcctgagcccatgactgccagcgaggccgcagcaaggaaaagccaaattaaggccagaattactgacaccatcggcccaacagaaacttccatcgcccctcgccaaaggccgaaggctaactctgctacaacggctacccccagtgtgctcaccatccaatcatccgccacccccgtcaaggtcctcgcccctggtgaattcggcaatcaccgacctaagggagccctgcggcctggaaacggccctgagatcctgctggggcaagggccaccccagcaaccacctcaacagcatcgagtgctgcagcagttgcagcagggggattggcggcttcaacaattgcaccttcagcacagacacccgcaccagcagcaacagcagcagcagcaacagcagcagcagcagcagcagcagcaacaacagcagcagcaacagcaacaacagcaacatcaccatcatcaccaccaccaccttcttcaggacgcttacatgcagcagtatcagcatgctacccagcaacaacagatgctccagcagcaattccttatgcactccgtgtaccaacctcagccatcagccagtcagtatcctacaatgatgccacagtaccaacaggctttttttcaacagcagatgttggcacaacaccagcctagccaacaacaggcctcccccgaatatttgaccagtccccaggagttctccccagcactcgtgagctatactagttccctgccagctcaggtgggcacgattatggattcgtcctacagcgccaaccgtagcgttgccgacaaggaggcgatcgcaaactttactaatcagaagaacatttcaaatccacctgacatgagcgggtggaatccgttcggagaggacaatttttcaaaactgaccgaggaagagctgttggatagagaatttgatttactgagatctaatcgtttagaggaacgggcatcgtccgacaagaacgtggattctctatcagcaccccacaatcacccacccgaagacccattcggcagcgttcccttcattagccactctggttctccagagaagaaggccgagcattcttctatcaatcaggagaacgggacggcaaatcccataaagaacgggaagacatctcccgctagcaaagatcagaggacagggaaaaagacatccgttcagggacaggttcagaagggcaacgacgaatcagagtcagatttcgaaagtgatccaccaagcccgaagagctccgaagaggaggaacaggacgacgaggaagtgctgcaaggcgagcaaggcgatttcaacgatgatgatacagaaccagagaacttgggtcaccggccattgcttatggatagtgaagacgaggaggaggaggagaagcattcaagcgacagcgactacgagcaggccaaagccaagtactctgacatgtcttctgtgtacagagacagaagcgggtccgggcctacccaggatctcaacacaatccttctgactagcgcccaactcagcagtgacgtggccgttgaaaccccaaagcaggagttcgatgtgtttggagccgtgccattcttcgctgtgagagcgcagcaaccccagcaggagaagaatgagaaaaatctcccccagcaccgtttcccagccgcagggctggaacaggaagaatttgatgtgttcactaaggctccctttagcaaaaaggtgaatgttcaggagtgccacgcagtgggccctgaggcccacacaatacccggttaccccaaatcggttgacgtcttcggctccacccccttccagcctttccttacaagcactagcaagagtgaaagtaacgaggatcttttcggcttggtgccttttgatgagatcaccggaagccaacagcagaaagtgaaacagcggtctctgcagaagctgtcctccaggcaacgcaggactaaacaggatatgtcaaaatctaatgggaagagacatcacgggacacccacctcaactaagaaaactctgaagcccacttatcgcactccagaaagagctcgccgacataagaaggttggcaggcgcgactcacagagttcaaacgaatttctgactatcagcgactcaaaagagaacatctcagtggcccttacagatggtaaggatagaggcaacgtgctacaacccgaagaaagcctgctcgacccgttcggggcaaagccattccattcccccgacctgagctggcacccccctcaccagggactctcagacattagggccgatcacaacaccgttctgcccggtaggcctagacaaaattctctgcacgggagctttcactcagcggatgtgttgaagatggacgatttcggggctgtgccctttacagaacttgtggtccaatctattacccctcaccagtctcagcaatcgcaaccagtggaattggatccatttggcgctgcgcctttcccatctaagcaatag

SEQ ID NO: 22456 - DNA, 1989 bp, Artificial Sequence
  Description of Artificial Sequence: Synthetic coding sequence
atgaaaaagttttccagaatgcctaagagcgaagggggtagcggcggaggtgccgcaggaggcggtgctggcggagctggagctggggcaggctgcggatctggagggtcatccgtgggcgtccgcgttttcgccgtgggtcgccaccaggtaacactcgaggagtctctcgcagaggggggatttagcacagtctttctggtacgcacccatggcggtatccggtgcgcactgaaaaggatgtatgttaataacatgcctgacttgaatgtgtgcaaacgggagatcacaattatgaaagaactgtccggacacaaaaacatagtcgggtacctcgattgcgctgttaacagcatctctgacaacgtatgggaggttctcatccttatggaatactgccgagccggacaggtggtgaaccagatgaacaagaagttgcagactggtttcaccgagccggaagtgttgcagatattctgtgatacctgtgaagcagtcgccaggctccaccaatgtaaaactcccattatacatcgtgatttgaaggttgagaatatcttactgaacgacggcggaaattatgtcttatgtgatttcggctctgcgaccaacaagttcctgaacccccaaaaagatggggtgaatgttgtggaagaagagatcaaaaaatacactacactcagctaccgcgcacccgagatgatcaacctgtacggcggaaaaccaattacgacaaaagccgacatctgggccctaggttgtctactttataagctctgcttttttacccttccattcggggagagccaggtggcaatctgcgatggtaacttcacgatccccgacaattcaaggtacagccggaacatacactgtcttataagattcatgctggaaccagatcccgagcaccgccctgatatctttcaagtgtcatacttcgccttcaaatttgccaaaaaggactgcccagtgagcaacatcaataattcatccattcccagcgcgctgccggaacctatgacagcctccgaggcagccgcaagaaaatcgcagatcaaagcccgaatcactgatacaattgggcctacagaaaccagtattgctcccaggcagcgccctaaggccaattccgccaccaccgccacaccaagtgtgcttaccatccagtcttcggcaactcctgtgaaggtcttagctcccggagagtttggcaaccatcgtcccaagggggcattgcgcccaggcaacggcccagagattctgctgggacagggacctcctcagcagccacctcagcaacaccgggtgctgcaacagctgcagcagggggattggaggttgcagcagctgcacttgcaacaccgccacccccaccagcagcagcagcagcagcagcagcaacagcagcagcagcagcaacaacagcagcagcagcaacaacaacagcagcagcagcatcaccatcatcaccaccaccacctactacaggatgcctatatgcagcagtaccaacacgctactcagcagcaacagatgctccagcagcagttcctgatgcattccgtctatcagcctcagccaagcgcttctcagtatcccaccatgatgcctcaatatcagcaggccttttttcagcagcaaatgcttgcgcagcaccaaccctctcagcagcaggcaagccctgagtatctcactagcccccaggagttttcgcccgctctggtttcctatacctcatcactgccagcccaggtcggtaccatcatggatagtagctactcggctaatcgcagcgtggcagataaagaagcgatcgccaacttcacaaatcaaaaaaacatcagcaacccacccgatatgtccggttggaaccctttcggcgaggataatttctcaaaactgacggaggaagagctcctggatcgcgaattcgatttgctacggagtagcaagggccatctgaaagcctatttcgcgagtcagtag

SEQ ID NO: 22457 - DNA, 3849 bp, Artificial Sequence
  Description of Artificial Sequence: Synthetic coding sequence
atggaagctaaggaccagaagaagcaccgcaaaaaaaattctggtcccaaggccgctaagaagaaaaaaaggctccttcaagacctgcagctaggcgacgaggaagacgctcgcaagcgcaatccaaaggctttcgccgtgcagagtgctgttcgtatggccaggagcttccaccgcacccaggacctgaagactaaaaaacaccacatccctgtagtggaccgtacccctttagaacctccaccaattgttgtggtggttatgggccctccaaaggttggcaagagtaccttaattcagtgcctgataagaaacttcacacgacagaaacttacagagatcagagggccagtgaccatcgtgtccggcaaaaagaggcggcttaccattatagagtgtggctgtgatataaatatgatgatcgatctcgcaaaagtcgcagacctcgttctgatgctgattgacgctagctttggctttgagatggagacgttcgaatttttgaatatctgtcaggtgcacggcttcccgaagatcatgggagtcctgacacacctggactcattcaagcataacaaacaattgaagaaaactaagaagcggttaaagcacagattctggacagaagtgtacccaggtgccaaactgttttacctgtcagggatggtgcatggtgaataccagaatcaagagatccacaacctcgggcgatttattactgttatgaaattcagacctctcacatggcaaacctcacacccatatatcttggccgataggatggaggatctcaccaatcccgaagacatacggacaaacattaaatgtgatcgcaaggtctccctgtatggatatctcagaggtgcccatttaaagaataaatcccagatccacatgcccggtgttggagacttcgcagtttccgacatctctttccttcctgatccatgcgccctgcccgagcagcagaaaaaaagatgcctcaatgaaaaggagaaactggtctacgcccctctgagcggagtgggtggagttttatacgacaaggacgcagtttacgtcgacttgggcggaagccacgtatttcaggacgaggttgggccaacccacgaactggtgcagtctctcattagtacacatagtacgattgatgctaaaatggccagcagtagggtgacactcttctccgattcgaaacctctggggtccgaagatatcgataaccaaggcctgatgatgcctaaggaagagaaacagatggatctcaacaccggtaggatgcggcgtaaggccatctttggggacgaagacgagtccggcgactcagacgatgaagaggacgatgagatgtcagaggatgacggcctcgagaacggaagttctgatgaggaggccgaggaagaagaaaacgcagaaatgacagaccagtatatggccgttaagggcattaagaggcgcaaattggagttggaggaagattcagagatggatcttccagcttttgccgattcagatgatgacttggaacgttcttcagccgaagaaggggaggcagaggaggctgacgaaagcagcgaggaagaagattgtaccgctggtgaaaaaggcatcagcggttccaaggcagccggagagggttccaaagcaggcctgtcacccgctaattgccagtcagatcgagtcaacctggaaaagtctttgctgatgaaaaaagcggctctgcccacttttgacagtggacattgcacagcggaggaagtcttcgccagcgaggatgagagtgaagagtcatcttcactgtcggccgaggaggaagattctgagaatgaggaagccataagaaaaaaattgtctaaaccatcccaggtgtcctcaggtcagaagctgggccctcagaattttattgacgaaacctcagatattgaaaatctgctgaaagaggaggaagattataaagaggaaaacaacgactctaaggaaacctctggcgctttgaagtggaaagaagatttgtcacggaaggcagccgaagcctttctgcgtcagcagcaggccgctcccaacctccggaagcttatatacgggaccgtcacagaggataatgaagaggaggacgatgatactctcgaggagcttgggggtctgttccgggtgaatcagccagacagggagtgtaagcataaggctgatagcctggattgcagcaggttcctcgttgaagccccacatgactgggacctggaagaggtgatgaacagtatcagagattgctttgtcactggcaaatgggaagatgacaaagacgctgccaaggtgctggctgaagatgaagagctttacggagactttgaggatctggagactggagatgtccataaaggcaaatcagggccaaacacccagaacgaggatatcgagaaagaagtcaaggaggagatcgatcctgacgaggaggaaagcgcgaaaaaaaaacacctggataaaaaacgcaagctgaaggaaatgtttgatgctgaatatgatgagggtgaaagcacctactttgatgacctgaagggagaaatgcagaaacaggctcagttaaaccgggctgaatttgaggatcaggatgatgaagcccgtgtgcagtacgagggcttcagacccggaatgtatgtgagaatcgagatcgagaacgtgccctgcgagtttgtccagaactttgatccccactatccgatcatcctggggggactcggtaacagtgagggtaacgttggttatgtgcaaatgagacttaagaaacaccggtggtataaaaagattctgaagagccgagaccctataattttcagtgtcggctggagacggttccagactatcccactttattacatagaagaccataacgggcgtcagagactgttaaagtacacaccacagcacatgcactgcggtgcagcgttttggggaccgattacaccacagggaaccgggtttctggcaatccaatcagtgtcagggattatgccggatttcagaatcgcagctaccggggtggtgctagatctagacaagtcaatcaagatagtgaagaagttaaagctgacagggttcccatacaagatatttaagaatacttccttcatcaaaggcatgttcaattctgcactggaagttgcaaaattcgaaggcgcagtcatcagaacagtgtctggaattagagggcagatcaagaaggccctgagagctccagaaggcgcatttcgagcatcttttgaagacaaactgctcatgtcggatattgtcttcatgcgcacctggtatccagtgagtatcccagctttctacaatccggtaacctccctgttaaaaccagtcggcgaaaaggacacatggagcggcatgcgtacgacaggacagctgcggcttgcccacggcgtgagattaaaggctaataaggattctctgtataaacccatcctacgccagaaaaaacacttcaatagtctccacatccctaaggcattgcaaaaagctctgccattcaagaacaaaccgaagactcaggccaaagctggaaaggtacccaaggatcgtagacggcctgctgtgatacgcgaacctcatgagcggaagatactggcactgctggatgccttaagtacagtacattctcagaagatgaaaaaggccaaggagcagaggcacctccacaataaagagcacttcagagccaagcagaaagaagaggaggagaaactgaagcgacaaaaggacctccggaagaagctgttccgtatccagggccagaaagaacgaagaaatcagaaatcttccctgaaaggcgcagaaggtcaactgcaatag

SEQ ID NO: 22458 - DNA, 909 bp, Artificial Sequence
  Description of Artificial Sequence: Synthetic coding sequence
atggtaagctaccacaagcaggcatgcgagatccctccgacagtgaatcctcggaagaagttgtgggctttcccttccgattcctctcgtgacctgcccagtccgaagaaggccaaaactgaggaaatgccccagctgaactttgggatggcagacccgactcagatgggcggtctgagcatgcttctactcgcgggagagcacgctttgggtactcccgaggtgagttcaggaacgtgcagaccagatgtctctgagtcgccagagctgagacagaaatcgcctctgtttcagttcgctgaaattagctcttctacgtcacactccgatgcgagcaccaagcaatgtcaaacgagcgcactgttccaattcgcagagatttcctcaaacacatctcagcttggcggagccgaacctgtgaaaaggtgtgggaaatctgcgttgtttcagctggccgaaatgtgcctggcatcagaggggatgaaaatggaggaatctaagctcattaaagccaaggagtccgacggcggacgcattaaggaactcgagaaaggcaaggaggagaaagagatcaaaatggagaagaccgacgaaacgcgcctccagaaggaggctgagtttgagaagtcggcaaaggagaatttaagagactccaaggaattgaggaattttgaggccctacaaatcgacgacataatggccattaaaatggaggaccccaaggagatcaggaaagaagagctggaggaggatcacaagtgttcacatttccctgatttcagctactctgcaagctccaagatcataattagtgatgttccatctagaaaagaccacatgtgtcacccgcacgggattatgatcattgaggatcctgcagctctcaataagccggagaagctcaagtag

SEQ ID NO: 22459 - DNA, 2826 bp, Artificial Sequence
  Description of Artificial Sequence: Synthetic coding sequence
atgaagggatccaatagaaacaaagatcattctgccgaaggagagggtgtgggaaaaaggccaaagaggaaatgtctgcaatggcatcccctccttgcaaagaagcttttggatttttcagaggaggaagaggaagaggatgaagaagaagatatagataaggtgcaactgctcggcgctgatggtttggaacaagatgtgggcgaaaccgaggatgacgaatctccagaacagagggcccgtcgccctatgaacgccttccttctattttgcaagagacatagatcactggttcgacaggaacacccccgtctcgacaatcgaggcgctacaaaaatcttggccgactggtgggcagtgctggatccaaaggagaaacaaaaatacacagacatggctaaagagtataaagatgcattcatgaaggcaaaccccggttacaaatggtgcccgacgacaaataaacccgtaaagtccccaacccccacagtcaacccaaggaagaaactctgggccttccctagtgatagcagccgggaccttccctctcccaagaaagccaagaccgaagagatgccccagcttaattttggcatggcggaccccacacagatgggcggattgtccatgcttcttttggctggggagcacgcactgggtaccccagaagtctcaagcgggacctgtagaccagacgtgtcagagtcaccggaattaaggcagaagagtcctctgtttcagtttgctgagatcagttccagtacaagccatagcgacgcttcaacaaaacagtgccagacgagcgcactgttccagttcgctgagatttccagcaatactagccagctcggaggcgctgagccagtgaaaaggtgcggtaagtctgccctttttcagctggccgagatgtgcttggctagcgaaggaatgaagatggaggagtctaaattgataaaggccaaggagtctgacgggggtaggattaaagagctggaaaaggggaaagaggagaaggaaatcaagatggagaaaacagacgagactcgcctccaaaaggaggcagagtttgagaagagcgccaaggagaaccttagggactctaaggagctgcggaactttgaagccctacagattgatgacatcatggcaattaagatggaggatccaaaagagatcaggaaggaggagctcgaggaagatcataagtgtagccattttcctgatttctcatactccgctagcagtaagataattattagcgatgtgccatccagaaaggatcatatgtgtcacccccatggcatcatgatcattgaagatcctgctgctttaaataaacccgagaagttgaagaagaagaaaaagaaaagcaagatggaccgacacgggaatgataaatccacaccgaaaaaaacttgtaaaaagcgtcaatcatccgagtcagacattgaatctgtgatctacactatcgaggccgtggctaagggcgactggggcatcgagaaactgggggacacccctaggaagaaagtgagaacgtcgtcctcggggaagggctcaatcctggacgcaaagccaccgaagaaaaaagtcaagtctagagaaaaaaagatgtcaaaagaaaaaagctcagacactaccaaggagtcgagaccaccagattttatatccatcagcgcctcgaagaacatctccggagaaactccggaagggatcaaggctgagcctctcacccctatggaggacgctctccctccttcactaagtggacaagcaaagcctgaggacagcgattgtcataggaaaattgaaacatgcggctcccgcaagtcggaaaggtcttgcaaaggagcgttatacaaaactctggtgtcagaaggaatgttgaccagtcttagggccaatgttgatcgcggaaagaggagctcaggcaaaggcaacagttccgatcatgagggctgttggaatgaggaaagttggaccttctcgcagtcggggacatccgggagcaaaaagttcaagaagaccaagcccaaggaggattgcctgctcggatcagctaagctggatgaagagttcgagaaaaagttcaatagccttccccaatattcccctgtgacgttcgacagaaagtgcgtcccagtgccgagaaaaaaaaagaaaactgggaacgtgagttctgaacccaccaaaaccagcaagggaccattccagtctcagaagaaaaacctcttccacaagattgtttcaaagtataagcacaaaaaagagaagcccaatgtgcctgaaaagggctcaggagataagtggagcaataaacagcttttccttgatgccatccatcccactgaagcgattttcagcgaagaccgaaacaccatggagcccgtgcataaggttaagaatatacctagcattttcaatacaccggaacccaccaccactcaagaacccctggtgggctcacaaaagagaaaagcaaggaagaccaagatcactcacttagttcgcacggctgacgggagagtgagccctgccggtgggacgctggacgacaaacctaaggagcagctgcaacggagcttacccaaggcgaccgaaactgattgtaacgacaagtgcagtcataatactgaagtcggagagacccgtagctccacgccagagatgcccgcagtgtcagccttctttagcttggctgcactggccgaagtggcagcaatggaaaatgtacaccgtgggcagcggagcacgccactgacgcacgacggccagcccaaggaaatgcctcaggcccctgtgttgatctcctgtgcagaccagtag

SEQ ID NO: 22460 - DNA, 1347 bp, Artificial Sequence
  Description of Artificial Sequence: Synthetic coding sequence
atgaaaggttcgaaccgcaataaggatcactctgcggaaggcgagggcgtagggaagaggccaaagagaaaatgcctgcagtggcatcctctcctggcaaaaaagctgctggacttctctgaagaggaagaagaggaagacgaagaggaggatatcgacaaggttcagcttctgggggctgatgggctggagcaggacgtgggagagacggaggatgacgagtcaccagagcagcgtgctcgtagaccaatgaacgctttcttactcttctgcaagcgccaccggtctctggtcaggcaagagcaccccaggctcgataacagaggcgcaaccaaaattctcgccgattggtgggcggtactggatcccaaagagaagcagaaatacacagatatggccaaggaatacaaagacgcctttatgaaagcaaatccgggatataagtggtgcccaactacaaataaacctgtcaagtcccccacaccaacagtgaacccccgtaagaaattgtgggctttccccagcgacagcagtcgggatcttccttcgccaaagaaagcgaagacagaggagatgccgcagctcaattttggcatggccgatcccacacagatgggcggtctgagcatgctgctcctggcgggtgagcacgccctggggacccctgaagtgtcttctggcacttgtcggcctgacgtatctgagtctcctgagctgaggcagaagtcccccctcttccagtttgccgaaatttcgtcatccacctctcatagcgatgcttccacaaagcaatgccagacctcggccctgtttcaattcgcagagatcagcagcaatacctctcagctcgggggagctgagccagtcaagcgttgtggtaaatctgccttattccagctcgctgagatgtgcctggcttccgaaggcatgaaaatggaggaaagcaagctgatcaaggccaaggagagcgacggagggaggatcaaagagctggaaaagggcaaggaggaaaaagaaataaagatggagaaaacagacgagacacgattgcagaaggaagccgagttcgaaaagagtgcgaaggaaaacctgagagatagcaaggaattgagaaacttcgaggcgctccagattgatgatatcatggccattaagatggaggaccccaaggagatccggaaggaagagctggaggaagatcacaagtgctcacacttccccgatttctcctacagcgccagctcaaaaatcatcatttcagacgtaccctcacgcaaggaccatatgtgccacccgcacggcattatgataatcgaggatccggctgcacttaacaagccggaatag

SEQ ID NO: 22461 - DNA, 2736 bp, Artificial Sequence
  Description of Artificial Sequence: Synthetic coding sequence
atgaaaggcagcaatagaaacaaggatcactcggctgagggggaaggagtggggaagcgacctaaacgcaagtgtctgcaatggcaccctttacttgcaaaaaaattgctagatttctcggaggaagaggaggaagaggacgaagaagaggatattgataaagtgcaactgcttggcgctgatggtttagagcaggacgttggcgagaccgaggacgatgaaagcccagaacagcgagccagaaggcccatgaacgctttcctccttttctgtaaaagacatcgcagtctagtccgccaggagcatccaaggttagataaccggggagcaacgaaaatactggctgactggtgggcggttttggaccctaaggagaagcaaaaatataccgacatggctaaggagtataaagatgcttttatgaaggctaaccctggttacaaatggtgtccgactacaaacaaacccgtaaaaagccccaccccaaccgtgaatccgaggaaaaaactctgggcgtttcctagtgactcctcacgagatctgccttctcccaagaaggcaaaaaccgaagagatgccacagttgaattttggtatggctgaccccactcaaatggggggattgtccatgctgttgctcgccggagaacacgctctaggaaccccagaagtgtccagcgggacatgtcgcccagacgtttctgagagtcccgaattaaggcagaaatcacccctgtttcagtttgctgaaatctctagttccacctctcactccgacgcttctacaaagcaatgccagacatcggcgctcttccagtttgccgagatctcttccaatacttcccagctcggcggagccgaacccgtgaagaggtgtggaaagtctgccctgttccagctggctgagatgtgtctggcttcggagggcatgaaaatggaggagtccaagctcataaaggcgaaagagtcggatggcggtcgcatcaaggaactggagaaaggcaaggaagagaaggaaattaagatggaaaagacagacgagacccgcctgcagaaagaggccgaattcgagaaatccgcaaaggagaatctacgggattcaaaggagcttaggaacttcgaggctctccaaatagatgatattatggctatcaagatggaagaccccaaagagattcggaaagaagaacttgaggaggaccacaagtgcagccatttcccggacttttcctacagcgcctcctcaaaaattatcatttctgatgtcccttcccgcaaggatcatatgtgccaccctcacggcattatgatcattgaggaccctgctgcactcaacaaaccggagaagctgaaaaaaaaaaaaaaaaaatcgaaaatggaccgacatggcaacgataaaagcacaccaaaaaagacctgtaaaaagcgccagtcctctgagtccgacatcgagtccgtgatttacacaatcgaagcagtggccaaaggtgattggggcatagagaagctgggagataccccacgaaaaaaagtccggacctcaagcagcggaaaggggtctatcctggatgccaagcctcccaaaaagaaggtgaagtctagagagaaaaaaatgagcaaggaaaagagctccgacacaaccaaagaaagtagaccccctgacttcatctctattagtgcctccaaaaacatcagtggggagacccctgaggggattaaggccgagccactaacacccatggaagatgccctgcctccaagcttgtccggccaggcaaagcctgaggatagcgactgccaccgcaaaatcgagacgtgcggttcccggaagtccgagcgttcctgcaagggtgccttatacaagaccctggtgagcgaaggaatgttaacatctctaagggctaatgtcgacaggggtaagcggtcttctggcaagggtaatagcagtgatcatgaaggatgctggaacgaagagtcatggacttttagccagagcgggacttccggatccaaaaagtttaaaaagacgaaacctaaggaagattgccttctggggtccgccaaactcgacgaggagttcgagaaaaaattcaactcactgccccagtattctccagtgacttttgaccggaaatgcgtgcctgtacctcgcaaaaagaagaagactgggaatgtgtcttccgagcccaccaaaacctccaagggatctggcgataagtggtcgaataagcagctctttcttgatgccatccaccctacggaggcaattttcagtgaggataggaatactatggagccagttcataaagtgaaaaatatcccaagcatattcaacaccccagaaccaacgactacccaagaaccactagtcgggagccagaagagaaaagctaggaaaaccaagatcacgcacctagtccgcacagctgatggaagagtgtctccagcaggcggtacactcgacgacaagcctaaagaacaacttcagcgctctttgcctaaggcaaccgaaaccgactgcaacgacaaatgctcccacaatacagaagtcggcgagacccgcagttccactcccgagatgcctgctgttagtgccttcttttcactggccgctctggctgaagtggcggcaatggaaaatgtgcatcggggtcaacgttcgactccacttacccatgatggccaacccaaagagatgcctcaggcaccagtcctgattagctgcgctgatcagtag

SEQ ID NO: 22462 - DNA, 450 bp, Artificial Sequence
  Description of Artificial Sequence: Synthetic coding sequence
atgaaaggttctaaccggaacaaagatcatagtgcagagggagaaggtgtcgggaagaggcccaagagaaagtgtctccagtggcatcctctgcttgcaaagaaattgctggacttttccgaggaggaagaagaggaggacgaagaggaggacatcgacaaagtgcagttgctgggcgctgacggactggaacaggatgtcggcgaaacagaggatgatgaatcaccagagcaacgagcgaggcggccaatgaacgcattcctcctattctgtaaacgacatagaagtcttgttagacaggaacatcccaggttagataataggggagccacaaagatcctagccgactggtgggcagtgctggaccctaaggaaaagcaaaaatatacggacatggcaaaagaatacaaggatgccttcatgaaggcgaatcccggttataagtggtag

SEQ ID NO: 22463 - DNA, 2736 bp, Artificial Sequence
  Description of Artificial Sequence: Synthetic coding sequence
atgaagggttctaacaggaacaaagaccattctgccgaaggggaaggggtgggcaagagacctaaacgcaagtgcctgcagtggcatcctctcctcgcgaagaagcttcttgatttcagtgaagaagaggaggaagaggatgaagaagaggatatcgacaaagtccagctcctaggcgctgatggtttagagcaagatgtaggggagacagaagacgacgagtctccagaacaacgggctcgaagacccatgaatgcatttcttcttttctgtaagagacacagatcactcgtgcgccaagagcacccaaggctggacaatagaggagctacaaagattctggccgattggtgggccgtgctggacccgaaagagaagcagaaatacaccgacatggccaaggaatacaaggacgccttcatgaaggccaaccccggatacaaatggtgtccaactactaataagcctgtgaaatcccctactccaaccgtgaacccacgtaagaagctgtgggcgtttccttctgactctagtcgggatctcccttcgccaaagaaggccaaaactgaggaaatgccccagttgaatttcggtatggcagacccaacccagatgggtggcctgagcatgctgttgctggccggtgagcacgccttggggactcccgaggttagctcaggaacttgccgccctgatgtctctgagagtccagagcttcggcagaaatccccactgttccagttcgcggagatttcctcttcgacgtcccactcagacgctagtactaaacaatgccagaccagcgcactttttcaattcgcagagatcagtagcaacacaagtcagcttggcggagctgagcctgtgaagagatgtggtaaaagtgcactctttcaactggcggagatgtgtctggcaagcgaaggaatgaagatggaggagagcaagttaattaaagccaaggaatccgatggcggtcgaatcaaggagctcgagaaagggaaagaggaaaaggagataaagatggagaaaacagatgagacccgccttcagaaggaggccgagtttgagaagagcgccaaggagaaccttcgtgactcaaaggagttaagaaactttgaagccctccaaatcgacgacatcatggcgattaaaatggaggaccctaaggagatcaggaaggaggagcttgaggaggatcacaaatgcagccatttccctgattttagctattctgcctcgagtaaaatcatcatttccgacgtgccatctcgaaaagatcatatgtgtcacccgcatggaatcatgatcatcgaggatccagcagccctgaacaagccagagaaactcaagaagaagaaaaagaagtccaagatggaccggcatggcaatgataaatccacgccaaagaagacatgcaaaaaacgccagtcctccgagtccgacattgagagcgtgatatacacaattgaggcagtcgcaaagggggactggggtatcgagaaactgggggatacgcctcggaaaaaggtcagaacatcaagctccggaaagggtagcatcctagacgccaagcctccaaaaaagaaggtcaagtcacgtgagaaaaaaatgagcaaagaaaaaagcagtgacaccacaaaagagtcacggccacctgacttcatctctatcagcgcaagtaaaaacataagtggcgagacccctgagggaatcaaggcagagcctctgaccccgatggaagacgcactgccacctagcctgagtgggcaggctaaaccggaagactctgactgccaccggaagatcgagacatgtggctcccgcaagtcagaacggtcctgtaagggagccctctacaaaacactggtctccgaggggatgcttacctccttgcgtgccaatgttgaccgcggaaaaaggtcttccggaaaaggaaacagttcagatcatgaaggctgctggaatgaggaaagctggacattctcccagtctggaacgtcaggcagtaaaaaattcaaaaagacaaaaccgaaagaggattgccttttggggagcgccaaactggatgaagagttcgaaaaaaaattcaattccttaccacaatattctccagtcacattcgataggaagtgcgtgcctgtgccgcgaaaaaagaaaaaaacaggaaacgtttcttccgagcccaccaagacaagcaaaggttccggcgacaagtggtcaaacaagcaactgttcttggacgctattcatccaaccgaggccatcttttccgaggaccggaacactatggagccagttcataaagtgaagaatatccctagtatttttaatacccccgagcctaccacaacacaggaacccctggttggcagtcagaagaggaaagctcgcaagaccaagatcactcacctcgtgagaactgccgacggcagagtaagtcctgcaggagggaccttggacgataaaccaaaggaacagcttcagcgttcactccccaaggctactgagaccgactgtaacgacaaatgctcccacaacaccgaggtcggagagacccgatctagcacgcctgaaatgcctgccgtgtcggcttttttcagtctggccgctctcgccgaagtagcagccatggagaacgtgcacaggggacagcgcagcacgcccctgacccacgatgggcagccaaaggagatgccccaggccccagtcctcatttcttgtgccgaccagtag

SEQ ID NO: 22464 - DNA, 75 bp, Artificial Sequence
  Description of Artificial Sequence: Synthetic coding sequence
atgaagggctcaaatcggaataaggatcatagtgccgagggtgaaggcgttgggaagcgacctaagcggaagtag

SEQ ID NO: 22465 - DNA, 582 bp, Artificial Sequence
  Description of Artificial Sequence: Synthetic coding sequence
atgaagggctccaacagaaataaagatcatagcgcagagggtgagggagttggaaaacgacctaaacgcaaatgtttgcagtggcaccctctgttagccaaaaagttactggactttagcgaggaagaggaagaggaggacgaggaagaagatatagacaaggtgcagttacttggtgccgacggactggagcaggacgttggcgaaacagaagatgatgagtcgccagaacagcgagctcgacgacccatgaatgccttcttgctcttttgcaagcgacatcggtctctcgttcggcaggaacacccgcgtttagacaacaggggcgctaccaagattttggcggattggtgggcagtgttagatcccaaggaaaaacagaagtatactgatatggcaaaagagtataaggacgctttcatgaaagcaaatccaggctacaagtggtgtcccacaacaaataagcctgtcaaaagcccgactcctactgtgaatccgagaaaaaagctgtgggcatttccctctgatagctctagagacctgcccagtcccaagaaggccaaaaccgaggagatgccttag

SEQ ID NO: 22466 - DNA, 501 bp, Artificial Sequence
  Description of Artificial Sequence: Synthetic coding sequence
atgaagggatcaaaccgcaacaaggatcactcggccgagggcgaaggagttggcaaacgacctaagagaaaatgcctgcagtggcacccactgctcgccaagaaactgttggacttctccgaagaagaggaagaagaggatgaagaggaggacattgacaaggtgcaactgctgggcgctgatggactcgaacaggatgtgggcgagacagaggatgatgaaagtcctgagcagagagcacggaggccaatgaatgcttttctgctgttctgcaagagacacaggtcactggtgcgtcaagagcacccaaggctggataacagaggcgcaactaagatcctcgcagattggtgggccgtattggaccctaaggagaaacaaaaatacactgatatggctaaagaatataaagatgcatttatgaaggccaacccaggctataagtggtgtccaaccactaataagccagtcaagtctcctacgcctaccgtgaacccctag

SEQ ID NO: 22467 - DNA, 312 bp, Artificial Sequence
  Description of Artificial Sequence: Synthetic coding sequence
atgaagggaagcaatcggaataaagaccacagcgctgagggcgagggggtcgggaagagaccaaaacgtaagtgtctgcagtggcatcctctcctggccaaaaagcttcttgatttcagcgaagaagaagaggaagaagacgaggaggaagacatcgacaaggttcagctgctcggcgctgatgggctcgagcaggacgttggtgaaactgaggatgatgagtcacccgaacagcgtgctagaagacccatgaacgcattcctgttgttctgtaaacggcatcgcagtctggttcgacaggaacacccatag

SEQ ID NO: 22468 - DNA, 480 bp, Artificial Sequence
  Description of Artificial Sequence: Synthetic coding sequence
atgaagggctccaaccgaaacaaagaccactcagccgagggagagggcgtggggaaaagacctaaaaggaagtgtctgcagtggcacccgctactggccaagaaactacttgacttctcagaagaagaggaagaagaggatgaggaggaggatatcgataaagtgcaactgttgggtgccgacgggctcgagcaggacgtgggagagacagaagacgacgaatcccctgagcaaagagccagacgccctatgaatgctttcttgctgttttgcaaacgccacaggtcactggttaggcaagagcatccaaggcttgataaccggggagccaccaaaattcttgctgattggtgggccgtcctcgatccaaaagaaaagcagaaatacaccgacatggccaaagagtataaggacgccttcatgaaggcgaatcccggatacaagtggtgcccgaccacaaacaagcctgtgaagagctag

SEQ ID NO: 22469 - DNA, 345 bp, Artificial Sequence
  Description of Artificial Sequence: Synthetic coding sequence
atgaaagggtccaatcgcaataaggaccactccgctgagggcgagggggtcggcaagcggcctaagaggaagtgtctgcagtggcaccccctgctcgctaagaagctgctggatttttccgaagaggaggaggaagaagatgaggaggaggatatagacaaagtgcagctactgggcgctgatggcctagagcaggacgtcggagaaacagaagacgatgagagtcctgaacaacgtgccagacgcccaatgaatgccttcctattattttgcaagcgtcatcggtccctggtgcgccaggaacatccaaggctggacaatcgcggtgccacgaagatcctgtag

SEQ ID NO: 22470 - DNA, 435 bp, Artificial Sequence
  Description of Artificial Sequence: Synthetic coding sequence
atgaaaggtagcaatagaaacaaggatcactccgccgagggggaaggggtgggcaagaggccaaagcggaagtgcctgcagtggcacccactactggccaaaaagttgttagatttctccgaggaagaagaggaggaagacgaagaagaagatatcgacaaggtgcagcttctcggtgccgatggactggaacaggacgtgggtgagaccgaggacgacgaatccccagagcagagggccagacgtccaatgaacgcttttctactcttctgcaagcgacaccggtccctggtgcggcaggagcatccacgccttgataacagaggcgcaactaaaatactcgccgattggtgggccgtcctggatccaaaggagaagcaaaaatacacggatatggcgaaggagtacaaggacgcattcatgaaggctaattag

SEQ ID NO: 22471 - DNA, 42 bp, Artificial Sequence
  Description of Artificial Sequence: Synthetic coding sequence
atgaagggatcgaatcgcaacaaagaccactccgctgagtag

SEQ ID NO: 22472 - DNA, 618 bp, Artificial Sequence
  Description of Artificial Sequence: Synthetic coding sequence
atgaaaggcagtaaccgcaataaggatcatagcgcagagggtgaaggcgtcggcaagagaccgaaacggaaatgtcttcaatggcaccccttgctggccaaaaaactgctggacttttccgaggaggaagaagaggaagatgaggaagaggacatcgacaaagtgcagctcctgggtgcggatggactcgagcaggatgtaggggagacggaggatgatgaatccccagagcagcgggctcggaggcctatgaatgcatttctgttgttttgcaagcggcaccggtccctcgtgcgacaagaacacccaagactagataatcgcggagctaccaagatactcgccgattggtgggctgtactggatcctaaggaaaagcagaagtacacagatatggccaaagaatacaaagacgcttttatgaaggcgaatcccggatacaagtggtgtcccacgactaataagcctgtcaaaagccctacacctacagtgaaccctaggaaaaagttgtgggccttcccaagtgacagttctcgtgatctgccctctccaaaaaaggccaagaccgaggagatgccccaattgaattttggaatggccgaccctacacagatgtag

SEQ ID NO: 22473 - DNA, 216 bp, Artificial Sequence
  Description of Artificial Sequence: Synthetic coding sequence
atgaaaggtagcaaccggaacaaagaccacagcgccgagggggagggggtcgggaaaaggccaaaaagaaagtgcctgcagtggcatcctcttctcgccaagaaattgcttgattttagtgaggaggaggaggaagaggacgaagaagaggacatcgacaaagtacagctgctaggcgcagatggactcgaacaagatgtgggagagaccgagtag

SEQ ID NO: 22474 - DNA, 258 bp, Artificial Sequence
  Description of Artificial Sequence: Synthetic coding sequence
atgaagggcagcaatcgcaacaaagaccacagcgcagagggcgagggcgttggaaagcggccaaagaggaagtgcctccagtggcaccctctattggccaagaaactgcttgacttcagcgaagaagaagaagaggaggatgaggaagaggacatcgacaaagttcagttgcttggagctgacggtttggagcaagatgttggcgagactgaagatgacgaaagccccgaacaaagggccagacgcccaatgaactag

SEQ ID NO: 22475 - DNA, 297 bp, Artificial Sequence
  Description of Artificial Sequence: Synthetic coding sequence
atgaaaggaagtaatcggaataaggaccattccgccgagggcgaaggagtgggcaagcgtcccaagcggaaatgcctgcaatggcacccgctgcttgctaaaaaattactggactttagcgaggaagaggaagaagaagatgaagaggaagacatcgacaaggtgcagctactcggagccgacggacttgagcaagacgtgggtgagactgaggacgacgagtcccccgagcaacgagcaagacggccaatgaatgcctttctgttgttctgcaaacgccacagatctctggtgtag

SEQ ID NO: 22476 - DNA, 2466 bp, Artificial Sequence
  Description of Artificial Sequence: Synthetic coding sequence
atggaccccgaatgcgcccagctgctgcctgcgctctgtgctgtgttggtcgatccaagacaaccagtcgcggacgatacgtgtctggagaagctcttggattggttcaagacggtcaccgaaggtgaatctagtgtagtcctcttgcaggaacatccgtgcttggttgagctgctgtctcacgtcctgaaggtccaagacttatcaagcggggtgctcagtttctccctgagactggccggaacttttgcagcccaggaaaactgctttcagtaccttcaacagggggagcttctgccaggtctctttggagaacctgggcctctcggcagggctacgtgggctgtgcctaccgtcaggagtgggtggatccaaggccttcgctccctggctcagcatcctagtgccctccgctttctcgccgaccacggagccgttgataccatattctcccttcagggggactctagtctgttcgtcgctagcgctgcatcacagctcctggtacacgtactagcactgagtatgcggggaggtgctgaagggcagccatgcctgcccggaggcgactggcccgcttgtgctcagaaaataatggatcatgtggaggagtccctgtgttcagcggcaacccccaaggtgacccaggccctgaatgtgctaaccacaaccttcggtcggtgccagtccccctggaccgaagcactctgggttagactgtcgcccagggtagcttgtctgctggaaagggaccctatcccggcagctcatagctttgtggacctccttctgtgtgtggcccgatccccagtgttctcttctagcgacggctccttgtgggagactgtggctagagccctgagctgcctcggcccaacgcacatgggacccctggccctgggaatcctcaagctcgaacactgtccccaggccttgcggactcaggcatttcaagttctccttcaaccccttgcatgtgttctgaaggccacagtgcaggctccaggcccaccaggcctcttggacggaaccgctgacgatgccactaccgtggatacattactggcctccaagagctcttgtgctggacttctgtgtagaacgctcgcccacttagaggaattgcagccactgccccagagaccttcaccatggccccaggcttcactgctcggcgcaaccgtaacagttctgcgcctctgcgacggctccgctgctccggctagctccgtcgggggacacttgtgcggtacactggccggatgtgtgcgagtgcaaagagcagccttagatttccttgggaccctgagtcagggtactggtccgcaagagctggtgacacaggcattggccgtcttgctcgagtgtctggagtctcccggtagtagcccaactgtactcaagaaggcctttcaggctacgctgcgttggctcctttcatctcccaaaacccctggctgcagcgacttaggccctctaatcccgcagttcttgcgcgaactgtttccggtactacaaaaaaggctgtgccacccttgctgggaggtccgcgacagcgcactcgaatttcttacgcagctcagtcgtcattggggaggtcaggctgatttccgctgcgcattgctcgctagcgaagttcctcagctggccctccagctcctgcaggatcccgagtcttacgtccgcgcttccgccgtgaccgctatggggcaattgtcttcacagggcttgcacgctccaacctcccccgaacatgccgaggcgcgtcagtcactgttcttggagctgcttcacattctgagcgtagacagtgaggggttcccgaggcgggcagtgatgcaggttttcacagagtggctcagggacggacatgccgatgccgcacaagacaccgaacaatttgtggccacggtcctgcaagcagccagtcgcgatttagattgggaggtacgagcccaaggtctggaattggctctggtctttctgggccagactctcgggccaccccgaacacattgtccctacgccgtcgccctgccagaggtggcccctgctcagccactgactgaagccctgagggctttgtgtcacgtcggactgttcgactttgcattttgcgccctgttcgactgtgacaggcctgtggctcagaagagctgcgacctccttctatttcttagagacaagatcgcgtcatattccagcctacgtgaagcaagagggtctcctaatacagcgagcgctgaggcaaccttgcctcgatggcgtgcaggagagcaggcacaaccaccgggtgaccaggagcctgaggccgtgctggctatgctgagatcgctggatctggagggactgaggagcactttggccgagtcctccgatcatgttgagaagagccctcagagtcttttgcaggacatgctggcaaccggcggtttccttcaaggggacgaggccgactgttattag

SEQ ID NO: 22477 - DNA, 720 bp, Artificial Sequence
  Description of Artificial Sequence: Synthetic coding sequence
atggccaagccatgcggcgttcgattgagtggcgaagctcgaaaacaagtcgaggtattccgacagaatttgttccaggaggctgaggaattcctgtatcgattcctgccccaaaaaatcatctatcttaaccaactgctccaggaggacagtctaaatgtggcagacctgacatctcttagggctcctctggatatccctattcctgatccccctcccaaagatgacgagatggaaacagataaacaagaaaagaaggaggtgcacaagtgcgggttcctccctgggaacgagaaggtgctgtctctgctggccctagtgaaacccgaagtttggaccctcaaggagaagtgcattttggtgattacgtggattcaacatctgatccccaaaatcgaagatggcaacgacttcggggtggccattcaggagaaggtcctcgaacgtgtgaacgcagtgaaaacaaaagttgaggcattccagaccaccatatccaagtacttctctgagcggggagacgcagttgctaaggcttcaaaggagacccacgtgatggactacagagccttagtgcacgagagggatgaggccgcttacggcgagttaagagcaatggtgctggacttaagggccttttacgccgaattgtaccacatcattagcagcaatttagaaaagattgtgaatccaaagggagaagagaagccatccatgtattag

SEQ ID NO: 22478 - DNA, 828 bp, Artificial Sequence
  Description of Artificial Sequence: Synthetic coding sequence
atggacgatgaggactgtgaaagaagacggatggagtgtctggacgagatgtcgaatcttgagaagcagttcactgacctcaaagaccagctatacaaggagcgcctgtcccaggtagatgctaagctgcaagaggtaatagcaggcaaggcgcctgaatacctggaaccactcgctactcttcaggaaaacatgcagatacggaccaaggtggcgggtatctaccgagaattgtgcctggagagcgttaaaaataagtacgaatgtgaaattcaggcctcccggcaacattgtgagtctgagaaactgcttctgtacgacacagtccagagcgagctcgaggagaagattaggcggctggaggaagaccgacactctatcgacattacatctgagctgtggaacgatgagttgcaaagcaggaaaaaacgtaaggatcccttttcacctgacaaaaagaaacctgttgtggtgagtggcccttatatagtctatatgcttcaggatctggatattctggaagattggactaccatcaggaaagccatggccaccctgggacctcacagagttaagaccgaacccccagtcaagttggagaaacacctccactctgcaaggagtgaagagggacgactttactacgacggggaatggtatatacggggtcagaccatctgtatcgacaaaaaggacgaatgtccaaccagtgctgtcattacgaccattaaccacgatgaggtttggttcaaacgccctgacgggtccaagtcaaaactgtacatatcccagttgcagaaaggcaagtactcaattaaacactcctag

SEQ ID NO: 22479 - DNA, 1614 bp, Artificial Sequence
  Description of Artificial Sequence: Synthetic coding sequence
atgggagcgacaggagcggctgagccgcttcagagtgtgctgtgggtgaaacaacaaaggtgcgcagtttccttggagccagctcgggctctgctccggtggtggcgctcacctggaccaggggcaggggctcctggagccgacgcgtgctcagtgccggtgtccgagatcatcgcagtagaggagacggatgtgcacggaaagcatcaggggtcgggcaaatggcagaaaatggaaaagccatacgctttcacggtccattgcgtgaaacgggctcggaggcatcgctggaaatgggcacaggtgactttttggtgtcctgaggaacaactgtgccacctgtggctgcagacattgcgcgagatgctagaaaagttgacgtctcggccaaagcatctactagtgttcattaaccctttcgggggtaagggccagggcaaaaggatctatgagaggaaagtggccccactgttcacgttggcctccatcacgactgatatcattgtcacagagcacgctaaccaagctaaggaaacgctgtatgagattaacatagataaatacgatggcattgtgtgcgtggggggagatggcatgttcagcgaagtccttcacggactgattgggcgtacccagcgcagcgccggagtggatcagaaccatcctagggccgtgctagtcccaagtagcttacgcatcggcataatccccgcaggctcaacagattgtgtgtgttatagtaccgtgggcacatcagacgctgaaacatcagcgctgcacatcgtcgtcggcgattctctggcgatggatgtgtcttctgtccaccataactcaacactcctcaggtattctgtgtctctgttaggttatgggttttatggagacatcatcaaggattctgagaaaaagaggtggctcgggctcgcacgctacgacttttctggactgaaaacctttctgtctcatcattgctacgaaggtacggtcagtttcctaccagctcaacataccgtaggttctccccgtgacagaaagccctgtcgagctgggtgttttgtgtgcaggcaaagcaaacagcagctggaggaagagcagaagaaagccctgtatggtcttgaggccgcagaggatgtcgaggagtggcaggttgtttgtggaaaatttctggcaattaacgcgaccaatatgtcttgtgcatgtagaaggagcccacgcggattatctcccgcagcacacctgggcgatggcagtagcgatctgatcctgatccgcaagtgctcaagatttaactttctgcgattcctgatcaggcacactaatcaacaagatcagtttgactttacttttgttgaggtttatcgggtgaagaagtttcaattcacatcaaaacacatggaagatgaagatagcgaccttaaagaaggcggtaagaaacgattcggacacatatgcagttctcacccttcatgttgctgcactgtgtccaactccagctggaactgcgacggggaggtcctccatagccctgcgatagaggtacgagtgcattgtcagttggtaaggctgtttgctagggggatcgaagaaaatcccaagccggacagtcattcctag

SEQ ID NO: 22480 - DNA, 2355 bp, Artificial Sequence
  Description of Artificial Sequence: Synthetic coding sequence
atgcagtctcggaaatgcctaaaaagggattgcgatcagcaggctgatggtctttgtcggtttggcagcttcgattgttttcgttcttctagacgtagttcatctactacacgcgcttggacgtccgcttctagaactagaacttcggaccggctcaatagaatcgctaatcaggtggccatccagcgcaaaaagcaatttgtggaacgggcacactcctactggttactgaagcgactttctaggaacggcgctcctctcctccgaaggctccaatcttctctgcagtcgcagaggtcttcacagcagcgcgagaacgatgaagagatgaaggccgctaaagaaaaacttaagtactggcaaagactgcgtcatgatttggagagggcacggctgcttatcgagctgctgcgcaagagggagaaattaaagagagagcaggtgaaagtggagcaggtggcaatggagttgcgccttactcccctgactgtgctgctgcgatcggtgttagatcagctccaagacaaagaccctgccagaattttcgctcagccagtgagcttaaaagaggtgccagattacctcgatcacatcaagcatcccatggactttgcgacaatgaggaagcggttggaagctcagggatacaaaaacttacatgagtttgaggaagactttgaccttattattgataattgcatgaagtacaatgctcgggatactgtgttctaccgtgcagccgtcaggcttcgggaccaggggggagtggtccttcgccaagcacggagggaggtagactctattggactcgaggaagcctctgggatgcatctgccggagcggcctgcagccgctccaaggcggccattctcctgggaggacgttgatagactcctggacccagcaaaccgggcacacctcggtcttgaggagcagctgagggaacttttggatatgctggacttaacctgcgcaatgaaatctagcgggtctagaagcaagcgtgccaaactcttaaagaaggagatcgcactactgcggaacaagctgtcgcagcagcattcccagcctctgccaaccggacctggcttggaagggttcgaagaagatggcgcagcactgggtcccgaagctggagaagagggcgataagagtcctccaaaactggaaccttctgacgccctgcccctcccaagcaacagtgagacaaattcagagccaccgaccctaaaacctgttgaattaaaccccgagcagtccaaactcttcaagcgggtcacttttgacaatgaatctcattcagcttgcacgcagtccgcccttgtgagcggcagaccaccagagcctaccagagcctctagcggtgacgtgcccgctgccgctgcgagtgccgttgcggaaccagctagtgacgtgaacagacgtacgagtgtgctgttctgcaagagcaagtcggtgtctcctcctaagtctgctaaaaacaccgagacacagcccacttcgccccaactgggaacgaaaacattcttatccgtcgtactaccaagactggaaacgctgctgcagccaagaaaaagaagccgatctacatgcggtgacagtgaagtggaggaagagagccctggtaaacgcctggatgcgggacttaccaacggctttggtggagcacgtagcgaacaggaacccggagggggactgggcaggaaagccacccccagacgtcggtgtgcaagtgaatcttccatcagcagcagtaattctccattgtgtgattcatccttcaacgctccaaagtgcggaaggggaaaacccgcactggtaagaagacacacgctggaggatcgatccgaattgatctcatgtatcgaaaacggtaactatgcaaaagctgcaagaattgccgctgaagtgggccagagtagcatgtggatcagtacggatgccgctgcctctgtgctggagcccctgaaggtcgtgtgggccaagtgtagtggctatcccagctaccctgctctgatcatagaccctaaaatgccaagagtaccaggccatcataacggtgtgaccataccagcgccaccactggacgttctgaagattggagagcatatgcaaacaaagagcgacgagaagctgttccttgtgctgtttttcgacaataaacgcagttggcagtggttacccaagagcaaaatggtaccactcgggattgacgagactatcgacaagctgaagatgatggagggccgaaacagcagtatccgaaaggccgttaggattgctttcgacagagctatgaaccacttgtccagagtgcacggagagcctacaagcgatctcagcgacattgactag

SEQ ID NO: 22481 - DNA, 3177 bp, Artificial Sequence
  Description of Artificial Sequence: Synthetic coding sequence
atgaggaggaaaggaagatgccatcgagggtctgcagcacgccatccctcttccccatgcagcgtgaaacattcccctactcgggagactttgacctacgctcaggcacagcgcatggtggagatcgagattgaggggcgattacataggatatctatctttgaccctctggaaatcatactggaggatgacttaactgcccaagaaatgagcgagtgcaacagcaataaggagaacagtgaacgcccacccgtgtgtctgaggaccaagcgtcacaagaataatagagtaaaaaaaaaaaacgaggccctcccttcagcgcacggaacaccagcgtcagcctccgctctccctgaacccaaggtaaggattgtggaatattcacctccgtctgctccaaggaggccacccgtttactataagtttatagagaagagcgcagaggagctcgacaacgaggtggaatacgatatggatgaagaggactatgcttggctggaaattgtgaacgagaagcgcaagggagactgtgtaccagccgtaagccaatcaatgttcgagttcctgatggaccgattcgagaaggagagccactgcgaaaaccagaagcagggggagcagcagagcttgattgacgaggatgctgtgtgttgtatctgcatggatggcgagtgccagaacagtaacgtgatcctgttctgcgatatgtgtaatctggcggtccaccaagagtgttatggtgtcccatatattccggaaggccagtggctctgccgacattgcctgcagagtagggcccgaccagccgactgtgtactctgtccaaataaagggggtgcattcaaaaaaacagacgatgacaggtggggccatgtggtctgtgccctgtggattccagaggtaggctttgccaataccgtgttcattgaacccatagacggcgtccgcaatattccccctgcacgatggaaactcacctgttacctttgcaagcagaaaggcgtcggcgcatgtattcaatgccacaaggccaattgttacaccgcttttcacgtcacctgtgcgcagaaggccggactctacatgaaaatggagcccgttaaggagcttacaggcggtggtacaacattctctgtccgaaagacagcttactgcgatgttcacacccctcccggatgtacaagacgacccttgaacatctacggggatgtggagatgaagaacggcgtgtgcaggaaagagtccagcgtcaagactgttagaagtacatccaaggtcagaaagaaggcaaagaaggccaagaaagcactcgccgaaccgtgcgctgtgttgccaactgtgtgcgctccatacattccgcctcagcgcctcaatcggatcgcaaatcaggtggcaattcagagaaaaaagcagtttgtggagagagcacactcctactggctcttaaagcggttaagccggaacggagcaccactgctgcggcgtttgcaatctagtctacagagccagcgcagttctcagcagcgtgagaacgacgaggagatgaaggccgcaaaggagaagctcaaatattggcagagactgcgtcatgacctagagcgtgctcggcttttaatcgagttgctgcggaagcgggagaagttgaagcgcgaacaggtcaaggtggagcaagtggctatggagctgcgactgaccccgcttaccgtccttctgagatctgtcttagatcagcttcaggacaaagatcccgcacggatctttgcccagcccgtcagcctcaaggaggtccctgattatctggatcatatcaagcatccaatggacttcgccacaatgcgaaaacgtctggaggcacaggggtacaaaaatctacatgagttcgaagaagatttcgacctaattatcgataactgcatgaaatataatgcccgagacacagttttttatcgcgcagctgtcagactccgggatcaagggggagtggtcctgcgccaggcgaggagagaggtggactccatcgggcttgaagaagccagcgggatgcacctgccggagaggcccgctgccgcacccaggaggccttttagctgggaagatgtcgacaggttacttgaccctgctaatcgtgctcacctcgggctggaagaacaactgcgagaactcctcgacatgctggaccttacatgtgcgatgaagtcctcaggatcacgcagtaagcgcgcaaaacttttgaagaaagagattgctctgcttagaaacaagctgtcccaacagcacagtcaacctttaccaactggtccgggtctggaagggttcgaagaggatggggctgccctggggccagaagccggagaagaagtgctgccccgtcttgaaaccctgctccagcccagaaagcgcagtagatccacctgtggtgacagcgaggtcgaggaggagtcccctggcaaaaggcttgacgcaggactaactaatggcttcggaggcgcacggtccgagcaggagcctggcggaggcctggggcgaaaagccaccccaaggcggagatgcgcttcagagtcttccatcagcagcagtaactctcctctgtgcgattcctcattcaacgctcccaagtgtgggcgtggaaagcctgccctcgtccggagacacacgttggaagaccggtcagaactgatctcatgtatcgagaacggcaactatgccaaagcggctaggatagccgcagaggtgggccaaagcagtatgtggataagcacagatgccgctgccagcgtgttggaacctctcaaggtggtgtgggctaaatgctccggctacccatcctaccctgctctgatcattgatcccaaaatgcctcgagtccccggacatcataatggagttaccatacccgcacctccactggatgtgttaaagatcggagagcacatgcaaaccaagtccgatgaaaaactgttcctggtattattttttgataacaagcggtcctggcagtggctgcctaagtctaagatggttccactcgggatcgatgaaactatcgataaactgaagatgatggagggccgaaactcatcgattcgcaaggccgtgcgtatcgccttcgaccgagctatgaaccacctgtcccgggtacatggcgaaccgaccagcgacttgagcgatatcgactag

SEQ ID NO: 22482 - DNA, 1950 bp, Artificial Sequence
  Description of Artificial Sequence: Synthetic coding sequence
atgaaagccgctaaggaaaaactgaagcgcgaacaagtaaaggttgagcaggtcgctatggagctgagactgactccactgacggtcttgctgcgcagcgtgctggatcagctccaggacaaagacccagccaggattttcgcgcagcccgtgtccttgaaggaagtgcctgactatctggaccacattaaacaccccatggactttgcaacaatgcgaaagcggttggaggctcaggggtacaagaacttgcacgagtttgaagaggatttcgacctgatcatcgacaactgcatgaagtacaatgcgagagatacggtcttctaccgcgctgcagtgagactgcgtgaccagggcggtgtggttttgagacaggctagaagagaggtcgacagcattgggttggaggaagcttcaggaatgcacctgcccgaacgcccagctgctgctcccaggcgtccattctcttgggaggatgtcgataggctgcttgacccggcaaatcgtgcacacctggggctggaagaacagctgcgcgaacttttagacatgttagacttgacgtgtgccatgaagtcaagtggctcaaggtctaaaagagccaaactgttgaaaaaggagattgccctgctaagaaacaagctctcccagcaacacagccaaccactacctaccggcccaggactcgagggcttcgaggaggatggcgcagcactgggacccgaggccggagaagaaggggacaaaagccctcctaagctggaaccttccgacgctctccccttaccttctaacagtgagaccaattctgagccccctaccctaaagccggtcgaactgaacccagagcagtctaagctttttaagcgcgtgacttttgataatgaatctcactcagcatgcactcaaagcgcgctggtttctggcagaccccctgaaccgacacgagcttcatcaggtgacgtccccgctgctgctgccagtgctgtggccgaaccagctagcgatgttaataggaggacgtctgtgctattctgtaagagtaaatcggtgtcacctcccaaatctgcgaagaacaccgagacccagcctacttctccccaactgggcacgaagacctttttgtccgtagtcttaccaagattggagactctgctacagcccaggaagcggagccgctccacatgtggcgattctgaagtggaggaagagagccctggcaaacggttggacgccggtctcacgaatggctttggtggcgcaagatccgaacaggaaccaggtggaggcctgggcaggaaggccactcccagaagacgctgtgctagtgagagtagcatctcttcatcaaactcacccctgtgcgatagctcctttaatgcaccgaagtgcggcagaggcaaacccgctctcgttagacgccataccctcgaagacaggagcgaattgatctcttgcatcgagaatggaaattacgctaaagccgcaagaatcgcagctgaggtcggtcagtcgtcaatgtggatcagtacggatgctgccgcatccgtgttggagccgttgaaggtggtgtgggccaagtgttctgggtatccgtcataccctgccttaataatcgaccccaagatgccacgcgtgccgggacatcacaatggtgtgactatacccgctcctccgctggacgtgctgaagattggggagcatatgcaaaccaaaagcgacgaaaagttattcctggttctgttttttgacaacaaacgctcctggcagtggctccctaagtcaaagatggtgcctttgggaatcgatgaaacaattgacaagctgaaaatgatggaggggcgaaattcatcaattagaaaggctgttcgaatcgcttttgacagggccatgaaccacttgtctcgcgtacacggcgaaccaaccagtgatctgagcgatatagattag

SEQ ID NO: 22483 - DNA, 2988 bp, Artificial Sequence
  Description of Artificial Sequence: Synthetic coding sequence
atgcgacgaaaaggtcgctgccacagaggttcagcggctaggcatccctcctctccatgttccgtgaagcactcacctacccgggagactcttacctatgcccaggctcagcggatggtcgagattgaaattgagggtcgcctgcatcgcatcagcatattcgatcccctcgagatcatcctcgaggatgatctcactgctcaagagatgtccgagtgcaactcaaataaagagaactctgagcggcctccagtttgcctccgcaccaagagacacaaaaataaccgcgtcaaaaagaaaaacgaggcactgccatcagctcacggcacaccggcttccgcctctgctctccctgagccaaaagtcagaattgtggaatattctcctccatctgcacccagacgaccgccagtatattataagttcattgaaaagtccgcagaagagctagataatgaagtggagtacgatatggacgaggaggactacgcttggctcgaaatcgtaaatgaaaaacgtaaaggtgactgtgtcccagctgtttcccagtccatgttcgagtttctcatggaccgttttgaaaaggaatcccattgcgaaaaccaaaaacagggcgagcagcaaagccttattgatgaagatgccgtatgttgtatctgcatggacggtgagtgccagaatagtaatgtgattcttttctgtgacatgtgtaatctcgcggttcaccaagagtgttatggagtcccttacatccccgaaggacagtggctgtgccgacactgccttcagtccagggcacgtccagcggactgcgtcctctgcccgaacaagggcggagcgttcaagaaaacagacgacgacagatggggtcatgtagtgtgcgcactgtggatccctgaagtcggattcgcgaataccgtgtttattgagccgattgatggagtgcgcaacatcccacctgcccgatggaaactaacttgctacttgtgcaaacagaagggagttggagcttgcattcagtgtcacaaagcgaattgttacaccgcattccacgttacctgcgctcagaaggcaggactttacatgaaaatggagcccgttaaggaactgactggagggggaactactttttctgttagaaaaaccgcttactgcgacgtacatacaccccctggctgtactcggagacccctcaacatctatggcgacgtggagatgaaaaatggagtgtgtcggaaggaatcgtcagtgaagacagtgaggtctacgagcaaagtccggaagaaggcgaagaaggctaaaaaggcgctggctgagccatgcgctgtacttcccacggtgtgtgcaccgtacatacctccccagaggctcaatcgaatcgcgaatcaggtcgctattcagcgaaagaaacagttcgtcgagagagcccatagttactggcttctgaaaaggctatcacgaaatggtgcgccactcctacgtcggttgcagtctagtctccagtcacagcgtagcagccagcagcgggagaacgacgaagagatgaaggcggcaaaggagaaactgaagtactggcagcggttgagacacgatctagaaagggcacggctgctgattgaacttcttcgcaagcgagagaagttgaaacgtgagcaggttaaggtggagcaggttgcgatggagctgagactgacaccattgactgtgcttctcaggagcgtacttgaccagttacaggacaaagaccctgccagaatttttgcgcagcccgtgtctctgaaagaggtgccagactatctggatcatattaaacaccctatggatttcgccactatgaggaaaagattggaggctcagggatataaaaaccttcatgagttcgaggaggatttcgatctaattatcgataactgcatgaagtacaatgctcgcgatacggtcttctatagggccgctgtaagattgagagatcagggcggtgtggtgctaaggcaggcaaggcgggaggtcgacagcatcgggttagaagaggcatccggcatgcatttaccagagcgtcccgctgcagcaccacggaggccctttagctgggaggacgtggacaggctcctagaccccgcaaatcgagcccacctcggcctggaagaacagctgcgagaactgctggacatgctggaccttacgtgtgcaatgaagtctagtggaagtaggtctaagagggctaagcttctaaaaaaggaaattgccctactcagaaacaagctttcacagcaacacagccagcccctgccaaccgggccaggacttgagggtttcgaggaggatggcgcagcccttggaccggaagccggagaagaaggcgacaaatcccctcccaagctagaaccctctgacgccctgccgctaccctcaaacagtgagacaaatagcgagccacccacacttaagcccgtggagcttaacccagagcagtcaaaactgtttaaacgagttacgtttgacaatgaatctcactctgcctgtacgcagagtgccctggtatccggccgacctcctgagcccactagagccagctccggcgacgtgccagcagctgctgctagcgctgtcgccgagcccgcatccgatgtaaacagacgcacaagtgtcttattctgcaaatcgaaaagctcctttcgcggatggagactcttttgctctcagggcaagggcaggggtgctcacgcggagactcccaggtggcggaggagcccacaggagtccgcctggacacaagtctctcctaccgcccttggcgtgaggggggcttctcgatcaagggccgcagcctggggcggtcggcctcatcccgacgatgctgtgccaccatctcccgcaagtcctcccgctactgccaggtctgctacacgggctctgatgcggccaaatgtcgggggtgcaaataggctcttgtgtgacggaacgcgctggcgtaccgcagtgtcgtag

SEQ ID NO: 22484 - DNA, 2241 bp, Artificial Sequence
  Description of Artificial Sequence: Synthetic coding sequence
atgaagatggagcctgtaaaggagcttaccggtggcggaacaaccttctccgtgaggaaaaccgcctattgcgacgtgcatactcctccaggatgcacgaggaggccgctcaacatttacggggacgttgaaatgaaaaatggcgtctgccggaaagaaagctctgtgaaaaccgtgaggtctacttctaaagtgcgaaagaaggccaagaaggctaagaaggccttggccgaaccgtgcgcggtattgccaactgtctgcgcaccatacatccctccccagcggtttatacggatgcaatcaagaaaatgcctgaagcgcgactgtgatcagcaggcagatggtctatgtcgcttcgggagctttgattgctttaggtcctcaagaaggtccagctcaacgaccagagcttggacttctgcgtcccggactaggacttcagacaggttgaaccggatagcaaatcaggtggcgattcagcgcaaaaaacaattcgtagaaagagcccatagttattggttgctgaagcgattgagccggaatggcgcacccctgcttcgccgtctgcagtcctctctccagtcacagcgctcttcgcaacagcgcgagaacgacgaagaaatgaaagccgcaaaagagaaactgaagtattggcagcgcctacgccacgatttagaaagagcccgattacttatcgagctgctgcggaaaagagagaagctcaaacgggaacaggtcaaggttgagcaggtcgccatggagctgaggctgacgccccttaccgtccttctgcgcagcgtcctggatcagttacaggataaagatcctgccagaatctttgcgcagcccgtgccagattatctggaccacattaaacatccaatggactttgccactatgagaaagcggttggaggcccagggctataaaaacctccatgaatttgaggaggatttcgaccttattattgataattgtatgaaatacaatgcccgagataccgtgttctatagagccgctgtccggctcagggatcagggtggcgtggtgctgcgccaagctaggagggaggttgacagcatcggcctcgaagaggcgtccggtatgcacctgcccgagcgcccagcagcagcgccaagaagacctttttcgtgggaggatgttgacaggttgttagatcccgcaaacagagcacacctcggcctggaggagcaactgcgagagctgctggacatgctggacctcacttgtgctatgaagtcctcgggaagccggtccaagagagccaagctcctgaagaaggaaatcgcattgctaaggaacaaactgtcgcagcagcacagtcagccactgcctaccggacctgggctcgaagggttcgaagaggatggggcagctctcggtccagaagcaggagaggaagtattgcctagactggaaacccttctgcagcccaggaagcggtcccgaagcacatgcggtgatagcgaggttgaagaggagtcgcctggtaaacgcctcgacgccggtttaacaaacggttttggcggagccaggagcgaacaagagcctggaggcggtctgggacgcaaagccaccccccgacgcagatgcgcatccgaaagcagcattagctccagcaattcacccttatgcgattcgtccttcaacgcccctaagtgtggcaggggcaagccggcattggtaaggaggcacaccttagaggatcgtagtgaactgattagctgtatcgaaaacggtaactatgccaaggcggctaggattgcggcagaagtggggcagagctcaatgtggatatccaccgacgccgctgccagcgtgctcgagccactgaaggtagtatgggccaagtgttccggatacccttcctacccagcgctcattatcgatccaaagatgccccgtgttcctggccaccacaatggcgtgaccatacctgcacccccactggacgtgctcaaaattggagagcatatgcagacaaagtctgacgagaaactttttttggtgctcttttttgataacaagaggagctggcagtggctgcccaaatctaaaatggttccgcttggtattgacgaaacaatcgacaagctgaaaatgatggagggtcgtaatagcagcattcggaaggccgttaggattgctttcgaccgggcaatgaatcatctgagtcgcgtgcacggtgagccaacaagcgatctgagtgacatcgattag

SEQ ID NO: 22485 - DNA, 2181 bp, Artificial Sequence
  Description of Artificial Sequence: Synthetic coding sequence
atgtctactgccactaccgtagcccctgcgggtattcctgctacacccggacctgtgaatccaccccctccagaggtgtctaacccttcaaagcccggacgtaagacaaatcaactccagtatatgcagaacgtggtcgttaaaacactgtggaagcaccagttcgcctggcccttctaccagccagtggatgctataaagttgaacctccccgactatcacaagataatcaaaaaccctatggatatgggtacgataaagaagagactcgaaaataattactattggtctgcatccgaatgcatgcaggacttcaatactatgttcacaaactgctatatatacaacaagcctacagatgacattgtcctgatggcccaggcactcgaaaagatcttcctccagaaggtagcgcagatgccgcaagaggaagttgaactgctaccccctgcaccaaagggcaaaggacgcaagcctgctgccggagcccagagtgctggcacccaacaggtggcggcagtgtcatcagtgagcccagccacgccgttccagtctgtaccgccaaccgtgtcacaaactcccgtgattgctgcaacacccgtcccaacaattacggctaacgtcactagcgtgccagtgccacctgccgcagcccctccacccccagcaaccccaattgtgcctgtcgtgcctccgactcctcccgttgtgaagaagaagggcgtgaaacgcaaagctgatacgactactcccaccacatcagcaatcactgcaagcagaagcgagtctcctccacccctctccgatcctaagcaggccaaggtggtggccagacgggaatccggaggcagaccaattaaaccccctaagaaagacttggaggatggagaggtacctcagcacgcaggaaaaaaaggcaagttgtcagagcacctgaggtattgcgactctatactcagggaaatgctttctaaaaaacatgctgcatatgcatggccattctacaaacccgttgacgcagaagctctagaactacatgactatcacgatatcatcaagcacccaatggacctgtccaccgtcaagaggaagatggatgggagggaatacccagatgcgcaggggtttgctgcagatgtgaggctgatgttcagcaactgctataaatataacccacctgatcacgaggtggttgctatggcccgaaagctgcaggacgtgttcgaaatgaggtttgcaaagatgcccgacgagccggtcgaagcgcctgctttgccagccccagccgcacctatggtgtctaagggcgctgaaagttccagaagttcggaagaatccagctcagacagcggctcatcagactctgaagaagagagggcaactagacttgccgagcttcaagaacagctgaaagcagtgcacgagcagcttgcagccctgtcccaggctccggtcaataagcccaagaagaagaaagaaaagaaagagaaggaaaagaaaaagaaagataaggagaaggaaaaggaaaaacataaggtgaaagccgaggaggagaagaaggccaaggttgcccctcctgccaagcaagcccaacagaagaaggctcccgcaaaaaaggctaactctaccactacagcgggaagacagctgaaaaaggggggtaaacaggcctccgcatcctacgatagcgaagaagaggaagagggcctgcccatgagttacgacgagaaacgccagttgagcctggatataaaccgactccctggtgagaaactgggaagggtggtccacattatacaatcccgggagccaagcctgagggacagcaacccggacgagatagaaatcgattttgaaacgctgaaacccacgacgctgcgggagttagagagatacgtgaagtcctgccttcagaaaaaacaacggaagccattctcagcatcgggtaaaaagcaggcagctaaatccaaagaggaactggctcaggagaaaaagaaggagctggagaaacgtcttcaagatgtgagcggccagctctcctcttctaaaaagcctgccagaaaagagaagccaggctcagcacctagcggagggccatcacggctgagctcaagcagttcatctgaatcaggttcttccagttcatcgggatcgagtagcgactcatcggacagcgaatag

SEQ ID NO: 22486 - DNA, 1671 bp, Artificial Sequence
  Description of Artificial Sequence: Synthetic coding sequence
atgtccacagcaacgacagttgcccctgccggtatacccgctacgcccggacccgtgaaccccccacctccggaggtgtcaaatccttctaaacccggtagaaaaacaaaccagctccagtacatgcagaacgtggtcgtgaaaactctgtggaagcatcagtttgcgtggccattctatcagccggttgacgctatcaagcttaatctgcccgattaccataaaatcattaaaaacccaatggacatggggacaatcaagaaacggctcgaaaataattactactggtcagcttccgaatgcatgcaagactttaatacaatgtttaccaactgttatatctataacaaacctacagacgatatagttcttatggcccaggcgctcgagaagatcttccttcagaaggttgctcagatgccccaagaggaggtggagctgttgcctccagcccctaagggtaagggtagaaagccagcggctggggcacaatcggctggtacccaacaggtggccgcagttagttctgtctcccctgcgactccctttcagtccgttcctccaacagtatcccagaccccggttatcgcagcgaccccggtcccaacaattacggctaacgtgacatccgtgcccgtcccaccagcagctgcgcctccacccccagcaacacccattgtccctgtggtgcccccaacccctcccgtagtgaaaaagaagggagtgaagagaaaggccgacacaacgactcctactacaagcgccattaccgcaagtcggagcgaatcgccgccaccactgagcgatccaaagcaggccaaggtcgttgccagaagggaatcaggtggtagaccaattaagcccccaaagaaggatctggaggacggtgaggtgccacagcacgccggaaaaaaagggaaactgagtgagcatctgagatattgtgactccattctccgagagatgctatccaagaagcatgccgcatacgcgtggcctttttataagcccgtcgatgctgaagcgctcgaactgcatgactatcacgacatcattaagcatcccatggacctgtcgacagtgaaaaggaagatggacggacgcgagtatccagatgcacagggcttcgcggcagacgtccggctcatgttctccaactgctataagtataaccctcccgatcacgaagtagtggcaatggccaggaaacttcaggatgtgttcgaaatgcggttcgccaaaatgccagacgaaccagttgaagcacctgcactgcccgcacccgctgccccaatggtctctaagggagcagagtcttctcgcagcagcgaagagagctcaagtgattcagggtcatcagattcagaggaagagcgagccacccgcctggctgagctgcaggagcagttgaaggcggtgcacgaacagctcgctgcactctcccaggcgccagtgaacaagccgaagaaaaagaaggagaagaaggagaaggagaaaaagaagaaagataaggaaaaggaaaaagaaaaacacaaggttaaagccgaggaggaaaaaaaagccaaagtggctcctcctgccaagcaggcccagcagaagaaggcacctgccaagaaggctaactccaccacaaccgcaggacgcgaccactttcttacctgtggcgtgtag

SEQ ID NO: 22487 - DNA, 1671 bp, Artificial Sequence
  Description of Artificial Sequence: Synthetic coding sequence
atgagtacggccacaaccgtggctcccgcagggattcccgcaaccccaggtccagtgaacccccctcccccagaagtctcaaatccgagcaagcctgggaggaagaccaaccaactgcaatacatgcaaaacgtcgtcgtcaagactctctggaagcatcagttcgcatggccattttatcagcctgttgacgcaattaagctcaatctcccagattaccataaaataattaagaaccccatggacatgggaaccattaaaaaacgcctggagaacaattattattggagtgcctcagagtgtatgcaggacttcaatacaatgttcacgaattgctacatctataacaagcctaccgatgatatcgttttaatggcccaagcgctagaaaaaatattcctccagaaagtcgcccagatgccacaggaggaggtggagcttctgcctccagcccctaagggcaagggcagaaagcctgccgcaggagcccagagtgccggaacacagcaagttgcggctgttagctccgtgagtccagcaacgccgtttcagtctgtccctccaacggtgtcccagacccctgttatcgcagcaacccccgtccccaccatcactgcaaacgtgacttccgtcccagtgcccccagctgcggcacctccaccgcctgccacacccatagtccccgtcgtgcctcccacaccccctgtcgtgaagaagaaaggagtgaagcggaaagccgacaccaccaccccgactacctcagccattaccgcatcaaggtccgaatcaccccctccattgtctgatccaaaacaggccaaggtcgtcgctcggcgagagtctggcggtcggccaataaagcctcccaaaaaggatctggaggatggagaggttccgcagcatgctggcaagaagggcaaattgagtgagcaccttcgatactgcgattctatactgagagagatgttgtccaagaagcatgcagcatacgcctggcctttctacaaacccgtcgatgctgaggctctggaactacacgactaccacgacatcattaagcatcctatggatctttctaccgtgaagagaaaaatggacggacgcgagtatccggacgcacagggcttcgccgcagatgtgagactcatgttctcaaattgctacaagtacaaccctcctgatcatgaagtagtcgccatggctcggaagctacaggacgttttcgaaatgaggttcgctaaaatgccagacgaacccgtggaagcccctgctctgcctgccccagcagccccaatggtttccaagggcgctgagtcgtcacggtcatccgaggaaagctcttccgatagtggttcttccgattccgaggaagagagggctactcgactagctgaactccaggagcagttaaaagctgtgcatgaacagctggctgccttgagtcaagcgccagtgaataaacctaagaagaaaaaggaaaagaaagaaaaggaaaaaaaaaaaaaggataaagaaaaagagaaggaaaaacataaggtgaaagcagaagaggagaaaaaggctaaagtagcaccacctgccaaacaagcccagcagaaaaaggctcccgctaaaaaggccaatagtactactactgccggacgcgaccatttcctcacgtgcggagtgtag

SEQ ID NO: 22488 - DNA, 225 bp, Artificial Sequence
  Description of Artificial Sequence: Synthetic coding sequence
atgtctacggctacaacagtggccccagccggtatcccagcaacaccgggtccagtcaaccctcctcctcctgaggtttcaaatccttccaagcctgggcgaaaaaccaaccagctccagtatatgcagaatgtcgtggtgaagaccctgtggaaacatcaatttgcctggcctttctaccagcctgtggacgctattaagctgaaccttcccgactaccactag

SEQ ID NO: 22489 - DNA, 63 bp, Artificial Sequence
  Description of Artificial Sequence: Synthetic coding sequence
atgtcaacagctactactgtggccccagctggcattccagcaacaccaggccctgtcaattag

SEQ ID NO: 22490 - DNA, 1218 bp, Artificial Sequence
  Description of Artificial Sequence: Synthetic coding sequence
atgttatccaagaaacatgccgcatatgcgtggcccttctataaaccagtggatgctgaagccctagaactccacgactaccacgacatcatcaagcacccaatggacctaagtaccgtcaagagaaagatggacggcagagagtaccccgatgcgcagggattcgcagcagatgttaggctgatgtttagcaactgttacaaatataatccacctgaccatgaggtcgtggccatggcaaggaagttgcaggatgtgttcgaaatgcgatttgccaagatgcctgacgaaccagttgaagcacctgcccttcccgcacctgccgctccaatggtttccaaaggagctgagagctctagaagcagcgaagagagctccagcgattctggttcctcagactcggaagaggaaagggccacccgtctagctgagcttcaggagcagctcaaggccgtgcacgagcaactcgcggctttgagtcaagcacctgtaaataaacctaaaaaaaagaaggaaaagaaagagaaggagaaaaaaaagaaggataaggagaaagagaaggagaaacataaagtaaaagcagaggaagagaaaaaggcaaaggtcgcacctcccgctaagcaggctcagcagaagaaggcaccagcaaagaaggccaattctaccacaactgctggaaggcagcttaaaaaaggtggaaaacaagcatctgcctcctacgactccgaagaggaggaggaggggttgcccatgtcctatgacgaaaaacgtcaactgtctcttgatataaatcggctgccaggagagaagctggggagggtggtccatatcatccagtccagggagccctctcttcgggattccaaccctgacgagatcgaaatcgactttgaaaccctgaagccaacgacgctcagagaacttgaacggtatgtgaagagctgtctccagaagaaacagcgcaaacctttcagcgccagtggtaaaaagcaggcagcaaaatctaaagaagaattggctcaagagaagaagaaagagctggagaaacgcctgcaagacgtaagtggccagttaagttcatccaagaagcctgcgagaaaggagaagcccggttcggcaccgtctggcggaccatcaaggctttcgagctcaagcagcagcgaaagcggctcatcatccagctcgggttctagcagcgactcgtcggacagcgagtag

SEQ ID NO: 22491 - DNA, 1062 bp, Artificial Sequence
  Description of Artificial Sequence: Synthetic coding sequence
atggccgctactaagcgcaaaagacgcggaggcttcgcagtgcaggcaaagaagcctaagcggaacgagatcgacgctgaaccccctgccaagcgccacgccaccgctgaagaggtggaggaagaggagagagatagaatcccaggaccggtttgtaaaggaaagtggaaaaacaaggaacgaatacttattttttctagccggggaatcaatttccgcacccggcacctcatgcaggacctgagaatgctcatgccccattcaaaagcggatactaaaatggataggaaagataaacttttcgtcatcaacgaggtttgcgaaatgaagaactgcaacaagtgcatatatttcgaggccaagaaaaagcaagatctgtacatgtggctgtccaattctccccacgggccaagtgctaagttccttgttcagaacattcacaccctggccgaactgaaaatgactgggaattgtcttaaaggatcccgcccattattatcattcgatcctgcatttgacgagctaccacattacgctctccttaaggagcttttaatccaaatctttagcacaccacgataccatcctaagagccagccctttgtggatcacgttttcactttcaccatcctggacaaccgaatttggttccggaattttcagatcattgaagaggatgctgccttggtcgagatcgggcctaggtttgtgctaaacctgatcaaaattttccaggggtccttcggtggccctactctctatgaaaatcctcattatcaatcaccaaacatgcataggagggtcatcaggtctatcacagctgcaaaataccgcgagaaacaacaggtgaaggatgtccagaagttaaggaagaaggagcccaagaccctcctgccacacgacccgacggcggacgtcttcgtgaccccagcagaagagaaacctatcgagatccagtgggtgaagcctgagcccaaggtggatttaaaagccaggaaaaaacgaatctacaagagacagcgcaaaatgaagcaaagaatggattctgggaagacgaaatag

SEQ ID NO: 22492 - DNA, 1428 bp, Artificial Sequence
  Description of Artificial Sequence: Synthetic coding sequence
atggccggtaggccccatccctacgacggcaattccagcgaccccgaaaattgggatcgaaaactgcattctcgacccagaaagctgtataagcactccagcacaagcagcagaattgctaaaggcggagttgaccatacgaagatgtcattgcacggcgcttccggcggtcacgagcggtctcgggaccgcagacgcagttctgatagatctcgcgactcatcccatgagcgaacggagtcccagctgaccccctgtatccggaatgttacatcaccaacacggcaacaccatgtcgagagagagaaagatcactcgagtagtaggccttcttctccccgtccccagaaggccagtcctaacgggtcgatctcttccgcgggtaactcaagccggaatagcagccagtccagttccgacggtagttgtaaaacagccggtgagatggtgtttgtctacgagaacgcaaaggagggggctcgcaacatcaggaccagcgaaagagtgacattgatcgttgataacaccagatttgtcgtcgacccgtccatcttcacagctcaacccaacacaatgctgggtaggatgttcggcagcgggcgtgagcataatttcacccgccctaatgaaaagggtgagtatgaagtggccgagggaattgggtccacagtctttcgggctatacttgattattataagactgggattattcgatgcccggatggcatcagtataccggagctgagagaggcctgtgactatctgtgcatcagcttcgaatactctaccattaagtgtcgtgatctgtccgccctgatgcacgagctctctaatgacggcgcacggagacagtttgaattttacctcgaagaaatgattctgcctctgatggtcgcttcagcccagagcggtgaaagagaatgccatatagtggtgctgacggatgatgacgtggtcgactgggatgaggaataccctccccagatgggagaggagtattcccagattatatattctacaaaactgtatcggttttttaaatacatcgaaaatcgcgatgtggccaagtccgtgctgaaagagcgtggcctgaagaagattcgtctggggatagaaggctatcccacttataaggaaaaggttaaaaaacgaccgggagggagacccgaggtaatctataactacgttcagcgtccttttattcggatgagctgggagaaggaggaggggaagtcacgacatgtagattttcagtgcgtgaaatctaagtccataacgaacctagccgctgcagccgctgatattcctcaagaccaacttgtagtcatgcaccctactcctcaggtcgacgagctggacatactgccaattcacccaccgtcaggtaatagcgacctggacccggacgcccagaaccccatgctttag

SEQ ID NO: 22493 - DNA, 195 bp, Artificial Sequence
  Description of Artificial Sequence: Synthetic coding sequence
atggcaggcaggccccatccatacgacggtaattccagcgatcccgaaaattgggaccgaaaactccattcgaggcctaggaagctgtacaagcattcaagcaccagctcaagaatcgcgaaagggggagtcgaccatacaaagatgagcctgcatggcgctagcggcggtcacgaacgttctcgcgaccggtag

SEQ ID NO: 22494 - DNA, 201 bp, Artificial Sequence
  Description of Artificial Sequence: Synthetic coding sequence
atggctggcagacctcacccttacgacggcaactctagtgatcctgaaaactgggaccgcaagcttcatagtcgtccgaggaagctatataagcactccagcaccagctcccggatcgctaaagggggtgtggaccacactaagatgagtctgcatggggcatcaggtggtcacgagagaagtcgtgatcgaaggagatag

SEQ ID NO: 22495 - DNA, 1137 bp, Artificial Sequence
  Description of Artificial Sequence: Synthetic coding sequence
atggcaaggtgtggcgagggctccgcagcccctatggtgctcttggggagtgctggagtctgttctaaggggctacagcgaaagggcccttgcgagcggagaaggctcaaggcgaccgtcagcgaacagctttcacaagatctgctgagattactgagggaagagttccacactgacgtcaccttttctgtgggttgtaccctctttaaagcacacaaagctgtgctgctggccagggttccggacttctacttccacactatcggacaaacctctaactccttgactaaccaagagccgattgccgtggaaaacgtggaggctctcgaatttcgcacattcttgcagatcatttacagcagtaatcgtaatataaagaactatgaggaagagatcttacgtaagaagatcatggaaattgggatttcgcaaaagcagctggatatttctttccctaagtgcgagaactcatctgactgcagtctgcagaagcacgaaatccccgaggacataagtgacagagatgatgacttcatttccaatgacaactacgacctggagccagccagcgaactgggggaggacctcctgaagctgtacgtgaaaccctgctgcccggatatcgatattttcgtggacggtaaaaggttcaaagctcatcgcgctattcttagtgctcgcagttcctactttgccgctatgctctcgggatgttgggccgagagttcacaggagtatgtgaccttgcagggaatcagccatgtggagctgaacgtcatgatgcactttatttacggtggtactcttgacatccctgataaaacgaacgtgggccaaatcctaaatatggctgatatgtatgggttggaaggtctgaaggaggtggcgatatacattctgcggagggactattgcaattttttccaaaagccagtgccgaggactctgacatccatccttgagtgtctcattatagcccacagtgttggagtggaaagcttgttcgccgactgtatgaagtggatcgtaaaacacttcgctagattttggtctgagcggtcatttgccaacatacctccagagatccagaaatcttgtttaaacatgctgatacaaagtcttgtcagcataacctag

SEQ ID NO: 22496 - DNA, 918 bp, Artificial Sequence
  Description of Artificial Sequence: Synthetic coding sequence
atggccagatgcggtgaaggcagtgctgcgcctatggtcctgctgggaagtgcaggtgtctgtagcaaaggcctgcagcggaagggcccttgtgaacggagacgcctcaaggctaccgtttccgagcaattatctcaagatctcctgcggctactgcgggaagaatttcatactgacgttacttttagcgtggggtgcactctttttaaggcccacaaggccgtcttactcgctcgggtaccagatttttacttccacacgatcggccagacctccaacagcctcaccaaccaagagccgatcgctgttgagaatgtggaggctctggagttccggacctttctgcagatcatttattcaagcaatagaaacatcaagaactacgaggaagagattttaaggaagaaaatcatggagattggtatttctcaaaagcagctcgatatctctttcccgaagtgcgagaatagctctgattgcagtctgcaaaagcacgagattccagaagacatatcagacagggatgatgattttattagcaacgacaattacgacctggaacccgcttccgaattgggcgaggacttattaaagctgtatgtcaaaccttgctgtcccgatatcgatatctttgtcgatggcaagcgctttaaagcccatcgcgcaatcttgtcggccagatcctcctactttgccgctatgttgtctggttgttgggccgaatctagccaggagtacgtgaccctacagggcatttcacacgtggaactcaacgttatgatgcacttcatctatggaggcaccttggacattcccgataagacaaacgtcgggtatgttttcctgtttaataatctaaagtacaagcgggtgaggttctgtttcgtggagctctgttgtaaggttctaatgaagtag

SEQ ID NO: 22497 - DNA, 852 bp, Artificial Sequence
  Description of Artificial Sequence: Synthetic coding sequence
atggcccgatgtggagaggggtccgccgcaccaatggtcctcctgggatcagccggagtatgttccaaaggactccagcggaagggaccatgcgagaggagacgactcaaagctacagtctccgaacagctgtcccaggacctgctgcgcctgctccgcgaagagtttcataccgacgtgaccttcagcgttggatgcaccctgtttaaagcgcataaggcagttctgctggcacgagtccccgacttctattttcacaccattggccagactagcaattcactgacaaaccaggagcctatcgctgtggagaacgtggaagccttggaatttcgcaccttcctgcaaattatctattcctccaatcgcaatatcaagaattatgaagaagagatcttgaggaagaagatcatggagattggtatatcccagaaacagttggacatcagctttccaaaatgcgaaaactccagtgactgttctcttcaaaagcatgaaatcccggaggatatatctgaccgcgatgacgattttatttccaatgataattatgacttggaacctgcctctgagctgggggaggatctgctaaaactctatgtgaagccttgttgtccagacatagatatttttgtcgacgggaagcgtttcaaagctcaccgcgcaattctgtccgctaggtctagctacttcgctgcgatgctctcaggctgttgggctgagtcatctcaggagtatgtcacccttcagggcatcagtcatgtggaactaaatgtgatgatgcactttatctatgggggaacgcttgacatccctgataagaccaacgtgggcttgttccctgaacattag

SEQ ID NO: 22498 - DNA, 360 bp, Artificial Sequence
  Description of Artificial Sequence: Synthetic coding sequence
atggccggtcttatgacaatcgtcacaagcctgctgttcctcggtgtgtgcgctcatcacattattccaaccgggtccgtggttataccttccccatgctgtatgtttttcgtctccaaacggattcccgaaaatcgcgtggtgagctaccagttgagctcgagatctacctgtttgaaggccggtgtcatctttacaacgaaaaaggggcagcagttttgtggcgacccgaaacaggagtgggtacagagatacatgaaaaacctcgatgctaaacagaagaaggctagcccacgcgctcgggctgttgccgtgaagggacccgtccaacgctaccccggtaatcagacaacttgctag

SEQ ID NO: 22499 - DNA, 435 bp, Artificial Sequence
  Description of Artificial Sequence: Synthetic coding sequence
atgcctaaagtgaagcgctcaaggaaggcgcctcctgatggctgggaattgattgagccaacccttgatgagctcgaccagaagatgagagaggcggaaaccgaacctcatgaggggaagaggaaggtggagagcttatggcccatctttcgaatacatcaccaaaaaaccaggtatatattcgacctcttctacaagagaaaagccatttcccgtgagttatatgagtattgcattaaagagggctacgcagataaaaaccttattgcgaagtggaagaagcaggggtacgaaaatctctgctgtctgcggtgcatccagactagagacactaacttcggtacaaactgtatctgccgcgttccgaagtctaagctcgaggtaggacgcattattgaatgcactcactgcggctgccgaggttgtagtggatag

SEQ ID NO: 22500 - DNA, 312 bp, Artificial Sequence
  Description of Artificial Sequence: Synthetic coding sequence
atgccaaaagttaagaggtctcgaaaggcacccccagacgggtgggagcttattgaacccacccttgacgagctggaccagaagatgcgggaagagctgtacgaatactgcatcaaagagggatacgccgacaagaacctgattgccaagtggaaaaaacagggttatgaaaatctctgctgtctgcgctgcatccagacgagggacaccaacttcgggaccaactgtatctgtcgggtgcccaaaagcaaactggaagtgggccgaattatcgaatgcactcactgcggatgcaggggatgctctggatag

SEQ ID NO: 22501 - DNA, 1527 bp, Artificial Sequence
  Description of Artificial Sequence: Synthetic coding sequence
atgatatacgaggaatctaagatgaatctggaacaggaacggccatttgtttgcagcgcccctggctgctctcagaggtttccgaccgaagaccatctcatgattcatagacacaagcatgaaatgacgctgaagtttccttctataaaaaccgataacatgttgtctgaccagactccaacgcctaccaggttcctgaaaaactgtgaggaggtcggcctgtttagcgaactagattgttcactggagcacgagttccggaaagctcaggaggaggaatcctccaagcgtaacatctccatgcataatgccgttggaggcgctatgacaggccctggcacacaccaattgagttccgccagattaccaaaccatgatactaatgtggtgatccaacaggctatgccgtcaccccagtcctccagcgtcatcacacaggccccttctaccaaccggcagatcggacccgtccctggtagtcttagctcccttctgcatctgcataacaggcaacgccaacccatgcctgcttcaatgccaggaacgttacctaatcctacaatgccaggttccagcgctgtgttaatgcctatggagaggcagatgtccgtgaatagctccatcatgggcatgcagggccctaatctgtcaaacccatgtgcatccccccaggtccagcctatgcatagcgaggccaagatgcgcctgaaggcagcactgactcatcacccggcagcaatgtccaacgggaacatgaatactatgggacatatgatggaaatgatgggctctcgtcaagatcagacaccacaccaccacatgcattcccacccccatcaacatcagactctaccaccacaccacccctacccccaccagcatcagcaccccgcacaccatcctcacccccagccccaccaccagcagaatcacccccaccatcactctcactcacacctgcatgcccatccagcccaccatcagacctctccacaccctccactgcacaccggaaaccaagcccaggtgtctcctgccacccagcaaatgcagccaacgcagacaatccagcctccccagccaactgggggtcgcagaagacgcgtggttgatgaggatccggatgaaaggcggcgaaagttcttggagcggaaccgagctgctgctacgagatgtagacagaagcggaaggtctgggtgatgagcctcgaaaaaaaagctgaagagctcacgcagaccaatatgcaattgcagaatgaagtgtctatgctgaaaaacgaagtggcgcagctgaagcaacttctgctgactcacaaggattgccctatcaccgctatgcagaaggagtcacagggctacctgtcacccgaaagcagtcctccagcaagtccagtccccgcatgctcacagcagcaggttatccagcacaatacaatcacaactagctcatccgtgtcagaagttgtagggagctctaccctttcgcagctcactactcatcggactgacctcaacccaattctgtag

SEQ ID NO: 22502 - DNA, 1110 bp, Artificial Sequence
  Description of Artificial Sequence: Synthetic coding sequence
atgttttgtacgtcaggaggtaactccgcctcggtgatgtcaatgcggccagtccccggatccttaagctctctgctccatctgcataaccgtcagcgccaaccaatgccagcctccatgcctggtactctgcccaaccccacgatgcctgggtcttcagccgtgctcatgccaatggaacgccagatgtctgtaaacagttctataatgggcatgcaaggccctaacctaagcaacccttgcgctagcccacaggttcagcctatgcatagcgaggcaaagatgcggttaaaagcagcgttgactcaccaccccgcagccatgtccaatggtaatatgaatacaatgggccacatgatggaaatgatgggatcccgccaggatcaaacgcctcatcaccatatgcattcacatccacatcaacatcaaacacttcccccacaccatccatatccccaccaacaccagcaccccgctcaccatccccatccacaaccacaccaccagcagaaccacccacaccaccactcccattcccacctgcatgctcaccctgcccaccatcagacctccccacaccccccactgcacaccggaaatcaagcccaagtttcccccgcaacacagcaaatgcaacctacccagaccatccaaccaccccagccaaccggtggacgcaggcgacgggttgttgacgaggatcccgatgagcggagaagaaagttcctcgagcggaatagagctgctgctactcggtgtaggcagaagcgaaaagtgtgggttatgagcttagagaagaaggccgaggaactaacccagaccaatatgcagctgcaaaacgaggtatctatgctgaagaatgaggtcgcccaattgaaacagttgctcctgacccacaaggattgtcccatcacagctatgcagaaagaaagccagggatacctcagtcctgaaagttccccaccagctagcccagtgcctgcctgtagtcaacagcaagtgatccagcacaataccatcacaaccagcagcagcgtgtcagaggtggtgggctcttctaccttgtcccagctcacaacacatcgtactgacttaaaccctatcctgtag

SEQ ID NO: 22503 - DNA, 1428 bp, Artificial Sequence
  Description of Artificial Sequence: Synthetic coding sequence
atgattcatcgacacaaacacgaaatgaccttgaagttcccttcaatcaagacagacaacatgctctccgaccagactccaactcccacccgcttccttaaaaattgcgaagaggtgggtctcttctccgagcttgactgcagcctagagcatgaattccgcaaggcacaggaggaggagtcatccaagcggaatatttccatgcataatgcggtcggtggcgctatgaccggacctggtacccaccagctttccagcgcaaggttgcctaatcatgacacaaatgttgtgatccagcaggcgatgcccagccctcagtccagctccgtaataacccaagcacctagcacaaaccgtcagatcggtccagtcccaggtagcctcagttctcttctgcatctgcataatagacaaagacagcccatgccagccagcatgcctggcacccttccaaatcccacaatgccagggtcctccgctgtcctgatgcctatggaaaggcagatgagtgtcaattcttctatcatggggatgcagggacctaatctgtcaaacccatgtgcatctccacaagtgcagccaatgcacagcgaagcaaaaatgcggctgaaagccgcactaacacatcaccctgctgctatgagtaatgggaatatgaacacaatgggccacatgatggagatgatgggttcgcgccaggatcagacaccacaccaccacatgcattctcatccccatcaacatcagaccctccctccacatcacccctacccacaccagcaccaacaccctgcccaccacccccatcctcagccccatcaccagcagaatcatccccatcaccactcccatagccaccttcacgcacaccctgctcaccatcagacctcaccccacccaccactccacactgggaatcaggcacaggtgagccctgccacacagcaaatgcaaccaacacaaaccatccagcctccacagcccacagggggtcgccgacgccgtgtcgtggacgaggacccagacgaacgacgcagaaagttccttgaacgaaaccgcgctgcggctactcgatgcaggcaaaaacgcaaggtgtgggtgatgtctctggagaagaaagctgaggagcttacccagaccaacatgcagctacagaacgaggtatcgatgctgaaaaacgaggtagcccaacttaagcagctgttgttaacccacaaggactgcccaatcacagctatgcagaaagaatcacaaggttatttatcccccgaatccagcccccctgccagccccgtaccagcctgctcccagcagcaggttatccagcataatactatcactacgagctcgtccgtgagcgaagtggtgggcagctctaccctctcacaactcactactcaccggaccgacctcaaccccatcttatag

SEQ ID NO: 22504 - DNA, 1506 bp, Artificial Sequence
  Description of Artificial Sequence: Synthetic coding sequence
atgaacttggaacaggaaaggccgttcgtgtgttcagcacccggatgcagtcaacggtttcctactgaggatcatttaatgattcatagacacaaacacgagatgactcttaaattcccatccattaagaccgacaatatgctatccgaccagacacccacgcccactcgctttctgaagaattgcgaagaagtgggcctattctctgagctggattgctctctggaacatgaattccggaaggcccaggaagaagagagctcaaagagaaacatcagcatgcacaatgctgtgggcggagccatgacgggccctggaacacaccagttaagcagtgccagattgccaaatcatgatactaatgtagtgatccagcaggccatgccaagcccacagtccagctcggtaatcacccaggccccaagcaccaaccgtcagatcggaccggttcctggatcactctcaagcctgttacatctccacaaccggcaaagacagcctatgcctgcctcaatgcctggtaccctgcccaaccccacgatgccaggtagtagcgccgttctcatgccaatggaacgacagatgtcagtgaatagttcgataatgggcatgcagggcccaaacttgtccaacccttgtgcctctccccaagtgcaaccaatgcactccgaagctaagatgcggcttaaagctgccctgacgcaccatcccgctgctatgtctaacggaaatatgaatacaatgggccatatgatggagatgatggggtcacggcaagaccagacaccacaccaccatatgcactcacatccccaccagcaccagacgttaccccctcatcatccctacccacaccagcaccagcaccctgctcaccacccccatccccagccgcatcaccaacagaatcatccccatcatcattcccacagccatctgcatgcacaccccgctcaccatcagacctcgcctcatccaccgctgcacacagggaatcaagcacaagtgtcgcctgccacccagcaaatgcagcccacccagactatccagccacctcaacctactggtggacgcaggcggagggtggtcgacgaggacccagacgaacgcaggcgtaaatttctcgagcggaaccgggctgcggctacacgttgccggcagaagcggaaagtatgggtgatgagcctagaaaaaaaggccgaggagttgacccaaaccaacatgcagctgcagaacgaggtcagtatgctgaaaaacgaagtcgcgcagctgaagcagctccttttgactcataaagattgccctattacagcaatgcagaaggaatcacaagggtacctgtcacccgaatccagcccaccagcttcaccagtacctgcctgctcacagcaacaggtgatccaacataacaccatcacaacctcatcaagcgtaagtgaagtggtcggaagcagcaccctctctcagcttacaacccaccgaactgacctgaaccccattctctag

SEQ ID NO: 22505 - DNA, 1428 bp, Artificial Sequence
  Description of Artificial Sequence: Synthetic coding sequence
atgattcaccgacataagcacgagatgacactgaaattccctagcattaaaactgataatatgctaagtgaccaaacgcctaccccaacccgtttcctcaagaactgcgaggaggtcggcctcttctccgaacttgactgctccctcgagcatgaatttcgtaaagcccaggaagaagaatcgagcaagaggaacatttccatgcacaacgcggttggtggcgctatgaccggaccagggactcaccagctgtcttccgcacgcctgcccaaccatgacacgaatgtagtaattcaacaggcaatgccttcgccccaatcttccagcgtgattactcaggcccctagcaccaaccgacagatcgggccagtgccaggatcacttagctctcttctgcatctgcataaccgacagcggcaaccaatgccggctagcatgccaggcacactgcctaatccaaccatgcctggatcctccgctgtgctcatgcccatggaaaggcagatgagcgtcaattcaagcattatgggtatgcaaggaccgaatttgagtaacccatgcgcatcccctcaagtgcagccaatgcacagcgaggctaagatgagattgaaagcagccctgacacaccatcccgcagccatgtcaaatgggaacatgaataccatggggcacatgatggaaatgatgggctcccgtcaggaccaaaccccccaccatcacatgcactctcacccacaccaacatcaaacccttcctccccatcacccttacccccaccagcaccaacaccccgctcatcatcctcatccccaaccacatcaccagcaaaatcacccccaccaccactcccattcccatctccatgcccatcctgcccaccaccagacaagcccacatcctccactgcataccggaaaccaagcacaggtgtcccccgctacgcagcagatgcaaccaacacaaaccatccaaccccctcaacccacaggtgggaggaggagacgtgtggtggatgaagaccccgacgagaggaggcgcaagttcctcgaacggaaccgcgcagctgctaccagatgtcgacaaaagaggaaggtgtgggtgatgtccttagaaaaaaaggcagaagaactcactcaaactaacatgcagctgcagaatgaggtcagcatgctgaagaacgaggtggctcagctcaagcagctgctcttaacacacaaagattgtccaataaccgcaatgcagaaagaatcacagggctatctctccccagagtccagcccacccgcttcccccgtccccgcttgctcccagcagcaggtgatccagcacaacaccattacaacatcctcgagtgtttcagaagtcgtgggatcatctactctgtcacagctcacaacccacaggacggatctgaaccctatcctctag

SEQ ID NO: 22506 - DNA, 348 bp, Artificial Sequence
  Description of Artificial Sequence: Synthetic coding sequence
atgaacctggaacaggagaggccatttgtgtgctccgcaccaggatgcagtcagaggttcccaactgaggaccaccttatgatccaccggcacaaacacgaaatgaccctgaaattcccttccatcaagacagacaacatgctatctgatcagacgcccacccccactagattccttaagaattgcgaggaagtcggtctcttctctgagttagactgttccctggagcatgaattcaggaaggcacaggaggaagagtccagcaagcggaatatctccatgcacaacgcagtgggcggtgccatgacgggtccaggaacccaccagttgtcctctgctaggctctag

SEQ ID NO: 22507 - DNA, 453 bp, Artificial Sequence
  Description of Artificial Sequence: Synthetic coding sequence
atgtctaaaattagccaacagaattccaccccaggagtaaacgggatcagtgtgatacacactcaggcacacgcttctggcttacaacaggtgccccagctggttcctgcaggacctggtggaggcggaaaggcggtcgctccctcaaagcagtccaaaaaaagctcacctatggaccggaactctgacgagtaccgtcaacgccgagagcgaaacaatatggccgtgaagaagtcgcgcctcaaatcaaaacagaaggctcaggacacccttcaaagggtgaatcagttgaaagaagaaaacgagcgcctggaggcaaaaatcaagcttctcaccaaggaactcagcgttttaaaggatttatttctggagcacgcgcacaacctggcggacaacgtccagtccatctctaccgagaatactaccgcggacggcgacaacgccggtcaatag

SEQ ID NO: 22508 - DNA, 1509 bp, Artificial Sequence
  Description of Artificial Sequence: Synthetic coding sequence
atggagactcttcaagagagtctgaatactctcctaaaacagcttgaggaggaaaaaaaaaccctggagagtcaagtaaagtactacgccctgaagctcgagcaggaatccaaggcttaccagaaaatcaataacgagcggcgaacctatctcgctgagatgtcccagggcagtggcctgcaccaagtctccaagcgtcaacaggtcgaccaactccccaggatgcaggaaaacctcgtcaagaccctactattaaaggaagagttagacccactgaaggcgaaaattgacatcctgctggtcggcgatgtgacagtgggatacctggctgataccgtacaaaagctgttcgccaacattgccgaagtgacaataaccatttcggacacaaaagaagcagctgctttgctggatgattgtattttcaacatggtcctgctcaaggttccttcatctctcagcgccgaggaactcgaagcaattaagctcattaggttcggtaaaaagaaaaacacacacagcctctttgtgtttatcatccccgaaaactttaaaggttgcatcagcggccacggcatggacattgcattaaccgagccactaactatggagaaaatgagcaacgtggtgaagtattggacaacctgtccaagcaacaccgttaaaaccgaaaacgctactgggcctgaagaactgggtctacctctgcaaaggagctattcagagcacctgggttactttcctacggatctatttgcttgttctgaatcacttcgcaatgggaacggactggaactgaatgcctctctgtccgagtttgagaagaataaaaagattagccttcttcactcctccaaggaaaagctaaggcgtgaaaggattaaatactgttgtgaacagctgagaacattgctcccatatgtcaaggggaggaagaatgacgcggcttccgttttggaggcaaccgtggactatgtaaaatatattagggagaaaataagccccgcagtcatggcacagatcacagaggctctgcagtcaaacatgcgtttttgtaagaagcagcagactcccatagaactctcactcccgggaaccgtaatggcccagcgggagaactctgtcatgtccacttactcccctgaaaggggcctccagtttctcaccaacacttgttggaacggttgctccacccctgatgccgagtcgagccttgacgaggccgtaagggtacccagcagctctgcctctgaaaatgccatcggcgacccttacaaaacccacatcagtagcgccgctctatctctaaacagcctccacacagttcgctactactctaaagttaccccaagctacgatgctacagccgttacgaatcagaatatctcaattcacctgccttctgctatgccccctgtgagcaagctgctacctcgccattgtacgtctggactcggccagacatgtacgacgcaccctaactgtctgcagcagttttgggcctattag

SEQ ID NO: 22509 - DNA, 1533 bp, Artificial Sequence
  Description of Artificial Sequence: Synthetic coding sequence
atggaggagccccaggcaggcgatgcagccagattcagttgccctccaaacttcacagccaaacccccagcttccgaaagccccaggtttagtctagaggcccttacaggcccagataccgaactgtggctgattcaggctccggctgacttcgctcccgagtgttttaatgggaggcatgtccctttaagcgggtctcaaattgtcaaaggcaagcttgccggaaagagacacagataccgggtgctaagtagctgcccacaggccggtgaggccaccctgttggctccttctaccgaggctggaggaggacttacttgcgcaagtgctccccaaggcacacttcgtattctggaggggccacagcagagtctttccgggagcccgttacagccaatccctgcctctcctcctccgcaaataccacctggcctgcggccacgattctgtgcttttgggggtaacccgcctgtgaccggtccaagatcggctttggccccaaatttactgactagtggcaagaagaaaaaagagatgcaagtgacggaggccccagtcacccaggaagcagtgaatgggcatggggctctggaggtcgacatggctttagggtctccagaaatggatgtgaggaaaaaaaagaaaaaaaagaaccagcaactgaaggagccggaggcagccggacctgtgggtacagaacccaccgttgagacactggagccactgggagtactgttcccctccaccaccaaaaagcgaaaaaagcccaaaggaaaagagacgtttgagcccgaagacaagaccgtgaaacaagaacagataaacaccgagcccttggaggacacagtgctcagcccaacaaaaaagagaaagcggcagaaaggtactgagggaatggagcccgaggaaggggtgactgttgaaagccagcctcaggtgaaggtggagccgttagaggaggctattccactaccacctacaaagaagcgaaaaaaagagaagggccagatggccatgatggagcctggtactgaggcgatggaaccagtagaacctgagatgaagccactggagtccccaggcggaacgatggctccccagcaacccgagggcgcaaagccccaggcccaggcagcactggccgcaccaaaaaagaaaacaaagaaggaaaaacagcaggacgccaccgtggaacctgagaccgaggttgtgggcccagagctccctgacgatcttgaaccccaggcagctcccactagtaccaaaaaaaagaagaagaagaaggaaaggggccacacagtcacagaacctatccagcccttggaaccagaactgcccggagaggggcaacccgaggcaagagcaacccctggttccactaaaaagcgcaagaaacaatctcaggagtcaagaatgccagaaaccgtgcctcaggaggagatgcccggtccccctcttaattcagaaagtggcgaagaggccccaactggccgtgataaaaagcggaagcaacagcagcaacagcctgtttag

SEQ ID NO: 22510 - DNA, 1446 bp, Artificial Sequence
  Description of Artificial Sequence: Synthetic coding sequence
atgaggcacagtaaacgaacccactgtccggattgggacagtcgagagtcttgggggcatgaatcataccggggatcccacaagcggaaacgacgatcccacagctccacccaggaaaaccgccactgcaagcctcaccaccagttcaaggagagcgattgccattacctggaagccagatcacttaacgaacgcgattatcgtgacagacgctatgtggatgagtatcgtaatgattactgcgaggggtacgttcctcgccactaccaccgcgacatagagagcggataccggattcactgcagcaagagctccgtccgatcgaggcggtcaagccctaagcgaaaacggaatcggcactgttcctcccaccagtcgcgctccaaatctcacagaagaaaacggagccgcagcatcgaggacgacgaagaaggccaccttatttgtcagtctggcgatgtactgcgggcacggtatgaaattgtcgacaccctgggggaaggcgcttttggcaaagtcgttgaatgtatcgaccacggcatggatggtatgcacgtggccgtgaaaattgtgaagaatgtcggtcgctatcgcgaggccgctaggagcgagattcaggtcctggagcatctcaatagcaccgatcctaacagcgtcttcaggtgcgttcaaatgcttgagtggttcgatcatcatggccacgtgtgtattgtattcgagttgctgggattgtcaacatatgactttataaaagagaactccttcctgcccttccagatcgaccatattaggcagatggcctaccagatatgtcagagtatcaacttcctccaccacaacaaactcactcataccgacctgaagcccgaaaatatcttattcgtgaaaagcgattatgtcgttaaatacaactctaaaatgaaaagggacgagcggacactgaagaacacagacattaaagttgtggattttggcagcgccacgtacgatgatgaacatcattccaccctcgtaagtactagacactaccgggctcccgaggtaatcctggctcttggctggagtcagccctgcgacgtgtggtccattgggtgtatcttgatcgagtattatctgggctttactgtattccaaacacatgattcaaaggagcacctggctatgatggagcgtatcctaggtcccatcccgcagcacatgatccaaaagacacggaaacgcaaatacttccaccacaatcagctagattgggacgaacactcatctgctggtcgatatgtgagaagacggtgtaaacccctaaaggagtttatgctgtgccacgacgaagagcacgaaaagctgttcgatctggtccgacgcatgctcgagtacgaccctactcaacgcatcacactggatgaggccctgcagcatcccttcttcgatctgctgaaaaaaaaatag

SEQ ID NO: 22511 - DNA, 165 bp, Artificial Sequence
  Description of Artificial Sequence: Synthetic coding sequence
atgcgacatagcaaaagaacccactgtccagactgggatagccgcgagagctggggtcatgaatcctatagaggttcccacaagagaaagaggcgcagtcactcgagcactcaggagaacagacactgcaaaccacatcatcagtttaaagagtctgactggtag

SEQ ID NO: 22512 - DNA, 162 bp, Artificial Sequence
  Description of Artificial Sequence: Synthetic coding sequence
atgagacactccaaaaggacacattgtccggactgggattccagggaaagttggggccacgagagctatcggggatcccacaagaggaaacggagaagccattcctctacccaggaaaacaggcattgcaagccccaccatcagtttaaagagtcagactag

SEQ ID NO: 22513 - DNA, 432 bp, Artificial Sequence
  Description of Artificial Sequence: Synthetic coding sequence
atgcggcattctaagaggacacactgtccagactgggacagtcgggagtcttggggacatgaatcctaccggggatcccacaaacgcaagaggcggagtcactcgagcacccaggagaacaggcactgcaaaccccaccaccaattcaaagagtccgattgccattatctagaggccagaagccttaacgagcgcgactacagagacagacgctatgtcgacgagtacaggaacgactactgtgaggggtatgtgcccagacactatcatcgcgacattgaatcgggataccgcattcattgttctaaatcctccgtacggtcaaggcgcagttcccctaagcggaaaaggaatcgccattgctccagtcatcagtctagatctatgaagagctggacgctgtgggtgaaagaaccgctggcaaagctctag

SEQ ID NO: 22514 - DNA, 270 bp, Artificial Sequence
  Description of Artificial Sequence: Synthetic coding sequence
atgcgacattctaaaagaacccattgccctgattgggatagtcgagagagttggggccatgagtcctatagaggtagccataagcgcaagcgcaggtcccatagctccacacaggagaataggcattgtaagccccatcatcagtttaaagagtccgactggacttgcgtggatattaaaacaaatgccctgactctgattcgactcggatacttgaaaggctactcagagatcttcaccggacatagtgtggacattctgaagaattag

SEQ ID NO: 22515 - DNA, 1122 bp, Artificial Sequence
  Description of Artificial Sequence: Synthetic coding sequence
atgcgacactccaagagaacacactgccccgattgggacagccgcgagagctggggccatgagtcttatcggggaagccacaagagaaaaagacgctcgcactcaagcacccaggagaatcggcactgcaagccccatcatcaatttaaggaatcagactgccattacctggaagcccgatctttgaatgagcgtgactaccgggataggagatatgtggatgagtatcgtaacgactattgtgaggggtacgtaccacgacattatcacagagacatagaatccggatatagaatacattgtagtaagagcagcgtaaggtcccggaggtcgtcgcccaagcgaaaaagaaatagacactgttcctcacaccaaagtaggagcaagtctcacaggagaaaaagaagcagatcaattgaagacgacgaggagggccatttgatctgccagagtggggacgtcctccgagcgaggtacgagatcgtcgacacattgggggaaggcgcatttggtaaggtggttgagtgtattgatcacggtatggacggaatgcatgtcgcagtgaaaatcgtcaagaacgtgggacgctacagggaagccgcacgctcggagatccaggttcttgagcatttgaatagcactgatccaaattcggtattcaggtgcgtccagatgctagaatggttcgatcaccatggccacgtctgcatcgtctttgagttactggggctgtccacctatgactttatcaaggaaaatagctttcttcctttccagatcgatcacattcgacaaatggcttaccagatttgtcagtcaattaactttctccaccataacaaactaactcacaccgatctgaagccagagaacatcttattcgtgaaaagcgattatgtggtaaagtacaactctaaaatgaaaagggacgaacactcctctgccggtaggtacgtgaggaggcggtgcaagcccctgaaggaattcatgctatgtcacgatgaggaacacgaaaagctattcgacctcgtaagaaggatgttggagtatgacccgacacagcggattactctggacgaggcactgcagcacccatttttcgatctccttaagaagaagtag

SEQ ID NO: 22516 - DNA, 2613 bp, Artificial Sequence
  Description of Artificial Sequence: Synthetic coding sequence
atgttctcccagcagcagcagcaacaactgcaacaacagcagcagcagctccagcagctccagcaacagcagctccagcaacagcagctgcaacaacaacaactgctgcagcttcagcagctgctgcagcagtccccgccacaggccccactgcccatggctgtgtctaggggcctcccaccacagcagccacagcagcctttactcaacctccaggggaccaatagcgctagcctcttaaatgggtccatgctgcagagggccctgctgctgcagcagttacaagggctcgaccagttcgccatgcccccagcaacctatgatacagcgggactgactatgccaacagctactctgggtaatctcagggggtacggtatggcgagcccagggctcgctgccccaagcctgacgccaccccagctcgccacgcccaatttgcagcagtttttccctcaggctacgcggcaatcattgcttgggccaccgcctgtgggcgttccgatgaacccctcccaattcaacctgagtgggagaaacccacagaaacaagcacgcacatcctcctcaaccacacctaataggaaggattcctcaagtcagaccatgcccgtggaggacaagagtgatcctccagaaggatctgaggaggctgcagagccaagaatggatacgccagaagaccaagatctgcccccttgtccggaagatatcgctaaggagaagaggacacctgcacccgaacccgaaccctgcgaggcttccgaactgcctgcaaagcgtctccgatcctccgaagaacccaccgagaaggaaccgcctggtcagctgcaggtaaaagcacaaccacaggcacgcatgactgtgcccaagcagacccagacccctgacttattgcccgaagccctcgaggcccaggtcctccccagatttcaacctcgcgtgctccaagtgcaggcccaggttcagtcacagactcagcctcgcattccgtctacagatacccaagtacagcccaagctccagaaacaggctcagactcagacaagcccagaacatctcgttctccagcagaagcaagtgcaaccgcagctgcaacaggaggcagaaccacagaaacaggtgcaaccacaggtgcagccgcaggcccactctcagggacctcgtcaggtgcaactgcagcaagaagccgaaccgctaaagcaggtgcaaccacaggtgcacacacaggcccagccatccgtgcagcctcaggagcacccgcctgcccaggtgtccgtccagcccccagagcagacacatgagcagccacacacccagccccaagtgagcttgctagcacccgaacagaccccagttgttgtccacgtgtgtggccttgaaatgccccctgacgcggtagaagccggagggggaatggaaaagactctgccggaacctgtcggaactcaggtgtctatggaggagatccagaacgagagtgcttgcgggctggatgtcggagaatgtgaaaacagggcacgagagatgcccggagtctggggtgccggtggttcattgaaggtgacgatactccagtcatcagacagccgggcttttagcaccgtccccctaactcccgtcccccgaccaagtgacagcgtttcctcgacgccagcagcaacctccacaccatcaaagcaagccctgcaattcttttgctacatttgcaaggcctcctgtagttcacaacaggaattccaggaccatatgagtgagccccaacatcagcagcgtctgggtgaaatccagcacatgagccaggcttgcctgctaagcctcctgcctgtccccagagacgtcctggagacagaggacgaagaacctccacccaggagatggtgcaatacatgccagctttattatatgggcgacttgatccaacatcgcagaacacaagatcataagattgctaaacagtctcttcggcctttttgcacggtctgcaaccgatactttaaaacaccccgaaagttcgtggaacacgtaaaatcacaggggcataaagataaagctaaggaactcaagtcactcgagaaagagatcgctggtcaggatgaggaccactttataaccgtggacgctgttgggtgctttgagggggacgaggaggaggaggaagacgatgaagacgaagaagaaattgaagtggaggaggaactgtgcaagcaggtgaggtctcgggatatctcacgcgaggagtggaaggggagcgagacctatagcccaaatacggcttacggagtagactttctggtgcctgttatggggtacatctgcaggatttgtcataagttttatcactcaaatagcggtgctcaactcagccactgcaaatccctcggacactttgagaatctccagaagtacaaagccgctaagaacccatcccctaccactagaccagtgagccggagatgcgccattaacgctcgtaacgccctgaccgcgttgttcacgtcatctggccgtcccccttcacagcccaatacccaggacaagacccccagcaaggtgactgcccgaccctctcagccgccactgcctcgcagaagcacgcgcttgaaaacctag

SEQ ID NO: 22517 - DNA, 759 bp, Artificial Sequence
  Description of Artificial Sequence: Synthetic coding sequence
atgttctcccagcaacagcagcagcaactccagcagcagcaacagcaattgcaacagttgcagcagcagcagttgcaacaacagcagttacaacagcagcaactgctgcagctgcagcagctactgcaacagagtcctccacaggcgccactacctatggcagtcagcagaggtctgcctccacagcagcctcaacagccgctactgaacctacaaggcactaactcagccagcctgctaaacggcagcatgttgcagagggcccttctgctgcagcagctgcaggggctggaccaattcgcaatgcccccagctacatatgacacggcaggcctgaccatgcccaccgcaactctgggcaacctgcgtggctatggaatggcttccccgggtttagctgccccatctctgactccgcctcagctggctactcccaatttgcagcagttttttccccaggccacccgtcagtctctgctaggccctccaccggtaggcgtccctatgaatcccagtcagttcaatctctcaggtcgcaacccccagaaacaagccaggactagctcaagcacgacccccaatcggaaagacagctcttcgcagacaatgccagtcgaggataagtcagatccaccagaagggagtgaagaagccgctgagcccagaatggatactccagaagaccaagatctccctccatgcccggaagacatcgccaaagagaagcgtacacctgctcccgagcctgagccatgttag

SEQ ID NO: 22518 - DNA, 2610 bp, Artificial Sequence
  Description of Artificial Sequence: Synthetic coding sequence
atgttcagccagcagcaacagcagcagcttcagcagcagcaacagcaacttcagcagctccaacagcagcagttgcagcagcagcagcttcagcaacagcaattgcttcaactacagcagctgctacagcagtcgcctccccaagcccctctaccaatggcagtgtctcgcggactccctcctcagcaaccacagcaacctctgcttaatcttcagggtaccaatagtgcaagcttgctgaatggcagtatgttacagcgcgcacttctactgcagcagctccaagggaatctccgcggttatggcatggcttcacctggcttggcagccccaagtttaactccccctcagctggcaactccaaacctgcagcagtttttcccccaggctacccgtcagagccttctgggaccccctcctgtcggtgttcctatgaacccgtcacaattcaatttgtctggacggaatccccaaaaacaggcaaggacctcttcatccactacgcctaaccgaaagaccatgcctgtcgaggataagtcagatccccctgaggggtctgaggaagcagcagaacctagaatggacactcctgaagatcaggacctgcctccatgccctgaagatatcgctaaagaaaagcggactcccgcacctgagcctgagccatgtgaagcctctgaactgccagccaaaaggctgagaagctcagaggaaccgaccgagaaagagccccctgggcagcttcaagtgaaagcccaaccacaggcgaggatgaccgtccctaagcagactcagacaccagacctgctgccagaggctttagaagctcaggtactccctcggttccaacctcgtgtccttcaggtgcaagctcaagtccagtcacaaactcaaccgagaatacccagtacagacacccaggttcaacccaaactacagaaacaagctcagacacagactagcccagaacaccttgtcttgcagcagaagcaggtccaaccccaactgcagcaggaggccgaacctcagaaacaggtccagcctcaggtccaaccccaggcccacagccagggtcccaggcaggtgcaactgcagcaggaggctgagcctctgaagcaggtgcagccacaggttcagccacaggcccattcacagcctccgaggcaggtgcagttacaactgcagaaacaggtccagactcagacctacccccaggtgcatacacaagcgcagccttccgtgcagcctcaggaacatcctcctgctcaggtgtccgtgcagcctcctgaacagacacacgaacagccacatacccagccccaggtgtccctccttgcccctgagcagaccccagtagtagtgcacgtatgcggtcttgagatgcctcctgatgcagtggaggccggtgggggaatggagaagacactgccagagccagtcgggactcaggtctccatggaggaaatacagaacgaaagcgcctgcggtctggatgtcggtgagtgcgaaaatcgtgccagagaaatgccaggcgtgtggggcgcaggaggaagcttgaaggtgaccatcctccagtcatctgattcacgggctttctcaacagtccctctaactccagtccctcgccctagtgactccgtgtcatcaactcctgctgcgactagcacccctagcaagcaggcattgcagttcttttgctatatctgtaaggcctcctgctcatcacaacaggagtttcaggatcatatgtccgagcctcagcaccaacaacggttaggcgagatacagcatatgagccaagcttgcctacttagcctgctgcccgtcccccgtgacgtgctggagacagaggatgaagaacctccaccacgacgttggtgtaatacctgccagctctactatatgggcgacctgattcaacaccgcagaacccaagaccacaagattgcaaaacagtctttgaggccattctgcacggtgtgcaacaggtatttcaaaacaccacgcaaattcgtggagcacgtgaagagtcaaggccataaagataaagcaaaggagctgaagtcactggaaaaagagattgcaggacaagatgaggaccattttatcactgtggatgcagtaggatgttttgaaggcgacgaggaagaagaagaagatgacgaagatgaggaggagattgaagtggaggaggaattatgtaaacaagtgaggagtcgggacatcagccgcgaggaatggaaaggcagtgagacctacagtccaaataccgcatacggcgtggactttcttgttcccgtgatgggatacatctgccgtatctgccacaaattttatcactcaaattctggcgctcagctaagtcactgcaagtccctcgggcacttcgaaaatctacagaaatataaggcagccaagaatccgagccctactacccggccagtgagtcggaggtgcgcaattaatgcgaggaatgcgctaacagctctctttacaagtagcgggagaccaccttcacagcccaatactcaggacaagacaccatcaaaagtgaccgcaaggccatcccagccccctttgccaaggcggtccacacgtctcaagacttag

SEQ ID NO: 22519 - DNA, 2613 bp, Artificial Sequence
  Description of Artificial Sequence: Synthetic coding sequence
atgttttctcaacaacagcaacagcagctgcagcagcagcagcagcaactgcagcaattgcagcagcagcagctgcaacagcagcagctacagcagcaacaactgctgcagctgcaacagctcctccagcagtccccaccccaggccccactccctatggctgtcagcagggggctgcccccacaacagccacaacaacctcttctaaacttgcagggaacaaactcagctagcctactaaacggcagcatgctgcagcgcgctctgctcctacagcagctgcagggtttggatcagtttgcaatgcctccagccacctacgataccgctggcctgacgatgccgactgctactcttgggaacctacgcggatatgggatggcatcacccggacttgcagccccttccctgactccaccccaactggctacaccgaaccttcagcaattcttcccccaggccaccaggcaatccctactcgggccacccccagttggcgtcccaatgaatccatcacagttcaatctgagcggcagaaatccccagaagcaggctagaacttccagtagcactacaccaaaccgcaaggacagttcaagccaaaccatgcccgtggaggataagagcgaccctcctgagggttctgaagaggcggctgagccaaggatggatacaccagaggatcaggatctacccccttgccctgaagatatcgctaaggagaaaaggactcctgcacccgagccagaaccttgcgaggcctccgaactccccgctaagagacttcggagcagtgaggagcctactgagaaagaaccgcctgggcagctccaggtgaaggcgcagccgcaggcacggatgactgtgcctaaacagacgcaaacacccgatctgctacctgaggcattggaggcccaagtcctgcctaggttccagccgagggtactgcaagtgcaggcgcaggtacagtctcaaacgcaacccagaattcctagtactgatacacaggtccagcccaaactgcagaaacaagcccagacacagacctctccagagcatctcgttctccagcagaagcaggtccagccgcagctgcaacaggaggccgaaccccagaagcaggtacaaccacaggttcagcctcaggcacattctcaagggccacgccaagtccaactgcaacaggaggctgagccactgaagcaggtgcagccgcaggttcacactcaagcacaaccatctgttcaacctcaggaacatccaccagcgcaggtgtctgtgcagcctcctgagcaaacccatgaacagccacacacacagccacaggtttcacttctcgccccagagcagacacccgttgtcgttcacgtttgcggcctggagatgccgcctgatgcagtcgaagccggtggcggaatggaaaaaactctgcctgagcccgtaggaacccaggtgagcatggaagaaattcagaatgagagcgcctgtggtctcgatgtcggagaatgtgagaatcgggcacgagaaatgcctggagtatggggagccggaggatcattaaaggtgactatccttcagtccagcgactcccgggctttttcgaccgtgcctttaactccagtgccccgacccagtgactccgttagctctacccctgccgcaacgtcaactccatcgaagcaggctcttcagttcttctgttatatatgtaaggcgagttgcagctctcagcaggagtttcaggatcacatgtcagagccccagcaccagcagcgattgggcgagattcagcacatgtcccaggcatgccttctaagcttattacctgtaccccgagacgtacttgaaaccgaagacgaggagcctccacccaggcgctggtgtaacacctgtcaattgtactacatgggcgacctgatccagcacagaagaacacaggaccacaagatagcaaaacagtcgctcagacccttttgcactgtatgcaaccggtattttaagactccaagaaaattcgtggagcatgttaagtctcaaggccacaaagacaaagcaaaagaactcaagagtctcgaaaaggagatcgcaggacaagacgaggatcacttcattacagtcgatgcagttggatgcttcgagggggatgaagaggaggaggaagatgatgaagacgaagaggagatcgaagtagaggaagaactgtgtaaacaggtgagatcccgtgatatatcacgtgaggagtggaagggctctgaaacctatagcccaaatacggcttatggcgttgatttccttgtgccagttatgggctacatctgtaggatttgtcacaagttctaccattcaaactccggagctcagttaagtcattgcaagtccctggggcacttcgagaacctgcagaagtataaagctgcaaaaaacccaagtccgaccactcgccctgttagcaggagatgtgccatcaatgcgcgaaatgccctaacagccctctttacaagtagcggaagacctcccagccagccaaacacacaggataaaactccaagcaaggtaacagccaggcctagtcagccccctcttcccaggaggtccacccggttgaagacctag

SEQ ID NO: 22520 - DNA, 2697 bp, Artificial Sequence
  Description of Artificial Sequence: Synthetic coding sequence
atgttctcgcaacaacagcagcagcagttacagcagcagcagcagcaactgcagcagctgcagcagcagcagcttcaacagcagcaactgcagcagcagcagctgttgcagctgcagcagcttctgcagcagagccctccacaggccccattaccgatggccgtcagccggggtctgccaccacaacagccacagcagccgctactcaacctgcagggaactaattccgcttcattactcaatggttccatgcttcaacgcgcactcctgctccagcagctacaaggcctggatcagtttgccatgcccccagccacctacgataccgctggattgacaatgcctactgcaaccctggggaatctaaggggatatggcatggccagtcccggactggccgcaccaagcctaacacctccccagctggccacaccaaacctgcaacagtttttcccacaggccactcgacagtctttgctgggaccccctccagtaggtgtacccatgaacccttctcaatttaacctttcaggcaggaacccccagaaacaggccagaacctcaagcagtaccactccaaaccggaaggattccagctcccagacaatgcctgtcgaagacaagtccgatccccctgagggtagcgaagaggcggcagaacctaggatggatacaccagaggaccaggacctgcccccttgtcctgaggatattgcaaaggagaaacggactcccgctccggagcccgagccatgtgaagcctccgaactgcccgcaaagagactgaggagtagtgaggaaccaacagagaaggaacctcccggacagctgcaagtcaaggctcaaccccaggcaagaatgactgtgcccaagcagacccaaactccagacctgctgcctgaagctctcgaagctcaggtcttgccccgatttcagccgagggtgttacaagtgcaggcgcaagtgcagagccagacccaaccccgaatccccagcactgatacccaggtgcaaccaaagttgcagaaacaggctcagacccaaacgtcacccgagcatttggtgttacaacagaaacaggtacaaccgcaactgcaacaggaagccgaaccgcaaaagcaggtgcagcctcaggtccaaccccaggctcacagtcaggggccaagacaggtgcagcttcagcaggaggctgaacccctcaaacaggttcaaccacaagttcagccccaggcacactcccaaccgcctcgccaggtccagctgcaactgcagaaacaggtgcaaactcagacgtatccccaggtgcacactcaagcacaaccatcagtccagccacaggaacatccacccgcacaggtgagcgtacagcccccagagcaaacacacgagcagccccatactcagccccaggtgagcctgctggcccctgagcagactcccgtcgtggtgcatgtgtgcgggctggaaatgccaccagacgcagttgaggccggaggagggatggaaaagactctacccgagcctgtgggcactcaggtcagcatggaagagattcagaacgaatccgcgtgtgggctggacgtgggagagtgcgagaatagggccagagaaatgccaggagtttggggcgcagggggatctctgaaggttaccatcctgcagagctcagacagcagggcttttagcaccgtgccactgactccggtccctcggcctagtgatagcgtgtccagcactccagcggcaaccagtacacctagcaaacaagccctgcagttcttctgttacatctgtaaagccagctgcagctcccagcaggagtttcaggatcatatgagcgaaccacagcatcagcagagattgggagaaatccagcatatgagtcaggcctgcctgctttctctgctgcctgtgccaagagacgtacttgagactgaggatgaagagcctccgccaaggagatggtgcaatacttgccaactctactatatgggagacctgatccagcatagacgcacgcaggatcataagattgcgaagcagagcctgcgacccttttgtactgtgtgtaatagatatttcaagacccccaggaaattcgttgagcacgttaagagtcaaggtcataaggataaagccaaggagcttaagtctctcgagaaggagattgctggacaggacgaggatcatttcatcactgtagatgccgtcggatgtttcgagggcgatgaagaggaggaagaggacgacgaggatgaggaggagatcgaggtggaggaggaactgtgcaagcaggtgcggagtagagatattagccgcgaggagtggaaaggctcagaaacctatagccctaacaccgcctatggagtcgattttctggtacctgtaatggggtacatctgtaggatctgccacaagttctatcattcaaattctggcgcacagctgtcccactgcaagagcctaggccatttcgaaaacctccagaaatacaaagcggctaagaacccctcccccaccactcgcccagtgtctcgacgatgcgcgatcaacgcacgcaacgctctgaccgcgttgtttaccagcagcggtcgcccacctagccaacccaatacacaggataaaacccctagcaaagttactgctcgcccttctcagcctcccctgccgagacgctccaccagactgaagacatag

SEQ ID NO: 22521 - DNA, 1245 bp, Artificial Sequence
  Description of Artificial Sequence: Synthetic coding sequence
atgttctcacaacagcagcaacaacagctgcaacaacagcagcaacagttgcagcaactccagcagcagcagctgcagcaacaacagctacagcagcaacaactgctccaactgcagcagctgctgcagcagagcccccctcaggccccactgcccatggcggttagtaggggcctgccacctcagcaaccgcagcagccattacttaacctgcaaggcacaaactccgcctccttactgaatggctcaatgttgcagcgggcattgctgttgcaacagctgcagggcaatctcagagggtatggcatggctagccctgggctagcggcacctagtcttaccccacctcagttggcaacacctaatttacaacagttcttccctcaggcaacacggcagtctcttctcgggccacctcctgttggagttcccatgaatcccagtcaattcaacctgtcaggcaggaacccccagaagcaggccaggacttccagcagcacgacgcccaatagaaaggactcttcctctcaaaccatgcctgtggaggacaagtcggaccccccagagggtagcgaggaggctgccgagcctcgtatggatacacccgaggaccaagatctgcctccatgcccagaggatattgcaaaagagaagcggacaccagctcctgaacccgaaccatgtgaggcctccgagctgcctgccaagaggctgaggtccagtgaggagcctaccgagaaagagccccctggtcaacttcaggtaaaagcccaaccccaggcaaggatgactgtccccaaacagacacaaacccctgaccttctacctgaggccctggaggcacaagttcttccacggttccaacctagagtgctccaggtgcaagcccaggtccaatcccagacacagcctcggatcccatccacagatactcaggtgcagccaaagctgcagaagcaagctcagacacagacgtcgccagagcatctggttctgcaacagaaacaggttcagccccagctgcagcaggaggcagagccacaaaaacaggttcaaccgcaggtgcagcctcaggcacattcacagggccctagacaggtccagctgcagcaagaggctgagccgcttaagcaggttcagccccaagtccagccacaggcccacagtcagccacacctcccacaggtcctctctcagcagttgaggggtacggctctacctctccaggttcctggccctttgtag

SEQ ID NO: 22522 - DNA, 2529 bp, Artificial Sequence
  Description of Artificial Sequence: Synthetic coding sequence
atgttctctcagcaacagcagcaacagctccagcaacagcagcagcaattgcaacagctccagcagcaacagctgcagcaacaacaacttcaacagcaacagctcctgcaactgcagcagttgttgcagcagtcacctccccaagcgccactgccaatggccgtttcccgcggtctacccccacagcagccacagcagcctttactgaacctgcaagggactaacagtgcaagtctactgaatggctctatgctgcaacgcgctctgttacttcagcagctgcagggtctcgaccagttcgcaatgcccccagccacctatgacaccgccggactcacgatgcccacagctactctggggaacctgagagggtatggcatggcctcacctggactggcagccccttcgttgacccctccacagctagcaacaccaaaccttcagcagttttttccccaagcaacaaggcagagtctgctgggccctccccctgtaggtgtacctatgaaccccagtcagtttaatctctctggccgtaatccacaaaagcaggcccgaactagctcctcaaccacaccgaaccgaaaggattccagcagccagacaatgccagtagaagacaagtcagatcctccagagggctctgaggaggcagccgagccccgtatggacactcctgaagaccaagacttacctccctgtcctgaggacattgcaaaggaaaagagaactccagctcccgaacccgagccctgtgaggccagcgagctgcccgctaagagattgaggagctctgaggaacctacggagaaggagccacctggacagcttcaggtgaaggcccaacctcaggctcgcatgaccgtacccaaacaaacgcagacccccgatttgctgcctgaggcactggaagcacaggtcctgccacgcttccagcccagggtactgcaggtgcaggcccaggtgcagagccagacgcaaccccgaatcccctccaccgacacccaagtgcagccgaaattgcagaagcaggctcagacacagacttctcccgaacacctggtcctacagcagaaacaggttcagcctcagctccagcaggaagctgagcctcagaagcaggtgcagccccaggtgcacacccaggcgcagccatccgttcagcctcaggaacatcctcccgctcaggtcagcgtgcagccccctgagcagacccatgagcaaccacatacacagcctcaggtctccttgctggctcccgaacagaccccagttgtggttcacgtttgcgggcttgagatgcccccagacgcggtcgaggcagggggaggaatggagaagaccctccccgaaccagtgggtacacaagtgtcaatggaggagattcagaacgagagcgcctgcggtctggacgtgggagagtgcgagaatagagccagggagatgcctggagtctggggagctggtggttctctgaaagtaacgatattgcaatcctcagatagtagggccttctctactgttcccctaacgccagtaccacgaccgtccgatagcgtgtcttctacccccgcagctacctccacgcctagtaagcaagctcttcagtttttttgctatatctgcaaagcaagctgcagttcacagcaggaattccaggaccacatgtcagagccacagcaccagcagagactgggagagatccagcatatgagccaagcatgcctgttgtccttacttcctgttcccagagacgtacttgaaaccgaggacgaggagcctcctcctcgacggtggtgcaacacatgccagctgtattacatgggagacctgatacaacataggcggacccaggaccataagatcgcaaagcagagcctccgaccattctgtactgtgtgtaaccggtacttcaagacaccacgcaaatttgtggaacacgtgaaaagtcagggtcataaagataaagcaaaggaactgaagtccctcgaaaaagagatcgcaggtcaggacgaggaccactttattaccgtggacgcggttggatgcttcgagggtgacgaggaggaggaagaggacgatgaggatgaagaggagatcgaagttgaagaagaactgtgcaagcaggtgagatcccgagacatttctcgcgaagagtggaagggctcagaaacctattccccaaacactgcttacggcgtggacttcctcgtaccagtgatggggtacatttgtaggatttgtcataagttttaccacagtaactccggagcgcaactgtcccactgtaagagcctcggtcattttgagaatttgcagaaatacaaagccgctaaaaaccccagtcccacgacacgccctgtttccagacggtgcgctattaacgccaggaacgcccttaccgccctgtttaccagttcaggcaggccacccagccaacctaatactcaggacaaaacaccctctaaagtgactgccagaccctcccaaccccctctacctagaagatccactaggcttaaaacatag

SEQ ID NO: 22523 - DNA, 2457 bp, Artificial Sequence
  Description of Artificial Sequence: Synthetic coding sequence
atgttcagccagcagcagcagcagcagctccagcaacaacagcaacagctgcaacagctgcagcagcagcaactgcagcagcagcagctgcagcaacagcaacttctccagctgcagcaactgctgcagcagagtccaccacaggcccctctgcctatggcagtcagtcggggtctgccccctcagcagcctcagcaaccgctcctgaacttgcaaggaactaattctgcctccttgctgaatgggtcaatgctacagagggctctactgcttcagcagctgcaagggaacttacgagggtacgggatggcaagccccggactcgcagcccctagcctcacaccgcctcagcttgcgacaccaaacctgcagcaattcttcccccaggcaactcgacagagcctcctggggccaccccctgttggcgtgcccatgaatcccagtcagttcaacctcagcggcagaaatccacagaagcaggcccgtaccagttcttcaactacaccaaataggaaggactctagctcacagacgatgccggtggaagacaagagtgacccccctgagggaagtgaggaggccgcagaaccgaggatggatactccagaagaccaggaccttcccccttgccctgaagacatcgcaaaagagaaacgaactcccgcacctgaacctgagccatgtgaggcttcagagctacctgcaaagcggttgcggagtagcgaggagccaaccgagaaggagccccctggccaactgcaggtcaaggcacagccacaggctagaatgacagtgcctaagcaaacccagaccccggatctgttgccagaggcattggaggctcaggtgctgcccagatttcagcccagggttttgcaagtgcaggcacaagttcaatcccagacacagccacgaataccgtccaccgacacacaagttcagccaaagctgcagaaacaggctcagacccagaccagccctgagcatctggtactgcagcaaaaacaagtccagccccagctgcaacaggaggccgaacctcagaaacaggtgcagccgcaggtgcacactcaggcccagccttccgtacagccgcaggagcatcctccagcgcaagtctccgtccagccacctgagcaaacgcacgaacagcctcacacacagcctcaagtgtctttgttagcgcctgagcagacccctgtcgtcgtgcacgtatgcggcctcgagatgccacctgatgctgtcgaagcgggaggaggcatggaaaagacactgccagagcctgtcggaacccaggtgagtatggaggagattcagaatgagtccgcttgtggcttggatgtgggcgagtgtgagaatagggccagggagatgcccggtgtgtggggagccggtggcagtcttaaggtaacaattctccaaagtagtgatagtagagccttttctacggtgccgctgacgccagtcccacgcccaagcgacagcgttagtagtactcctgcggctacatctacccctagtaaacaggctcttcagtttttttgctatatctgcaaagcttcatgttcctcccagcaagaattccaggatcatatgagtgagcctcaacaccaacagcgacttggcgagatccagcacatgtctcaggcttgcctgctcagtctcctgcccgtgcctcgcgacgtgctggaaactgaagacgaggaaccaccccctcggcgatggtgcaatacctgtcagctatattacatgggcgaccttatccagcaccggagaacccaagaccataagatagctaagcagagtctgcggcctttttgcaccgtctgcaatcgctactttaagaccccccgaaagttcgtggaacacgtgaagagtcaggggcataaagacaaggctaaagaactcaaaagtctggagaaggagatcgcagggcaggatgaggaccacttcatcacagttgacgctgtggggtgtttcgagggggacgaagaggaggaggaagacgacgaagacgaggaggaaatcgaagtcgaggaagaattgtgcaagcaggtgcgtagccgggatatttcgcgagaggaatggaaagggtctgaaacctactctcccaacacagcatacggcgtggatttcttagtgcctgttatgggctatatttgccggatttgccataaattctatcatagtaacagcggagctcagctatctcattgcaagagtttggggcactttgagaatctgcagaaatacaaggcagctaagaatccaagcccaacgaccaggccggttagtagaagatgtgccattaatgcacgcaatgctctcacagcgctatttacaagcagcggccgacctcccagtcagcccaatactcaggataagacaccttccaaagtgacagccaggccttcacagccaccacttcctcgtcggtctacacggctgaagacatag

SEQ ID NO: 22524 - DNA, 2697 bp, Artificial Sequence
  Description of Artificial Sequence: Synthetic coding sequence
atgttcagtcagcagcaacaacaacagcttcagcagcagcagcaacagctgcagcagcttcaacaacagcagctccagcagcagcaactccagcagcagcagttgctccagctgcagcaactcctccagcaaagtccaccacaggcccctcttcctatggccgtcagtagagggctgcctccccaacagccccaacagcccttgctgaatctgcaaggtactaactccgctagtctccttaatggatcaatgttgcagcgggcacttcttctacagcagctccagggactggatcagttcgccatgccacctgctacctatgataccgctggactaactatgcccaccgctactttggggaacctgcgaggctatgggatggcttctcctggcctcgcagcacctagccttactccaccccaactggctacacctaatctacagcagttttttccccaggcaactcggcaatcacttcttgggccacctccagtaggcgtccccatgaatccctcccagtttaacctgtccggtaggaaccctcagaaacaggctcggacgagtagtagtacaacgcccaacaggaaggattcttcgagtcaaacaatgccagtggaagacaagagcgaccccccagagggatccgaggaggcagccgagcctcgcatggacacacccgaggaccaggatctgcccccttgccctgaggatatagcaaaggagaaacgcactcccgctccggagccagaaccttgcgaggcttcggaactccctgcaaagcgcctgcgatcctccgaggagccaaccgaaaaagagcctccaggccaactccaggtcaaggcgcaaccccaggcaagaatgacggtccccaagcagacccagacccctgatttgttaccagaagcccttgaagcgcaggtgctcccaaggttccagcctcgcgtgctacaggtacaggctcaggtgcaatcacaaacacagcctaggataccttcaactgacactcaggtacaaccgaagcttcaaaaacaggcacagacccagaccagccctgaacatcttgtattacagcaaaagcaggtgcagccacagctgcagcaagaggccgagcctcagaagcaggtccagcctcaggtgcaacctcaggcacacagccagggcccaagacaagtgcagcttcagcaggaggctgaacctctgaaacaggtccaaccgcaggtccagccgcaggcccacagccagccccctcgccaggtgcagctgcagttgcagaaacaggtgcaaacccagacctaccctcaggtccatacgcaggctcagccctccgtacagccacaagagcaccctccagctcaggtgtccgtgcagcctcccgaacagacacacgagcagccccacacacagccacaggtcagcctgctggcccctgagcaaactccggtcgtggtccatgtttgcggactcgagatgcctcctgatgcagtggaggctggaggcggtatggagaaaacattgcccgaaccagtggggacccaggtttctatggaggagattcagaacgagtctgcatgtgggctcgacgtaggtgaatgcgaaaatcgcgctcgcgagatgccgggagtctggggtgctgggggatctctgaaggtcacaatcctccagtcgtctgactcaagagcattttcaacagtgcctctaacacctgttccgaggcccagtgacagcgtctcatccactccagccgcaactagcacgcccagtaaacaagcattgcaatttttctgctatatttgtaaagcatcttgcagcagtcaacaagagtttcaggatcatatgtcagaaccgcagcaccagcagcggctaggggaaattcagcacatgtcacaagcatgcctgttgagcctgttaccggtccccagggatgtccttgaaacggaagatgaagaaccccctcctcgcagatggtgcaacacctgccagctgtactacatgggtgacctgatccagcacaggcgaacgcaggaccataagatcgcgaaacagtccctgagacccttttgcactgtgtgcaataggtacttcaaaaccccgaggaaatttgtcgaacatgtcaagtctcaagggcataaagacaaagccaaagaactaaagtcactggaaaaggagattgccggacaggacgaggaccattttatcacggtggacgcggtcgggtgcttcgagggggatgaggaagaggaagaggacgacgaggatgaagaggagattgaagtcgaagaagagctatgcaaacaagtccggtcccgcgatatctctagggaggagtggaagggatcggaaacttacagcccaaacaccgcttatggagtcgattttctggtgcccgttatggggtacatatgccgcatctgccacaaattttatcattccaattctggggcacaactcagccattgcaaaagccttggccacttcgagaaccttcaaaagtataaggcagccaagaaccccagccctactactaggccggtctcccgccgttgtgccataaatgccaggaacgccctgacggccctctttacctcctccgggaggcctccttcccagcccaacacacaggacaaaacccccagcaaggttactgcgagaccttcacagccaccactgccaaggaggtcaactcgactgaagacttag

SEQ ID NO: 22525 - DNA, 2463 bp, Artificial Sequence
  Description of Artificial Sequence: Synthetic coding sequence
ccacttccaatggcagttagccgcggtctccctccacagcagcctcagcagcccctccttaacctacagggaaccaatagcgccagtctcctgaacggcagcatgcttcagcgagccctcctgctccaacaacttcagggtaacctgcggggttacggtatggcaagcccaggccttgcagcgccaagcctgaccccccctcagcttgcaacccccaatctgcagcagtttttcccgcaggcgacgaggcagagtctgttggggcctcccccagtgggagtacccatgaaccccagtcagtttaatctttccggccgaaaccctcaaaaacaggcccgtacctcatcgtccacgacaccaaataggaaaactatgcctgtcgaagataagagtgacccccctgaggggtcagaggaagctgccgaacctaggatggatacccccgaggaccaggatcttcctccttgcccagaggatatcgccaaggagaaaagaactccagcgccagaacccgaaccatgtgaagcaagtgaactgccagccaaacggcttcgcagtagtgaagagccgaccgaaaaggagccccctggccaactgcaggtgaaggcgcagccccaggctcggatgacggtaccaaagcagacccaaacccccgacctcctgcctgaagccctcgaggcacaggtacttccccgtttccagccgagggtactccaggtgcaggcgcaggttcagtcccagacacaaccgaggatacccagcaccgacactcaggtgcagccaaagcttcaaaagcaggcccaaacacagacctcaccagagcatctggttctgcagcagaaacaggtacagccccagctgcagcaggaggccgaacctcagaaacaggtgcagccacaggttcagccacaggcccactcacagggcccacgtcaagtccagcttcaacaggaggctgagcctctcaaacaggtgcaaccgcaggtgcagccacaggcacacagtcagcctcccaggcaggtgcagctgcagctgcagaaacaggtgcagacccagacatatccgcaggtgcacacccaggctcaacctagcgtgcaaccacaggagcaccctccagcccaggtctccgtgcagccaccagagcagacacacgaacagccccacacccagcctcaggtatccctgttagccccagaacagacacctgtggttgtgcatgtgtgtgggcttgagatgcctcctgacgccgtggaagccggtggcggtatggagaagacgctgccggagccagttggaacacaggtcagcatggaggaaatccagaacgagtccgcctgcgggttggatgtgggagaatgtgaaaacagggcacgggaaatgcccggagtttggggggctggcggatccctgaaggtaacaatcttacagtcgagtgattcccgggcattttccaccgtcccgctcacccctgtgcctcgacccagtgatagcgtgtcctcaacacccgcagcaaccagcacacccagcaagcaggccctccagttcttttgctacatttgcaaggcatcctgttcttcccagcaggagtttcaggatcacatgtcagagcctcagcatcagcagaggctgggggagatccagcacatgtcacaagcatgtctgctaagccttttgccagtcccacgtgatgtcctcgaaacagaggacgaggaacccccaccccgacgttggtgcaacacttgtcagctgtactatatgggggatctcatccagcacaggcggacacaggatcacaagattgcaaaacagtcattgcgccctttttgtaccgtgtgcaaccggtattttaaaacccccagaaaatttgtcgagcatgtcaaatcacaaggccacaaagataaggccaaagagctcaagtcccttgagaaagagatcgcgggacaggatgaggaccactttattacagttgacgctgtcggctgcttcgagggggacgaagaggaggaggaggacgacgaagacgaggaggaaatcgaggtcgaggaagaactctgtaagcaggtgaggtccagggacatctccagggaagagtggaagggttcagagacttactcccctaatacagcgtatggggtggacttccttgtacctgtaatgggatatatttgccggatctgtcataagttctatcattctaactcaggcgcacagctgtctcactgtaaaagcctgggacatttcgaaaacctccagaaatataaagcagctaagaatccatccccaactactcggcctgtgtcaaggcgatgtgccatcaacgctaggaacgcgctgactgccctgtttacttcctccgggcgaccaccctcccaacctaatacccaggacaaaacgcctagcaaggtaacagcccgaccaagccagcctccactgccaagacgatccactcgcttaaagacctag

SEQ ID NO: 22526 - DNA, 507 bp, Artificial Sequence
  Description of Artificial Sequence: Synthetic coding sequence
atgttctctcagcagcagcagcagcagctgcagcagcagcagcaacagttacaacagctccagcagcagcagctacaacagcagcagctccaacagcaacagctgttgcagctgcagcagctgctgcagcagtccccgccacaggcaccactgcctatggctgtgtccaggggactgccccctcagcagccacaacagcccttgctgaaccttcagggaaccaacagcgcaagtctactgaacgggagcatgcttcagcgggctctgctgctgcagcaacttcagggtttggaccagttcgcaatgccacccgctacttatgataccgctggtctgaccatgcctacggccactctaggcaatctgcgcggttacggaatggccagcccagggctggctgccccaagcctgacacctccacagcttgcgactccaaatttacagcagttctttcctcaggcaaccagacagtctcttctgggcccacccccagtgggcgtgccgtag

SEQ ID NO: 22527 - DNA, 2514 bp, Artificial Sequence
  Description of Artificial Sequence: Synthetic coding sequence
atgttttctcagcagcagcaacagcagctgcagcagcagcaacaggccccacttcctatggctgtgagccgaggcctcccaccccagcagccccaacagcccctactgaaccttcaggggacaaactctgcttctctactcaatggttcaatgcttcaaagggctttgctgcttcagcagcttcagggacttgatcagtttgctatgccaccggctacctatgacactgctggccttaccatgcctacggccactctcggaaatctgcggggatacgggatggcctcgcccggacttgccgcacccagcctcactcccccacagctggcaactcctaacttacagcagttcttcccccaagctacccgccaatcactactcggccctccccctgtcggggtacccatgaacccctcccaatttaacctttcaggcagaaacccccagaaacaggcacggaccagcagttctaccacaccaaatcggaaggatagctcctctcagacaatgcctgtcgaggacaagagcgacccacccgagggctccgaggaagccgcagaacctaggatggacactccagaggaccaggatttgcccccttgcccagaggatatcgccaaggaaaagcggactcctgcgccagagccggagccatgcgaagcttcagagctccctgccaaaaggctcaggtcttctgaagaacctactgagaaggagccaccaggtcagttgcaagtaaaagcacagcctcaagcccgaatgaccgttccaaaacaaacccaaactcctgatttacttcccgaagcactcgaggctcaggtactgccgcgttttcaaccgagagtcctgcaggtccaggcacaagtccaaagtcagacacagcccaggatacctagcacagatacccaggtccagcctaaactgcagaagcaggcccaaacacagaccagtccagagcatcttgtcctgcagcagaagcaggttcagccccagttgcagcaggaggcagaaccacagaagcaggtacagccccaagtgcaaccacaggcacatagtcagggccctcgccaggtccagctgcaacaggaggcagagcccctgaagcaggtccagccccaagtgcacacccaggcccagcccagcgtgcagccacaggaacaccccccagctcaagtaagcgtgcaacccccagagcagacacacgaacagccacatacacagccacaggtgagcttactcgcgccagagcagacccctgtggttgtgcatgtttgtggcctggaaatgcctcctgacgccgtagaagcgggagggggaatggaaaagacgctgcccgagccagtgggcactcaagtctctatggaggaaattcagaacgaatctgcctgcggcctggacgtgggcgaatgcgagaatagagccagagaaatgcctggggtttggggagccggaggaagcttgaaggtgacaatactgcagtccagtgattcgcgcgcttttagcaccgtgcctctgaccccggtccctaggccttccgacagcgtgtcaagcaccccagccgctacgagcacccctagtaagcaggcactacaatttttttgctacatttgcaaagcatcatgtagttcgcagcaggaatttcaggaccatatgagcgagcctcagcatcagcagagattgggcgagatccagcacatgagtcaggcctgcctgctctcactgctacctgtgccgcgtgatgtgctggaaactgaggatgaggagccccctcccagaagatggtgcaacacctgccagctctattacatgggcgatctcatacagcatcggaggacccaagatcacaaaatagccaaacagagcctgcgcccattttgcacagtgtgtaaccgatacttcaagacacctcgcaagtttgtggaacatgtcaaaagtcaggggcacaaggacaaggctaaagagttgaaatcattggagaaagagattgctggccaggatgaggaccatttcatcacggtcgatgccgtgggttgcttcgaaggggatgaggaagaagaagaagatgatgaggacgaagaagaaatcgaagtggaagaggagctgtgcaagcaggtgagatcaagggacatttcaagagaagagtggaagggttccgagacttactcccctaacaccgcctatggcgtcgacttcttggtccccgttatgggatacatatgccgtatctgtcacaaattttatcacagtaattctggggcacagctttctcattgcaagtccctgggccactttgaaaacctgcagaagtacaaggcagccaaaaacccttctccaacaacacggcctgtatcccgcagatgtgccattaacgccagaaacgctttaaccgccctgttcacgagcagtgggcgtcccccttctcagcccaacacgcaggacaaaacaccttctaaagttaccgctaggccctctcagccacctctgccacgaagatctactagactgaagacatag

SEQ ID NO: 22528 - DNA, 2775 bp, Artificial Sequence
  Description of Artificial Sequence: Synthetic coding sequence
atgttctcacaacagcagcagcaacaacttcaacagcagcagcagcaactccagcagcttcagcagcagcagctgcagcaacagcagttacagcaacagcagctccttcagcttcaacaattgttgcagcagtccccccctcaggcccctttgccaatggctgtatctcgcggtctacccccacaacaacctcaacaaccccttctgaacttacaaggcacaaattccgccagcctccttaatgggtccatgctgcagcgagccctgttgttacagcaactgcagggtctggatcagttcgctatgccaccggcaacatacgataccgcaggtctgaccatgcccaccgcaacactgggaaacttaaggggttatgggatggcttcaccaggtctcgcagctccaagcctcaccccgccacaactggccaccccaaacctgcagcagtttttcccacaggcgactaggcagtcactgctggggcctcctcccgttggggtacccatgaatccaagtcagtttaacctgtccgggagaaatcctcagaaacaggcacggacaagtagttctaccactccaaacaggaaggactcaagctcccagactatgccagtggaagataagagcgaccctcccgaagggagcgaagaggcggctgagccacgcatggatacccccgaggaccaagatctccctccatgccctgaagacatcgcaaaagaaaagcgcaccccagccccagaaccagaaccctgcgaagctagcgagttacccgcaaaacggctgcggagctctgaagagcctacagaaaaggagccacccggacaactccaggttaaggctcagccccaagccagaatgaccgtacctaagcagacgcagactcccgacttactgcccgaagcactggaggcacaggtgttacctaggttccagcctcgagtccttcaagtccaggcgcaggttcagtcccaaacgcaacccagaatccccagtactgacactcaggtgcagccgaaactgcagaaacaggcccagactcagacttcaccagaacatctggtgctgcagcagaagcaagttcaaccgcaacttcagcaggaagccgagccacaaaagcaggtgcagccccaggtacagccgcaggcgcacagccagggccctagacaggtccaattacagcaggaagccgaaccattgaaacaggtccagccacaggtgcagcctcaggcacattcgcaacctccccgacaggtgcagctgcagctgcaaaagcaggttcagactcagacatatccccaggtgcatacgcaggcgcaacccagtgtgcagccacaggagcaccctcccgctcaggtctcagtccagccaccagaacagacacatgagcagccccatacacagccacaggtgtctcttctggctcccgagcaaaccccagttgtggtccatgtctgtggcctcgaaatgccgcctgacgctgtggaagccggaggcggaatggaaaaaacactgcccgagccggttggaactcaagttagtatggaggaaatccagaacgagagcgcttgtgggctggatgtgggtgagtgcgaaaatagagctcgagaaatgcctggagtctggggagccggaggatccttaaaagtcaccatccttcagtcctccgactctagggcattcagtaccgttccactgactccagtgccaagaccttcggatagcgtatccagcacgccagcagcaacatccactcccagtaaacaagccctccagtttttttgctacatctgtaaggcctcttgttcttcccagcaggaatttcaggatcatatgtccgaacctcagcaccagcagcgtctaggcgagattcaacacatgagccaggcctgtctgttatctttgctccctgttcccagggatgtactagagaccgaggacgaggagccgcctcccagacgttggtgtaacacctgccagctatattacatgggggacctgatccagcatcgccgaacccaggaccacaagccgcctacccccagacgcgatgtctttgcacatgtgccagtgcagggctggtcgactgctcgcttggtcaccgacatgattgccaaacagagtttacgacccttttgcacagtgtgtaatcggtatttcaaaactccgaggaaatttgtcgagcacgtcaagagccagggccacaaagacaaggctaaggagcttaaaagccttgagaaagagatcgcaggtcaggacgaggaccactttatcactgtggatgcggtgggttgcttcgagggggatgaggaggaggaggaagacgacgaggacgaagaagagatagaagtagaagaggagctttgtaagcaggtgcgttctagggacattagccgggaagagtggaaaggcagcgaaacttacagccccaacaccgcctacggggtcgacttcctggtgcctgtaatgggctacatctgtagaatatgccacaagttctatcactccaattcaggagcgcagctctcccactgcaagagtttagggcattttgagaatttgcagaaatacaaagctgcaaagaatccttccccaactacaagacccgtgagcagacgatgcgctattaacgccagaaatgccctgacggcgcttttcacgtcctccgggagacctccaagtcagccgaacacccaggacaaaaccccatcaaaggtgacagccaggccaagccagccccctctgccaagaaggtctaccagactgaagacctag

SEQ ID NO: 22529 - DNA, 2394 bp, Artificial Sequence
  Description of Artificial Sequence: Synthetic coding sequence
atgcccccagctacctacgatactgctggcctgacgatgccaacggccacattaggcaatcttcggggttatgggatggccagccccggattagctgcacctagcctgacccctccacagctcgctactccaaacctgcagcaatttttcccccaggccacccgccagtccctactcggacccccacccgtaggcgtcccaatgaacccgagccaattcaacctgtccggcaggaacccacaaaagcaggccagaaccagcagctccacaacaccaaaccggaaggattccagcagccagacgatgcctgtggaggataaatcagatcccccagagggctcagaggaagccgcagagcctcggatggatacccccgaggatcaggaccttccaccgtgtccagaagatattgctaaggagaagcggacacctgctcccgagccggagccatgcgaggcttccgaactgcccgctaaacggctgagatccagtgaggaacctaccgaaaaagagccccctggccaactgcaggttaaggctcagcctcaagccagaatgacggtgccaaaacaaacccaaacacctgacctcctgccagaggctctagaggctcaggtcctgccgagatttcagccaagggtgttgcaggttcaggcccaagtccaatctcagactcaaccaaggattccctcaacagacacacaagtgcagccgaagctccagaagcaggcacagactcagacctcgcccgaacatctggtccttcagcagaagcaggttcagcctcaacttcaacaggaagccgagccacagaaacaggtgcagccccaggttcaaccccaggcacacagccaagggccacgccaggtccagctccagcaggaagccgagcctctcaagcaggtgcagccacaggtgcagccccaggcccactctcagcctcccagacaggtgcagcttcagctccagaagcaagtgcagactcagacttacccccaggttcatacacaggcccaacctagcgtgcagccgcaggaacacccaccagctcaggttagtgtccagccacctgagcaaactcacgagcagccgcacacacagcctcaggtgagcctgcttgcacccgaacaaacacccgttgttgtccatgtttgcggccttgagatgcccccagacgccgtagaggctggcggtggcatggagaagaccctgcctgagccagtgggaacccaggtgtccatggaggaaatccagaacgagtccgcgtgtggactcgacgttggtgaatgcgagaaccgggctagggagatgcccggagtctggggagctggaggatccctgaaggtcactatcctccaaagctctgattcccgggctttctctactgtgccgctgacacccgtccctaggcccagcgactctgtgtcgagcacaccagccgcaaccagcactccctcaaagcaggctcttcagttcttttgttatatttgtaaagcatcatgtagctctcagcaggagtttcaagatcatatgtcagagcctcagcaccagcagaggctgggagagatccagcacatgtctcaagcctgcctgctttcactgctgcccgtgccacgggatgtgctagaaaccgaggatgaagaacccccaccccgacgatggtgtaacacttgtcaactttattatatgggcgacctgattcagcataggagaacccaggaccacaagatcgctaagcaatctttacgaccattttgtacggtttgtaatagatactttaagactccccgtaaattcgtagaacacgtgaaatctcaggggcacaaggataaagcaaaggaacttaagtccctagaaaaggagatagcagggcaggatgaggatcactttatcacggtcgacgccgtgggatgttttgaaggtgacgaggaggaagaggaggatgacgaggacgaggaagagattgaggtcgaggaagaactgtgtaaacaggtgagatcaagggatattagccgggaggaatggaagggctccgagacatattctcccaacacagcttacggggtagatttcttagttccagttatgggctacatctgccggatatgtcataagttctatcacagcaatagcggcgcacaattaagccattgcaagagtcttggacacttcgaaaacttacaaaagtacaaagcagccaagaaccctagtccaacaaccaggcccgtgtcccgcagatgcgccatcaatgcacgtaacgcgctgacagccctgttcacttccagtgggagaccaccttcccagcctaacactcaagataagaccccttccaaggtgaccgcacgcccaagccagcccccacttcccaggcgttcaaccagacttaagacatag

SEQ ID NO: 22530 - DNA, 1743 bp, Artificial Sequence
  Description of Artificial Sequence: Synthetic coding sequence
atggcccaggaggtctcggagtatctgtcgcagaatcctcgggtcgctgcatgggtagaagcattgcgctgcgatggagagaccgacaagcattggaggcatcgcagagattttctgctccggaacgcaggcgacctggctcccgctggcggagctgcatcagcctcaaccgacgaggcagccgacgccgaatccgggacacggaatcgtcagctccagcagctcatctcatttagtatggcttgggccaaccatgtgttcctaggatgcagataccctcagaaagtgatggacaaaatcctctccatggctgaggggattaaggtaaccgacgcgccaacctacaccacccgagacgagctcgttgcaaaggtgaagaagcgagggatctcaagtagcaatgaaggggttgaggaaccttcaaagaagagagtgatcgaaggcaaaaattcatctgccgtagaacaggatcacgccaaaacatctgcgaagacagagcgggcatctgcacaacaggagaattccagcacctgcatcggttccgccattaaatcagagagcggaaatagtgctagaagcagcggcatatctagccagaattcttcaacctctgacggtgacaggtccgtctcaagccagtcatccagcagtgtcagctctcaagttaccacagctggatccggtaaagcatccgaggccgaagctccagacaaacacggctcagccagcttcgtgagccttctcaagagcagcgtgaatagtcacatgacacaaagcacagattcaagacagcagagcggatcccccaaaaagtccgccctggagggtagctcggcctccgcttcccagtcaagcagtgaaattgaggtcccactgctgggatcttccggaagctcagaagtcgagcttccgctgctgtcttcaaaaccatcatctgagactgcgagttccggcttgacttccaagacaagcagtgaagcttctgtttcctcttcagtagctaagaatagcagctcctccggaacctctttattaacccctaagtcttccagctctaccaatacttcccttctgacctctaagagtacgagtcaggtggccgctagtctgctggcatctaaatcatccagccagacttcaggaagtctagtctcaaaaagcacttccctcgccagcgtcagtcagctcgcctcaaaatcgtcctcacagaccagcacttcccagttgcctagtaagagcacgtcccagagtagcgagtctagtgtgaagttttcttgcaagctaaccaatgaggatgtgaaacagaaacagcctttttttaacagactttataagacagtggcctggaaactggtggcagtcggcggattcagcccgaacgtgaatcatggagagctgctgaatgccgcaatagaggccctgaaggcaactttggacgtgttcttcgtgccactgaaagagctggcagatctgccccagaataagagctcacaggagagcattgtatgcgaactgaggtgcaaatctgtgtatctgggcaccggctgcgggaaaagcaaagaaaatgctaaggctgtcgcatctcgagaggccctgaaacttttccttaagaagaaggttgtcgtgaagatttgcaaaagaaagtacagggggtctgaaattgaagatttagtgcttctcgatgaagagagtcgtcccgttaacctcccacctgccctgaaacacccgcaggagctcttgtag

SEQ ID NO: 22531 - DNA, 564 bp, Artificial Sequence
  Description of Artificial Sequence: Synthetic coding sequence
atgccaggggagagacccactgacgcaaccgtcatcccttcagctaaaagagaaagaaaagcgatcactttggatttgaagttggaagtccttcgacgctttgaggcgggagagaaattgtcacagatcgctaaagccctcgacctcgcaatctccacagtggccacgattagagactccaaggagaagatcaaagcaagcagccagatcgccactccactgcgcgctagtagattgaccaggcaccgcagcgctgttatggagtcaatggagcagctgctttccttgtggctcgaagatcagagccagcccaacgccactctctccgccgcaatcgtgcaagaaaaggccgagttcgatgatctccagcgagaacacggcgaagggagccagacagaacgctttcatgccagtcagggttggttagtccggtttaaggagtgccattgcttaccccatttcaaaatgaactctgccgctccatccaacaaagatatgtatacagagatgttgaagtccattatcgaagagggcgagtatacaccacaggtgtccctgacctag

SEQ ID NO: 22532 - DNA, 312 bp, Artificial Sequence
  Description of Artificial Sequence: Synthetic coding sequence
atggccctatccacgatcgtgtcccaacggaagcagatcaaaaggaaagcacctagaggatttttgaaaagagtgttcaagcgcaaaaaaccccagctgaggctcgagaaaagcggggatctgttggtgagattccacccattcagtggctgggagtggggaactggcgaggtgcaccttaattgtcttctctttgttcatcgcctggccgaagagtcacgaaccaacgcatgcgctagcaaatgtagagtgatcaataaagaacacgtgttggctgccgcaaaagtcattctgaaaaaatcaagaggctag

SEQ ID NO: 22533 - DNA, 204 bp, Artificial Sequence
  Description of Artificial Sequence: Synthetic coding sequence
atggcactgtctacaatcgtgagccaaaggaagcagataaagcggaaggctcctcgcggtttccttaagagagtcttcaagcgcaagaagcctcagctgaggttggagaagagcggggacctgctgaaaagtccgggtcagactcttgttagggttaatgtcgaaagcctcactaggtcaatgtactggcctcaacagcgctag

SEQ ID NO: 22534 - DNA, 267 bp, Artificial Sequence
  Description of Artificial Sequence: Synthetic coding sequence
atggcactgagcacaatcgtcagtcaaaggaaacaaatcaagcggaaggcccctcggggattcttgaagcgggtttttaagaggaagaagccacagctgaggctcgagaaaagtggagatcttttggtacatctgaactgccttctattcgttcatcgacttgctgaagaatccaggaccaacgcatgtgcaagtaaatgcagagtgatcaacaaggaacatgttctggcggctgcaaaagtgatactgaaaaaaagtagggggtag

SEQ ID NO: 22535 - DNA, 3846 bp, Artificial Sequence
  Description of Artificial Sequence: Synthetic coding sequence
atggtgcggaagaagaacccacccctgcgcaatgtggcttcagaaggtgaggggcagatcctggaaccgattgggactgagtctaaagtgtccggaaaaaataaggaattcagcgctgatcagatgagcgagaacacagaccagtctgatgctgcggaactaaaccacaaggaggaacactccctccacgtgcaggatccctccagctcaagcaagaaggacctcaagtcagctgtcctttcggaaaaggcaggattcaactatgaatccccgtctaagggcggtaacttcccatcattcccacacgatgaggtgactgacagaaacatgcttgcattctcatctccggctgctgggggagtctgcgagccactaaagtcacctcagcgggcagaagcggacgacccacaagatatggcatgcacgccatcaggggactcccttgaaaccaaagaggaccagaagatgtctccgaaagccactgaggagaccgggcaggcccagagtggacaggcaaattgtcaaggtcttagcccagtgagcgttgcttctaaaaacccgcaggtgcccagtgacggcggagttcgcctgaacaaaagtaaaacggacctgttggttaacgataatccagacccagcccctttgtcacctgaactccaagatttcaagtgtaatatttgcggttacgggtactatggcaatgacccgacagatcttatcaaacactttcgtaaataccacctgggcctgcacaatcgtacccggcaagatgcagaactggactctaagatcctcgccttgcataatatggtgcagtttagtcatagtaaggacttccagaaggtcaaccgcagcgtttttagcggggtgttacaagatatcaattcttctaggcctgttctgctaaacggtacttacgatgttcaggtcacttccgggggtaccttcattgggatcggacggaagactcctgattgccaaggaaacacaaagtacttcagatgcaagttctgtaattttacttacatgggcaactcctcgacagagctggaacagcattttctgcaaacccacccaaacaagatcaaagcctctctcccctcttcagaggttgccaaaccatctgaaaagaatagcaataagtcaattccagcactccaatcatctgacagcggagatctcggcaaatggcaggacaagattacagtaaaagccggagacgacactcccgtgggatattcagttcccattaagccgctcgatagtagcaggcagaatggcacagaggccacaagttattactggtgtaagttttgctcctttagctgcgagtctagctcttctctcaagctgttggagcattacggcaagcaacatggcgctgtacagagtgggggactgaatcctgagctgaatgacaaactgagcagaggctcagtgattaaccagaacgacttggcgaagagctccgagggagagactatgactaagaccgacaaatctagctcaggcgctaaaaaaaaagacttttcttcaaaaggtgcagaagacaacatggttaccagttataactgccagttttgtgacttcaggtactctaagtcgcacgggcctgacgtgatcgtggttggccctctgctgcgccactaccagcagctccacaacatccacaagtgtacgattaaacactgtcctttctgcccaaggggcctgtgctccccagagaagcacctgggagaaattacttaccccttcgcctgccgcaagagtaactgcagtcactgtgccttactcctccttcacctgtctcccggagcagcagggtcctcccgcgtgaagcatcagtgccatcagtgctctttcaccacaccagacgtcgatgtcctgttatttcactacgaatcagtgcacgagtctcaggccagtgatgtgaaacaggaagccaatcatttacagggatccgacggccagcagagtgtcaaagagtctaaagagcattcttgtacaaaatgcgacttcatcacacaggtggaggaggagatttcccgacattacaggagagcccattcttgttataagtgccgccagtgcagctttaccgcggctgatacacagagtctgttagagcattttaacactgtgcattgtcaggagcaggacatcaccacagccaatggagaggaagacggccacgcaatatccacaatcaaggaggaaccaaagatagacttccgggtctacaacctcctaacacctgactctaagatgggcgagcctgtctcagagtctgttgtgaagagggaaaaattggaagaaaaagatgggctaaaagaaaaagtgtggacagagtcttcgagcgacgacctgcgcaacgtcacctggagaggcgcagacattctgcgtgggtctccgtcatatactcaggcctctttgggcttgttgacccctgtgtccggtacccaggagcaaactaagactctgcgtgatagcccaaacgtggaggcagcacatttagccagacccatttacggcctggctgtagagacaaaggggttcctgcagggggctcccgcagggggagaaaaatctggggcactcccgcagcaatatccagcctccggggagaataaatccaaggatgaatcccagtccttactgcgcaggcgcaggggaagcggagtgttttgtgcgaactgcctgacaactaaaacatctctatggagaaaaaatgctaatgggggatacgtatgcaacgcctgcggactctatcaaaaactccactcgactcctcgcccactgaacattatcaagcagaataacggcgagcaaataatacggagaagaaccagaaaacgattaaatcctgaggcactgcaggcagagcagctgaacaaacagcagcgtggtagtaacgaagagcaggtgaacggctcccccctggagaggcgctctgaagatcacttgacagagtcacaccaaagggagatcccactgccatcactgtccaagtatgaggcgcaaggaagcttaaccaagtcccactccgcacagcagcctgtcctcgtgtctcagacattggatattcacaaaagaatgcagcccctccatattcagatcaagagtccacaggaaagcaccggagatcccggaaattccagctcagtaagcgaaggcaagggtagttccgagcggggaagtcccattgagaagtacatgcgcccagccaaacaccctaattattcaccgcctggaagcccgatagagaaatatcagtacccgctttttgggctgccctttgttcacaacgacttccagtccgaggctgattggctgaggttttggagcaagtataaactgagtgtccccggaaaccctcattacctcagccatgtgcctggtctacccaacccttgccagaattacgttccctaccctacatttaacctgcctccccacttctccgcggttggtagcgataacgatatccccttggatctggctattaagcactccaggccgggtccgaccgccaacggtgctagcaaggagaagactaaggcacctcccaatgtgaaaaacgaggggcctctgaacgtggtaaagaccgaaaaggtggacaggagcactcaggacgaactgtccacaaaatgcgtgcactgtgggattgtgttcctcgacgaggtcatgtatgccttacacatgtcttgccacggcgattctggtccttttcagtgttccatatgtcaacacctgtgtaccgacaaatatgatttcacaacacatatccagcgcggactgcataggaataatgcacaggtggagaagaatggcaaacctaaagagtag

SEQ ID NO: 22536 - DNA, 2871 bp, Artificial Sequence
  Description of Artificial Sequence: Synthetic coding sequence
atgctggaggagctggagtgtggggctccaggcgcaaggggggcagccacagctatggattgcaaagaccgtcctgcttttcctgtgaagaagctgattcaggccaggttaccttttaagcgcttgaacctcgtccccaagggaaaagcagacgacatgagcgacgaccagggcactagcgtacaaagtaagtctccagacctggaggccagcctcgacacactggaaaacaactgtcatgtgggctctgacatcgatttccgcccaaaattagtgaatggcaagggaccactggataatttcctgaggaaccgtatcgaaacgagcatcgggcaatctactgtcatcatagaccttactgaagactctaacgaacagccagatagtctcgtggatcacaataagctgaactcggaagcatcacctagccgtgaagctatcaacggacagagagaggacaccggagaccagcaagggctgctgaaagccatccagaacgataaattagcattccctggtgagactctgtcagatatcccatgtaagacagaggaggagggggtcgggtgcggtggcgcaggacgcagaggggacagccaggagtgtagccccagatcctgccccgaattaacttctggccctcggatgtgcccacgtaaggagcaggatagctggagcgaagcgggtggaatcctattcaaggggaaagttccaatggtcgtgctgcaggacattcttgcagtccgccctccacagatcaaaagcctgcccgctaccccccaagggaaaaacatgacgcctgaaagtgaggtcctggagtcttttcccgaggaagatagcgtactatctcactccagcctctcaagtcctagctcaacctcaagccctgagggcccacccgcaccacccaaacaacactcatcgaccagcccattcccaacatctacccctctgagacgcattaccaaaaaattcgtaaaaggctccaccgaaaaaaacaaactgaggcttcaacgagaccaggagcgactgggcaagcagctgaagctgcgggctgagagggaagagaaagaaaagttaaaggaggaagctaaacgggcaaaggaagaagcaaaaaaaaaaaaggaggaggagaaagagctcaaggagaaagaaaggcgcgaaaaaagagaaaaggatgaaaaagagaaagctgaaaaacaacgtttaaaagaggagcggcgaaaggagagacaagaagctctcgaggctaaactagaagagaagaggaaaaaggaagaggagaaacgcttgagagaggaagaaaaacggataaaagccgagaaggccgagatcacgagattcttccaaaagcccaagactccccaagcccctaaaactcttgctgggtcctgcgggaagtttgctcctttcgagattaaagagcacatggttctggcccctaggagaaggacagcctttcacccggatctgtgcagtcaacttgatcagttattgcagcaacagagcggcgagttctcattcctgaaagatctcaaaggtcggcagcccctgcgcagcggtccaacacatgtgagcacaagaaacgccgatatctttaactctgatgtggttatcgttgaaagggggaaaggtgacggagtgccagagcggaggaaatttggcagaatgaagttactgcagttctgcgaaaaccacaggccagcttattggggcacgtggaataaaaagactgccctgatcagagcccgagatccgtgggcccaggacactaagctgttggattatgaggttgacagcgatgaagaatgggaggaggaagagccaggcgagtccctgtcacattcagagggtgacgacgatgacgatatgggggaggacgaggatgaggatgacgggttctttgttccacacgggtacctctccgaagatgaaggcgttacagaggagtgcgccgacccggagaaccacaaagtccgtcaaaagctcaaagccaaagaatgggatgagtttctcgccaaagggaagcggttcagagtgctgcagccagtgaagattgggtgcgtctgggcggcagacagagattgtgccggtgacgatctaaaagtcctacagcagttcgcggcatgctttctggagaccctgccagcccaagaagaacagactccgaaggcatctaagagagagcggagagatgagcaaatactcgctcagcttctgcctctcctccatggtaacgtgaatggatccaaagtgattatcagggaatttcaggagcactgccggaggggtcttctgagtaatcatacaggttccccacgctctccatccacgacctacttgcacacgccaactccctctgaggacgcagcaatcccttccaaaagccgtttgaaaagactgatttccgagaactcagtctacgaaaagcgccctgatttccggatgtgctggtatgtgcaccctcaggttctccagtctttccagcaggagcacctgccggttccttgtcagtggagttacgtgactagcgtacccagtgcccctaaggaggacagcggttcagttccgagtaccggaccctcgcagggtacgcctatttcactcaagcggaaatccgctgggtctatgtgcataacccaattcatgaagaagcggaggcacgacggacagattggtgccgaagacatggacgggtttcaggccgacactgaggaggaggaagaggaagagggtgactgtatgattgtggatgtgcctgacgccgctgaggttcaggccccttgcggagccgcatccggagccggaggcggtgtcggtgtggacaccggaaaagctacactaacctcatctcctctcggcgcttcctag

SEQ ID NO: 22537 - DNA, 2250 bp, Artificial Sequence
  Description of Artificial Sequence: Synthetic coding sequence
atgctggaggaactggaatgcggagctcctggagctcgcggagccgcaacggccatggattgcaaggaccgtcccgcattccctgtgaagaaactgatacaggctcgcttacccttcaaaagacttaacctagtacctaagggaaaggccgatgatatgtccgacgaccagggcacgagcgtgcagagtaaatcgccagacctcgaggcctctctggatacattggaaaataattgtcacgtaggttcagacatagatttcaggcccaaattggtgaacggaaagggaccgctcgacaacttcctgcggaacaggattgaaacaagcattggtcaatctacagtgatcattgatctcactgaagactcaaacgagcagcctgattccctggtagaccacaacaaattgaatagcgaagcctccccatctagagaggcaatcaatgggcaacgtgaagacactggagaccaacagggtttactgaaggcgatccagaacgacaaattagccttccctggcgaaactttgagtgacatcccctgtaaaactgaggaagagggcgtcggctgcggcggagccggtaggcggggtgacagtcaggagtgtagcccgagatcctgtccggagctcaccagtggacctcggatgtgcccgaggaaggagcaggattcctggtctgaggcgggtggcatcttgttcaaaggaaaagtacctatggtggtgctgcaggatattctcgccgtgcgtccacctcaaatcaagtcactccctgccacgccacaaggcaagaacatgacccctgaatccgaggtcctggagtccttccccgaagaggattcagtactgtctcactcaagtttaagcagtccctcctctacgtcctctccagagggcccaccagcccctcctaaacagcacagcagtacatcacctttccccacctcgacgcctctccggaggatcactaagaagttcgtaaagggatcaacggagaagaacaagctgcgccttcagagggaccaggagagattgggtaaacagttaaaactgcgcgctgaacgcgaggagaaagaaaagctcaaagaagaagccaagcgagcaaaggaagaggcaaagaaaaaaaaggaggaagagaaagagttgaaagagaaggagagaagagaaaagagagaaaaagacgagaaggagaaagccgagaaacagagactgaaggaagaaagaagaaaggagaggcaagaagctctagaggccaagctggaggagaaacgcaagaaggaggaagaaaagcggttgcgggaggaggagaaacggatcaaggcagagaaagccgagattacccgattctttcagaaacccaaaacaccccaggcaccaaagacactggcagggtcgtgtgggaagtttgccccattcgaaataaaagagcacatggtgctggcacccagacggcgtacagctttccatcccgatctgtgctctcagctcgaccagctcttgcaacaacagagtggcgagttcagctttctgaaggaccttaaaggacgccagcctctgcgctccggccctacccatgtttcaacaagaaatgccgacatcttcaactcagacgtggtgattgttgaacgaggaaaaggcgatggtgtcccagaaagaaggaagttcggtcgaatgaagttgctccaattctgtgaaaatcataggcccgcttattggggtacgtggaataagaagacggccctgatcagggcccgtgatccatgggcccaggatacaaagctgctggattacgaggtggatagcgacgaagagtgggaggaagaagagcctggcgagtccctgtcccacagtgagggcgatgatgatgacgacatgggggaagatgaagatgaagacgatggtttcttcgtaccacacggctacttgagtgaggacgaaggagtaacggaagaatgtgcagaccctgagaaccacaaagtgcggcagaagttgaaggctaaggaatgggatgagttccttgctaagggtaagaggttccgggtcctccaacccgtgaaaatcggctgtgtgtgggctgctgacagagattgtgctggagatgacctaaaagtattgcagcagtttgcggcacactgggtgcatcctgagtcacgaggcgatgtctgtcggatgctgcgcgtgagcagcccacagtcccggtatctaaacaggctcaattcatgtgtgaagagcaccctctcgtgttttacgtag

SEQ ID NO: 22538 - DNA, 2352 bp, Artificial Sequence
  Description of Artificial Sequence: Synthetic coding sequence
atgctggaggaactagagtgtggcgctccgggtgcacggggtgccgcaacagcaatggattgtaaggatagaccagcgttcccagtgaagaagctgatacaggcacgattgccttttaaaagactgaatttggtgccgaaaggtaaagctgatgatatgtcagacgaccagggaacttctgtgcagagtaagtctcccgacctggaggcatccttggacacgctggaaaataattgccatgtcgggtctgacattgactttcgccctaagctggttaatgggaagggccctctcgacaattttctgaggaatcggattgaaacatccatcgggcagagcactgtgatcatcgatctcacagaagatagcaatgagcagcctgactctctggtggaccacaataagcttaattccgaagctagcccttcgcgcgaagcgatcaatgggcagcgcgaggacacaggcgaccagcagggtctgctgaaggcaatccagaatgacaagttggcctttccgggagaaacgctttcggatattccctgcaagaccgaggaagagggcgtgggctgcggaggcgctggacgccgaggcgattctcaggaatgctcgccgagaagctgtcctgagttgaccagtggtccaagaatgtgcccccgaaaggaacaggactcttggtcggaggctggtggcatattgttcaagggaaaagtgcctatggtcgtcctccaggacattttagccgtgcgccctcctcagattaagagcctgcctgccaccccgcagggcaaaaacatgactcccgagtctgaggtcctggagtctttccccgaagaggacagtgtactgagccactctagcctgtccagcccttcctccaccagtagcccggagggacctcctgccccaccaaaacagcactcatctacatcaccattccccacctccacccccctgcgcaggatcacaaagaaatttgtcaagggaagtactgagaagaataagcttagactacagcgggaccaggagagactgggaaagcagcttaagcttagggcagaacgcgaggaaaaggagaagctgaaagaagaggctaagcgcgcaaaggaggaggcaaagaagaagaaggaggaggagaaggaactgaaagagaaggagagaagagaaaaacgcgagaaagacgagaaggagaaggcagagaagcaaagactaaaggaggagaggagaaaggaacggcaggaagctctggaggccaagctggaggagaagcgtaagaaagaagaggaaaagaggttgcgggaagaggaaaagaggattaaggctgagaaagcagagatcacaaggtttttccagaaacccaaaacgccacaggctcccaagaccctcgcgggatcctgtggcaagtttgctcccttcgagataaaggaacacatggtgttggccccacgacggaggactgccttccaccctgacttatgttcccaacttgatcagttgctgcagcagcagtccggcgagttctcttttctcaaagatttgaagggaaggcagccactgcgctcaggacccacccatgtgtcaactcgcaatgctgacattttcaactcggacgtggtgatagtggagaggggtaaaggcgatggggtgcccgaacgccgaaagtttggacgtatgaagcttttacagttctgcgaaaaccacaggcctgcttattgggggacatggaataagaagaccgccctgatacgggcacgtgatccttgggctcaggatacaaagcttttagactatgaagtagactcagacgaagagtgggaggaggaggaacctggggaatccctcagccactctgaaggcgatgatgacgacgacatgggggaggatgaggacgaggatgatggcttctttgtgccacatggctacctctccgaggacgagggtgtgacagaagagtgcgccgacccggaaaaccataaagtccgacagaaactcaaagctaaagagtgggacgagttcctagcaaaggggaagagattcagagttctgcagcccgtaaagataggctgtgtttgggcggctgaccgtgactgtgctggggatgatctcaaggtgttgcagcagttcgctgcgtgcttcctggagactctgcctgctcaagaagagcagaccccgaaagcctcaaaaagagaacggcgagatgagcagatcctggcccaactgctgcccttgctccacggcaatgttaacggatcaaaggttataattagagagttccaggaacactgccgccgagggttgttgtcaaaccacacaggaaaggccactcttacttcctcccctctgggcgcaagctag

SEQ ID NO: 22539 - DNA, 519 bp, Artificial Sequence
  Description of Artificial Sequence: Synthetic coding sequence
atgacaagcgcttcaacgaaagtgggtgaaatcttcagcgcagctggggcagccttcaccaagctgggcgagctcacgatgcaactacaccccgtggcagattcatcgcctgccggtgcaaaatggaccgagactgagattgaaatgctgcgggcagcagtgaaacggttcggtgatgacctgaaccatataagctgtgtcattaaagaaagaactgtcgcccaaatcaaggcgaccgtcaagagaaaagtttacgaggattctggtattccactgccagccgagagcccaaagaagggccctaagaaggtggccagtggcgtcctgtctccgccacctgctgctccaccacccagctcctcttcggtacccgaggctgggggaccccctatcaaaaagcagaaagctgacgttactttatcggcgcttaatgatagcgacgccaactccgatgtggtggacatcgagggcctcggcgagacaccccctgctaagaagcttaattttgaccaagcttag

SEQ ID NO: 22540 - DNA, 579 bp, Artificial Sequence
  Description of Artificial Sequence: Synthetic coding sequence
atgacctcagctagtactaaggtgggtgaaatatttagcgccgcaggagcggcttttacaaagcttggcgaacttaccatgcagctgcaccctgtcgccgattcatctcccgctggggctaaatggaccgaaacagagatcgaaatgctgagagccgcagtcaagcgattcggcgatgatctcaatcacatatcttgtgtcatcaaagagcgtacagttgcccagatcaaagcgacggtgaagcggaaggtttacgaggactcaggcatcccactgccagctgaatcaccgaagaaaggacccaagaaagtagcaagcggggtgctgtcaccacctcctgctgccccacccccaagctctagcagcgtgcccgaggcgggtggaccacctattaagaagcaaaaggctgacgtcaccctatccgcgctgaatgacagtgatgcgaactccgatgtagttgacatagagggtctgggcgagacacctccagccaagaagttgaacttcgatcaagactctctgactctggactcagggctgctgatgacttccgccgaccccccacttctatcttgttag

SEQ ID NO: 22541 - DNA, 417 bp, Artificial Sequence
  Description of Artificial Sequence: Synthetic coding sequence
atgacctcagcctccactaaggtgggagagattttcagcgctgcgggagctgcgttcaccaaactgggagagctaactatgcagttacatccagtagccgattcctcgcctgctggggcacaaattaaagcaacagtgaagcggaaagtgtatgaagactcaggtattccactgcccgcagagtctcccaagaaaggccctaagaaagtcgcctctggggtgttgtcacctcctcctgcagccccacctcccagcagctccagcgtgccagaggctggcggaccccctattaaaaagcagaaagcggacgtgacactaagcgccctgaatgacagcgacgccaactcagacgttgttgatatagagggccttggtgagacccccccagccaagaagttgaattttgaccaggcatag

SEQ ID NO: 22542 - DNA, 306 bp, Artificial Sequence
  Description of Artificial Sequence: Synthetic coding sequence
atggcctcaaataagaccaccctgcagaagatggggaagaagcaaaatggcaagtctaagaaggtggaggaggcagagccagaggagttcgtagtcgaaaaggtgttagacaggcgcgtggtcaatgggaaagtcgagtattttctcaagtggaaaggatttacggagaagctggctaagaagaagatggtgcagaaggagaatctgtatttgactgtcaatctgatgaccgccaaccagcggaggaaggagatgctcctgacaaaccaggaagatctgccagaggtgcttattctcaaggagtag

SEQ ID NO: 22543 - DNA, 2049 bp, Artificial Sequence
  Description of Artificial Sequence: Synthetic coding sequence
atgacctgcccacctaccggtctgtacggcccagaagggatcctgcccgctagaaggacactgaggccacaggggaaagggaggtggcagcagctgtgggaaaccccaacccttctctgggaggcccctcggctgggactcgacacagcacaaggcttggagctcctgagtcttttgggcgctttggtcgcactgggcgctctcttgctgagccctcttcgtcaccctgtcatttacttgctcttatgggctgcctacctttcagcatgccaagtgggccaggtcttcctgtatttccagtgggactcactcctgctggagactggatttctcgccgttctggtcgcaccactccgccctgcctctcacagaaaggaagcacctcaaggcaggcaagctggggcactccctcatgaagatctgcctttctggttagtgcggtggcttttgttcaggctgatgtttgccagtggtgtggtgaagctgacatctagatgccctgcttggtggggcctaacagcactgacctaccactacgagacgcagtgcctgcctacgcccgcagcctggtttgctcaccatttgcccgtctggttgcacaagctgagcgtcgtagccacgttcctgattgaaatcgcagtgccccctttattctttgcacccatcagacgcctacgcctagccgcattttattcccaggttctgctgcaggttttaattatcatcaccgggaattataacttctttaacctgatgaccctagtcctcacaaccgccctgcttgacgatcaacatttggccgctgaacccggacatgggtcccgcaaaaagaccgcgacgtcctggcccaaagccttgctcgcaaccctgtcacttctgttggaactggccgtctacggcctccttgcttacggcacagttcactatttcgggctcgaagtggattggcagcagcgcacaattcactctagaaccacatttacatttcaccaattctcacagtggctcaagaccctcaccctccccaccgtctggcttggagtggccagcctggtgtgggaattgttgtcagctctgtggaggtggacccaggtcaggggctggctgaggaagctcagcgcggtggttcaactctccctggtgggcactgctacagtggcattgtttctgattagcttagtcccgtacagttatgtggaaccgggaacacatggcagactgtggactggcgcacatcgattgtttggcgctgttgagcacctgcagctggcaaactcttatggactattcagacggatgacaggactgggaggcaggcccgaagttgtacttgaggggtcttacgacggccatcactggactgaaatcgaatttatgtacaagccaggtaacctatcacgacctcccccagttgtggttccccaccaaccaaggctggactggcaaatgtggttcgcggcactgggaccacatactcacagcccatggtttaccagtcttgtgctgcggctgttgcagggcaaagagcctgttattcgcctggtccagtcgcaggttgcacgctatccatttcataagcagccccctacctatgtccgcgctcagagatataagtactggtttagccagcccggagagcagggccaatggtggagacgacagtgggttgaggagttcttccccagcgtgtcactgggcgacccaaccttggagactttgctccggcagtttgggctgcaggagaaatcaccaccacgaaccagaagcgctaattctacactcgcccaggccctgcactggacacgcagtcagttgtcacctcttgaggccccagcccttctgtggggcctgttgatggcagtgggggcagtgcgtttcgtgcaagctctgctggccccttgcagcctgagaagctctcccttggcacccgttagcggcgaaaagaggaggccggcttcccagaaagactccggtgccgctagcgaacaggctacggcagcgccaaatccctgttccagtagctcgcggacaaccaggcggaagaagtag

SEQ ID NO: 22544 - DNA, 1239 bp, Artificial Sequence
  Description of Artificial Sequence: Synthetic coding sequence
atggagctgagcgccgtcggggagagggtgtttgctgccgagtccattatcaagaggagaatccgtaaggggcgaattgagtacctcgtcaaatggaagggctgggctattaaatacagtacatgggagccagaggaaaacattttagacagtagactaatcgccgcttttgagcagaaagaaagggagagagagctgtacggcccaaagaagagaggccctaagccgaaaacattccttctgaaagctcgggctcaagccgaggcgttacggatctccgatgtgcatttcagcgtcaaaccctctgcctccgccagcagtccaaaactgcactcttcggctgcagtgcacagactcaagaaagacattcgcaggtgccaccgtatgtcacgacgccctctgccacgcccagatcctcaggggggaagcccaggccttcgtccccctatcagcccgttctccgagacagtgcgtatcataaaccgcaaagtgaaaccaagagagcccaaaagaaaccggattattctaaatctcaaggtgatcgataagggcgcaggaggaggaggcgcaggacagggcgctggcgcacttgcaaggcctaaagtgccaagcaggaaccgggtcatcggaaagagtaagaaattctctgaatccgtgctcaggactcagatacgtcacatgaagtttggcgcatttgcattatacaaacctcctcccgcaccccttgtcgccccttcccctggcaaggccgaggcctccgcccctggacctggcttgctgttggcggctccagctgcaccgtacgacgcaaggtcttcaggtagctccggctgtccctcacccaccccgcagagttccgacccggacgacacccccccaaaactgctgccagagacggtgagccctagtgctccatcttggagagagcccgaggtgctggacctctctctccctccagaaagcgcggctacctctaaacgtgccccacccgaagtcaccgcagccgctgggcctgccccacctaccgctccggaacctgccggtgcatcatctgagcctgaagctggtgattggcgacccgaaatgagtccatgttctaacgttgtcgtcacagacgtcacctcaaatctgttaacagttacgatcaaggaattttgcaacccggaggactttgagaaggtcgccgctggagtcgcaggcgcagctggaggcggagggtcaattggagctagcaagtag

SEQ ID NO: 22545 - DNA, 1170 bp, Artificial Sequence
  Description of Artificial Sequence: Synthetic coding sequence
atggaactttctgccgtgggagagagggtgtttgcagccgaagccctgctgaaacggagaatccgcaaaggaaggatggaatacctggtcaagtggaaagggtggtcccagaagtactcaacttgggagcctgaggagaatatccttgatgccagacttctggctgctttcgaggaacgggagcgggaaatggagttgtacgggccaaagaagcgtggacccaaaccaaaaactttcctcctgaaggctcaggctaaagcgaaggctaaaacctacgaatttcgatccgatagcgctcggggtattaggattccctatccaggaaggagccctcaggacctggcaagtaccagtagggccagggagggactccgcaacatgggcctgtctcctcctgcatcctcaacatcaactagcagcacctgtcgcgctgaggcaccacgagatcgggacagggatcgtgatcgtgacagagagagggatcgtgagcgcgaaagagagcgcgagagggaacgcgagcgggagagagagcgagagcgtggtacgtcccgggttgatgataaaccctcaagtccaggcgacagctctaagaagaggggtccaaaacccaggaaggaattgccagatcccagtcaaagacccttaggcgagccctctgccggtctgggagaatatttgaagggtcgcaagctcgatgatactcctagtggggctggtaagttccctgccggtcattccgtgatccagctcgccagacgccaggatagcgacctagtgcagtgtggtgtaacatccccctccagtgcggaagcaaccggtaagttggcagtggatacattcccggctcgagtcattaagcaccgagctgcgtttctggaagctaaaggccagggagccctcgatccgaacggaacaagggtcaggcatggaagcggaccccctagctcagggggtggcctgtatcgggacatgggggcacaggggggaagaccctctcttatcgcacgtatcccagtggccagaattcttggcgatccggaagaggagagttggtccccatccctgacaaacttggagaaagtggtcgttactgatgtcacctccaacttcctgacagtgacaatcaaagagtccaacaccgaccagggcttcttcaaggagaaaaggtag

SEQ ID NO: 22546 - DNA, 2469 bp, Artificial Sequence
  Description of Artificial Sequence: Synthetic coding sequence
atgaaaatgaagatacagaaaaaagagaagcaactgagtaacctgaaagtactaaaccactctcccatgagcgacgcctctgttaatttcgactacaaatcaccttcaccatttgactgctcgaccgatcaggaagaaaaaatcgaggacgtcgcctctcattgtctgccccagaaagatctgtacacagctgaggaagaggccgcaaccttgttccccaggaaaatgacttcccataatggaatggaggactccggcggaggcggtaccggggtgaaaaaaaaacggaaaaagaaggagccaggggaccaagagggggctgcaaaagggagcaaggaccgggaaccaaagcccaagagaaagagagagcccaaagagccaaaggagccacgcaaggccaaggaacctaagaaggctaaggagcacaaggaaccaaaacagaaagacggggctaagaaggccagaaagccgcgtgaggcgtcaggcaccaaagaagctaaagaaaagcgttcatgcaccgactcggctgcacgtacaaagtctcgaaaggcctcaaaagaacagggacctacccccgtagaaaaaaagaagaaggggaaaagaaaatcagaaaccactgtggagtccctggagctcgatcaagggctgaccaaccccagcttacgatcaccagaggaaagcaccgaaagcactgactcccagaagaggcgctccgggaggcaggttaaacgaaggaagtataacgaagacttagatttcaaagtagtcgatgatgacggtgaaaccatcgccgtgctcggtgcaggcaggactagtgcattaagcgcctccacccttgcttggcaggcagaagaaccacccgaggacgacgccaacatcatcgagaaaattcttgcctccaagaccgtacaggaagtgcacccaggcgaacccccatttgatctggagttattctatgtcaagtataggaatttctcctacctgcactgcaagtgggctacaatggaggagctggaaaaagacccaaggatcgcccaaaagattaagcggtttcgcaataaacaagcccagatgaaacacatttttacagaacccgacgaagatcttttcaatcccgattacgtggaagtcgacaggattctggaagtagcccataccaaagatgccgagacaggggaggaggtgactcattatctggtgaaatggtgctcccttccttacgaagaatccacctgggagctggaagaggatgtagatcccgcaaaggtcaaggaattcgagtctcttcaagtgttgcccgagattaaacatgtggagcggcctgccagtgattcgtggcagaagctcgaaaaatcccgagagtacaaaaattcaaatcagctgcgggagtaccagctggaggggatgaactggctgctgttcaactggtacaaccgcaagaattgtatcctcgcagacgagatggggttaggaaaaacgattcagtctatcaccttcttgagcgagattttcctgcgaggaatacatggcccatttctgatcatcgcaccgctatccacaataaccaactgggagcgtgagttcaggacttggaccgagatgaacgccattgtgtaccatggaagtcagattagcaggcaaatgatccagcagtatgaaatggtgtatagggatgcacagggtaaccctctctcaggagtgtttaagttccacgtcgtcatcactacatttgagatgattctggctgactgcccagacctgaaaaagattttctggggaagatggaaagatattctgacacacggacgcttcaaatggcatctcaacgagaaggacatggaaatgatttgtcgggcactcctggtgtactgcgtaaagcattacaagggtgatgaaaagatcaaatcctttatttgggaactgatcacccctactaaggacggccaggcccaaacactgcagaatcattccgggctttccgctcctgtgccgagagggaggaaaggcaaaaaaacaaaaaaccagctgctgattcctgaactgaaagatgccgactggttagccacttgtaatccagaagtagtgctgcacgacgacgggtataagaaacatctgaagcagcactgtaacaaggtattactgcgggtgcggatgctctattacctgaaggccgagatcttgggtgaagctgctgaaaaggcattcgaggggtcgcctgcgagagagctagatgtccccctgccagatatagattacatggaaattccggtagactggtgggacgccgaggccgacaagagcctcctgataggcgtgtttaaacacggttacgaacgatacaatgctatgagagccgaccctgctctgtgttttctcgagaaggtgggaatgcctgatgagaaatcattatctgccgaacagggagtcactgatggtaccagcgacattccggaaagacagcatcgttag

SEQ ID NO: 22547 - DNA, 1122 bp, Artificial Sequence
  Description of Artificial Sequence: Synthetic coding sequence
atgtgccaatcacacatgatcggattttgtacctctagcgttaacgaagagactgagactcaaggcgaccagataagttgccctaaccccaccactttagtgttcagaacacagatttcctctctcccctccctgcagctgagcaacttgaaggttctgaaccattctccgatgagcgacgcgagcgtgaactttgattacaagagtccaagcccctttgattgctctactgaccaggaggaaaagatcgaggacgttgcctcacactgtctgccccaaaaggacctgtatacagcagaagaggaggccgctaccttgttcccaaggaagatgactagccacaacgggatggaagactcaggtggaggcggtaccggagttaagaaaaaacggaaaaagaaggaacccggagaccaggagggagctgccaaaggttcaaaggacagagagccgaaaccaaaaaggaagcgtgagcccaaagaacccaaagaaccaaggaaggccaaagagcccaagaaggctaaagagcacaaagagcctaaacaaaaagacggcgcaaaaaaagcacgcaagccacgtgaggctagtggaacaaaagaagctaaggaaaagagatcttgcacagatagcgcagccagaactaagtcccgcaaggcatctaaggagcaggggccaactccggtggagaagaaaaaaaagggaaagcgcaaatccgagactaccgtagaatccctggagctggatcaggggttaactaatccatccctgcggtctccagaagagtctaccgaatctaccgacagtcagaagcgtcggtcaggacgccaggtgaagaggaggaagtataatgaagatttggacttcaaagtagtagacgacgacggtgagacaatcgcagtcctgggtgccggtcgtaccagtgcactctctgcctcgaccctagcttggcaggctgaggagcccccagaggacgatgccaatataatcgagaagatcctggccagcaagacagtacaggaggtccaccccggtgagccaccattcgatctcgaacttttttacgttaagtatcgaaatctgtacgtgtatcttaagtactctctctatttgggttttatctag

SEQ ID NO: 22548 - DNA, 8147 bp, Artificial Sequence
  Description of Artificial Sequence: Synthetic coding sequence
atgaaaatgaaaattcagaagaaggagaagcaattgtccaacctcaaggtactcaaccattcccctatgtcagatgcatcagtgaacttcgactacaagagccccagtccctttgactgttctaccgaccaggaagagaagatcgaagacgttgcgagtcactgtctgccccagaaagacctgtatacggccgaggaagaagcggctaccctgttccctcgtaagatgacttcccacaacgggatggaagacagcggcggtggcggaactggggttaaaaagaaacgaaagaagaaggaacccggtgaccaggagggcgcagccaagggcagcaaggatagagagcctaagcctaagcgaaagagggaaccgaaagagcctaaggagccccgaaaggcaaaggagcccaaaaaggccaaagagcacaaagaacctaagcagaaagatggcgctaagaaggccagaaaacccagggaggcatcaggaactaaagaagctaaagagaaaagatcttgtaccgattcagctgctagaaccaagagtcgcaaagcaagtaaggagcagggacccactccagtcgagaagaagaaaaagggcaagagaaaatctgagaccaccgtcgaaagcctggagctggatcaaggcctgaccaatccctctctccggagccctgaggagtctaccgaatccacggatagccagaagcggcgttctggcaggcaagtgaaacgcaggaagtacaatgaagacctggatttcaaggtcgttgacgacgatggggagacaatagcagtactgggtgccggaagaaccagcgccctgtctgcatccacgttagcttggcaggctgaagaaccgccagaggacgatgctaacataatagagaagatactcgcaagcaagaccgtgcaggaagtgcaccctggcgagcctccgttcgatctggaactgttctatgtcaagtatagaaatttctcctacctgcactgtaagtgggccacaatggaagaacttgagaaggatccaaggattgcccaaaagattaagcggttcaggaataagcaggcacaaatgaaacatatcttcaccgaacctgacgaggacctgtttaaccctgactatgtggaggtggatcgtatcttggaagtggctcacaccaaagacgctgaaacaggggaagaggtgactcactatcttgtgaagtggtgtagcctgccctacgaggaaagcacatgggaactcgaagaagacgtcgatcccgctaaggtaaaggagttcgaaagcctgcaggtgcttccggagattaaacatgtggaaagacctgcctccgactcttggcagaaactggaaaaatcccgggaatacaaaaactcgaatcagctgcgtgaataccaacttgagggcatgaactggctcctgtttaattggtacaaccgaaagaattgcattctcgctgacgaaatggggcttggtaaaacaattcagtctatcacctttctctccgaaatttttttgcgtggcattcatggcccattcctcattatcgcacctctgagtacaattaccaattgggagcgggagttcaggacttggaccgaaatgaacgccatcgtgtaccacggaagtcagatttcgcgccagatgattcagcaatacgaaatggtttatcgcgatgcgcagggaaaccctctcagtggagtgtttaagtttcacgtggtaatcaccacctttgagatgattctggctgactgcccagaacttaagaagatccactggtcatgtgttatcattgacgaggcccaccgtctgaagaatagaaactgcaagttgctcgaaggactgaagcttatggcgctggaacataaagtcctgttgactggtacaccactgcagaattccgttgaagagctatttagtctgttaaatttcctcgaaccaagccagttccccagcgagacagctttcctcgaggagttcggggacctgaagacagaggaacaggtgaagaagttgcagtccatactcaagccgatgatgttacggagattgaaggatgatgtggaaaagaatctggccccaaagcaggagacaatcatagaggttgaactcacaaatattcagaagaagtactacagggcaatcctcgaaaagaatttcagctttcttaccaagggggctaaccaacacaatatgccaaacctgatcaataccatgatggagttacggaagtgctgcaaccacccatacctcatcaacggcgctgaggagaaaatcctggaggatttcagaaagactcactccccagatgccccagacttccagcttcaagcaatgatccaggccgcaggcaagttggtccttatcgataagctattgcctaaattgatagccggtgggcacaaagttcttatttttagccagatggtccgctgtctcgatatcctggaggactatttaatccagaggcgctacacttatgaaagaatcgacggaagggtgagagggaatttacggcaagctgcaatagatcgattctgcaagcccgattctgaccgattcgtgtttctgttgtgcacccgggctgggggactgggcattaacctaaccgctgcagacacgtgcataattttcgattccgactggaatccgcagaacgatctgcaggctcaggctcgctgtcaccggatcgggcagtcaaaggcagtcaaggtgtaccggctgattacaagaaactcttacgaaagggagatgttcgataaagcaagcttaaaactcggactcgacaaagccgtgttgcaggacataaaccgcaaagggggaacgaacggtgtgcagcaactgtctaaaatggaggtcgaggacctcttacgaaagggggcatatggtgcccttatggacgaagaggacgagggaagcaaattttgtgaggaagacatcgatcagatactgcagagaagaactcatactatcaccattcagagcgagggcaagggctctaccttcgccaaagcctccttcgtggcttcaggcaatcggacggatatcagtctcgatgaccccaacttttggcagaaatgggcgaagatcgctgagctggatacagaagcgaagaacgagaaagagtccctggtgattgacaggcctagggttcgcaagcagacaaaacactacaacagcttcgaggaggatgagttgatggagttttctgagctagactccgacagcgatgagaggcctacccgctctagacggttgaatgacaaggccagaaggtatcttcgcgctgagtgcttccgggttgagaagaacctgctaatcttcgggtggggcagatggaaggacatcctcacccacggcaggtttaaatggcatttgaacgagaaggacatggagatgatttgtcgagcattgctggtgtattgtgtcaaacattacaaaggagacgaaaagattaaaagctttatatgggagctcattacacccaccaaggatggacaggcccagactttgcagaatcatagcggtttatcagccccagtgccgagggggaggaaagggaagaagacaaaaaaccagcttctcatcccagaactgaaagacgccgactggctggcaacctgcaatccagaggtggtgctccacgacgatggatacaagaagcatctaaagcaacattgcaacaaagtgttgcttagggttagaatgctgtactacctcaaagctgagatccttggagaggctgcggagaaagcttttgagggctcacccgcaagagagttagatgtgccactgcctgatattgattatatggaaatccctgtagattggtgggatgcagaagctgacaagtcattgttaatcggcgtgtttaagcacggctatgagaggtataacgccatgcgggctgaccctgcgctctgctttctagagaaagtggggatgccggacgagaagagtttgtctgccgagcagggcgtcaccgatggaactagcgacattcctgagagaggtaatacagacaaagaagataacgccgaggataaggtggacggacttcagaagcagacagaatcatcctctgatggcggagacggagtgttcagcgagaagaaggacgatagcagagcagcccaggatggctccgatcccgacaaatccccatggccagtcagctctgctctgacagccaggctgagaagactcgtaacagtgtatcagagatgtaatagaaaagaactgtgccgaccagagatcctgggccctgggaaccagggctactgggttcaagaggaaatgtttcgtcggacttccgagatggacctgatcaacaaagaggcccaaaaacggtggacccgtagagagcaagccgacttctaccgtactgtgtcgtcctttggggtggtttacgatcaggaaaagaagacctttgactggacccagtttcggattatcagtcggctggacaagaaatccgatgaaagtctggaacagtatttctatagctttgtggcaatgtgtaggaacgtgtgcaggcttcccacgtggaaggacggtggaccacctgatactacgatctatgtcgagccaatcaccgaagaaagggctgcacggaccctgtataggattgaactactcaggaaagtgcgcgaacaggtactcaaatgtcctcagcttcatgagcgtttacaactatgtcgaccctcgctgtacttgcctgtatggtgggaatgcgggaaacatgatcgagatcttttaatcggtactgccaaacatgggctgaacaggactgactgctacatcatgaatgacccccagctgtcgttcctcgacgcctaccggaactatgctcagcacaagaggtccggcactcaggccccaggcaacctgtgctgcctttatcagaccaattccaagttgtacgagagcctaacatatagtcaaatgtctcggacgtctgaaagccttgagaacgagcctgagaatttagtccgggtggagtcacgagatgatcatctgtcactgcccgatgtgacgtgcgagaattttatcagcaaggtgcaggacgtcattagtataaatcacgatgagagcctcctccccgaaagcctggagtctatgatgtacggtaaaaaagtgctatctcaggagccaagctccttccaggagtccccctctacaaacaccgaaagccggaaagatgttataacaatttcaattagcaaagatggcaactgtcagagtgggggacccgaggccgagattgcttcggggccaacattcatggggtccctcgaggccggaggggtggcccaggcaaacatcaaaaacggaaaacacctgcttatgtcgatctcaaaggagggcgaactgtgttgttccgaggcaggccagagacccgagaacattggtcaactggaggcaaaatgcctcgcctcaccttccttgaacccagggaacgagagcggtttcgtggacatgtgttctctttctgtgtgtgatagtaagaggaacctcagcagcgaccagcagcttatcgacctgctcgaaaataaaagcctcgagagtaagcttatcctgtcacaaaaccatagcgacgaagaggaggaggaggaggaaaacgaagaagaaaaccttgccatggctgtcggtatgggggaaagacccgaggtcctgcacctgacagagcctaccacaaacatttctcgagaaaaaaatcagggcttccaagatgagacaaagaagggatccttagaagtcgccaatcagacaccaggcctgcagagagctttcccagcgccagctgcctgccagtgccattgtaagcacatggaaagatggatgcacggattggagaatgacgagttcgaaatcgagaagcccaaggcttacatccccgatctgtttaaaagtaaaaccaacacaatagctatggagggcgagcccaccgcaatcccgagccagcccttcaaagtaaagcatgaactgctgaaggagccttggaaagaatcagccgagggccagaacgtcttcccgacctaccctctggaaggcagcgagctcaaaagcgaggacatggattttgaaaataaggatgattatgatcgcgatggcaattgtcacagccaggactatcccggaaagtactccgaagaggaatcaaaatcatccaccagtggcattactggagatattggcgatgaattgcaggaggcgagggctcccactattgctcaacttctccaggaaaagacgctgtactctttctctgagtggcctaaggaccgagtgataatcaaccggcttgataatatctgccacgtggtgctcaaaggtaagtggccatctagccagcagtatgagccttccggaacgttacctacacccgtgctgacatcctcagccggaagtaggactagcctcagcgagcccgaggcagctgaacattccttctcaaacggtgccgctctggcagcccagattcacaaagaaagttttctcgcccctgtttttaccaaggacgaacagaagcacagacgcccttacgaattcgaggtcgagagggatgcaaaggcacgcggtttggagcagttttctgcaacgcacggacatacgcccattatcctgaatggatggcatggtgagtctgccatggatctgtcctgcagctctgaaggatccccaggtgccacatctccttttcctgtcagtgcctccactcctaagattggcgctatttccagcctgcagggcgcattaggcatggatctctcgggcattctacaggcgggtctgatccacccagtcacaggacaaatagtgaatggatccctaaggagagatgatgccgctactaggcgcaggcgcggacgccgaaagcacgttgaaggaggcatggacctcatctttttgaaagagcagaccctgcaagccggaatcctagaagttcacgaagaccccggacaggccactctcagcaccactcatcccgaaggcccagggcctgccactagcgccccagagccggctacagctgccagttcccaggccgagaaatcgataccctctaagtcacttcttgactggcttcgtcagcaggctgattatagtctcgaagtccccggtttcggtgcgaacttctctgacaaacccaagcagcgaagacccagatgtaaggagccaggtaagctggatgtgtctagtctgagcggcgaggaacgcgtgccagctataccaaaggaacctgggttgcgcggttttttgcccgagaataagttcaaccatacccttgcggaacctattcttagagacacaggaccgaggaggaggggccgacgcccacgcagtgaactgctcaaggcacctagcatagtggccgactctccgagtgggatggggccactgtttatgaacgggctgattgccggtatggatctggtaggcctgcagaacatgagaaatatgcctggcattccattgaccggcttagtgggcttcccagcgggttttgccaccatgcccacaggggaagaggtgaagtcgacgctgtccatgctgccgatgatgttgccaggcatggccgcagtgccccagatgtttggcgtcgggggactcttaagcccaccaatggcgactacctgtacatctactgctcccgcatcactgtcttctactaccaaaagcggaacggccgtcactgagaaaaccgccgaggataaaccaagcagtcacgacgtgaaaacagatactctcgcagaggacaaaccgggtcccggtcctttctccgaccagagcgagcccgctattaccacatcaagccccgtagcgttcaacccattcctgatcccaggagtgagccccggactgatttacccaagcatgtttttatcacctggcatggggatggctttacctgccatgcaacaagcaaggcactccgagattgtgggcctggaatctcagaaaagaaagaaaaaaaagactaaaggtgacaatccaaattcgcacccagaacctgcgcctagctgcgagagagagcctagcggagacgaaaattgtgctgagccaagtgcccctctgccggctgagcgagagcatggggctcaggctggggaaggcgctcttaaagatagcaataacgacactaacta

SEQ ID NO: 22549 - DNA, 450 bp, Artificial Sequence
  Description of Artificial Sequence: Synthetic coding sequence
atgaagatgaagatacagaagaaggaaaaacagttaagcaatctgaaagtgcttaatcactctcctatgagtgacgcaagtgtgaactttgactataaaagtccatctccattcgattgctccacagatcaggaagaaaagatagaggacgtggcttcccattgtctgccccaaaaggatctctatacagccgaggaggaggcagccactctgttcccaagaaagatgacctcccacaatggcatggaagattcaggaggcggaggaactggagttaagaaaaagagaaaaaaaaaagaacccggagatcaagaaggggcagcaaaggggtccaaggatagggaaccaaagccgaagaggaaacgggagcccaaagagccaaaggaacccagaaaagccaaagaaccgaaaaaggctaaagaacacaaagagcccaaacagaaggactag

SEQ ID NO: 22550 - DNA, 1578 bp, Artificial Sequence
  Description of Artificial Sequence: Synthetic coding sequence
tgagccagcaagactgtacaggaggtgcaccctggagagcccccattcgatcttgagctgttttatgtgaagtatcgcaacttcagctatttacattgtaagtgggccacaatggaagagcttgagaaagacccacgaatcgcccagaaaattaagaggtttagaaataaacaggcccagatgaagcacatcttcactgaacctgatgaggacctatttaaccccgactacgtagaggtcgacagaattttagaagtagcccacacaaaggacgcagagacaggagaggaagtgacccattatcttgtaaaatggtgtagcctgccctacgaggaatccacctgggaattggaagaggatgtagacccagcaaaggtcaaagagtttgaatctctccaggttctcccagaaatcaaacatgtggagcggccagcgtctgattcttggcagaagctggagaagtcaagagagtacaaaaatagtaatcaacttagagagtaccaactggagggtatgaattggctcctcttcaattggtataaccggaaaaattgtatccttgcggacgaaatgggcctgggcaagaccatacagtcgatcaccttcctgagtgagattttcctgaggggcattcatgggccattcttgattattgctccactctctacaatcactaattgggaaagagagtttagaacatggacagaaatgaatgcaatcgtgtaccacgggtcgcagattagcagacagatgatccagcagtacgaaatggtttaccgggacgcgcagggtaaccctctatccggtgtgttcaagttccacgtggtgatcacaacatttgagatgatactggccgattgtcctgaactgaaaaagatccattggggtcgttggaaggacatcctcacacacgggagattcaaatggcacctgaatgagaaggatatggaaatgatctgtcgggcactcctggtgtattgtgtcaaacattacaagggagacgagaagattaaatcgttcatttgggaactaatcacaccaaccaaagatggccaggcgcagactctgcagaaccactccggcttgtccgcacccgttcccagagggagaaagggtaagaaaaccaagaatcagctgctcatcccagaactgaaggacgcagattggctcgctacttgcaaccctgaagtggtgctgcacgacgatggctataaaaaacatctcaaacaacattgcaataaggtcttgctcagagtcaggatgctgtactaccttaaggctgaaattcttggcgaagccgcagaaaaagctttcgaaggctccccagctcgtgagttggacgtgccccttcctgacatcgattacatggagattcctgtcgactggtgggacgcggaggcagacaagtctttgcttatcggggtgtttaagcacggatatgagagatacaatgcgatgcgcgctgaccctgcactgtgtttcctggagaaggtaggtatgcccgatgagaagtccctctcagctgaacagggagtgacggacggtacctcagacattccagaaaggcaacatcgctag

SEQ ID NO: 22551 - DNA, 1521 bp, Artificial Sequence
  Description of Artificial Sequence: Synthetic coding sequence
atggcctccggtgacctttacgaagtggaacggatcgtggacaaaaggaagaacaagaagggcaagtgggagtatctcattcgctggaaagggtatggttctactgaggacacgtgggaacctgaacaccaccttctacactgtgaagagttcatcgacgaattcaatggactccacatgagcaaggataaacgcatcaaaagtggaaaacaaagcagcactagcaaattgctgcgcgatagtagaggacctagcgttgagaagctttcccacaggccaagcgaccctggaaaaagcaaaggaacaagtcataagagaaagcgcatcaatcctcctctcgctaagccgaagaagggctactccgggaaaccctcatccgggggtgacagagcaaccaagaccgtttcttacagaacaacgcctagtgggctgcagatcatgcctctgaagaagtcacaaaacgggatggagaatggagatgctggatctgagaaagatgagcgccacttcgggaacggaagtcatcagcccggactggatttgaacgaccacgtgggcgagcaggatatgggcgaatgcgatgtgaaccatgcgacgctcgccgaaaatggccttggatcagcccttaccaacggcggattgaacctgcactctccagtgaagagaaagctggaggctgaaaaggactacgttttcgataagagactccgttattccgtccgccagaacgagagtaattgtcgctttcgtgatattgtcgtgcggaaggaggagggattcacgcatatcctcctgtcaagtcaaacctctgataacaacgcgctgacaccagagataatgaaggaagtgcgtagggccctgtgtaatgccgctacagacgattccaagttactgcttctatctgcggtcggatcagtgttctgcagtggcctggactatagctatctgattggacgattgagctctgataggcgaaaggagagtacccggattgctgaggcgattagagactttgtgaaagcttttatccagtttaaaaagccaatcgtcgtagctattaacggccctgctctgggactgggagcctcaatcctgcccctgtgtgatattgtctgggccagtgagaaggcctggttccagaccccctacgccaccattaggctgacgccagccggatgtagctcgtatacattcccccagattttgggtgtggctctagccaacgagatgttgttctgcggaagaaagctgacggcccaggaggcctgtagtcgcggattggtaagtcaggtcttttggcccacaacattctctcaggaggtgatgctgagagtgaaagagatggcctcctgtagtgccgtggtactcgaggaatccaagtgcctcgtgcggagcttcctgaagagtgtgttagaggacgtgaacgagaaagaatgcctcatgctaaagcaactttggagctcctctaaaggcctggacagcctgttcagctacctgcaggacaaaatctacgaggtgtag

SEQ ID NO: 22552 - DNA, 1665 bp, Artificial Sequence
  Description of Artificial Sequence: Synthetic coding sequence
atggcctctcaggaatttgaggttgaggccatcgtggataaacgtcaagacaaaaatgggaacacccagtacctcgtgcgatggaaaggatacgacaaacaagacgatacctgggagccagagcagcatttgatgaactgcgaaaaatgcgtccacgacttcaatagaagacaaaccgagaagcagaagaaactgacatggaccactacttcgagaatcttcagcaataatgccaggcgtcggacctctcggtcaaccaaagccaactacagcaaaaactctccaaaaacccctgtgaccgacaagcaccatcgtagcaaaaatagaaagttattcgccgcttccaaaaatgtgagacgaaaagcggcttcaatcctgtcggacactaaaaacatggagatcatcaactcgacgatcgagaccctcgcccctgacagccctttcgaccataagacagtctcgggctttcagaagctggagaagctcgatcctatagccgctgaccagcaggacacagttgtatttaaagtgaccgaaggcaagctcctgcgggacccactgagtagaccaggagccgagcagacggggatccaaaataagactcaaatccatcctcttatgagccagatgtcaggcagcgtgaccgcttcaatggcaaccggtagtgcaactcgtaagggtatcgttgtcctgattgatccccttgcagccaatggcaccaccgatatgcacacctccgtgccgcgagtaaaggggggacagaggaatattaccgatgattctagagatcagcctttcatcaaaaagatgcacttcactattagactgaccgaaagtgcctcgacttaccgggacatcgtggtaaagaaggaagatggatttactcagattgtgctcagcacaagatcaaccgaaaaaaacgccctgaacaccgaagttatcaaggagattgtgaacgcgctgaacagtgctgccgctgatgacagcaagctcgtcttgttttctgctgccggttccgtgttttgctgcgggctcgatttcggatacttcgtcaaacacctgaggaacaatcggaacacggcgtccctggagatggtcgacacaatcaagaactttgttaatacgttcatccagttcaaaaagcctatcgttgtaagcgtcaacggaccagccatcggcctgggggcaagtatactccccctatgcgacctggtgtgggcgaacgagaaggcttggtttcagactccttacacaactttcgggcaatcccccgatggttgttcaagcattacattccccaaaatgatggggaaggccagcgcaaatgaaatgctgatcgctggacggaaattgactgcacgggaagcctgtgccaaagggctggtttctcaggtctttctaactgggacattcacccaggaggtgatgatccagattaaggaactggcaagctataacccgatcgtgcttgaggaatgtaaagcattggtgcgctgcaatattaagctggaactggagcaggctaatgaaagggaatgtgaggttctcaggaaaatttggagttccgcccagggaatagaatccatgctgaaaatacccttgttagggtacaaggctgcctttccacccaggaagacacagaacgaccagcgctggtgcccctag

SEQ ID NO: 22553 - DNA, 1623 bp, Artificial Sequence
  Description of Artificial Sequence: Synthetic coding sequence
atggccagccaggagtttgaggtggaggccatagtcgataagaggcaggataagaacggcaacactcagtatctggtgcgctggaagggctatgacaagcaggacgacacatgggaaccggagcagcatttgatgaactgcgagaaatgtgttcatgattttaaccgccgtcagactgaaaaacagaaaaaacttacatggactacaacttctagaattttttctaacaatgctcggaggagaacaagtaggagcactaaggctaattatagcaaaaattctcccaagacacccgtgactgataagcaccacagatctaagaacaggaagctttttgccgcttcaaaaaacgttcgccgtaaggccgcatcaatcctgagtgacaccaaaaatatggagatcatcaattcaaccattgaaacacttgcccctgattctcctttcgatcataagaccgtgtcaggttttcaaaagctggagaagcttgaccctatcgcagccgatcaacaagacactgtggtgtttaaagtgaccgaaggaaagttactgagggatccactttctaggcctggcgcagagcagacaggcatccaaaataagactcagatccacccactgatgtctcagatgtctgggagcgtgaccgcatcgatggccactggaagtgctacacggaagggcatcgtggttctgattgaccctctggctgccaatgggaccaccgatatgcacacatcagtgccgagagtcaagggagggcagcggaacattactgacgatagcagggatcagccattcattaagaaaatgcacttcactattaggttgaccgagtcagcttctacatatcgggacatcgtggtcaagaaagaagacggtttcacccagattgtcctgagtacaagaagtaccgagaagaatgccctcaatactgaggtcattaaagagatcgtaaatgcactcaattcagctgccgctgacgacagtaagctcgttcttttctctgcggctgggtcggtcttttgctgcggcctggactttgggtacttcgtaaagcacctgcgcaacaacaggaacaccgcgagccttgaaatggtggacactataaaaaactttgtgaacacattcattcaattcaagaagcccattgttgtgagtgttaatggtccggcaatcggcctgggtgccagcatcctccccctctgtgatttggtgtgggctaatgagaaagcttggttccagactccctacacaactttcgggcagagccccgacgggtgtagctccatcacatttcccaagatgatgggcaaggcgagcgctaacgaaatgttgattgctgggaggaagctcactgccagggaagcctgtgcgaagggactggtgagtcaggtttttttaacaggaactttcacacaggaggtgatgatccagataaaagagcttgccagttacaacccgattgtgctcgaggagtgcaaggccctcgtacggtgtaacatcaagcttgaattggaacaggctaatgaaagagagtgtgaggtactgcggaaaatttggtccagcgctcaaggaattgagtctatgctgaagtatgtggagaataaaattgatgagttctag

SEQ ID NO: 22554 - DNA, 1626 bp, Artificial Sequence
  Description of Artificial Sequence: Synthetic coding sequence
atggcgagtcaggagtttgaagtggaagccattgtggataagcggcaggacaagaacggtaatacacagtacttggttcgttggaaagggtatgacaaacaggacgatacctgggagccagaacaacatttaatgaactgtgaaaagtgtgtgcacgactttaaccgtagacaaaccgaaaagcaaaagaaattgacttggactaccacttcgcgaatattttcaaacaatgccagacggagaacttcaagatccactaaagcgaactactccaagaacagtcctaaaaccccagtaaccgacaagcaccacagaagcaagaattgtaaactcttcgccgcatcaaagaacgttcgccgtaaggccgcttccaccttgtcggacaccaagaacatggagattataaacagcaccatcgaaactctcgcccctgacagcccgttcgaccacaaaaagacagtctctggcttccaaaaactggagaagctcgatccaatcgctgccgaccaacaggacaccgtggtatttaaggtgacagaaggcaagttactgcgggatcctctgtctcatcctggtgccgaacaaactggtatccagaataaaacacagatgcaccctttgatgtcgcagatgtcaggcagcgtgactgcaagcatggccacaggatcggccactagaaaggggatcgtggtgcttattgaccctcttgccgcaaatgggaccaccgatatgcacacgtccgtcccccgtgtgaagggaggacaaaggaacataacagacgattctaggggtcagcctttcataaagaagatgcacttcaccatccgcctgaccgagtcggcgatcacttaccgcgacatcgtcgtcaagaaggaagacggtttcacccaaatagttctgtccactagatcaaccgaaaaaaacgccctcaatacagaggtgatcaaggagatggtcaacgccctgaactcggctgcagcagatgactctaagcttgtgctgttctccgctgccggatccgttttttgttgcggactggatttcggctactttgtgagacacctgaggaacgatcgaaataccgccagtctggagatggtggacacaataaagaacttcgttaataccttcattcaatttaaaaagcctatcgtggtgtccgtgaacggccctgcaatcggactcggcgcttctatcctgcccctgtgtgacctcgtttgggccaacgagaaggcgtggttccaaacaccctatactactttcggccagtctcccgatggttgcagttcaattacatttcctaagatgatggggaaagcaagtgctaatgagatgttaatcgcgggaagaaagcttaccgcacgggaggcctgtgccaagggtctggttagccaggtattcctgactggcaccttcactcaggaggtgatgattcagattaaggaactggcctcctacaacgccattgtgctggaggagtgcaaagcccttgtgcgctgcaatatcaagttagagcttgagcaggctaacgaacgggagtgcgaggtgctccggaagatctggagctcagcacaaggaatcgaatccatgctcaagtatgttgagaataaaatcgatgagttctag

SEQ ID NO: 22555 - DNA, 1668 bp, Artificial Sequence
  Description of Artificial Sequence: Synthetic coding sequence
atggctagccaggagtttgaggtggaagctatcgtcgataagcggcaagacaagaatggaaatacccagtaccttgtccgttggaaagggtatgacaaacaggatgatacttgggaaccggaacagcatttgatgaactgtgagaagtgtgtccatgatttcaaccgacgccagactgaaaagcagaagaaattgacttggactaccacatcaaggatcttttccaataatgcgaggcgccgtacctcccgtagcactaaggccaactatagcaaaaacagcccaaaaacgcccgtaacggacaagcaccaccgctcgaaaaattgcaaactgttcgccgcatctaagaatgttagacggaaagcggcttccaccttgtccgacacaaaaaatatggaaatcataaactccacgattgagacactcgcgccagacagcccttttgatcacaaaaagactgtctccggcttccaaaagctcgaaaaactggatcctatcgccgcagaccagcaggataccgtggtctttaaggtaaccgagggcaaattgctcagggatcctctgtctcacccaggcgctgagcaaacgggtattcaaaacaagacccagatgcaccccctgatgagccagatgtcagggagtgtaactgcttctatggccacaggatcagctacccgcaaggggatagtggtgctcatagatcccttggcagccaacggtaccaccgacatgcacacatctgtaccccgtgttaaggggggtcagagaaacatcaccgacgactcccgtggtcaaccatttattaaaaaaatgcactttactataagattgactgaaagcgctattacctacagggatatcgtagtgaaaaaagaggacggatttacccagattgtcctttccaccaggtctactgagaaaaacgctttgaataccgaggtcattaaagaaatggtaaatgctctcaatagcgccgcagccgatgatagcaaattagtgctcttcagcgctgcaggtagcgtcttttgttgcggtctcgatttcgggtattttgttaggcatttgcgaaatgacaggaacacagcctctctcgaaatggtggacaccatcaaaaatttcgtcaacaccttcatacagttcaaaaaacccatcgtggtctcagtgaacggccctgccattggactaggggcatcaattctgcccctatgcgacctcgtgtgggctaatgagaaggcctggttccagaccccttatacgaccttcggacagtctcctgatggctgctcctctataactttccccaagatgatgggaaaggcgagcgcgaatgagatgctcatcgccggtagaaaattaacagctagggaggcttgtgccaaaggcttggtgtctcaggttttcctgacagggacctttactcaggaggtgatgatccaaataaaggaactagctagttacaatgccatcgtgctggaagaatgcaaggccttagttcgctgcaatataaaactggagcttgaacaggccaacgaaagagagtgtgaggtcctgcggaagatttggtcttcagcacagggcatcgaatctatgctgaagatcccgttgcttggatacaaagcagccttccctccgcgaaaaactcagaacgaccaacggtggtgtccttag

SEQ ID NO: 22556 - DNA, 423 bp, Artificial Sequence
  Description of Artificial Sequence: Synthetic coding sequence
ggtccacccgagcagtcccttctgctgacagaggcttggagttgggcatcgaagaaaaaacagccgcacctgttctcaggagtgatcgttggcggacacttgtggttattgggtttttcccccggtgcaggcggattttgcacaaccctgccgcctagctttttaagggtcgatgatcgtgccacttctagtactaccgatagttcgcgcgcaccctctagtcctagaccaccagggagcaccagtcactgcgggattagtacgagatgcactgagcgctgcctatgcgtcttgccgctacggaccagtcaggtgcccgatgtgatggcccctcagcatgaccaagaacctaaacgacgaatgtattttatctggctcgggtggatcccgtcggataaaccaagccaactaactgagcgatag

SEQ ID NO: 22557 - DNA, 510 bp, Artificial Sequence
  Description of Artificial Sequence: Synthetic coding sequence
cctcctgagcagagtctgttacttactgaagcttggtcttgggcatctaagaaaaaacaacctcatctgttcagtggcgtgatagtggggggacatctttggctgctgggtttcagtcctggagctgggggattctgtaccaccctacccccttcctttctcagggtcgacgacagagcgaccagctcaacaaccgactccagcagagcaccctcatcgcctcggccacctggtagcaccagccactgtggtatctcaactcggtgtaccgagcgctgcctctgcgtgctgccactccgcacaagccaggtcccagacgttatggcgccacagcacgaccaggagaagttccacgatttggcctatagttgtttggggaagagcttctctatgtcaaaccaggacctgtacggctactctaccagttccctcgcactggggctggcatggctgagttgggaaaccaaaaagaaaaacgttctgcacttagtaggcctggattccctgtag

SEQ ID NO: 22558 - DNA, 567 bp, Artificial Sequence
  Description of Artificial Sequence: Synthetic coding sequence
taggcccagcgaggtcctggcaaagccggactgacgggcggtcgggaacgtctcgaacggggtgcgagggccgctcgcacagaccagcaccaaagaattcaggaggaggagagggatctgacgggcagtggggacatttctccgccacagcacccttcacgacatagtttctcacccggagctggcggattttgtactaccctccctccttcgtttctgcgggtggacgatagagccacatcatctaccactgactccagcagggcaccctcatccccacggccaccgggatcaaccagccactgtggtatatcaactcgttgtacagagcggtgcctttgcgtgctgcctctccgcacatcccaggtccccgatgtgatggcccctcagcatgatcaggaaaagtttcatgatctggcctactcttgtctgggaaaatcattttccatgtctaatcaggatctctatgggtactcaacctcaagtctggctctcggcctcgcctggcttagttgggagacaaagaaaaaaaacgtcctccatttggtaggccttgattcgctgtag

SEQ ID NO: 22559 - DNA, 471 bp, Artificial Sequence
  Description of Artificial Sequence: Synthetic coding sequence
atgtttctcaccgaggatctaatcacattcaaccttcggaattttctgctgtttcagctttgggagtcatctttcagtccaggagctggagggttttgtacgacgcttcctccgagttttttacgcgtcgatgatagggctacttccagtacgactgactccagtagggccccaagttctccaaggcctccaggctccactagccactgtggcatttccacaagatgcaccgagagatgcttatgcgtgctgcctctcagaacaagtcaggttcccgacgtaatggctcctcagcacgatcaagaaaaattccacgacttagcctacagttgcctaggtaagagtttctccatgagtaaccaggatctgtatggttattccacgtcctctctggccctgggtctggcgtggctgagctgggaaacgaagaagaaaaacgtcctgcatctagtgggactcgacagtctctag

SEQ ID NO: 22560 - DNA, 201 bp, Artificial Sequence
  Description of Artificial Sequence: Synthetic coding sequence
tgacaaccccagggccctcctgagcagtccttattgctgacagaggcctggtcttgggctagtaagaagaaacagccccacctcttctccggcgtgattgtgggcggtcatctatggttgttgggtccgaaaagaaggatgtactttatatggcttggttggattcccagcgataagccttcacagctgaccgagcggtag

SEQ ID NO: 22561 - DNA, 3615 bp, Artificial Sequence
  Description of Artificial Sequence: Synthetic coding sequence
atgggtgacgcaaaagaggcaggcgctgaagggccaccagctggtgccgctgctcgcggaggactaagcctcctaagccaaggtgagagtgaggagagttctgcacagggaagcgccctgtttttggggggaaatgaggtgaagagccgtgcagtggtcaagtacagctccgcccctccacgaacggctttcgccaggttggaagaaaaaacagacttgaagctacctccggctaattggctgcgggagtctgcgaagttgggcccagctggcactacaatcctgggtaacagcaaaaagtcaaagccgttcagctctttcggaatggcctacgattttatcgactccgtgggaaatgacgtggatgtcgtgtccgacagcgagaacatcaagaagttgcttaaaataccgtactctaagtcacatgtcagcatggctgtgcatcgcatcggcaggacactgctcctggatgagctggatatccaggagctttttatgagaagctcccagaccggagactggacatggctcaaggaattttatcagcgcctcatagaccaaaagtggcagcgcaagaagaaatccaaggagcattggtaccaaaaagccatactgtcaaagtttttatattattctattaatggggacggcgcagcacagcctgttagctcgaccgctgagcagcaagaaagttcctcaagcgatcagaccaacgactccgaaggcgcttcctggcccgctcctttcgaaatgccaagtagtgtatccgaggatcctagcgctagctctcagggcctcaagaacgatttcgtgcgcaatattctctggaccttcgaagacattcacatgctggttggttccaacatgccgattttcgggggtggccgttaccccgcagtctcactgcggctccgggacaataataaacccatcaacgtgctcactgggattgattattggctggataatctgatatgcaacgtcccagagcttgttatgtgctttcacgtgaacggcatcgtccagaagtacgagatgatcaaaactgaggaaatccctaacttagagaattcaaattttagcacaaaggtcattaaagacattgctcaaaatattctcagttttctaaagagcaattgcaccaaagagggtcacacatattggctattcaaagccagcggatctgatattgtgaaactatacgaccttacaactctgtgcgaagagaccgaggataagtatcagaacccattcacaatgcccgttgcaattctgctctacaaggtggcttgcaacatgatgatgaagaaaaaccagaataagaagcactacgggacaattcgcacgctcctactgaactgtctgaagctcctcgataagtcgaggcaccctcagatcatcgcttctgcaaattatatgctcagtgaactgtttcaactggacgaacccaaaaaagaggagaactctgagtctccgctgaatgaaaactccgatgagtcttatagcgaggaggaggaagaaatgcccgattcagatgagaatggaagctattccaccagcagcgatccctccgacgactccaaagcggttgccatcattaaatcagtcggtgaactgagcgtgcccgaaaaatacaagtcaatccatcagatccgcccttcttgtgccttcccagtgtgtcacgacactgaggagcgctgcaggttagttctgagttacgtccttgagggcctaaaatccgtagactcatcaatcaagaaagagtccgatctgccagcagcggatccatccacccctatcccattaaagtatgaagacgagtcctcacgcggtggccctgaggggttagaaaaacagatggccctatttttggataaaatgggctcattgcagaaaggcaattactcaagccagtctggcatgatccccggtagctggcagcataagatgaaactgcagctaatactaaaaagctcaaaagcttactacgtgctcagcgacgcagccatgagcctgcagaagtacggaagggctctgagatatatcaaactggctctgcagagccatgatacgtattgctgcctgtgcacaaacatgctttcagaagtgctgttgtttttgagccagtatctgaccctgtgtggcgatatccagctgatgctggcgcagaatgccaacaatagggcggcacacttggaggagttccactaccagactaaggaggatcaagaaattctgcattccctccacagggaaagttcatgccaaggattcgcatgggctaccgacctgagcacagatctggaatctcagctgagcgtctcatgtaagtgctatgaagctgccaacgagatcctgcagttttctgatttgaagtctcaaaatcccgaacactatgtccaggtccttaaacgcatggggaacattaggaatgaaatcggggtgttctatatgaaccaagccgctgctttgcagagcgagagactggtgtccaagagcgtgtctgccgctgagcagcaactctggaaaaagagcttctcctgcttcgagaaggggattcataactttgagtcaattgaagatgccaccaacgccgcactgttgctgtgtaataccggaagactgatgagaatatgtgcacaggcacattgtggagccggagatgagctgaaaagagagttcagtcctgaggagggcctgtattacaataaggccatcgattattatctcaaggcgctgcggagccttggaactagagatatacatccagcggtgtgggatagcgtgaactgggagctatctacgacgtacttcacaatggctactttgcagcaagactacgctccactgtcccgcaaagcgcaggagcagattgagaaggaggttagcgaagctatgatgaagtccctgaagtattgcgatgtggacagcgtcagcgccagacagccactttgccagtaccgagccgctacaatccatcaccgtctggcaagcatgtatcatagctgcctgaggaatcaggtgggcgatgagcacctgcggaagcagcacagggtactggctgacttacactactccaaggctgcaaagctgtttcagcttctaaaggacgccccatgcgagctgctgcgggtgcagcttgaacgggtcgcatttgccgagtttcagatgactagtcagaattctaacgtgggcaaattaaagacgctttcaggggcactggacatcatggttaggacagaacacgcgttccagctgattcagaaagagctaatcgaggagttcggtcaacccaaaagcggcgatgcagcagcagcagccgacgcatcccctagtttaaaccgtgaagaagtaatgaaactgctgtctatcttcgagagcagactgtcatttctgttgctgcagtcaattaagctgctgtctagtacaaagaagaagacttccaataatatcgaggatgacacaatcctcaaaacgaataaacacatatactctcaactgctgcgagccacggcgaacaaaaccgcaaccctgctggagcgaatcaatgtcatcgttcacctgctgggtcagcttgccgcaggaagcgcagccagttccaatgctgtgcaatag

SEQ ID NO: 22562 - DNA, 3717 bp, Artificial Sequence
  Description of Artificial Sequence: Synthetic coding sequence
atgggagacgccaaggaggctggtgccgagggtccccctgctggggctgctgctcgcggtggtctctcattgctaagccagggtgagtcagaggagtcgagcgcccagggcagtgcgctgtttctgggtggcaacgaggtcaagtcacgcgcagtggttaaatacagctcggctccaccaagaaccgctttcgcacgcctggaagaaaagactgacctcaaactccctccggctaattggctgcgggaatcagctaagctggggccagccggaactacaattttgggaaattccaagaagtccaagcccttctcctcatttgggatggcctacgactttatcgacagcgttgggaacgacgttgacgttgtctcagactccgagaatatcaaaaagctcctgaaaatcccctactctaagagccacgtgagtatggccgtgcacagaattgggcgtactctgctgcttgacgaactggacattcaggaactgttcatgagatcttctcagacgggggactggacttggctgaaagagttttaccaaaggctcatagatcagaagtggcaacggaagaagaaatcaaaggagcactggtaccagaaagctatactgtctaagttcctgtactacagtattaatggagatggggcagcccagcccgtttcatctactgctgagcagcaggaaagcagcagttccgaccagaccaatgattctgagggcgcatcttggccggcaccttttgaaatgccaagctctgtgtccgaggacccatctgcaagctcgcagggtagcgagcctctggaaccttcttacatcgtgggacatgtggcaagtgcaccaaaggaacagaacctgataacacttttcaacgacggagagcactcccagggcttgaagaacgacttcgttcgaaatatactttggacatttgaggacatccacatgctggtcggaagcaatatgccgatttttggaggagggaggtaccctgccgtttcactccgcctgcgcgacaataacaagcccatcaatgtgctgaccggaatcgactactggctggataacctcatctgcaacgtgcctgagttggttatgtgcttccacgtgaacggaatagttcagaaatatgagatgatcaaaacagaagagatcccaaacttagagaacagtaacttcagcactaaggtcatcaaggatatcgctcagaacatcctgagcttcctgaaatccaattgtactaaggaagggcacacttactggctgttcaaagcaagcggaagcgatatagtgaagctctacgacctcactaccctgtgtgaagagaccgaggataagtatcaaaaccccttcacaatgcccgtggccattctactgtataaagttgcctgcaacatgatgatgaagaaaaaccagaacaagaagcattatgggactattagaacactccttctgaattgtctgaaactgctggataagtcacgccatccacaaattattgccagtgcaaattacatgctgagcgagttattccaactggacgaacccaagaaagaggaaaacagcgaatctccactaaacgaaaatagtgatgagtcgtattctgaggaagaagaagagatgcccgattcggatgaaaatgggtcatatagcacatccagcgacccaagtgatgattctaaagccgtcgctattatcaaaagcgtgggggaactgtcagtgcccgagaagtataaaagcattcaccagattaggccctcatgcgcatttcctgtctgtcacgataccgaggaacggtgcaggttggtcctaagctacgtactggagggtctaaagagcgttgactcttccattaaaaaggagtctgatctgccagccgctgatccctcaactcctataccattaaagtatgaggacgaatcatctcgaggcggtccagagggcctggagaagcagatggctctgttcttggacaaaatgggaagcctgcagaagggtaactactccagccagtcgggaatgatccctggcagttggcagcacaagatgaaactacagttaattctgaaaagcagcaaggcgtactacgtcctgagcgacgccgcaatgtctctgcagaagtacggccgagccctgaggtatatcaagttagcattgcaatcccacgacacatactgttgcctttgtacaaatatgctttctgaggtgctacttttcctcagccagtatctgacattgtgtggcgacatacagctgatgttagctcagaacgctaataaccgggctgcccatttggaggaatttcattaccagacgaaggaggatcaggaaattttgcatagcctacacagagagtcctcttgccaaggatttgcttgggccacagatctgtcaacagacctcgaaagccagttatcagtgtcctgtaagtgttatgaagccgcaaatgagatcctccagtttagcgacctgaaatcacagaaccccgagcactacgtccaagtcctaaagaggatgggcaacatccgcaacgagattggggtcttctatatgaaccaggccgctgccctgcagagcgaacgccttgtgtctaagtcggtcagtgcggcagagcagcagctatggaaaaaatcattcagctgctttgaaaaagggatccataatttcgagtcaattgaggacgccacaaatgctgcactgctgctttgtaacacaggaaggctcatgagaatctgcgcccaggcccactgtggcgcaggagacgagttaaaaagggagttttcaccagaagagggcttgtactataataaggcgatcgactactacttgaaggcattacggtctctgggaacacgtgacattcaccccgcagtatgggattccgtgaattgggagctgagtactacctacttcacaatggctaccctccaacaagactacgctcccctgtcccgaaaagcgcaagagcaaatcgagaaggaagtttctgaagcaatgatgaagtccttaaaatactgcgacgtggacagcgtgagcgccagacagccactgtgccagtaccgcgctgctactatccatcatcgactggcaagcatgtatcacagctgcctacgcaaccaggtcggcgacgagcacctgcgtaagcaacatagggtcttagctgacctccattactcaaaagccgctaaactattccagctcctcaaggatgccccatgcgagctgctgagggtgcaattggagagggtggcgttcgccgagttccagatgacgtcccagaattctaatgttggcaaacttaagacgcttagcggggcactcgacatcatggtacgcacagaacacgcattccaattgattcagaaggaactcattgaggagttcgggcagcctaagtctggggatgccgctgccgctgctgacgctagtccttcgctcaatcgggaggaggtgatgaagttactgtctatcttcgagagtcggttaagtttcctcctcctccaatcaattaagctactgtcctctaccaaaaagaaaacaagtaataatattgaagacgatacaatcttgaaaaccaataagcatatctattcacaactgctccgggctaccgctaacaaaactgcaactttactcgagcggatcaacgtaatagtgcaccttctgggccagctagcggcaggttcagctgcttctagcaacgccgttcagtag

SEQ ID NO: 22563 - DNA, 954 bp, Artificial Sequence
  Description of Artificial Sequence: Synthetic coding sequence
tccatccaccaaatacggcctagttgcgcatttcctgtgtgtcacgatactgaggagcgatgtcgtctcgtgctctcatacgtgctagaaggtctgaagtcagtggattctagtattaaaaaggaaagtgacctccccgcagctgaccctagcacacctatcccgctcaaatatgaggacgagagtagcagaggcggacctgaaggtctcgagaagcagatggcactgttccttgacaagatggggtccttgcagaagggaaattactcttctcagtccggtatgattccagggtcctggcaacacaagatgaaattgcaactgattttgaaatcgtcaaaagcctactacgtactgtccgacgccgctatgtcactgcagaagtatggaagggctctcagatacataaagttggccctacagtcccatgacacatactgttgcctttgtactaatatgctcagtgaggtgttgctcttcctaagccagtatcttaccctgtgtggcgacatccaacttatgctcgcacagaacgccaacaaccgagctgcacatctggaggagttccattaccagacaaaagaggaccaagagatcctacattcactgcatcgcgaatccagctgtcagggtgttccgcaggcgtggacaacatggtttacagtgggcctgtgttcgctggcccatgcctatctgtcgatccaaaagcgtggaagaaatatcagggtcctgatctttgcattatatctttttatctactttctgaggcggtcctttgctctggttgcccaggccggtgtgcagtggtgtaatcttggcagcttgaagccccctcctccgggatttaaacagttctcatgcctgtctctgcccagtagctggaattatcgccacgctccaccctgtcctgcttcacctccatggcctcccaaggtgctgggattacaagtgtag

SEQ ID NO: 22564 - DNA, 2391 bp, Artificial Sequence
  Description of Artificial Sequence: Synthetic coding sequence
atgggcgatgctaaagaggctggtgcagaggggcctcctgcaggggcagcggcacgaggcggactgtcactgcttagccagggagagtccgaggaaagctctgcgcagggctccgccttgttcttgggtgggaacgaagtgaaaagcagggctgtcgtgaagtactccagtgcccctccaaggacagcatttgcgaggctcgaggagaaaacagatctgaagctccccccagctaactggctccgggagagcgccaaactgggccctgcgggaacaacaatcctagggaactcaaagaaaagtaaaccctttagtagttttggaatggcctatgacttcatcgattccgtggggaacgacgtcgatgtggtgagcgattctgagaatatcaaaaaattgctgaagatcccttattccaagtcgcacgtttccatggcagtccatcgcatcggccgaaccctactcctggacgaactggacattcaggagttgttcatgcggtcatctcaaactggagactggacatggctaaaggaattctaccaaagacttatcgatcagaagtggcagaggaaaaagaagagcaaggagcattggtaccagaaagctattttgtcgaaattcttgtattacagcatcaacggggatggggctgcgcagccagtatccagcacagctgagcagcaggaatcttctagttctgaccagacaaatgatagcgagggggctagctggccagctccattcgagatgcctagcagcgtgagcgaggaccccagcgcctcctctcaggggtccgagcccctcgaaccttcctacatcgtcggccatgtggcaagtgcaccgaaggaacagaacttaatcacactctttaatgacggtgagcactctcagggactgaaaaatgacttcgttcgtaatatcctgtggacattcgaggatattcatatgctggtcggcagcaacatgcctatttttggtgggggtcgctatcctgctgtctctctgcgcttgagagataataataaaccaatcaacgtgctgaccgggattgattattggttagacaatctaatttgtaatgtacccgagctcgtcatgtgtttccacgttaatggcattgtgcagaagtacgagatgataaagaccgaggaaatacctaacctagagaactctaacttttctactaaggtcattaaggacatcgcacagaatatcctctccttcttgaaatcaaactgtacaaaggagggacacacatactggctgttcaaggctagcggcagcgacatcgtgaagctatacgatctcactacactgtgcgaggagaccgaagataagtatcagaatcctttcacaatgcccgtcgccatcttgctgtataaggtagcctgtaatatgatgatgaagaagaaccaaaataaaaagcactatggcactatcagaactctactgctgaactgtctgaaactgctagataaatctcgacacccccagatcattgccagcgcaaattatatgctgtcagagctgttccagctggacgagcctaaaaaggaggagaactccgagtcccccctgaatgaaaattccgatgagtcctatagtgaggaggaggaagaaatgccggatagcgacgagaatggttcgtactcaacttcctccgacccttcggatgacagcaaggcagtggctattattaaaagcgttggggagctgagtgtgccagagaagtataaatcaattcaccagatccggccatcgtgtgcttttcctgtatgtcacgacactgaggaaaggtgtcggttagttctatcatacgtgctagaaggcttaaagagcgtggacagcagcataaagaaagagtcggatcttcctgcagccgatcccagcactcccattccgctcaagtatgaggacgaatcaagtcgcggaggccctgagggcttagaaaagcagatggccctgtttctcgataagatgggctcccttcagaaaggcaactattctagtcagagtggcatgattcctggctcttggcagcataaaatgaagctccaactaattctgaagagtagcaaggcatactatgtgctcagcgacgcagctatgtctttgcagaagtacggacgcgctctgcgatacattaaactggcccttcagagtcacgatacatactgctgcttgtgcactaacatgctctctgaggtgctactcttcctctcccagtacctgaccttatgtggagatatccaattgatgttagctcagaacgcaaacaacagagccgcacacctggaggagtttcactatcagacgaaggaggatcaggagattctccactctctccacagggagtcctcatgtcaggtttttcgcaagggcgtgtag

SEQ ID NO: 22565 - DNA, 2490 bp, Artificial Sequence
  Description of Artificial Sequence: Synthetic coding sequence
atgggtgatctgaaaagcggctttgaggaggtggacggtgttaggctcggctacctgataataaaggggaagcaaatgttcgcactgagccaggtatttactgacttattgaaaaacattcctcgcacaaccgtacacaaaagaatggaccacttgaaagttaagaaacaccactgcgacttggaggagcttcgaaaactgaaagccattaactccatcgctttccacgcagctaagtgtaccctaatttctagggaggatgtagaagctctgtatacgtcatgtaagaccgagagggttctcaaaacaaaaaggcggagagtgggacgagcactggctactaaggcaccccctccggagcgggctgccgcagcatctccgagacctggcttctggaaagacaagcatcagttatggcgaggtcttagtggggctgctcggccacttcccatctcggcacagtcccagcggccaggggctgccgctgcacgtccagcagctcatttgccacagatctttagcaaatatcctgggagccactatcccgagatcgtacgaagtccttgcaagccaccacttaactacgaaaccgctcctttacagggcaattacgtggccttccccagcgaccccgcatactttcgctcgctcctctgctcgaagcatcctgccgctgccgcagccgcagccgcagctgctgccgctgctgcggcagcaggggctacctgccttgaacgatttcacctggtgaatggattctgtcctccccctcaccaccatcatcaccatcaccaccatcatcatcaccatcaccatcgcgcacagccacctcagcagtcgcaccaccccccacatcatcatcggccacagccgcacttggggagtttcccagagtcctgttcttctgactccgaaagctcatcctattctgaccatgcggcaaatgactcagatttcggcagttccctcagctccagctccaatagtgttagttcagaggaggaggaagaagaaggggaggaggaagaggaggaggaggaagaagaaggcggttccggagcatcagatagctcagaagtctcgagcgaggaggaggatagcagtacggaatccgattccagttccggttcgtcccaagtgtccgtccagtccataagattcaggcggacctccttctgcaagcccccttccgttcaagctcaggcaaactttttgtaccacctcgcctccgctgctgcggctaccaagcccgctgcctttgaagacgccggacgactacctgacctgaagtctagcgtgaaggccgaatcccctgcggagtggaatctacagagctgggcacccaaggcctcaccggtatactgtccggcttccctgggaagctgcttcgctgaaatccggaatgatcgggtgtccgaaataacatttccccactctgagatttccaatgcagttaagagaacagatctcacaataaattgtctggctgaaggcgcttctagcccctcccccaaaacaaataatgctttcccacagcagcgcatcttaagggaggctcgaaagtgtttgcagacaacccctacaacccattgcgccgacaataatactatagccgctagatttctgaacaacgactctagcggcgctgaggcaaattccgaaaagtattctaaaatccttcactgtccggagttcgccacagacctcccctcgtctcagactgaccctgaggtgaatgctgcgggagccgcagcaacaaaggccgagaacccctgtactgacacaggcgacaaaacactgccctttctccacaacataaagatcaaggttgaggatagctccgccaatgaggagtatgaacctcacctgttcaccaataaactgaaatgcgagtgtaacgacaccaagggagagttttactccgttaccgagagcaaggaagaggatgcattgttgaccaccgctaaggaaggatttgcctgtcctgagaaggagacaccctccctgaatccccttgcgcagagccaggggctgtcatgcactttgggatcgccaaagcccgaggatggcgagtacaagttcggggctagagttcggaagaactacaggactttagtcctgggaaagagacctgtcctgcagactccacctgtcaaacccaatctcaagtcagccaggtcccccagacccaccggaaaaacggagacaaacgaaggcaccctagacgattttacagtcatcaaccgcaggaagaaagtcgcatctaacgtggcctcagctgttaagagacccttccacttcatggcgaactttccatgcccaccaagtctgatcatagggcgtgatggcgacctgtggccagcctacagcctgaacaccacaaaggatagccagactcctcacaaggcgcaccctatctggaagtggcagcttggtggatccgctatcccattgccacccagccacaaatttagaaaattcaattcgtag

SEQ ID NO: 22566 - DNA, 2727 bp, Artificial Sequence
  Description of Artificial Sequence: Synthetic coding sequence
atgggagacctgaaatctggcttcgaggaggtggatggagtaagattagggtatttaattattaaggggaagcaaatgttcgccctctcccaggtcttcaccgacttgttaaaaaacatcccaagaacaaccgtccacaagcgcatggaccaccttaaggtgaagaagcatcattgtgatttggaagaactccgcaaattgaaggctatcaactcaattgccttccatgcggctaaatgcacattaatatctagggaggatgtagaagcgctctacacttcatgtaaaactgaaagagtacttaaaacaaaacgcagaagagtcggcagagccctagcgactaaagccccaccacccgaaagggccgctgccgcatctccaagacctggcttttggaaggacaagcaccagctgtggcgtggcttatctggggcagctagaccacttccaatttccgcccagagccagcggccaggcgcagctgctgctcgccctgctgcccacttgccccagattttcagtaagtatcctgggagtcactatccagaaattgttagaagtccctgcaagccccctctgaattacgaaacggcccctctgcagggtaactatgtggccttcccatcagacccagcttatttcagatcgctattatgtagcaaacaccctgccgctgccgcagcggctgcagcagccgctgccgcagctgcggctgctgccgctgccgctgcctattaccaggtttccgccgcaggacctcaacctaaagccgcagctggcgcaggtggtccgggttcccttagctacaggtgtaagcgaaaacgtggaggcgcaaaagattgcctgcttgccccacacgctggcgctcggaggcttctgctactcccgaggtcctacaaggccaaagccgctgcagcagccgcagccgctgcagccgctgcagccgctgcagcaggagccacctgcctggagcgctttcatctcgtcaatggtttttgtccaccccctcaccaccatcaccaccaccatcaccaccaccaccatcaccatcacagggcccagccaccccagcaaagccatcatccaccccaccaccataggccacagccgcatctcggcagtttccccgaatcatgtagttccgattcagaaagctccagctatagcgaccatgctgctaatgacagtgacttcggcagtagtctgtcttccagcagcaactccgtgagcagtgaagaggaagaggaggagggagaggaggaggaagaggaagaagaagaagagggtggatctggggcaagtgatagtagcgaggtcagctcagaagaagaagacagctccactgagtccgacagcagttccggcagctcccaggtcagcgtgcaaagcatccgtttcaggcggacatccttctgcaaaccaccctcagtccaggctcaggctaattttctttatcatctcgcttctgcggctgcggcaacaaagccagctgcctttgaagacgctggaagactgcccgaccttaaaagtagtgtgaaggctgagtcccctgcagagtggaacctgcagagctgggccccaaaagctagtcccgtgtactgccctgcttctctcggctcctgcttcgcggagatccgtaacgatcgcgtttcagaaatcacatttccacacagcgagatttccaacgctgtgaaaaggacggatctaacaatcaactgtctcgcagagggggcttcaagtcccagccctaagactaacaatgcttttccgcagcagagaatcctgagggaggccaggaagtgcctccaaacgacgcccacaacccactgtgccgacaataacaccattgccgcaaggtttctcaacaatgattcaagcggggcagaggctaacagcgagaagtatagtaagatcctgcattgtccagaatttgctacggatttacccagcagccagaccgacccagaagtaaacgctgcaggagcagccgctaccaaggccgagaacccctgtaccgacacaggtgataagacactacctttcctgcataatatcaagatcaaggtggaagatagcagcgcaaacgaggagtatgaaccacacctgttcacaaacaaattgaagtgtgaatgtaatgataccaagggcgaattctatagtgtaactgaaagcaaggaagaggatgccctgctgaccactgcaaaagagggctttgcgtgccccgaaaaggagactccctccttgaacccattagcgcagtcgcagggtttaagctgcactttagggtctcctaagccagaggacggggagtacaagttcggggcaagagtgaggaagaactatagaacgctggtattagggaaacggcctgtgctccagactccacccgtgaaaccaaacttaaaatcagccagaagcccccgtccaacagggaagactgagactaacgagggaacactcgacgacttcacagttatcaaccgacggaagaaggtcgcttcaaatgtggcttcagcagtgaaaagacctttccactttatggcaaacttcccttgtccgccaagtctcataatcggtagagatggggacctctggccggcttattccctgaacaccacgaaggattctcagacccctcacaaagcacacccgatttggaagtggcagctgggaggatctgctatcccacttccgcctagccataaatttcggaagtttaacagctag

SEQ ID NO: 22567 - DNA, 453 bp, Artificial Sequence
  Description of Artificial Sequence: Synthetic coding sequence
atggccgcatcccagtgcctgtgttgtagcaaatttcttttccagcgacaaaacctggcgtgcttcttgaccaatcctcactgtgggtctctggtgaacgccgacggccacggcgaggtgtggactgattggaataatatgtcaaagtttttccagtacggctggcggtgcactactaatgagaatacatactcaaaccgcactctcatgggtaattggaaccaggaacggtacgacctgagaaacattgtgcaacctaagcccctgccatctcagttcggtcactactttgaaacaacttacgatacaagttacaataataagatgccactctctacccacagattcaagcgcgagcctcattggtttccaggccaccagcctgagctggatccccctcggtacaaatgcacagaaaaaagcacctacatgaacagctactccaaaccatag

SEQ ID NO: 22568 - DNA, 948 bp, Artificial Sequence
  Description of Artificial Sequence: Synthetic coding sequence
atggcctgtgcagaattttcttttcacgtgccatccttggaggaattggccggagtcatgcagaaggggctgaaagataactttgccgacgtgcaagttagcgttgtcgattgtccggacttgaccaaagaaccctttacatttccggtcaagggcatctgcggcaagaccaggatagccgaggtgggtggagttccttacctactgcctctggtcaatcaaaagaaggtttacgacttgaacaaaatcgccaaggaaatcaaactgcccggagcatttattctgggagcgggagccggacctttccagacattgggatttaactcggagtttatgccagtcatccaaacagagagcgaacacaagccaccagttaatggaagctactttgcccatgtcaatccagcagatgggggttgtcttctagagaagtactctgaaaagtgtcatgacttccagtgtgcgctgctcgcaaatcttttcgccagtgaggggcaacctggaaaagtgatcgaagtaaaagctaagcgcagaaccggccctttaaactttgtgacttgtatgagggaaacactcgagaaacactacggaaataagcccattggtatgggcggtactttcatcattcaaaaggggaaagtgaaaagccacatcatgccggcagagttttcgagttgccctctgaattctgatgaggaggtaaataaatggctgcacttttatgagatgaaagcgcctctagtctgcctgcccgtgttcgtttccagggatcccggtttcgacctgaggctcgagcatacgcatttcttttctaggcacggcgaaggcggtcactaccactatgacaccactcccgacatcgtggagtacctcggctatttcctacctgcagagttcttgtaccggatcgatcagccaaaggagacacattctatcggccgtgactag

SEQ ID NO: 22569 - DNA, 948 bp, Artificial Sequence
  Description of Artificial Sequence: Synthetic coding sequence
atggcttgtgcagagttcagtttccacgtgccctcactggaggagctggccggtgtcatgcaaaagggcctcaaagacaatttcgcagacgtccaggtgtccgtggtcgactgtcctgatctgacgaaagagcccttcacatttcctgtgaaaggaatctgtggtaaaaccaggatagccgaggtgggcggtgtgccttatctactgcctctggtgaatcagaaaaaagtctacgacctgaataaaatcgcgaaagagattaaactgccaggagcatttattcttggggcaggggctggacctttccagacgttaggttttaactcagaattcatgccggtgattcagacagagtcagaacacaagccgccagtgaacggaagctatttcgcccatgttaacccagctgatgggggatgccttcttgaaaaatatagcgaaaaatgccacgatttccagtgtgctctcctcgccaacctgttcgcttctgagggccagccaggcaaagtgatcgaggtaaaggccaaacgtcgtacaggccctctcaattttgtgacatgtatgagggagacgctcgagaagcactacggcaacaaaccgataggtatgggaggaacattcatcattcaaaagggtaaggttaaaagccatatcatgcccgcagaattctcctcgtgccccctgaatagtgacgaggaagtgaacaagtggttgcacttttacgagatgaaggccccattagtttgcctgcccgtattcgttagcagagaccctggctttgacctgcggctggagcacacccacttcttcagccggcacggggaggggggacattatcactatgacacaactcctgatattgtggagtacctcgggtactttctccccgcagaatttctgtataggatcgaccagccgaaggagacacactccattgggagggactag

SEQ ID NO: 22570 - DNA, 891 bp, Artificial Sequence
  Description of Artificial Sequence: Synthetic coding sequence
atgcaaaaaggcctgaaggataatttcgccgatgtgcaggtgtcagtggtggattgtcccgatctcaccaaggaaccctttacatttccagtgaagggcatttgcggaaagacacgaattgcagaggtggggggtgtaccgtacctgttacctctggtgaaccagaagaaagtgtacgatctgaacaagattgccaaagaaataaagctgcctggcgcattcatactaggcgctggtgccggaccattccaaacgctgggctttaactctgaattcatgcctgtaattcagaccgaaagcgagcataagccacctgttaacggctcttatttcgcccatgttaacccagcggacggtgggtgcctgctggagaagtacagtgagaagtgccatgactttcaatgtgccctgctcgcgaatctttttgccagtgagggtcagcccggtaaagttatcgaggttaaggccaagcgtcggacgggccctctcaacttcgtgacctgtatgagggaaactctggagaagcattatggcaacaagccaatcggtatggggggaaccttcatcatccagaagggtaaagtgaagtcacacatcatgccagcagagttcagctcctgtccactgaactcggatgaggaggtgaataaatggctccacttttatgaaatgaaggccccactggtctgcctacctgtattcgtttcacgcgacccaggattcgatctgcgcctggaacacacacactttttttccaggcatggtgaaggtgggcactatcattacgatacaactcccgacatcgtggagtacctaggctacttcctccctgctgaattcctctaccgaattgaccaacctaaggagacccacagcattggacgtgattag

SEQ ID NO: 22571 - DNA, 450 bp, Artificial Sequence
  Description of Artificial Sequence: Synthetic coding sequence
atggcctgcgccgaattttcttttcacgtgccaagcctggaagagctagcaggtgtgatgcaaaagggccttaaagacaatttcgcagatgtgcaagtttcagtagtggattgtcccgatctgactaaggagcccttcacgtttcccgtgaagggcatttgtgggaagacccgcattgccgaagtgggtggtgttccctatttgttaccactggtgaatcaaaagaaagtctacgacctgaacaagatcgctaaagagataaaactacctggggcattcatcctgggagctggggctggcccatttcagaccctgggatttaactctgagtttatgcccgtcatccagaccgagagcgaacataagccccctgtcaacgggagctactttgcacatgtgaatccagccgatggaggttgtctgctggaaaagtattccgagaaatgttag

SEQ ID NO: 22572 - DNA, 234 bp, Artificial Sequence
  Description of Artificial Sequence: Synthetic coding sequence
atggcctgcgccgagttctcttttcatgtaccatcgctggaggaactggccggagtgatgcaaaaaggactgaaggacaattttgccgatgtacaggtctctgtagttgattgccccgacttaactaaagagcccttcacattcccggttaagggaatctgcggaaagactaggatcgctgaagtagggggtgtaccttatttgcttcctctcgttaatcaaaaaaaggtctag

SEQ ID NO: 22573 - DNA, 516 bp, Artificial Sequence
  Description of Artificial Sequence: Synthetic coding sequence
atggcttgtgccgagttctcttttcacgtcccgagcctagaggagctagcaggagtcatgcagaagggactgaaagataacttcgcagatgtacaggtgtccgtcgtcgattgcccagatttgacaaaggagcccttcacctttccagttaaaggaatctgtggcaaaacacgtatcgcggaagttggtggcgtgccgtatctgctgccccttgtcaaccagaagaaggtctacgacttaaacaaaatcgcaaaggagatcaagttgcccggtgccttcatactgggcgctggagcaggacccttccaaacgctgggatttaacagtgaatttatgccggtcatccagaccgagagtgagcataaacccccagtgaatgggtcttattttgcccatgtgaacccagcagacggcggatgcctcttggagaaatatagcgaaaagtgtcacgactttcagtgtgccctactagccaacctgtttgctagtgagggacagccaggcaaagtgatttag

SEQ ID NO: 22574 - DNA, 948 bp, Artificial Sequence
  Description of Artificial Sequence: Synthetic coding sequence
atggcctgtgcagaatttagctttcacgttcccagcctggaagaacttgcaggggtcatgcagaaaggactgaaggataattttgcggatgttcaggtgtccgttgtcgactgccctgatctaacaaaagagccattcacatttccagttaaggggatttgcggcaaaactagaattgctgaggtgggcggagtgccataccttctgcctctcgtgaatcagaaaaaggtctatgatctcaacaaaattgctaaggagatcaaactgccgggagctttcatcctgggcgctggcgcagggccattccagacactcgggttcaatagcgagttcatgccggtcatacagacggagagtgaacataagccaccggttaacgggagttactttgctcacgtaaacccagccgacggcggttgtctgctggaaaaatattccgaaaaatgtcatgacttccagtgcgcactgctggctaatcttttcgcatcagaaggccagcctggaaaggtcatcgaggtcaaggcaaaaagacggacagggccacttaatttcgtgacatgtatgcgggagacactggaaaagcattacggcaataagccaattggcatgggcggaactttcatcattcagaaaggaaaggtaaaaagccatattatgcctgccgagttttcaagttgtccactgaactccgatgaggaagtaaataagtggctccatttctatgagatgaaggccccactggtgtgcctcccagtctttgtaagtagagaccctggatttgacctccggctggagcatacccatttcttttcacggcatggcgagggcggtcactatcactacgacaccactcctgacattgtggagtaccttggctatttcctaccggcagagttcctttaccggatcgaccagcctaaagaaacacactccatcgggcgtgattag

SEQ ID NO: 22575 - DNA, 798 bp, Artificial Sequence
  Description of Artificial Sequence: Synthetic coding sequence
atggcgtgcgcagagtttagtttccatgtccctagcctggaagagctggccggtgttatgcaaaaggggctgaaggacaattttgccgacgtgcaggtgtctgtcgttgattgtccagacctaacaaaggaacccttcacatttcccgtgaagggtatttgtggtaaaactcggatcgcagaagtcggtggagtcccatatctgctaccactggttaaccagaagaaggtctacgatctcaacaagatcgccaaagaaattaagctccctggagcgttcattctgggagctggagcgggtccctttcagactctcggattcaacagcgaatttatgccagtgattcaaaccgaaagcgagcacaagcctcccgtgaatggcagctatttcgcccacgtcaatccagccgacggtgggtgcttattggaaaaatattctgagaagtgccacgatttccagtgtgctttactggcaaacctgtttgccagcgagggccagcctggaaaacccgcagagttctcttcctgtcccctgaactctgatgaagaagtcaataaatggctgcacttctatgagatgaaggccccattagtctgccttcccgtattcgtaagccgcgatcccggttttgatttgagactggagcatacacactttttttccagacacggcgagggaggtcattatcattacgacaccaccccagatattgttgagtatcttggatatttcttgccggcagagtttttatatcgtatagatcagcccaaagagacccactctatcggaagagactag

SEQ ID NO: 22576 - DNA, 291 bp, Artificial Sequence
  Description of Artificial Sequence: Synthetic coding sequence
atggcctgcgccgagttttccttccacgttccttcattggaggagctcgcgggagtgatgcagaaggggttgaaggacaacttcgcagatgttcaggtgagcgtggtcgattgccctgatttgacaaaagaaccatttacgtttcccgtcaaaggaatttgtggcaagacaaggatcgccgaggtaggcggtgttccgtatcttctccctctggtcaatcaaaaaaaagtttacgacctgaacaaaatcgctaaagaaattaagttacctggagcgtttatattgggctag

SEQ ID NO: 22577 - DNA, 720 bp, Artificial Sequence
  Description of Artificial Sequence: Synthetic coding sequence
atgcagaaaggtttgaaagataattttgcagacgtgcaggtatccgtggtggactgccctgatctaacaaaggagcctttcacatttccggttaagggtatttgcggcaagactaggatcgccgaagtcggtggggtgccatacctcctgcccctcgtgaatcagaagaaggtatatgaccttaacaaaatagctaaggaaatcaaactgcctggggcattcatactgggggctggcgcaggtcccttccaaactctagggttcaactccgaatttatgccagttattcaaactgaatctgagcacaagcctcccgtcaacggctcttatttcgcacacgtcaacccggcagacggaggatgtttgctagaaaagtacagcgaaaagtgccatgatttccaatgtgccttgttggccaatctcttcgcttccgagggacagcctggaaaggtgatcgaagtcaaggctaaacgcagaaccggcccactaaatttcgtgacatgtatgagagagactcttgagaagcattacggtaataagccaattggtatgggaggaacattcatcatccagaaaggcaaggtgaaaagtcatatcatgcctgctgagttctcaagctgtcccctgaatagtgacgaagaggtgaataaatggcttcacttctacgaaatgaaagccccactcgtctgtctacccgtcttcgtaagccgcgatccatag

SEQ ID NO: 22578 - DNA, 303 bp, Artificial Sequence
  Description of Artificial Sequence: Synthetic coding sequence
atggcatgcgccgagttcagctttcatgttccaagtctcgaggagcttgccggtgtcatgcagaagggactcaaagataacttcgccgatgtgcaggtttcagttgtagattgccccgatctcactaaagagccatttacgttcccggtgaagggcatctgcggtaagactcggatcgccgaagtggggggtgttccctatcttctgccactcgtaaaccagaaaaaggtctacgacctcaacaaaatcgctaaagaaattaagcttccaggtgctttcatcctgggcgctggcgcaggatag

SEQ ID NO: 22579 - DNA, 891 bp, Artificial Sequence
  Description of Artificial Sequence: Synthetic coding sequence
atgcagaaaggactaaaagacaacttcgcagacgtacaagtctccgtcgtagactgtcctgacctgaccaaggaaccgttcacattccctgtgaagggaatctgcggaaaaactcggatcgccgaggtagggggagtgccttacttgctgccgctggtcaatcagaaaaaagtgtatgacttgaacaagatcgccaaggagataaaactacccggtgcatttattttgggtgctggcgctggaccatttcaaactttgggcttcaactctgagtttatgccggttatccagaccgaatctgagcacaagcctccggtgaacggctcctatttcgcccacgtcaatcccgcagatggaggttgcttgcttgaaaaatacagcgagaagtgtcacgactttcaatgcgcactgctcgccaacctcttcgcaagtgaagggcaacctggcaaggtgattgaggtgaaggccaagagaaggactggcccactaaactttgtgacatgtatgcgcgagacattggaaaagcactatggcaacaagccaatcggaatgggcggaacattcatcattcagaaggggaaagtaaagtcacacatcatgcccgctgagttttcaagctgtccacttaactccgatgaggaggttaacaagtggctccacttttatgaaatgaaggcacccctggtctgtctgcccgtgttcgtcagcagggacccgggttttgatctcaggctcgagcatacccactttttcagccggcatggagagggaggacattatcactatgacactactcccgacatcgtggaatatctggggtatttcctgcctgccgagtttctgtaccggattgatcaaccaaaggaaactcacagcatcgggcgtgactag

SEQ ID NO: 22580 - DNA, 1221 bp, Artificial Sequence
  Description of Artificial Sequence: Synthetic coding sequence
atgacgcagacgttggatacacgagaggaccccctgaaccttggaggcggtggcggaggcggatgtgggtgcggctgggcgcactctgcaagcctgagttcctggagtagctgccaccgacgcagaccgggtgctccggcatacaacaggccccacaggtattcccctaagacggaatatggccctccgaggaaacaacctaaacagcagcatggcccaggtttttggtttcagccgccagtgtgttccaactgggggtgttggggcggtccttggcggccacctccccctggtttctggaagtttccctgtcctgtccaggtattccgtgtctatggcttgcatcccttgtgcttctgctgttgttcttgttggtcggggtcctggaatcccggatgggttaaacctcctggtcgaaaaaagcgttggggcaggagaggccgaggtctacggcatcatccacggcactcttatccaagatctccacctgctgatgtgagtaccctcccaaggcctgtgaaactgtacgagtggagggaacccggaatgcgcgcaccccctaacacaactcagtttataatgaaccagatttacgaggacatgcggcagcaggagaaggtcgaaagacagcaggaggctcttcgtgcccaaaaggcaaccgtcagcggcgaagcctctcctgcgcgttcttcagggaatgatgcgccaccgggtggtagcaaggagacctgggggcttcaggagaccctttatggcttcgtgcagaatccaagcctggccttttctccaaaccccgaggaaaatcagtctctggcaccactcctggtggaggaagaggaggagaaaaaaaacgacgatgaggaagagtacgatcaggaggtgtgtgatgccaaagaggcgtccgaggaggaggaagaagtcgaagacgaggaagaggaggtcgaagacgaggaggaggaggaggttgaggaggcagagtatgtggaagaaggagaagaagagcttgaggaagaggagctggaggaggaagaggaagttctggaggagaacgaacagaggggcgaggaatttcacctccctttagaaatgcccctgagtatctttgtcgaagcggaggagaaacgggagaatttcatttcctgtacctttctgaaccccgaacagataatcccgaaggtgccccaggagtccctatttatggctcaggatttcaactgttag

SEQ ID NO: 22581 - DNA, 195 bp, Artificial Sequence
  Description of Artificial Sequence: Synthetic coding sequence
atgcctcctaggaaaaagagaaggcaaccctctcagaaagcgcctttactcttccatcagcagccgcttgagggccctaagcatagttgcgccagtactcaacttccgatcacacacaccaggcaggtcccatccaagccaatcgaccatagcacaatcactagctgggtatcgcccgacttcgatacagcttag

SEQ ID NO: 22582 - DNA, 717 bp, Artificial Sequence
  Description of Artificial Sequence: Synthetic coding sequence
atgccacctcggaaaaagaggcggcagcccagccagaaagccccattgttatttcaccaacagcctctggagggcccaaagcactcctgtgcaagtacacagttgcctattacccatactcgccaggtcccttccaagcccattgatcacagtacaatcaccagttgggtgtcccccgattttgatacggccgctgggtcactcttcccagcctaccagaaacatcagaaccgggctcggcattcttcccggaagcctacaacatctaagtttccgcatctgacattcgaatcaccacagtcaagcagtagtgagactctgggcattcctttgatccgggaatgcccaagtgagtcagagaaggatgtcagcaggaggcccctggtgccagtgctgtcgccgcagtcatgcggaaacatgtcagtccaggcgctgcagtccctcccttatgtgttcatcccccctgacattcagacgcccgagtcttcatcagttaaagaggagttaatccctcaggatcaaaaagagaactcgctcctcagttgcaccctgcacacagggacacctaattccccggaaccaggccctgtcctggtgaaggatacaccagaggataagtacgggatcaaggtgacgtggcggaggcggcagcacctgttggcctacctcagagagcgtgggaaattgtcgcgctctcaattcctagtaaaaagctag

SEQ ID NO: 22583 - DNA, 399 bp, Artificial Sequence
  Description of Artificial Sequence: Synthetic coding sequence
atgccacctcggaagaagcgccgtcaaccatcacagaaagccccactcctgttccaccaacaacccttagagggacccaagcactcgtgcgcatccactcagctgccaattacacatacgcgtcaagttccctccaagccgatcgatcactccactattacttcttgggtctctcccgactttgacacggctgctggctcactgtttccagcctatcagaaacaccagaaccgggcaagacacagctctagaaagccaaccacttctaaattccctcatctcacgttcgaatctcctcaaagttcctcgtcagagaccctggggatccctctcatccgggaatgccctagcgagtctgagaaagacgtgtcacgccgtccattagttccggtgctttag

SEQ ID NO: 22584 - DNA, 318 bp, Artificial Sequence
  Description of Artificial Sequence: Synthetic coding sequence
atgcccccaaggaaaaagaggcggcagccttcacagaaggctcccctgttatttcaccaacaaccactggagggccctaaacattcatgcgcatcgactcagctgccaattactcacaccaggcaggtaccttccaagcctatcgatcactccacgattacttcctgggtgtctccggatttcgacaccgctgccggtagcctgttccccgcttatcagaagcaccagaacagggctagacacagttcccggaagcctacaaccagcaagttcccacacctgaccttcgagagcccccagtcttcctcatctgaatag

SEQ ID NO: 22585 - DNA, 3138 bp, Artificial Sequence
  Description of Artificial Sequence: Synthetic coding sequence
atgaaccttcaggcacagcctaaagcccagaacaaaagaaagaggtgtctgttcgggggacaggaaccagccccaaaggagcagcctcctcctttgcagccccctcagcaaagcataagagtcaaagaggagcagtatctggggcatgaaggtcccggaggcgcagtgagtacaagccaacctgtagaacttccgcctcctagttcgctggccttactaaatagtgtggtgtacggaccagaacggacctctgccgcaatgctctctcaacaagttgcgagtgtcaagtggcctaactctgtaatggctccagggcgaggcccagaacgcggaggcggtggcggtgtttctgatagctcctggcagcagcagcccggtcagccgcctccccattcaacatggaactgccacagtctctcgctctactcagcaactaagggtagtccacatccaggagtgggcgtgcctacgtactataaccacccagaagccctgaaacgggagaaggcagggggtccccagctggaccggtacgtcagacccatgatgcctcagaaagttcagctagaggtagggcgtccacaggctccactgaactcgtttcacgctgcaaaaaagcctcctaatcagtcgctacctcttcagccctttcagctagccttcgggcatcaggtcaatcgacaggtcttcaggcagggaccgccaccccctaacccagtagccgcatttcccccacaaaagcaacagcagcagcagcagccacagcagcaacagcagcaacagcaggctgctctgcctcaaatgccactttttgagaatttctactccatgccacaacagccctcccagcagccgcaagacttcgggctgcagcccgcaggcccattaggccagtctcacttggctcaccacagtatggccccttatccctttcctcctaaccccgatatgaacccggagctgcgtaaggctctcctgcaagactccgcaccccagccagccttaccacaagtgcagattccatttccaaggagaagcaggcgcctttccaaagagggaatactgcctccctcagccctggacggagccggaacccagcctggtcaagaggcgactggcaacctctttctgcaccattggcccttgcagcagcctccgcctggctctttaggtcagcctcaccctgaggcattgggtttcccgctggagctccgagagtcccaattgcttcctgatggtgaacgactggccccaaatggacgggagagagaggcccctgcgatgggaagcgaagagggcatgagagccgtaagcactggtgattgtggccaggtacttcgcggtggtgtcatccagtccacaaggcggaggcgaagggcgtctcaggaagctaacctgctgaccctggctcagaaggcagtggaattggccagtttgcaaaacgccaaggatggatccggttcggaagaaaaacgcaaatctgtgctggctagtactacaaagtgcggcgtggagttctccgagccctcactcgccacgaagcgagcccgtgaggattccgggatggtgcctcttatcatcccagtatctgtgcccgtcaggacagtggacccgactgaggccgcacaggctggaggtctggacgaagacggaaaaggccctgaacagaaccccgcagaacataagcccagcgtgattgtgacccgaagaaggtccactcggatccccggaactgacgcacaggcacaggccgaggacatgaacgtgaagctggagggagaacctagcgtacgcaaacctaagcagcgacccaggcccgaacctttaatcatccccacaaaggcgggtactttcatcgccccacctgtctattccaacatcaccccctatcaatcccatttgcgttctccagtcaggctcgccgatcacccctccgaacggagctttgagttgcctccctacaccccacctccaatactatctcctgtgagagaggggtccggcctctatttcaacgccattatctcaacctccacaattccagcccctccacctattactccaaagagtgcccatagaacgttgttgaggacaaattcggccgaggtgactccacccgtgttgagcgttatgggtgaggccacccccgtgagcatcgagcctcggattaacgtcgggtcgcgttttcaggcagaaattcctctgatgcgggaccgcgcactggccgctgccgacccccacaaggctgacctggtttggcagccgtgggaagatctggaatcctcccgggaaaaacaaagacaggttgaggatctacttaccgccgcttgttcctccatcttcccaggggcaggcactaatcaagagctggccctccattgcctgcatgagagcaggggcgatattctggaaacactcaataagctcctgctcaaaaagccactgaggccacacaatcatcccttggcaacttaccactatacagggagcgatcaatggaaaatggcagagagaaaattgtttaataaaggcattgcaatttacaagaaggattttttcctcgtgcagaagctcattcaaacaaagaccgtagcccagtgcgtcgaattctactatacttacaagaaacaagttaagattgggaggaatggaacactgacgtttggtgacgtggacaccagtgatgaaaaaagcgctcaagaggaagttgaggtggatatcaagacgagccagaaattccccagagtgccccttcccaggagggaatccccctccgaggagagattggagcccaagcgcgaggtgaaagaaccccgaaaagaaggggaggaggaagttccggaaatccaggagaaagaggagcaggaggagggcagagagaggtctcgacgggcagcagctgtcaaagcaacccagacgctgcaagcaaatgagtcagctagcgacatcctgatactgcgcagtcacgaaagcaacgcaccaggaagtgccggtggccaggcttcagaaaagccaagggagggtacgggaaagtctagaagagccctcccattcagcgagaaaaagaaaaaaactgagactttttccaaaacacagaatcaggagaacacctttccttgcaagaaatgtggtcgctag

SEQ ID NO: 22586 - DNA, 3138 bp, Artificial Sequence
  Description of Artificial Sequence: Synthetic coding sequence
atgaacctgcaagcgcagccaaaagcacagaacaagaggaagcgctgtctgttcggagggcaggagcctgcacccaaagaacaaccacccccactccagcctcctcaacagtccatccgtgtgaaagaggaacagtacctaggtcacgagggcccaggaggtgccgtgtccacctctcagccggtcgagttaccgcctccctcatctctcgcactacttaatagcgtggtttacgggcctgaacgaacaagtgccgctatgctgtctcagcaggtggctagcgtgaagtggccaaattcggttatggcccctggacgtggtcctgagcgtggtggaggaggcggtgtaagcgatagctcttggcagcagcagccgggtcagccaccgccacacagtacttggaattgccattctttaagtctatactcggccacgaaagggtcccctcaccccggagtaggagtgccaacttattacaaccacccagaggcgctgaagagggagaaagcagggggaccccagctggatcggtacgtacggcctatgatgcctcagaaagtgcagctcgaagttggtagaccacaggctccgctcaactcgtttcatgcagccaagaagccgccaaaccagagtctgccccttcaacccttccaacttgcttttggtcaccaggttaatcggcaggtgtttcggcaaggacctcccccacccaatcctgtcgcggcatttcccccacagaagcagcagcagcagcagcagccacaacagcagcagcagcagcaacaggctgccctgccacagatgcctctgttcgaaaatttttacagcatgccccagcagccctcccaacagccccaggatttcggtctacaaccggcaggaccactcggccagagccacctcgctcaccactccatggctccttatcctttcccccctaatcccgacatgaatcctgagctgcgcaaagcactgcttcaagatagcgcaccacaacctgctcttccccaggtgcaaatcccttttcccaggaggagtcgccgactgtccaaggaggggatcctgccaccctcagcactggacggagcgggaacacaaccagggcaggaagcgacggggaacctcttcttgcatcattggccgttgcagcaaccaccgccaggctcccttggacaaccccaccccgaagccctggggttcccccttgaactccgggagtctcagctgctccctgatggggagcgcctggcccctaatggtcgggaaagagaagcacctgcgatggggagtgaggaggggatgcgagccgtgtctactggtgactgcgggcaggtcctgagaggcggagttattcaaagcactaggagacggagaagagcctcgcaggaagccaacctgttgacccttgcccagaaagcagttgagctggcttccctgcaaaacgcaaaggatggttctggctccgaagagaaacggaaatccgtgctggcttcaacgacaaaatgtggtgtggaatttagcgagccatccctggccaccaagagggccagagaggacagcggcatggtgcctctcataattcctgtgtcggttccagtaaggaccgtggatcctactgaagcggctcaagctggcggactagacgaagacggcaagggacccgagcagaacccagccgagcacaagcctagcgtaattgtgaccagacggaggtctactcgcatacccggaacagatgcacaagctcaagccgaggatatgaatgtgaaacttgagggagagccctccgttcggaaacctaaacagcggccaagaccagagccattgattattcccaccaaagccggtaccttcattgccccacctgtctactcaaacatcaccccctaccagagtcacctccgcagtcctgtgcgccttgccgaccacccgtccgagagatcttttgaactgcctccatatacaccacccccaattctctcccctgtccgcgagggcagtgggctgtactttaatgccattatttctacatccactattcccgctccaccgccaattacccccaagtcggcacaccgaactctcttgcgcaccaacagtgcagaggtgaccccaccggtcctaagcgtgatgggagaagctacccctgtgtcaatcgagccccgaattaatgtcgggagcaggtttcaggcggagattcccctgatgcgggaccgggcactggccgcagcggatccccacaaggcagacttagtgtggcagccatgggaagatctggaatcttccagagagaagcagcgtcaggtagaagacctcctgactgccgcatgttcttccatatttccaggggcaggcactaatcaggagctggcactccattgtctgcatgagagcagaggcgacattctggaaacacttaacaagcttctgctgaaaaagccacttagaccacataatcaccccctagcgacttaccactacactggcagcgatcagtggaagatggccgaaaggaagctgttcaacaaaggcattgccatttataagaaggatttctttctggttcagaaactcatacaaacaaagaccgttgctcaatgtgtggagttctattacacatacaagaaacaggtcaagatcggccgtaacggaacattgacttttggggatgtcgatacgagcgacgagaaaagcgctcaggaggaggtcgaagtggatatcaagacctcccagaagttccccagagtgccgctgccaaggagagaatctccatcagaagaacggctggagcccaagagagaagtgaaagagccacgtaaggagggtgaagaggaggtgccagagatccaggaaaaagaggaacaggaggaaggacgagaaaggagccgtcgtgcagccgctgttaaggccacccagacactgcaggcgaatgagagcgcatctgatattctcattctgagaagccacgaatccaatgcacccggatctgccggagggcaggcttccgaaaaacctcgggaggggaccggcaaatcacgacgggctcttcccttctctgagaaaaagaaaaagaccgagactttttctaagacccagaatcaggagaacacttttccatgtaagaaatgtggacgctag

SEQ ID NO: 22587 - DNA, 201 bp, Artificial Sequence
  Description of Artificial Sequence: Synthetic coding sequence
atgaatctacaggcgcagcccaaggcccagaataagcgaaagcggtgtcttttcggtggccaggagccagcaccaaaagaacagcccccacccctccagccacctcaacaatctattagagtcaaagaagaacagtatctgggccatgaaggcccaggaggggcagtgtctacatcacagcctgtggagctccccccttag

SEQ ID NO: 22588 - DNA, 3138 bp, Artificial Sequence
  Description of Artificial Sequence: Synthetic coding sequence
atgaacctgcaggcccagccaaaagcccagaacaaacggaaacgctgcctttttggcggacaggaacccgcaccaaaagagcaaccgcctcccctccaacctccacagcaatctatcagagtgaaggaagaacagtatctgggacacgagggtcccggaggggcagtgagtaccagccagccagtggagctgccacccccatcttcactggctttgctgaactccgttgtctacggccctgaacgcacatctgccgcaatgctgtctcaacaggttgcctcagtgaaatggccaaactctgtgatggctcccggtcgcggacccgaacgcggaggtggcggtggcgtgagtgacagtagctggcagcaacagcccggacagcccccacctcactctacttggaactgtcactccctgtccctgtactccgccacaaagggcagtccacaccctggcgtgggggtaccgacttactacaatcatccagaagcgctgaagcgggagaaagctggcggtcctcagttggatagatacgtccgcccaatgatgcctcagaaagtacagctggaggttgggagaccacaggcccctttgaatagcttccacgctgcgaagaaaccccctaaccagtctctgcctctgcaaccatttcagctggccttcggacaccaggtgaatcgacaggtgttcagacagggtccaccaccgcctaacccagtggcagccttccctccacagaaacagcaacagcagcagcagcctcagcagcagcagcagcagcagcaggcggctctgcctcagatgcctctgttcgaaaacttttatagcatgccacagcagccttcgcagcagccacaggatttcggcctccagcccgctggcccactggggcaatcccatctggcccatcactccatggccccatatccatttccgcctaaccctgacatgaaccctgagctccggaaagccttattgcaggactcagctccgcagcctgctctcccccaggtacagatcccatttccacgacgatcgcgcagactgtccaaagaagggatcctacccccttcggctcttgacggcgcaggcacccagcccggacaggaagccaccggaaatttattcctgcaccactggcccttgcaacagcctccaccaggttcgctgggacaaccccaccctgaggcactcggattccccctcgagctgcgagagtcccagctcctccccgatggcgagaggttggccccaaacggacgcgagcgggaagcaccagccatggggtctgaggagggcatgagggctgtttccacaggcgactgcggacaggtcctgcgtggcggtgtgattcaaagcacaaggagacggagacgagcctcccaggaggccaaccttttgactctggcacagaaagctgtagaactggcctcactccagaacgctaaggacggctctgggtccgaggaaaagaggaagtctgtactcgcatccacgacgaagtgtggggtggagtttagcgaaccctctcttgctactaagagagcacgggaagactctggaatggtccctctgatcatccctgtgtcggtgccagtaaggacagtggatccgacagaagccgcacaggctgggggactcgacgaagatggcaagggccctgaacagaatcccgcagaacacaagcctagcgtaatcgtgaccagacggcgaagcacacgcataccaggtactgacgctcaagcccaagccgaggatatgaatgtgaagcttgagggagagccaagcgtaaggaagccaaagcaacgccctagaccggagcccttgatcatcccgactaaggctggcacatttatcgctccccctgtgtactccaacatcactccataccagtctcacttgaggtcccccgtcagacttgccgatcatcccagcgagagatcattcgagctccccccttatactcccccacccattctctcccccgtgagggagggcagtggcttgtattttaacgccattatatctacatcaactatccctgcgccacccccaatcacaccaaaatctgcccaccggaccctcctgagaaccaactccgccgaagtgacccctcctgtgttatcagtgatgggagaggctacaccggtctcgatagagcctaggattaatgtgggtagtaggtttcaagcagagattcccttgatgcgcgatagagccctggccgctgctgaccctcacaaggccgatctggtgtggcagccatgggaggacctggaatcatcacgagaaaaacagaggcaggttgaagacctgcttacagccgcatgcagttcgattttccccggagctggaaccaatcaagagctggcactgcattgcctgcatgagtctcgtggcgatatactcgagaccctcaacaaactactcttgaagaaacctctcagaccccataatcaccccctcgctacctaccactacaccggcagtgatcagtggaaaatggctgagcgaaaattattcaacaaaggcattgccatctacaagaaggactttttcctggtacagaagctcatccagacaaaaaccgtggctcaatgcgtagaattctattacacgtataagaagcaggtaaagattggtcgcaacgggacacttacatttggcgatgtagataccagcgatgaaaagagtgctcaggaagaggttgaagtggacatcaagaccagccagaagtttcctagggttcccctgccacgcagggaaagccccagcgaagaacggctggagcctaaacgcgaggttaaggaacccagaaaagagggagaagaggaagtcccggaaatccaggagaaagaggagcaggaagaaggacgagaacgtagtcgacgggctgccgctgtcaaagccacccaaactttgcaggccaatgagagtgcctctgatatcttaatcctgaggagtcacgagagcaacgctcctgggtcggctggtggacaggcatctgagaaacctagagaaggaaccgggaaaagtcgcagagccctgcccttcagtgagaaaaaaaagaaaaccgagaccttttctaagacacagaaccaggagaacacattcccttgcaagaaatgtggtcggtag

SEQ ID NO: 22589 - DNA, 3060 bp, Artificial Sequence
  Description of Artificial Sequence: Synthetic coding sequence
atgaacctccaggcccaacctaaggcacagaataaaagaaagaggtgtttgtttggagggcaggagcccgctcctaaggagcaaccaccgccactgcagccaccccagcagtcaataagggtaaaggaagagcaatatctggggcacgaagggcctggtggcgctgtgtccacttctcaacccgtcgagctgccccctccaagcagcctagcacttctcaattcggtcgtatatgggccagaacgcacgtctgctgcaatgctgtcgcaacaggttgcaagcgtgaagtggccaaacagtgttatggctccgggaaggggacccgagcggggagggggtggtggagtgagtgacagctcttggcagcagcagcccggacagcctccccctcatagcacctggaattgccacagcctcagtttatactccgcaacaaaaggatcaccccaccccggagtgggcgtcccaacatattacaaccatcctgaggccctaaagagagaaaaagctggagggccacaactggacaggtacgtgcgaccaatgatgccacagaaggttcagttggaagtcgggagaccacaggcccctcttaattcattccatgcagccaaaaaaccacccaaccagagcctgcccctgcagccattccaactcgcattcgggcaccaagtcaatcgacaggtctttaggcagggaccccctcctcctaatcctgttgcggcatttcctccccagaaacagcagcagcagcagcaacctcagcagcaacagcagcagcagcaggcagcactcccacagatgcccctatttgaaaatttttacagtatgccacagcagccaagccagcagccgcaggatttcggactgcagcctgccggtccattaggccagagtcatttagcacatcattccatggcgccttatcctttcccacctaaccccgacatgaacccagaactccgtaaggcactgctacaggatagtgcgcctcagccggctctgccccaagttcaaattccatttccaaggcggtcccgccgtttatcaaaggaaggaatcctgccgcctagtgccctggacggggctggtactcagcccggacaagaagctactggaaatctgttcctgcaccattggccgctgcagcagccacctcctggctctcttggacagccccatcctgaagccctgggattcccactcgaactcagagaatcgcagctgctgccagacggtgaaaggttagcccctaacggcagagaacgagaggcccctgcgatgggatccgaggaaggtatgagagcggtgtctaccggagactgcggccaagtcctgcggggaggcgtcatccaatcgacacgcagacgtagacgggcatctcaggaggcaaatcttttgacgctggctcaaaaggccgttgaactcgccagtttgcagaacgcaaaggatgggtctgggtcagaagaaaagagaaaatcagttctggcctctacgacgaagtgcggggttgagttctctgaaccttcactggctactaaaagagctagagaagactctgggatggtaccccttatcatacctgtgagcgttccagtcagaactgtagaccctacagaagcagcccaggctggtgggttggacgaggacgggaaaggcccagagcagaaccctgccgaacacaaaccaagcgttatcgtcacgcgcagacgtagtacccggatcccaggcactgatgctcaggcccaggctgaggatatgaatgtgaagttagaaggcgagcctagtgtgcgaaagcctaaacagcgccctcggccagagcctctcatcataccgacaaaagccggtacatttatcgcccctcccgtatatagcaacatcaccccttaccagagccatcttagatcccccgtgagactggccgaccacccctctgagcgcagttttgaactgcccccttacactccacctcctatcttgtcccctgttagagaaggcagcggtctctactttaacgctatcatctcaactagtactattcctgcacccccacccattacacctaaaagcgcccaccgcaccctgctacggacgaactcagcagaggttacgccgccagtacttagtgtgatgggtgaagcaactccagtctcaatcgaaccaagaattaatgtgggcagccgcttccaggccgaaatccctctgatgagggatcgcgcactcgctgctgcggacccacacaaagccgatctggtgtggcagccgtgggaggatttagagtcttcccgggaaaaacagcgccaagtggaggacctgctgaccgccgcatgtagctctatttttcccggtgcaggcactaatcaggaattagcccttcactgtttacacgagtcccggggagacatactcgagaccctcaacaagttgttgttaaaaaagcctcttcgccctcataaccatccactggcaacttaccactatacaggcagtgatcagtggaaaatggcagagagaaagctgtttaacaagggcattgccatctacaaaaaagatttcttcctggtccagaagctaatccagactaaaaccgtagctcagtgcgtagaattttattacacctacaaaaaacaggtcaaaatcggacgcaatggaactctgacctttggagatgtggacactagcgacgagaagtctgcccaggaggaggtagaggtcgacattaaaacgtcccagaaattcccgagggtcccccttcctagaagagagagtcctagtgaagagcggttggagcccaagagggaggtgaaggaacctcgcaaagagggcgaagaagaagttcccgagatccaggaaaaggaggagcaggaagagggaagagagcggtcccggagggcagcagctgtgaaggccacccagaccttacaggctaatgaaagtgcctccgatatcctaatcctccgatcacacgagtccaatgcaccaggcagcgcaggagggcaggcatcagaaaagccacgtgaaggtacggggaagagtcgtagagcactgcccttttcctag

SEQ ID NO: 22590 - DNA, 951 bp, Artificial Sequence
  Description of Artificial Sequence: Synthetic coding sequence
atggccgctccagaggccccaccgctggacagggttttccgcaccacctggctgtccaccgagtgcgacagccatcctttacccccttcatatcgaaagtttctttttgagacgcaggccgcagacctcgccggaggcaccaccgtggccgcaggcaatcttctgaacgaaagtgagaaggactgcggtcaggatcggcgtgccccaggtgttcagccgtgcaggctcgtgactatgacgtctgtggtcaaaactgtatacagtctgcaaccaccatccgctctgagtggaggacagcccgctgatacacagacaagagctacctccaaaagtctcctgccagtgagatctaaggaggtagacgtgagtaagcaattacactccggcggacccgagaacgatgtgaccaaaataactaaattgcggcgtgagaacggacagatgaaggccaccgacacagccactaggcggaatgtgagaaagggctataagccgctctccaagcagaagtccgaagaggaacttaaagacaagaaccagctgttagaggccgttaacaagcagctgcaccaaaagctcacggaaacgcagggggagcttaaggacctcacacagaaagtggaacttctggaaaaatttagggacaattgcctggcaatattggaaagtaaaggactggatccggcactaggcagcgaaaccctggcctctcggcaggaatcgaccacggatcatatggatagcatgctcctcctggagaccttgcaggaggagctcaagctgttcaatgagaccgctaagaaacagatggaagaactccaagctctgaaagtgaaactggaaatgaaggaggaacgagtccgatttctggagcagcaaacgctgtgtaacaaccaggttaacgatttgacaacggccctaaaggaaatggagcagctgcttgagatgtag

SEQ ID NO: 22591 - DNA, 861 bp, Artificial Sequence
  Description of Artificial Sequence: Synthetic coding sequence
atggctgcacccgaggccccaccgctcgatagggttttccggacaacttggttatcaactgagtgcgattcacatcctctgcctcccagctatcgcaaatttctctttgaaactcaagcagcagacttagccggaggcaccacagtggcagccggtaatctgcttaatgaatcagaaaaggattgtggacaggaccgccgtgcacctggggttcagccttgccggctggtcacaatgactagtgtggtcaaaacagtgtactctcttcagcctcctagcgccctgagtgggggtcagccagctgatactcagacccgagccacatctaagtcgctgttgcccgtacgaagcaaggaggtggacgtgtccaagcagttacacagtggtggacctgagaacgacgtgactaagatcactaaactccgtcgagagaacggccagatgaaagccactgatacggcaacgagacgcaatgtgaggaaggggtacaagccacttagtaagcagaaaagcgaagaggagttgaaagataaaaaccagctcctggaggccgtcaataagcagcttcaccagaagctcacagagacgcagggcgaactgaaagacctcacgcaaaaggttgaactgctcgagaaattccgagataattgtctggcaatactcgaatcaaaaggcctcgaccccgctcttggctctgaaacattggccagcagacaagaaagcaccactgatcatatggacagcatgctcctgcttgaaacacttcaagaagaactcaagctgttcaatgaaacagccaagaagcagatggaggagctccagatagcctggatgaaccatggcatcctgcaccaaatgtag

SEQ ID NO: 22592 - DNA, 726 bp, Artificial Sequence
  Description of Artificial Sequence: Synthetic coding sequence
atggccgctcctgaagctccccctctagatcgggtgtttagaacaacctggctaagtacagaatgtgacagccacccactcccccctagttatcgcaagttcctgtttgagacacaggcagctgacttagcagggggtaccaccgttgccgctgggaacctactgaatgaatctgaaaaagactgcgggcaggataggagggctcccggtgtgcagccctgccgactcgtaaccatgaccagcgttgtgaaaactgtctactctctgcaaccccctagtgctctatctgggggtcaacccgctgacacccaaactcgtgcaaccagtaagagcctgctgcctgtgagatctaaggaggtcgacgtcagcaaacaattgcattcagggggacctgagaacgatgtgactaagattaccaaactccgccgagaaaacggccagatgaaagcgacggatactgccacaagacggaatgtccgcaagggctacaaacccctttctaaacagaagtccgaagaagagctgaaagataaaaatcagctgctcgaggcagtgaacaaacaactccaccagaaattaacggaaacgcagggagagctgaaggatctgacacaaaaggtggaactgctagaaaaattccgggataattgtcttgccattctggagagcaaagggctcgatccagtggccgtacgcaacttcgctcggggagcggaagcgttttag

SEQ ID NO: 22593 - DNA, 915 bp, Artificial Sequence
  Description of Artificial Sequence: Synthetic coding sequence
atggcgtccgagacccataacgtgaaaaaaaggaatttctgtaacaagatcgaagaccatttcattgatctcccacggaagaagatatcaaatttcaccaataagaatatgaaggaagtaaagaaatcccctaagcagttagcagcctatattaataggacagtgggccaaaccgtgaaatcgccggacaagttgcgaaaagtcatatacagacggaagaaagtgcaccaccccttccccaacccttgttataggaaaaagcaaagcccaggatccgggggatgtgacatggccaataaagaaaatgaactcgcttgtgccggacatcttcccgagaaactgcaccacgattcacgaacatacctggtcaactcatccgacagtggctcatcacaaacggagagtcctagcagcaagtactcgggattttttagcgaggtgagccaggaccatgagaccatggcgcaggtgctattttccagaaacatgcgcttaaacgtggccctgactttctggcggaaacgctcgataagtgaactggtagcctacctgctgagaattgaggatttaggagttgtcgtagactgtttgcctgtcctcaccaactgtctgcaagaagagaagcaatacatctcactgggatgctgcgtagacttgctcccactagtgaagtctttgctgaagtccaaattcgaggagtacgtcattgtcggccttaactggcttcaggcggttataaaaaggtggtggtcggaactcagcagcaagaccgaaattattaacgacggtaacatccagattttgaagcagcaactgtcaggcctgtgggaacaggagaatcacttgaccttggtgcccggatacactggaaacatcgcaaaggacgtggacgcttatttgctccagttacactag

SEQ ID NO: 22594 - DNA, 537 bp, Artificial Sequence
  Description of Artificial Sequence: Synthetic coding sequence
atggcttccgaaacacataacgtgaagaagagaaatttctgtaataagattgaagaccactttatagacctcccccgtaaaaagatctccaacttcactaacaagaacatgaaagaagtaaagaagtcacccaagcagcttgccgcatatattaacagaaccgtcggccagaccgtgaagtctccggataagctgcgtaaagttatctatcggagaaaaaaagttcaccaccctttccccaacccttgctatcgcaaaaagcagagccccggatctggaggatgtgatatggcgaataaggaaaatgaactcgcctgcgcgggtcacctgccagagaaactccaccatgattcacgaacttacctggttaacagctctgacagcggatccagtcagactgagagtccctcctccaaatattcgggattttttagcgaggtgtcacaggatcatgagaccatggcacaggtgttattctcgcgtaacatgcggttgaacgttgcactaacgttttggaggaaaaggtccattagctag

SEQ ID NO: 22595 - DNA, 120 bp, Artificial Sequence
  Description of Artificial Sequence: Synthetic coding sequence
atggccagcgaaacccataacgtcaaaaaacgtaacttctgcaacaagatcgaagatcactttatagatctgcccaggaagaagatttccaattttacaaataagaacatgaaagagtag

SEQ ID NO: 22596 - DNA, 225 bp, Artificial Sequence
  Description of Artificial Sequence: Synthetic coding sequence
atggcaagtgaaacacataatgtcaaaaaaaggaacttctgcaataaaattgaagaccacttcattgacctccctcggaagaaaatttccaatttcactaacaagaatatgaaagaggtgaagaaaagcccaaagcagctggccgcatatataaatcggaccgtgggacaaacagtgaagtcgccggacaaactccgtaaagtcatctatcgcaggaaaaaatag

SEQ ID NO: 22597 - DNA, 534 bp, Artificial Sequence
  Description of Artificial Sequence: Synthetic coding sequence
atggccagcgaaacgcataatgtgaaaaagcggaatttctgcaacaagattgaggatcatttcattgacttgcccagaaaaaagataagtaacttcaccaataaaaacatgaaagaagtgaagaaatcccccaaacagctggcggcatacatcaaccggacagtgggccagaccgtgaagtctcccgacaaattgaggaaagttatctatcggagaaaaaaagtccatcatccatttcctaacccatgttatcggaagaaacagagccctggctccggaggatgtgacatggccaataaggagaacgaacttgcatgcgccggtcacctccccgagaaactccatcatgacagtcggacctatttggttaatagcagtgactcaggcagctcccaaaccgaaagtcccagttctaaatactccggtttcttcagtgaagtgtcacaggaccacgaaaccatggcacaggtgctctttagcaggaatatgcgcctcaacgtggctttgactttctggcgcaaaagaagcatctag

SEQ ID NO: 22598 - DNA, 1887 bp, Artificial Sequence
  Description of Artificial Sequence: Synthetic coding sequence
atgctgctggccagaatgaaccctcaagtccagccagagaacaacggggctgatacaggccctgagcagccactacgcgcaagaaagactgcagagctactggtggtgaaggagagaaatggagtgcaatgtctcctggctcctcgggatggcgacgcacagcccagagaaacatggggcaagaaaattgattttttactgagcgtagttgggttcgccgttgatttagctaacgtgtggcgattcccatacctgtgctataagaacggcggaggcgcattcctgatcccctacactctctttttaatcatagccggaatgcctctcttctacatggagctggccttgggtcagtacaatagagagggggcagccacagtatggaaaatttgtcccttttttaagggggtaggttacgccgtaatactgattgctctctacgtggggttctattataatgtgattatagcctggtctctctactacctgtttagctcctttaccttgaacctgccctggactgactgtggacacacgtggaactcccctaactgtacagatcccaaactcctaaacggctcagttttggggaaccatacaaagtattcaaagtataaattcaccccagcagctgagttctacgaacgaggtgttttacacctccatgagagtagtggaattcacgatatcggtcttcctcagtggcagctgctgctatgcctaatggtggttgtgatcgtcctctacttcagcctttggaaaggcgtcaaaacatcaggtaaggtcgtttggataacagccactctaccttatttcgtattatttgtgctgctcgttcacggcgtcacactgccgggtgcatccaatggtatcaatgcatatctgcatattgatttttatagactgaaggaggcaactgtctggattgatgccgctacgcaaattttcttttctctaggggctggctttggcgtcctgatcgcgttcgctagctataataaatttgataacaattgctacagagatgcgttgcttacctcaagcatcaactgcataacatcctttgtgagtggttttgcaatattcagcatcttaggatatatggcacatgaacataaggtcaacattgaagacgtagccacagaaggcgcaggacttgtgttcatcctgtatccggaggctattagcaccctatcagggtctaccttctgggctgtcgtgtttttcgtcatgctgctcgccctaggccttgacagcagcatgggcggaatggaggcagtgattacaggcctggcagatgattttcaagtgttgaagcggcatcggaaactgttcaccttcggcgttacgttcagcacatttttactcgcccttttttgcattaccaaagggggaatatatgtcctgactctcctcgatactttcgcagccggtacttccatcctgtttgcggtgcttatggaggccatcggggtgtcctggttctacggtgtggacagattctccaatgatatccagcagatgatgggcttccggccaggcctttactggaggttgtgctggaaatttgtcagccccgctttcctcctgttcgtcgtagtggtgtcaattatcaattttaagcctctgacatatgacgactatatttttcccccatgggctaattgggttgggtgggggatagctctatcctccatggtcctggtgcccatttatgttatttataagttcctgtctactcagggaagcttgtgggagagactggcatatggaatcactcctgaaaatgagcaccacctggtagcacaaagggatatacgccagtttcagatgaagactcgccagggtaggcgccgagctacgaattcatgccagatttcgtgctag

SEQ ID NO: 22599 - DNA, 519 bp, Artificial Sequence
  Description of Artificial Sequence: Synthetic coding sequence
atgacatcagcctccaccaaggtgggagaaatctttagtgccgcaggggcagcttttaccaaactgggcgagctcaccatgcaattgcatccagtggcagacagcagtccagccggagcaaagtggaccgagaccgagattgaaatgctcagagccgctgtcaagaggttcggcgacgacctgaatcatatctcatgcgtgattaaagagcggactgtagctcagatcaaggcgacagtaaagagaaaggtgtacgaagatagtggaattcctctgccggctgaatcgcccaagaaaggtcccaagaaagtcgcatcaggcgtactgtcccctcctcccgcagcccctccgccttcgtcttctagcgtccccgaggccggagggcctccgattaaaaaacagaaagccgacgtaacactcagcgcactgaacgacagtgatgccaatagtgatgtggttgatattgaaggtttgggtgaaactcccccagccaaaaaactgaacttcgaccaagcctag

SEQ ID NO: 22600 - DNA, 417 bp, Artificial Sequence
  Description of Artificial Sequence: Synthetic coding sequence
atgacaagcgccagtaccaaggtgggcgagatcttttctgctgcgggtgcagccttcaccaaattgggcgaactgacaatgcagctgcatcctgtcgcagattctagccctgctggagctcagataaaggcaactgtgaaaagaaaagtgtatgaggattcagggatcccccttcctgccgaatctcctaaaaagggcccaaaaaaggtggccagtggagttctgtctccacctcccgctgcacccccaccctcttccagctccgtgcccgaggctggaggacccccaattaagaaacaaaaggcggacgttaccctctccgcactgaatgacagtgatgccaattcagacgtagtagacattgagggcttaggcgagactcctcccgctaagaaactgaatttcgatcaggcatag

SEQ ID NO: 22601 - DNA, 555 bp, Artificial Sequence
  Description of Artificial Sequence: Synthetic coding sequence
atggacctgcaagcggcaggtgcccaggcacagggagccgctgagccatcccgaggcccacctctcccgtccgctagaggagcccctccttcccccgaggccggttttgccaccgccgaccatagctcacaggagcgggagaccgagaaagccatggaccggctcgcgaggggaacccagagtatccccaatgacagtccagccagaggagaaggaactcactctgaggaggagggcttcgcaatggacgaggaggattcggatggcgagcttaacacatgggaactaagcgagggaaccaactgcccccctaaagagcaaccaggggacctctttaacgaagactgggattctgagttaaaagcagaccaggggaacccctacgacgccgacgacatccaggagtccataagccaggagttaaagccttgggtgtgctgcgcgccacagggtgacatgatatatgatcccagctggcaccaccccccacccttgattccatattattcaaagatggtctttgagacaggacaattcgatgatgccgaagactag

SEQ ID NO: 22602 - DNA, 519 bp, Artificial Sequence
  Description of Artificial Sequence: Synthetic coding sequence
atgggcggtgacgctggagatagggagcctggccctgctgcccgatcgctcggggaggggcaggccggattcgccacagccgatcattcctcccaggaacgggagaccgaaaaggccatggacagactcgcccgaggaacgcaatctattcccaacgatagccccgctagaggagaaggcacacacagtgaggaggagggctttgccatggatgaagaggacagcgacggcgaactgaacacatgggaactcagcgagggcacgaattgccctcccaaggaacagcccggtgacttattcaacgaggattgggatagtgagctcaaagccgaccagggcaacccttacgacgcagatgacatccaggagtccatttcccaggaactaaagccatgggtttgttgtgccccacagggggacatgatctacgacccttcatggcaccaccctccaccacttatcccctattacagtaagatggtcttcgagaccgggcagttcgatgatgctgaggactag

SEQ ID NO: 22603 - DNA, 1956 bp, Artificial Sequence
  Description of Artificial Sequence: Synthetic coding sequence
atgggtccggcaagtccggctgctaggggactatccagacgccctgggcagccccctctgcctttgctcctgcccctactcttgctgctgctccgcgctcaaccagccatcggaagtctggcgggtgggagccctggagctgccgaggcacccggaagcgctcaggtggccggactctgcgggcgactgaccctccaccgggaccttcgaacaggaaggtgggagcccgacccacagcggtcgcggagatgcttacgggacccccagcgagtccttgagtactgcaggcaaatgtatcccgagttgcagatcgccagggtggaacaggctacgcaggccattcctatggagcggtggtgcggcggtagccggagcggatcatgcgcccaccctcatcaccaggtggtgcccttcagatgtttacctggcgaattcgtgtccgaggccctcttagttccggaagggtgcagatttctgcaccaggagaggatggaccagtgtgaaagctctacacgcagacatcaggaagcacaggaggcgtgctcgagccagggactcatcctgcacggtagcggaatgctcttaccgtgcggttccgatcggtttcgaggagtagagtatgtgtgctgcccaccccctggaaccccagatccatccggcacggccgttggggacccatctactaggtcttggccaccaggaagcagagtagagggagcagaagacgaggaggaggaagagtcctttcctcagcctgtggacgattacttcgtggagccaccccaggccgaggaggaggaagagaccgtaccaccccctagctctcataccctggccgtggtaggcaaggttacccctactcctcgtccgaccgatggcgttgatatatatttcgggatgcctggcgagatctcagaacacgaagggttcctccgggcaaagatggacctggaggagaggcggatgcgacaaataaatgaagtgatgcgtgagtgggccatggcggacaaccaaagtaaaaacttgcccaaagcggatcggcaggccctgaatgaacactttcaatcaatactgcagacacttgaggaacaagtgtccggggaacgccaacgtctcgttgaaacccatgccaccagagtgattgccctgatcaatgatcagaggcgggctgcactggaaggcttccttgcagccttacaggccgaccctccacaagcagaaagggtgctgctggctctaagaaggtacctgagggctgagcagaaagaacaacgtcacacccttcgtcactatcaacatgtggccgctgttgacccagagaaagctcagcagatgaggtttcaagtccatacgcacctgcaagtcattgaagaacgagtcaaccagtcgctgggcctgctggaccagaacccccacctagctcaggaactccgacctcagatccaggagctgctgcatagcgaacatcttggcccatctgaactggaggctcccgctcctggaggctcctccgaagacaaagggggactccagcccccagacagcaaggacgctgatacccccatgaccttgcctaaaggcagtacagaacaagatgccgctagtccagagaaagagaagatgaatcccctggaacagtacgagaggaaggtaaatgccagtgtccccagaggatttccttttcacagctccgagattcaacgcgatgaactagcacccgctgggactggagtcagtcgcgaagctgtttcagggctgctgattatgggcgctggcggaggatctttaatcgtcctgtctatgctcctgttacgcagaaaaaagccatacggtgcaatctctcacggtgtggtggaagtggatcccatgctaacacttgaagaacagcagttgcgtgaacttcagcggcacggttatgaaaatccaacttatcgcttcctggaagaaaggccttag

SEQ ID NO: 22604 - DNA, 2277 bp, Artificial Sequence
  Description of Artificial Sequence: Synthetic coding sequence
atgggccgagacactcggagccggtcacgtagtgctggcagacggggtcggcgacgccagagccaaagcgggagtcgttcgcgaagccgcagccatggcagacgaaacagaagaaggagggaagacgaggggaggcggaggcgcaggcgcagatctcgcgaacgaagatctgactccgaggaggagcgctggcagcgctcaggaatgcgtagtaggtctccacctaggcccaaatggcatagtcgcgacgggagttcccaatccgatagtggagaagaacagtctcgaggacagtgggccaggaggcggaggagggcccgttcatggtcgccttcttcatccgcaagttccagtgccagtcctggaaggagtcagtccccacgcgcagccgcagcagctttgagccaacaacagagccttcaagaacgccttcgcctcagagaggaaaggaagcagcaggaggagttgatgaaggccttcgagacacctgaagaaaagagagccagacgattagccaagaaggaggcaaaggaacggaagaagagagaaaaaatgggatggggagaagaatacatgggttacaccaatactgataacccctttggggataataatctgcttggtacctttatttggaacaaagcactggaaaagaagggcatatcccatctcgaagaaaaagaactgaaagagaggaacaagcgcattcaggaggataataggctggagctgcagaaagtgaagcagctgcgccttgagcgggaacgagaaaaggccatgcgagagcaagaactggagatgctgcaacgagaaaaggaagcagaacacttcaagacatgggaggagcaggaggataacttccatctccaacaagccaagctcagatctaagataaggattcgggacggcagggctaagccaattgatctcctagccaaatatatcagcgctgaggacgacgatctagccgtggagatgcacgagccctataccttcctgaacgggctgaccgtcgccgatatggaggatcttcttgaggatatacaggtgtatatggagctggagcaaggtaagaacgcagatttctggagggacatgacaacaatcactgaggatgaaatttctaagctccggaagcttgaggcatccggcaagggccctggggagagacgagagggagtgaacgcatccgtgtcttcagacgtgcagtccgtttttaaaggaaagacgtataatcaacttcaggtcatttttcagggtatcgagggtaaaattagggcgggaggacccaacctggacatgggttattgggaatcattgctgcagcagctgagggctcacatggccagagccaggctgcgggaaagacaccaggatgtgctgagacaaaagctctataaactgaagcaggaacagggagttgagtctgagcccttattcccaatcttgaagcaggaaccccagagtccctcccgctcactggagcccgaagatgccgcacctacccctccgggaccatccagcgagggaggtcctgcagaagccgaagttgacggagccacccctaccgaaggtgacggcgatggtgacggcgagggggagggagagggggaagcggttctgatggaggaggaccttattcagcagtctttggatgattatgatgcaggtaggtattcaccacgattgctgaccgctcatgaactgcccttggatgcccatgtccttgaacccgacgaagacctgcagcgattgcaacttagccggcaacagttgcaggtgacaggcgacgcatcagaatccgcagaggacatttttttccgacgcgcaaaagaaggcatgggccaggacgaggcccagtttagtgtggaaatgcccctcacagggaaggcctatctgtgggccgacaagtacagaccacgaaagcccaggtttttcaaccgcgttcacaccggattcgaatggaataaatacaatcagacccactatgatttcgataatccaccgcctaagattgtacaaggttacaaattcaatatattctatccagacctgatcgacaagcggtccacacccgaatatttcttggaagcttgtgctgataacaaagacttcgccatactgagatttcacgctggccctccgtacgaggacattgctttcaagatcgttaaccgggaatgggagtacagccacagacatggctttaggtgccagtttgcgaacggtatctttcagctctggttccatttcaagcgttacaggtatcgcaggtag

SEQ ID NO: 22605 - DNA, 2277 bp, Artificial Sequence
  Description of Artificial Sequence: Synthetic coding sequence
atgggtagagacactcgctctcggagccgtagtgcgggtagacgcggtcgcaggaggcagtctcaatctggctctcgttctcgtagtcggtctcatggtagacgcaacagaaggcggagagaggatgagggccgacgacggagaaggcggcgaagcagggaaagaaggtccgacagcgaggaggagcggtggcagagatcaggaatgcggtctcgatctccccctaggcccaagtggcattcacgcgatgggagttcacagtcagattccggtgaggaacagagcagggggcaatgggcgcgacgtcgcaggcgtgcaaggtcttggtccccttcctccagtgcgtcttcatccgcctcacccggacgcagtcagtcccctagggctgcggctgctgctctgagccagcagcaatcactgcaggagaggctgcggctaagggaggaacgcaagcagcaagaagagctgatgaaggcctttgaaacgcccgaggagaaaagagcccgaaggctcgcaaaaaaggaggccaaggagcgcaagaagcgcgagaaaatgggctggggagaggagtacatgggatacaccaacacagacaacccctttggtgacaacaacttgttgggaacctttatatggaataaggctctcgaaaagaaaggaatttcacacctggaggagaaagagctgaaggagcggaataagagaatccaagaggacaatcgcctagaactccagaaagtgaagcaactgcggttggaaagagagagagaaaaggcaatgcgggaacaagagctggaaatgctgcagagagagaaagaagcagagcacttcaaaacttgggaagaacaggaagataacttccacctgcagcaggctaaactccgctcaaaaatccgaattagggatggtcgggctaagccaattgacctattagcgaagtatatcagtgccgaggatgatgacctggccgtagagatgcatgagccttatacatttctgaatgggttgactgtggcggatatggaggatttgctggaagatattcaggtctacatggaactggaacaaggcaagaacgccgatttttggagagacatgacaacgatcaccgaagacgaaatcagtaagttacggaagctcgaggcatctggcaaaggaccaggcgagcgaagggagggggtcaacgcgtctgtctctagcgacgtccaatctgtgttcaagggaaaaacctacaaccaactccaagtgatctttcagggcatagagggcaaaattagggctggcggaccgaatctcgatatgggctactgggagagcttactgcagcagctgagagcccatatggctagagccagactacgcgagcgtcatcaggacgtactgcgtcaaaagctgtataagctgaaacaggaacagggagtggagtctgaaccactttttccaatcctcaagcaagagcctcagtcgccatctcggtctctggagcccgaagatgcagctcccacgcctcccggtccaagctccgaagggggaccggcagaagcagaggtagatggcgcaactccaacggaaggcgacggcgatggtgatggggaaggggaaggggagggcgaggccgtcctaatggaggaggatctaattcagcagtccctcgatgactatgacgccggacgctactcacctcgcctgttgacagctcatgagctgccgctggacgcacacgttctggaaccagatgaggatctgcagagattgcagctttcacgccagcagcttcaagtcacaggtgatgccagtgagtctgcggaagatatcttctttcgtcgggctaaggaaggaatgggccaagacgaggcccagttctctgttgaaatgcccctcacgggcaaggcatatctgtgggcagacaagtaccgccctcgtaaaccacggtttttcaatagggttcatactggctttgagtggaacaaatataatcaaacacattacgactttgacaatccgcctcccaaaattgtgcaggggtacaagttcaatattttctatcctgatctcattgataagcggtccactccggagtacttcctggaagcatgcgccgacaataaagactttgctattttacggttccacgccggtcccccatacgaggatattgcgtttaagattgtcaaccgcgagtgggagtactcgcaccggcatgggtttaggtgccagtttgcaaacgggatcttccagctgtggttccacttcaagcggtatcgatacaggagatag

SEQ ID NO: 22606 - DNA, 792 bp, Artificial Sequence
  Description of Artificial Sequence: Synthetic coding sequence
atgggccgagacacaagatcccggagtcgttccgccggaagacgaggcaggcggaggcagagccaaagcggctctcggcgtggccctagccccttcccccgaagtgtgcaccagcctagacacctcaggaccaatccctgcgctcaaggctcatgggtcaaagctgggccacccgtgaagcagcttagattagagagggagcgtgagaaggcaatgcgggaacaggaactagaaatgcttcagcgcgaaaaggaagccgagcactttaagacctgggaagaacaggaggataactttcatctacagcaggccaagttgagaagtaaaattcgcatacgggatggccgtgccaagcctatcgacctattggccaaatatatcagtgccgaggacgacgatctggctgtggaaatgcacgagccttacactttcttgaatggattaactgtcgctgatatggaagatctccttgaggatattcaggtatatatggaattagagcaaggaaaaaacgcggatttctggagagacatgactactatcactgaagacgagattagtaaactcaggaaactggaggcttccgggaagggtccaggtgagcgaagggagggggtgaacgcctccgtcagtagcgacgtgcagagtgtgttcaagggaaaaacatataatcagcttcaggtcatcttccagggcatagaaggcaagatacgcgctggagggccaaacttagatatgggctactgggagtccctgttgcagcaactcagagcccatatggcccgtgcctag

SEQ ID NO: 22607 - DNA, 321 bp, Artificial Sequence
  Description of Artificial Sequence: Synthetic coding sequence
atggaattcgatttaggcgcagccctggaacctacttctcagaagcctggggtcggggctggccatggtggagatcccaagctcagcccccacaaagtgcaagggaggtccgaggctggagcaggccctgggccaaagcaaggccaccatagcagcagcgattcttcctctagtagttccgactctgacaccgacgtcaagtctcacgctgctggtagtaaacagcacgaatccattcctggcaaagctaaaaagccaaaagtgaaaaagaaagaaaaaggcaagaaggagaaaggtaaaaagaaggaagcgcctcattag

SEQ ID NO: 22608 - DNA, 543 bp, Artificial Sequence
  Description of Artificial Sequence: Synthetic coding sequence
atggccggtgtgaagtacccgggacaggaccctgtggacttggacatttatcaaagctcgcatatggtcgattatcagccttatcggaagcacaaatactcccgggtcaccccgcaggagcaggccaaactggacgctcagctccgcgataaggagttttacaggccaattccaaatccaaacccaaagctcaccgacgggtatccagcttttaagaggccccacatgactgcgaaggacttagggttgccaggattttttccttctcaggagcatgaagcgacaagggaagacgagaggaaatttacttccacttgtcattttacttacccagcctcccacgatttgcatctggctcagggtgaccccaaccaggtgttgcagtccgccgacttcccatgccttgtcgatcccaagcaccagccagctgccgagatggcgaagggatacctcctcctcccaggctgtccctgcctacactgtcatatcgtcaaagtgcccattcttaaccggtggggccctttaatgcccttttaccagtag

SEQ ID NO: 22609 - DNA, 1041 bp, Artificial Sequence
  Description of Artificial Sequence: Synthetic coding sequence
atggtgggtgggggaggcaagagaagacctggaggagaaggtccccaatgcgaaaagactacagacgtcaagaaaagtaagttctgcgaggcagacgtaagctcggatctccggaaagaggtggagaaccactacaaactcagccttcccgaggatttctaccacttctggaagttctgcgaggaacttgatcctgagaaaccctccgattcactgagcgcctctctcggcctgcagcttgtgggtccttatgatatcttggcaggaaagcataagacaaagaagaaatcaacgggcctgaacttcaatctgcattggcggttctattacgatcctccagagtttcagacaattatcataggggataacaaaacacagtatcacatgggttacttcagggattctcccgatgaatttccagtgtacgttggtattaacgaagctaaaaaaaattgtatcatcgtgcctaacggggacaacgtgttcgcggcagtcaaattgtttctgacaaaaaaactgagggaaattactgacaagaagaagatcaatttgctaaaaaacattgatgagaagctgacagaggctgcgagggaactgggctactcactggaacagaggacagtgaagatgaaacaacgggataagaaggtggttactaaaaccttccacggcgctgggctcgtagtgccagttgataagaacgacgtaggttacagagaactgcccgagacagacgccgacctcaaacgaatatgtaagacaatcgtggaggccgcatcggatgaggagagacttaaagcttttgctccaatccaggagatgatgacctttgtccagtttgccaacgatgaatgtgactacggtatgggtcttgagctcggaatggatcttttttgttacggttcccattatttccacaaggtcgcagggcagcttctgcctttagcctacaacttgctcaaaagaaatctctttgcagagatcattgaagaacatctcgctaataggtcacaagaaaacatcgatcagctggctgcctag

SEQ ID NO: 22610 - DNA, 780 bp, Artificial Sequence
  Description of Artificial Sequence: Synthetic coding sequence
atgcgcgaccggaggggacctctaggaacctgtctggcccaggtccagcaggccggaggcggagatagtgataaactctcttgctcactcaaaaaaaggatgcccgaaggcccttggcccgcagacgctccaagctggatgaataagcccgtagttgacgggaattctcagtcggaagcactctcgttggaaatgcgcaaggacccctccggagctggactgtggctccacagcggcggtccagtactgccctacgtgcgagagtccgtacgcaggaaccccgcaagcgctgcaaccccatccacggcagttggcctgttcccagccccaacggagtgctttgctagagtctcatgtagcggggtggaggcactcgggaggagggattggctcggcggtgggcctagggccaccgacggccatagagggcagtgtccaaaaggcgaaccgagagtcagccgcctacctagacaccagaaagtcccagagatgggcagcttccaagatgatccaccgtcagcatttcctaaggggctgggaagtgagctggagcctgcctgcctgcactccatcctctcagccacacttcacgtctatcctgaagtgctcctgtccgaagagacaaaacgtatattcctggatcggctcaagcccatgttctccaaacaaaccatcgaatttaaaaagatgctcaaatccacttctgatggcttgcagataaccctcggcctgctcgcgcttcagccctttgaactcgctaacaccctctgccactcctag

SEQ ID NO: 22611 - DNA, 363 bp, Artificial Sequence
  Description of Artificial Sequence: Synthetic coding sequence
atgcgcgatcgaagagggcctttaggtacctgcttggcccaggtccagcaggccggaggcggagattcagacaagctgtcgtgctcattgaaaaagcggatgcccgaggggccatggcctgctgacgccccatcatggatgaacaaacctgtggtggacggtaatagtcagagtgaagccctgtcactggagatgcggaaggatccatctggagccggtttgtggcttcatagcggcggtcccgtcctaccttacgtgcgagaaagcgtccgcaggaatcccgcaagcgctgctacaccttcgacggcggtgggtctgtttcctgcccctactgaatgtttcgccagagttagttgcagctag

SEQ ID NO: 22612 - DNA, 330 bp, Artificial Sequence
  Description of Artificial Sequence: Synthetic coding sequence
atgcgggacagacgtgggcctctggggacctgcttggcccaggtgcaacaggctggtggcggagactccgacaaactctcttgttcgttgaagaagagaatgcctgaaggcccatggcctgccgacgctccttcatggatgaacaaacctgtcgtcgatggcaattcccagtccgaagcactatccctggagatgagaaaggacccttccggagccggtttatggctccattcggggggacctgtactgccctacgtccgcgagagcgtgcgcagaaatccagccagtgctgctacaccctccaccgcagtgggtctgtttcctgcctag

SEQ ID NO: 22613 - DNA, 2391 bp, Artificial Sequence
  Description of Artificial Sequence: Synthetic coding sequence
atggccgagaccaaagacgtgtttggccaggaaccccaccccgtggaggatgacctttacaaagagagaaccaggaaaagacgcaaatccgacagggaccaacgcttccgtgcctttccatctatggagcagtcagccctgaaagaatacgagaagttagagagtcgtaccaggcgcgtgcttagcaatacataccagaaactgatccagagcgtcttcctcgacgattccatccctaacggggtaaaataccttattaacaggctcctggccctaattgaaaaacccacagtcgacccaatctacattgctctgtttgggtcgacaggcgcaggaaagagctccctcattaatgcaattatccagcaggcgatgttcctacctgtgtcaggcgaatctatctgcacttcctgcatcgtgcaggtgtcctcgggttgctgcgtccagtacgaggccaagatacatctgctgtcagaccaagagtggcgagaagagttgaagaatctgacgaagctcctgcatcggactgaggagctgagcagagaggaggcagacgcctggaatagagatgaggccgtggaagaagcgacctggaaacttcagatgatttacgggaatggtgccgagtccaaaaactatgaagagttacttagggcgaagccgaaaaggaaaattccgacctcccgggtcatcaccctgaaggcagaagaagctgaggaactcagcatcaagctcgacccatatattcgcactcagcgaagggactgggacggtgaagccgctgaaatgcgcatctggcctctaatcaagcacgttgaggttacccttccaaaaagcgatttgataccggaaggagtcgtgctggtcgatatccccggaacgggcgacttcaattcaaagagagatgaaatgtggaagaagactattgacaagtgcagtgtgatctgggtgatatctgacatcgagcgtgtgagtggaggtcaagctcatgaggacctactgaatgagtctattaaggcttgtcagagaggattctgcagagacgtcgctttggtggtgactaaaatggataaactgcatctccctgagtacttgcgagaggagaggaagggttggcaggccattcagtcacaacgcgaggcagtgctggagcgcaacgagatgatcaaactgcagaggacccgcatattaaaagagaagctcaaaagaaagttaccggcagatttcaaggttctggaagcatccgacctcgtgtataccgtgagcgctcaggaatactggcagcaggctctcctcaccgaagaggagaccgagatcccaaagttgagagaatatatccgaaagtctctgctggacaagaagaagcgaacagtcacgaagtacgtgaccgaggcgtttggcttactcctcttgacagattcttttaattcaacccagaacctcccgaatgagcacctgcatatgtccgtcttgcgccgatttgcggaagaaaaagttgagctgcttgaaaaggcgattgcccagtgctttgcatgcatggagcagcctctccaggaaggcgtgagaacagctcgcacatcttatagatgcattctgagggcctgcctggtcaggtctaaagggaaccaagggtttcaccagaccctgaaggctgtttgcctgaaaaatggaatctacgcttcccgcaccttagcaaggattgacttgaatgaagcccttacccaacctgtttatgaccaaattgatcctgtgttcggatctatttttcgcaccggaaaacccactggcagcgctctgatgccccatatagacgcttttaaacagtcgctccaggagaaaatgacggagatcggaatccgatctggctggaaatacgactcttgtaagaaaaatttcttaattcaggagatttctgccatcttggggggactggaggatcacatcttacgtcggaaacggagaatctacgagagtctgaccgcttcagtccaatccgacctgaagctgtgttacgaggaagccgcacagatcaccggaaagaaggcatgtgagcgtatgaaggatgccatacggaggggcgttgatcggcaggtcgccgaaggtatgttcgaacgggctcaggagcgcatgcagcatcagttccagcaactcaagactggtatcgtagaaaaggtaaagggttccatcacaaccatgctggcactcgcctcaagtcagggtgatggtctatataaggaactggctgacgtgggttctgagtacaaggaaatggagaaactgcaccggtcactgagggaagtggctgagaatgccagactgcgcaaagggatgcaggagttcctcttaagggcgagtcctagcaaagccggacccccaggaacttctttatag

SEQ ID NO: 22614 - DNA, 2391 bp, Artificial Sequence
  Description of Artificial Sequence: Synthetic coding sequence
atggctgagactaaagacgtgttcgggcaagaaccccacccagtagaggatgatctgtacaaggagcgcacacgaaaacggcgtaagtctgatagggaccagcgattccgagcattccccagcatggagcagtcagctctgaaagagtacgagaaactggaatcaagaactaggcgtgttctgtctaacacataccagaagctaattcagagtgtgtttctggatgacagtattccaaatggagtgaagtacctcatcaatcgcttacttgccctgattgaaaagcccaccgttgaccccatctacatcgcactctttggaagcacaggcgcaggaaagtctagcctaatcaacgctatcatccagcaggcgatgtttctgccggtgagcggagaaagtatatgtacttcatgcattgtgcaggtttcctcaggatgttgtgtccagtatgaagctaagattcatctgctgagcgaccaggagtggcgggaggagctgaagaacctaactaagctactccaccgcacagaagagctgagtcgcgaggaggctgatgcgtggaacagagacgaagcggtagaagaggctacctggaagctgcagatgatttacgggaacggcgcagaatccaaaaattacgaagagctgctgcgggctaagcctaagcgtaagatacccacatctcgagtgatcacactcaaggcagaggaggctgaggaactgtccattaaattggacccttatattcggactcagcgccgtgactgggatggagaagcagcagagatgagaatttggccactgattaaacatgtggaggtcacattaccgaaatccgatctaatacctgagggagtggtgctggtggatatccctggcaccggtgactttaatagtaaaagggacgaaatgtggaagaagactatcgataagtgctcggttatctgggttatatcagatattgagagggtcagtggtggacaagcccatgaggatcttctgaatgagtcaattaaagcatgccagcggggattttgtcgggatgtggccctagttgtgacgaagatggacaagctgcaccttccagagtacttgcgcgagagaaaagcaggcaaccaggctatccagagccaaagggaggcggttttggagagaaatgagatgattaagctgcagagaacccgaatcctgaaagaaaaactgaagcgaaagctgccagctgacttcaaggtgcttgaggcaagcgatctggtatataccgtcagcgcacaagagtactggcagcaggccttgttaaccgaggaggaaaccgagatccccaaactccgagagtatattaggaaatccctgttagacaagaaaaagagaaccgttacaaagtacgtcaccgaggccttcgggctgctcctcctcaccgactcatttaacagcactcaaaacctgcccaacgagcatctccatatgagtgtgctgcgacgatttgcagaggagaaagtggaactcctggaaaaggccattgcgcagtgtttcgcgtgcatggagcagcctctgcaggagggggtgcgcaccgctcggacctcctacaggtgcatcctgcgtgcctgtctggtgcgttctaaggggaaccaagggtttcatcaaactcttaaggccgtatgcctgaagaatggaatttatgcttctcggaccctggctagaatcgacctgaacgaggccctcactcagcccgtgtatgaccagattgacccagtgtttgggtctatattcaggactggaaaacctacaggctctgcactcatgccacacatagatgcctttaaacagtctctccaagaaaagatgaccgaaatcggaattcgctcaggatggaagtacgacagctgcaagaaaaatttcttaattcaggaaattagcgctattctgggcggactggaagaccacatccttcgacgaaaacggagaatctacgagtccctgacagcctccgtgcagtctgatcttaaattatgctacgaggaggccgcacagataaccggcaagaaagcatgtgaacgcatgaaagacgctatcaggcggggagtagatcgacaagtggccgaaggaatgttcgagcgggcacaagaaaggatgcagcaccagttccagcagttgaagactggtattgttgagaaagtcaaaggcagcataactacgatgcttgccttagcgagcagccagggcgacggcctctataaggaactggctgacgtcgggtctgagtacaaagagatggaaaaactccacagaagtctcagagaagtcgccgagaacgcccgactgagaaaaggaatgcaggaattcctcctcagggcatcaccaagcaaagcaggccctccaggtacatccctgtag

SEQ ID NO: 22615 - DNA, 3999 bp, Artificial Sequence
  Description of Artificial Sequence: Synthetic coding sequence
atgactggagaggtgggctccgaagtgcacctagagataaacgatcccaatgtgatttctcaagaagaggccgactcgccgtctgactccggccagggctcctacgaaactatagggccactgtcagaaggcgacagcgatgaagagatctttgtcagtaaaaaactgaagaatcgcaaggtgctgcaagatagcgactctgagacagaagataccaacgcctcccccgaaaagactacctatgactctgctgaagaggagaacaaagagaacctctatgctggaaagaatacgaaaatcaagcggatctataagactgtagctgatagcgacgagtcctatatggaaaaaagcctttatcaggagaacctggaagcccaggtgaagccatgcctggagttatccctgcaatcgggaaacagcacagatttcactaccgataggaaatccagcaaaaagcacatacacgacaaggagggaacagccggtaaggcgaaagtgaaatcaaagcgacgtcttgaaaaagaggagcgcaagatggagaaaatccggcaactaaaaaaaaaagaaactaagaatcaagaggacgacgtcgagcagccgtttaatgattcaggctgcctgctggtcgataaagatctgtttgaaaccggtttagaggatgagaacaacagtcccctcgaggacgaggaatctctcgagagcattcgcgcagccgttaagaacaaggtaaaaaagcacaaaaagaaagaaccatcactggagagcggcgttcatagtttcgaagagggaagcgagctctccaaggggaccacacgaaaagaacgaaaagccgctcggctgagcaaagaagcactcaaacagctgcactcagagacccagcggctgatccgggagtcagccctgaatttgccataccacatgcccgaaaacaagactattcacgacttttttaagcgcaaacccaggcccacgtgccacggcaatgccatggccttgttgaaatcttccaagtatcaatcatcacatcataaagagataattgataccgctaatacaacagagatgaactcagaccatcacagcaaaggctccgagcagaccacaggagctgaaaacgaggtggagaccaacgcattgcccgtggtgagtaaggagacccagatcattactggcagcgacgaatcctgccgcaaagacctggtgaaaaacgaggagctagagatacaggagaagcagaaacagtccgacataaggccttcacccggagacagctccgtgctgcagcaggagtcaaattttctaggcaacaatcacagcgaagagtgccaggtgggcggtctcgtagcgtttgagccacacgcactcgagggtgaggggccacagaacccagaggagactgatgagaaagtggaggagcccgagcagcagaacaagagttctgccgtgggccctccggaaaaggtccgccgttttacgttggaccggctgaagcaattgggcgtggatgtctccatcaaaccgaggctgggcgcagacgaggattcatttgttatccttgaacccgagacgaacagggagctggaggccctgaaacagaggttttggaaacatgccaatccggctgctaagcccagggcgggtcagaccgtcaacgtgaatgttatcgtcaaagatatggggactgacggcaaagaggagctgaaggccgatgtggtgcccgtaacattggcccctaaaaagctggatggggcttcacatactaagccgggagaaaaactgcaggttttaaaggcaaaactgcaggaggcaatgaaactgcgaaggtttgaggagaggcagaagagacaggccctgttcaaattagataacgaggacggcttcgaagaggaggaggaagaggaagaggagatgaccgatgaatccgaagaagacggcgaagagaaagtagagaaagaagaaaaagaggaggagttagaagaggaagaggaaaaggaggaggaagaggaagaagaaggcaatcaggaaaccgctgagttcttactaagctctgaagaaattgagacgaaggacgagaaggagatggataaggaaaataacgacggatcatcagagattggcaaggcagtcgggttccttagcgttccaaagagtcttagctcggattcaaccctactgctgtttaaagatagcagctctaaaatgggctacttccccacagaggagaaatccgaaacagatgagaattcaggcaagcagccttctaaattggatgaagacgattcctgttcccttttgaccaaggaaagcagtcataacagttcgtttgagctgattggctctactattccatcttaccagccctgcaatcgtcagaccgggagaggcacatcattttttccaacagctggtgggttccgttcgccatccccagggttgtttcgcgctagcctcgtgtccagcgcctcaaagtccagtggtaagctatccgagccctctttacctattgaggatagtcaggacctgtataacgcatccccggagcccaagacattatttctgggggctggcgattttcagttttgtctggaagatgatacacagtctcagttgttagatgccgatggatttctgaatgtccggaatcacaggaaccaatatcaagccctgaagccccgacttcctttagcctcaatggatgaaaacgccatggatgccaacatggatgagctgctagatttatgcaccggcaagtttacttcccaggcagaaaaacacctccctcggaagtccgataaaaaggagaatatggaagaactgcttaacttatgttctggtaagtttactagccaggatgcttccacgccagctagctcagagttgaataaacaggagaaggaatcatctatgggagatcctatggaggaagcactggcactatgttccggctcatttccgactgataaggaggaggaggatgaggaagaggaatttggcgacttccggctggtttcgaacgacaacgagttcgacagtgatgaagatgagcactctgacagtggtaacgatctggctctggaagaccatgaggacgatgacgaggaggagctgcttaaacgctccgagaagctgaaacgccagatgaggctccggaagtacttggaagacgaggccgaggtgtccggaagcgatgtcggctccgaggatgagtatgacggcgaggaaattgatgaatacgaagaggatgtgatcgatgaggtcttgccctctgatgaggaacttcagagtcagattaagaagattcacatgaagactatgcttgacgatgataaacgtcagctgcgcctctatcaggaacgctacctagctgacggcgacctgcacagcgacgggccaggcagaatgcggaaatttcgatggaagaacattgatgacgccagccagatggatctcttccacagggattctgatgatgaccagactgaggaacagctagacgaatccgaagcaagatggcgcaaagaaaggatcgagcgcgaacagtggctacgagatatggctcaacagggtaagatcacagcagaggaggaagaagagatcggggaggactcacagtttatgatactggctaaaaaggtcaccgccaaggccctccagaagaacgcatcccggccaatggtgatccaggagtccaaatccctactgaggaaccccttcgaagccatcagacctggcagtgcccagcaggtgaagaccgggtcactgttgaaccaaccaaaggccgtgcttcagaagctcgccgctctcagcgatcataatccctcggccccacgcaactcccggaatttcgttttccacacacttagcccagtgaaggccgaagcggctaaggaatcctccaagagccagaagatccccgagaaagattctgattggctgacctggtccggagcccctattccgggattttttcgcctgtcatttgacccccatggatag

SEQ ID NO: 22616 - DNA, 4020 bp, Artificial Sequence
  Description of Artificial Sequence: Synthetic coding sequence
atgacaggcgaggtgggtagtgaggtgcatctggaaatcaatgatccaaacgttatctcacaggaggaggccgattccccctccgatagtggccaggggtcctatgaaacgatcggaccactgtccgagggtgactcagatgaggagatctttgtttccaagaagctcaagaacaggaaggttctgcaggatagtgatagtgaaacggaggacaccaacgcaagtcctgagaagactacctatgatagtgcagaagaggagaataaggaaaacctgtacgctggaaagaatacaaaaatcaaacgcatctacaagaccgtcgccgatagtgacgagtcttacatggaaaagtcattataccaggagaatcttgaggcccaggtaaagccatgcctcgagctctccttacagtctgggaatagcaccgattttaccactgaccgcaaatccagtaaaaagcatattcacgataaagaaggtacggcagggaaggccaaggtcaagtccaagaggaggctcgagaaggaggagaggaagatggaaaaaattcgtcagctgaaaaagaaggagactaaaaaccaggaagacgacgtggagcagccattcaacgatagcgggtgcctcctggtggataaggatttattcgaaacaggcctggaggatgaaaacaattcgcccctggaagatgaggagagccttgagagtatccgggcagccgttaaaaacaaagtgaagaaacataagaaaaaagagcccagccttgaatcaggcgtgcattccttcgaagaggggagcgagctgtccaaagggaccacacgcaaggagcgaaaagctgccaggctgtccaaggaggccctaaaacaattgcatagtgagacgcagaggcttatccgcgaatccgccctcaatttaccctaccatatgcccgagaataaaactatccacgatttcttcaagcgaaagcccaggcctacctgtcacgggaacgcgatggcactgcttaagtcctcaaaataccagagtagtcatcacaaggaaatcatcgacaccgctaacacaacagagatgaatagtgaccaccatagtaaaggttccgagcaaacaactggggcagaaaatgaagtcgaaacaaatgctctacccgtggttagtaaagagacccagatcatcaccggctccgatgagagctgtcgcaaagacctggtgaagaatgaggaacttgagatccaggagaagcagaagcagagcgatattaggccaagccccggtgatagcagcgtgctgcaacaagagtcaaatttcctggggaataatcacagcgaagagtgtcaagtcggtggcctcgttgcgtttgaaccacacgcacttgagggggagggacctcagaaccctgaagaaactgatgagaaggtcgaggagcctgagcagcaaaataagtcttccgccgtaggcccacctgagaaggtgcgcaggttcaccctcgatcgcctgaagcaactgggcgtggatgtgtctatcaaacctagactaggagcagatgaggactcgttcgtgattctggaacctgaaaccaatcgggagctagaagccctaaagcagagattctggaaacatgccaaccctgccgctaagcccagggcaggccagaccgtaaatgtgaacgtaatcgtaaaggacatgggaactgacggcaaagaagaactgaaagcagacgtggtgccagtgacccttgctccaaagaagctggatggagccagtcacacaaagcctggcgaaaagctacaagtcctgaaggcgaaacttcaagaggcaatgaaactgagacggttcgaggaaaggcagaagcggcaggcactctttaagttagacaacgaagacggcttcgaggaggaggaagaggaggaagaggagatgaccgacgagtctgaggaagacggtgaggaaaaagttgagaaggaggagaaggaagaggaactagaggaggaggaagaaaaggaggaggaggaggaagaagaaggaaatcaggagaccgctgagttcttgctgtcatccgaggaaatcgagaccaaggatgagaaggagatggacaaggaaaacaacgatggctcttcggagataggaaaggcggtgggatttctgagtgtgcccaagtcactctctagtgacagcaccctcctcttattcaaggatagtagcagtaagatggggtactttcccactgaagagaaaagcgaaactgacgagaatagcggaaaacagccgagcaagctggatgaggatgacagttgtagtctgcttacaaaggagagttcacataattcaagctttgagctcattggctcgactatcccctcgtatcagccttgtaatagacaaacaggcaggggcacatcatttttccctacagcgggaggctttcgctctccaagcccaggcctgtttcgcgcaagtttagtctctagcgccagtaaatcctctggaaagctatccgagccctctctccccatcgaggacagtcaggatctgtacaacgcctccccggagccaaaaacactgttcctaggtgcgggtgacttccaattttgcctggaagatgacacccagtcacaactgctcgacgctgacggtttccttaatgtgcgcaaccaccgaaatcaataccaggcccttaaaccacggctgcccctggccagtatggacgagaacgccatggacgccaatatggacgaactcttggacctgtgcaccggtaaattcacgtctcaggccgagaaacaccttccaagaaagtccgataagaaggaaaacatggaggaacttctgaacctttgctcagggaaattcaccagccaggacgcttcgaccccagcttcttccgagctgaacaagcaggagaaggagtctagcatgggggaccctatggaggaggcactcgcactgtgtagcggcagcttcccgaccgacaaagaggaggaggatgaagaggaggaattcggggattttaggctggtctcaaacgacaatgagttcgatagtgatgaagacgagcactcggatagtggaaatgacttggctttagaggatcacgaagatgatgacgaagaggagctgctgaagcgcagcgagaagttaaagcgccagatgagactgcgaaagtatctggaggacgaagcagaagtgtcgggcagtgacgtcggtagtgaagacgagtatgacggcgaagagatcgacgaatatgaggaagacgtgatcgatgaggtgctaccatctgatgaggagctgcaatcccagatcaaaaaaatccacatgaaaacaatgcttgacgatgataaaagacagctccggctataccaggaaaggtacctagctgacggcgacctgcactccgatgggccagggcgtatgcgcaaattcagatggaagaatattgatgacgcatcccagatggacctgtttcacagggattctgacgatgaccagacagaggaacagctggatgaaagtgaagccaggtggcggaaagagaggattgaaagggagcagtggctccgcgatatggcccaacagggcaagatcacagccgaggaggaggaagagatcggggaggattcccagtttatgatcctcgccaaaaaagtgaccgcgaaagctctccagaagaacgcttcccgtcccatggtgattcaggaaagcaagagtctcctgagaaaccccttcgaggccatacggccagggtccgctcaacaggttaagacaggatcccttttgaaccagcccaaagcagtgcttcaaaaacttgctgcactttctgatcataatccgtctgcgccacgtaattcacgcaactttgtctttcacacattaagtccagtgaaggctgaggcagccaaagaatcatccaaatcccaggtgaagaagcgcggacccagtttcatgacaagtccatcccctaagcacctgaaaaccgacgatagtacctccggcttgacgcgatcaatctttaagtatcttgagagctag

SEQ ID NO: 22617 - DNA, 3828 bp, Artificial Sequence
  Description of Artificial Sequence: Synthetic coding sequence
atgactggagaggtggggagcgaggtgcacctagaaatcaatgaccccaacgtgatttcacaggaagaggccgatagcccttcagactccggacagggtagttacgagaccatcggtcccctttccgagggcgactctgacgaagaaatttttgtatctaaaaaacttaagaatcgtaaggtattgcaggactctgacagcgagacagaggacactaacgcttctcctgagaaaacaacctatgattctgcagaagaggaaaataaggaaaacctatacgcgggaaagaacacgaagattaagaggatctacaaaacggtcgccgactcagacgaaagctacatggagaagagtctatatcaggaaaatttagaagctcaggtcaaaccatgtctagaattatctctgcagagcggcaactctacagatttcactacggatcggaaatcatccaagaaacacatccacgataaagaaggcacggcgggtaaagccaaggtgaagagcaagcgtcggctggaaaaggaggagagaaagatggagaagataagacagctcaaaaagaaagaaacaaagaaccaagaggacgatgttgagcagcccttcaatgactctggctgcttgctggttgacaaggatcttttcgaaacaggcctggaggacgaaaataattctcctctggaggatgaagagagtcttgaaagcattcgcgctgcggtaaagaacaaagtcaaaaaacacaaaaagaaggaaccttcgctcgagtccggcgttcattcctttgaggaggggtctgagttgtctaaaggaactacacgtaaggagaggaaggcagccagactgagcaaagaagccctcaaacagctccattctgaaacgcagagactcatcagggaaagcgccttaaatctcccataccacatgccggagaataagactattcatgattttttcaaacgaaagcctcgcccaacctgccacggaaatgcaatggccttgcttaagtcttccaagtaccagagcagtcaccacaaagagattattgacaccgcaaacacaaccgagatgaactccgaccaccactctaaaggaagtgagcagaccactggtgccgaaaacgaagtcgagacaaatgctcttccagttgtctccaaagagacccagatcatcacagggagcgacgagagttgcagaaaggatttagtgaagaacgaagagctggagatccaggagaaacagaagcaaagtgatatccgacccagtcctggtgattcaagcgtgctgcagcaggagtccaacttcctgggcaacaaccactctgaagaatgccaggtcggcggtctggtggcatttgagcctcacgctctggaaggtgaaggccctcagaaccctgaggaaactgacgagaaggttgaggaaccagagcagcagaacaaatcaagtgccgtcggtcccccagagaaagtgcggcgatttacacttgaccgcttaaaacagctcggcgtcgatgtatctatcaaacctcggttaggcgcagatgaagactctttcgttattctcgaacctgaaactaatcggggagaaaagcttcaggttctcaaagccaagttacaagaagccatgaagctcaggagattcgaggagagacagaaaagacaggccctgttcaaattggataacgaggacgggtttgaggaagaggaggaagaggaggaagaaatgactgacgagagcgaggaagacggcgaggaaaaggtggaaaaggaagagaaggaggaggaactggaggaggaggaagaaaaagaagaggaggaggaagaggaggggaatcaggagaccgccgagttcctcttgtcctccgaggaaattgaaacgaaggacgagaaagagatggacaaagagaataacgacggctcctctgaaattggaaaagctgtagggttccttagcgtgcctaagtcgctgagttctgattccactcttctcctgtttaaggactcatcctccaaaatgggctacttccctacagaggaaaaaagcgagacggacgaaaacagtggcaaacagcccagtaagcttgatgaggatgactcttgttcgcttctgactaaggaatcctcacataactcaagcttcgagctgatcggtagcaccataccctcatatcaaccctgcaaccgccagacaggtagggggacttcatttttccctacggcaggtggcttccgcagccccagccccggactgtttcgagcttctctggttagttccgccagtaaatcgtctggaaagctgtccgagccctcccttcctattgaagactcccaagacctctataatgctagcccggaacccaagaccttgttcttgggggcaggcgattttcagttttgcttggaagacgatacacagtcccagctgttggatgccgacggctttctaaacgtcagaaaccaccggaaccaataccaggcactgaagcctcggctccccctagcctcgatggacgaaaacgccatggacgccaacatggacgagctgttagatctctgtacaggaaaatttacctcacaggcagagaaacatctgccacgcaagagcgataagaaggaaaatatggaggaactgctcaacctgtgttctggaaaatttacgtctcaggacgctagtacccccgcttccagtgagcttaacaaacaggagaaagagagttcaatgggtgaccccatggaggaggctctcgcactgtgctccggatccttcccaacggataaggaggaagaggatgaggaagaagagttcggggatttcagattggtgtccaatgataatgaatttgatagcgatgaggatgaacatagcgactccggaaacgacttggcgttggaagaccacgaagacgatgacgaggaagaacttctgaagaggtcagaaaagctgaaacgccagatgcggctaaggaagtatctcgaagatgaagccgaggtgtcagggagcgacgtgggaagcgaggatgagtacgatggggaagagatcgatgaatatgaggaggacgtgattgatgaagtgttgccctcggacgaagagttgcaaagtcagatcaagaagatacatatgaaaactatgctcgacgatgataaacggcagcttcgattatatcaggaacgctatctggccgacggtgatctgcactcggatgggcctggacgaatgcgcaagttccggtggaagaacattgatgatgctagccagatggacctgtttcaccgggactcggacgacgaccagacagaggagcagttggatgagtccgaagcaagatggcggaaggagcggatagaacgagaacagtggcttcgtgatatggcccagcaggggaagatcacggcggaggaggaagaagaaatcggggaagacagccagttcatgattcttgctaagaaagtgactgctaaggccttgcagaaaaatgcttctagaccaatggtgattcaggagagcaaaagcctgctccgcaacccctttgaggctattcgccctggaagtgcccaacaggtgaaaaccggttcactgctaaaccagcccaaagccgttcttcagaagctggccgctctctcagaccataatccctccgcccctaggaacagcagaaacttcgtctttcacacactgtcgcccgttaaggctgaagccgctaaggaaagctccaagtcacaagtcaaaaagcgagggccttctttcatgaccagcccctccccaaaacaccttaaaactgacgatagtacgtccggactgactagatccatcttcaaatacctagaatcatag

SEQ ID NO: 22618 - DNA, 1977 bp, Artificial Sequence
  Description of Artificial Sequence: Synthetic coding sequence
atgaccggggaggttggttctgaggtgcacctggagattaacgaccccaatgtgatttcacaagaggaagctgacagtccttcggatagcggccaggggtcgtatgagaccatcggaccactttctgagggggattccgacgaggagatctttgtttcaaaaaagctcaagaataggaaggtgctgcaggattcggactcagagacagaggacactaatgcgtcaccagaaaagaccacgtacgactccgctgaagaggaaaacaaggagaatctatatgccggtaagaacacaaagattaagcgtatttacaagactgtggcagacagtgacgagtcttatatggaaaaatccttgtaccaggagaatcttgaagcacaggtaaagccctgcttggagctgagtttgcaatcagggaattccactgatttcaccactgaccgaaagagtagtaagaagcatatacacgataaggagggtacagctggaaaggctaaggtgaagtccaagcgccgactcgagaaggaggagaggaaaatggagaagatcagacaattaaaaaagaaggagaccaagaaccaagaggacgatgtcgagcagccatttaacgacagcgggtgcctcctggtggataaagatttattcgaaactggactggaagatgaaaataacagtcctctggaggacgaagaatccctggagtctattagggccgctgtcaagaacaaggttaagaagcataaaaagaaagagcctagcttagaaagcggggttcactccttcgaagagggaagcgaattatcaaaaggaaccacccgcaaagagaggaaggcagccagactgagcaaagaggcgttgaagcagctgcacagcgagacacagcgcctgattagggagtccgcgctcaatctgccctatcacatgcctgagaacaaaactattcacgacttctttaagcgaaagcctcgcccaacttgtcacggaaatgccatggcccttctcaaatcaagtaaatatcagtctagccatcataaggagattatcgatacagctaacactaccgaaatgaactcagaccatcattcgaaaggttcggagcagactactggagccgaaaacgaggtagagacaaatgccctgcccgttgtctcaaaagagactcagatcattaccggctccgacgagagttgtaggaaagatttggtcaagaacgaggaattagaaatccaggaaaagcagaaacaatcggatattcgtccgtcacccggagacagctcagtgctgcagcaagagtccaactttctaggtaacaatcacagtgaggaatgccaagtgggtgggcttgttgccttcgagccccatgccctggagggggaaggaccgcagaacccagaggagactgatgagaaagtcgaagagccggagcagcagaataaatctagtgctgtaggccctccggaaaaagtgcgcagattcaccctagaccgcctcaagcagctgggtgtggacgtgtcaattaagccaaggttgggcgctgatgaggactcttttgtgattttggaacccgagaccaatcgcgagctcgaagctttgaagcagcgtttctggaaacatgccaatcccgctgcgaagccgagggcaggccaaaccgttaacgtgaacgtgattgtcaaggatatgggtacggatggcaaggaagaactgaaggctgacgtagtgcctgtgaccctggcgcctaagaagctagatggggcatcccacacaaaacctggcgagaagctgcaggtgttgaaagcgaaactacaggaggccatgaagctacggagatttgaggaaaggcagaagcgccaggcgctatttaagctggacaacgaagatggattcgaggaagaagaggaagaagaagaggaaatgaccgatgagagcgaggaggatggtgaggagaagaaaaagaagaaaaagaagaagaagaactag

SEQ ID NO: 22619 - DNA, 3393 bp, Artificial Sequence
  Description of Artificial Sequence: Synthetic coding sequence
atgaggtgcctagccccaagacccgctggttcgtatctgtcagaaccccagggtagttctcagtgtgccaccatggagcttgggccacttgaaggtgggtacttagagctcctgaatagtgatgccgaccctttatgtctgtatcatttttatgaccagatggatctggcaggagaagaggaaatcgagctgtactccgaacctgacacagataccattaactgcgaccagttctcacgccttctctgcgatatggagggcgatgaggagactagagaagcatatgccaatatcgcagagttggatcagtacgtttttcaagactctcagttagaagggcttagtaaagacatttttaagcatatcggcccagacgaggttattggggagagcatggaaatgcccgctgaggtgggccagaagtcacaaaagcggccatttcccgaagagctgcctgccgacctaaaacactggaaaccggctgagccacctactgtcgtcactggatccctgctcgtgcggcctgtaagcgattgctcaacactcccctgcctgccgctgccagccttattcaatcaggaacccgcttcaggccagatgcgccttgaaaaaaccgaccagatcccaatgccgttctctagcagctcactgagctgcttgaatctccctgagggacctattcaatttgtgccgaccatctccaccttgcctcacgggctgtggcaaatctccgaagcagggacaggtgtgtccagcatctttatctaccacggtgaggtgccacaggcctctcaagtacctcccccttcaggcttcactgtgcatggcctgcctacctcccctgacagacctggctctaccagtccttttgcccctagtgccactgacctgccatccatgccagaaccagccttaacctctcgggctaacatgactgagcacaaaacaagcccaacacagtgtcctgccgctggcgaggtatcaaataagctaccaaagtggcccgaacctgtcgagcagttttaccgatccctgcaggatacatacggagctgagccagcaggacccgacggaatactcgtggaagtcgatctcgtgcaggcaaggctggaacgctcctcatccaaaagcctcgaacgcgaattggcaacccctgactgggctgaacggcaacttgctcaggggggtttagcggaggtgttactagccgctaaggagcatcgcagacctagggagacccgcgtgattgccgtgttgggaaaagcaggccaggggaagtcatattgggccggtgcggtgtcccgggcttgggcttgcggtaggctgccacagtatgacttcgtgttcagcgtgccttgccattgcctaaacaggcctggcgacgcgtacgggctgcaggaccttcttttttccctgggcccacagcccctggttgcagcagacgaagtattctcgcatattcttaagagaccagacagagtgctgctgatcctcgatggtttcgaagaattagaggcgcaggatggtttcctgcacagcacttgcgggccagcccctgcggagccctgcagtctgagggggctcctggcgggtctgttccagaagaaactgcttcgaggctgcaccctgctgctgacagcgagacccaggggaagactagtgcagagtctgagcaaggctgatgctctcttcgagctctctggatttagtatggagcaggcccaggcctatgtgatgcgctatttcgaaagctctggtatgacagaacaccaagatcgagcgctgactttattgcgagaccgtccacttctgctctcccatagccactcccccacgctgtgccgcgcagtttgtcagctgtctgaggccctcctggagctgggggaggacgctaagctgccgtccactctgaccggactctacgtgggcctactggggcgagcggcacttgactctccgcctggagcccttgcagagctggccaaattagcctgggagctcggcagaagacaccaatccacactccaagaagatcagtttccgagtgccgatgtgaggacctgggctatggcgaaaggcctggttcagcacccccctcgggcagctgaaagtgaactagcattcccgagcttcctgctccaatgcttcctcggtgcactgtggctcgccctttcaggagagatcaaagataaagagttgccccagtatctcgccctaacacccagaaaaaagcgcccttatgacaactggctggagggcgtcccacggtttctggcaggcctgatttttcagcctccagcgagatgcttaggagcactgctggggccatctgcagccgctagcgtagataggaagcagaaggtgctggcaaggtatctgaaacggctgcagcctggaacactcagggccaggcagttactagagctgctgcattgcgctcacgaggccgaggaggcaggcatctggcagcacgtggtgcaggagttacccggtaggctgtccttcctgggcacacggttgacaccccctgatgcgcacgtgctgggcaaggccctcgaggccgctgggcaggatttttctcttgacttgcgatccacaggcatatgcccttcaggacttggctcactcgtgggcctgtcttgtgtcaccaggtttagggccgctctgtccgacacagtggccctgtgggaatctctacagcagcatggagaaacaaagttactgcaagctgcggaagaaaaatttactatcgagccatttaaggcaaagtcgctgaaagatgtcgaggacttgggaaaacttgtacagacacaacgcactcgctcctcctcggaagacacagccggtgagctgcccgcagttcgcgacttaaaaaaactcgaatttgccttaggcccagtgtcggggcctcaagccttccctaaactggtcaggatcctcacagcgttctccagcttgcagcaccttgacttggacgcgctctccgaaaataagatcggtgacgagggggtatctcagctttcagcaactttcccgcagctgaaaagtttggagacacttaacctatcccaaaacaatatcactgatctcggcgcatataaactggcagaggctcttcctagcctcgccgcatccctattgcgtctgtccttgtacaataactgtatctgcgacgtgggggcagaatccctcgctcgcgttctgccggacatggtctctctgagagtgatggatgtgcagtacaataagtttacggcggcaggagctcaacagctggccgcatcattgaggagatgcccccacgtcgagacattagctatgtggacccccacaatcccattctccgtgcaggagcaccttcaacagcaggatagtagaatctcgctgagatag

SEQ ID NO: 22620 - DNA, 1641 bp, Artificial Sequence
  Description of Artificial Sequence: Synthetic coding sequence
atgcggtgtctggctccaaggcctgccggatcctacctgtccgagccccaaggatcctctcaatgcgccaccatggagttagggcctttggaaggcggataccttgaacttttgaattctgacgccgaccccctatgcctctaccacttctatgaccagatggatctggccggtgaggaagaaatcgagctgtattcagagcccgataccgatactatcaattgtgaccagttcagcaggctactttgcgatatggagggagacgaggaaactagggaggcttatgcaaatatagcagagcttgatcagtatgtgtttcaagactcacagcttgagggactctcaaaggatatctttaagcacataggacctgatgaggtgatcggggaatctatggagatgcctgcagaagtcggccagaaatcccaaaaacgacctttcccggaggaacttcctgctgatctcaagcattggaaacccgtgccctttagctcctccagcctgagctgcctgaacctcccagagggacctattcagttcgtcccaacaattagcactctcccgcatggactgtggcagatctcagaagctgggacgggggtgtcctccatctttatctatcatggcgaggtgcctcaagcttcacaggttccaccaccctccggttttacagtccacggcctgccgaccagccccgaccggccaggctccactagccctttcgccccttcagcgacagacctcccttctatgcccgaacctgccctgaccagcagagcaaatatgaccgagcacaagaccagccctacacaatgtcccgcagccggagaggtttccaataaactccccaagtggccgggtctcgcttggtctccttgcctcggcctgagaccttccctgcaccgtgccgctttgagcgacactgtggccttgtgggagtctctgcagcagcacggggaaactaagttgctccaggccgctgaggaaaagtttaccatagaacctttcaaggcaaagtctttaaaggatgtggaggatcttggtaagctggtgcagacacagcgaactcggtcctccagcgaggacaccgccggagaattaccagcggttcgagacctcaagaagctggagttcgccttggggcctgtcagcggcccacaggcttttccaaagctggtaagaatcctcacagcctttagcagtttgcagcatctcgaccttgatgcactcagtgagaacaagatcggggatgagggtgtgagccagctttcagcaacgttcccccagttaaagagcttggagacattgaatttgtctcagaacaacatcaccgatttgggcgcttacaagcttgctgaagcacttcctagcttagccgcatcccttctgagattatccctttacaacaattgtatctgcgacgtgggggctgaatccctggctagagtactacctgacatggtcagtctaagagtgatggacgtacagtacaataagttcaccgcagctggcgctcaacagttggcagcctctctgcgcagatgtccccatgtcgaaacccttgcaatgtggacacccaccattcctttttcagtgcaggaacatctgcagcaacaagatagccgaatctccctccgctag

SEQ ID NO: 22621 - DNA, 2655 bp, Artificial Sequence
  Description of Artificial Sequence: Synthetic coding sequence
atgcgatgtctcgcgccacgtccggcaggctcttacttaagcgaacctcagggctccagtcagtgtgccacaatggaactgggccctttggaaggtggatatctcgagctgttgaattccgacgctgatcccctgtgtctgtaccacttttacgaccagatggacttggccggagaggaggagatcgaactctattctgagccagataccgacacaattaactgtgatcagttctcccggctcctgtgcgacatggaaggcgacgaagagactcgggaggcttacgccaacattgctgagctggatcagtacgtgtttcaggactctcagttagaaggtttgtccaaggatatcttcatcgagcacatcgggcctgatgaggtgatcggggaatccatggagatgcccgcagaggtcggacaaaaaagccaaaaaagacctttccccgaggaacttcctgcagacctgaagcactggaagcctgtccctttcagctcttcatcgctgagttgcctcaacctgccagagggacccattcagtttgtgcccactatttccactctgcctcatggcctgtggcaaatcagtgaggccggtaccggtgtgtcttcaatcttcatctaccacggcgaagtaccacaggccagtcaggtcccacctccctcggggtttaccgtccacgggctgccgaccagtcctgacaggcctggctcaacctcaccttttgccccatccgccacagatcttcctagcatgcctgagccagcgctgacctcaagagcgaatatgaccgaacataaaacctcccccacccagtgccctgcggcaggagaagtgtctaataaactgcccaagtggccagaacctgtggagcaattctacagatcgttacaggatacatacggtgcagagccggctggtcctgacgggatcctcgtggaagttgacctggtacaagctcgccttgaacgcagtagtagcaagagcctggaacgcgaactggccacacctgactgggccgaacgtcaactggcccagggcggactggccgaagtgctgctagccgcaaaggagcatcggcgacccagagaaacccgtgtgatcgccgtcctgggcaaggctggccagggaaaatcctactgggctggcgcagtgtcaagggcctgggcctgtggaagactcccacagtatgatttcgtgttcagtgtgccttgtcactgtctgaatcggccaggtgatgcctatggcctgcaggatttgttgtttagcctggggcctcagccactcgtggctgctgatgaggttttcagtcacattcttaagagacctgaccgggtgctcctcatcttggacggctttgaggagttggaggctcaagacggatttctacacagtacctgcggtcctgcccctgccgagccctgttccctccggggactgctcgccggactctttcagaagaaactactacgcggatgtaccctactgctaacagcacgtcctcggggaaggcttgtacagtctctgtcgaaggccgacgcgctgtttgaactaagcggttttagcatggaacaggcccaggcatacgtaatgaggtatttcgaatcctctggaatgaccgagcaccaggaccgagcgctcacgctgcttcgcgacagacctctcttactgtcccatagtcacagcccgacgctctgcagagcagtgtgccagctgtccgaggccctgcttgaattaggtgaagatgcgaagttaccatctacgcttactgggctgtatgtgggccttctgggcagagccgcactcgactctcccccaggcgcactggccgaactcgccaagctggcttgggaacttgggcgacgacatcagtctacactgcaagaggaccagtttccttcagcggacgtgcgaacatgggccatggccaagggactggttcagcacccacctcgagcagcagagtccgaactcgccttcccatcattccttctgcagtgtttcctaggcgcactgtggctagcgttgtcaggggagattaaggacaaagagttaccacagtacctggcgctcactcccaggaaaaagaggccctatgataactggcttgagggtgtgccccgttttctggccggactcatatttcagcctcctgcaagatgtctaggcgcattattgggcccatccgccgctgcctcggtggatagaaagcagaaagttctggcaaggtatctaaaacgactccaacctggtaccctccgggctcgacagctcttagaactactgcactgcgcacatgaagctgaggaggccggaatatggcaacatgttgtgcaggagctcccaggaaggctttctttcttgggaacacgactgactccacccgatgcccacgtgctaggcaaagctctggaagctgcaggccaagacttctcgttagatctgagatccacaggcatttgccccagtggattagggagcctggttggccttagctgcgtcactcgatttcggtggggcgagggtctgggccgtgacattttggtgctgggtattaactgtggactgggggcaaagcctagtgcactctggggcagttttagcatgcagtcatcacgcgtgggccagaacggattttccccatttctgcgttag

SEQ ID NO: 22622 - DNA, 1062 bp, Artificial Sequence
  Description of Artificial Sequence: Synthetic coding sequence
atgaggtgtctggctcctcgcccagctggatcctacctttcagagccccaaggcagttcacagtgcgccacaatggaactaggaccactcgaggggggttacctggaactcctgaacagtgatgccgatcctctgtgtctttaccatttttacgatcagatggacctggctggcgaggaagagatcgaactgtattcagaacccgacaccgatacaatcaactgtgatcagttctcacggcttctttgtgacatggaaggggatgaggaaacccgggaggcctatgccaatatcgctgaattggaccagtatgtctttcaggattctcaactcgaagggctgagtaaagatattttcaagcatatcgggccagacgaagtcatcggcgaaagcatggaaatgcccgctgaagtgggtcagaaatctcagaagcgcccattccctgaggaactccctgccgacttgaagcactggaaaccggcagagcccccaaccgtggtgactggatcgttgctggtccgacctgtctccgactgcagtaccttaccttgtctgcccttaccggcattattcaatcaggagccggctagcggccagatgagattggagaagactgatcagattccaatgcctttctctagtagctccttaagttgtctgaacctgcctgagggacccatccagtttgttcctactatcagcacactgccacacggtctgtggcagatctcagaggcaggcactggggtctctagtatcttcatctaccatggcgaggttcctcaggcctctcaagtgccacctccctccggttttaccgtgcacgggctccccacctcccccgatcggcctggaagcacatcccctttcgcacccagtgccactgatctaccttccatgccagagcctgccctgacctcccgagccaacatgacagagcataagacctccccaacacagtgccctgctgccggtgaggtgagcaacaagctgccgaaatggccaggacgggaggtccctcgaaagactcagttaggaagcagcctcttattcggaacctag

SEQ ID NO: 22623 - DNA, 4332 bp, Artificial Sequence
  Description of Artificial Sequence: Synthetic coding sequence
atgtacgctgtctataagcaggctcacccaccaacaggccttgagttcagcatgtactgcaatttctttaataactcagagcgaaacctggtcgtagccggaacgtctcagctgtacgtgtatcggctcaaccgggacgctgaggccctgacaaaaaacgacaggtctaccgaaggcaaggctcacagggagaaactagagcttgccgcatctttttctttttttggcaatgtcatgtctatggcatccgtgcagttagctggcgctaagcgggatgctctgctgctgtcttttaaggacgccaagttgtcagtggtggagtacgaccctggaacgcacgacttaaagaccctgtcattgcactacttcgaagaacctgaactgcgggatggatttgtccagaatgtccacaccccaagggtgcgagttgatcctgatggtcgctgcgccgcaatgctggtgtacgggacgcgcctggtggtattgccgttccggcgtgaaagtcttgctgaggagcacgagggacttgtgggagagggccagcggtcctcttttttgcccagttacatcatcgatgtcagagctttggacgagaagctgctcaatattatcgacctgcagtttctccatggatattacgagcccacattgctgatactgtttgaaccgaaccaaacatggccaggacgcgtggctgtgagacaggacacctgtagtatagtggctatctctctcaacataacccagaaagtgcacccggtcatctggtcacttaccagtctaccattcgattgcacacaggctctggcagtgcccaaaccaattgggggagtagtggtgtttgccgtcaactccctcctctacctaaaccagagcgtacccccttacggcgtggctctgaacagcctgactacaggcaccactgccttcccactgcggacccaggagggcgtccgaataactttagattgtgcacaagcaacatttatttcatacgacaagatggtgatcagcctgaaaggcggagaaatttacgtgctaactctgatcacagatggaatgcgctctgtgcgcgcttttcatttcgacaaagccgcagcgagtgtactaacaacatctatggtcaccatggagccaggatacctattccttggatcccggttgggcaactcactgctgctcaaatatactgaaaagttacaggagccccctgcaagtgcggtgagagaggccgcagataaggaagaacccccttcgaagaaaaaacgtgtcgacgctacagcgggttggtccgctgctggcaagagtgtccctcaggacgaggtggatgaaatcgaagtctatggatcggaagctcagagtggtactcagctcgcaacgtactcatttgaagtttgtgacagtatcttgaacatcggcccatgtgcaaatgctgctgtgggggagcctgccttcctaagcgaggaattccaaaattccccagagccagacctggagattgtcgtatgctccggccacgggaagaacggggctttgagcgtcctgcagaaatctattaggcctcaagtggtgaccacattcgaactccccggatgctatgatatgtggacggtgatcgctccggtgcgcaaggaggaagaagataacccaaagggagagggaaccgagcaggaaccatccaccactcctgaagccgatgacgacgggcgacgtcacgggttcctcatcttgagcagggaagactcaacgatgatcctacagactggccaggagattatggaactagacacatcggggttcgcaacacaggggccaacagtgtttgccggaaatatcggagataacaggtacattgtacaggtcagcccccttggcattaggctgctggaaggtgtaaatcaattgcacttcattccagtggatctgggagcaccgatcgtccagtgcgcagtggcagatccatatgtggtgatcatgtctgcagaaggacacgtgactatgttcctgcttaagagcgactcttatggcggtcgacaccacaggcttgctctccacaaaccccctctccatcatcagtccaaggtgatcaccctgtgtctttatagagatctcagcggaatgtttactaccgagtctcgcctgggtggggcaagggatgaactggggggacggagcggaccagaggccgagggtttgggctcagaaacctccccaactgtggatgatgaggaggagatgttgtacggggactcggggtcacttttctccccctcaaaggaagaggccagacggtcatcccaacctcctgccgaccgcgatccggcacctttcagggctgaacctacacactggtgccttctcgtgcgggagaatggcactatggaaatttaccagctacccgactggcgtcttgttttcttagtgaaaaatttcccggtgggtcaacgtgtattggtggactctagcttcggacaacccacgacacagggtgaggctagacgggaggaggcgacgcggcagggggaattgcctctggtgaaggaagttctcctcgttgccctgggtagcagacagagccggccatacctgctcgtgcacgtggaccaagagctcctgatctatgaagccttccctcacgattctcagctgggtcaaggaaacctgaaagtacggttcaagaaagttccccacaacattaatttccgcgagaagaaacccaagccatcgaaaaagaaggccgaaggcggtggagctgaggagggcgctggtgccagaggacgcgtagcacgatttaggtacttcgaggatatctatggatattccggggtattcatttgcggaccaagccctcattggctcctggttaccgggagaggcgcactaagactacaccctatggcaatcgacggccctgttgactctttcgccccttttcacaatgtaaactgtccgagggggtttctctactttaaccggcaaggagaattgcggattagcgttctccccgcttacctgtcatacgacgccccttggcccgtgcgcaaaatcccgctccgatgcaccgcgcactatgtcgcatatcacgtggagtctaaggtatatgcggttgccacaagcacaaataccccttgtgccaggatccccagaatgacaggcgaagagaaagagttcgagaccatagaacgcgatgagcggtatattcatccacaacaagaggcattttccattcagctcattagcccagtgtcttgggaagcaatcccaaacgccagaatcgaactccaagagtgggaacacgtgacttgcatgaaaactgtgagcctgcgatcagaagagacagtgtctggactgaaaggctatgtggctgccggaacctgccttatgcagggggaagaagtgacttgtagagggaggatactgatcatggatgtgatagaagtcgtccccgagccagggcagccactgaccaagaacaagttcaaggtgctgtatgagaaagagcaaaaggggccagtgaccgctttgtgccattgtaatggacatctagtgagcgcaatcggccagaaaatattcttgtggtcacttcgggctagtgaattgaccggaatggcttttattgatacgcagctctacattcaccagatgattagcgtcaagaacttcatattggccgcagatgtgatgaagtcaatcagtctcctccgttaccaggaggagtctaaaaccctaagtctcgtttcgagggacgccaagcccctggaggtctacagcgtcgacttcatggtggacaacgctcagcttgggtttttagtgtcagacagggacagaaacctcatggtttacatgtatctgccagaggccaaggagtcatttggtgggatgcggctactgagacgggcagatttccacgtgggtgcccacgttaacacattctggaggaccccgtgccggggagcaactgagggcttgtcaaagaagtccgtcgtgtgggaaaataaacacattacatggttcgcaacactggacggcggtatagggcttctactcccaatgcaagaaaaaacttataggaggcttctgatgttgcagaatgctctcaccaccatgctgccgcatcatgccggactgaatccgcgtgcatttcggatgctccacgtggataggcgtactctgcagaacgctgttaggaatgtcctggacggagagttactaaaccgatatctgtatcttagcactatggagcggtcggaattagccaagaagataggcaccacacctgacattatcttagacgacctgctggaaacagacagagttaccgcccacttttag

SEQ ID NO: 22624 - DNA, 2349 bp, Artificial Sequence
  Description of Artificial Sequence: Synthetic coding sequence
atgacaagcatcattaaacttactaccctgtctggggttcaggaggaatcagcactgtgctacctcctgcaggttgacgaatttcggttcttgttagattgtggctgggatgagcatttctccatggacatcattgacagcctgcgcaagcatgtgcaccaaatagatgcagtgcttttatcccaccccgacccactgcatttaggcgctttgccctacgctgtgggcaagctggggctgaactgtgctatttacgcgacaatccccgtctataaaatgggccagatgtttatgtacgatctgtatcagtcccgccataacaccgaggactttaccttgtttaccttggacgacgtcgatgctgcatttgacaagatccaacagctgaaattctcccagatcgtcaatctgaaaggaaagggacatgggctctcaataacccctttgccagcaggccacatgattggcggaaccatctggaagatcgtcaaagatggagaggaagagattgtgtatgcggtggatttcaaccataaacgggaaattcatctgaatggctgctcactagaaatgctcagtcgaccatctctgcttataacagattccttcaacgctacttacgtgcagccccgacgaaaacaaagagacgagcagctcctaactaacgtgctggaaacattgcgcggtgacggtaacgttttgatagccgtggatactgcagggagagtgctggagcttgcgcagttacttgaccagatctggcggactaaggacgctggcctgggtgtgtattccctcgcattgctcaataacgtgtcttacaacgtggttgaattcagtaaatcacaggtggaatggatgtctgacaagctgatgagatgttttgaagataaaaggaacaaccctttccagttccggcatctgtcactgtgtcacggactttctgacctggcacgggtcccttcacccaaagtggtcctcgcttcccagccggatctggagtgtggattttctagggacctcttcatccagtggtgccaagatcccaaaaattctatcatcctaacataccgaacaactccaggtactctagcgaggtttttgatagataacccaagcgaaaaaattaccgaaattgaacttagaaaaagagtgaagctggaagggaaggaattggaagaataccttgaaaaggaaaaactgaaaaaggaagcagcgaagaaactcgaacagtccaaagaagccgacatagactcttcagacgagtctgacattgaagaggatattgatcagccatcagcacataagacaaagcacgacctgatgatgaagggagaaggatcaaggaaaggcagctttttcaaacaggccaagaaatcatatcccatgtttcccgctccggaggagcgaattaagtgggacgagtacggtgagattatcaagcccgaagatttcttggttcctgaactgcaggccaccgaggaagaaaagtctaagctggagagtggtctcacgaatggtgatgagccaatggaccaggatctctcagacgtgccaactaaatgcatatctacaaccgagagcatcgagattaaggccagggtgacatatatcgattatgaaggcagatcagacggtgacagtatcaagaaaattatcaatcaaatgaagccaagacagctcattattgttcatgggcctcctgaggcaagtcaagacctggccgagtgttgtagagcctttgggggtaaggatataaaggtatatatgcccaaattacacgagaccgtcgacgccacgtccgagacgcacatttaccaggtacgactgaaagattcgttagtgagctccctccagttttgcaaagccaaggatgcagagctggcatggatcgatggcgtgttagacatgagggtatcgaaagtggacaccggcgtgattttggaagagggagagctgaaggatgacggcgaggacagtgaaatgcaggtggaggcgcctagcgattccagtgtgattgcccaacaaaaggccatgaagtccctctttggagacgatgagaaggaaacaggggaagaaagtgagatcatacccacgctcgagcccctgccaccccacgaagtacccggtcatcaatctgtattcatgaatgagccgaggttgagcgactttaagcaggtactcctaagagaagggatccaggctgagttcgtagggggagtgttagtgtgtaataatcaggtggcagtgcggaggacggagacagggaggattgggctcgagggatgcctgtgccaggatttctacagaattagagatctgctttacgagcagtatgcaattgtctag

SEQ ID NO: 22625 - DNA, 243 bp, Artificial Sequence
  Description of Artificial Sequence: Synthetic coding sequence
atgaccagtattatcaaactgactactctttctggcgtgcaagaagagagcgccctttgttatctcttacaagttgatgaattcagattcctccttgattgcggatgggatgagcacttttctatggatattattgacagcctgcggaagcacgtgcaccagatcgacgcagtattgctcagccacccggaccccctgcatctcggtgcactcccgtacgccgtcggaaagctgggactctag

SEQ ID NO: 22626 - DNA, 2055 bp, Artificial Sequence
  Description of Artificial Sequence: Synthetic coding sequence
atgtccgcgatccctgcagaggaaagtgatcagctactgatcaggcctcttggcgctgggcaggaagtgggacgaagttgcatcattctggagtttaagggccgtaaaattatgcttgactgcggaatccatcccggtctggagggtatggacgcgctcccgtatattgacttaattgaccccgctgagatcgatttactcctaatcagtcacttccaccttgatcattgcggggcattgccctggtttctgcagaaaacaagcttcaagggacgcaccttcatgacccacgcaacgaaggcgatctatcgatggctgttgtccgactacgtgaaagtatcaaacatctcagcagacgatatgttatacactgagaccgacctggaagagtccatggacaaaatcgagactattaatttccatgaagtcaaagaagtggccggtatcaaattttggtgttaccacgcgggacacgtgctgggagctgccatgtttatgatcgagatcgctggcgttaagctgctctacactggggacttttcacggcaggaggatcggcacctcatggcggctgaaattccaaacatcaagcctgacattttgatcatagagtctacttatggcactcatattcacgagaagcgtgaagaacgcgaagctaggttctgtaacactgtccatgacatcgtgaacagaggagggcgaggcctgatccccgtctttgctctgggtcgggcacaggagctgctcctaattctggacgaatattggcaaaaccaccccgaactgcatgatattcccatatattatgcctccagcctggctaaaaaatgcatggctgtctatcagacatacgtgaacgccatgaatgataagatacggaagcagatcaatataaacaatccattcgtgtttaagcacatttcgaatctcaaaagtatggatcatttcgacgacatcgggcctagtgttgttatggcatcccctggaatgatgcagtccggactgtcacgtgaacttttcgagagctggtgcactgataagcgtaatggcgttataatcgcaggatactgtgtggaggggacactcgcaaagcacattatgtccgaaccggaggaaatcacaaccatgtccggccagaagctacccctgaagatgtcagtcgactacatcagttttagcgctcataccgactatcagcagacctctgagttcattagagctcttaaaccccctcacgtaatcctggtacacggggagcaaaatgagatggccaggctaaaggccgctctgattcgcgagtatgaggacaacgatgaagttcacatagaggtacataacccacgtaatactgaggccgtcaccctaaattttagaggggagaaactcgcaaaggttatgggctttctcgctgacaagaagcctgaacagggccaaagagtgagcggaatcctcgtaaaaaggaactttaactaccatatcctgtccccctgtgatttgtccaattataccgacctggccatgtctacagtgaagcaaacccaagcaataccttacacgggcccattcaacctgttatgctatcagctgcagaagttaactggcgatgtggaagaactggagatacaggaaaaacctgccttgaaagtgttcaaaaatatcactgttatccaagagcccggaatggtggttctagagtggcttgctaacccctcgaacgatatgtacgccgacacagtgactacagtcattctcgaagtgcagagcaatccaaagattaggaaaggagctgtgcagaaggttagcaagaaattagagatgcatgtttactctaaacgacttgagataatgctccaggatatctttggagaggactgtgtctcagtgaaggatgattccatccttagtgtcactgtcgatggaaaaaccgctaacttgaatctggaaacacgaacagttgaatgcgaagagggcagcgaagatgatgagtcattacgtgaaatggtggagctcgccgctcagcggttgtatgaggccctcaccccagttcattag

SEQ ID NO: 22627 - DNA, 1641 bp, Artificial Sequence
  Description of Artificial Sequence: Synthetic coding sequence
atgagtgccatacctgccgaggagagcgaccagctcctgattagacctctcggggcaggtcaagaggttgggaggtcatgtattatcctggagtttaagggaagaaaaattatgctggactgtggaatccatcctgggctggaaggaatggacgccctaccatacattgatttgatcgatccggcagagattgatctcctgctgatctcccattttcatctcgaccattgcggggcactgccttggttcctgcagaagacaagctttaagggcaggactttcatgactcatgccacaaaggctatatataggtggcttctgagtgattatgtgaaggtctcgaatatttccgccgacgacatgttgtatactgaaaccgatctggaagagagcatggataagatcgagacaatcaatttccatgaggtgaaagaagtagccggaatcaagttttggtgttaccatgccggacacgtgctaggtgccgctatgtttatgattgaaatagctggcgtcaaactcctgtacactggcgatttttctcgccaggaggatcgacacttaatggcggcagagatcccaaacatcaagcctgatattctgatcatcgaaagtacttatggcacccacattcatgaaaaacgggaggaacgggaggctcgattttgcaacaccgttcatgatattgtcaatcgcggaggccgtggcctgatccctgtgttcgcgttgggccgagcgcaagagttgctgctgatactagacgaatactggcaaaaccaccctgaactgcacgacattcccatctactacgcttcctcgctggccaaaaagtgcatggcagtctatcagacttacgttaatgcgatgaatgacaaaatccggaagcagataaatataaataatccctttgtctttaagcacattagtaatctgaagtccatggaccactttgatgacatcgggccttccgtggttatggccagtcccggtatgatgcagtcagggctatctcgcgagttgttcgagagttggtgcacagataagcggaatggagtgatcatcgccggttattgcgttgaaggaaccttagccaaaatattggtgcacggcgaacagaacgagatggccaggctcaaggccgctctcatacgcgagtacgaagataacgacgaggtgcacatcgaggtgcacaacccgagaaacacggaagcagtcaccctaaatttccgaggtgaaaagttagcgaaagtgatgggcttccttgctgataagaagccagagcaagggcagcgagtgtctggtatcctggtcaaaaggaattttaattaccatattctgtccccctgcgatctcagtaattataccgatctggcgatgagtactgttaaacaaactcaagccatcccctacaccggaccatttaacctactgtgttaccagctacagaaactgactggtgacgtcgaagaactggaaatccaggaaaagccggcacttaaagtgttcaagaatataaccgtcatccaagaacctggaatggtggttctcgagtggcttgcaaacccctcgaatgacatgtatgctgacactgtgacaaccgtgattttggaagtgcagtcaaaccccaaaatcagaaaatag

SEQ ID NO: 22628 - DNA, 1221 bp, Artificial Sequence
  Description of Artificial Sequence: Synthetic coding sequence
atggcagtctaccagacctacgttaacgcaatgaatgataaaatccggaaacaaataaacatcaacaacccattcgttttcaaacacatttcaaatctcaagtccatggaccactttgatgacatcggcccatccgtcgtcatggcctcccctggaatgatgcagtcaggcctgagccgggaactgtttgagtcttggtgcactgacaaacgcaacggagttatcatcgccggatattgcgtagagggaacactggccaaacacattatgtctgagccagaggaaattacgacaatgtccggtcagaaactacccttaaagatgagcgtcgactatataagctttagtgctcacactgattaccaacagactagcgaatttattagggcgttgaaaccgcctcacgtcatattagtgcatggtgagcagaacgaaatggcccgactcaaagctgccctgattcgggaatacgaggacaacgacgaggtccatattgaggtgcacaaccctcggaacaccgaagcagtgaccctcaatttcaggggggagaagctcgccaaggttatgggctttttggccgacaagaagcctgagcaggggcaaagggtcagcggaattttagtcaagcgcaatttcaactatcacatcctctctccttgtgatctgtcgaattatactgacctggccatgagtacggtgaagcaaacacaggcgattccttataccggacctttcaatttgctctgctaccaactgcagaaactaacaggggacgtcgaagagctggaaatccaggaaaaaccggctcttaaggtgttcaagaacatcaccgtgatccaggagcctggcatggtggtgctggaatggctcgccaatccctctaacgacatgtatgccgacaccgtcactaccgtaatcctggaggtccagagtaatcccaaaatccgcaagggagctgtgcagaaggtgtccaagaagctagaaatgcacgtgtattcgaagaggctggaaataatgctgcaagacatctttggcgaggactgtgtcagcgtgaaggacgacagtatcctgagtgtgacagtggatgggaaaaccgctaatctgaatctggaaacaaggacagtggagtgtgaggaggggtcagaagatgacgaaagtttgagagagatggtcgagttagccgctcaaaggctgtacgaagcactcactcctgtccattag

SEQ ID NO: 22629 - DNA, 1545 bp, Artificial Sequence
  Description of Artificial Sequence: Synthetic coding sequence
atgggccgtccagaaagtgctggaggtgggagccgcggaccgttcgagggaggagggcgtgctcgcagagccggaggtattttcctgacactcagcatcctgcgaacacgcgatttacctagcggagcaatgagtgagggggtcgacctgattgacatatacgccgacgaagagttcaaccaggatcctgagtttaataatacagaccagatcgacctctacgatgatgtattgacggccacctcccagccatctgatgatcggagttcaagcaccgagccgccaccacccgttcgtcaggagccaagtcccaagccaaataataagaccccggcaatattatatacctattctggactgagaaatcgcagagctgcagtttacgtcggatcattctcatggtggacaaccgaccagcagctcatacaggtgattaggtctattggggtgtatgacgtggtcgagcttaagttcgctgagaatagagctaacgggcagtcaaaggggtacgccgaagtagtggtcgcaagcgagaactccgttcacaagctcttggagctgttgcctggcaaggtccttaatggtgaaaaggttgatgtgcgtccagcaacaagacaaaatctgtctcagttcgaggcacaggcacgcaagagggaatgcgtgcgggtgcctagaggtggtatacccccacgggcacatagcagggattccagcgattccgcggatgggagggccaccccttccgaaaatctggtcccttcgtctgcaagagtggacaagcccccttctgtgctgccgtactttaatagacctccctccgcattgcctcttatgggtctccctccgccaccgatcccgccacctcccccattaagttcatccttcggggtacctccacccccacctgggatacattatcagcacctgatgcctccaccacccaggctcccacctcaccttgccgtgccaccccctggggctattcctccggcactgcaccttaacccagcattttttcctccgccaaatgccaccgtgggccctccgccagacacctatatgaaagcttctgcgccatataaccatcacgggtcgagagattctggccctccaccctccacagttagcgaagccgaattcgaagatatcatgaaaaggaatcgcgcaatctcctcctcggccatctcaaaagcggtttctggcgctagtgcaggagattactccgacgccattgaaactctcctcaccgccatagcggtcataaaacagagcagagttgcgaatgacgagcgatgtagagtgctgatttcaagcctgaaggattgcctgcacggaattgaagccaagtcctactccgtcggggcaagcggcagctcgagcagaaaacgccatcgctctagggaaaggtcacccagtaggagcagggagtcctcgagacggcatcgagatctgcttcacaatgaagataggcatgatgattatttccaggaaaggaaccgagagcatgaacggcacagagaccgcgagagagatcgacatcattag

SEQ ID NO: 22630 - DNA, 1416 bp, Artificial Sequence
  Description of Artificial Sequence: Synthetic coding sequence
atgagcgaaggggtcgatcttatcgacatctatgcagatgaagaatttaaccaggacccggaattcaataacaccgatcagatcgacctttacgatgacgtactgactgctacaagccagccatcagatgatagaagctcgtcaacagagccccctcccccagtacgtcaggaacccagccctaaaccaaacaataagacacccgctattctgtatacttatagtggccttaggaatcggcgtgccgctgtttacgtcggatccttcagctggtggactacagatcagcagctgattcaggttatccgatccatcggtgtgtatgacgtagttgagctgaagtttgccgagaatcgggcaaacggccaatcaaaagggtacgctgaggtagtggtggcctcagagaattccgttcataaattactggaattgctgccagggaaagtgcttaacggggaaaaagtagatgtgcggccagctacccgccagaatctgtcccagttcgaagcccaagcccgtaaaagagaatgcgtgcgtgtacctcgcggaggcataccgccaagggcacactcacgagactcctcggactccgccgacggcagagccactccaagtgagaatctggtaccatccagcgcgcgtgtcgacaagcctccgtctgtgcttccctacttcaatcggccaccatccgctcttcctctaatgggcctgccgcctcctcctatccctcctccccctcctttatcctcctctttcggtgtgcccccacctcctccgggtatccactaccaacatctgatgcctccgccaccgcgtttaccgccacacctggcggtgcctcctcccggtgccattcctcctgctctgcacctgaaccccgctttttttccccctcccaatgccacggtcggaccgccacccgacacatatatgaaggcgtccgcaccctataaccaccatggctctcgcgatagcggaccacccccttctaccgtgagcgaggccgaattcgaggatatcatgaaacggaaccgagcaatttctagctctgcaatctccaaagctgtgagtggtgcttccgcaggtgactattccgatgcaatcgagaccttattgacagccatagccgtaataaagcaatcccgcgtggctaatgacgaaagatgccgtgtcctcatcagcagccttaaggattgcttgcacggcatcgaagccaaaagctactccgttggcgcttcaggttcttccagtaggaaacgccaccgaagtcgggaacgcagcccgtctcgctccagagagtcctctcgccgacaccgcgacctcttacataatgaggataggcatgatgactattttcaggaacgcaaccgcgaacacgagaggcaccgagatcgcgagagggatcgccatcactag

SEQ ID NO: 22631 - DNA, 618 bp, Artificial Sequence
  Description of Artificial Sequence: Synthetic coding sequence
atgtcggagggagtggatctgatcgatatctacgctgatgaggagtttaatcaggaccctgagtttaacaacactgaccagatcgacctgtatgatgatgtcctaactgctactagccagccatcagatgatcgcagcagctcaacggagcccccacccccagtgagacaggaaccctctcccaaacctaataacaagactccggctatactctacacctattccggactgcgaaacaggagggcagctgtctacgtggggtcattcagctggtggaccaccgatcaacagctgatccaggtgatccggtctatcggggtatatgatgtagtcgagctaaagttcgccgagaaccgggcaaacggacagagcaagggctacgccgaagtggtagtcgcatccgagaacagcgttcacaaacttctggagcttctgcctgggaaggtgctgaacggagaaaaggtggacgtacgacccgctacacggcaaaacttatcacagttcgaggcccaggcgagaaagagaattccccctcgcgctcactcacgtgattccagtgatagtgctgatggtagagctactccttcagagaatctcgtaccttcgtcagctagatag

SEQ ID NO: 22632 - DNA, 1389 bp, Artificial Sequence
  Description of Artificial Sequence: Synthetic coding sequence
atgagcgaaggcgtagatcttattgatatctatgctgatgaggagttcaaccaagatccggaattcaacaacactgatcagattgacctatacgacgatgtgctaaccgccacatctcagccctcagatgatcgatccagcagtaccgagcctccacccccagttagacaagagcccagtcctaagcctaacaacaaaacccccgctatcttgtatacatactcaggcttaagaaatcgtcgagccgcagtttacgtggggagttttagctggtggacaacagaccagcagctgatccaggtgattcggtcaataggagtctatgacgtcgtagagcttaagttcgccgaaaatcgggcaaacggtcagtccaagggctatgcagaggtcgtggtggcatccgagaattccgttcacaagctgctggaattattaccaggcaaagtattgaatggggagaaggtggacgttcggcctgcaacacgccagaacctgtcccagttcgaggcccaggctcggaagagaatccccccacgggctcattcacgcgacagcagcgattctgccgacggtcgcgctaccccttctgagaacctggtcccgagctcggcccgagtggacaaacccccttccgtcttaccctactttaatagacccccatccgcactgcctctcatgggcctgccccctccccctattccacctccaccaccgctctcttcctccttcggcgttccacctcctccgcctgggattcactatcagcacctgatgcctcctccccctaggctgcccccacacctggcagtgccccctcccggtgctattcccccagctctccacctcaatcccgcttttttcccaccacccaacgccacggtaggtccgcctccagacacatacatgaaagccagcgcgccttacaatcatcacggtagtagggattctgggcctcctccaagtaccgtatctgaagcagagtttgaggatattatgaagaggaatcgggctatctctagctccgcgatctcaaaagccgtaagcggcgcttccgctggagactactctgatgctatcgaaactctccttactgccatcgctgttataaaacagtcgcgtgtggccaatgatgagcggtgtagagtgcttatttcatctttgaaggattgtctgcatggaatagaggccaagtcatactccgttggggcatctggtagcagtagtcgaaaaaggcatcggtcgagagagcgtagcccgtcacgatcgcgagaaagctctcggagacatcgagatctcctgcacaacgaggataggcacgacgattattttcaagagagaaaccgggagcacgaaaggcaccgcgaccgggagagggataggcatcattag

SEQ ID NO: 22633 - DNA, 1389 bp, Artificial Sequence
  Description of Artificial Sequence: Synthetic coding sequence
atgtctgagggagttgatctaatcgacatatacgccgacgaggagttcaatcaggaccccgagttcaataacactgatcagatcgatctgtacgatgatgtgctaacggctactagtcagccttctgatgaccggtcaagttctactgaacccccacccccagtgagacaggagcccagccccaagcccaacaataaaacccctgctattttgtatacttactcaggtctgagaaatcgacgtgctgccgtgtacgtgggcagcttcagctggtggaccaccgaccaacagctgatccaggtgatccgatctatcggtgtgtatgacgttgttgagctaaagtttgcagagaacagagcaaacggtcagtccaagggatacgccgaggtggtggtcgccagtgaaaacagtgtgcacaagctcctggaacttttgccgggaaaggtcttgaacggagaaaaggtagatgtgaggccggctacccgccagaatctaagccagttcgaggcccaagcacggaagcggatcccgccaagagctcactcaagagatagcagcgattccgctgatgggagggctacaccgagcgagaacctggtccctagctctgcccgagttgataagcctccgtcagtactcccgtactttaaccgacctccgtctgccctgcctcttatgggcctgccccctccaccaatccccccaccccctcccctgtcatcttcatttggcgtgccgcctcccccacccggtatccactaccagcatctgatgccaccgcctccacgtttgcccccacaccttgcggtgcctcctcctggtgccatacccccagccttacacctcaatcctgccttcttccccccaccaaatgcaactgtgggcccacctccagacacttacatgaaggcctctgccccttacaatcatcacggaagcagagactccggcccacccccatcaactgtgtcagaggccgaattcgaggacattatgaagagaaatcgggctattagcagctctgcaatcagtaaggccgtgtccggcgcatctgctggtgattactctgacgcaatcgaaacgctgttgacggccatcgctgtgattaagcagtccagggttgcaaacgacgagcgttgccgcgttctcatctcttccctcaaagactgcctccacggaatcgaagccaaaagctactctgtcggggcatcgggctcatccagccgaaagcgacatagatctagagaaaggagcccaagcaggtcacgggagagttctagacgccatcgggatctgcttcataacgaggacagacacgacgactacttccaagagcgtaaccgggagcatgagcggcaccgtgatagggaacgcgaccgccaccactag

SEQ ID NO: 22634 - DNA, 435 bp, Artificial Sequence
  Description of Artificial Sequence: Synthetic coding sequence
atgtccgaaggcgtggatttaatcgatatctacgccgatgaagagttcaatcaagacccagaattcaataacaccgaccagatcgacctgtatgatgacgttctgactgctacttctcagccttccgatgaccgaagctccagtaccgagcctcctccccctgtgaggcaggagcccagccctaagcccaataacaaaacgcccgcaatactgtacacttacagcggactgcggaatcggagagctgccgtctatgtggggtcattcagttggtggactacggaccaacaacttatccaggttatacgctcaattggagtgtatgacgttgttgagctgaaatttgctgagaaccgcgctaacggacaatctaaaggatatgccgaagtggtggtggcgtctgaaaattctgtccataaactgctggaactctag

SEQ ID NO: 22635 - DNA, 441 bp, Artificial Sequence
  Description of Artificial Sequence: Synthetic coding sequence
atgtcggaaggcgtggatcttattgacatctatgcagacgaggagttcaatcaggaccctgagttcaacaatacagaccagattgacctgtatgatgatgtgctcaccgctacatctcagccaagcgacgatagaagctcatccactgagccacctcctccggtgagacaggaaccttcccccaagccaaataataaaacccccgcaatactttatacgtacagtggtctgcgcaaccgacgggcagcagtgtacgtggggtcattctcatggtggactacagaccagcaattaatccaggtgattcggtctatcggagtgtatgacgtcgtggaactcaaatttgctgagaaccgcgcaaacggtcagagtaaaggctatgccgaagtggtggtcgcctctgaaaacagcgttcataaattactggaactgcttccgtag

SEQ ID NO: 22636 - DNA, 867 bp, Artificial Sequence
  Description of Artificial Sequence: Synthetic coding sequence
atgagtgaaggcgtggatctaatcgacatctacgcggacgaagagtttaatcaagatccggaattcaacaacactgaccagatcgatctttatgatgatgtgctgacggctactagccagcccagtgacgacaggagctccagcacagagcccccacctcctgtacggcaggagcctagccctaaacccaacaataagactcctgcaatactgtacacatacagcgggttacggaatagacgcgcagcagtgtacgtcggtagcttctcttggtggactactgaccaacagcttatccaagtgataaggagtattggggtgtatgatgtagtcgaactgaaattcgccgaaaacagagccaatgggcagagcaagggctatgccgaagtcgtggtcgcctcagaaaattcagtgcacaagctactggagttgctcccagggaaggtgctgaatggtgaaaaagtggacgtcagacctgccacacggcagaatctttcccagtttgaagctcaggcgaggaaacgcatcccaccgcgagcgcacagtagggactcatccgattcagctgatggcagagccacccccagtgaaaatctcgtgcctagttccgccagggtggacaagcctccttccgtactgccatacttcaatcgacctccctctgctctccctttgatggggttgccgccacctcccatccctcctccccctcctctgtcatcctcatttggagttccccctcctcccccaggcatccattaccagcatttgatgccaccccctccccgtttacctccgcatcttgccgtcccgccaccgggagctatccctcccgctctgcacctcaatccagcctttttcccatag

SEQ ID NO: 22637 - DNA, 3162 bp, Artificial Sequence
  Description of Artificial Sequence: Synthetic coding sequence
atgtcccgaaggaagcaagccaaaccccagcacatcaattcagaggaggaccaaggagagcagcaaccacagcagcaaacacctgaatttgccgacgcagctccagccgcacctgcggcaggcgaactgggggcaccagttaaccaccccggtaacgacgaggtagcttcggaagacgaagctaccgtcaagagactgagaagggaagagactcacgtttgcgagaaatgctgtgccgagttcttcagtatctccgagttcctcgagcataaaaaaaattgtacaaagaatccacctgtgctgattatgaatgattccgaaggacctgtgccatccgaagactttagtggcgctgtcctgtcccaccagcccacttctccgggaagtaaagactgtcacagagaaaatggaggctcaagtgaagacatgaaagaaaagcccgacgccgagagcgtggtgtatttaaagactgagaccgctctgcctccgaccccccaggatatatcctatcttgcgaaaggcaaagtcgctaataccaatgttacactccaggccctgcggggtaccaaggtggctgtgaatcagcgatccgcagacgccttacccgcacctgtgcctggcgctaactccatcccttgggtgcttgaacagattctctgtctccagcagcagcaattacagcagatccagctaacggagcagatcagaatccaggtgaatatgtgggctagtcacgccctgcacagcagcggggcaggagctgacaccctgaagacgcttgggagccacatgtctcagcaggtgtcggccgctgtcgctcttctgtcccagaaagctggttctcaggggctttccctggacgctctgaaacaggccaaactgcctcatgccaacattcctagcgctacaagcagtctgtccccaggtctggcacctttcaccctgaagccagacgggacccgagtgctccccaacgtcatgtcgcgtctgccatcagcactgctgcctcaggccccaggttctgtgctcttccagagcccgttcagcaccgtggcactcgatacctccaaaaaggggaagggtaagccacctaacattagcgcagtcgacgtgaagccaaaagacgaagctgctttatacaagcacaagtgtaaatactgtagcaaggtgtttgggacggactcatccttgcagattcacctccgtagccacacgggcgaaaggccatttgtttgctccgtgtgcggtcacaggtttaccactaaaggcaacttgaaggtacactttcacagacacccacaagtaaaggctaatccacagctgttcgcagaatttcaggacaaggtagctgccggtaatggtatcccctatgccctgagcgttccggaccccatcgacgaacccagcctctcactcgattcaaaacccgtgcttgtgacaacttccgtaggtctgccacagaacctaagcagcggtacaaatccgaaggatctgactggaggctccctaccgggagatctgcaacccggaccatcccccgaaagcgaagggggaccgacactgccgggagtgggtcccaattataactcgcccagggctggaggtttccagggctccgggacgcccgagccaggtagtgagaccttgaaactacagcagctggtcgagaatattgataaggcaaccacagatccaaatgagtgcctgatctgtcatagagtcctaagctgtcagtctagcttaaagatgcattaccggactcacaccggtgagagaccatttcagtgcaagatctgtgggagggcatttagcacaaaaggaaacctcaaaacacatctgggtgtccacagaactaacacttctatcaaaacgcagcactcgtgtcccatatgccagaaaaagtttaccaacgccgtgatgttacagcaacacattagaatgcacatgggaggtcagatccctaacacccctctgcctgaaaatccttgcgattttaccgggagcgagcctatgaccgtgggagagaacggctctacaggcgcaatttgccatgatgatgtgatcgaaagcattgatgtggaagaggtgtcttcgcaggaagccccatcttccagctccaaagtgcccacacctttaccgagcattcacagcgcttctccaacactcggctttgcgatgatggcatccctcgatgccccaggaaaggtcggacccgcaccatttaatttgcagcggcagggctctcgggagaacggctctgtggagagtgacggcctcaccaacgattcaagtagtttgatgggggaccaggaataccaatcacgtagtcccgatatactggagaccacctcttttcaagcactgagccccgcaaattctcaagctgagtccatcaagagcaaatcccctgacgcgggtagcaaggcagagtctagtgagaatagtcgcactgaaatggaagggagatcctctcttccgagcaccttcatccgcgcacctcccacctacgtcaaagtcgaagtgcctggcaccttcgtggggccaagtacattgtcgccaggaatgacgccccttctggctgctcaaccaaggcggcaggctaaacaacacggatgcaccagatgtgggaagaacttctcctcagcaagcgcgctccagatccacgaaagaactcacaccggagagaagcccttcgtgtgcaatatatgtgggcgtgcctttaccaccaagggcaacctaaaggtgcattacatgacgcatggcgctaacaacaattcggcacgccgagggaggaagctggcgatagaaaacacaatggcactgctgggtactgatggcaagagggtgagcgagatcttcccaaaagaaattctcgctccgagtgtcaacgtcgaccctgttgtttggaaccagtatacaagcatgctgaatggaggcctcgctgtgaagacaaacgagatttccgttatccaatctggcggagttcctacgctccccgtgagcttgggagcaacatctgttgttaacaacgcaaccgtcagcaagatggacgggtctcagtcagggatatccgctgacgtagaaaaaccatctgcgactgacggggtcccaaagcaccagtttccacactttctggaagaaaataagatcgcggttagctag

SEQ ID NO: 22638 - DNA, 1038 bp, Artificial Sequence
  Description of Artificial Sequence: Synthetic coding sequence
atgtaccggactaaggttgggctcaaggatcgccagcagctctataaactcattatctctcagctgctctacgacggatacattagtatcgccaatgggctcataaacgaaataaaaccacagagtgtgtgtgccccatcagagcagctgctgcatctgattaaactgggcatggaaaacgatgacacggccgtgcagtatgcaatcggccgatcagatacagtggcccctgggactgggatcgacttggaattcgacgccgatgtgcagactatgtctcccgaagcttcagagtacgaaacctgctatgtaacttcacataaaggaccgtgccgagtggcaacctattccagggacggacagctgattgcaactgggagtgctgacgcttccatcaaaatattagatactgaaaggatgctggcgaagtcagccatgcctattgaagtaatgatgaatgaaacggcacagcaaaatatggagaaccaccctgttatacgcaccttgtacgaccacgtggatgaagtcacctgcctcgcttttcatcctacagaacagattctggccagcggttcccgggactatacactcaagttgttcgactatagcaagcctagcgcgaagcgagccttcaaatatattcaggaggccgagatgctgaggtctatttcgtttcacccaagcggggacttcatactggttgggactcagcatcctaccctccgcctctatgatatcaatactttccagtgttttgtgagttgcaacccacaggatcagcacacagatgccatatgctcagtcaattacaattctagtgccaatatgtacgtgacgggttcaaaagacgggtgtattaagctttgggacggagtgagcaaccgttgtatcacaaccttcgagaaagcccatgacggagccgaggtgtgctccgctatatttagcaaaaactcaaagtacatcttgagtagtggcaaagatagtgttgctaaactgtgggaaattagtaccgggcgtaccctggtgcggtatacttag

SEQ ID NO: 22639 - DNA, 1257 bp, Artificial Sequence
  Description of Artificial Sequence: Synthetic coding sequence
atgtatcggctgatcataagtcaactactgtatgacgggtacatctctatcgccaatggcctgatcaacgagattaagccacagagcgtgtgtgctcccagcgaacagctactccatctgataaaattgggaatggagaacgatgacactgccgtccaatacgccatcggcaggagcgatacagtggcgccaggcaccggcatcgatctggagttcgacgctgatgtacagacaatgagccctgaggcttccgagtatgagacttgctatgtgactagccacaaagggccatgtcgggtggcaacttacagcagagacggacagctgatcgctactggcagcgcggacgcgtctatcaaaatcttggacaccgagaggatgctagccaaatccgcgatgccaattgaggtgatgatgaatgagaccgctcagcagaacatggagaaccacccagtgattcgtaccctttatgaccatgtggatgaggtcacctgtttggcgtttcatcctacagaacaaattttagcatccgggagcagagactacacgcttaaactgttcgactactctaagccaagtgctaagcgggcatttaagtacatccaggaggccgaaatgttgagaagcatcagttttcatccctcaggcgattttatccttgttggcacccagcacccgaccctgcgactctatgacatcaatacctttcagtgttttgtttcatgcaatcctcaggaccaacacacagatgccatctgctctgtgaactacaatagctccgcgaacatgtacgtaacaggcagcaaagatggttgtatcaagttatgggacggagttagcaatcggtgtattacgactttcgagaaagcccatgacggagcggaagtatgttctgccatcttctcaaagaactcgaaatacattcttagcagcgggaaagattcagttgcgaagttatgggagatcagcacaggaagaacactggttcgctatacaggcgctgggctgtccggcagacaggtacaccggacacaggcggtgtttaatcatacggaggattacgtccttctccctgatgaacggaccatctcactctgttgttgggattctcggacagccgagagaaggaacctcttgagccttgggcacaacaacattgtgcggtgcatcgtccacagtccaacaaatcccggatttatgacctgctctgatgactttcgagctaggttctggtataggcgttccactacagattag

SEQ ID NO: 22640 - DNA, 429 bp, Artificial Sequence
  Description of Artificial Sequence: Synthetic coding sequence
atgtatcggaccaaggttgggctgaaggaccgtcagcagctgtacaaactgatcatttcccagctactgtatgatggatacatttcaatcgccaatggcctaatcaatgaaatcaaaccgcagtctgtgtgtgcccctagcgagcagcttctgcatttaatcaaactcgggatggagaacgatgatacagcggtacagtacgccatcggccgaagcgatacagtggctccaggcactggcatcgaccttgaatttgatgcagatgtccaaaccatgagtccagaagccagtgagtatgagacctgttatgtcacatcccacaaaggaccctgcagagtcgccacatattccagggacggtcaattgattgcaactggctccgccgacgccagcattaagatcctcgataccgagaggatgttggcctag

SEQ ID NO: 22641 - DNA, 1038 bp, Artificial Sequence
  Description of Artificial Sequence: Synthetic coding sequence
atgtatcgtacaaaggtggggttgaaggataggcagcagctctataagctcatcatatctcagcttctgtacgatggttacataagtatagctaatggcctgattaacgagatcaagccacaatcagtatgcgccccttctgaacagttgctccacctcattaagcttgggatggagaacgatgacaccgctgtgcagtacgcaattggcaggagtgacaccgtcgctccagggactggtattgatttagagttcgacgctgatgtacagacaatgtctcctgaagcatcagagtacgagacgtgttatgtcacatcacataaaggaccctgcagggtggcaacatacagccgggatggccaattaattgcaaccggatccgcggacgcctccataaagatcctggacacagaacggatgctggccaagtccgccatgcctattgaagtcatgatgaatgagaccgctcagcagaacatggagaaccacccagtcatccgcacgctgtacgaccatgtggatgaagtgacttgcttagcattccatccgactgagcagatcctcgcttccggctctcgcgattacacccttaagctgtttgattacagtaaaccgtcagccaagagggcgttcaagtacatccaagaggcggagatgctgagatccatcagtttccacccttctggagactttatactcgtgggcacacagcaccccaccctgagactctacgatatcaacacattccagtgctttgtatcatgtaatcctcaggaccagcacaccgatgcaatctgcagcgtgaattataacagttcagctaatatgtacgtaacaggttccaaggatggctgtattaagctgtgggacggggtgtctaaccgctgtataactacattcgaaaaggcgcacgacggcgcagaagtgtgtagtgccatttttagtaaaaactccaaatacatcctgtcctctggcaaggactctgttgccaagctgtgggagattagcaccgggagaactcttgtgagatatacttag

SEQ ID NO: 22642 - DNA, 1734 bp, Artificial Sequence
  Description of Artificial Sequence: Synthetic coding sequence
atggccggtctgactgtccgagatcctgcggtggatcgcagcctgcgatccgtgtttgtggggaatatcccctatgaggctaccgaggaacagctcaaagacatattttcggaagtcggtccagttgtctccttccgtcttgtatacgatcgggaaaccggtaagcccaagggctatggattctgtgagtatcaggatcaggaaaccgccctatccgcaatgaggaatctgaatggcagagagttcagcggaagggccctgcgggtggacaacgcggcatccgagaagaacaaggaagagctcaaatccttggggacgggggctcccgtaatcgagagcccctatggcgagactatttcacccgaggatgccccagagtctatttccaaagcagtggcctccttgccacccgagcagatgtttgaactaatgaagcagatgaaactgtgcgtgcaaaacagtcctcaggaggctcgaaacatgttgctccagaatccacagctcgcctacgccctgctgcaggcgcaagttgtgatgcgcattgtggatcccgagattgccctgaagattctccataggcagacaaacatcccaacactgattgctggaaacccccagcctgtccacggagcgggacccggaagtggctccaatgtcagcatgaatcagcagaatccacaggccccacaggctcagtcattaggcggaatgcatgtcaacggtgccccacccttaatgcaggcttcaatgcagggcggtgtcccagcccctggccagatgcccgcagctgttacaggacctgggccaggttccctcgcgccaggaggcggaatgcaggcccaggtgggcatgccgggttcaggacctgtgagcatggaaaggggccaggtgccgatgcaagaccctcgcgctgccatgcaacgagggagcctccctgcaaatgtgcccacaccaagggggctccttggggacgccccaaatgacccgcgagggggaacactacttagcgttacaggtgaagtcgagccgcgaggatatttgggcccacctcaccaagggcctcctatgcatcatgtgccgggacacgaaagtcgaggcccaccacctcatgagctgaggggcggtcccttgcctgagccaaggccactgatggccgagccccgaggtccgatgctggatcagcggggacctcctctcgatggtcgaggcggaagagatcccaggggaatagatgccagaggcatggaggccagggctatggaggcccgaggcctggatgctagaggactcgaagcgcgagccatggaggcccgtgctatggaggccagagccatggaggctagggctatggaggccagggctatggaggtccggggtatggaagcacggggtatggacactagagggccagtccctgggcctcgcggtcctataccaagcggcatgcaggggccatctcccattaatatgggcgctgtcgtgccccaggggtctaggcaggtgcccgttatgcaggggactggtatgcagggcgctagcatccaggggggatcccaacctggagggttttctccgggtcagaaccaagtcactccacaggatcacgagaaggctgccctgatcatgcaggtgctgcagctcaccgccgaccagatcgccatgctgcctcccgaacagagacagtcaatcctgatactcaaggagcaaatccagaagagtacaggagccccttag

SEQ ID NO: 22643 - DNA, 1662 bp, Artificial Sequence
  Description of Artificial Sequence: Synthetic coding sequence
atggctggtctcacagtccgagatccggcagtcgaccgctccttgagatcagtgttcgtcggtaatatcccctacgaggccactgaggagcagttgaaagacatattctccgaagtgggacctgtggtttccttcaggctggtctacgaccgtgaaaccggaaaacctaagggatacggattctgtgagtaccaggaccaggagaccgccctatcagccatgcggaacctgaacggcagagaattctccggcagggctctaagggttgataacgcagccagcgagaagaacaaggaggagctgaaatccctggggactggagcccctgtgatcgaaagcccttatggggaaactatttcacctgaggacgccccagagtcaatttccaaagctgttgccagcctgccccctgaacaaatgtttgagcttatgaaacaaatgaaactgtgcgtccagaattctccgcaagaggcaaggaacatgctgctgcagaacccccagctggcatatgcattgctgcaggctcaggtagttatgcgcatcgtggacccagagattgctctgaaaattctacacagacaaaccaacatccctaccttgatcgcgggtaatccgcaggcccagagcttagggggaatgcacgtaaacggcgctccacccttgatgcaggcttccatgcaggggggtgtccctgcccctgggcagatgcccgctgcagtgactggccctggaccaggatctctggcgccagggggaggcatgcaggcccaagttggaatgccaggttcaggtcccgtctccatggaacgcggacaggttcccatgcaggatcctcgggctgctatgcagcggggatctttgcctgcaaatgtcccaactccacgaggcctgctgggggacgcaccgaacgacccacggggaggtaccctgctgtctgtcacaggagaggtcgaaccacgaggctaccttggcccaccacaccagggtccacctatgcaccacgttcctggtcatgagtcccgcggacctccccctcatgaactgagagggggacccctgccagagccacggccactgatggccgagcccagggggcctatgttggaccagcggggtcctccactcgatgggaggggtgggagagatcccaggggcattgatgccaggggcatggaggcaagagctatggaggccagagggttggatgccaggggtttagaagcaagggccatggaagccagggccatggaagctcgcgcaatggaagctagggcaatggaggctagagccatggaagtgaggggcatggaggctagaggaatggacacgcgcggaccagtgcctggccctagaggaccaatcccctcaggcatgcagggacccagccccatcaacatgggtgcggtggtgccccaggggtccaggcaggttccagttatgcaggggactggcatgcagggcgcttcaattcaaggagggtcacagcctggaggtttttcgcctggccaaaatcaggtgacccctcaggaccacgagaaagcagcactgataatgcaggtcctccagctgacggccgatcagattgccatgttaccgcctgagcaacggcaaagcatactcattctgaaggaacaaatccagaagtccaccggcgcaccatag

SEQ ID NO: 22644 - DNA, 2154 bp, Artificial Sequence
  Description of Artificial Sequence: Synthetic coding sequence
atgagcggagatggcgctactgagcaggctgccgagtatgtgcccgagaaagttaaaaaggctgagaagaagctagaagagaacccttatgatttagatgcttggagtatcttgattagggaagcccaaaatcagcccatcgacaaggccaggaaaacctacgagcggttagtggcacagttccctagcagtggcagattctggaagttatatatcgaagcggagattaaggctaagaattacgacaaggttgagaaactgtttcaacggtgtctgatgaaagttcttcatatcgacttgtggaaatgctacctttcctacgtcagagaaaccaagggaaagctgccgagctataaggagaaaatggcacaagcgtacgacttcgcgctggataagattgggatggaaataatgtcataccagatctgggttgattacattaacttcttgaaaggagtggaggccgttggaagttacgctgaaaatcaacggatcaccgcagtccgacgcgtgtaccaacgtggttgcgtgaatccgatgataaatattgaacaattgtggagagactataacaaatacgaggaaggcataaacattcaccttgccaagaaaatgatcgaagaccgtagcagggactacatgaatgctcgcagagttgctaaagagtacgaaacagtcatgaagggactggatagaaatgctccaagcgttccccctcagaacactccccaagaggctcagcaggtcgatatgtggaagaaatatatacaatgggaaaaaagtaacccattgaggaccgaggaccagacccttatcaccaaacgggttatgtttgcatatgagcaatgtctgctggttctggggcaccaccccgacatctggtacgaggctgctcagtacctggagcaatctagcaagctgctggccgagaagggcgatatgaataacgccaagctcttctctgacgaggcagccaacatttatgaacgcgctatcagcaccctgttgaaaaagaatatgctcctgtattttgcatacgctgactatgaggaatctaggatgaagtatgagaaagtgcactctatatataacagactattagctatcgaggatatcgatccgaccttggtttacatccagtacatgaagttcgccaggagagctgaaggtatcaaaagtggtcgcatgattttcaaaaaggctcgggaggacacccgaacaagacatcatgtgtatgtgacagccgctctgatggagtactattgctccaaagacaagtcagtggcgttcaagatatttgaactcggattgaagaagtatggggatatccctgagtatgttctagcttatattgactatctgagtcacctgaatgaggataataatacacgcgtgttatttgaaagagtgttaacctctggatccctgccaccagaaaagtccggcgaaatctgggctcgcttcctcgcattcgagagtaatattggcgacttggcctcaattctcaaggtggaaaagcgccgattcacagccttcaaagaagagtacgagggtaaggaaacagccctcctggtggatcggtacaaattcatggacttgtatccatgtagcgcctcagagctcaaggctctgggatacaaggatgtgagcagagcaaagcttgccgctatcattcctgatcccgtagtggctccctctatcgttccagtcttgaaagacgaggtggatcggaagccagaatatccaaagccggatacccagcagatgatacctttccaaccccgtcacctggcaccccctgggctgcatccagtgccgggaggtgtgtttcccgtgcctccagcagctgttgttctgatgaagctgctgccccctccaatttgcttccagggacccttcgtgcaggtcgacgagcttatggagatattccgcaggtgcaaaatccccaacacagtcgaggaggccgtgcggattatcaccggcggagctcccgagctggcggtggagggaaacggcccagtggaatcaaatgcagtattgacaaaagccgtcaagcggcctaacgaggattctgacgaggacgaggagaaaggggcagttgttccacctgtgcatgatatctacagagccaggcagcagaagagaataagatag

SEQ ID NO: 22645 - DNA, 135 bp, Artificial Sequence
  Description of Artificial Sequence: Synthetic coding sequence
atgtcgggtgacggcgcaaccgagcaagccgcagagtatgtgccagaaaaggtgaaaaaagccgaaaaaaaattggaggaaaacccttacgatctggatgcttggtccatactgataagagaggcccaggtctag

SEQ ID NO: 22646 - DNA, 312 bp, Artificial Sequence
  Description of Artificial Sequence: Synthetic coding sequence
atgtcaggcgacggagcgaccgaacaggcagcagagtatgtgcctgaaaaagtgaaaaaagctgagaaaaaactcgaggaaaatccatatgatctggacgcctggtccatactgatccgcgaagctcaaaaccagcccattgacaaggcaaggaagacttatgaacgactcgtggctcagtttccctccagcgggaggttctggaagttgtacattgaagctgaggtgaccattttgttttacttcttcttataccagtactgttccatacattgctccgaccgcaaacaggtgaggaacatcgctaactag

SEQ ID NO: 22647 - DNA, 186 bp, Artificial Sequence
  Description of Artificial Sequence: Synthetic coding sequence
atgtcaggcgacggtgccacagagcaggcagcggagtacgttccagagaaagttaaaaaagcagaaaaaaaactggaagagaacccatacgatcttgatgcttggtcgattcttatcagggaggcccaaaatcagccaatagataaggccaggaaaacatatgaacgtctggtcgcccagttttag

SEQ ID NO: 22648 - DNA, 1953 bp, Artificial Sequence
  Description of Artificial Sequence: Synthetic coding sequence
atgaccctgatgttgggtgcccagatcaaagcaaaaaattatgacaaagtggaaaagctgtttcaacgctgtttaatgaaggtcctccacatcgatttgtggaagtgctatctatcctacgtgagagaaacaaaggggaagctgcctagttataaggaaaagatggcccaggcctatgacttcgcactcgacaaaatcggtatggaaatcatgtcttatcagatttgggtagactacataaacttcctcaagggggtggaagcagtgggatcttatgcagagaatcagcgaatcactgccgtccgcagagtgtaccagaggggttgcgttaaccccatgattaatattgagcagttgtggcgtgactataataagtatgaagaaggtatcaacattcatctcgccaaaaaaatgatcgaggaccgatctcgcgattacatgaacgccaggagagttgccaaagagtatgagactgtgatgaaaggcttggataggaatgcccctagcgtcccgccacagaatacgcctcaagaggcccagcaggtcgacatgtggaaaaaatacatccagtgggaaaaaagcaacccacttagaactgaggatcaaaccctgatcaccaaacgcgtcatgttcgcctacgagcagtgcctcctcgtcctaggccaccacccagacatttggtatgaggccgctcaataccttgaacagagttctaaactgctcgcagagaagggagatatgaacaatgcgaaactgttctctgatgaggccgctaacatctacgaacgggctataagcacattgctcaaaaagaacatgctgctgtactttgcctacgcggattatgaggaatcgagaatgaagtacgagaaggtgcattccatctacaaccggttgctcgccattgaggacatcgatcctacactcgtgtacatccaatatatgaaattcgccagaagagccgagggaatcaagtccgggcgaatgatttttaagaaggcaagagaagatacccgtacccggcaccatgtttacgtgaccgccgctctgatggagtattattgctcaaaggataaatctgttgccttcaaaatcttcgaacttgggttaaaaaaatacggcgatataccagagtacgtgcttgcctatatagattacctttcacacttaaatgaggacaacaatacacgggttctgttcgagcgcgtcctgacgagcgggtcactgcctccagaaaaatcaggcgaaatatgggccaggtttttggcatttgaatctaacattggggacctcgcttcaattttaaaagtcgaaaaacgccgtttcaccgccttcaaggaagagtacgaaggaaaggagaccgctttactcgttgatcgatataagtttatggacctttacccatgcagcgccagcgaactgaaagctctaggatacaaggacgtcagccgcgcaaaactggcagcaatcattcccgatccagtagtggctccatcaatcgtccctgtcctaaaggatgaggtggatagaaaacctgaatatcccaagcctgacacacagcagatgatcccctttcagcccagacacctcgcaccacctggccttcatccagttcccggaggggtctttccggttccacccgcagccgtggtgctgatgaagctgctgccccctcccatctgctttcagggtcctttcgtgcaggtggacgagctcatggaaatttttcgacggtgtaagatccccaatacagtcgaagaagctgtgcgcataataaccgggggtgcacccgaattagctgtggagggcaacgggccagtggagagcaacgctgtgctgacgaaggccgtgaagagacccaacgaggacagtgacgaggatgaagaaaaaggagctgtcgtaccgcctgtgcacgatatctatcgggctaggcagcagaagaggatacgctag

SEQ ID NO: 22649 - DNA, 1740 bp, Artificial Sequence
  Description of Artificial Sequence: Synthetic coding sequence
atgttaagaagcggcccagcatccgggcctagcgtgccaacagggagggccatgccgagtcggcgagtggctcggcctccagctgcgccagagttgggggctctgggcagcccagacctgagctccttgagtctcgcggtgtcaagatctactgacgagctcgagatcatcgatgaatacatcaaagaaaatgggtttggtctggacgggggacagcctgggcctggagaaggtctgcccagactcgtgtcccggggagccgcttccttgtccactgttaccctcggtccggtcgctccaccagcgactccacccccatgggggtgccccctgggtcggctggtctctcccgcaccagggccagggccacagccccatttagttatcaccgagcagcccaaacaaaggggaatgcgcttccgatacgaatgtgagggaagatccgcagggagtatcctgggtgaaagtagtactgaggcctcgaagaccctgcccgcaattgaactgcgggattgtggcggactgcgtgaagtggaggtcacagcctgcctagtatggaaggactggccacatagagtacatccacatagtctcgtcggaaaggattgcaccgacgggatttgccgcgtgcgactccgccctcacgttagtccccgtcactccttcaacaatctgggaatccagtgtgtccgcaagaaggaaatcgaggccgcaatcgagcgtaagattcagctgggtattgatccatataacgctgggtctcttaagaaccaccaggaagtagatatgaacgtcgttcggatctgcttccaggcttcatacagggaccaacaagggcaaatgaggcgcatggatcccgtcctttccgagcctgtgtacgacaaaaagagtaccaacacaagcgaactgcgcatctgtcgaatcaacaaagaaagtggcccttgcactggaggcgaggagttatacctgctgtgtgacaaggtccagaaagaggacatatcggtggttttcagccgggctagctgggaaggcagagctgactttagccaggcggatgtccaccgacagatagccattgtattcaagacacccccatatgaagacctcgagattgttgagcccgtgaccgtgaatgtgtttcttcagaggctgaccgacggggtttgttcagaacctttgccctttacctatctgcccagggatcacgattcatacggcgttgataagaaacgtaaaaggggtatgccggacgttctgggcgagctcaactccagcgatccgcatggaatcgaatcaaaaagaaggaagaaaaagcccgctatcctggaccatttcctgccgaatcacggatccgggccttttctgcctcctagcgcactcctgccagaccctgatttcttctccgggacagtgtccctgcctgggctcgagcccccaggaggccctgatcttttggacgatgggtttgcctatgacccgacagccccaacattattcacaatgctggatctcctccccccagcaccccctcatgcatctgctgttgtgtgcagcggaggcgcaggagccgtggtgggggagactccaggcccagagccgctgactcttgactcttaccaggcgcctggacctggagatgggggaactgcaagtctcgtcggctctaacatgttcccaaaccattaccgcgaggccgctttcggcggagggttactatcccctggaccagaagcaacctag

SEQ ID NO: 22650 - DNA, 1785 bp, Artificial Sequence
  Description of Artificial Sequence: Synthetic coding sequence
atgtggcacgaggcccgaaagcacgagcgaaaactgcggggaatgatggtcgactataagaagcgcgctgagcgacggagggagtactacgaaaagatcaagaaggaccccgctcaattccttcaggtccacggccgtgcgtgcaaagtccacctggacagtgccgttgcactggctgccgagagtccagtgaatatgatgccctggcagggagataccaataatatgatagaccggttcgacgtgcgagctcacttggaccatattccagactacacacctcctctgctcactaccatctcgccagagcaagagagcgacgagagaaagtgcaattacgaacgataccgtggcctcgtccagaatgactttgcaggaatctcagaggaacagtgcctctaccagatttacattgatgaactgtatggcggtctgcagaggcctagcgaagacgaaaaaaaaaaactcgccgaaaagaaggcttccatcggctacacctacgaggactccacagtggcaaaggtggaaaaggcagccgaaaaaccagaagaggaagaaagtgcggctgaggaggaatcaaatagtgacgaggacgaagtgatcccagatatcgatgtggaggttgatgtggacgaacttaatcaagagcaggtggctgacttgaacaagcaagccaccacatacgggatggccgatggtgattttgtcaggatgctgcgcaaagacaaggaggaagccgaggcgattaaacatgcaaaggccctcgaagaagagaaggccatgtactctggccgaagaagcaggaggcagagacgagagtttagagagaaacgcctgcggggtcgcaaaatctcccctccgtcttacgcccgacgtgacagccctacctatgatccatataaacggtctccctctgaatcatcaagtgaaagtcggagccgttccagatcgccaaccccaggacgggaggagaaaatcaccttcattacgtcttttggcggtagtgacgaggaggccgctgccgcagccgctgctgccgcagcctctggggtgactactggcaaaccaccggctccaccccaaccagggggtccagccccaggacgcaacgcttctgctagacggaggtcatcctcttcttcttcgtcctcatcagccagcagaacaagcagcagtcggagttcaagccgtagctctagtagaagccggaggggcggtggatactatagatctgggaggcacgcaagatcccgtagtcgcagctggagcagatcaaggagccggtcccgacgttattctagatcgcgctcgagaggtaggaggcacagtggaggcggttcccgagacggccacagatactcccgttccccagctcggagggggggatatggccctcggagacgatcacggagtaggagccactctggagatagataccgtagaggcggacgtgggctgagacaccactcaagctccagatcacgttcgtcttggtctctttccccctccagatctcggtcattgactcggtcccgaagtcactcaccgagccccagccaatcccggtcccgcagtaggtcacgaagccagagtccatcgcccagtccggcacgcgaaaagcttaccagacccgcagcatctccagctgttggcgagaagctcaagaaaacagagcccgcagcaggcaaggagaccggcgctgctaaggtgacccaggccgatgctagtggagaagccgagacagaggatgctgagggagcagaacaagccgttcagggtggctag

SEQ ID NO: 22651 - DNA, 1839 bp, Artificial Sequence
  Description of Artificial Sequence: Synthetic coding sequence
atgtggcatgaggccagaaaacacgagagaaaactgaggggaatgatggtagactacaagaaacgcgcagagaggcgccgtgaatattacgagaaaataaaaaaggatcccgcacagtttctgcaggagagtgatgagaggaaatgcaattacgagcggtatcgcggattggtacagaacgattttgccggaattagtgaagagcaatgcctataccaaatctacatagacgagctgtatggcggactgcagcgtccttccgaggatgagaaaaaaaaactggcagagaaaaaagctagtatcggctacacatacgaggactccactgtggcaaaggtggagaaagcagcggagaagcccgaggaagaagagtccgccgctgaagaagagagtaactctgatgaggatgaggtgatcccagacatcgatgtggaggttgacgtggacgaactaaaccaggagcaggtagcggatctaaacaaacaagccaccacttatggtatggcagatggagatttcgtgaggatgctgcgcaaagataaggaggaagctgaggcaattaagcatgccaaggcattagaagaggagaaagccatgtactctggtaggaggtcaagaagacaaagaagggagttcagggagaagcggctgcgtgggagaaagattagccctcctagctatgccagacgcgactcccctacatacgatccatataaacggtccccgtccgaaagctcttcagaatctaggagcagatcacggagtcctacgcccggtcgagaggagaagatcaccttcataacttcctttgggggaagcgatgaggaggccgctgcggcagctgctgcagcagccgcttccggggtgactactggaaaaccaccggcaccccctcaacctggaggtcccgcaccgggaagaaacgcctcagctcggcgaaggtccagttcaagttcttcaagtagtagtgcgtcccgaactagtagctctcggagttcctcaaggtctagtagtagatcccgaaggggtgggggatactaccggagtggaagacacgcaagatcgcgctcaagatcttggagccgaagcaggagccgcagcaggaggtattcccgatcccggagccggggacgacggcacagcggtggcggaagcagagacggccatcggtattcaagaagccctgcaaggcgaggtgggtacggcccaagacgcagatctcgatcccgctcccattccggcgatcgttataggaggggcggaagagggctgaggcatcatagctctagcagaagcaggtcctcatggagccttagtcctagccggagtcgctctctaactagaagtcgcagtcattcaccatctccctcccaaagtaggagcagatcaaggtcaaggtcccagtcaccatctccctcaccagcaagagaaaaactgacccggcctgccgctagtcccgctgtgggagaaaaattaaagaagacagagcctgcagcaggcaaggagacaggggctgccaagcctaaactaacaccccaagaaaagctgaagcttcgcatgcagaaggcactgaaccgtcagtttaaggctgacaagaaagcggctcaagagaagatgatccagcaagagcacgagagacaggaacgggaagatgagttacgggctatggctcgtaagattcgtatgaaggaacgagaacgaagagaaaaggaaagggaagaatgggagcgccaatacagtaggcaatccaggtcaccaagccctagatatagcagggagtactcctccagccggcgtcggtcaagaagcaggtctcgatctccgcattacaggcattag

SEQ ID NO: 22652 - DNA, 1968 bp, Artificial Sequence
  Description of Artificial Sequence: Synthetic coding sequence
atgtggcacgaagccagaaaacacgaacgaaagcttcgaggtatgatggtggactacaagaaacgtgctgagcggagaagggaatactatgaaaaaatcaagaaggatcctgcccagttcttacaggtccacggtcgtgcctgcaaagttcatctagacagcgcagtcgccttggctgccgagagtcctgtcaatatgatgccttggcagggcgatacgaataacatgattgatcgttttgacgtgcgtgcccacctggatcacataccagattatactcctcctttgcttaccaccatatcgcccgaacaggaatcagatgagagaaaatgtaattacgaacggtatcggggactggtacagaacgattttgccggaatctctgaggaacaatgtctgtaccagatttacatcgatgaactgtatggtggactgcaacggccatccgaagatgaaaagaaaaaactcgccgaaaagaaagctagcatcgggtacacgtacgaggattccaccgttgccaaagtagagaaagcggctgagaaacccgaggaggaggagagcgccgcagaggaggagtcaaactccgatgaggatgaggtcatccccgatattgatgtggaagtagatgtcgatgagctgaatcaggagcaagtggcagacctgaataagcaggccacgacttacggcatggccgatggggatttcgtgcggatgcttagaaaagacaaagaggaagctgaagcaataaaacacgctaaggcccttgaagaggagaaagccatgtatagcggtaggcggagcagacggcaacgccgagagtttcgggagaaacgccttcgcggtaggaagatatccccaccgtcctacgcaagaagggacagtcctacctatgatccctataaacgtagcccatctgagagctcatcagagtcccggtctcggagtcgaagtcctacgcccggaagagaggagaagattacctttattacatcattcggtggttctgacgaagaggcggctgccgctgctgcagcagccgctgctagtggcgttacaactggaaagccgcctgcgcctccacagcccggagggcctgctcctggcagaaacgcaagcgctcggcgacggagctcctcctcgtctagctcctcctccgcttctagaacctcaagcagtaggtcgtcatccagatcctcttccagatcaagacgcggtgggggttattaccgcagtggtcgacatgctaggtcaagatcccgatcttggtccagaagccgtagccggtcaaggaggtatagccgctccaggagtaggggccgtcgtcactccgggggaggcagcagagatggccataggtacagccggtcaccagcgaggagggggggatacggacctagaagaaggagccgatcacggagccatagcggcgatcggtacaggcgcggaggccgaggcttgaggcatcattcctcttcccgctcccgctcatcttggtccctcagccctagcaggtcccgcagtctcacgagatctcgatctcattctccctcaccaagccagagcaggtctagatcaaggtctaggtcccagtctccaagcccatctccagctagggaaaagctgactcgcccagccgcttcccccgctgtaggcgaaaagctgaagaaaaccgagcccgctgccggaaaagaaaccggagcggctaaggtgattaaggccgacaaaaaggcagcccaggaaaagatgattcagcaggagcatgaacgtcaggagagggaggacgagctccgcgcaatggcacgcaaaattcgtatgaaggaacgtgagcgtcgagagaaggagagagaggagtgggaaagacagtactcacgacagtctagatcccccagtcctagatattcacgcgagtactcatcatcgaggagacgctctcgttctagaagcagaagcccccattataggcactag

SEQ ID NO: 22653 - DNA, 1242 bp, Artificial Sequence
  Description of Artificial Sequence: Synthetic coding sequence
atgtcatttagagacctgcgaaattttaccgaaatgatgcgtgctctgggctaccctaggcatatctccatggagaatttccgaacgccaaacttcggcctcgtcagcgaggtcctactgtggctggtgaaacgctacgagcctcagactgacatccccccagacgtagacacagaacaggatcgggttttctttatcaaggccatagctcaatttatggccaccaaggctcatattaagctcaacaccaagaagctgtatcaggctgacgggtacgctgttaaggagctccttaagataacctccgtgctctacaatgccatgaagaccaaggggatggaaggcagcgagatcgtggaagaggacgtgaacaagtttaaattcgatctggggtccaagatcgccgatctgaaggctgcccgtcaattggcctctgaaattacctctaagggagcttctctctacgacctgttggggatggaagtggagctgagggagatgagaacagaggccatcgccagaccattggagataaacgagactgaaaaagtcatgagaatcgccatcaaggagattctgacacaggttcagaaaactaaagacctgcttaacaacgtcgcctctgacgaggccaatctggaggctaagatcgagaaacgtaaactcgagctggaaaggaaccgtaaaaggttagagacgttgcagtctgtgagaccttgcttcatggacgaatacgagaagacagaagaggaattacaaaaacagtatgacacatatcttgaaaaatttcaaaatctgacctacctggagcagcagctggaagaccaccatagaatggaacaagaacgatttgaggaagccaaaaacacactgtgcctgatccagaacaagctaaaggaagaggaaaagaggctcttgaagagcggaagcaatgacgatagtgacatcgacatccaagaagacgacgagtctgatagcgagttagaggagcgcagattgcctaaaccccagaccgcgatggaaatgctcatgcagggtagaccgggaaaacgcattgtagggactatgcagggcggagattcagacgataacgaagactccgaagagagcgagatcgacatggaggacgacgacgatgaggacgacgacttagaggatgagtccatctcactctctcccacgaagccgaatcggcgtgttagaaagtccgagcctttggacgaatccgataatgacttttag

SEQ ID NO: 22654 - DNA, 744 bp, Artificial Sequence
  Description of Artificial Sequence: Synthetic coding sequence
atgcgtacagaggccattgctagacctctcgagattaacgaaaccgagaaagtgatgagaatagctatcaaagaaattttaacccaggtgcaaaaaaccaaggacttacttaacaatgtggcgtcggacgaggcaaatctggaggctaaaatagagaagaggaagctcgaactggagcgcaacaggaagcgtttggagactctgcaatcagtgcggccttgcttcatggacgagtacgaaaagaccgaggaagagttgcagaaacaatacgatacctatctggagaagttccaaaatctgacttatctagagcagcaactggaagaccaccacaggatggagcaagagaggtttgaagaagctaagaatactctgtgtctgattcagaacaagctgaaagaagaggagaagaggctgctgaaaagcggatctaatgatgactcagacatcgatatccaagaggatgacgaaagtgacagcgaattggaggagcgccgtttaccaaaaccacagaccgcgatggaaatgctgatgcaggggaggccaggcaaaagaattgttggcacaatgcagggcggtgatagcgacgacaatgaggacagcgaggagagcgaaattgatatggaggatgacgatgatgaagacgacgatctcgaggacgaatcgattagtctgagccccaccaaaccgaacagaagggtgcgtaaaagcgagccactcgacgagagcgataacgacttctag

SEQ ID NO: 22655 - DNA, 576 bp, Artificial Sequence
  Description of Artificial Sequence: Synthetic coding sequence
atggacgagtacgagaaaactgaagaagagctgcagaaacagtatgatacatatctggagaaatttcagaatcttacctatttagaacagcagctcgaagaccatcatcgtatggaacaggagagattcgaagaggccaagaatacactgtgtttaatccagaacaagctgaaggaagaagagaaacggctactgaagtccggctccaacgatgatagcgacattgacatacaggaggatgatgaaagcgatagtgaactagaggagcgcaggctccccaagccgcaaacagctatggaaatgctgatgcagggaaggcctggtaagcggattgtgggcacaatgcagggtggggatagcgatgataacatggaagccgcaccagcgctgctgggaaaatgtaaaactagcagcagtaagaagcaggaggactctgaggagtccgaaattgatatggaggatgatgacgacgaggacgatgatctcgaagacgagtctatttcgctctctcctaccaagcctaatcggcgagtccgcaagagcgaacccttagatgagtcagacaacgatttctag

SEQ ID NO: 22656 - DNA, 1242 bp, Artificial Sequence
  Description of Artificial Sequence: Synthetic coding sequence
atgtcattcagggacctgcgaaatttcactgaaatgatgagggcattagggtacccacgtcacattagtatggaaaactttcgaactcccaacttcggtttagtcagtgaagtgttgctgtggctggtaaaaaggtacgagcctcaaactgatataccgcctgacgtggacactgaacaggacagggttttttttatcaaggctatagcccaatttatggcaaccaaggcccatattaagttaaacacaaagaaactctaccaggctgatggatacgctgtgaaggaattactcaaaatcacatccgtcttgtataacgccatgaagaccaaaggcatggaaggttcagaaattgtggaggaggacgttaataagtttaagttcgacctgggctctaaaatcgctgacctgaaggctgcaaggcagctagcatcagagattactagcaagggggcaagcttatatgatctgctgggcatggaggtcgagctgcgcgagatgaggacggaagccatcgcaagaccactcgaaattaacgagacagagaaggttatgcgaatcgctattaaggagatcctgacgcaggtgcagaaaacaaaagatctgttaaacaacgtggccagtgacgaggccaacctggaggccaaaatcgaaaagagaaagcttgagctcgaacgtaacaggaagcgcttggagactctccaatccgttagaccttgtttcatggatgaatatgaaaagaccgaagaggagctgcagaaacaatacgacacatacctggagaaattccagaacctgacctatcttgagcagcagctggaggatcatcatagaatggagcaagagagatttgaagaggctaagaatactttgtgcctcatccagaacaaactgaaggaagaggagaaaagattactcaagtccggcagcaacgatgatagcgacattgatatacaggaagatgacgagtcggatagtgagctggaagaacgcaggttaccaaaaccacagacagcgatggaaatgcttatgcaggggcgacctggcaagcggatagtgggcaccatgcagggcggagactccgatgacaacgaagactcagaggaatccgagatcgatatggaagatgatgacgacgaagacgatgaccttgaagacgagtctataagcttatcaccaaccaagcctaaccgacgcgttagaaagtctgaacctcttgatgagtccgacaacgacttctag

SEQ ID NO: 22657 - DNA, 1116 bp, Artificial Sequence
  Description of Artificial Sequence: Synthetic coding sequence
atggcggcagcagctgccggattgggcggaggaggtgccggacccggtcctgaggctggagacttcctagccagataccgtctggtttccaataaactgaaaaaacggttccttagaaagcctaatgtcgctgaggccggtgagcaatttggccagctgggcagggaactaagggcccaagagtgtctgccttacgccgcatggtgccaactggccgttgcacggtgccaacaggccctttttcacgggccaggtgaggctttagcccttaccgaagctgcaaggttgtttcttcgccaggagagagatgcccgacagagactcgtgtgccctgcagcctacggcgagccgctgcaggccgcagcaagcgctctgggggctgccgtgcggttgcatcttgagctgggtcaacccgctgccgcagctgctctctgtctcgagttggctgctgccctacgagatttaggccagcccgctgccgcagctggacatttccagagagcggcacagctgcagcttcctcaactgccccttgccgcactccaagccctgggggaagcagcctcgtgccagctccttgccagggactacaccggcgcactggctgtcttcacacgcatgcagcggctggccagagagcatggtagtcatccggtccagagtctgcccccacccccacccccagcaccacagccaggcccaggggctacaccggcactgccggctgctctcttgcccccaaatagcggttcagcagcgccaagcccggctgcacttggagccttttcggatgtgctggttcgctgcgaagtaagcagggtgctgcttctgcttctccttcaaccccctccggcaaaattgctgccggaacacgctcagaccctggaaaaatattcctgggaagcctttgatagtcacggacaagagtcttcaggccagctcccggaggaactcttcctgcttctgcagagcctggtgatggcgacacacgagaaagacacagaggcaatcaaatctcttcaagtcgaaatgtggcccttgctgactgccgaacagaaccacctcctgcatctcgtccttcaggaaacgatcagccccagtggacaaggagtctag

SEQ ID NO: 22658 - DNA, 1116 bp, Artificial Sequence
  Description of Artificial Sequence: Synthetic coding sequence
atggctgctgcggctgccggattgggcggaggcggtgcgggacccggacctgaggcgggagacttcctggcccgttatagactggtatcgaacaaattgaaaaaacggttcttacgcaaacccaacgtcgcagaagcaggcgagcagtttggccaattgggacgcgagttgagggcccaagaatgccttccctacgccgcttggtgccagttggcagtggctagatgccagcaggccctatttcacggaccgggagaggctctggcccttaccgaggcggctaggttatttcttcgccaggagcgcgacgctagacagcgactggtatgccccgcagcatatggcgaaccccttcaggcagccgcatctgcgctcggcgctgctgtgagactgcacctggaattggggcaaccagcagccgctgccgctctgtgcttggagcttgcggcagccttgagagatttggggcagcccgcagccgcagccggtcactttcagagagcagcccagctccagttgccccaactcccactggcagccttacaagcattaggcgaagccgctagttgccagcttctggcaagggattacacaggcgctttggctgtgttcacacgaatgcaacgtttggcacgggaacatggaagccacccagtgcaatcattacccccacctccacctcctgctccccaaccgggtcccggagcaacgcccgcactgccggcagccctgttgcccccaaattcgggatccgctgctccttcgcctgctgcattaggagccttcagcgatgttctggtccgctgtgaggtgtcaagagtgctcctgttactcctgctgcaaccaccccctgctaagcttctccctgagcatgctcaaactcttgaaaagtacagctgggaagcatttgactcccacggacaagagagctctggtcaactcccggaagagctgttcctcctgctgcagagtctggtgatggcgacccacgagaaggacaccgaagcaataaaaagcctccaagttgagatgtggcctctcttgactgcggagcagaatcatcttctccatctggtgctgcaggaaactatctcgccttctggccaaggggtttag

SEQ ID NO: 22659 - DNA, 1116 bp, Artificial Sequence
  Description of Artificial Sequence: Synthetic coding sequence
atggccgctgcggcagcgggtctcggcggagggggagcgggtcccggacccgaggccggtgatttcctcgccagatacagattggtgtccaacaagctgaaaaaacgcttcctcagaaaacccaacgtggccgaggcaggtgaacagttcgggcaattagggagggagctgcgagcccaagaatgcctgccatatgcggcttggtgtcagttagccgtagctcggtgccagcaggcactctttcatggtcctggggaagctctggccctcactgaggccgctcgactattccttaggcaagagcgcgacgcccgacagagactagtttgtcctgcggcatatggggagccactccaggctgcagcttcggctctgggtgccgcagtgcgcttgcatctcgagctaggccagccggcagccgcagccgctctatgtctggagcttgccgcagctctcagagacctcggtcaacccgctgcggcagctgggcatttccagcgcgcagcccagctgcagttgcctcaacttcccctggctgcacttcaggcacttggggaggctgcttcatgtcagttgttagcacgcgactacacaggcgcactcgccgtgttcacccgtatgcagcgccttgccagggaacatgggtcacatcctgttcagtccctccccccaccacccccacccgctccgcagcctggacccggagccacccccgctctacccgctgccttactgcctcctaactcagggtccgcggctccatcccctgccgcattgggtgctttcagcgacgtgcttgtaagatgcgaggtctcgcgcgtgctgctattgttgctgctccagccaccgcctgcaaagcttctgcccgagcacgctcaaaccctggaaaagtatagctgggaggcattcgattcccacggacaggagtcttcgggtcaattgccagaagaactgtttctgctcctccaatcactggtaatggctacccacgagaaagacaccgaggctattaagtctctgcaagtggagatgtggccattactgacagctgagcaaaaccacctcctgcatctggtactccaggagacgattagtcctagtgggcagggcgtctag

SEQ ID NO: 22660 - DNA, 2502 bp, Artificial Sequence
  Description of Artificial Sequence: Synthetic coding sequence
atgtctcctgagaaacagcaccgggaggaagatgaggtagacagtgtattgctttcagcaagcaagatcctgaactcaagcgagggagtgaaagagtctggctgttccgataccgagtatggctgcattgctgagtcagagaaccagatacaaccacagagcgcattgaaggtgctgcaacagcagcttgagagttttcaagcgctccgcatgcagacactacagaacgtcagcatggtccagagcgagataagcgaaattctgaacaagtcaattatagaggtggagaacccacagttctcctcggagaagaacctcgtgtttggaacgagaatcgagaaggacctccctaccgaaaaccaggaagagaacctaagtatggagaagtcccaccattttgaggatagcaagactctgcattccgtcgaggagaagttatccggcgattctgtgaactcactgccccaaagtgtgaacgttcctagccagatacatagtgaggacacgctgactctcagaacttccactgataacttgtctagtaatatcattattcacccctctgaaaatagtgatattctgaaaaattacaacaacttttatcgtttcctgcccacggcccctcccaacgtgatgtctcaggctgataccgtgattctggacaaatccaagataactgtgccttttttgaaacacggtttttgtgagaaccttgacgatatctgccattccattaagcagatgaaagaggagctgcagaaatcccacgatggagaggtggcactcaccaatgagctccagactctgcaaactgaccccgacgttcataggaatggcaagtacgacatgtcgcctatccatcaagataagatgaatttcattaaggaggagaatctggatggtaatctgaacgaagacatcaagagcaaacgaatttcagagctggaggcgttggtaaagaagctgctgccctttagagaaacagtgtccaagttccacgttcatttctgcagaaagtgcaaaaagctcagtaaatcggagatgcacagggggaagaagaacgaaaaaaacaacaaggagatccctattaccggtaagaatattactgacctcaagtttcactcaagagtgcccaggtataccctgtccttcctggatcagaccaagcacgaaatgaaagataaggagagacagcctttcctggtcaaacagggcagtatcatctccgagaacgagaagacttctaaagtgaacagcgtgacagaacaatgcgttgccaagatccagtacctgcaaaactaccttaaagaatcagttcagattcagaagaaggtaatggaactggagagtgagaatctgaatctgaagtctaagatgaagccccttatcttcaccactcagtctctaattcagaaagtggagacgtatgagaaacagttaaagaacctggtggaagaaaagtccactatccagtctaagttgtccaagacggaggaatactctaaggagtgtctgaaagaattcaagaagatcatctccaagtataacgttctgcaaggtcagaacaaaactctagaggagaagaatatacagttgtcacttgagaaacagcagatgatggaggccctggatcagctgaagtccaaggaacacaagactcagtctgatatggccatcgtaaacaatgagaataataggatgagcatagaaatggaagccatgaagacgaacatcctactgatccaggacgagaaggaaatgctggaaaaaaagacgcatcagcttttaaaggaaaaatcctctttggggaacgaactgaaagagtcacaattagagatcatccagctgaaggagaaggagcggctagccaagacagagcaggagaccctcctgcagattattgagactgtgaaggatgagaagctgaacttggagaccacgctgcaagagagtaccgctgctcgacagattatggaaagggagatcgagaatattcaaacataccagtcgacagctgaagagaactttttacaagagatcaaaaacgcaaagtcagaggcgtccatctacaaaaacagtttgtccgagatcggcaaagagtgtgaaatgctgagcaagatggtcatggaaactaagacagacaaccagatcctgaaggaagagctgaaaaagcatagtcaggagaacattaagtttgagaattcaattagtcggctgaccgaggacaagatactccttgagaattacgttcgtagtatcgagaacgaaagagacactctggaatttgagatgcgtcacctccagcgcgaatacttaagtctaagcgataagatctgcaaccagcacaatgacccatctaagactacgtatatttctagacgggagaagttccacttcgataattacacgcacgaggacacatcaagtccccaaagtagaccactggcttctgatctcaaaggctactttaaggtgaaagatcgtacactcaagcatcactag

SEQ ID NO: 22661 - DNA, 2391 bp, Artificial Sequence
  Description of Artificial Sequence: Synthetic coding sequence
atgagtccagagaaacaacaccgggaggaggatgaggtggattctgtcttactcagtgcgtctaaaattctgaatagcagcgagggggtgaaggaaagtggctgctccgatacagaatacgggtgtatcgccgagtcggaaaaccaaattcagccccaaagcgccttaaaggtgctgcagcagcagttagagtccttccaggccctgaggatgcagacacttcagaatgtcagcatgccaacagagaatcaggaagaaaatctgtccatggaaaagtcacaccacttcgaggactcaaagacgctgcacagcgttgaggagaaactgtctggggatagcgtgaattctctgccccagagcgttaacgttccctctcagatccactctgaggatacgcttactctgcgtacctcaacggacaacctgtcttccaacattatcatccatccatcagaaaattcagacatcctcaaaaactacaacaacttctaccgcttcctgccaactgcgccaccgaacgtaatgagtcaggcggacaccgtgattcttgataagtctaaaattacagtccccttcttgaaacacggcttctgcgagaacttggatgatatttgtcattccataaaacagatgaaagaggagctgcagaagtctcatgacggcgaagtagccctgaccaatgagcttcagactctgcagactgaccccgacgtccatcggaacggtaagtatgacatgtctccaatccaccaggataagatgaatttcattaaagaggagaacctcgatggcaacctcaacgaggacattaagagcaagagaatttcggaactagaggcactggttaaaaaattactgccattccgagagacagtgagtaagtttcacgttcacttctgtagaaaatgtaagaaactgtccaagagcgagatgcatagaggcaaaaagaatgagaaaaataacaaagaaataccaatcaccggtaagaatataacagacttgaaattccactctcgggttcctcggtacacgctatcttttctggaccaaacaaaacacgaaatgaaagataaagaaagacaaccatttctggtaaaacagggttcgataatttccgagaacgagaaaacttccaaggtgaactcagtgactgagcagtgtgtcgccaaaatacagtacctccaaaactatcttaaggagtcagtgcaaatccaaaaaaaagtgatggagctggagagtgagaacctgaatttgaagtcaaagatgaagcccctgatctttacaacccagagcttgatccaaaaggtggaaacatacgaaaaacaactgaagaacctggtggaggagaagtctacgattcagagtaagctgagcaagacagaggaatactctaaggaatgtctaaaggaatttaagaaaatcatcagcaagtataatgttcttcaaggacagaacaaaacactggaagaaaagaatatccagctaagcttggaaaagcaacagatgatggaagcccttgaccaactgaaaagcaaggaacataagacccagtccgatatggctatagtgaataatgagaacaatagaatgtcaatcgagatggaagccatgaagaccaatattctcctgatccaggacgaaaaggaaatgctggaaaaaaagacgcaccaactgctgaaggagaagagctccctaggaaatgaactgaaggaaagtcaactagaaatcatccagctgaaggaaaaagagagactggctaaaaccgaacaggagactttgcttcagatcattgaaacagtgaaggatgagaagctgaacctcgaaacaaccctgcaggaaagtacggcagctaggcagatcatggagcgagagatcgagaatattcagacatatcagtcaacggcggaggaaaacttcctgcaagaaatcaaaaatgcgaaatccgaagcttcaatttacaaaaatagtctctcggaaattgggaaagaatgcgagatgttgtctaagatggtaatggaaactaagactgacaatcagatactgaaggaggagttgaagaagcactcccaggagaacatcaagttcgagaattccatctcacgactgactgaggacaagattttgcttgaaaactacgtccgatctattgagaatgagcgtgataccctggagttcgagatgcgtcatctgcaaagggagtatttgagtttaagcgataaaatttgtaaccaacataacgatccaagcaagaccacctacattagtcgcagagagaagttccattttgacaactacactcacgaggacacatcctctcctcaaagtcgtcccctggcctcggatcttaaaggttacttcaaggtgaaagatagaacccttaaacatcactag

SEQ ID NO: 22662 - DNA, 726 bp, Artificial Sequence
  Description of Artificial Sequence: Synthetic coding sequence
atggctcctgtcagaaggtccgcgaagtggcgcccaggcggaattgaagcaagaggcgaaggagtgagtacagtgggatataggaataagaatgtccgacagaagacctggcggccaaaccatccacaggcctttgttggctctgtccgcgagggacagggcttcgcattcagaagaaaattaaagattcagcaatcatataagaagcttctgcgcaaagagaaaaaagcgcaaacgtcactcgagagccagttcaccgatcgctatcctgacaatttgaagcacctgtacctagcagaggaggagcggcaccggaagcaggccaggaaggtggatcacccactgagcgagcaagttcatcaacccctgctggaggaacaatgcagcattgatgaaccattgttcgaggaccagtgttcctttgaccagccacagcctgaggagcagtgcatcaaaaccgtcaactccttcactatacctaaaaaaaacaaaaagaagacctctaatcagaaagctcaggaggaatatgagcagatacaggcgaagagagctgcaaaaaaacaggagttcgaacgacgtaaacaagagcgagaagaggcgcagcggcagtataaaaagaagaagatggaagtcttcaagattctcaataagaaaaccaagaaaggacagccaaatctgaatgtgcagatggaatatcttctccagaagatacaggagaaatgttag

SEQ ID NO: 22663 - DNA, 888 bp, Artificial Sequence
  Description of Artificial Sequence: Synthetic coding sequence
atggaacaccaattgctctgttgcgaggttgagaccattcgccgagcttatcccgacgcgaacttactcaatgaccgcgttctgcgcgctatgctgaaggcggaggagacctgtgctccctctgtcagttactttaaatgcgtgcagaaggaggttttgcccagtatgcggaagatcgtggccacatggatgttggaggtatgtgaggagcaaaaatgtgaggaagaagtgttcccgctcgcaatgaattatctagaccgattcttatccttagagcccgtgaaaaagtcccgcctgcagctcttaggtgcaacttgcatgttcgtcgcaagcaaaatgaaagaaaccattcctcttactgccgagaagctatgtatttatacagataactcaatccggccagaagaactacttcagatggagctccttctggttaacaagctcaagtggaatctggccgctatgacaccgcatgattttatcgagcatttcctgtcaaaaatgcctgaggccgaggaaaataaacaaatcattcgcaagcacgcccaaacattcgtcgccctgtgcgccacggacgtaaagttcatctcaaacccccctagtatggtggcagccggaagcgtggtggctgcagtgcagggccttaacctcagaagccctaacaattttctttcttattaccggttgactcggtttctttccagggtgatcaagtgcgatcccgactgtctgagagcatgccaggagcagatagaggctctgctggagtctagcttgcgccaagctcagcagaacatggacccaaaggcggctgaggaggaggaggaggaggaggaagaagtggacctggcttgcacccctacagacgttcgagatgtagacatctag

SEQ ID NO: 22664 - DNA, 492 bp, Artificial Sequence
  Description of Artificial Sequence: Synthetic coding sequence
atggatacccccctcagacgctccaggcggcttggcggactgcgacccgagagccctgaatcattgacatcggtcagcagaactagacgcgctctggttgaatttgagtcaaaccccgaagaaacgcgagagccaggcagccccccttcagttcagcgcgctggactgggttctcccgagcgccctcccaagacttctccagggagccctcgcctgcagcagggtgccggattggagagtcctcaaggccagcctgagccgggagcggcaagtccacagagacagcaggacctccacctggagagcccccagaataaagaagagcttacccccggtgctccccagcaccagctgcccccagtcccaggatctcccgaaccctacccgggacagcaagcgacatcctcctggggcgacggtgatcgcagactccgcggaaaagaggctaagcggttctttatccctggtccatccgtgcaagaggttgagtag

SEQ ID NO: 22665 - DNA, 315 bp, Artificial Sequence
  Description of Artificial Sequence: Synthetic coding sequence
atgcttcaggataagccactaagaaccagctggcagaggaaaatgaaagaacggcaagaacgtaaactcgccaaagacttcgccaggcacctagaagaagagaaagaacgccgacggcaggagaagaaacagaggcgtgcagagaaccttaaacggcgactggaaaatgagaggaaagctgaggtcgtccaggtgatccggaaccccgcaaaattgaaaagggccaaaaaaaagcagctgagaagtatcgaaaaaagagacactttggcgctgctgcagaagcagcccccacagcagcctgctgccaagatctag

SEQ ID NO: 22666 - DNA, 819 bp, Artificial Sequence
  Description of Artificial Sequence: Synthetic coding sequence
atggaggaggaggccattgcctccctgcctggcgaagagacagaggacatggacttcctatcagggctcgagctggctgatcttctagatcctagacagccagattggcatctggaccccggactaagctcacctggccctctctcttcgtcaggcggtgggtccgattcaggtggtctgtggagaggggacgatgacgatgaagccgcagcagccgagatgcagcgttttagcgatctgctgcaacgactgttgaacggaatcggaggatgttcatcctcgagcgatagtggaagtgccgagaaaaggagacgtaagagtcccggaggcggtggtgggggtggtagcggcaacgataataaccaagcagctaccaaatccccacgaaaagccgctgcggcagctgccaggctgaaccgactgaagaaaaaagagtatgtaatgggcctggagagccgggtgagaggcctcgctgccgaaaatcaggaactgagggccgagaatagggaactgggcaaaagggttcaggccctgcaggaggagagcagatatctgagggcagtgttggcaaatgaaacaggacttgcacgtcttttaagccgcctgagcggggttgggttacggctgaccacatcactatttcgggattctcctgccggtgatcacgattatgccctgccggtggggaaacagaaacaggacctactcgaggaagatgactccgccggtggggtttgcttgcatgttgacaaagataaagtgagtgtggagttctgttcggcctgcgcgagaaaagcaagcagcagtctgaaaatgtag

SEQ ID NO: 22667 - DNA, 1065 bp, Artificial Sequence
  Description of Artificial Sequence: Synthetic coding sequence
atgagacacagcctcacaaaactcctcgccgcatcaggaagtaatagcccaactaggagcgaatctcccgagccagccgcaacatgcagtcttccctcagatctgactcgcgcagcggctggcgaggaagaaaccgccgctgcgggatcccccggaagaaaacagcaattcggggacgaaggcgaactggaagcgggaagaggctcaaggggcggagtggctgtgagagccccatcacccgaggagatggaagaagaggccattgcatccttacctggggaagagacagaggacatggacttcctgtcaggtttagagcttgctgatctgcttgatccacggcagcccgattggcacctggatccagggctgtccagtccaggccctcttagctcctccgggggtggcagcgacagcggagggctctggaggggggatgatgatgacgaagccgctgctgctgagatgcaacgcttcagtgacttattgcagaggctgttgaacggaatcggtgggtgctcttcatcctccgactccggctcagccgagaaaagacgccgaaagagccctggaggcggtgggggtggagggtctggtaatgataacaatcaggctgcaacaaaaagcccaaggaaggccgcagccgcagccgcacggctgaacagactgaaaaaaaaggaatacgtgatgggcctggaatcgagagtgaggggacttgcagccgaaaaccaggaattacgggctgaaaaccgcgagctggggaaaagagtacaagccctgcaggaagagtctcgttatctgagagctgttttggccaacgagacaggcctggccagacttttatcaaggctgtccggcgtaggattacggttaaccacctctcttttccgcgattcccctgcaggggatcatgattacgccttaccggtcgggaaacagaagcaagatctgctggaggaggacgacagcgctgggggtgtttgcctgcacgttgacaaggataaggtaagcgtggagttctgcagcgcctgcgctaggaaggcctcgtcgtcattgaaaatgtag

SEQ ID NO: 22668 - DNA, 1065 bp, Artificial Sequence
  Description of Artificial Sequence: Synthetic coding sequence
atgcgccactccctgaccaagctccttgcagccagcggaagcaatagccctacgcggagtgaaagtccagagcctgccgcaacttgctcactgccctccgatctaacaagagctgcagctggagaggaagaaacagccgcagccggttccccaggtagaaaacagcaattcggagacgagggtgagctggaggctggaagaggcagccggggaggcgtcgcagtacgggctccctcccccgaggagatggaggaagaggccattgctagcctgccaggcgaagagacagaggacatggacttcctctccgggctggaactggcagatctgctggaccctcgtcagccagactggcacctggatcccggattgtccagccctgggcctctgtcatcaagcgggggaggtagcgatagtggaggcttatggagaggggatgatgatgacgaagctgccgctgctgaaatgcagagattctctgacttgctgcaaaggctcctgaacggcatcggcggttgctcttcatcatcagactccggatctgcagagaagcgcaggaggaaatctccgggagggggaggcggagggggatctggtaacgacaacaaccaggcagccaccaaatcaccacgcaaggcagcggctgcggctgctagactgaatagactgaagaagaaagaatacgtgatggggctggagagcagggtgagagggctggctgcggagaatcaggagcttagggcagaaaacagggaattgggaaagagagtgcaggcgttgcaagaggaatcccgttatctgagagccgtgcttgccaatgagacaggactggcgagactgctgtcgcgcttaagtggagttggtttgcgtctcacaacatccctattcagggattccccagctggcgaccatgactacgcgctgcctgtaggcaaacaaaagcaggatttactagaggaagatgattcagccggaggcgtgtgtttacacgtggataaggataaagtaagtgtggagttctgttccgcatgtgctcggaaggccagttctagcctgaagatgtag

SEQ ID NO: 22669 - DNA, 816 bp, Artificial Sequence
  Description of Artificial Sequence: Synthetic coding sequence
atggagcatgggtctatcattacacaagctcgccgagaagacgctcttgtcctcacgaaacagggactggtgtctaaaagcagtcccaagaagccaaggggcagaaacatattcaaagcactgttctgttgcttccgagctcagcatgtcggccaaagttctagctctaccgagttagcagcgtacaaagaggaggccaataccatcgccaagagcgacctgttacagtgcctgcagtaccagttttatcagattcccggaacttgtctgctgcctgaggtcaccgaagaggaccagggaagaatctgtgtcgtgattgacctggatgagactcttgtccactcatcttttaagcctattaataacgccgatttcattgtgcctatcgagatcgaggggacaactcaccaggtatatgtcctgaagcgcccatacgtggatgagttcttgcgcagaatgggtgagctcttcgagtgtgtcttattcaccgccagtttggccaaatacgcagaccccgtgacggacctgctcgataggtgtggtgtgttccgggcacggttgtttagggagtcatgcgtctttcaccaaggctgctacgtcaaggatctctcaaggctgggacgggatttgagaaagacacttatcttagataatagccccgcatcatatattttccacccggagaacgcagtgcccgttcagagctggtttgatgacatggcagatacagagttgctgaacctcattcccatcttcgaggagttgagcggtgccgaggacgtctataccagcttgggacagttacgggctccttag

SEQ ID NO: 22670 - DNA, 831 bp, Artificial Sequence
  Description of Artificial Sequence: Synthetic coding sequence
atggacggccctgcgattattactcaggtgactaaccccaaagaggatgagggcaggttgccgggtgcgggagagaaagcatcacagtgtaatgtgtcactcaaaaagcagagatcacgaagcatactctcaagcttcttctgttgctttagagactacaatgtcgaggctcctccaccctctagcccctcggtgctgccacccttggtcgaagaaaacggcggtctgcagaagggggatcagcggcaggtcatcccgatccccagccccccagcaaagtacctgcttcctgaggttaccgtgctggactatggtaagaaatgtgtagtgattgatctagatgaaactctggtgcacagctcctttaaacccatctcaaatgctgactttatcgtgccagtcgagatagacggcaccatccaccaggtgtacgttctgaaacgaccccatgttgacgaattcctgcagaggatgggacaactcttcgagtgtgtgctgttcactgccagtctggcaaagtacgctgatccagtagcagatctgctagatcgttggggagtcttcagggcacgtctcttccgcgagtcctgtgttttccaccgaggaaactacgtgaaggacctttcccgccttggcagagagctgtctaaggtcataattgttgataacagccccgctagctatatattccaccccgaaaatgccgtccctgtccagtcttggtttgacgacatgacagacacagaactgctcgatttgatcccatttttcgaggggctcagtcgcgaggacgacgtttactccatgctgcacaggctttgcaacaggtag

SEQ ID NO: 22671 - DNA, 798 bp, Artificial Sequence
  Description of Artificial Sequence: Synthetic coding sequence
atggacggccctgccatcatcacacaggtgacaaatcctaaagaagacgaggggagactgccaggagccggagagaaagctagccagtgcaacgtgagcctcaaaaaacagaggagcagatccatcctgagttcatttttctgctgtttccgggattataacgttgaagcccctccgccatcaagcccaagcgtcttaccaccattggtggaggagaatggaggcttacagaagccccctgccaaatatctgctgccagaagtgactgtactcgattacggtaaaaagtgtgtcgtaatcgatctggatgagacattagttcacagttcttttaaaccaattagcaatgccgacttcatcgtgcccgtggagatcgacggcacgatccaccaggtgtacgtcctgaagaggcctcacgtggacgagttcttgcagaggatgggacagctgtttgaatgcgtactgtttaccgcgtctctcgccaagtatgcagacccggtagcagacctcctcgacagatggggtgtgttccgcgctagactcttcagagaaagttgtgtgttccaccggggtaattacgtcaaggacctgtcgcgattggggagagagctcagcaaagttatcattgtcgataacagtcctgcctcatatatatttcatcccgagaatgcagtcccagtgcagtcctggttcgacgatatgactgacaccgagctgctcgacctgatccctttcttcgaagggctttctagggaggatgatgtttactcaatgttgcaccggctttgtaaccgctag

SEQ ID NO: 22672 - DNA, 3522 bp, Artificial Sequence
  Description of Artificial Sequence: Synthetic coding sequence
atgtcgcgtggatccatcgaaattcccctgcgcgacacggatgaagtcatcgaactcgactttgaccagctgcccgagggtgatgaggttatctccattctgaagcaagaacacacccaactccatatctggattgcattggcactggagtactacaaacagggcaaaacagaggagtttgtcaagttgctagaggctgctcgcattgacggaaacttggactaccgggatcacgaaaaagaccagatgacatgtttggacacacttgccgcttattatgtacagcaggcgagaaaagagaagaacaaggacaataagaaggacttaataactcaggcaacacttctctacaccatggccgacaagataatcatgtacgatcagaatcacctactcggacgtgcctgcttttgccttctggaaggagacaaaatggatcaagccgacgcgcagtttcatttcgttttgaaccagagccccaataacattccagctctgctgggaaaggcatgcatttcctttaacaaaaaggattatagaggcgcactggcttattataagaaagctctcaggacgaaccccggatgccccgctgaagtgcgtctgggaatgggacactgtttcgttaaacttaataaactggagaaggccagacttgccttctcccgggctctcgaactgaactcaaagtgtgttggggctctggttggcctggctgtcctcgagctgaataacaaagaggcggatagcatcaagaacggagtccagctgctgagtcgcgcatacacgatcgacccatctaaccccatggtgctcaatcacctggcgaatcatttcttctttaagaaggattattctaaggtgcagcacttggctcttcacgcatttcacaacacggaggttgaggctatgcaggcagagtcctgctatcagctggctaggtctttccatgtccaggaggactacgatcaggccttccagtattactaccaagcaacccaattcgcttccagttctttcgttctcccattcttcggcctgggacagatgtacatctaccgcggagataaagagaatgcctcccagtgctttgaaaaggtgctaaaagcttaccccaataattatgagacaatgaagattctcgggagtttatatgctgcaagcgaagaccaggaaaagagagatatcgccaagggtcacctcaaaaaggtgaccgaacagtatccagatgacgtggaggcctggattgaactggcccaaatactggaacagactgacatccagggtgcactgtctgcctatggcacagcaacacggatcctgcaggaaaaggttcaagccgacgtccctcctgaaatattaaataacgtgggggcactgcattttagacttgggaacctcggcgaggcaaaaaaatattttttggcgtcactggatagggccaaagcagaagcagaacatgacgagcattactacaacgccatatccgtgactaccagttacaatttagccaggctttacgaggccatgtgcgagttccacgaagccgaaaagctttataagaatatcttgagggaacatcccaattacgtcgactgctatcttcgccttggagctatggccagagataagggcaacttctacgaggcgtccgattggtttaaagaagctttgcagatcaaccaagatcaccctgatgcatggagtctgatcggcaatctgcatctggccaagcaggaatgggggcctggccaaaaaaaattcgaacgaatcctcaagcagcccagtacccagtccgatacctatagtatgctggctcttgggaacgtgtggctgcaaacactgcaccagccaactagggatcgggaaaaagagaagcggcatcaagaccgcgcactagcgatctacaagcaagtcctgagaaatgacgccaagaatctgtatgcagcaaatggaatcggggcagtcttagcccacaagggctattttagggaagcgcgagatgtgtttgcccaggttagggaggcgacggccgatataagcgatgtgtggctgaatctcgcacacatctatgtggagcagaagcagtacatttcggctgtacagatgtatgagaactgtttacggaaattttacaagcaccagaacaccgaagtggtcctttacctggccagagctttgttcaaatgtggcaagctgcaggagtgcaagcaaaccctgctgaaagctaggcacgtcgctccttcggacaccgtactgatgtttaatgtcgccctcgtgcttcagcgtttggccaccagtgtcctgaaggatgagaaaagtaacctgaaggaagtgctgaatgccgtcaaagaactcgagttagctcaccggtacttctcctatctctctaaggtaggtgacaaaatgcggtttgacctggccctggccgcaactgaggcgcgacagtgctctgatcttctctcccaggcacagtatcacgtagcgcgtgcaaggaaacaggatgaggaggagcgggaactgcgggcaaaacaggagcaggagaaggagcttctgcggcagaaactgctgaaagagcaggaggagaaacgtctgcgggagaaggaggaacagaagaaattattagaacagcgcgctcaatacgtggagaagactaaaaacatcctgatgtttaccggagagacagaagccacaaaagagaagaagaggggaggcggagggggtaggcgcagtaagaaggggggtgagtttgacgagttcgtgaatgatgataccgacgacgatctccctatttccaagaaaaagaagaggcggaaaggatctgggtctgagcaggagggggaggacgaggagggtggggagcggaagaagaagaaacggaggcgacacccgaagggcgaggaaggatccgacgatgacgagaccgagaacggtccgaagcctaagaaaaggcggccaccgaaggctgaaaaaaaaaaggcaccaaagccagaacgtctgccgccttccatgaaaggtaagatcaaaagtaaggctatcatcagtagctctgatgattcatctgacgaggataaacttaaaattgcagacgaagggcatcccaggaacagtaattctaattctgattctgatgaagatgagcagcggaagaaatgtgcgtcctcagaaagcgattctgatgagaatcagaataaaagcgggagcgaggccggttcccctcgtcggcctaggagacaaagatctgaccaggacagcgactcggaccagccttctcgaaaaaggcggccatcaggatccgaacaatccgataatgaaagcgtgcaatctgggaggagtcactcaggggtaagcgagaacgattcccgaccggctagtcctagcgcggaatccgaccacgaaagcgaacggggatctgacaacgaagggtctggccaaggctccggaaacgagtcagagcctgagggctccaacaacgaagcctccgatcggggatctgaacatgggtcagacgattctgactag

SEQ ID NO: 22673 - DNA, 3693 bp, Artificial Sequence
  Description of Artificial Sequence: Synthetic coding sequence
atggcttcggcctcctatcacatctccaacctattggagaaaatgacatctagcgacaaagacttccgcttcatggccaccaacgacctgatgaccgagctccagaaggactccataaagctcgatgacgactcagagcgcaaggttgtcaaaatgatccttaaacttcttgaagacaaaaacggggaagttcagaaccttgcagttaaatgtctcggaccccttgtttcaaaggtcaaggagtaccaagtggagaccatcgttgatactctgtgtaccaacatgctttctgataaagaacagttgcgcgatatttcttctatcgggctcaagaccgtgattggagagctgcctccagctagtagtgggagcgcgctcgctgccaacgtgtgtaagaagatcaccggaaggttaacttcagccattgccaagcaagaagacgtgagcgtccagcttgaagctctggacatcatggctgatatgctgagcagacagggtggcctgctggtgaactttcaccctagcattctcacttgtcttctgccacaacttactagtccacgactggccgtgcggaaacgcacaatcatcgccctcggtcacttggtgatgtcatgtgggaacattgttttcgttgatctgatcgagcatctgctgagcgagttgtcgaagaatgatagcatgagcaccacacgaacttatattcagtgtatcgcagcaatttcacggcaggccggacacagaatcggggagtacctggaaaaaatcattccgcttgtcgtgaagttctgcaacgtggatgacgacgagcttagagaatactgcatccaggcctttgagagttttgttcgaaggtgccccaaagaagtttatcctcacgttagcactattataaatatatgtctcaaatacctgacatacgaccccaactacaactatgacgatgaagatgaggacgagaatgccatggacgccgatggaggggacgatgatgaccagggcagtgacgatgaatatagtgatgatgacgatatgtcgtggaaggtccgcagggctgccgctaaatgtctcgacgccgtggtctctacacgacatgagatgctgcccgaattttacaaaaccgttagccctgccttaataagtcgtttcaaggaacgggaggagaacgtaaaagccgatgtgttccacgcctatttatctcttctgaagcagacaaggcccgtgcagagctggctgtgcgaccccgatgctatggaacaaggggagaccccacttacaatgctgcagagtcaggtgccaaatattgttaaggctctgcacaaacagatgaaggagaagtccgtgaagacccgccagtgctgcttcaacatgcttactgaattggtgaatgtgctgcctggcgctctaacgcagcacatcccagtactagtgcctggcataatcttcagcctcaatgacaagagctcctcatctaatctcaagatcgatgcactgtcttgtctgtatgtgatcctctgtaaccactccccacaggtgttccacccacacgtgcaggcactggttccccctgtggttgcttgtgtaggggaccctttttacaagatcacaagcgaggctctcttggtgacacagcagctggtgaaagtaatccgaccgctcgaccaacctagctcttttgatgcgaccccatacatcaaggatctctttacttgtacaataaaacgccttaaggcggctgatatcgatcaagaggtaaaggagcgtgccatctcttgtatgggccaaattatctgcaatttgggggacaacctcgggtctgacctgccaaataccctccagatattcctggaacggcttaagaatgaaattacgcgactgaccaccgtgaaagcgttgactttaatcgccggtagccccctaaagatcgacctgaggcccgttctaggcgaaggcgtgcctatcctcgcctcctttctcagaaagaaccaacgagccctcaaactcggcactttaagcgccctggacatacttatcaaaaactactccgattctcttacggccgcaatgatagacgcagtcctggatgagctcccaccacttatcagcgaatccgatatgcacgtttcccaaatggctataagttttttgactacactggccaaagtgtatccgtccagcctgagcaaaatctcaggcagcattctgaacgagctcattggcctagtcaggtctccactccttcagggcggagctctatcggcaatgttggactttttccaagctctcgtagtgactggcacgaataatctgggatacatggatctactgagaatgctaacaggacctgtctactctcagtccactgcactaacccacaagcagtcctactatagcatcgctaagtgtgtggccgctctgactcgagcctgtcctaaagaaggacccgctgttgtggggcagtttattcaggatgtgaaaaactccagatcgacagattctatcaggctattagcactgctgagccttggcgaggtggggcatcatattgacctctcaggccagctggagctgaaatccgtcattctagaggcattcagttctccttctgaggaggtgaaaagtgcagccagctacgccctggggtccatctctgttggcaacctgccagagtatcttccattcgtattacaggaaattacttcccaacctaagagacaatatttgctacttcatagtctgaaggagattatatcctccgcttcggtggtcggcctcaagccctatgtggagaacatttgggcccttttactgaagcactgcgaatgtgctgaagaggggacaagaaatgtggtggccgagtgcctggggaagttaacactcattgatccagaaacactgttacccaggctgaaaggatacctcatctctggctcaagttatgcaagatcctcagtggttacagctgtcaaattcactatttccgaccatccgcaacccatagatcctctcctgaagaactgtatcggggattttctgaaaacgctggaggatcccgacttaaatgtcagacgggtcgccctggtaacttttaactcagcggctcacaataaaccctccctgatccgggacctgctggatacagtcttgccccatctctacaatgagaccaaggtgcggaaggagttgatccgggaggtcgagatgggacccttcaagcacaccgtcgacgacggcttggacatccgtaaggcagctttcgaatgcatgtacacgcttcttgactcatgtctggataggctggacatcttcgaatttcttaatcatgtggaagatggccttaaggatcactacgatattaaaatgctgacctttctcatgctagtacggctgtctaccctctgtcccagcgccgtactgcagcggcttgataggctggtcgagcccctgcgtgcaacttgcacgaccaaagtgaaagccaacagcgtgaaacaggagtttgagaagcaggacgagctgaagcgcagcgctatgcgggctgtggctgccctgctcacaatcccggaggccgaaaaatccccactcatgtccgaattccagtcccaaataagcagcaaccctgagctggctgccatctttgagtctattcagaaagacagcagcagcaccaacctcgaatctatggacactagttag

SEQ ID NO: 22674 - DNA, 1209 bp, Artificial Sequence
  Description of Artificial Sequence: Synthetic coding sequence
tacgaactggtctctaggcagggcggactgcttgttaatttccaccctagcatcctgacttgccttctgccacagctgacatcccccagactcgccgtacgaaaaagaaccatcattgccctggggcacctggtcatgtcttgcggaaatattgtctttgtggacctgatcgagcacctgctgagcgagctctccaaaaatgattcaatgtctacaacgcggacttatatccagtgcatcgcagctatctctcggcaggctggtcatcgaatcggcgagtatctggagaaaatcatcccgctcgtggtgaagttttgtaatgttgatgacgacgagttacgggaatattgcatccaggctttcgagtcgttcgtgagaagatgtcccaaagaagtgtaccctcacgtgagcaccatcattaatatttgtcttaagtaccttacgtacgatccaaattataactatgatgacgaggacgaggatgagaacgcgatggatgctgacggtggagacgacgatgatcaagggtctgacgatgaatatagtgatgacgacgacatgtcttggaaggtgcgccgagctgccgctaaatgtctcgatgctgttgttagcactcgccacgagatgttaccagagttttacaaaacagtgagtcccgcactaatcagcagattcaaggagcgggaagagaacgtgaaggccgatgtcttccacgcatacctttccctgttaaaacagacgagaccagtacagagctggctttgtgacccagacgcaatggaacaaggcgagacacctctcacaatgctgcagagccaagtacctaacatcgtaaaggctctgcacaaacaaatgaaggaaaagagtgtaaaaacacgacaatgctgcttcaatatgctgaccgagttagtgaacgttctgcccggagcccttacccagcacattccagtgctggtccccggtattattttcagcctgaacgacaagtcctcctctagcaatctaaagattgatgccctgagctgcctctacgttatcttgtgcaatcacagtcctcaggtctttcacccccatgtgcaggcgctggtgcctcccgttgtggcctgcgtgggggatccgttctacaaaattacctccgaggctttgttagtcactcagcagctagtgaaggcccaccacatgccagaagcccagtggctgcgactttag

SEQ ID NO: 22675 - DNA, 3693 bp, Artificial Sequence
  Description of Artificial Sequence: Synthetic coding sequence
atggcaagcgcaagctaccacattagcaacctgctggagaagatgacttcctccgacaaggattttagattcatggcgacaaatgaccttatgaccgaactgcaaaaggactccattaaacttgacgatgattccgagaggaaggtggttaaaatgatccttaagctcttggaggacaaaaatggtgaggtgcaaaatttggccgtgaagtgtctcggtcccctggtctccaaggtcaaagaataccaggtagagacaatcgtggacaccctgtgcaccaatatgctttctgataaggagcagctgcgagacatatccagcattggattgaaaaccgtcatcggagagctccccccagcctcgtcgggcagcgcactggcagcaaatgtgtgcaagaaaataacgggacgactcacttctgccatagcgaagcaggaagatgtcagcgtgcagctggaagctctggatattatggcggatatgctgagccggcaaggcggtcttcttgtcaactttcatcctagtatattgacctgtttgctcccacagcttacatccccacgcttagctgtcagaaagagaaccattattgctctgggccatctggttatgtcttgcggtaatatcgtatttgtagacctgatcgagcatttgctttctgagctctcaaagaacgactctatgtcgacaacgcgcacatacatccagtgcattgccgcaatctcgcggcaggcaggacatcgcataggcgagtacctcgagaaaattattcccttagtggtgaaattctgcaatgtcgacgatgacgagctcagagaatactgtatacaagccttcgaatcttttgtcaggcgctgcccaaaagaggtttatccccatgtgtcaaccatcatcaacatatgcttaaaatatctcacttacgaccctaattacaactacgacgacgaagatgaggatgaaaatgcaatggatgccgacggaggcgatgatgacgaccagggaagcgatgatgagtactccgatgatgacgatatgtcttggaaggtgcgtcgagcagctgctaaatgccttgacgcagtcgtcagtacccgacacgagatgcttcccgaattttataagactgttagccctgctctgattagccggttcaaggagcgggaggaaaacgttaaagcagacgtcttccatgcctatttatctctcctgaagcaaactagaccagttcagtcttggttatgtgatccagatgcaatggagcaaggggaaacccctctgacaatgctccaatcccaggtgccaaacatagtcaaggccttgcataagcagatgaaagaaaaaagcgtcaaaacccggcagtgctgctttaatatgcttacagagctcgtgaatgttttgcctggagcactgactcagcacatccccgtgctagtcccaggaatcatttttagcttgaatgataagtccagtagttcaaatttaaagattgatgctctgtcgtgcctgtacgtcatcctctgcaaccactccccccaggtctttcatccacacgtccaggcactggtccccccagtggtggcctgtgtcggtgatccattttacaagatcaccagtgaggccctgctggtgactcaacaactggtgaaagtgattagacccctggatcaaccctcatccttcgacgctaccccgtatataaaagatctgttcacctgtacaataaagcggcttaaagcggcagatatcgatcaggaggtgaaagagcgcgcaatctcttgtatgggccagatcatttgcaacttgggcgataatctggggtctgacctgcctaacactctccagatattccttgaaaggctgaaaaacgaaattactcgcttgacgaccgtaaaagctctaaccctaattgcaggctctcccctgaagatcgatctaaggcctgtactcggggagggagtgcctatcttggcctcatttctcaggaagaatcagagagccctgaagttgggaacactgtctgccttagacattctcatcaagaactactctgacagccttaccgctgccatgattgacgccgtcttggacgagcttccacctcttatttctgaatccgacatgcacgtaagccagatggccatatctttcctaacaactttagccaaagtgtatccctcctcgctgtctaagatttcaggatcaattctcaacgagttaatcgggcttgtccggtccccactgctgcagggaggggcacttagtgcaatgctggatttcttccaggccctggtggtgaccggcactaataacttaggctatatggacctgctgcgaatgcttacagggccagtctatagccagtcgaccgcgctgactcataaacagagctattattccatcgccaagtgcgttgctgccctgaccagagcttgtcctaaagagggcccagcagttgtgggacaatttatccaagatgtcaagaactctagaagtactgacagtataaggctgctcgcgctgctatccttgggcgaggtcggtcaccacatagatctctccggacaactggaacttaaatcagtaatcctggaagccttctcatcgccatccgaggaggttaagtcagcagcgtcgtacgcccttggatccattagcgttggtaacctgcctgagtacttgccatttgtactgcaagaaattacaagccagccaaaaagacagtatcttctgctgcacagtctgaaggagatcatttccagtgccagcgtggtgggcctcaagccgtacgtcgaaaatatttgggctctgctcttgaagcactgcgagtgtgccgaagagggaacccggaacgtggtcgccgaatgtctaggcaagctaacactgatcgaccctgagacactgctgcctcgattaaagggttaccttataagcgggagctcctacgcccgtagctctgtcgttacggccgtgaagtttaccatatcggatcacccccaacccatagatcccctgctgaaaaactgtataggggactttctcaaaaccctggaagacccagacctcaatgtgagacgggtggccctcgtaaccttcaacagtgcagcccataataagccttcactgatcagggatttactggacacggtcctgccacacctatacaatgagaccaaagtgcgtaaagagctcatacgcgaagttgaaatgggacccttcaaacacaccgttgatgatgggctggacatacgcaaagccgcatttgaatgtatgtacacactgctagactcttgtctggaccgcctggacatatttgagtttcttaatcacgttgaggacggtctgaaagaccattatgatattaagatgttgaccttccttatgttggtgagactgtccactctgtgcccatctgctgtactccaacgattggacagattagtggagcctcttcgggcaacctgcacgacgaaagtgaaagccaacagcgtcaagcaagagtttgagaaacaggatgaactcaaacggagtgcaatgagagccgtggccgcactactgacgattcctgaggcagagaagtcacccctgatgtcggaatttcaatcccagatctcctccaatcccgagttggcagcaattttcgagagtatccagaaggactccagctctactaacctcgaaagtatggacacaagttag

SEQ ID NO: 22676 - DNA, 3360 bp, Artificial Sequence
  Description of Artificial Sequence: Synthetic coding sequence
atgtctacagcggctttccacattagcagcctcctcgaaaagatgactagttccgataaggattttagattcatggctacaagcgaccttatgtctgagctgcaaaaagactctatacagctggatgaggacagcgaaagaaaagtcgtgaaaatgctacttaggctcctggaggacaaaaatggcgaggtacagaacctggccgttaagtggctcggggtgcccctgggagcttttcacgccagcctcctgcactgcctcttgccccagttgtcaagcccccgacttgccgtgcggaaacgagcagtgggagccttagggcacttagctgccgcatgcagtacagacttattcgtcgagttggcagaccatctgctggatcgtcttccaggacctagagttcctacaagcccgactgccattcggaccctgatacagtgcctgggctcagtgggtcgccaagctggccaccgccttggcgctcatctggaccgattggtccctctagtggaggacttttgtaatttggatgatgatgaactgagagagagctgtcttcaggcttttgaggccttcctgaggaaatgccccaaggagatggggccacacgtacccaatgtaacctcgctgtgccttcaatatatcaaacatgatcccaactacaattacgattctgacgaggatgaagagcagatggagacagaagattctgagttttcggagcaggagtccgaggatgagtacagtgacgacgatgacatgtcttggaaggtcagaagagctgcagcaaaatgtatagccgcacttatctccagtcgtccagacctattgcctgactttcactgcactctggccccagtgctgattcggcgattcaaggaacgcgaggagaatgtaaaggccgacgtctttaccgcttatatagtgctgttaaggcagacacagcccccaaagggctggctcgaagctatggaagagccaacccaaacgggatctaatcttcacatgcttagaggacaagtgcctctggttgtgaaagccctccagagacaactaaaggaccgctctgtacgagctaggcaaggatgcttcagcctgctgaccgagttggccggagttttgcctgggtccctggcagagcatatgcctgtcctggtgtcggggatcattttttctctggctgatcgttcttcttcctcaacaatccgcatggacgctctagccttccttcagggactgctgggcacagagcccgctgaggccttccatcctcacctccccatcctactccctcccgttatggcatgcgtggcagatagtttctacaagattgctgccgaggccctcgttgtcctgcaggagttggtccgggctctgtggcctctccacaggcccagaatgcttgacccagaaccctacgttggagagatgagcgctgtgacactggcaaggctccgggctacagacctcgaccaggaggtgaaggagcgggcaatcagctgcatggggcacctcgtggggcatttaggggaccgcctgggcgacgatttggaaccaacgctccttcttttgcttgacaggcttcgtaacgaaataacacgcctcccggctatcaaggctctgacactggtggctgtgtctcccctgcaacttgacctgcagcctattcttgcggaggcactccacatactcgcatcatttctcagaaaaaatcagcgcgctctgagattggccaccttggctgcgttagacgccctggcacaaagtcagggtctatccctccccccaagcgccgtccaagcagtgctcgctgagcttcctgctttagtaaacgagagtgacatgcacgtggctcagctcgcggtggatttcctcgctacagtgacacaggcccagccagcaagcctcgtcgaagtgtcgggcccagtcctttccgagcttctccgcttactgcgttcacctctcctgccggctggtgtgctagccgctgctgaaggatttcttcaagctctcgtaggaacccgaccaccgtgcgtagactacgcaaaactgatctctttactgaccgctcctgtctatgagcaggccgtggacggcggacctgggcttcacaagcaggtgttccacagcctggctcggtgcgtcgccgcactctcagcggcatgtccacaggaggcggcttcgacagcctctaggctggtgtgtgatgctaggtccccacactccagcaccggagtcaaggtgctggcctttcttagcttggctgaagtaggacaggtggctggacccggtcatcaacgcgaattgaaggcagttctgctcgaagccctgggaagcccgagcgaggacgtgcgcgctgctgcgtcatacgctctgggaagagttggggcaggttcccttcctgactttcttccttttttgctcgaacagattgaggctgagccccgtagacagtatctgttgttgcatagcctgcgtgaggctcttggcgcagcacagcctgatagcctgaagccatacgctgaagacatttgggcacttctcttccagcgctgtgaaggagctgaagaaggtaccaggggagtggtggccgagtgtataggcaaattagttctggtcaacccaagtttcctgctgcctaggttgcgtaaacagttggccgcagggaggcctcacactcgatcaacagtgatcacagcagtgaaatttctcatttccgaccagccacatcccatcgacccgctcctaaagtctttcattgctgtgcataacaagccatcactggtgcgcgatttgcttgatgacattcttccgctgttatatcaagagacaaagattcgaagggatctcataagggaggtggagatggggccttttaaacacacagttgacgatgggttggatgtgcggaaggccgcattcgaatgtatgtactcgcttttggaatcatgtctgggacagttagacatctgcgagtttttaaaccacgttgaggacggtttgaaggatcattacgatatccgcatgctgacattcataatggttgcgcgtttggcaacactttgccctgcccctgtgcttcaaagggtggaccgcctgatcgaacccctgcgcgcaacatgcactgcaaaggtgaaggcaggtagcgttaagcaggagttcgagaagcaagacgagctcaagcgatcagcaatgcgagcagtggctgccctgttaactatcccggaggtaggaaagtcaccaattatggccgacttcagctcccagattcgtagtaatccagagctggcggcattgtttgaatcaattcagaaagactccgccagcgccccatccacagactctatggaactctcatag

SEQ ID NO: 22677 - DNA, 3711 bp, Artificial Sequence
  Description of Artificial Sequence: Synthetic coding sequence
atgtctacagccgcattccacattagctccctgctcgaaaagatgacatcctccgacaaggactttcgcttcatggcgactagcgatctcatgtcagaactgcagaaggatagcattcagcttgacgaggatagcgaacgaaaagtagtcaaaatgctgctgaggctgctggaggacaaaaacggcgaagtacagaatttggccgtgaaatgcttagggccactggttgtgaaggtgaaagagtatcaggtcgagacgatcgtggatacactgtgcactaacatgcgatctgataaggagcagcttagggatatcgccggtattggcctgaagacagtgttaagtgaattgcctccggctgccaccgggtcagggttggccaccaacgtctgccgcaagattacagggcagctcacttcagccattgctcaacaggaagacgttgccgtgcagctggaagccctggacattctgtcagatatgctgagcaggctgggagtcccactgggagcattccacgccagcttgttgcattgcctcctcccacagctctcctcccccagactcgctgtcagaaaacgcgctgtgggcgcactcggacacctggccgctgcctgcagcaccgatctcttcgtcgagctcgctgaccacctgctggaccggttaccgggacccagagtgcccacgtcgccaacagctatccggacgctcatacaatgcctgggatccgtggggagacaagccggacacagattaggagcccacctggatagactggtaccactggtggaggatttctgtaatctggatgacgatgagctgagggaaagctgcctccaggcatttgaggcatttctccgcaagtgccccaaggaaatgggaccccacgtgcccaacgttacctctctgtgcctgcagtatatcaaacacgaccccaactacaattatgacagtgacgaagacgaggagcaaatggaaacggaggacagcgagttctctgaacaggagtctgaggatgagtacagtgacgacgacgatatgtcttggaaggtgcgcagggctgcagctaagtgcattgccgctttgatcagtagccgcccagacttgctgccagatttccactgcacactggcgccagtgttgatcagaaggtttaaagagagagaggagaacgtgaaagcagacgtatttacagcctacattgtgctgttacgacagacccagccccctaaaggatggcttgaagcgatggaggaaccaacccagactggatccaatctccacatgctcagaggccaggttcctctggtggtgaaagcactgcagcggcaactcaaggaccggtccgttcgtgccaggcagggctgttttagtctgctgaccgaacttgctggtgtgctcccgggatctctcgctgaacatatgccggtgctagttagtggaattattttctccctggctgataggagttctagctcaaccattcgcatggacgctttggcatttttgcagggtcttctgggcactgaacccgcagaggccttccacccacatttgcccatcctgctgccccctgtcatggcttgcgtggccgattctttttacaagattgccgctgaggccttggtcgtcttgcaagaactggtgcgggctctgtggcctctccatagacctcggatgctagatcctgaaccatacgtcggggagatgagcgctgttacactggctcgcttgagggccaccgaccttgaccaggaagtcaaagagagggcgatctcttgcatggggcacctggtgggtcacctgggggacaggcttggcgacgatctggagcctactctgcttctgctcctggatagactgcgcaacgaaattactcggttgccagctattaaggccctgactcttgtcgcggtctcccctctccagctcgatctgcaacctattctcgccgaagccctccatatcctggctagcttcttacgcaaaaaccagagggccttaagactcgccactttagcagcactggacgccttggcgcaaagccaggggttgagcctgcccccaagtgctgtgcaagctgtgctggctgaacttccagccctggtaaacgaaagcgacatgcacgttgcccagctagccgtagatttcctcgccacggtgacgcaagcccaaccggcatcgctggttgaagtcagtgggccagtcctgtcggagctactcagattgctgcgcagccctttgctgccggcaggcgttttggcagcagccgagggattcctacaagccctcgtgggcaccagacctccctgtgtggattacgctaagctcatcagtttactcacggcgcctgtgtatgagcaggctgtcgatggaggccctggactccataagcaggtgttccattccctcgccagatgtgtggctgccctgagcgcagcctgcccccaagaggctgctagcacagcctcacggctggtatgtgacgcaaggtccccccactcatccactggagtgaaggttctggcctttctctccttggccgaggtgggccaggtggcgggtcctggccaccagcgggagttaaaggcagtgcttcttgaggccctcgggagccccagtgaagatgtgcgagccgcagcctcctatgctctcggccgagttggcgcagggagtttgcctgacttcttgccatttttactggaacaaatcgaagctgagcccaggagacagtacttgttgctccatagtctccgcgaggccctgggggcagcccagccagactcactcaagccctacgccgaggatatatgggctttgctcttccaacgctgcgaaggtgccgaggaggggaccaggggtgtagtggccgaatgcattgggaagctggtgctagttaacccgagcttcctactgccgcgactgaggaaacagttggctgccggacgccctcatacccgcagcacagttatcacagcagtcaagtttctgatctctgatcaaccacaccctattgatccactgctcaaatcttttatcggcgaatttatggagtccctccaagaccctgaccttaacgtaagaagggccaccttggcctttttcaattctgccgtgcacaacaaaccaagcctggtcagagacctcctggatgacatactccctctgctctaccaggagactaaaattagacgagacctcattcgagaggttgagatgggaccattcaagcataccgtagacgatggactcgacgtcaggaaggcagcattcgagtgcatgtactccctgctcgaaagctgcctagggcaactggacatttgcgaatttctgaaccatgtcgaagacggccttaaggatcactatgatattaggatgctgacctttattatggttgcgagacttgccacgctgtgtcccgctccagttctccaacgcgtggaccggttgatcgagcctctacgagccacctgtactgccaaggttaaggctggcagcgtcaagcaagaattcgaaaagcaagacgaactgaaacgctcggcaatgagggcagtggccgctcttttgaccatccctgaggtgggcaaatctccaattatggccgacttttcttcgcagatcaggtcaaacccggagctggctgccctctttgagagcattcagaaggattctgcgtccgcacccagcaccgatagtatggagctcagctag

SEQ ID NO: 22678 - DNA, 4461 bp, Artificial Sequence
  Description of Artificial Sequence: Synthetic coding sequence
atggccgcaaacgtgggcagtatgttccaatattggaaacggtttgatctgcggagattgcagaaagaactaaatagcgtggcctctgaactctccgccagacaggaggagtccgagcacagtcacaaacatttgatcgaactccgaagggagtttaaaaagaacgtgccagaggagatcagggagatggtggcccctgtcctgaagagtttccaggctgaggtggtggccctgtctaagcgatcacaggaggccgaggctgccttcttaagtgtgtacaaacagctgatcgaagctccagaccctgtgccagtgtttgaggctgccagaagcctagatgacagactgcagccgccttccttcgatccctccggccaaccccgacgggacctgcacacatcttggaaaaggaatcccgagctcctgagcccaaaagaacaaagagaagggacaagtccagctggacctacgttgacagagggctctagacttcctggcattcccggaaaggcactgctgacagaaactttgctccaacggaacgaagccgaaaagcagaaggggctgcaagaggttcaaatcacgctggcagctagattgggcgaggccgaggaaaaaatcaaggtcttacattctgcattaaaggcgacacaagcagagctgctcgaactcaggcggaagtatgacgaggaggcggctagtaaggccgacgaggtgggtctcatcatgacgaacctcgagaaggccaatcagcgcgcagaagccgcacagcgggaggtggagagtctgagggaacagctggcctcagtgaactcctccatccgccttgcttgttgctctccacaaggcccttctggagacaaggttaattttacactgtgctctggaccacgactcgaggctgcccttgcctccaaagatcgcgagatccttaggctgttgaaggacgtgcagcacttacaaagcagcctccaggagcttgaggaggctagcgctaaccagattgccgacctggagcgtcagttgacggccaaatctgaggctattgagaagcttgaggagaagctgcaggcccaaagcgattacgaggaaatcaaaacggagctaagcattctaaaagccatgaaattggcatcttcgacatgctctctcccacagggcatggcaaagcccgaggactccttgctcatcgcaaaggaagctttttttccaacacaaaaatttctccttgaaaagcctagcctactggctagtcccgaggaggaccccagcgaagatgactccattaaagactctctgggcacagagcagtcctatccttcgccacagcagcttcctcctcctccaggaccggaggaccccctctccccgagccccggacaaccactcctcggacctagtctggggccagacggcactcggaccttcagtctgagtccattcccatcactcgcttcaggggagcggctgatgatgccacctgccgcattcaagggagaggccggtggattgctggtcttccccccagccttttatggagctaagccccctactgctcctgctaccccagccccaggccctgaacctctgggtggtcccgagccggcagacggaggaggaggtggcgctgctggacctggtgccgaggaagaacagcttgatactgctgagatcgcattccaagttaaggaacagttattgaaacacaacatcgggcagcgggtcttcggacactatgtcttaggactttctcaaggatccgtcagcgaaatcctggcacgtccaaaaccctggagaaaactaaccgtgaagggtaaggaaccctttataaaaatgaagcagttccttagcgacgagcaaaacgttctggccctgcgcaccattcaagttcgacagcggggtagcataactcctcggattcgcacaccagagaccggctctgacgatgccatcaaaagtattctcgagcaagcaaagaaagagattgagagccagaagggcggagaacccaagacaagcgtcgctccgctcagtattgctaacggaactacgccggcatccacatctgaggatgctattaaaagcatcttagaacaggcccgtcgcgagatgcaggcacagcagcaggcactactggaaatggaagtcgcccctagaggcaggagtgtgccaccctcaccacccgagagaccctccttggccacggcttcccagaatggagcacccgcattagtaaaacaggaggaagggagcggtggccctgcacaggcccctctgcccgtcttgagccccgctgcatttgtccagagcatcatccgcaaagtgaagagcgagattggggacgcaggatattttgatcaccactgggccagtgaccgcggactgctttctcggccatacgcaagtgtgagccccagcttaagttcaagttccagttcaggatatagcggccagcccaacggccgtgcatggccacgaggcgatgaggccccagtaccccctgaggacgaagcagcggctggggctgaggacgaaccaccaagaacaggcgaactgaaggccgagggcgcaacggcagaagccggagctaggttgccatactacccagcatacgtacccaggaccctcaagcctaccgtaccaccactaactcctgagcagtatgaactgtacatgtatcgggaggttgacaccctcgaactcactcgccaggtgaaagaaaaactggccaaaaacggaatctgccagaggatctttggagagaaagttctcggactctcgcaaggaagtgtgagtgatatgttatcacgaccgaagccatggagtaaactcactcagaagggacgcgagccctttattaggatgcagctctggttgagtgaccagttggggcaggccgttggccagcagcctggcgcaagccaggcgtctcctacagaaccaagaagctcccccagtcccccaccttctccaactgagcctgagaagtcttcccaggaacctctatctttgtccctggaatcgtcaaaagagaatcagcaaccagagggcaggtcaagcagttctctgagcggcaagatgtactccggttctcaggctcccggtggcattcaggaaatagtagcaatgagccctgagctggatacatactccattaccaaaagggtcaaggaagtactgacggacaataacctcggccaacggctgtttggagaaagcattctggggttgactcaaggctcagtctccgacctactctctcgcccaaaaccctggcacaagctcagtctaaagggcagggaacccttcgtacgaatgcagctgtggctgaacgatccacacaatgttgagaagctcagggacatgaaaaagcttgaaaagaaggcctacttaaaaaggagatacggcttgattagcaccggtagtgactccgaatcaccggcaactaggtcagaatgtcccagtccttgtttgcagccccaggacctcagccttctacaaatcaaaaaaccgagagtggtgctcgctcctgaagagaaggaagccctgcgcaaggcctatcagcttgagccatacccctcgcagcaaaccatagagctactgagttttcagctgaatctcaagactaatacggtcatcaattggttccacaactatagatctcgtatgcggcgagagatgctggtcgaaggaactcaggatgaacccgacctggacccttcaggcggacctggaatcctgccacctggacacagccatcccgatccaacccctcagagtcctgactctgagaccgaggatcagaagccaacagtaaaggaattggagctgcaggaggggcctgaggagaattcaacacccctgactacccaggataaggcccaggtgcgtatcaagcaggaacaaatggaggaggatgccgaagaggaggcagggtcacagccccaagatagtggcgaactcgacaaaggccaaggtcctcctaaggaggagcaccccgatcccccaggaaacgatggtctccccaaggtggctccagggccactgctgcccggaggtagcaccccggactgcccatctctgcaccctcagcaagagtcagaggctggggaacgattgcatcctgatcccctatccttcaaatctgcttcggagtctagccggtgtagccttgaagtgtccctgaattctccaagtgctgcctccagccccggactcatgatgtccgtctccccagtaccaagctcttcagccccaatcagtccctccccaccgggagcccctcctgcgaaggtgccgtcagccagccctacagccgatatggcaggggctctgcaccccagcgccaaggtgaaccctaatcttcagaggcgacatgaaaagatggccaatttgaacaacattatctaccgagtcgagcgtgccgcaaatagggaagaggcgctggaatgggaattctag

SEQ ID NO: 22679 - DNA, 375 bp, Artificial Sequence
  Description of Artificial Sequence: Synthetic coding sequence
atggtggcccctgttttaaagagtttccaggccgaggttgtggccctatccaagaggtcacaggaagccgaagcagcttttctaagcgtatataagcaactgattgaggcccctgacccagttcctgtcttcgaggcggcacggtccctcgatgacagactccagcctccatcgtttgacccaagcggccagcccagaagagacctgcatacatcatggaaaagaaatcccgaattgctttccccaaaggagcagcgcgagggaacttccccagccggtccaaccttgacagagggaagtcgactgccgggaatccctgggaaggctctgttgaccgagactttactccaaagaaatgaggctgagaaacagtag

SEQ ID NO: 22680 - DNA, 2727 bp, Artificial Sequence
  Description of Artificial Sequence: Synthetic coding sequence
atgaaatctagcgtcgctcagatcaagccttccagcggccacgataggcgcgaaaacttaaattcttaccagcgcaactcctctcccgaagatcggtacgaggagcaagaacgaagcccacgcgatcgggactacttcgactactctagatcagactatgaacattcacgtagaggcagatcttacgatagttccatggaatccaggaacagagatcgggagaagaggagggagcgcgagagggacaccgacagaaagcgctcacgcaagtcgcccagcccagggaggaggaatcctgaaaccagtgtcacccaatcttcatctgcacaagacgagcccgcaacaaaaaagaagaaggacgagctagatccccttctgactaggacagggggtgcatatatccccccagcgaagctcaggatgatgcaggagcagatcactgacaagaacagtctcgcttaccaaaggatgagctgggaggccctcaagaaatctatcaatgggctgattaataaagtaaacatctctaacatatcaattatcatacaggagttgctccaagagaatatagtgagagatcgcggattactatcaagatcagtgttacaggcgcagtccgcctccccaatttttacgcatgtgtacgccgctctagtggccattattaattccaaatttccacagataggagagttaattctgaaacggctgatccttaactttaggaagggttataggcggaacgataagcaactatgtttgactgcctccaagtttgtagcccatctgatcaatcaaaacgtggcacacgaggttctgtgcctggagatgttgaccctgctgctagagcggccaactgacgactcggtcgaggttgctataggattcctgaaggaatgtggccttaaacttacacaagtatctccgagagggatcaacgcaatcttcgagcggctcaggaacatccttcatgagtccgagatagacaaacgcgtgcagtacatgatcgaggtgatgtttgcagtgcgcaaggatggctttaaggaccatccaatcatattggaaggtctcgacctcgtcgaagaagacgatcagttcacacatatgctcccattggaggatgactacaatccagaagacgttctgaatgtatttaaaatggacccaaattttatggagaacgaggagaagtacaaggctatcaagaaggaaatcctggatgaaggcgataccgattccaataccgatcaagatgccggatcttcagaggaggacgaggaggaggaagaggaggagggggaggaggatgaggaagggcagaaggtcactattcacgataagactgagataaacctggtgagtttcaggcgcacaatctacctcgcgatacaaagctctctggatttcgaggaatgtgcgcacaagctcctcaaaatggagttccctgagagtcagactaaggagctgtgcaacatgattctggactgctgtgcacagcagcgcacatatgaaaaattctttggccttttagccggacgattctgtatgctgaaaaaagagtacatggaatcttttgaaggaatattcaaggagcagtacgatacaatccacagactggaaaccaacaaattgagaaacgtagctaagatgttcgctcacctcttatataccgactctttgccctggagcgtactcgaatgtattaagctgtcagaggagaccacaacctcgagctcgcgcattttcgtaaagatcttttttcaggaactgtgtgagtacatggggctgcctaaattgaacgctagactgaaagatgagacactccaacctttctttgagggactgttaccgagggataatcctcgcaacactcgttttgcaatcaacttctttacaagcataggcctcggcggactgacggacgagctgagggagcacctgaaaaacaccccgaaggtcatcgttgcccagaagcctgatgttgagcagaataagtcctcgccttccagttcttctagcgccagttcaagctctgaaagcgacagctctgattcagactccgactccagcgatagctccagcgaaagttcaagcgaggagtctgactcttcaagcatctctagtcatagctctgcaagcgcgaacgacgtccgcaaaaagggtcacggaaaaacccggagtaaagaggtggacaagctcatcagaaaccagcaaacaaatgatcgcaaacaaaaggagcggaggcaggagcatggccaccaggagacgagaactgagagagagcggcgttccgagaaacatcgggaccagaattcaagtggctcgaactggcgggatccgatcactaaatatacatcagataaggatgtcccttctgagcgtaataactattcacgagtggccaacgatagagatcaggaaatgcatatcgatctggagaataaacacggtgaccccaagaagaagagaggcgagcggcgtaattctttcagcgaaaatgagaagcacacgcacagaatcaaagacagtgagaatttcaggaggaaggatagatccaagtcaaaggagatgaatagaaagcactctggctcaaggtccgatgaggacagataccagaatggagctgaaaggcgctgggaaaagagttccagatattcagagcagagtcgggaatccaaaaagaatcaggaccgccgaagggaaaaaagccctgccaagcagaagtag

SEQ ID NO: 22681 - DNA, 2238 bp, Artificial Sequence
  Description of Artificial Sequence: Synthetic coding sequence
atgaaatcatccgtcgctcaaattaaaccaagtagcggtcatgaccgtagagagaacctcaattcttaccagaggaattcgtcaccagaggatcggtatgaggaacaagaacgaagcccccgagatcgggattatttcgactacagcagaagcgattatgagcatagccggcgagggagatcttacgacagttccatggagagtagaaatcgcgatagagaaaagcgccgagagcgggaaagggatactgaccgcaaacggtcccgtaagagccctagcccaggtcgcagaaatccagagacttctgtgacccaatcatccagtgctcaggatgagcctgcaacaaaaaagaagaaagacgagctggatcctctcttgacccggaccggcggtgcatacatccctcccgctaaactccgtatgatgcaggaacagatcacagacaagaatagtcttgcttatcagcggatgagctgggaggctctgaagaagagtatcaatggcttgataaacaaggtgaacatttctaatatttcaatcataatccaagaacttctccaggaaaacatcgtgcgcggaaggggactgctcagccgatccgtcttgcaggcccagagtgcatctcctattttcacgcacgtctatgccgctctagtggcaattattaattccaaattcccacaaattggggagctgattttaaaacgactcattctgaactttagaaaggggtaccgcagaaacgacaagcagctgtgtctgactgcctcaaaattcgtggcccacttaatcaatcagaatgtggctcacgaggtgctctgtctggaaatgctcactctgctgttggaaaggcccacagatgattccgtggaggtggcgattggatttctgaaggaatgcggattaaaactcactcaggtgtctccaagaggtataaatgctattttcgagagactccgcaacatcctgcacgaatccgagatcgataaacgggtgcagtatatgattgaagtgatgtttgctgtccgaaaagatggatttaaggaccaccctatcatcctcgagggattagaccttgtcgaagaagatgatcagttcacacatatgcttcctctagaggacgactacaatcctgaagacgtgctcaacgtattcaaaatggatccaaattttatggaaaacgaggaaaagtataaagccatcaagaaagagattctggatgagggagataccgatagtaacacagatcaggatgccggatcatctgaggaagatgaagaggaagaagaagaagagggcgaggaggacgaggagggtcagaaagtcaccattcatgataagacagagataaatctggtcagctttcggaggaccatctatctggcaatccagtcatcactcgacttcgaggagtgtgcacataagctcctcaagatggagtttccagaaagccagaccaaggagctgtgcaatatgatcctcgattgttgcgcacaacaacggacttacgagaaattctttggcttattggcgggacggttctgtatgctgaagaaagagtacatggaaagtttcgagggcatattcaaagagcagtacgacactatccatagactggagacaaacaagctccgaaatgtcgccaagatgttcgcacatctgctgtacacagatagccttccctggtcagttctggaatgcattaaactaagcgaggaaactacgacctcaagtagtcgtatttttgtgaagatcttttttcaagaactctgcgagtatatgggcctcccaaaactgaatgcccgtctgaaggatgagactctacaaccgtttttcgagggactgctacccagggacaacccacgtaatacacggttcgccatcaatttttttaccagtatcggacttggaggcctgacagacgagttgagggagcatttgaaaaacacgccgaaggtgatagttgcccagaaacccgacgtggagcagaacaaatcgagtccaagttcaagctcctcggcgtcaagctccagcgaatccgatagtagcgactcagactctgacagctcagattcttcttccgaatctagttcggaagaatccgatagttcctcgatcagctcacactccagcgcctccgccaatgacgtgaggaaaaaggggcacggaaaaactagaagcaaggaagtggacaagttgatacgcaatcagcagacaaacgaccgaaaacagaaatag

SEQ ID NO: 22682 - DNA, 2727 bp, Artificial Sequence
  Description of Artificial Sequence: Synthetic coding sequence
atgaagtcctccgttgcgcagatcaaacctagcagcggacatgatcgcagagagaatctgaatagctaccagagaaattccagtccggaggacaggtacgaggagcaggagcggtctccgagggaccgcgattacttcgactactctaggtctgattacgagcactcgcgtcgcggaagaagttacgactcatccatggaatcacggaacagggaccgcgagaaacggagagaacgggagcgcgacaccgaccgtaagaggagtcgtaaatcaccttctccaggcagacgtaatcctgaaacttctgttacccaaagcagttccgcacaggacgaaccggctaccaagaaaaaaaaggacgaactggaccccctgctgacacggacaggcggagcctacattcctccagccaaattgagaatgatgcaggaacaaataactgataagaactccctggcctatcagcgaatgtcttgggaagccctcaagaaatcaatcaatggcctgattaataaggtgaatatcagcaacatctcaattattatccaggaattgctgcaggaaaacattgttaggggtcgcggactgctctctcgctcagttttgcaagcacagagcgcctcccctattttcactcacgtctacgcggctctggtcgctatcattaactccaagttccctcagataggggagctgatcctcaagcggctgatccttaacttccgcaaaggatatcgcagaaacgataagcaactctgtctgaccgcttctaagttcgtcgctcatctcatcaaccagaacgttgcccatgaagtgctgtgcctagaaatgctcacgttgctgctggaacggccaaccgacgattccgtggaggtagcaattggcttcctcaaagagtgcggcctgaagctgacccaagtttctcccagaggtattaatgcaatctttgaaagactccgcaatatccttcacgagtcagagatcgacaagagggtgcagtatatgatagaagtgatgttcgccgtgagaaaagacgggtttaaagaccatcccatcattctggaagggctggacttggtggaggaggatgaccagttcacccatatgctgccccttgaagacgattataatccagaagatgtgctgaacgtctttaagatggatcctaattttatggaaaacgaggaaaaatacaaagcaattaaaaaagagatcctggacgagggagacacggattcgaatacggatcaagatgccggatcatcagaagaagacgaagaagaggaggaagaggagggagaggaagacgaagaaggccagaaagtgactatccacgacaaaaccgagatcaatcttgtgagctttcgcagaacaatctacttggcaatccagtcatcactcgattttgaggaatgcgcccacaaactcctgaagatggagttccccgagtcgcaaaccaaggaactgtgcaatatgatcctggactgctgtgctcagcagcggacctacgaaaagtttttcgggctcttggccggaagattttgtatgctgaagaaggaatacatggaatcatttgagggcatcttcaaagagcagtatgacacgatccaccggctggagaccaacaagttacgcaacgtggccaagatgttcgctcacttgctttacactgattcactgccatggtcagtgcttgagtgtattaaactctcggaagaaaccacaacctcatcgtcacgtatctttgtgaagatctttttccaggaactgtgtgagtacatgggtctccctaaattgaatgcgaggctgaaggacgaaacccttcaaccattcttcgaggggctcctgccgcgagacaacccgagaaacactcgcttcgccatcaatttcttcacatccataggcctcggcggtctgaccgacgagctcagggaacacctgaaaaacacccccaaagtcatcgtcgctcagaaacctgatgttgaacagaacaaatcatcaccgtcctctagctccagcgcaagcagcagttctgagagtgactcttcagattctgactccgactcttccgatagtagcagtgagtcctcaagtgaagaatctgactcctcttctatctcttctcacagttccgccagcgctaatgacgtgagaaaaaagggccacggaaaaacaaggtctaaagaggtagacaagctgatccgcaaccagcagactaatgatagaaagcagaaagaacgcagacaggagcatggtcatcaagagacacgcacagagagggagagaaggtccgagaagcaccgggatcagaacagttcaggctcgaattggcgtgacccaattaccaagtatacttccgacaaggacgtgccatcggagagaaacaattacagtcgagtagctaatgaccgggatcaagagatgcacatcgacttagagaacaagcatggggaccccaaaaagaagcgcggagaacgtcgcaactccttcagcgagaatgaaaagcatactcaccgaattaaagactccgaaaactttagacgcaaggaccgaagtaaaagcaaagagatgaaccgcaagcacagcggctcccgttccgacgaggatagatatcagaacggtgcagaacggagatgggagaagtcttcccggtatagcgaacaaagtcgggagtccaaaaagaatcaagacagaaggagggagaagtcgcctgcaaagcagaagtag

SEQ ID NO: 22683 - DNA, 1419 bp, Artificial Sequence
  Description of Artificial Sequence: Synthetic coding sequence
atgtctaacatctacattcaggagccaccaaccaatggtaaagtgttgttgaagactacagcaggggatattgatatcgagttgtggtctaaggaggcgccaaaagcctgcagaaacttcattcagctgtgcctggaggcttattacgataataccatattccacagagttgtgcctggttttattgtgcagggaggagatcccactggaaccggaagcgggggagagagtatttacggggctccgtttaaggacgagttccacagtcggctacgctttaacagacggggtctggtagccatggcaaacgccggatctcacgacaatggatcccagttcttctttactttaggtcgagctgacgagttaaataacaaacacaccattttcggcaaggtgacaggtgacaccgtgtacaatatgctaaggctatctgaggtcgatatcgacgatgacgagcgcccacacaatccgcataaaatcaagagctgcgaagttctgtttaacccatttgacgacattattccgagagagattaagaggctcaaaaaagaaaagcctgaagaggaggtgaagaagttaaagcccaaaggtacaaagaattttagcttgttgtccttcggtgaggaagccgaagaagaagaggaggaggttaaccgcgtctcccagtccatgaaaggcaagagcaaatccagccacgatttgttaaaggatgacccacacctgtcctctgtgcccgtggtcgagagcgagaagggcgatgcacctgacctagttgatgacggggaagatgaatccgctgaacacgacgagtatattgatggggatgaaaagaacctgatgcgggagaggatcgctaagaagctgaagaaggacacgtcagcaaatgtgaaaagcgctggggagggcgaggtagagaaaaaatcagtgtcccgaagcgaggaactgagaaaagaagctcggcagcttaaaagagaacttttggctgcaaagcagaaaaaagtggaaaacgccgcaaagcaagccgagaaaaggtctgaggaggaggaagcacctcccgatggcgctgtcgccgagtaccggagagagaagcagaagtatgaggccctgcgtaaacaacagtctaaaaaaggaacctctagagaagaccagacattagctctgctgaatcaatttaaaagcaaactgacccaggccatcgccgagacccctgagaacgatattcctgagaccgaagtggaagatgatgagggatggatgagtcacgttcttcagtttgaagacaagtctaggaaagtaaaggacgcgtccatgcaggattccgataccttcgaaatttacgaccctcgaaatccggtcaataaaagaagacgtgaggaatcgaaaaaattaatgcgggagaaaaaggagcgcagatag

SEQ ID NO: 22684 - DNA, 1173 bp, Artificial Sequence
  Description of Artificial Sequence: Synthetic coding sequence
atgagtaacatctatatacaggaacctccaactaatggcaaggtcctgctgaagacaactgcaggagacatcgatatagaactctggtcgaaagaagccccaaaggcatgtcgtaattttattcagctctgtctggaagcctactacgataacacaatcttccaccgcgttgtccccggatttatcgttcagggcggtgaccccactggaaccggtagtggaggggaatcaatttacggcgctccatttaaagacgaattccacagcaggctcaggttcaaccgacgaggcctggttgccatggctaatgcaggttcacatgataacgggagtcaattttttttcacactgggacgagctgacgagttaaacaataaacatacaatcttcgggaaggtcaccggagatacagtctacaacatgcttagattgagcgaggtagatatcgacgacgacgagaggcctcataacccccataagattaagagctgtgaggtgctgttcaacccattcgatgatattatcccacgagaaataaaacggctgaagaaggagaaacctgaagaagaagtgaaaaagctgaaacctaagggcacaaaaaacttctctctcctcagctttggggaggaagctgaagaagaggaggaagaggtgaaccgggtgagccaatcaatgaaaggtaagtctaaatcatcacacgatctgctgaaggatgatcctcacctgagcagcgtgccggtagttgagtccgaaaaaggcgatgctcctgacctggtggacgatggagaagatgagtccgccgagcacgatgagtacattgatggcgacgagaagaaccttatgagggagaggatcgcgaaaaaactgaagaaggacacctccgccaacgtgaaaagcgccggagagggagaggtcgagaaaaaaagcgtatcccgaagtgaggaactcagaaaagaggctcgtcaactgaagagggaactgcttgccgctaagcagaaaaaggtcgaaaatgccgctaagcaggcagagaaacgatcagaagaggaggaagcccctcctgacggggctgtagccgagtataggagggaaaagcagaagtacgaggcccttaggaagcagcagtccaagaagggaacatcccgtgaagaccaggaaatcactaagtcaagctag

SEQ ID NO: 22685 - DNA, 1971 bp, Artificial Sequence
  Description of Artificial Sequence: Synthetic coding sequence
atggaaggcgatggatccgatcccgagcctcccgatgcgggagaggatagtaaatcagaaaatggcgaaaatgcgccaatctactgtatatgcaggaagcccgacatcaattgttttatgatagggtgtgataactgcaatgagtggttccacggcgactgcatccggatcaccgagaaaatggcaaaggcaatcagggaatggtactgccgggaatgtcgtgaaaaggatcccaagctggagataagatatcgacataaaaaatccagagagcgagacggaaacgagcgcgattcaagcgagccccgtgacgaaggagggggaagaaagcgccctgtaccggatcccgatctccaaagacgggctggcagcgggacaggagtgggcgcaatgctggctagaggcagcgccagcccccacaaatctagccctcagcccctggtggccaccccctctcagcaccaccaacagcagcagcagcagatcaagcggagtgcgagaatgtgcggagagtgcgaggcctgtagacgcacagaagattgtggccactgtgacttctgccgcgatatgaaaaaatttggagggccaaataaaatcagacagaaatgccgtctgcgtcagtgccaactgagggcaagggagagctataagtactttccctccagcctgtccccagtgacacctagcgaatcattacccaggcctcgtcgaccattacctacacagcaacaacctcagcctagccaaaagctcggtcgcatcagagaagacgaaggcgctgttgcttcatctacagtgaaagagccacctgaggcgacagcaacgcctgaacctctgtctgatgaggatctccccctggacccagacctctatcaggatttctgtgcgggagcttttgacgaccacggactgccatggatgtcggatactgaggagtcccccttcctggatccagccctgcgcaagcgggcagtgaaagtgaagcacgtgaaaaggcgggagaagaagtctgagaaaaagaaagaagaacgttacaaacgccataggcaaaagcaaaaacataaagacaaatggaagcaccctgagagggccgacgccaaagaccccgcaagtttgccccagtgtttaggaccaggctgcgtgagaccagcccagccctcctctaaatactgtagcgatgattgcggcatgaagttggctgcaaaccgcatctatgaaattctgccccagaggatccaacagtggcagcagtctccatgtattgccgaagagcacggcaaaaagctactagaaaggatccgcagagaacaacaaagtgctcggacccgcctacaggagatggagagaagattccatgaactggaagctatcattctgagggccaagcagcaggctgtgcgcgaagatgaagagtcaaatgaaggggacagtgacgacacagacctccaaatcttttgcgtgagttgtggacaccccattaacccacgtgtggcgctgcgccacatggagcggtgctacgccaagtacgagtctcagaccagctttgggagcatgtaccctactcgtatcgagggggctacaaggctcttctgcgatgtgtataaccctcagtccaagacctactgcaagcgactgcaggtgctttgccccgagcattcccgagacccaaaagtgccagcggatgaagtctgtggctgccctctcgtgcgcgatgtgttcgagctaacaggcgatttctgcagactacctaaacgccaatgtaatcgccattattgctgggagaagctgcgacgagctgaagtcgacctggagagggtaagagtctggtacaaactcgacgagttgtttgaacaggaacggaacgttcgtactgcaatgacaaatagggccggtcttctcgctctgatgctgcatcagaccattcagcacgacccactcacaaccgacctgcgatcatccgcagatcgctag

SEQ ID NO: 22686 - DNA, 1983 bp, Artificial Sequence
  Description of Artificial Sequence: Synthetic coding sequence
atggaaggcgacgggagtgacccagagcctcctgatgccggagaagactctaagagtgagaacggcgagaatgctcccatatactgtatttgccgcaagcccgacattaactgctttatgatcggatgcgacaattgtaacgagtggttccacggcgattgtatcagaatcacagagaaaatggctaaggccattcgcgagtggtattgtcgcgagtgccgtgaaaaggaccccaagctggaaatacgctaccgacataagaaaagccgcgaaagagatggcaacgaacgggacagcagcgaaccgagggatgaaggcggtggaagaaagaggcccgtgcccgaccctgatcttcagaggcgcgcaggtagcgggaccggcgtcggcgctatgctggctcggggatctgcaagcccgcacaaaagctccccgcaacccctcgttgcaactcccagtcagcaccaccagcaacagcagcagcagataaagcgcagcgccagaatgtgtggggagtgcgaggcatgtcggagaacagaggactgcggacattgtgatttttgcagagacatgaagaaattcggaggcccaaataagattagacagaagtgccggctgagacagtgtcagctaagagccagggaatcctacaaatattttccatctagccttagccccgtcacgccgtcagaaagtcttccacggcctcggaggcctctacccacacagcagcagccccagccttcccaaaagctgggcaggattcgggaggacgaaggggctgtagcctcatctactgtaaaagagccacccgaagcaacagctacacctgaaccgctgtcagatgaggacctgccgttagatccagatctgtatcaggatttctgtgccggtgcctttgacgatcatggcctgccctggatgtctgacaccgaggagtccccattcctcgatcctgctttgagaaagcgagcagtcaaggtcaagcatgtaaagagaagggagaaaaagagtgaaaaaaaagtgatggaaagaaaagaggaacggtacaagcggcaccggcagaaacagaaacacaaggacaagtggaaacatcccgagcgggctgatgctaaagatcccgcaagcctgcctcagtgcctcggccctggatgcgtgcgcccagcccagcctagttctaagtattgtagtgacgactgtggtatgaagctggctgcgaaccgaatctacgagatactgccccagagaatccagcagtggcagcagtctccttgtattgcagaggagcatggcaaaaagctgttagaacgcattcggagagaacagcagtccgcaaggactcggctgcaggaaatggagagaagattccacgaactggaagccattatccttagggcaaaacagcaagcggtaagggaggacgaggaatctaacgagggggacagcgatgatacagatttacagatattttgcgtgtcctgtggtcatcccatcaaccctcgtgtggccttgcggcacatggaacgctgttacgcaaaatatgagtctcaaacatctttcggctccatgtatccaacccggattgagggggctacacgccttttctgtgacgtgtacaatcctcagagcaagacatactgcaagcgactgcaggtgctgtgccccgaacatagccgcgacccaaaagtgcccgctgacgaggtgtgtgggtgtccgctggtgagagacgtgttcgagcttactggagatttttgccgcctgcctaagcggcaatgcaatcgccactactgctgggaaaagctcagacgagctgaggtggacttagaaagggtgcgggtgtggtataagttggacgaactcttcgagcaggaaagaaacgtcagaacggcaatgaccaacagggccggactgcttgctctgatgctgcatcagacaattcagcatgatcctctcaccaccgacctgcggagtagtgccgaccggtag

SEQ ID NO: 22687 - DNA, 834 bp, Artificial Sequence
  Description of Artificial Sequence: Synthetic coding sequence
atgtctctctgcgaggacatgttgctttgcaactatagaaagtgtcggataaagctgtccggctacgcatgggtgacagcctgtagccacatattttgcgatcagcatggctccggcgagttctctcgatccccagcaatttgccctgcttgtaatagcactctgtctggcaagctggacattgtgaggactgaactgagtccaagcgaagaatataaggcgatggtgctggccggtttgcgtccagagatcgtactagacatttcttccagagcgctggctttctggacctaccaagtgcatcaagagaggctctatcaggaatacaacttctctaaggccgaaggtcatctgaagcagatggagaagatctacacacaacaaattcagtccaaggatgtggagctgacttctatgaagggagaggtgacgtcgatgaaaaaggtgctggaggagtataaaaagaagtttagtgatatttccgaaaaactgatggaaagaaatcgtcaataccaaaagctccagggcctgtacgatagcctacggttgcgcaacatcacgatcgccaaccatgagggtaccctggagccttccatgatcgcccagagcggagtattagggttcccgctgggtaacaattccaaatttcccctggataatacccccgtgcgcaatcgtggggacggcgatggcgactttcagttcaggcccttctttgccggtagccctaccgccccagagcctagcaacagttttttctcctttgtcagcccctcccgggagctggagcagcagcaggtcagctcacgggctttcaaagttaagaggatctag

SEQ ID NO: 22688 - DNA, 834 bp, Artificial Sequence
  Description of Artificial Sequence: Synthetic coding sequence
atgagcttatgcgaggacatgctgctatgtaactatcgcaagtgtagaatcaagctgtcaggctatgcgtgggtcaccgcgtgcagccatatattctgtgaccagcacggttctggtgagttttcaagaagtccagccatatgccccgcttgtaattctacgcttagcggaaagctagacatcgtgagaacagagctctcaccctcagaggagtacaaggccatggttctggccggactgaggcccgagattgttcttgatatcagctcccgagccctggctttttggacatatcaggtgcatcaggagcgcctctaccaggagtacaacttttctaaggctgagggacaccttaaacagatggagaagatatacacgcagcagatccagtctaaggatgtggagcttacctccatgaaaggtgaggtgactagtatgaagaaagtcttagaggaatataagaagaaattttcggacatctccgagaagctgatggagagaaacagacaatatcaaaagctccaagggctgtatgattcccttcgactgagaaacatcacgatcgctaaccatgaggggacattggagccatccatgatcgcacagagcggagtcctgggctttcccctcggaaataattccaaattcccactggacaacacaccggtgcgaaatcggggagacggagacggcgacttccagttcaggccattttttgctggctcgccaaccgcccctgagccgagcaactctttcttctccttcgtgtcgccctcccgcgaactcgagcagcagcaagtgtcttcccgggcatttaaggtaaagagaatatag

SEQ ID NO: 22689 - DNA, 834 bp, Artificial Sequence
  Description of Artificial Sequence: Synthetic coding sequence
atgtctctgtgtgaggacatgttactgtgtaattatcgaaagtgcagaataaagctttcgggctacgcttgggtgacagcatgcagtcatatcttttgcgaccaacatggttctggggagttttctcgcagccccgcaatctgcccagcctgtaacagtaccctgtctggcaaacttgatatagtgcggaccgaactatctccgagcgaggagtacaaggcgatggttctggccggtctcagaccagagattgtgctggatatcagctcacgtgctttagctttctggacataccaggtgcaccaggagaggctctaccaagaatataatttttctaaagctgagggacaccttaagcaaatggaaaaaatatatacccagcaaattcagagcaaggacgtggagctcacctcaatgaagggcgaggtgacatcgatgaagaaagttcttgaagagtacaaaaaaaaatttagtgatatctccgagaaactgatggaacgaaatcggcagtatcagaagctgcaagggttatacgatagtctgcggctgagaaacattactatcgccaatcatgagggcactctcgagccgtcaatgattgctcagtccggagtcctcggctttcctctggggaataactccaaattccctctcgataacaccccagtgcggaataggggagatggagatggagatttccagttcagaccgttcttcgcgggaagtccgacggctccagagcctagcaacagttttttttcttttgtctcaccatctagagagctcgagcagcagcaagtgtcaagcagagcttttaaagttaagagaatctag

SEQ ID NO: 22690 - DNA, 834 bp, Artificial Sequence
  Description of Artificial Sequence: Synthetic coding sequence
atgagcctgtgcgaggatatgctgctgtgcaattaccgtaaatgcagaataaagctctctgggtatgcatgggttaccgcttgctcacacatattctgcgatcagcatggctccggtgagttctccagatctcccgctatctgtcctgcctgcaatagtactctgtctggcaaactagacatcgttaggacagagttgtccccaagtgaagagtacaaggctatggtacttgccggtttgcggccagaaatcgtgctggacatcagctcccgcgctcttgccttttggacatatcaggtccaccaggagcggttgtatcaggagtacaatttcagtaaggctgaaggccacctgaaacagatggaaaaaatttacacgcagcagatccagtccaaggatgtggaattgacaagcatgaagggagaagtgacctcaatgaaaaaagtcctggaagagtataaaaagaagttcagtgacatctctgagaagctgatggaacggaatcgccagtatcagaaactgcagggactgtatgatagtctgcgcttgagaaacatcaccatagctaatcatgaggggaccctggagccaagcatgatagcacagagcggagtcctcgggtttcccctaggaaacaattcaaagtttccgctggacaacactccagtacggaatcgtggtgatggtgacggcgatttccaattcaggcccttcttcgctggttctccaaccgctccagagccatcaaatagcttcttttcatttgtgtccccatcccgagaactggaacagcaacaggtttcatcacgtgcgtttaaggttaagagaatctag

SEQ ID NO: 22691 - DNA, 834 bp, Artificial Sequence
  Description of Artificial Sequence: Synthetic coding sequence
atgtcgctctgtgaagatatgctgctgtgcaattatcgcaaatgccggattaagctgagcgggtatgcatgggtcaccgcctgctcgcacatattctgcgatcaacacggctctggagaattctcacggtctccagcaatatgccctgcttgcaactctacactaagcgggaagctggacattgtaagaacagaactctcaccttctgaggagtataaagctatggtcctggctgggctgaggcctgagatcgtcctggacataagctcgagggcccttgcattttggacttaccaggtgcatcaagagcgcctgtatcaggaatacaacttttctaaggccgaaggtcacctgaagcagatggagaaaatatatacccagcagattcagtccaaagacgtagaattgactagcatgaaaggcgaggtcactagtatgaagaaggtactcgaggagtacaagaaaaaattttcagatatttcagagaagctgatggaaaggaatcgccagtatcaaaagctgcaggggctttatgatagcttacgccttcggaatattactattgctaaccacgagggaaccctcgagccctctatgattgcccaatccggagtgctggggttccccctcggcaacaattctaaattcccattggataacaccccagtgaggaatcgtggcgatggggacggtgacttccagttccgacccttttttgctgggtctccgaccgcacccgaaccaagtaattccttctttagcttcgtgagccccagcagggaactagaacagcagcaggtcagcagccgcgcttttaaggtgaagcggatttag

SEQ ID NO: 22692 - DNA, 834 bp, Artificial Sequence
  Description of Artificial Sequence: Synthetic coding sequence
atgtctttatgtgaagatatgttactttgcaactaccggaagtgtcggatcaagttgagcggatacgcatgggtcacagcctgcagccatatcttctgcgaccaacacggcagcggggaattttctagatccccggcaatttgtcctgcctgcaatagtaccttatccggaaagcttgatattgtgagaacggagctgtccccctcggaggagtataaggctatggtgctggctggccttcgaccagagatagttctggacatatcttcaagagcacttgctttttggacataccaagtgcaccaagagcggctttaccaggaatacaacttctccaaagcggaaggccacctgaaacagatggagaaaatctatacacaacagatccagtctaaggacgttgagctgacttctatgaagggggaggtgacaagtatgaaaaaggtacttgaggagtacaaaaaaaaattttcagacatttcggaaaagctaatggagcgcaaccgtcagtaccagaagctccaagggttatatgatagtctccgattaagaaacattactattgctaatcatgagggcacgctcgagccctcgatgattgcacagtcgggggtgttgggattccccctagggaacaacagtaagtttccccttgacaacactccagtgagaaatcgcggtgatggagacggcgacttccagtttcgcccatttttcgcaggatcgcctacagcccctgaaccatcaaacagctttttctcgtttgtgtcaccttctagagaacttgaacaacagcaggtatcttcaagggccttcaaggtaaaaagaatctag

SEQ ID NO: 22693 - DNA, 15 bp, Artificial Sequence
  Description of Artificial Sequence: Synthetic coding sequence
atgagtctgtgctag

SEQ ID NO: 22694 - DNA, 465 bp, Artificial Sequence
  Description of Artificial Sequence: Synthetic coding sequence
atgtctctctgcgaagatatgcttctgtgcaactatcgaaagtgtaggattaaactcagcggatacgcctgggtgacagcctgcagtcacatcttctgtgatcaacatggcagcggcgaattcagcaggtcacccgctatttgccccgcttgcaatagtaccctctcaggaaaactggatattgtgcggaccgagttgtcccccagcgaagaatacaaggctatggttctggcgggtctgcgaccagaaattgttctggacatatcttcaagagctctggcgttctggacttatcaggtgcatcaggagaggctctaccaggaatataacttcagcaaagccgaggggcacctaaagcagatggaaaagatctatactcagcagattcagagtaaagacgtggagctgacaagcatgaagggggaagtaacaagcatgaagaaagttcttgaggaatacaaatag

SEQ ID NO: 22695 - DNA, 1119 bp, Artificial Sequence
  Description of Artificial Sequence: Synthetic coding sequence
atggaacttgagggccagtggtggaggggccaacttgcagccgacatacatcaagctttaagatataaggaactgaaactcccaagttataaggggcaatccccacagctgtctctgcgtcgttattttgctgatctgattgccattgtcagcaatcgtttcactctttgcccatcagctcgccacctggcagtataccttcttgatttgtttatggaccgatatgacattagtatccaacagttgcatctagttgcgctgtcttgcctcttgttagccagcaagtttgaggagaaggaggactctgtccccaaactggagcagttaaattctttgggatgcatgaccaatatgaacttagttttgactaagcagaacctgctccatatggagttactcctgctagaaacttttcaatggaacttatgcctgccaaccgccgcacacttcatagagtattacctgtcggaggctgtgcacgaaaccgacctgcacgacggctggccgatgatttgtctggaaaagactaaactatacatggcaaaatacgccgactattttttagaggtttcattgcaagtggctgccgcttgtgtggcatctagtaggatcatcctccgactaagtcccacctggcccacgcgcctgcaccgcctgacagcgtacagctgggatttcctcgtgcagtgtattgaacggctgctgatcgcccatgacaatgatgtcaaagaggccaacaagcaaaggggccaggccggaccccaatccgcccaactttccgtgttccagactgcttctcagccaagtcgtccagttcattttcagcagccccagtatctgcaccagacgcaccagaccagcctgcagtaccgccatcctacgtcagagcagccaagttgtcagcagatcgtgagtactacacataccagcagctataccctgcagacctgtcctgcgggatttcaaacttctgtgcaaggtctggggcacatgcaaactggtgtgggcatgtctttagcgatacctgtggaggtgaaaccctgtctttctgtgagctataataggtcttaccagatcaacgagcattatccttgcatcacaccctgtttcgagcgttag

SEQ ID NO: 22696 - DNA, 1116 bp, Artificial Sequence
  Description of Artificial Sequence: Synthetic coding sequence
atggaactcgaaggacagtggtggaggggtcagctggccgctgacattcaccaagcattgaggtacaaagagttgaagctgccctcttacaaggggcaatccccccagttatccctccgtagatacttcgccgatcttatcgccatcgtgagcaatagattcacattatgtccttctgccagacatttagctgtttaccttctcgacttgtttatggatcgttatgacatttcaatccagcagctgcacttggtagcccttagttgccttctcctggcatctaagtttgaagaaaaagaggacagtgtacccaaactcgaacagctcaatagcttaggatgcatgaccaacatgaacctagtcctgaccaaacagaatctgctccacatggagctcttactcctggagacctttcagtggaacttgtgtctgcctactgccgctcacttcattgaatactatctgtcagaggcggtgcatgagacagatcttcacgacggatggccaatgatctgcctcgaaaaaacaaagctctatatggccaaatacgccgactattttctcgaggtttcgttacaagccgcagcttgtgttgctagttcccgcataatcctgagactgtctccgacctggccaacccggctgcatcggctgacggcctactcgtgggactttctcgtccagtgcatcgagcgtttgctcattgcccatgacaacgacgtgaaagaggcaaacaagcagagaggacaggctggacctcagagtgcacagctcagtgttttccagaccgcctcccagcccagtcggcctgtgcatttccaacagccccagtatctccaccaaacacaccagacttccctgcagtaccggcatcccacttctgagcagcccagttgccaacagatcgtgtcaacaactcacacaagctcatacacgcttcagacatgccctgccggatttcagaccagcgtgcagggactgggtcatatgcaaactggggtcggaatgagtctggccatacccgtagaggtcaagccctgtttgagtgtgtcctacaaccggtcttaccagatcaacgagcattatccctgcataacaccgtgtttcgaacgctag

SEQ ID NO: 22697 - DNA, 1152 bp, Artificial Sequence
  Description of Artificial Sequence: Synthetic coding sequence
atggagctggaggggcagtggtggcgcggtcagctagccgctgatatccatcaggcactgcgctacaaggagctgaagctgccatcctacaaggggcagtccccacagttgtctttgaggcggtatttcgcagacctgatagccattgtgagcaacaggttcaccctatgcccatctgccagacacctggccgtctacctcctcgacctgtttatggataggtatgatatttctatccagcagctgcatctggtggccttgtcttgcctgctcttggctagcaaatttgaggaaaaggaggacagcgtgcccaagctggagcaactaaatagcctggggtgtatgacaaacatgaacctggtgctgactaagcaaaacttgcttcacatggagctcctgctgctggagactttccagtggaatctgtgcctgcccactgccgctcacttcatcgagtactatctgtctgaagcggttcatgaaactgacctgcatgacggttggcccatgatttgcttggagaagacgaaactgtacatggcaaagtacgctgattattttctggaagtgtcgttacaggactacgcttttcttaattatgccccttctctggtagctgctgcctgtgtggcgtccagccgcattattctgcgcctcagtccaacgtggccaactcgactgcatagacttacagcctacagctgggacttccttgtccaatgcattgaacgcctgttgattgctcacgacaacgatgtgaaagaggccaacaagcagcgcggtcaggccggaccacaaagtgctcagctgagtgtgttccagaccgcctcccagccctcgagaccagtccatttccagcagccccaatatctgcatcaaacccaccagacaagtctccagtaccgacaccccacaagcgagcagccctcctgccagcagatcgtgtcaactacgcataccagttcctacactctgcagacttgccccgctggctttcagacttccgtccagggactgggacacatgcaaaccggggtgggtatgtccctagccatcccagtcgaagtaaagccctgtctgtccgtgtcctataaccggagctaccaaattaacgagcattacccttgcattacaccttgtttcgaacgttag

SEQ ID NO: 22698 - DNA, 1119 bp, Artificial Sequence
  Description of Artificial Sequence: Synthetic coding sequence
atggagttggaaggccaatggtggcgtggacagctggccgctgatattcaccaagctcttaggtataaggaattgaaattgcctagctataaaggccaaagcccacagctcagcctgaggcgttatttcgctgatctgatcgccatagtgtccaatcgcttcaccctgtgccccagtgccaggcacctggccgtctatctgctggatttgtttatggaccgctatgacatttccatccagcaattacacctggttgctttatcctgcttgttgctcgcaagcaagttcgaggaaaaggaagactcagtgccgaagcttgaacaactcaattctttgggctgcatgacaaacatgaacctggtcctgacaaagcaaaacttattgcatatggagctgctgttgctggaaacatttcagtggaatctctgcctgcccacagctgctcattttattgaatactatctcagtgaagccgtgcacgagacagatctccatgacggatggcctatgatctgcttggagaaaactaagttgtatatggcaaaatacgccgattactttctcgaagtctccctgcaggtggccgctgcctgcgttgcgagctcaaggatcatcctgcggctttcccctacatggcccactagactacatcgcctgactgcttacagttgggactttctcgtccagtgtattgaacgcctcctaatcgcccatgataatgacgtaaaggaggcgaacaagcagcgcggacaggccggaccccagtcagctcagctaagtgtctttcaaaccgcttcgcagccatctaggcctgtccactttcaacagcctcagtatttgcaccagacacatcagacgagtctgcagtaccgccatccaacaagcgaacagcccagttgccagcaaattgtttctactacccacactagttcttacacactgcaaacctgcccggctgggttccagaccagtgtccaggggctagggcacatgcagactggagtgggcatgagcctagccattcctgtggaagttaagccttgcctgtcagtgagttacaaccggtcttaccaaattaatgagcattacccctgcatcactccctgcttcgaaaggtag

SEQ ID NO: 22699 - DNA, 4446 bp, Artificial Sequence
  Description of Artificial Sequence: Synthetic coding sequence
atgcctaactcagaacggcacgggggtaagaaagacggctctggtggcgcatcaggcaccttgcagccatcctctggcggagggtctagtaattcgcgggaacgccacaggctcgtgagtaaacacaagcgccataagagtaagcacagcaaggatatggggttggtcactcctgaagctgcctccttgggtactgttattaagcctctggtggaatacgacgatatttcctcagatagtgacaccttttctgacgacatggcattcaaattggaccgcagggagaatgacgagaggagaggctcagaccgctcagataggctccataaacatcggcatcaccagcatcgcaggtcccgcgacctccttaaagccaaacagacagagaaagaaaagtcacaggaagttagctctaagagcggttccatgaaagacagaattagcgggagcagtaagcggtcaaacgaagagaccgacgactacggcaaggctcaagtggctaagagctcttcaaaggaatctcgatcaagcaagttgcacaaggaaaaaactcgcaaagagcgtgagttgaaatcagggcataaagacagatcaaaaagtcatcgtaaaagagagacaccgaagtcctacaaaaccgtcgattcccctaaaagacgatcaagaagtccacacaggaagtggtcagactctagtaagcaggatgacagtcccagtggtgccagctatggacaggattacgacctgagcccatcccgatcccacacatcttctaactacgatagctataagaaatcccccggatccacctctcggcgacagagcgtcagtccaccatacaaagaaccatcggcctaccaatccagcacccgcagtccctccccttacagcaggagacagcggtcggtctccccatactctcggcgaagatcatcatcatacgaaagaagcggaagctatagcggccgttctcccagtccatatgggaggcgacgcagcagtagccccttcctgagtaagagaagcctgagtcggtctcccctcccctccagaaaaagcatgaaaagccgtagcagaagtccggcatacagccgtcactcatcatcccactctaaaaaaaagcggagtagttctcgatctcgacacagttcaatctccccagtgaggctgccactgaactccagcttgggggcagaactctctagaaagaaaaaagaacgagcagcggcagctgctgctgcaaagatggatggcaaggaatctaaaggttctcctgttttcttgcccagaaaagagaattcctctgtagaagctaaagatagtggtctggaaagcaagaaactgccccgaagcgtaaagttagaaaaatcggcaccagacactgagctggtgaacgtcactcatctgaacaccgaggtcaagaactcttccgacaccgggaaagtcaagctggacgaaaacagcgagaagcacctggttaaggatttgaaggcccaaggcactcgggattccaaacccatagctcttaaagaggagatagttactccaaaagagactgagaccagtgaaaaagagaccccaccccctctaccaacaattgctagccctccacctcccctcccgactaccacgcctcctcctcagacaccacctctgccaccactgcctcctatccctgcgctgcctcagcagccacctcttcccccaagtcaacctgctttttctcaggtccccgcttcttcaacgtctaccctgccgccaagtactcacagtaagacgtctgctgtatcgtcccaggctaacagccagcctccggttcaggtgagtgtgaaaactcaggtgagcgttacagccgcaatcccacatctgaagacaagcaccctgcctcccctgcccttgccccctctattgccaggagacgacgacatggacagccccaaagaaaccttgcccagtaaacctgtcaaaaaggagaaggaacagaggacaaggcacctgttgacggacctacccttaccgcctgagctgcctgggggtgatttaagcccccctgatagcccagaaccgaaggccattactcccccacaacaaccctacaaaaagcgcccaaaaatatgttgcccacggtacggtgaaagacgtcagactgagagcgactggggcaaacgctgtgtggataagtttgatatcataggaatcattggtgaagggacctacggacaggtctacaaagctaaagataaggacaccggggaactggttgcacttaaaaaagtcagattagacaatgaaaaggagggattccccattactgctatccgggaaatcaaaattcttcgccagctcatccacagatccgtagtgaacatgaaagagatagttacagataagcaggatgccctggactttaagaaagataagggcgctttctatcttgtgttcgagtacatggatcacgacctcatgggcctcctcgaatcaggcctggtgcactttagcgaggaccatattaagagcttcatgaagcagttaatggaagggttggagtactgccacaagaaaaacttccttcaccgcgacatcaaatgcagcaatatccttctgaacaactcaggacagataaaattagcggactttggtttggcaaggttatacaactccgaagaaagtcgcccatataccaacaaagtgattacattatggtaccggccaccagagctgctgctgggagaggagcggtacaccccagcgatcgacgtttggtcgtgtggatgtattctcggagaactttttacaaagaagccaatcttccaagccaacttggaactagcccaattggagctgatctccagactgtgcgggtcaccctgccccgcagtgtggccagatgtgatcaagttaccctacttcaacaccatgaaacctaaaaagcagtatcgccgtcggctgcgcgaggaatttagtttcattccatccgccgctctggacctcctggatcatatgctgaccctggacccgtcaaagcggtgtaccgccgagcagaccctgcaatccgatttcctcaaggacgtggaactctccaagatggcccctcccgacctaccgcattggcaggattgccacgagctgtggtcaaaaaagcgtaggcgccagcggcagtcaggtgtggtggtcgaagagccgcctccctctaagacaagtagaaaagagaccacatctggcactagcactgaacccgtcaagaattcatctcccgctcctccacagccagcacctggcaaggtagagtcaggcgcaggagatgctataggcctcgccgacattacacaacagctgaaccaatctgaactggcagtgttactgaacctgttgcaatcccagaccgatctcagcatcccccaaatggcccagctgctgaacatccatagcaatcctgaaatgcagcaacagcttgaagcccttaaccagagcatctcagctctgacggaggccacctctcagcagcaagattctgagacgatggctccggaagaaagtcttaaggaggccccaagtgcccctgtcattttgccatccgctgagcagacaaccctggaagcatccagcacaccagccgatatgcagaatatactggcagttttgctgtcacagctgatgaaaacacaggagccggctgggtcactggaggaaaataatagtgataaaaactctggcccacagggcccacggaggacaccaacgatgccccaggaggaggccgctgaaaagcgcccacccgaacctcccggacctcccccaccacctccccctccacccctggtggagggcgatctgagttcggccccacaagagttgaatcctgccgtgaccgctgctctgctccaattgctcagtcagcccgaagcagaaccgccaggccatctgccccatgagcaccaggccctgagacccatggagtatagcactagaccccgacctaatcgaacttatggtaacaccgatgggcctgaaacaggattttccgccatcgatactgatgagcggaactctggcccagcactgacagaatctctggtccagacactggtaaagaatcggacctttagtgggtctctttctcacctcggcgagtcttcttcctatcagggtaccggaagtgtccagtttcccggtgatcaggatcttcgattcgcgcgagtgcccttggcacttcaccctgtggtcggacaaccttttctgaaggccgagggcagctcaaatagcgtggtgcacgcggaaacgaaactgcagaattacggagagctgggccctggaaccacaggcgctagctcctcaggcgctggactacattgggggggtcccacgcagtccagcgcatatggtaaactctatcggggtcctactcgagtacctccacggggtggcagaggccgaggtgtgccttattag

SEQ ID NO: 22700 - DNA, 4473 bp, Artificial Sequence
  Description of Artificial Sequence: Synthetic coding sequence
atgccaaatagtgagcggcatggagggaagaaggatggaagcggtggcgcttctggcacactccaacctagttccggaggcggatcaagcaactccagagaaaggcaccgcttagtttcgaaacacaagcggcacaagtcgaaacactctaaggatatgggcctcgttacacccgaggctgccagccttggaaccgtgatcaagccactagtggagtatgacgatatctccagtgacagcgataccttttccgatgatatggcatttaaacttgatagaagagaaaatgatgagaggcgtggttctgatagatcggatagactgcacaaacaccgacatcaccagcaccggcgatcacgcgacctactgaaggctaaacagacggagaaggaaaagagccaagaggttagcagcaagtctggcagtatgaaagaccggatcagtggttcttccaaaaggagcaatgaagaaactgacgactacggcaaggcacaggtggccaagtcaagctctaaagagtctagatcttctaaactgcacaaggagaagacacgcaaggagcgcgagctcaaatcaggtcacaaggacaggtccaaatcccaccggaagagagagactcccaaaagttacaaaactgtagatagcccgaagcgaagaagtagatcgccccaccggaaatggtctgatagttcgaaacaggacgactcccctagcggagcttcatacggacaagactatgacctaagtccaagtcgctcacatacgtcgagcaactatgacagctacaaaaaatctcctgggagtacttccagacgccagagtgtctctcccccatataaggagccatccgcctaccagtcaagcacccgcagtccctccccgtattccagaagacagcggtctgtgagcccctattctcggaggcgatcgtcttcctatgaacgctcgggatcctactctggtcgctcgccatcaccctatggccgaagacggtcttccagtccatttctcagtaaaaggtctctttcaaggagtccacttccaagtcgaaaatctatgaagtctcggtcaagaagtcccgcttatagtagacatagcagtagtcactcaaaaaaaaagagaagtagcagccgaagtagacacagctctatatcccctgttcgcttgcccctgaacagctctctcggcgctgaactaagtcgcaagaagaaggaacgagctgccgcagcagcggctgccaaaatggacggcaaggagtctaaagggagccccgtttttctgccacgtaaagagaattcgtctgttgaagccaaggacagcggactggagtcaaaaaagcttcccagatctgtaaaacttgagaagtctgcccctgacaccgagctagtgaacgtaacccatctaaataccgaagtcaagaactccagtgacactggaaaggtgaaactggatgaaaatagcgaaaaacaccttgtgaaagacttaaaggcacagggaactagagatagcaaaccaatagccttaaaggaggagattgtgactccgaaggagaccgagaccagcgagaaagaaactccccctcctcttcccactatagcctcaccgcctccccctcttccaacgacaacaccaccccctcagacccccccattacctcctctccctcccattccagccttgccccagcagccaccccttcctcctagccaacctgccttctcacaggtgcctgccagctccaccagcaccttaccccctagcacacactccaagacgagcgcagtttcgtcccaggctaactcccagcctcccgttcaagttagcgtcaaaactcaggttagtgtcacagcagcaatccctcatttgaagacatcaacacttcccccattgcccttgccccctctactgcccggtgacgacgatatggattcgcccaaggagactcttccaagtaagcccgtgaagaaggaaaaagaacaaagaacacggcacctactgaccgatctgcccctacctccagagctgccaggcggagacctgtctcccccagattctcctgaacctaaggcaatcacgccccctcagcaaccatataaaaagcgccctaaaatctgttgtccacgatatggggagagacggcagacagagagcgactggggtaaacggtgcgtggataagtttgacataattgggatcattggcgaaggcacctacgggcaggtatacaaagcaaaagacaaggataccggcgagctggtggccttgaagaaggtgagactggataatgaaaaggaggggttccctattaccgctattagagaaatcaaaatccttcgccagttgatccaccgcagtgtcgtcaatatgaaggagatcgttacagacaaacaggatgccctcgattttaaaaaagacaagggggctttctatctggtgttcgagtatatggaccacgacttaatgggcctgctggagagtggcttggtacactttagcgaagatcacatcaaaagcttcatgaagcagttgatggagggccttgagtattgccacaagaagaattttttgcatagggatattaaatgttccaatatacttctgaataattcaggccagatcaagctcgccgactttggtttggccaggctgtataactcagaggaatcgcggccatacactaacaaagtcatcacgctgtggtaccgtccccctgaactgctgctgggcgaggagcgatacacaccagcaatcgatgtttggagctgcggctgtatacttggtgagctctttaccaagaagcccatttttcaagccaatctggagctcgcccaacttgagctgatatccaggctgtgtgggtctccctgccccgctgtgtggcccgacgtgattaagttgccatacttcaacaccatgaagccgaagaagcagtaccgacggcgtttgcgcgaggaattctcctttattcctagcgccgcattagatcttctcgatcatatgctgactctggaccctagcaagcggtgtacagcagaacaaacgttacagagcgactttctcaaggatgtggaactgagcaagatggccccaccagacctgccccactggcaggattgtcatgaactctggtcaaagaagcgtagacgccagagacagtcaggtgtggtcgtggaggaacctccaccatccaagactagtaggaaggaaaccaccagcggaacatctacagaacccgtcaagaattcctccccagcccctccgcagcctgctccgggaaaagtggaatcgggagcgggtgacgctatcggcttagccgacataactcagcagttgaaccaaagtgaactcgccgtgctccttaatttgttgcaaagccagacagatctctcaatcccacagatggcacaactgttaaatatccactccaatccagagatgcaacaacagcttgaagccttaaatcagagcatttcagctctcaccgaggctacatcacagcagcaagactccgaaacgatggcaccagaagaaagcctcaaggaagcaccttcagctccggttatccttcccagcgccgagcaaactacactggaggcctcgagtacacctgccgacatgcagaacatccttgctgttctgctgtctcagcttatgaaaacacaggagcccgctggttctctcgaggaaaataattccgacaagaactcaggcccacagggcccacgcagaacccctacaatgcctcaggaggaagcggcagcctgtccaccacatatcctgcctcctgagaaaagacctccggaacctccagggcctcccccaccgccacctccccctcccctcgtggagggggacctctcttcagcccctcaggaactgaatccggctgtcactgccgctttgctgcagctgctgagccagcctgaggctgaaccacctggccacttaccacacgagcaccaagccttaaggcccatggaatactccacccgtcccaggcctaatcgcacctacgggaacactgatggcccagaaacagggttctcagctattgacacggacgaacggaacagtgggcctgcccttacggagagcctggtccagacactcgtgaaaaatagaactttctctggttcgttatctcacctaggagaatcttcctcctaccaagggaccggctctgttcaatttcctggagaccaggatctgagatttgccagggtccctctggcgctgcaccccgtggtcggtcagcctttcttgaaggctgagggcagctcaaattcagtcgtgcacgcggaaacaaagctccagaattatggagagctcggcccaggcacgactggcgctagctccagtggcgcaggtttgcactggggcggtcctacacagtccagcgcatacggcaagctgtaccgcggaccaacccgggtgcctcctaggggcggtcgcggacgcggagttccttattag

SEQ ID NO: 22701 - DNA, 4539 bp, Artificial Sequence
  Description of Artificial Sequence: Synthetic coding sequence
atgcctagttcatccgatactgctctgggcggagggggtgggctttcctgggccgagaaaaagctggaggaacgcagaaagcgacggaggttcctaagcccacaacagccaccactgttactgcccttgctgcagccacaactgttgcagcctcccccacccccacctcccctgctgttcttggcagcccctggtactgccgcagccgctgcggctgccgctgcagcatccagctcctgtttcagcccagggccaccactggaggtgaaacgtctagctcgtgggaagaggcgcgcaggtgggagacagaaaagacgcaggggccctagagcgggacaggaggcagaaaaacggcgagtttttagtctgcctcagcctcaacaagatggaggcggaggtgccagctctggtggtggagttacgccccttgtcgaatatgaggatgtctccagccagagtgagcaaggactcctgctgggtggggcatcggccgctaccgctgctacagctgccggaggaacaggcggttcaggtgggagtccagctagcagttctggtacacaacgccgaggggagggttcggaacggcgaccccgacgggatcggaggagctccagcggccgatcaaaagagcggcaccgagagcatagaagacgggatggccaaagggggggttcagaggccagtaaatctagatcacggcattcccattctggcgaagagcgcgctgaagtggccaaatctggcagttccagttcaagtggcggacggcgaaagtcggcctctgcaactagctcttcttcctccagcaggaaagacagagattctaaggcccatcgtagcagaaccaaatcatccaaagaacctccaagcgcatacaaggagccaccaaaggcatatcgggaggataaaaccgagcctaaggcctatcgacggaggagatctctaagccctttgggcggtcgagacgattctcccgtctctcatcgggcttcccagagcttgcggagccggaagagtccatctcctgccggaggcggaagttccccctattcaagacggctgccccgttccccaagtccctattcacggagacggtctccctcatatagccggcattcttcctacgagcggggaggagacgtatcaccctccccttacagttcctcatcctggaggagatcccggagtccttactcccctgtcctgaggcgaagcggcaaatcccggagccggagcccatatagctcgagacactcccggtccagatcaaggcatcgactgtccagaagcagatcccggcactccagcatttcaccctccaccctcactctgaaatcttcactggccgcagaacttaataagaacaaaaaagcacgggcagcagaggcagctagggccgcagaagctgctaaagccgcagaggcaactaaagcggcagaagcagccgctaaggcagccaaagccagtaatactagcactcctaccaaagggaacacagaaacgtcggcctcggcctctcagactaaccatgtgaaagacgttaaaaagattaaaattgaacacgccccttcccccagctcgggaggaactctcaagaatgataaggctaagaccaagcctcccctgcaggtcaccaaggtcgaaaataatctgatagtcgacaaagcgaccaagaaggcagtcatcgtgggcaaggagagcaaaagcgccgctaccaaagaagaatcggtgagtttaaaagagaagacgaagcccctcaccccatcaatcggtgccaaggagaaggagcagcacgtagccctcgtaacaagtactctccctcccctgcccctgcctccaatgctcccagaggataaagaagccgattctttgagagggaatatatcagtgaaagcagtgaagaaggaggtggaaaagaagttgcgatgtcttctggccgacctccccctcccacctgagctacctgggggagatgatctgagtaaatcccctgaagagaagaagacagctacccagctccattcaaaaagacggccaaagatctgcggacctaggtacggggaaaccaaggagaaggacatcgattgggggaagaggtgtgtggataagtttgatattattggcatcataggggaaggcacctatggacaggtgtacaaagccagggataaagataccggggaaatggttgcactcaaaaaggtacggctggataacgagaaagaggggttccccataaccgcaatcagagaaatcaagatactgcgccagctgactcaccaaagcattatcaacatgaaagaaattgtcacagacaaggaggacgcactcgactttaagaaggacaaaggggcattctatctggttttcgagtatatggaccacgacttaatgggactgctggaatctggcctcgttcattttaacgaaaatcacattaaatcctttatgcggcagcttatggaaggactcgactactgccataaaaagaatttcctgcacagggacatcaaatgtagtaacattttgctcaataaccgaggccagataaaactcgcagacttcggattggcaagactgtactcatccgaagagagccgcccatacacaaacaaggttattactctctggtacaggccacccgaactgctcctgggggaagagaggtacacaccagcgatcgacgtctggtcctgtggctgtatcctgggcgagctatttacgaaaaaacctatcttccaggcgaatcaggaactagcccagcttgagctgatcagccgcatatgtggttccccctgcccggctgtctggccggacgttataaaattgccctattttaacacgatgaagccaaaaaaacaatacaggcggaagctccgggaagagttcgtattcattccagccgcagcactggatctgttcgactacatgctcgctctggatccctctaaaaggtgtaccgccgaacaagcgttgcaatgcgagtttctgagagacgtcgagcctagtaagatgcctcccccagatctgcccctgtggcaggactgtcatgagctgtggtctaaaaagcgccgacggcagaaacagatgggcatgacggacgatgtgtctaccatcaaagcacccaggaaggacctctccctgggactggacgactctcggacgaataccccacagggagtcctgcccagcagtcaattgaaaagccagggcagcagcaatgtcgctcccgtgaagaccggcccagggcagcacctgaatcactctgaattagctatattactgaaccttctgcagtccaagactagcgtcaacatggctgattttgtgcaggtcttgaatattaaggtaaattccgagacacagcaacagttaaacaaaatcaacttacctgcagggattctcgctacgggcgagaagcagactgaccctagcacaccccagcaggagtcctctaaaccacttggaggtattcaacccagcagccagacgatacagccgaaagtggagacggacgccgctcaagctgcggtgcaaagcgcctttgccgtgctgttgacccagcttattaaagcacaacagtcaaaacagaaggatgttctgctggaagaacgagaaaatgggtctggccacgaggcttccctgcagctgagaccaccccctgaaccttccactcccgtaagcgggcaggacgacttgatacagcaccaggatatgaggatcctcgaactaactccggaaccggaccggccacggatactgccccctgaccagcgccctcccgagccccctgaaccccctcccgtgacagaggaggaccttgattacagaactgagaatcagcacgtgccaacaacaagctcctcgctcacggacccacacgccggagtaaaggccgcactcctgcaactgctcgcacagcaccaaccacaagatgatccgaaacgcgagggagggatcgattaccaggcaggggatacttacgtatccacatctgattataaggataattttggctcctcatccttttcctctgcaccatacgtgagcaacgacggcttagggagctcctccgcccctcccctggagcgcaggtccttcatcggcaatagtgatatccagagcttagataactattccactgcctccagtcactccggaggcccacctcaaccaagcgccttctcagagagctttccatctagtgtcgccggatatggagatatttacctgaacgccggtcccatgctgttcagtggtgataaggaccaccgctttgaatactctcatggcccaatcgcagtcctggcaaatagttccgacccctccacaggcccagaatctacacaccccctaccagcaaaaatgcataattataactatggcggaaacctccaagagaatccatccggtccatcgctgatgcacggccagacatggacttcgccagcccaaggtcccggatattcacagggttacagggggcacattagtacttctaccgggagggggagaggaagaggcctcccctactag

SEQ ID NO: 22702 - DNA, 4359 bp, Artificial Sequence
  Description of Artificial Sequence: Synthetic coding sequence
atgcccagttctagcgacactgcactgggaggcggtggcggattgtcctgggcagagaaaaaacttgaggaaaggcgcaaacgacgacgctttctttccccacagcagccgccactgctgcttcccctcttacagcctcagcttctacagcctccccctcctcctccccctttgctttttctggcagctccgggtactgctgccgctgcggcagcggcagccgctgcaagcagctcgtgtttctccccaggtcctcctcttgaggttaagaggttggccagggggaagcgaagagccggaggcaggcaaaagaggaggagaggtcctcgggctgggcaggaggccgagaagagacgcgttttttccttaccccagccccagcaagatggtggtggcggtgccagctccggcggaggcgttacccctcttgtcgaatatgaggacgtaagttcccaatcggagcaggggttacttctgggtggagcctcagctgctacagccgcaacagcggctggcggtaccgggggatctggcggatcacccgcttccagcagtggcacccagaggcggggagagggttccgagagaagacccagaagagaccgaaggtcttcctccggacggagtaaggagcgccaccgggaacatcgcagacgggacggccagcgcggtgggtcagaggcctctaaaagtaggtctagacactcccactccggcgaagaaagggccgaggtcgccaagtccgggagctccagcagcagtggaggtcgcagaaagagcgccagcgcaacttcctcaagtagtagttcacgaaaagaccgggactctaaggcccaccggtcccggacgaaaagttctaaggagcctccctccgcatacaaggaaccacctaaggcctatcgcgaagataaaacagagccgaaggcgtatagaaggcgcaggtcactgtcaccactggggggaagagacgactcacccgtgtcccatcgcgcaagccagtcactcagaagccggaagtcccctagcccagcagggggtggctccagcccatactcacggaggctccccagatccccctccccctattctagacgccgttccccatcatatagtcgccactcgtcctacgaacggggaggagacgtgtccccatctccttacagttcaagcagctggcgcaggtcacgcagcccttattcaccagtactgagaagatcaggcaagagccgtagccgctcaccctattcttcccgacatagtcggtcacgatcacgtcatcgtctcagccgtagtagaagtcgacacagttctatttcaccttccacattgaccctcaagagttcactcgcggctgagcttaataagaacaaaaaagctcgggcagcagaggcagctagggcggcagaagcagcgaaagccgcagaagcaacaaaggcagcagaggccgcagctaaagccgctaaagccagcaatacatctacgcccactaaaggaaacactgagactagcgccagcgcttctcagacgaaccatgtgaaggatgtcaagaaaatcaagatagaacatgcaccctcaccttcatccggagggacactaaaaaatgataaagccaagacaaagcccccactacaagtcaccaaagtggaaaacaacctgattgtggacaaggctacaaagaaagccgtgatcgttgggaaggaaagcaaatccgccgcaaccaaagaagaatcagtcagccttaaagagaagaccaagcctctgacgccaagcattggcgctaaggagaaggagcagcacgtggcactggtgactagcacacttcctccattgcccttgcctccgatgctacctgaggataaggaggcagatagcttgcgcggtaatatctcagttaaggccgtgaaaaaagaggttgaaaagaaactcagatgcctgctcgcagaccttcccctgcccccagagctcccaggaggcgacgatctatccaagagccctgaagagaaaaagacagctacccagcttcattccaagagacgaccaaagatctgtggacccagatatggcgagacaaaggagaaggacatagactggggcaaaaggtgtgtggataagttcgacattattggtatcattggcgaagggacctacgggcaggtgtacaaggccagagacaaagatactggggagatggttgccttgaaaaaagtccgccttgataatgaaaaagagggcttccctattactgcgatccgggaaattaaaatcctgcgccagttgacacaccagtctataatcaacatgaaggagatcgttactgacaaggaggatgccctggatttcaaaaaggataagggcgcattctacctggtcttcgagtacatggatcatgaccttatgggcctcttagaatcaggtctggttcacttcaatgagaatcatatcaagagctttatgcggcaactgatggaggggttggattattgtcataaaaagaattttctgcatagagatataaaatgttctaacatcctacttaataacaggggccaaatcaaactagctgactttggattggctagactgtactctagcgaggaatcccgcccatacacaaataaggtgatcacactttggtacagaccacccgagcttctcttaggtgaagagcgttatacaccggcaattgatgtatggagctgtggttgtatcctgggcgagctgttcacaaaaaaacccatcttccaggccaatcaggagctggcacaactcgaactgatatcgcggatctgcggatctccctgtccagcagtctggcccgatgtgatcaagctgccgtactttaacactatgaaacccaaaaagcagtataggaggaagctccgggaggaatttgtgtttatccctgccgctgccctcgatcttttcgactatatgctagccttagatccctcaaagaggtgcaccgccgagcaggccctgcagtgcgagtttctgcgtgacgtggagccaagcaagatgcctccacctgatctgccactctggcaggactgtcacgagctttggtcaaagaaacgaaggcggcagaagcagatgggaatgaccgacgatgtgtccacgatcaaagcccctcgaaaggacctgtccctcgggctggatgattctcgaaccaacaccccacagggggtactcccaagctcccagctgaaatcacaagggtccagcaacgtagcccctggagagaaacaaaccgatccatctaccccccagcaggagagttcaaagccccttggaggtatccagccatcttcacagactatacagcccaaggtggagacagacgccgctcaagcggctgtccaatccgcattcgctgtgctgctgactcagctaatcaaagcccaacagagcaaacagaaggacgtgttgctggaagaacgtgagaacgggtcgggtcacgaggcttctctgcagttgcgcccaccacccgaaccctcgaccccagtctctgggcaagatgacctgattcagcaccaggatatgagaatcctggagctcactcccgagccggataggcccaggatcctccctccagatcagcgcccaccagaaccacctgagcctcccccagttactgaggaggacctcgattatcgcaccgaaaaccagcacgtaccaacaacctcaagcagcctgacagacccccatgccggagtgaaggctgcacttttgcagctcctggctcagcaccaacctcaggacgaccccaaacgtgaaggtggcattgattatcaggctggtgacacctacgtgagtacttccgattataaagacaattttggatcgtcgagcttttcttccgcgccttatgtcagcaatgatggcctgggatcctctagcgccccacctcttgagaggaggagctttatcggtaacagtgatattcagtctctggataattattccaccgcttccagtcactcgggaggtccccctcagcccagcgcctttagtgaaagctttccctcatcagtagccggatatggcgatatttacctcaatgccggtcctatgctcttctctggggacaaggaccaccgatttgaatactcccatgggccaatagccgtattagccaacagttcagaccctagcaccggcccagagtcaactcaccccctgccagccaagatgcacaactataactacgggggtaacctacaggagaacccgtctggcccaagtctgatgcacggacagacatggacttcaccagcacagggcccagggtacagccagggctacagaggacatatctctactagcacgggcagagggcgaggccgtggtctcccatactag

SEQ ID NO: 22703 - DNA, 1770 bp, Artificial Sequence
  Description of Artificial Sequence: Synthetic coding sequence
atgacaggcctcttaaagcggaagttcgatcagctcgacgaggataatagcagcgtctcttcttcttcctcgtctagcgggtgtcagtcccgcagctgcagcccaagctcttctgtatcccgcgcatgggattcagaggaagaaggtccttgggaccaaatgccactgcctgaccgcgacttctgcggcccacgttcattcaccccccttagcatcctgaagagggccaggagggaacgccctgggcgtgtcgctttcgatgggattaccgtcttttactttccaaggtgtcagggcttcaccagtgtgccctcccgtggtggatgtactttgggtatggcacttcgacattctgcttgtagaaggttttcactcgcggagtttgcccaggaacaggcccgtgctcggcacgaaaagctgaggcagcgactgaaggaggagaaattagagatgctgcagtggaagctcagcgccgcaggcgtcccacaggcagaagccggtttacctccagtcgttgatgccatagacgatgctagcgttgaggaagaccttgccgtcgctgtggccggaggtcggctcgaagaggtgtcctttctccagccttaccctgctcgtaggcgcagggccctgttacgcgctagcggtgtccgtcgcatagatagggaggagaaaagagaactgcaagctttacggcagtcccgtgaggactgcggatgccactgtgatagaatctgcgaccccgaaacatgtagttgtagtctggccggaatcaaatgtcaaatggatcacacggccttcccgtgtggctgttgtagggagggctgcgaaaaccctatggggagggtagaatttaatcaggcacgggttcaaacacatttcattcacactctgacgcgcttacagctggaacaggaggccgagagtttccgcgaacttgaagccccagcccagggttctcctccctctcccggtgaagaggctctagttccaacctttcctttagctaagcctcctatgaacaacgaactgggcgataacagctgctccagtgacatgacagatagttctacagcctccagctccgccagcggcacatctgaggcacctgattgccctacacaccctggtctccctggtccaggatttcagccgggagtagatgacgactccctggcacgtatcctgtccttttccgacagcgactttggaggagaagaggaggaagaagaggagggctcggttgggaacctggacaacctcagctgctttcatcctgctgatatatttgggacgtcagaccccggaggactggccagctggacacactcatacagtggttgctcttttacatccggggtcttggatgaaaatgcgaacctcgacgcaagctgcttcctgaacggcggtctcgagggatcaagagaagggtctctacccggtacatccgtacccccaagtatggacgccggacgctcttcttctgtcgaccttagcctatcatcctgcgactcttttgagctattacaagccttaccggattactcactggggcctcattacacaagtcagaaagtgtcggacagcctggataacatcgaagcgccacatttccctcttccgggactgtccccccctggcgacgcaagttcatgctttctagagtcactcatggggttctcagaaccagcagctgaagcactcgacccatttatagacagtcaattcgaagacacagtgcccgcaagtctaatggaaccagtgcctgtgtag

SEQ ID NO: 22704 - DNA, 744 bp, Artificial Sequence
  Description of Artificial Sequence: Synthetic coding sequence
agaaggcggtgcaggacacgtcgagctcgtgggggatggaccgatggctgtcgcgcagagcgcaccgagtctaggaggcgcggtagaccgaggccaggccgaggcagccggcgttgcccgccacgcgcttccggcctgcaggctgtttgccctcagacccccgaacacgttagacatcatcacgattgggccgtggaggaagaagagggtagcgtggggaatctagataatctctcctgcttccaccccgcagacatattcggaacttctgaccctggaggcctggcctcatggacccattcatactcgggttgctcatttaccagcggggtcctggatgaaaacgctaacctcgacgctagttgctttctcaatggcggactcgagggcagccgggaagggagcttacctggcacctccgtccctccctccatggatgctggcaggagctcctcggtcgacttgagcttgagctcctgtgactcttttgagttgctgcaggctctcccagactactcacttgggccacactacaccagtcagaaggtctctgattccctggacaacattgaggccccacacttcccactgccgggactgagtccgccaggcgatgcaagttcatgttttttagagtctctgatgggcttctcggagcctgccgctgaagctctcgacccattcatcgattcccaattcgaagacactgtgcccgcatccctcatggagccggtgcccgtatag

SEQ ID NO: 22705 - DNA, 1770 bp, Artificial Sequence
  Description of Artificial Sequence: Synthetic coding sequence
atgactggcttactcaagcgcaaattcgatcagctggatgaagataactcctcagtttcgtcatccagtagcagctccggctgtcagtccagaagctgttcaccaagttcttctgtgtccagggcgtgggactcggaggaagagggtccctgggaccagatgcctctacctgaccgtgacttctgtggacctcgctcctttacccctttatcaattctgaaaagggccagaagggagaggcccggtagggtcgcttttgacggcatcacagtcttctactttcctaggtgccagggattcacatctgtgcccagtagaggaggctgtaccctgggcatggccctgcgtcatagtgcttgtcgccgttttagtctggctgagttcgcacaggaacaagcgcgagctagacacgagaaacttcggcagagactaaaggaagagaagctggaaatgctacagtggaagctctctgctgctggtgtcccacaggccgaggcaggcctgccacctgtggtggatgcaatcgacgatgcatctgtggaagaggatcttgcagtcgctgtcgcaggtggtagactcgaggaggtgtcttttctgcagccttatcccgcacggcgaaggagagcacttctgcgcgcatctggagtccgacgaatagatcgggaggagaagagggagttacaggccctgaggcagagtcgggaggactgcggttgtcactgcgacagaatatgcgatcccgaaacatgttcatgcagcttagctggaatcaaatgtcagatggatcatactgcttttccatgcggctgctgtagggaggggtgcgagaatccaatggggagggttgagttcaaccaggcaagggtgcagactcattttattcacaccttgactagactgcagttagaacaggaggctgagagtttcagagagttagaagccccagcccaggggagcccgccatccccaggcgaggaggcgttagttccgacgttccctcttgcaaagcctcctatgaataatgaactaggggataatagttgcagctcagacatgactgattccagtacagcctccagctctgcttcgggcacctccgaagcccctgactgtcctactcatccaggcttaccaggccctggattccagccaggggtcgacgatgattcattggcccgtatcctatctttttccgattctgatttcggcggagaggaagaggaagaagaggagggatcggtgggtaacctggacaatctctcgtgtttccaccccgcagacatttttggtacatccgatcccggaggcctcgcaagctggactcactcatattctggctgcagttttacctccggggtattagacgagaacgcgaacttggacgcctcttgtttccttaacggaggcctcgaggggtccagagaaggtagtctgcccggtacctctgtccctccttcgatggacgctggtcgctcttccagtgtcgacttgagcctcagttcctgcgatagctttgaactgttacaggcactgccggattattcgcttgggcctcactatacctctcagaaggtgagcgatagtctcgataatatagaagcccctcattttccactgccaggtttgtcacccccaggagacgctagcagctgcttcctggagagcttgatgggatttagcgagcccgctgctgaagctcttgatccattcattgattctcagttcgaggacactgttccagcttctctaatggagcctgtgcctgtatag

SEQ ID NO: 22706 - DNA, 1191 bp, Artificial Sequence
  Description of Artificial Sequence: Synthetic coding sequence
atgctgtcagaggtcctactggtatccgctcctggaaaagtgattctgcatggggaacacgccgtcgtgcacgggaaggttgcgttagcagtgagtctgaatttgaggacattcctgcgccttcagcctcatagcaacggcaaggttgatctaagcctgcccaacatcggcataaagagggcctgggatgtcgcgagactgcagagcttagatacatcttttctggagcaaggcgatgtgactactccgacttctgagcaggtggaaaagctcaaggaggtcgctggactgcccgatgactgcgccgtgacggagagactcgccgtgttggcctttctgtacttgtacctatcaatttgtcggaagcagcgcgctcttccaagcctggacattgttgtctggtccgagttgccacccggagcaggcctcgggagcagcgccgcttactctgtgtgtctggctgccgcactgctcacagtctgtgaagagattccaaatccattgaaagatggggattgcgtgaataggtggactaaagaagacctggaacttatcaataagtgggcgtttcagggcgagcgaatgatacatgggaatccatctggtgtggataacgcagtgtccacgtggggtggcgcactgcgttaccaccaaggaaaaattagctcactgaaaaggagtccagccctgcaaattctcctaacaaatactaaagtgccacgtaatactagggccctagtcgctggcgttaggaaccgacttctgaaatttcccgaaatcgtggcaccattactgacgagcatagatgctatttcccttgaatgtgaacgggtgctgggagagatgggtgaggcccctgcccctgaacagtatcttgtcctggaggaattgatcgacatgaatcagcatcatttaaacgccttaggcgtgggtcatgccagcttggatcagctgtgtcaagttacgagagctagagggcttcatagcaagctgactggcgctggcggaggcggttgcggcatcacattactgaagcctggcctcgagcagccagaggtggaagctaccaaacaggcactcacatcctgtgggttcgactgtcttgagacctccattggcgcacctggcgttagcatccatagcgcaacctctctggatagccgcgtgcaacaggcactcgacggcctgtag

SEQ ID NO: 22707 - DNA, 177 bp, Artificial Sequence
  Description of Artificial Sequence: Synthetic coding sequence
atggatgctttcaccggatccggcttgaagcggaaattcgatgatgtagacgttggttcgtcagtatcaaactcagatgatgagatttcatcctcagattcagcggacagttgcgacagcctgaatcctccaactacggctagctttaccccgacttcaattctcaaacggcagtag

SEQ ID NO: 22708 - DNA, 345 bp, Artificial Sequence
  Description of Artificial Sequence: Synthetic coding sequence
atggacgcgtttacgggcagcgggctgaagcggaaattcgatgacgtggatgtcgggtccagtgtgagtaacagtgacgatgagatctctagtagcgacagcgcagacagctgtgattccttaaacccacccacgacggcctcatttacccccacgagtattttgaagaggcagaagcagctcagaagaaagaacgtgcgtttcgaccaggtgacagtgtattactttgctaggcgtcaaggctttacatctgtgcccagtcaaggcggttccagccttggaatggcccagcgccacaatagcgtccgcagttacaccctctgcgagttcgcccaggagcagtag

SEQ ID NO: 22709 - DNA, 261 bp, Artificial Sequence
  Description of Artificial Sequence: Synthetic coding sequence
atggacgcctttactggaagcgggctcaagcgcaaatttgacgatgtggatgtaggcagcagtgtttccaatagcgacgatgagatttcctcctcagacagcgccgactcttgcgacagccttaacccccctacgacagcttccttcactccaacctcgattcttaaacgtcagaaacagcttcggaggaagaatgttcgatttgaccaggtgacggtatactatttcgcccgacggcagggctttaccagcgttccatag

SEQ ID NO: 22710 - DNA, 1758 bp, Artificial Sequence
  Description of Artificial Sequence: Synthetic coding sequence
atgagcggtatcctgaagcgtaagttcgaagaggtggacggatcttccccctgctctagtgttagagaatctgatgacgaagtttcctccagcgaaagcgcggactctggcgacagtgtcaacccatctacctcctctcatttcacgccgtcgtccattctaaaacgtgaaaagcgcctcaggacaaagaacgtccacttctcctgtgtgacagtatactattttacaaggcgacaggggttcaccagtgtgccatcccaggggggaagtacactgggaatgtcgtcccggcataacagtgtgaggcaatataccctgggcgagtttgccagggagcaggaacggctgcaccgggagatgctgcgggagcacttgagagaagagaagctaaacagcctcaagctcaagatgaccaagaatggcaccgtagagtccgaagaggccagcacccttactctcgacgacatctcagacgacgatatcgacctggacaataccgaggttgatgagtactttttcttacagccccttcccactaaaaagcgacgcgcacttctgcgtgcatcaggtgtcaagaaaatagacgtcgaggaaaaacatgagctgcgggctatccggctcagtagggaggactgtgggtgcgactgcagagtgttctgtgacccggatacatgcacctgttctttggccggtatcaaatgccaggtagatagaatgagtttcccctgcggctgtaccaaagagggctgctcaaataccgccggtcgcatagagtttaatcctattagagtcagaacacacttcctccacaccattatgaagttggagttggagaaaaacagggagcagcagattcccactctgaatggatgccactccgaaattagtgcccactccagctccatgggccctgtagcccacagtgtggaatactcgatcgccgattcgttcgagattgagacagagcctcaagcggctgtactgcacctgcagtctgctgaggagctcgactgccagggcgaagaagaggaagaggaggaggacgggtcaagcttctgcagtggcgtgaccgacagcagcacacagtccctggctccctcagagagtgacgaggaggaggaagaagaggaggaggaagaagaggaggaagacgacgatgacgataagggcgacggcttcgtggaagggctcgggactcacgccgaggttgtgcccctgccatcagtgctttgctacagcgacggtaccgcggtccatgaatcccacgctaaaaatgcttcgttctatgccaatagttcaacgctgtattaccaaatcgattctcatatcccaggcacacccaaccaaatttctgaaaactactccgagcgcgacactgtcaaaaatggaacattatccttggttccgtatacaatgactcccgagcaatttgtcgactacgctcgccaagccgaagaagcctatggcgctagccattatcctgctgccaacccgtccgtgatcgtgtgttgttcatctagtgaaaatgatagtggcgtgccctgcaatagtctgtatcctgaacataggtccaaccatcctcaggtcgaatttcactcctatcttaagggtccttctcaagaaggtttcgtgtctgctctgaatggagacagccatattagcgagcatccagccgagaatagcctgtcactagccgaaaagtctatactgcatgaggagtgtatcaaaagccctgtcgttgaaaccgtaccagtctag

SEQ ID NO: 22711 - DNA, 1758 bp, Artificial Sequence
  Description of Artificial Sequence: Synthetic coding sequence
atgtcaggcattctgaaacggaaattcgaagaggtggacggatcaagcccttgctcttctgttcgcgagagcgacgatgaggtttcttcctctgagagcgctgattctggcgactccgtgaacccctctacctcttcccacttcacacccagctcgatccttaaacgggagaaacggctgcgaacgaagaacgtccacttcagttgcgtgaccgtgtactatttcacacgccgacagggctttacttccgttccttctcagggagggtccacactcggtatgagctcccgccataattcagttagacagtatacgctcggcgagtttgccagggaacaagagagattacacagagaaatgttacgtgaacaccttcgtgaggagaaacttaattctctgaaacttaagatgacaaagaacggcacggtcgaatccgaagaagctagcaccttgaccctggatgatatttctgatgacgatatcgatctagataatacagaagtggacgagtacttttttctgcagccattgcccacaaaaaaaaggagggccttgctgcgagccagcggagtcaaaaaaattgacgtggaggagaagcacgagctgcgggctatccgcctgtccagagaggactgtggttgtgattgccgcgttttctgcgatcccgacacctgcacgtgtagtttggcagggattaaatgccaggtggaccggatgagttttccttgcggttgtactaaggagggctgctctaacaccgccggaaggatcgagtttaaccccatcagagtccgtacacacttcctgcataccatcatgaagttggaacttgagaaaaaccgcgagcaacagatcccgaccctgaatggatgccacagcgagatttcggctcattcatcctccatgggacctgtggcccacagcgtcgaatactctattgctgatagcttcgagattgagacggaacctcaggccgctgtactgcacctgcaatccgcggaagagctcgattgccagggtgaagaggaggaggaggaggaagacggatcaagcttctgctccggcgtgacagactcctctacacagagtctggctccgtctgaatctgatgaggaagaagaggaggaggaagaagaggaggaggaagaggacgatgacgatgacaaaggcgacggatttgtggaaggtctggggactcacgctgaggtggtgccgctgccctcagtcctgtgctatagcgatgggacggccgtgcatgagtcacatgcgaagaacgccagtttttacgccaattcaagcaccctttactaccagatcgatagccacattcctggcaccccgaaccagatctccgaaaattacagcgagagagatactgtgaagaacggcacgcttagcctcgtgccctacactatgaccccagaacagttcgtggattatgcacggcaggccgaggaggcttatggggcaagccactacccagcagccaaccctagcgtcattgtatgttgcagcagctccgagaacgactcaggtgtgccttgtaactctctgtaccccgagcaccggtcaaaccacccccaggtcgagtttcattcttacctgaagggtccatctcaggagggattcgtttccgcactgaacggtgactctcacatatccgaacacccagcagagaatagtttatctctggccgagaagtcaatcctgcacgaggaatgtattaagtccccagttgttgagacggtgccagtctag

SEQ ID NO: 22712 - DNA, 1854 bp, Artificial Sequence
  Description of Artificial Sequence: Synthetic coding sequence
atgaagtgcgctctgttcctgagggttaaaatccttcagcgggtgtgtagaagccgctacattgttcatgccggaacatgcgatagtacagcggcaatgagcggtatcctcaaacgcaaattcgaagaagtcgatggctccagcccttgtagctccgtacgcgagtctgatgatgaggtaagctcaagcgaaagcgcggactctggcgacagcgttaatcccagcacatccagtcactttacaccttcctcaattctgaaacgggaaaaacgattacggaccaaaaatgtgcacttttcctgcgtgactgtctactatttcactcggcgtcaaggctttacttcagttccttcccagggtggaagcacactcggcatgtctagcagacacaactctgtcaggcagtatacactaggagaatttgccagggaacaggagagattgcatcgggagatgctaagggaacacttgagggaagaaaagcttaactctttgaaacttaaaatgacaaaaaatggcacggttgaatccgaagaggcaagtactctcacattggatgatatctcagatgacgatattgacttagataatactgaagtggatgaatatttcttcctgcaacccctccccacaaaaaagagacgggctcttctgcgggctagtggcgtgaaaaaaattgacgtcgaggaaaagcatgagctgagggcaatcagactgtcacgggaagactgtggatgtgactgtcgcgttttttgtgaccctgacacatgtacctgcagtctcgcaggcattaaatgtcaggtggatcgaatgtcctttccttgcggatgtaccaaagagggctgctcaaacacagcaggcagaatcgagtttaatccaatacgggtcagaacccacttcctccataccataatgaagttagagttggagaagaacagggagcagcagatccccaccctgaacggttgccactctgaaatttccgctcacagttcttctatgggtcctgttgcccattccgtggaatatagtatagctgactcattcgagattgagactgagccacaggccgctgtactccacctgcagagcgccgaggagctagattgccaaggcgaagaggaagaggaggaggaagacgggtctagtttctgttctggtgtaacggactcttccacccagagtttagccccaagtgaatctgacgaagaggaggaggaggaagaggaggaggaggaggaggaggatgacgacgacgacaaaggtgacggcttcgtggaggggctaggcactcacgcagaagtcgttcctctgccttcagtgttatgttattcagacgggactgcagtccacgagagtcacgctaagaacgcctccttctatgctaacagtagtaccctctattatcagatcgatagtcacattcccggaaccccgaaccagatcagtgaaaattatagtgagagggacaccgtaaagaatggtacgttgtctcttgtaccatataccatgacaccggagcagtttgttgactatgccaggcaggctgaggaagcatacggcgcatcacactatcctgccgctaaccccagtgtcattgtgtgttgctcctctagcgaaaacgattctggggtgccctgcaactcgttgtacccagagcaccgcagtaatcacccccaagtggagttccattcctatctcaaaggaccatcacaggaggggtttgtcagcgctctgaacggagactctcatattagcgagcaccctgccgagaatagcctgtccttggcagagaagtctattctccacgaggaatgtatcaaatcacccgtggtggagacagtgcccgtctag

SEQ ID NO: 22713 - DNA, 417 bp, Artificial Sequence
  Description of Artificial Sequence: Synthetic coding sequence
atgtcagggatcctgaaacgcaaattcgaggaggtggatggatctagcccatgctcttctgtcagagagagcgatgacgaagtctctagcagcgagagcgctgatagtggggatagtgtaaacccatctacatctagccatttcacaccttctagcatcctaaaaagggagaagagactccggacgaagaacgtccacttcagttgtgtaacagtgtattatttcacacgcaggcagggcttcacaagtgtcccgtcccagggcggtagtactcttggcatgtcttcaaggcacaatagcgtgcgacaatacaccctgggcgaattcgctagggaacaggagaggttacatagagaaatgctccgtgagcacctgcgggaggagaaacttaacagcttgaaactcaaaatgacttag

SEQ ID NO: 22714 - DNA, 1314 bp, Artificial Sequence
  Description of Artificial Sequence: Synthetic coding sequence
atgtccggtatccttaagaggaagttcgaagaagtagacgggtcctcaccatgttcttccgtgcgagaatcggatgatgaagttagctctagcgagtcagcagacagtggtgatagcgttaatcccagcacttcatctcacttcacaccttcaagcattctgaagcgcgagaaacgcctccgcacaaagaacgtacattttagctgcgtgactgtctactattttacgagacggcaaggatttacttccgtgccttcacaaggtggatctacacttgggatgtcgagtcggcataattccgttcgccagtatacactcggggagttcgcgagagaacaggaacgcctccaccgggaaatgcttcgggagcacctgagagaagaaaaactcaactcactgaagctgaaaatgacaaagaacggtacggtcgaaagcgaggaggccagcacactgactctcgatgacatctccgatgacgatattgacctcgacaataccgaagtggatgagtatttttttttgcagcctctgcccacaaaaaagagaagagcccttctgcgtgcctcaggggtcaagaaaatcgacgtggaggagaagcacgagttgagagctatcaggctgtcacgagaggattgcggctgcgactgcagagttttttgcgatcccgatacctgtacctgcagcttggcgggaatcaagtgtcaggttgatcggatgagcttcccctgcggatgcactaaggagggttgttctaacactgctggcagaatagagttcaaccctatcagagtccgtacacacttcttacacacaattatgaaactagagctggagaaaaatagggaacagcagatccctaccctgaatggatgtcattcagagattagtgctcatagtagcagcatggggccagtggcacactctgtcgagtatagtatcgccgattcatttgaaattgagactgagccccaagcggcagtgctacatctgcagtctgctgaggagctggactgtcaaggagaggaggaagaagaggaggaggacggatcttctttttgctccggcgtcacagactcatccacccagtcattggctccttctgagagcgatgaagaggaggaggaggaggaggaagaggaggaagaggaggacgatgacgacgacaagggagatggttttgtggaggggctgggtacgcatgccgaggtggtgccactgccctcagtgctgtgttattccgatggtactgccgtgcacgagtctcacgccaaaaatgcctccttttacgctaacagttcaaccctgtactactag

SEQ ID NO: 22715 - DNA, 1569 bp, Artificial Sequence
  Description of Artificial Sequence: Synthetic coding sequence
acatgtgacagcaccgctgccatgtcaggcatactgaagcgcaaatttgaagaagtggatggttcttccccgtgctcctccgtgcgagagtcagacgacgaggtgtcctccagcgaaagtgcggactccggagacagcgtgaacccaagtacgagcagtcatttcactccttcctccattttgaagcgggaaaaacgcctccgcacaaaaaatgtgcacttttcttgtgtgaccgtgtactatttcacccggcgtcagggctttacttccgttcctagccagggaggctctaccttaggcatgagcagtagacacaattcagtcaggcagtacacccttggcgaatttgcccgagagcaagaaaggctccacagggaaatgctgagggagcacctgcgagaggagaagctgaacagcttgaagcttaaaatgaccaagaatggtactgtggagagtgaggaggcttctaccctgaccttagacgacatttctgacgacgatatagacctggataatacagaagtggacgagtacttctttctacagcctctgccaaccaagaagagaagggccttactccgggcttcaggagtaaagaaaattgatgtggaggagaaacatgaactcagggccattaggctctcccgggaggactgtgggtgcgactgccgagtcttttgtgacccagacacatgcacctgcagtctcgcaggcatcaaatgtcaagtcgatcggatgtctttcccttgcggatgcactaaagagggatgtagcaacacagctggaaggatcgagtttaatcccatacgcgttcggacccactttctgcacacaattatgaagctggagctcgagaaaaaccgcgagcagcaaatccccactcttaatggctgccactctgaaatctcggcccattccagctcaatggggccagtagctcattcagtagaatactctatcgcggattcttttgaaatagaaacggagccccaggcagcagttctgcatctgcaatcagctgaggaattagactgtcagggggaagaggaggaggaagaagaagacggtagctccttttgctctggcgtgacagattccagcacgcagtcactggccccaagcgaatctgatgaagaagaagaggaggaagaggaggaagaagaagaagaagatgatgacgatgacaagggcgatggattcgtggagggtctcgggacacacgctgaggttgttcccctcccatccgtgctgtgctatagtgatggcactgccgtccacgaaagccacgcgaagaacgcgtccttctacgccaactccagtaccctatattatcagaatgattccggagtgccttgcaattctctgtaccccgaacaccgctccaatcatccacaggtcgagttccattcatatctgaagggcccatcccaggaagggtttgtgtctgccctgaacggcgatagccatatctcagaacacccggctgaaaacagtttgtctctggctgagaaatcaatcttgcatgaagaatgcatcaaatcccccgtggtcgagacagtgcctgtgtag

SEQ ID NO: 22716 - DNA, 2127 bp, Artificial Sequence
  Description of Artificial Sequence: Synthetic coding sequence
atggccgtgcccgcagccctaattccaccaacccagctggttccaccccagcctcctatctccacctctgcaagctcaagtgggactactacctctacaagcagcgcgacttcctcgccagccccttccattggaccacctgcctcaagtgggccaactctgttccggcctgaacccattgcctccgcagctgccgctgccgctacagtgacatccactggtggtggtggcggaggcggtggcggagggtcagggggtgggggaggctccagtgggaatgggggtggtggcggtgggggtggagggggttctaactgtaacccaaaccttgctgccgcatcgaacgggagtggaggcggtggaggcggtatcagcgcaggcggaggggtggcgtcgtccacacctataaacgcctctaccgggagctcctcttcgtcatcctcttcgagcagctcctctagttcatcttcaagttcatcttcgagttcctcaagctgtggcccattaccgggaaaacccgtgtatagtactccctctcctgtggaaaacactccccaaaacaacgagtgcaagatggtggaccttagaggcgctaaagtggctagttttacagtggagggctgcgagttgatctgcttaccacaggcgttcgatctctttttaaagcacttggtgggcggtttacacactgtctacactaaactgaaacggctggaaatcactccagtggtgtgtaacgtggaacaggtccgcatacttcgtgggctgggggcaatccagcctggagtaaacagatgcaaactcattagcaggaaggactttgagaccctttacaatgactgtaccaacgcctccagtcgcccagggaggcctcctaagagaacccagtcagttacctccccggagaatagtcacattatgccccatagcgtcccaggattaatgtcccctgggataatccctccaacagggctgactgcagctgctgcagcggcagccgcagcgacaaacgcagccatcgccgaggcaatgaaagtcaaaaaaatcaaactggaagcaatgagtaattaccacgcaagcaataatcagcacggggctgactccgagaatggcgacatgaatagcagcgtgggcctagaactgccgttcatgatgatgccgcacccactgatccccgtgtctttgccacccgcatctgtgacgatggccatgtcccagatgaaccacctgtcaacaattgccaacatggcagccgctgcgcaggtccagtcaccccctagtcgcgtggaaacgagtgttattaaggaaagggtgccagatagcccttctcctgctccttcccttgaggaagggcgacggcctggatctcaccctagctcgcatcgttctagctcagtttcaagcagccctgctagaactgagtccagcagtgatcggatcccagttcaccagaatgggctcagcatgaatcagatgcttatgggtctttcgccaaatgtactgcctgggccaaaagagggcgatttggcaggacatgatatggggcatgagtccaaacggatgcatatcgagaaagatgaaacacccctctctacaccaacagctcgggacagcctggacaaactgagtctcaccggccacggccagcccctaccccctggatttccatctccatttctattcccagatggccttagttcaatcgaaactcttctgacaaacatccagggcttgctcaaggtggcaattgacaacgcacgcgctcaagagaagcaggtgcagctcgaaaagacagagcttaagatggatttcctgcgagagcgtgagctgcgggaaacactcgaaaagcagctggcaatggaacagaaaaaccgggctatagtgcagaagagactgaaaaaggaaaagaaagccaagcggaaacttcaggaggccctcgagttcgaaacaaagcgtcgcgaacaggccgaacagacactcaaacaggctgcctctacggatagcctccgtgtgttaaatgatagcctgacccctgaaatcgaggccgacagatctggtggacggacagacgcagagcgcactatccaagacggtaggctgtatcttaaaaccactgtgatgtactag

SEQ ID NO: 22717 - DNA, 1683 bp, Artificial Sequence
  Description of Artificial Sequence: Synthetic coding sequence
atggctgtgcccgcagctttaatacccccaactcaattggtgcctccccagcccccaatctccacctctgcgagctccagcgggacaacaacatcaacctcaagcgctacgagctcccccgctccttccattgggccacctgctagtagcggccctaccctttttaggccagaaccgatcgcctcagccgcagctgccgctgctacagtcaccagcaccggcggagggggtggcggaggcggaggaggatctggagggggtgggggaagcagcggaaacggaggaggtggaggtggagggggaggcggttcaaattgcaatccaaatctggccgctgcatccaacggtagtggcggtggaggtggtggcatctctgcaggcggaggagtggctagctctacaccaattaacgcttcaaccggaagttcaagttcgagctctagttcttcgagctccagcagttcctcttcaagcagcagtagctcttcttcctcttgtggaccccttcctggtaaacctgtttactccacgccaagccccgtcgaaaacaccccccaaaacaatgagtgtaagatggtggacttacgtggggctaaagtagcgtccttcacggtggagggctgtgaattgatctgtctgccacaagcctttgacctctttctgaagcatttagtcggcggacttcatacagtgtataccaagcttaagcgactcgaaatcaccccagtagtgtgcaacgtggagcaggtgcggattctgcggggattgggggctatccagcccggagtgaacagatgcaagctgatttcacgaaaagactttgagacactgtataacgattgtaccaacgccagctcccggccaggaagaccccctaaaaggacgcagtcagtgacaagcccagagaactcccacattatgccccactccgtccccggtcttatgagtcccggaattattccgcctaccggactaaccgctgcagctgctgccgctgcagctgcgactaacgctgccatagccgaagctatgaaggtaaagaagatcaaactggaggcaatgtccaattaccacgcctccaacaatcaacatggtgcggattcagaaaacggcgatatgaatagcagcgtcgacgagacccccctttcaacccccacagccagagacagccttgacaagttatcactcactggtcatgggcaacccttgccaccaggctttcccagcccattcttattccctgacggcctttcttctattgaaactttgctgaccaatatccagggtcttctgaaggtggcaatagacaatgcacgtgcccaagagaagcaggttcagttggaaaaaactgagctgaaaatggattttttacgggagcgggagctccgagagaccctggaaaaacagctggccatggagcagaagaatcgagccatagtacagaaaagactgaaaaaagaaaagaaggcgaagaggaagttgcaggaagcgctggagttcgagaccaagcggagagaacaggccgagcagactttaaagcaggctgccagcacagacagcctgcgggtgctcaatgatagcttaacccctgagattgaggcagacagatctggcggtagaacagacgccgaaaggaccattcaggacgggaggctctatctgaagactactgtgatgtattag

SEQ ID NO: 22718 - DNA, 1521 bp, Artificial Sequence
  Description of Artificial Sequence: Synthetic coding sequence
atggctgtgccagccgcattgattccacccacccagcttgttcctcctcagcccccaataagcacttcagctagcagctccggaacgaccacgtctacaagcagcgccaccagttccccagcgcctagcatcgggccacccgctagttcggggccaacattgtttcggccagaacccatcgcctccgctgccgctgcggcagcaactgtcacttccacaggtggcggaggaggcggtggaggcggtggtagtggagggggaggaggctcaagcggcaacgggggtggagggggtgggggaggcggaggtagcaactgtaatcctaatttagccgctgctagtaatgggtcaggaggaggcggtggcggaatatctgcgggtgggggagtggccagtagcactccaatcaacgccagtaccgggagcagtagttccagctcttccagctccagctctagcagcagttcttcctccagcagtagctcttcgagttcttgcgggccacttcccggaaagcctgtttacagcaccccttctccggtcgagaacacaccccagaacaatgagtgtaaaatggtcgatctgagaggggcaaaagtggcttccttcactgtggaagggtgcgagctgatatgtctgccacaggcgtttgacttgttcctgaagcacttggtgggaggtttgcatactgtgtacaccaaactcaaaagattggaaatcacaccagtggtctgcaacgtggagcaggtgcggatcctgaggggactgggtgccatccagccaggcgtcaaccgctgcaagttgatctcaagaaaggactttgagaccctttataatgattgtaccaacgccagttctcggccaggacgaccgccaaaacgtacccagagtgttacttccccagaaaactcgcacattatgccccactcagtgcctggcctgatgagcccaggcattattccaccgacggacgagacacctctctcaactcccacagctcgcgactccttagacaagttatcgttgaccgggcatgggcagcccttgccacctggctttccctctcctttcttatttcctgatgggctgtccagcattgagaccctactgacaaatattcaaggcctgcttaaagttgcaatagacaacgcgagagcccaggagaaacaagtgcaactggagaaaactgagctgaagatggatttcctcagagagcgggagttgcgtgagacactcgagaagcagctcgcaatggaacaaaagaaccgggctattgtccagaagcgcctgaagaaagagaagaaagccaagagaaaactgcaagaggcactggaatttgaaaccaagagaagagaacaggccgagcagacacttaagcaggccgctagcactgattcgttgagagtactgaacgattctctcacaccggagattgaggccgataggtcaggagggagaaccgacgcagagagaaccattcaggatggcaggttatatctaaaaacgactgttatgtactag

SEQ ID NO: 22719 - DNA, 2283 bp, Artificial Sequence
  Description of Artificial Sequence: Synthetic coding sequence
atggccgttcctgctgcacttatccccccaacccaactcgtcccaccacagccacccatctctactagcgccagcagctccggcacaaccacgtccacgtcaagcgccacttcgagcccagctccctctattggcccaccagcatcaagtgggccaactctgtttcggccagagccaatcgccagcgctgcagctgccgctgctaccgtgactagcacgggcggtggcggaggaggcggtggcggaggcagcggagggggagggggttcaagtgggaacggcggtggaggcggaggtggcggaggcggatccaattgtaaccccaatctggctgccgcttctaatggttccggtggtggcggtggcggaatctcagcgggtgggggtgtcgccagttcaacccccatcaacgcaagcaccgggtccagcagctctagctcgtctagtagttccagttcatccagttcttcttcttcctcctcctcgtcgtcatcatgtggtccactgccagggaagccagtgtactcaactcccagtccagtggaaaacacaccgcagaataacgagtgcaagatggtagacttgcggggagccaaggtggcttcctttactgtggaaggttgcgagttgatttgcctgccccaggcattcgacttgttcctcaagcacttagtgggcggtctgcacacggtgtatacaaagctcaagcgactggaaatcaccccagttgtatgcaacgtggagcaggtgcggatcttaagagggttaggcgctatacagcccggagtgaacagatgtaaattgataagtagaaaagattttgagacactgtataacgactgtactaatgctagttcccgacccggtcgcccacctaagcgcacacagtctgtaacatctcctgagaactcacatatcatgcctcactccgtcccgggactgatgtcacctggcattattccacccacaggcctcaccgctgccgctgcagccgctgctgccgctaccaacgcagcaattgcggaagcaatgaaagttaagaaaattaaactcgaggccatgtctaattaccacgcatccaataaccaacatggtgctgactcagaaaacggagatatgaactccagtgtgggtagttctgatgggtcatgggacaaagagacattaccttcatccccctcccagggacctcaggcctccatcacccatcctagaatgccaggcgcacgatcgctgccactgagccatcctctgaaccacctccagcaatcccatctcttacctaacgggctagaactgccctttatgatgatgccacatcccttaatccctgtctcccttccaccagcctcagtaacaatggccatgagccaaatgaatcacttgagtacgatcgcaaatatggcagcagcagcccaggttcaaagtccccctagtagagtggagaccagcgtcatcaaggagagagtgcccgattcaccttcccccgctccaagcttggaggaaggtcgtcggccaggcagccacccatcgtctcatcgcagttcttccgtttctagcagtcccgctcggaccgaatctagctccgatcgaatcccagtgcaccaaaacggtctcagtatgaaccagatgctgatgggactctcccccaacgttctgcccggaccaaaagaaggagacctggcgggacacgatatgggccacgaaagcaaacgcatgcacatcgaaaaggacgagacgcctttatccacgcccactgccagggatagtcttgataagctgagtttgaccggtcatggacaacctctgccgcctggattcccctcaccctttctgtttcccgacggtctttcttccatagaaacgttgctgaccaatatacagggcctccttaaagtggccatcgataacgctcgggcacaggagaaacaagtccagctggaaaaaactgagttgaaaatggacttccttagggagcgagaacttcgcgagaccctggagaagcagctcgcgatggagcagaagaatcgtgccattgtgcagaagagacttaagaaggaaaagaaggcaaagcggaagctgcaagaggctctggaattcgaaaccaaaaggcgcgagcaagcggagcagaccctgaagcaggcagcctccacagactcgctgcgagtgctcaacgactccctcacaccagagatcgaggcagacagaagcggtgggcgaactgacgcagagaggactatccaggacggaagactttacctcaaaacaactgtgatgtactag

SEQ ID NO: 22720 - DNA, 2283 bp, Artificial Sequence
  Description of Artificial Sequence: Synthetic coding sequence
atggcggtgcccgcagcgcttattcctcctacacagttggttccaccacagccacccattagtacctccgcctctagcagtgggacaaccacgtcaacctcaagcgccacctcctcaccagccccaagcattggtccacctgcctctagcgggccaactctgtttagacccgagccgattgcatctgccgctgccgcagccgctacagtaacgagcaccgggggagggggaggtggaggcggaggcggatccggcggtggtggaggatcctcgggaaacgggggtggaggcggagggggaggcggtggatcaaactgtaaccctaatcttgcagccgcatccaatggatcagggggtggtggcggaggaatctctgccggaggaggcgtcgcttcatcaacaccaatcaacgcgagtaccggatcctcatcaagctcgtcctcatcctctagcagctcttcatccagctcatcaagttccagctcttcaagctcttgtggacctctcccgggaaagcccgtgtattccacgccctcacccgttgagaacacaccacaaaacaatgagtgtaaaatggtggatttgcggggagccaaggttgcatccttcacggtggagggatgcgaactgatctgtttaccccaagcatttgacctatttcttaagcacctggtcgggggactgcacacagtctacacaaagttgaaaaggctggagattactcccgtcgtctgtaacgttgaacaggttcggatcctccgaggcttgggtgctatccagcctggcgtaaatcgatgcaagctcatttcacggaaagacttcgagactctgtacaatgattgtaccaatgcctcttctaggcctgggcgtccaccaaagcggacccagagcgtgacatcgccagaaaatagtcatatcatgccacacagtgtgcctgggcttatgtctcccggtatcattcccccaaccggcctgaccgcggcagccgcagctgctgctgcagctactaatgccgcaatcgctgaagccatgaaagtgaagaagatcaagctcgaggccatgagcaattaccacgcatcaaataatcagcacggagccgactctgagaatggggacatgaattcgagcgtcggctcttccgatggctcctgggacaaggagacccttcctagctccccatctcagggtccacaggcctccatcactcatcctcggatgccgggagccagatcattacccctgtctcatcccctgaaccatctccaacaatcgcacctgctgccaaatgggttagagctgccttttatgatgatgccccatcctctcatccctgtgagcctgccacccgctagcgtgactatggccatgagccagatgaaccacttgtccaccatagcgaacatggccgctgctgcgcaggtccagtccccgccaagccgggtagaaacttcagtgatcaaagagcgcgttccggactctccctcccctgccccaagcctggaggaggggagaaggccagggagccatccctccagccaccgctcttcaagtgtaagcagctctcccgcaaggaccgagagtagctccgataggatacctgtccatcaaaacggtcttagcatgaatcagatgcttatgggacttagcccaaacgtacttcctggcccaaaagaaggtgatctggctgggcacgatatgggccacgaatctaagaggatgcatatcgagaaagacgaaacacctctttccacccctaccgctcgcgacagcctcgataaactgtctctgactgggcacggacaacctttgccaccgggatttccttctcccttcttgtttcctgacggactttcatcaattgagactctcctcactaacatccaggggttgttaaaggtggccattgacaacgccagagcccaggaaaaacaggtccagctcgaaaagacggagctgaaaatggactttttgagggaaagagagcttagggagacccttgagaaacagctggccatggaacagaaaaatcgggctatagtccagaaacgcctgaagaaagagaagaaagcgaaacggaagttgcaagaggccttagaatttgagactaaacgacgggaacaggcagaacagactctgaagcaagccgcatctaccgactctctcagagtactaaatgattcacttacacccgaaatagaagctgatcggagcggtggccgaaccgacgccgagagaacaattcaggccgctaggctgtacatcaaaacagtgtgcatgtactag

SEQ ID NO: 22721 - DNA, 1800 bp, Artificial Sequence
  Description of Artificial Sequence: Synthetic coding sequence
atggccgtatccgcctcacctgtgatttctgcaacttcttccggcgctggagtcccaggtgggctctttagggccgagccattatactcgaccccaagagagccgccaaggttgaccccgaacatgatcaattctttcgtggtcaataatcactcgaattccgcaggagggggaggacgcggaaataccaatactaatgagtgccgaatggtggacatgcacggtatgaaggtggccagcttcctgatggatggacaagagttaatttgtttgccccaggttttcgatctgttccttaaacatctggtcggaggcctgcacacagtgtacacgaagttgaaaagattggatatttctcccgtggtgtgcaccgtagaacaggtacgaatcctgaggggcctcggagccattcagccgggtgtgaatcgctgcaagcttattacaagaaaagattttgagaccctgttcactgactgtaccaatgcgagaaggaagcgccagatgacacggaagcaggctgtgaacagtagtaggccgggaagacctcccaaaagaagcctgggggtgctccaggagaatgctcggctcttgactcacgccgtaccgggtttattgagcccaggactgattactcctacaggcataacggcagccgctatggccgaagcaatgaaactccagaaaatgaaactcatggctatgaacacactccaagggaatggctcacagaacgggacggagtctgagcccgatgacctgaacagcaacaccgggggatcggagtcatcttgggataaggacaagatgcagtcaccattcgccgcaccaggaccgcagcacggaattgcgcacgcagccctggccggacaaccgggtataggaggcgctccgacgttgaacccgctccagcaaaatcacctactgaccaaccggctcgatctgcctttcatgatgatgcctcacccactcctccccgtgagcctcccccctgcctctgtcgcaatggctatgaatcaaatgaaccacctgaatacaatagctaacatggctgccgctgcccagatccattctcccctcagccgggctgggactagtgtcattaaggaacggattcccgagagcccttctccggctccttcccttgaggaaaatcataggcccggttcccagacgagtagtcatacctcctcgagcgtaagttcttcaccatcgcaaatggaccaccacctagagcgtatggaggaggtccccgtgcagatcccgataatgaaatcacccctcgataagatccaactgacacccggacaggctctgcctgccggatttcccggacctttcattttcgcagattcattatcttccgtcgaaactctgctcaccaatatacagggccttctgaaggtggccttggataatgcacgcattcaggaaaagcaaatccagcaagagaagaaagagctgcggctcgagctttacagggaaagagagatccgcgagaatctggagcgccagctggccgtggagctgcagagcagaacaacaatgcaaaaaagactgaaaaaggaaaagaaaacaaagcggaagttacaggaagccctagagttcgagagcaaacgtagggagcaggtcgagcaggccctgaagcaggccacaacttctgatagcgggttgaggatgctgaaggacaccggaataccagacatcgaaatcgagaacaacggcactccgcacgatagcgcggcaatgcagggcggtaattactattgccttgagatggcccaacagctctactccgcctag

SEQ ID NO: 22722 - DNA, 1800 bp, Artificial Sequence
  Description of Artificial Sequence: Synthetic coding sequence
atggccgtttcagcctcccctgttatctcagccacatctagtggggcaggtgtgcctggcggtctttttcgcgcagagcccttatactctacccctagggagccccctcgcttgacacccaatatgatcaatagctttgtagtcaacaaccacagcaacagtgccggaggaggaggcagaggaaacactaacactaacgagtgtagaatggtcgatatgcatggtatgaaggttgcttctttcctgatggacgggcaagaactcatatgtctacctcaagtgttcgacctgttcctgaaacatctggtgggtgggctgcataccgtttacacaaaactcaaaagactggatattagtcccgtcgtttgcacagtggagcaagtaagaattctgcggggactcggggctatccagcctggagtgaataggtgcaagctaattaccaggaaggactttgagaccctgttcaccgactgcaccaacgccaggcgcaagcggcaaatgacacgcaagcaggccgtcaattccagcagacccggaagaccccctaagcgctctctgggtgtgctccaggagaacgccagacttctcacccacgctgttcccggactgctgtcaccaggcctgatcacaccgacgggaatcaccgccgctgcgatggccgaggcgatgaaactgcaaaaaatgaaactgatggctatgaatacccttcagggtaacggcagccaaaatggcaccgagtcggaaccagatgacttgaactccaacaccggtggctctgaaagttcatgggacaaggataaaatgcaatcaccatttgctgctcccggaccacagcatggcattgcccacgctgccctggcgggtcagcctggaattgggggtgctcccaccctgaatcccctacagcagaaccacctcctgacgaaccgactggaccttcccttcatgatgatgccccatcctctgctccctgtgtccctacccccagcctctgtagcaatggctatgaatcagatgaaccacctgaacaccatcgccaacatggccgcagcagcccagatacatagtccgctgtctcgcgcagggacctccgtgatcaaagaaagaattcccgaaagcccctcccctgctcctagtctggaggaaaatcatcgacccggatcccagactagctctcacacaagcagctccgtttcgagttccccgtctcagatggaccatcatctggagcggatggaggaggtgcctgtgcagatccctatcatgaagtctcccctggacaagattcagctgacacctggccaggctcttcccgctggcttcccaggaccttttatatttgctgatagtctcagctccgtggaaaccctactcacaaacattcagggattattgaaggttgctctggacaacgcccgaatacaggagaagcagatacagcaggagaaaaaggaactgaggctggagctgtaccgcgagcgcgaaataagagagaatctggagcgccagctggcagttgaactgcaatctagaacaaccatgcaaaagaggcttaagaaagaaaagaaaacaaaaagaaagctccaggaagcccttgaatttgaaagcaaaaggcgggaacaagtggagcaggctctcaagcaggcaactacaagcgattcaggtctgaggatgctgaaggacactggcataccggacatcgagattgaaaataatggaaccccacatgactctgccgcaatgcagggcggtaattattattgcctggagatggcccagcagctctacagcgcctag

SEQ ID NO: 22723 - DNA, 1716 bp, Artificial Sequence
  Description of Artificial Sequence: Synthetic coding sequence
atggcagtttctgcttctccagtgatttcagcaacatcttccggcgctggagtccctggagggctcttccgagccgagcctctttattcgacacctcgagagcctcctaggctgaccccaaacatgataaactccttcgtggtgaacaaccattcaaattccgccggaggaggcggaaggggtaacaccaataccaatgagtgtcggatggtagatatgcatggcatgaaagtcgccagcttcctgatggatggccaggaacttatctgtttgcctcaggttttcgatttatttctgaagcatctggtgggagggctgcacacagtttatacgaaactcaagaggctggatattagcccagtcgtctgcaccgtagagcaggtgaggatcctgcgcggattgggcgcaattcagccgggagttaacaggtgcaaactgataacgcggaaagatttcgagaccctgtttactgactgcacgaatgcctcctctcggcctgggaggccaccgaaacgtagcctgggcgtgttacaggaaaatgccagactattaactcatgctgttcctgggttgctgtctccagggctaattacgccgaccggaatcaccgctgcagccatggccgaagcaatgaagctgcagaagatgaagctgatggcgatgaacacactgcagggtaacgggagtcagaatggaactgagtctgaaccagacgacctgaactccaataccggtggttctgaatcctcttgggataaagataagatgcaaagtccttttgctgcgccaggcccacagcacggcattgcacatgccgcattggccggtcaaccagggattggaggggcacccacattaaaccctctccagcaaaatcaccttctcacaaatagactggatctcccctttatgatgatgccccaccccctactgccggtttccctccctcctgcgtctgttgctatggcaatgaatcagatgaatcatctgaacactatcgctaacatggccgctgcagcacaaatccactcaccattgagtagggccggaacatccgtaattaaagagaggatacccgaatcacccagcccagccccttcactagaggaaaaccaccgaccaggatctcaaacttccagccacactagcagcagcgtgtcctcctcccccagtcagatggaccaccatctggagagaatggaagaggtgcccgtgcagatcccaatcatgaaatctccactggataaaatccagctgacaccaggccaggccttaccagctggattccctggaccttttatcttcgctgatagccttagttcggtggaaacactgctcaccaatattcaagggttattgaaggtggctctggataatgccaggatccaagagaagcagattcagcaagagaaaaaagagttgagactcgaattataccgggagagggagatcagggaaaacctggagagacagctggcagtagagttgcaatcccggactacgatgcagaagagactaaagaaggaaaagaagacgaagcggaagcttcaggaagccttggaatttgaatccaagagacgtgagcaggtggaacaagccctaaaacaggccaccacatctgattctgggctgcgaatgctgaaggacactggaatcccagatatagaaatcgagaataacgggactccccatgacagcgccgcaatgcaggcctag

SEQ ID NO: 22724 - DNA, 1299 bp, Artificial Sequence
  Description of Artificial Sequence: Synthetic coding sequence
atggcccagaatcagttctttaattcatcgaggccaggacgaccacccaagagaagcttgggagtcctgcaggagaatgctcggctgttaacccacgctgttccaggcctcctctccccaggtctaattacgcctaccggaatcacagcagccgctatggccgaagctatgaaactgcagaaaatgaaacttatggctatgaacacactccaggggaacggatcacagaatggcaccgagtccgaacctgatgatctgaattccaacacaggcggaagcgaatcatcttgggacaaggataaaatgcagtctcccttcgccgcacccggtccacagcacgggatcgcgcatgcggcactcgccggacagcccggaattggaggagcccctaccctgaatccacttcagcagaatcacctgcttaccaacagactggatctcccattcatgatgatgccccaccccctcctgccagtctctctgcctccagcttcggtcgctatggcaatgaatcaaatgaatcacctaaataccatcgcaaatatggccgcagctgcccaaattcattcccccctgtcgagagccggaacctcggtaataaaagaacgaatccccgaaagtccatcccctgccccaagtcttgaagagaatcataggcccggaagccaaacctccagtcatacgtcctcatcagtctcctccagtccttcccagatggatcaccacctcgaaaggatggaagaggtgcctgtacagatcccaatcatgaaatccccacttgacaagattcagcttactcctgggcaagcgttgcctgccggttttccagggccatttatttttgccgacagtctgtcatcagtggagacactactcaccaatattcagggcctcttgaaggtggcacttgacaacgctcgaatccaagagaagcagatccagcaggagaagaaagaactgcgtctcgagctgtacagagagcgggaaatcagggaaaatctagagagacagctcgctgtggagcttcaatctcgtactaccatgcagaagcgactgaagaaagagaagaagacaaagcgaaagctgcaggaggccctggaattcgagagtaagcgcagggaacaggtcgaacaggccctgaaacaggctaccactagtgatagtggactccgaatgctgaaggacaccgggataccggatattgagattgagaacaatggaaccccacatgactcagccgcaatgcaggggggaaactactactgtctggagatggcccagcagttgtacagcgcgtag

SEQ ID NO: 22725 - DNA, 1299 bp, Artificial Sequence
  Description of Artificial Sequence: Synthetic coding sequence
atgaccaggaaacaagctgtgaattctagcaggcctgggcgacctcccaaaaggtctttaggggtcttgcaagagaacgcccgtctgctaacacacgcagttcccggtttactgagtccagggctgatcacacccactggcatcactgccgctgccatggcagaagccatgaagttgcaaaagatgaagcttatggctatgaacaccctgcaagggaatggttcacagaacggtacagagtcagaaccagacgatctgaactccaacacgggtggttccgagtcgtcctgggataaggacaagatgcagtccccatttgccgcaccaggaccccaacacggcatcgcacatgcagcgctggctggccagccagggataggcggagccccaacacttaaccctctgcagcaaaatcacctgctcactaaccggctggatcttccctttatgatgatgccacacccattactgcccgtgtcgctcccaccggcatcagttgctatggctatgaatcaaatgaatcacctcaacacaatcgccaacatggcagccgctgcccagatccactcccctctctcccgtgctgggacttccgtaattaaggagagaattccagaaagcccaagtcccgcaccctcattagaagaaaatcataggcccggtagtcaaaccagcagccataccagctctagcgtgtcgagctccccaagtcagatggatcatcacctggagaggatggaagaagtccccgtgcaaatacctataatgaagtcacccctagacaaaatccaactgacccctggacaagctctgcccgcagggttccccggtccattcatcttcgctgattcactgtctagcgtggagacgcttctcactaatattcaaggactgctcaaagtcgcgctggacaatgccagaattcaagagaagcagatccaacaggagaaaaaggaactcaggctggaactttaccgggagagggagattcgagaaaatctagaacggcaacttgcagtggaacttcagtcccgaacaaccatgcaaaagagactgaagaaggagaagaaaacaaaaaggaagcttcaagaagcccttgagtttgaaagtaaacggagagaacaggtcgagcaagcgctcaagcaggctacaacatctgatagtggactcaggatgctgaaagacacaggcattccagacattgagattgaaaacaacggcactccacacgattctgctgcgatgcaggggggaaattattattgtctcgagatggcccaacagctctattctgcatag

SEQ ID NO: 22726 - DNA, 1143 bp, Artificial Sequence
  Description of Artificial Sequence: Synthetic coding sequence
atggccgaggcaatgaaactgcagaaaatgaagctcatggccatgaatactctacagggcaatggatcacaaaatgggacagagtccgagccagacgatctgaactccaacaccggcggaagcgagagttcctgggataaagacaagatgcagtctcctttcgccgctcctggtccccagcacggtatcgcacatgccgcactagctggacaacctgggattggcggagcccctaccctgaatccacttcagcaaaaccacttactgacaaaccgtcttgacctgcccttcatgatgatgcctcatcctctgttaccagtgtctcttcctcccgctagcgtggctatggcaatgaaccagatgaaccacctaaacacaatcgctaatatggcggctgctgcccagattcacagtcccctgtcccgtgctgggaccagtgttattaaagaacgaattccagaaagcccctcacccgctccctcactcgaagagaaccatcgccctgggagccagactagctcccacacatcttcctctgtgtcctcgagcccatcccagatggatcaccacctggagaggatggaagaagttccagtacagattcccattatgaagtcccctttggataagatccagctgacgccgggacaggctctgcccgcaggcttccctggcccattcatcttcgccgatagcctgtcgagcgtagagaccctgctgaccaatattcagggcctgctcaaagttgcacttgacaacgctcgaatccaggaaaagcagatccagcaggagaaaaaggaactacgcctcgagctgtaccgagaaagggaaataagggaaaatctggaaaggcagctggcagtggaactccagtcccgaacaacaatgcagaagagactaaagaaggagaaaaagaccaaaaggaagctccaggaagccctcgaattcgagagcaagcgcagggagcaggtggagcaggccctgaagcaggcaacgacttctgacagtggactgaggatgctgaaagacacaggaattcctgacatcgagatcgagaataatggcaccccccatgattcggccgcaatgcaaggcggaaactactactgccttgaaatggctcagcagctgtactcagcatag

SEQ ID NO: 22727 - DNA, 1794 bp, Artificial Sequence
  Description of Artificial Sequence: Synthetic coding sequence
atgcagtggcccccaccctggagacgaagccccctggtgagtgccacacctcctccaggcccaacgcggggactgctatgccctaggcgtgtgagtgaagcaggagatagttctaccgagggagctaggaccggccatagacattacgtgacacctgctgagtcggcaatggagggacgctctcagcctctgccctctctgcgccctgccagtccaacgaacgcacccgctcacggcaggggctcagactgtaccgccaaagagcctcctctcgccaacgtttgccgccaaaactacggtgccgctcaagatcctgtagagcccgctggtaggcgaagcgcttcccacgttaccgggtcctccctagggaaggcggaggtcgcgtgcggtagacggtggaggtgggctgagttgttagccgatactagttggtcccctgccggtagagctaccgaaatgaaagtaaagatgctgtctagaaaccccgacaactatgttagggagactaagctggacctgcaaagggtgcccagaaactacgaccccgctctgcatccctttgaggtccctagggaatacatacgggcactcaatgctaccaaactggaaagggtatttgccaaaccttttctggcatccctcgacgggcatcgagacggcgtaaattgtttggcaaagcaccccgagaaactggccactgtgctgtccggagcatgtgatggtgaggttcggatttggaatctgacgcagcgcaattgcataagaaccatccaggcccacgagggtttcgtccgagggatctgtactcggttttgtggcacctcgttttttacagtgggcgatgacaaaactgtcaagcagtggaaaatggatggtcctggctatggggatgaagaggagcctttacacactatcctcggcaagacagtgtatacaggtattgatcaccactggaaggaagcggtcttcgctacatgtggccagcaggttgacatttgggacgagcaacgtaccaaccccatttgctctatgacatggggattcgactccatcagctcagttaaatttaaccccatcgagacattcctcctgggatcatgtgcatctgaccgcaacatcgtgctctacgatatgcgtcaggccacgccactcaagaaagtgattcttgatatgcggacgaatacaatttgctggaacccgatggaagccttcatattcaccgccgctaatgaggactataatctgtatacctttgacatgagagcacttgatacccctgttatggtccacatggaccacgtgtccgcggtgctcgacgtcgactactcaccaactgggaaggagtttgttagtgcctcctttgacaagtccatacgaatcttccccgttgacaagtctaggagtagagaggtgtaccacactaagcgtatgcaacatgtgatttgtgtgaaatggacaagcgattctaagtacatcatgtgcggcagcgacgagatgaatatccgtttgtggaaagccaacgccagcgaaaaactcggggttctaacctcccgggagaaggcggcaaaagattacaaccagaagctgaaagaaaaattccagcactacccccatataaaaagaatagccaggcaccgtcacctgccgaaatccatatactctcagatccaggaacagcggataatgaaagaggccaggagaaggaaggaggtcaacagaattaaacattccaagccaggatcggttcccctagtgagcgagaaaaagaaacatgtggtcgcagttgttaagtag

SEQ ID NO: 22728 - DNA, 291 bp, Artificial Sequence
  Description of Artificial Sequence: Synthetic coding sequence
atgaaagtgaaaatgctatccaggaatcctgataattacgttagagagaccaaactcgatctccaacgggtccccaggaattacgatcccgctctgcaccctttcgaagtccctcgcgagtacatcagggccctgaacgctaccaagcttgaacgagtcttcgccaagcccttcctagccagcttggacgggcacagagacggtgtgaattgtctggctaaacaccccgagaaactcgctaccgtgctgtctggtgcatgcgacggtgagcttaatatgattaagctgtag

SEQ ID NO: 22729 - DNA, 2583 bp, Artificial Sequence
  Description of Artificial Sequence: Synthetic coding sequence
atgtctagagggggatcatacccacacctactgtgggatgttcggaaaaggagcctcggccttgaagatccctctagactcagatctcgatacttgggaaggagagagtttatccagcgtctcaaactggaagccactctgaacgtccacgatggttgcgtcaatacaatctgctggaacgacaccggtgaatatatcctgtcgggatcagacgacactaagctggttataagtaatccatacagccggaaggttctaacaacgatccgcagtgggcatagagccaacatcttctctgcaaagtttttgccttgtacgaacgataagcagattgtctcatgttccggggatggggtcatattctatacaaatgtagaacaggacgcagaaaccaacaggcaatgccagttcacttgccattacggtacgacctatgagattatgaccgtgccaaatgatccctacaccttcctctcctgcggtgaggacgggaccgtgaggtggtttgacacccggataaaaacatcttgcaccaaggaagactgcaaggatgacatcttgattaactgccgcagagccgctacatccgttgccatatgtccaccaatcccttactatctggcagtaggctgctcagactctagcgtcaggatctacgaccgtaggatgttaggaacgagagcaacaggtaactacgccggaagaggaacgacaggcatggttgcgaggtttattccatctcacctgaataacaaatcgtgtagagtaaccagtctctgttactccgaggacgggcaggagatacttgtatcctacagttccgattacatctacctgtttgatcctaaggacgacacagccagagagctgaaaacaccatctgctgaggagcgaagggaggagcttaggcagcccccagtgaagaggcttagactgcggggagattggtcagacacaggacctagagcacggccagagtctgagcgcgagagagacggagagcaaagccccaacgtgagtctgatgcagcgcatgtcagacatgctgtctaggtggtttgaggaggcctctgaggtggctcaaagcaacaggggcaggggtcggtctcgcccaagaggaggaacaagtcagagcgatataagcacccttcctacagtacctagctcacctgacctggaggtgtccgagaccgctatggaagtcgacacccccgcagagcaattcctgcaaccatccacttcaagtaccatgtccgcacaggcccactctacaagttctccaaccgaatcaccccacagcacccccctattgagttctccagactccgaacagcgccagtcagtcgaggctagcggacatcatacccatcatcagtctgacaataataatgagaagctgtctcccaagccgggtacgggagaacctgtgctgagtctgcactactcaacagagggcactaccacgtccaccatcaagcttaacttcacagatgagtggagctctattgcaagctcatcccgaggcattgggagtcactgcaagtcggagggccaggaggagtcattcgtgcctcagtcttctgtccagcctccagagggggattcagaaacaaaagctcccgaagaatcatctgaggatgtaaccaagtatcaggagggagttagcgcggagaaccctgtggagaatcacatcaacattacacagtcagacaaattcacggctaagccgctggacagtaattcaggggagcggaacgatcttaatctggaccggtcatgtggcgtacctgaggaaagcgcatcttccgagaaggcaaaggaaccggaaacatctgaccagaccagtacagagagcgcaaccaacgaaaataatactaaccccgaaccgcagtttcagaccgaggccactggcccaagcgcccatgaggagacaagcactcgggattccgcactgcaagacacggacgatagcgatgatgaccctgttctgattcccggagccagatacagagccggtcccggtgacaggcgaagcgccgtcgctcgcattcaagaattctttcggcgtcggaaggagcgcaaagaaatggaggagttggatacgctgaatatcaggagacctctggtgaaaatggtttataagggccacagaaattccagaactatgattaaggaggctaatttttggggggctaacttcgtgatgtctggctctgactgcggacatatattcatctgggacaggcatacggctgagcacttgatgctcctcgaagcagataatcacgtagtgaattgcttgcaacctcatccctttgatcccattctggcatctagtgggattgactacgacattaagatatggagtccattggaggaatctcggatcttcaataggaaactggccgacgaggtcatcacacgcaacgaactgatgctcgaggagactcgcaataccattaccgtgccagcttcttttatgcttcggatgttagcctctctgaaccacatccgcgctgatcgcttggagggcgatagaagtgaagggtccgggcaggagaatgagaatgaggatgaagagtag

SEQ ID NO: 22730 - DNA, 2856 bp, Artificial Sequence
  Description of Artificial Sequence: Synthetic coding sequence
atgagccgaggaggctcctacccccatctactttgggatgttagaaagagaagcttgggcctggaggacccatccagattgcgatcccgataccttgggagaagagaatttatccagaggctgaagcttgaagccactctgaatgtgcacgatggttgtgtgaacacaatctgctggaatgatacaggggagtatattctttccgggtctgacgacacaaagttggtaatcagtaatccctactcccgcaaggtgctcacaactatccgttccggacacagagccaacatttttagtgctaagtttctgccttgcacaaatgataaacaaatcgtctcttgtagtggcgacggggtcattttctatactaatgtggaacaggatgccgagactaatagacagtgccaattcacatgccattatggaactacctacgaaataatgactgtgcctaatgacccttacacgtttctgtcatgcggagaagacggtacggtccggtggttcgacaccaggatcaagacctcgtgcacgaaagaagactgcaaagacgatatcctgatcaactgcagaagggccgcaacttcggttgctatctgtccaccaattccatattatcttgccgtcggctgttctgacagttccgtgcgcatctacgataggcgaatgctcggaacccgtgccacgggcaactatgcaggacggggaaccactgggatggtggcacggttcattccttcccatctgaataataagtcatgcagagtcacaagtctttgctatagtgaggacggccaggaaatcctagtgagctacagtagcgactacatttacctttttgatcccaaagacgatacggccagagagctgaaaaccccttccgccgaggaacgtcgtgaagaactgaggcagcctcccgtcaagagactgcgtctaaggggtgactggagcgacactgggcctagagccaggcccgagtccgaaagggagagagacggggaacaatcaccgaatgtcagtctgatgcaaagaatgtcggacatgctttcaagatggttcgaagaggcctccgaggtagctcagtctaatcgcggacggggtcggtccaggcccaggggcggtacatcacagtccgatatttcgacactgcctaccgtgcccagcagtcctgacttagaagtctcagaaaccgccatggaggttgacacccctgctgagcagttcctgcaaccatccacttcatctactatgtcggcccaggcccatagcacatcctctccgacggagtctccacactctaccccattgttgtcttcgcctgactccgaacagcgccaatcagtcgaagcttcaggacaccacactcaccaccagagcgaatttctgcggggtccggagattgccctgctgcgcaaaagactgcaacaactgagattaaaaaaggccgaacagcaacggcagcaggagttagccgctcacacccaacaacagccctctacctcagaccagagctctcatgaagggtcatcccaggatccacacgcaagcgattctccgtctagcgtggtcaacaagcaactgggaagcatgtctcttgatgaacaacaggataacaacaacgagaagcttagccctaaaccgggaacaggcgaacctgtgctctcactgcattacagcacagaaggcactacaacgtccaccatcaagctcaatttcacggacgaatggagctcaatcgcctcctcttcacgaggtattggatcccactgcaagagcgaagggcaagaagagtcttttgtccctcagtcatccgtgcaacctcctgaaggtgactcagagacgaaggccccagaggagtcaagcgaggacgtcactaaatatcaggaaggagttagcgcagaaaacccggtcgagaaccacattaatatcacccagagtgataaattcactgctaaacctctagacagtaactccggtgagcgtaacgacctgaacttggatagaagttgtggggtgccggaagagagcgctagttccgagaaagctaaggagcctgagacttctgaccagacatccacagagagcgccacgaatgagaacaacaccaatcccgagccgcagttccaaaccgaagcgaccggcccttccgctcacgaggaaacttccacgagggacagcgcactgcaggatactgatgacagcgacgatgatcctgtccttatccccggagcacggtatcgtgcgggtccaggcgacaggtttaatattagggggacaaccattggcgacaggatcatgcggaggagtgcagtggccaggattcaggaattcttccgtcgccgtaaggagcgaaaggagatggaagaactcgataccctcaatatccggagacctctagtgaagatggtgtataagggacaccgaaatagccggacaatgatcaaagaggccaatttctggggagcaaactttgtgatgtccggcagcgactgcggccacattttcatctgggataggcataccgccgaacaccttatgttactggaggccgataaccatgtggtgaactgtttgcagccacaccctttcgatccaatcctcgcctcctccgggatagactatgacattaaaatatggtctcctttagaagagtctcggattttcaatcgtaaattggccgacgaggtgattacaaggaacgagctcatgttggaagagacgcgcaacactattactgtgcccgcttcctttatgttgaggatgctggcctccctgaatcacattagggcagaccgcctggagggtgatcgcagtgagggtagtggccaagagaatgaaaacgaagatgaagagtag

SEQ ID NO: 22731 - DNA, 2643 bp, Artificial Sequence
  Description of Artificial Sequence: Synthetic coding sequence
atgtcccgcggagggtcttacccacatttactgtgggacgtgaggaagcggagtctggggctcgaggatccttcccggctgagaagccgttacctgggccgacgcgaattcattcagcggctgaaactggaggcgacgctgaacgtccacgacggctgtgtcaacaccatctgctggaatgatacaggagaatacattctcagtggctccgacgacacaaaactcgttatcagcaatccttattcgcgcaaggtcctgacaaccataagatctggacacagggctaacattttctccgccaagtttctgccttgcaccaacgacaagcagatcgtgagctgctctggggacggagtgatcttctacacgaatgtggagcaagacgccgaaacaaacagacagtgccagttcacgtgtcactacggcactacttacgagattatgacagtgcccaacgatccttatacctttctgtcatgtggggaggatggaacggtacgctggttcgacacccggataaagacatcatgcaccaaagaagactgcaaggacgacattctgataaattgcaggcgggctgcaacctctgtggctatttgcccccctatcccctactatcttgcagtggggtgtagcgacagtagtgtccgcatatatgacagacgcatgctcggcactagggccaccggcaactacgctggacgaggcactacaggcatggttgctagattcattccttcccacctgaacaataaatcctgccgtgttacttccctctgctactccgaggacggacaggaaattctcgtatcttattcctcagactacatctacctcttcgatcccaaggacgacacagccagggagcttaaaaccccctctgccgaggaacgcagggaggaactgaggcagcctcccgtcaagcgcctgcgtttgcgcggtgactggtccgatacaggcccaagggcaagacccgagtccgagagggaaagagacggtgagcagagccctaacgtcagcttaatgcagcggatgtccgacatgttgagccgttggtttgaggaggcttcggaggtcgcacagtcaaatcgtggcagaggaagatcgaggccccgtggcggaacgtcacagtctgacataagcacactgcccactgtcccgagcagtcctgatttagaggtttctgagactgctatggaggtggacaccccggcagagcagtttctgcaaccctctactagttctaccatgtctgcgcaggctcactctacctcctctcccaccgaatctcctcattcaacgccattattgagcagcccagactccgagcaaagacagagcgttgaagcttcgggacaccacacacatcaccagagcgacagcccatcttctgtagttaacaaacagctggggtctatgtcactcgatgagcaacaagacaacaacaatgagaagcttagcccaaagcccggaacaggggagccagtgctcagtctacattatagcacagaaggcacaactacatcaacaataaagctcaacttcacagatgaatggagcagtatcgcctcttcgtcacggggaattggctctcattgcaagtcagaaggccaggaggaatccttcgtgccccagtccagcgttcagccacctgagggcgattctgaaaccaaagccccagaagaaagtagcgaagatgtgacaaagtatcaagagggagtcagcgcagaaaatcctgtggagaatcacataaatattacacagagcgataagtttacggctaaacctctcgattctaattcaggcgaaagaaatgacctaaacctcgacaggtcctgcggagtgcctgaagagtctgcaagttccgaaaaggccaaggagcccgaaacgtctgaccaaacctcgaccgaatctgcgaccaatgaaaacaataccaatcccgagcctcaattccagacagaagctaccggaccctccgctcacgaagagacttccacacgcgacagcgctctgcaggatacagacgactccgacgatgacccagtgttgatacctggcgcacggtaccgcgctggtccaggggaccgcaggagcgcagtggccaggatccaagagttttttagacggagaaaggagcggaaagaaatggaagagttagataccttgaacattagacgccctttggtcaagatggtttacaagggacatcgaaactcccgaactatgatcaaggaagctaatttctggggggctaacttcgtgatgagcggttcagattgcggccacatctttatttgggatcggcatactgcagaacacctgatgctgctggaagccgacaaccacgtggtgaattgcctgcaaccccacccattcgatcccattttggccagcagtggcatcgactacgatatcaagatatggtcccctctcgaggagagtcggatctttaatcgcaagttggcagatgaggtgattacacggaacgagctgatgctggaggagacccggaacaccataaccgtgcccgctagctttatgctaagaatgttagcatctttgaaccacatccgtgcagatcggctggaaggagatagatccgaaggctcaggtcaggagaatgagaatgaggacgaggagtag

SEQ ID NO: 22732 - DNA, 2763 bp, Artificial Sequence
  Description of Artificial Sequence: Synthetic coding sequence
atgtctcgcggaggaagttatccgcatctgctctgggatgttcggaagaggagccttggcttggaggatccttctcgcctgcgcagcaggtacttgggcaggcgcgagttcatccagcggttgaagctggaagcaaccctcaacgtccacgacggatgtgttctcacaactatcagatccgggcatcgagccaatatcttttcagctaaatttcttccctgtacaaacgataaacaaatagtgtcttgctctggggatggcgtcatcttctacactaacgttgagcaggatgctgaaactaataggcaatgccagttcacatgtcactacggcaccacatatgaaatcatgacggtcccgaacgatccctatacatttctttcctgtggagaggatggcaccgtgcgctggttcgacaccaggattaaaacctcctgtactaaagaagactgcaaggacgatattctgatcaattgccgaagagccgctacaagtgtggcaatctgcccaccaattccctactacttggccgtcggctgtagtgactcatccgttagaatctacgatcggagaatgctcggcactcgcgctaccgggaactatgccggacgagggaccactgggatggtggccagatttatccccagtcacttaaataacaaatcctgcagagtgacttctttgtgttactccgaagacggccaggaaattctggtttcttacagcagcgattacatctatctgtttgaccctaaggacgatactgcccgagagttgaaaacacctagcgcggaggagcgtagagaagaactacggcaaccaccggtgaagagactgcgcctgaggggggactggagtgataccggaccgagggcccgtcccgagagcgaacgcgaacgcgatggggagcagagccctaatgtaagcttaatgcagagaatgtctgacatgctatccaggtggtttgaggaagcctcagaggttgcacaatctaacagaggccgaggaagatcccggccaagaggcggtacttcccagtccgatattagtaccctgcccaccgtccctagtagtccagatttagaagtttctgagactgcaatggaagtcgacacccctgccgagcaattccttcagccatcaacctcttcaactatgagcgcccaggcgcactctacctccagccctacagaaagccctcattccactccactgctttcctcaccagattccgagcaaagacaaagcgtggaagctagcggacatcacacccaccaccagtctgagtttttgcggggacctgaaatcgccttgttgcgaaaacgtttgcagcaactgcggttgaaaaaggccgaacagcagaggcagcaagagctggctgcacatactcaacagcagccttccacctcagatcagagttcccatgagggatcgagccaggatcctcatgccagtgactcccctagtagcgtggttaacaaacagctggggtccatgtccctggacgagcagcaggataacaataatgaaaaactcagccccaaacctggaaccggtgagcctgtcctatctctgcattactccaccgaaggtaccacaacaagcacaattaagctgaatttcacagatgagtggtcatccatcgcctcttcttctcgcggaataggatctcattgcaagagcgagggtcaagaagagagctttgtgccacagtctagcgttcaaccccctgaaggggactccgagactaaggccccagaggaatcctcagaagacgttaccaaataccaggagggagtgagcgccgagaacccagtggagaatcacattaatatcacacagtctgataaattcactgccaaaccactagattccaactctggggagcggaatgatttgaatttagacagatcatgcggagtccccgaggaaagtgcctcgagtgagaaggctaaagagcccgagacctctgatcaaacctcaacagaatcggcaactaacgagaacaatacaaatcccgaaccccaatttcagaccgaggccacaggacccagtgctcacgaggaaacatctactagggactccgcgctgcaggataccgatgattccgatgatgatccagtgttgattcccggagcacgatatagggcaggaccgggagatcggtttaatattcggggtacaacgattggagaccgaatcatgaggcgctccgccgtggcccgtattcaggagttcttccggaggcgcaaagaacgtaaagaaatggaggagctggatacgctcaacatcagaagacctcttgtcaagatggtgtacaagggacacaggaactcaagaactatgataaaggaggccaatttttggggggcaaatttcgtgatgagtggctcagactgcggccacattttcatttgggataggcacacagccgaacatttaatgctgctggaagccgacaaccacgtcgttaactgcctgcagccccacccatttgaccccattctggcctctagcggtattgattacgacatcaaaatctggagcccactcgaagagtcgagaatcttcaacagaaaattggccgatgaggttatcacgaggaacgagctgatgctggaggaaaccaggaacacaattacagtgcctgcaagtttcatgcttcgcatgctggccagccttaaccatatccgcgcagaccgattggagggagatcgtagtgaaggtagcgggcaagagaatgagaacgaagatgaggagtag

SEQ ID NO: 22733 - DNA, 1524 bp, Artificial Sequence
  Description of Artificial Sequence: Synthetic coding sequence
atggaagactcagaggcgctcggcttcgagcacatgggcctggatcctaggttactgcaggccgtgacagacctcggttggagccgccctactctcatccaagagaaggccatccctctcgcgctggagggaaaggacttgcttgcacgggcacgaactggctcaggaaagaccgcagcctacgcaatccctatgttacagttgttacttcatcgaaaagcgaccggacctgtagtagagcaagcagtaagagggctcgtactcgtacctacgaaagaactggcaagacaggctcagtcaatgatccagcaacttgctacttactgcgcaagagacgtacgcgtggcaaacgtgagcgccgctgaggactctgtctctcagcgtgctgtactaatggagaagcccgacgttgtggtgggaacgcctagtagaatcttgtctcaccttcagcaggatagcctgaaattgagggatagtctggagctcttagttgtcgacgaggcggacctgctttttagcttcggcttcgaggaggaactgaagagcctcctttgccacctgccaaggatttaccaggcttttttaatgagcgcgactttcaacgaggatgtgcaggccctaaaagagttaattctgcataacccggttaccctgaaacttcaggagtcccagctaccagggcctgaccaactgcagcagttccaagttgtgtgtgaaaccgaagaggataaatttttactcctgtacgcactccttaaattaagcctgatacggggtaaaagccttctcttcgtgaacacactggagcggtcttaccgcctgcgcttgtttctagaacagttttcaatccctacctgtgttctcaatggagaactgcccctgcgctccagagcttccgaccccgaggctggcgtggcacggggaattgacttccatcacgtctccgccgtactgaactttgacttgcctcccactcctgaagcctacattcatcgcgctggtcgcacagccagagctaataatcctgggattgtgcttacgttcgtgcttccaacagaacagtttcacctcggcaaaattgaggagctcctgtctggggagaatcgtggccctattctgctaccttatcagtttcgcatggaagaaattgaggggttccgctatagatgcagagacgctatgaggtctgtgaccaagcaggccatccgtgaggctcgtctgaaggagattaaagaggaactgcttcattccgaaaaactgaaaacatacttcgaggacaacccgagagacttacagctgctgaggcacgatcttccattacatcctgctgtggtgaagcctcacttgggacacgttcctgattacttggttccccctgcactgcggggtctcgttagaccccataaaaaaagaaaaaagctgagtagttcctgtcgtaaagccaagcgtgcgaagtcacaaaatcctttgaggagtttcaaacacaaggggaagaaattcagaccgaccgctaaaccttcctag

SEQ ID NO: 22734 - DNA, 2391 bp, Artificial Sequence
  Description of Artificial Sequence: Synthetic coding sequence
atggtgttggcacagaggaggcggggaggttgcgagaagcttcgcgcaggtccacaggccgtactggcatctggaagtggcttctgcgacaacatgctggcggacctagggctcattggcactatcggtgaagacgacgaggtgccagtcgaaccagagtctgactccggcgacgaggaagaggaaggaccgattgtgctgggacggagacagaaggccttgggaaaaaatcgctccgctgattttaacccagacttcgtttttaccgaaaaagaaggtacatacgatggatcgtgggccctggctgacgttatgtcccagctgaaaaaaaaacgagcggcaaccacactcgatgaaaagatagagaaggtgcgaaagaaacgaaaaaccgaagataaggaggctaaatccgggaaacttgagaaggaaaaagaggctaaagaaggatccgagcctaaagagcaggaggatttacaagagaacgatgaggagggtagtgaggatgaggcaagcgagacagattattcctccgccgacgagaatatcctcacaaaggcagatacactcaaggtgaaggatcgtaaaaagaaaaaaaaaaagggccaggaggcaggagggttttttgaagatgcctcccagtacgatgaaaatcttagctttcaggatatgaatctgtccaggcccctgctaaaagcaatcactgccatgggattcaaacagcccactcccatacagaaagcctgtatccctgtaggcttactgggaaaggatatttgcgcctgcgccgctactggaacaggaaagacagcagcttttgcactgcccgttctcgaacgcctgatctataagccccgtcaggctcctgtaactcgggtgcttgtgttggtgcccacgcgggagcttgggattcaagttcattccgtgacccgacagctcgcacagttttgcaacatcacaacctgtctagccgtgggaggattggatgtgaagtcccaagaggcagctctgagagcggcacccgacattttgatcgctactcctggcagactgatagaccatcttcacaattgtccatcattccatcttagttccattgaggtgctgatcttggatgaggcagatcgtatgctcgatgaatattttgaggagcagatgaaagaaataatccgcatgtgttcacaccatcgacagactatgctgttcagtgccacaatgacggacgaggtgaaagaccttgcaagtgtgagcttaaaaaatccggttcggatatttgtgaattctaatactgacgtggcaccctttctgcgccaggaattcattagaatcagacccaatagggagggggacagggaggcgattgtagccgctttgctcacaaggaccttcaccgatcacgtcatgctttttacccagacaaagaagcaggcacacagaatgcacatcctattaggcctcatggggctccaagtcggggaactgcacggcaatctgtctcagacacaaaggctggaagccctacgtaggttcaaggacgagcagatcgatatactggtggcgactgatgtggctgcgagggggctggacatagagggagtcaagactgttattaactttacaatgccgaatacaattaagcattacgtccatcgagttgggaggacggcacgcgcaggacgggctgggaggtctgtaagcctggtgggagaggacgaacgcaagatgttgaaagaaattgttaaagccgctaaggctcccgttaaggctcggatcttgccccaggacgtcattctgaagttccgggataaaatcgagaaaatggagaaagacgtatacgctgtcctgcagttagaagcagaagagaaagaaatgcagcagtcagaggcccagattaacaccgctaagagactgttggagaaaggaaaagaagccgtggtacaggagcctgagaggtcctggtttcagaccaaggaggagagaaaaaaagaaaaaatagctaaggcgcttcaagaattcgacttggcactgcggggtaagaaaaaaaggaaaaagttcatgaaggatgctaagaaaaaaggcgaaatgactgccgaagaaagatcccagtttgagatcctgaaagcccagatgttcgccgagaggcttgccaaacggaataggagggcgaaacgcgcaagggccatgcccgaagaggaacctgtgagagggcctgccaagaagcaaaaacagggaaagaaaagcgtgttcgatgaggagctgactaacacctcaaagaaggccctcaaacagtatcgggcaggaccctcatttgaggaaagaaaacaactcggcttgccccaccagcgacggggaggcaacttcaaatctaagagtcgatacaagcgaaggaaatag

SEQ ID NO: 22735 - DNA, 411 bp, Artificial Sequence
  Description of Artificial Sequence: Synthetic coding sequence
atggtcctggcccagaggagacgcggaggatgcgaaaaactccgggcagggcctcaagccgtcctggcatctgggtccggattctgtgataatatgctggcagatctaggcctcataggcacaattggagaggatgacgaggttcctgtggagccagagagcgattctggcgatgaggaggaagaagggccaatcgtcctgggaagaagacagaaggctctagggaaaaaccggtcagcggacttcaatcctgatttcgtgtttaccgagaaagagggaacgtacgacggaagctgggccctggcggatgtcatgagccaactgaagaagaagagagcggcaaccaccttggatgagaaaattgaaaaggtgcgcaagaaaagaaagaagaaaaagaagaaaaagaagtag

SEQ ID NO: 22736 - DNA, 1758 bp, Artificial Sequence
  Description of Artificial Sequence: Synthetic coding sequence
atggcacccgacctggccagccagcggcattctgagagctttccaagcgtgaactcacgtcctaatgtgatcctgcccggaagagagggtcggagagaaggcctgcccccaggtggagggactagggggtctttggtgccaacccgccctgtgcctccttctccagcaccgttggggaccagcccatacagttggtcccggagcggacccggacgcggagggggagcgggttctagtagagttccgaggggagtacctgggccagccgtgtgcgctcccggatccctgctccaccatgcctcgcctacacaaaccatggcggctgccgacgggtctcttttcgataacccccgtacctttagccggaggcctccagctcaggcttcaaggcaggctaaagcgactaagaggaaataccaggcttccagcgaagcgcctccggctaaaagacgcaatgagaccagctttctcccagctaaaaagacctcggtgaaggaaactcagagaacgttcaaggggaatgcccagaagatgttttctcctaagaaacactctgtgtccacttccgaccgcaaccaggaggagagacagtgcatcaagacatcgtcactatttaagaataaccccgacattcccgagctacacagaccagtggtgaaacaggtgcaggagaaagttttcacctccgccgctttccacgagctgggacttcatccacacctgatatcaactatcaacacagtgctgaagatgagcagtatgacgagtgtgcagaagcagagcatccctgtgctgctggaaggccgagacgctctggttcgcagccaaaccgggagtggcaagactctcgcttattgtatccccgttgtccaatccctccaggccatggagagcaaaattcagaggagtgatgggccatatgccctcgtgctggtccctactcgcgagttagcactccagtccttcgatactgttcagaaattgcttaagccctttacttggattgtaccaggggtgctcatgggcggtgaaaagagaaaaagcgagaaggctcggttgagaaagggaatcaacatactgatttccacaccaggccgtctggtggaccacattaaaagcactaagaatatacacttcagtcgactgcgatggctggtctttgatgaggcggatagaatcctagacttgggcttcgagaaagatataacagttatcttgaatgctgtgaatgctgaatgtcagaagagacagaacgtgttgctgtccgccaccctgacagagggagtgacacgcctcgctgatatcagtctgcacgacccagtgtctatttccgtccttgacaaaagccatgaccagctaaacccgaaggacaaggcagtgcaggaggtatgcccacccccagcgggagataagttggacagctttgcaatcccagaaagtctaaagcagcatgtaactgttgtaccctcaaagttacgcttagtgtgcctggccgcatttattttgcaaaaatgtaaatttgaggaggatcaaaagatggtcgtcttcttctccagctgcgaactggtcgaattccactatagcttattcctgcagacgctcctcagctcttctggcgcacccgcaagcggacagcttcctagtgcatcaatgagattaaagtttcttcgcttgcatggtggaatggagcaggaggagcgcacagctgtcttccaggagttttctcactcacgcagaggggtactcctatgcacctag

SEQ ID NO: 22737 - DNA, 2337 bp, Artificial Sequence
  Description of Artificial Sequence: Synthetic coding sequence
atggcgccagacctcgctagccagaggcatagcgagagcttcccttccgtgaattctaggcccaatgtaatcctacctggaagagagggtaggcgggaagggctgccacctggcggtggtaccagaggcagtctcgtgcctactcggcctgtcccaccaagcccagctcctctgggaacatcgccttattcctggagcaggagtggaccaggacgcggaggaggcgctggttcatccagagtccccaggggggtgcccggaccagctgtctgcgctcctgggtcgctcctccaccacgcaagtcccacccagaccatggccgctgcagacggaagtctgttcgacaaccccagaaccttctctagaaggcctcctgcccaggcctcccggcaggctaaggccacaaaaaggaagtaccaagcctcctccgaagcgccacctgccaagcgcaggaatgagacaagttttctgcctgctaagaaaacgtcagtgaaggagactcagcgaacttttaaaggaaacgcacaaaaaatgttttcgcccaaaaagcacagcgtgtcgacttcagacagaaaccaggaggaacgacagtgtattaaaacctccagtctgttcaaaaataaccctgacatccctgagctgcaccgcccagtcgtgaagcaggttcaggaaaaagtgtttactagtgctgcgtttcacgagctcgggcttcaccctcacctgataagcaccataaacaccgtgctcaaaatgtccagcatgacaagcgtccagaagcagtctatacccgttctcctggaaggccgtgacgctctggtgcgctcacaaactggttcaggcaaaactttggcatactgtattcctgtggtacaatcactgcaagcgatggagtctaagatacaacggtccgatggcccatatgccctggttctggtccctacccgtgagctggccttgcaaagctttgacacagtccagaagctgctgaagcccttcacttggattgttccaggggtgctgatggggggagagaagagaaaaagcgaaaaagccagactacgtaaaggaataaatatcttaatcagcactcctggtaggctcgtggatcatatcaagtcaactaaaaacattcatttctccaggctgcggtggctcgttttcgatgaagcagatcggatactcgatcttggttttgaaaaggacatcactgtcatcctcaacgccgtaaatgctgagtgccagaaaaggcagaacgtcctcctttctgccaccctgaccgagggcgtgactcgtctggctgacatcagtctacacgaccctgtcagcattagcgttttagacaaaagtcacgatcagttgaatcctaaagataaggccgtgcaggaggtctgtccaccacctgcaggggataagctagacagctttgccatcccagaatcactgaagcagcatgtaactgtggtgccctcgaaattaagacttgtgtgcctcgccgcattcatccttcagaagtgtaaattcgaagaggaccagaaaatggtggtatttttctcttcgtgtgaattagtggagttccactacagcctctttttacaaactcttctatcgagcagtggcgcaccagcatccggacagttgccgtctgctagcatgaggctcaagttccttcggttacacggcggaatggaacaggaggaacgcacagcagtttttcaggagttcagtcatagtagacggggtgtgcttttgtgtacagacgtcgccgcacggggactggaccttccccaagtcacttggattgtccagaatacttccaccgggttagaggagcctcctgggttggcagctatgggcgctgcctgtagcttctggctgctgcggaggcagaatatgagcactcgctggcttttaaccaagagtaccctgcagtcattcattcaggcttacgccacatacccccgagagctcaagcacatcttccatgttaggtcactccatcttggccatgtggccaaatcgtttggcctccgggatgcacccaggaatctttcagctttgactagaaaaaagcgtaaggcccacgtcaagcggcctgacctgcacaaaaagacccagagtaaacacagtttagcagagatcttacggagtgaatacagctctgggatggaggcagacattgctaaggtcaagaagcagaacgctccgggtgagcctggaggtagacctctgcagcatagtctccagccaacaccatgttttggcagggggaagactctgaaatggaggaaaacacagaagggagttcaaagggatagcaaaacctcccagaaggtgtag

SEQ ID NO: 22738 - DNA, 2328 bp, Artificial Sequence
  Description of Artificial Sequence: Synthetic coding sequence
atggcacccgatttggctagccaaagacactccgaatctttccccagcgttaactctcgtcctaatgtgatattgccaggcagggagggccgaagggagggcttaccgcctggtgggggtactcggggaagcctggtccccacccgccctgttcccccatctcctgcgcctctcggcacttctccctatagctggagtagaagtggaccgggtcggggaggaggggctggcagtagtcgtgtgccaaggggcgtgccaggacccgctgtgtgcgcccctggtagcctgttgcatcacgcatcgcctacccagaccatggcggctgccgacggcagcctgttcgataaccctcgaaccttttccagacgcccacctgctcaggcctccagacaagccaaagctaccaaaagaaagtatcaggccagcagcgaagcacctcccgcaaagcggcgtaacgagaccagttttctccctgcaaagaaaacctcagttaaggagacccaacggacgttcaagggtaacgctcagaagatgttcagccctaaaaagcactctgtgtcaacatcagacaggaatcaggaggaacgacagtgcattaaaactagctccctgttcaaaaataatcccgatatccctgagctgcacagaccagtcgttaaacaggttcaagaaaaggtgtttacttcagccgcttttcacgagctggggcttcaccctcatctgatcagcacgataaacactgtcttaaagatgtccagtatgacaagcgtccaaaagcagtccatcccagtgctgctggaaggacgtgatgccctggtccgatcacagacaggaagcggcaagacgctggcctactgcattccagtagttcagagtctacaggcaatggaatctaagatccagcggtcggatggcccatacgcactagtgctggttccaactcgtgagcttgcacttcagtcctttgacacagttcagaagctgctgaaaccatttacctggattgttccgggtgtcctgatgggcggtgagaagagaaagtcagaaaaggcccgattacgtaagggcatcaatatcctgatctcaaccccagggagactagtagaccacatcaaatctaccaaaaacatacacttcagcagactgagatggctagtctttgatgaagcagaccggatattagacctggggttcgaaaaggatataacagttatcctgaatgctgtgaatgccgagtgccagaagcgccagaacgtgctactctcagccacactcacagaaggtgtgacacggcttgccgacataagcctgcacgatcccgtttccatctccgtcctcgataaaagccacgaccagcttaaccccaaagacaaagctgtacaagaagtgtgccctccgccagctggagataagctggatagtttcgccatcccagagtcattgaaacagcatgtcactgtcgtgcccagcaagttacgtctcgtgtgccttgccgcatttattctgcagaaatgcaagttcgaggaggatcagaaaatggttgtcttttttagctcgtgcgagctggtggaattccactacagcctgtttctccagactctgctgtcttctagtggtgcaccggcttctggtcagcttcctagtgcgagcatgcgactgaaattcctccggctgcatggcggaatggagcaagaggagcggaccgctgttttccaggagtttagccatagccgaagaggcgtgctgctatgtaccgacgtggcagccagaggattagaccttccccaggtgacttggatcgtgcagtataacgctccttcctcacccgcagagtatattcaccggatcggtagaacagctcgcatcggctgtcacggcagctcattactgatactcgccccttccgaagccgagtatgttaattccctagctagccacaagatcaatgtgtcggaaattaaaatggaagatatcctgtgtgtcctgacaagagacgattgctttaaggggaagcggtggggagcacaaaaatctcacgcggtgggtcctcaggagatcagagaaagagcaacagtcttacagacagtgttcgaggactacgtgcatagctccgaacggcgtgtgtcctgggcaaaaaaagtatggtctttggagacccctgtcctaactgcctccctgcccgctctcttcagcttctccagtgcggtcctccacccaagcctgcgccatttgcctcagggggctgaagcccacttacctagacccattccaccgccttgggcgtgcggcgaggagctaaggaccaaacgttgccctcaggagtcgtag

SEQ ID NO: 22739 - DNA, 2556 bp, Artificial Sequence
  Description of Artificial Sequence: Synthetic coding sequence
atggcgccagatcttgcttcccaaagacactccgaatctttcccctctgtgaacagtcggccaaacgtgatcctgcctggcagggaggggagaagggagggcctgccgccaggcggtgggacaagaggcagtctcgtgccaaccagaccagtgcctcccagtccagcccctctaggaactagcccgtattcatggagtcgatctggtcccggtagaggaggcggagccggaagctctcgcgtgcctcgaggggtcccgggaccagctgtttgtgcccctggctcactgctccaccacgcctcacctacacagacgatggccgcagcggatggaagcctgttcgacaaccctagaactttctcccggaggccgccagcccaggcaagtaggcaagctaaagctaccaaacgcaaatatcaggcgtcaagtgaagctccccctgcaaaacggagaaacgagacgtcattcttgcccgctaagaaaacatcagtgaaagagactcagcggaccttcaaaggcaatgcccagaagatgttctctccaaaaaaacactctgtgtctacctctgaccggaaccaggaagaaaggcaatgcattaaaacatcctcactgttcaaaaacaaccctgatattcccgaactccaccgcccagtagtgaagcaagttcaggagaaagtcttcacctctgcagccttccatgagctaggccttcacccccatctgatctcaactatcaacaccgtcttgaaaatgtcttccatgacatctgttcaaaaacagagtattcctgtcttacttgaaggcagggatgcgctggttaggagccagactggttctggcaaaacattggcatattgcattcctgtggtacagagtttgcaggctatggaatcaaagattcagcggtccgacggcccttacgcactagtgctggttcccacacgagaactagcattgcagtcttttgatacagtgcagaagctacttaaaccattcacctggattgtgccaggggtgctcatggggggagaaaagcgcaagagcgaaaaggcaaggctgaggaaaggtattaatatattaattagcacacccggtagactcgtagaccatatcaagtccacgaagaatatacacttttctcgtttacgctggctcgtgttcgatgaagctgacaggattctcgatcttgggttcgaaaaggacatcaccgttatccttaatgccgtgaatgccgagtgtcagaagaggcaaaacgtcctactgagcgccacgctgacagaaggcgtgaccagactggccgacatttcacttcatgatccggtgtctatctccgttctggataagagccatgaccagctcaatccaaaggataaggcagtgcaggaagtttgtcctcctcccgctggagataagcttgattcttttgcaattcccgagagcttgaagcagcacgtgaccgtggtgccgtctaagctgcgactggtctgcctagccgcttttattttgcaaaagtgtaagttcgaagaggaccagaagatggtggtgttcttctcctcatgcgagttggtagagttccactacagccttttcctccagaccctccttagctcaagtggcgctccagcctccggtcagcttcccagcgcctccatgcgcttgaagttcctgaggctgcacggtgggatggagcaggaggagaggactgccgtgtttcaggagttctcgcattccagacggggagtcttgctgtgtacggatgttgctgctagaggcctggacctaccccaggtgacctggatcgtccagtataacgctccatcctcacccgcagagtatattcacaggatcggtcgcaccgccagaataggctgtcacggttcatccctcctgattctggcaccttccgaggccgaatacgtgaactctctagcctcccataaaattaacgtctccgagattaagatggaagatattttgtgcgtcctcaccagagacgattgtttcaagggaaagagatggggcgctcagaagtcccacgccgtgggcccacaggaaattcgggaaagggccacggtcctccagaccgtgttcgaggattatgttcacagctctgaaaggagggtgtcatgggcgaagaaggccttacagtcattcattcaggcatatgccacgtatccccgagagcttaagcacatttttcatgttcgttccttacacttgggccacgtcgccaaaagttttgggctgcgtgacgcccctcgaaatctatctgcactcaccaggaaaaagcggaaggcgcacgttaagcgcccagacctgcacaagaagacccagagcaaacactcactagcagaaatcctcagaagcgagtattcttcaggcatggaggctgatatcgctaaggtcaagaagcagaacgcccctggggagcccggaggcagaccactgcagcatagtctacagccaacaccgtgttttggaagaggcaagacacttaagtggaggaaaacccagaaaggcgtccaacgcgacagcaagacttcacagaaagtatag

SEQ ID NO: 22740 - DNA, 2169 bp, Artificial Sequence
  Description of Artificial Sequence: Synthetic coding sequence
atgcaggctaaggctaccaagcgtaaataccaggcatcctctgaggccccaccagccaagaggagaaatgaaacaagcttcctgccagccaagaagacttccgtcaaggagacccagagaactttcaaaggaaacgctcaaaagatgtttagcccaaaaaaacatagcgtctccaccagtgaccggaaccaggaggagcgccaatgtataaagacatcttctctttttaaaaataacccagatatcccagagttacaccggccagtggtgaaacaggtgcaggagaaggttttcacgagcgccgcttttcatgagctgggccttcacccacatcttatctccaccattaataccgttctgaaaatgtcttccatgacaagcgtgcaaaagcagtcgattccagtcttattagagggacgcgacgcactagtgaggagtcagactgggtctgggaaaacattggcatattgcattcctgtcgtgcagtctctgcaggcgatggaatcaaaaatacaacgtagcgatggaccatacgctcttgtgttagtgccaaccagagaactggcactccagtcctttgacactgtccaaaagttgctgaagccttttacatggattgttccgggtgtactcatgggaggggagaaacgaaagtcagagaaggcacgtctccgcaaagggattaacattctaattagcactcctggacgactagttgaccacattaaatccaccaaaaacatccatttctctcgactgcgctggttggtgttcgacgaggccgaccgaatcctggatctgggctttgaaaaagacatcaccgtaatcctgaatgctgtgaacgcagaatgtcagaaacgccagaacgtgctgctatctgctaccttgactgagggggtgactcgcctggcggacatttccctgcacgaccctgtgtccattagcgtgctagataaaagccatgatcagttaaaccctaaggacaaggcagtccaggaggtctgtccaccccctgctggcgataagctagacagctttgccatcccggaatctctaaagcaacacgtgaccgtcgtaccttccaaactgcgccttgtctgtctggcggcttttattctgcagaagtgtaagttcgaggaagatcaaaagatggtcgtctttttcagtagctgcgaactggtcgaattccattatagtctgttcttacaaacgctgctctccagttccggagccccagcgtccggacaactacccagcgcttcgatgcgactgaaatttcttaggctgcacggcggtatggaacaggaagaacgcacggctgtttttcaggagtttagccacagtagacggggagttctgctctgtacagacgtggccgctcgagggctagatctccctcaggtcacatggattgtgcagtataatgctccgagctctcccgcagaatatatccaccgtatcggcaggaccgctcggatagggtgtcatggtagctcattgttgatactcgccccttccgaggctgaatacgtgaactctttagcgtctcacaagatcaacgtgtccgagatcaaaatggaagatatcctctgcgtgcttacacgtgatgattgttttaaaggcaaacggtggggggcacagaagagtcatgccgtcggtccccaggagattagggagcgtgccacagtgctgcagacagtcttcgaagattacgtgcacagcagcgagcgtagggtctcctgggctaagaaagccttacagtctttcattcaggcttatgcaacatatcccagagagctgaaacacatatttcatgtgcggtctctgcacttgggccacgtagctaagtcatttggtctgcgggatgctccccgaaatctatccgccctaacaaggaagaaacgtaaggcacatgtgaagagaccagacctccataagaagacacagagcaagcactccttagccgaaattttgcgctccgagtattcaagcggcatggaagcagacattgccaaagtcaaaaagcagaatgcaccaggagagcccggagggagacccttacagcactctctccagccaaccccatgctttggtaggggtaagacactcaaatggcgaaagacccagaagggcgtccagcgggatagcaaaaccagccaaaaagtatag

SEQ ID NO: 22741 - DNA, 483 bp, Artificial Sequence
  Description of Artificial Sequence: Synthetic coding sequence
atgcgactggaggcgggtagtggtgccgtttggaggggcggagaattggccccagcccctcgcaaggtgaaggagggaattaggggatgttttccctggaagcaggctaaagctaccaaaagaaagtatcaggccagctccgaggcacccccagctaagcggagaaacgagacctccttcctgcccgcaaaaaagacatctgtcaaagagacacagcggacatttaaggggaacgcccagaaaatgttctcaccaaaaaaacattccgtctcaacaagcgatcgcaatcaggaagagcgacagtgtattaaaacctctagtctgttcaaaaataatcccgatataccggagctacatcgtccagtagtgaagcaggttcaggagaaggtgtttacgtctgctgcattccacgagctagggcttcatccacacctgatttcgactattaacaccgtgctcaagatgtcttctatgacgcgctag

SEQ ID NO: 22742 - DNA, 1284 bp, Artificial Sequence
  Description of Artificial Sequence: Synthetic coding sequence
atggctgaacaggatgttgagaacgacctactggactacgacgaggaggaagagcctcaggctccacaggagtcaactccagctccaccaaaaaaggacatcaaggggtcatacgttagtattcattcctccggcttcagggacttccttcttaagcccgaattactgagagctattgttgattgtggcttcgagcaccccagcgaggtacagcacgagtgtattccacaagccatactggggatggacgtcctatgtcaggccaaaagtgggatgggaaagacggccgtatttgttctggcaacactacaacagattgaacctgtaaacggacaagtgactgtgctcgttatgtgtcacaccagggaactggcctttcaaatctccaaagaatatgaaaggttcagtaagtacatgccgtccgttaaagtgagcgtgtttttcggcggactgtcaatcaagaaggacgaagaggtgctcaaaaagaattgtccccacgtggtcgtcggcaccccaggcaggatccttgcattagtaagaaatcggtcattttctctgaagaacgtcaagcactttgtgttggacgaatgtgacaaaatgctcgagcagcttgatatgagaagggatgtccaagaaatctttagactgaccccacatgagaagcagtgcatgatgttctcagccactctctcaaaagatatccggccagtttgtcggaaatttatgcaagaccccatggaagtttttgttgatgatgagacaaaacttacactacacgggcttcagcaatactacgtgaagcttaaagacagcgagaagaacaggaaactctttgacctgctcgacgtccttgaattcaaccaggtcataatcttcgtgaagtcggtgcagaggtgcatggccctcgcccagctgctggtcgagcaaaattttccagcaattgccatccatagaggcatggcccaagaagagcggctgtcacgctaccaacagtttaaagacttccagagacgtatcctggtggctactaacctgttcggtcgcggtatggatatagagagagtgaacatcgtctttaattacgatatgcctgaggactcggacacatacctgcaccgggtcgctagggcagggagatttggcaccaaggggctagctatcacattcgtgtctgatgagaatgatgcgaagattctgaatgatgtccaggaccgtttcgaagttaatgtggccgagctccctgaagaaattgatatcagtacttacatcgaacagagtaggtag

SEQ ID NO: 22743 - DNA, 969 bp, Artificial Sequence
  Description of Artificial Sequence: Synthetic coding sequence
atggccgagcaggacgtggagaatgacctgctggactacgacgaggaagaggagcctcaggccccacaggagagcacacccgcacctcctaaaaaggacatcaaaggctcttatgtgtcaatccactccagtggatttagggactttctgctgaagcctgagctcctgagagccatcgtcgactgtggcttcgagcaccccagtgaagtgcagcacgagtgtattcctcaggccattctgggcatggacgtgttgtgtcaagccaaatcggggatgggtaagacagcagtctttgtgctggcgactctgcagcagattgaacccgtgaacggacaggtaaccgtgttggtcatgtgtcatacacgggagctggcgttccaaattagcaaagagtatgaacggttcagcaagtatatgccttccgtgaaagtttccgtgttcttcggaggtctgtccatcaagaaagacgaagaagttctgaaaaagaactgcccccacgtggtggtcggaacccctggtcggatcctcgccctggtgcgaaatcgtagcttttctctgaaaaacgtaaaacattttgttctggatgagtgcgacaagatgctcgagcagctggatatgcgtagagacgtgcaggagatctttcggttaacaccccatgagaagcagtgcatgatgttctccgccacacttagtaaggacatcaggcctgtctgtaggaagttcatgcaggacccgatggaagtgttcgttgatgatgagacaaaactaaccctccatggtttgcagcagtattacgtgaaactgaaggattcagagaagaaccgaaagttgttcgaccttctggacgttttagaatttaatcagccagtgacattgagcgccgtccaaggcttccctgccgcagaccccggaggccaccaatccgtttggcctggggatggacatcgggcaagtcagcacaggctatag

SEQ ID NO: 22744 - DNA, 1413 bp, Artificial Sequence
  Description of Artificial Sequence: Synthetic coding sequence
atggcttatggcgcaccttccccaacctggtccctctccgttcgtcccaaccggcctagaggaggcttaggtccgttcggtgaagtgcaagtaatcctcctcccccctagtagctgggactactcaatcatggctgagcaggatgtggaaaacgatctacttgactatgacgaggaggaagaacctcaggcccctcaagagtccaccccagccccacctaaaaaagatataaagggttcgtacgtctccatccactcgtccggatttcgagatttcctcctgaaacctgaactgcttagggccatcgttgactgtggctttgagcaccccagcgaggtccagcatgagtgcataccacaagccatcctgggtatggatgtactctgccaggcaaagtccggcatgggaaaaacggcagtgtttgttctggcaacactccaacagatagagcccgtgaacgggcaggtcacagtcctggtcatgtgtcatacaagagaattggcctttcagatctcaaaggaatatgagaggttctctaagtacatgccctcagtcaaagtcagcgtgtttttcgggggactttccatcaagaaggatgaggaggtgttaaaaaaaaattgtcctcacgtggtcgtcggaacgccaggacggattctggcgctggtgcgaaacaggtcatttagcctcaagaacgtgaaacatttcgtccttgacgagtgcgacaaaatgcttgaacaactggacatgagaagggacgtgcaagagatttttcgcctgactccacatgaaaaacagtgtatgatgttttccgccacactgagtaaggacatccgaccagtatgcaggaagtttatgcaagaccccatggaggtctttgtcgatgatgagacaaagctgactctgcacggtttgcaacagtattacgtgaaactaaaagactctgaaaagaatagaaagcttttcgatcttttggacgtgctggaatttaaccaagttataatcttcgttaaaagcgtccagcgctgtatggcactggcgcaattactggttgagcagaattttcctgccattgccattcataggggaatggcccaggaagaaaggctgagccggtatcagcagttcaaagatttccaacgcagaatactcgttgctactaacctcttcgggaggggcatggacattgagagggttaatattgtcttcaattatgacatgccagaggactccgatacatacttacatagggtcgcaagggccggaaggttcggtacaaaaggtctggcgatcacattcgtttctgacgagaatgatgctaagatcttaaatgacgtgcaagacagattcgaggtgaacgtggcggaactccccgaggaaatcgacatttctacttacattgaacaatcacgatag

SEQ ID NO: 22745 - DNA, 804 bp, Artificial Sequence
  Description of Artificial Sequence: Synthetic coding sequence
atggccgaacaggacgtggaaaacgacttactggattatgatgaggaagaggagccccaggcccctcaggagtctaccccagcccctcccaagaaggacattaaaggttcatacgtctcgattcattcctccgggtttcgtgactttttactgaaaccagaactgttacgagctatagtggattgcgggttcgagcacccaagtgaggtgcagcatgaatgtatccctcaggcaatacttggtatggatgtgctctgtcaagcaaagagtggtatgggtaagactgctgtgttcgttttggcaacgcttcagcagatcgagcctgtaaacggccaggtgaccgttctggttatgtgtcacacgagagagctggccttccagatctccaaagaatacgaacgattttcaaagtacatgcctagtgtcaaggtttctgtgtttttcggcggactcagtatcaaaaaagacgaggaggtactgaagaaaaactgtcctcatgtcgtggtcggcactcccggtaggatccttgccttggtgagaaatagaagcttctctctgaagaatgttaaacactttgtgcttgatgagtgtgacaagatgctggaacagctggatatgcggagagacgtgcaggaaatttttaggctgactccccatgaaaaacagtgcatgatgttttctgccactctgagcaaggacattagaccagtctgtcggaagtttatgcaggatgtcctctgggaggtgtcccacaaaggcgttgctcattggaaagtcttggggaggcgcgatgcgcagagatag

SEQ ID NO: 22746 - DNA, 3096 bp, Artificial Sequence
  Description of Artificial Sequence: Synthetic coding sequence
atgggtcgcgagagtcggcattataggaaaagatccgcgtcccgtgggaggtcgggcagtaggtccaggagccggagcccttcagacaagcggtcgaaaaggggagatgaccggcgaagccggagtcgcgatagggacaggaggagggagcgctcacgaagtcgtgacaagaggagatcaaggagcagggatcgaaagcgcctgagaagaagccgatcccgcgagagagacagaagccgtgaacggagaaggtcccgcagtcgggacaggaggcgcagccgcagtaggtctagagggagacgatctcggtcaagtagtcctggtaataaatcaaaaaagacagaaaatcggtctaggagcaaagagaagacagacggcggagagtcttcgaaggagaagaaaaaggacaaggatgataaggaagacgagaaagagaaggatgcaggtaacttcgaccaaaataagctggaagaggaaatgaggaagcgaaaagagagagtagagaagtggagagaagaacagcgcaagaaggccatggaaaacattggcgaactgaagaaggaaattgaagaaatgaagcagggcaaaaaatggtctctcgaagacgacgatgatgacgaagacgatccggctgaagctgagaaggaaggaaacgagatggagggtgaagagctcgatcccctggatgcttacatggaagaggtgaaggaagaggttaagaagttcaatatgcggtctgtgaagggcggtggaggaaacgagaagaaatctggacccaccgtgactaaagttgttactgtcgttacaacgaaaaaagcagtggtcgattcagacaaaaagaaaggggaattaatggagaatgaccaagacgccatggagtacagctctgaagaagaagaagtggacctccaaaccgcccttactggataccaaacaaagcagcgaaagttgcttgaaccagtggaccatggtaaaatcgagtacgaacccttcagaaaaaatttttacgtggaggtgcccgagctggcgaaaatgtctcaggaagaggttaatgtctttaggcttgagatggaagggatcacagtcaaaggcaaagggtgccctaagccaatcaagtcttgggtccagtgcggtatctcaatgaaaatattgaattctctgaagaaacatggatatgagaagccgacacctatacagactcaggcgattcctgcaatcatgagtggcagggatcttatcgggattgccaagacaggcagcgggaaaaccatcgcattcctactgcctatgtttagacacatcatggaccagcgctctctggaggagggagaaggcccaattgccgtgataatgacacctactcgagagctggccttgcagatcacgaaggaatgtaaaaagtttagtaagacattgggtctgcgagttgtctgcgtctacggcggtacaggcatttccgaacaaatcgcagagcttaagcgaggggctgaaatcatcgtatgcacacccggacggatgattgatatgctggctgccaattccggacgtgtcacaaacctgcgtcgagtgacctacgtggtgctcgatgaggcagacagaatgttcgatatgggattcgagccccaggtcatgagaattgtggataatgtgagaccagaccgtcagaccgtgatgttttcagccacgttcccaagagctatggaggccctcgcgaggaggatcttaagcaagcccattgaggtgcaggtagggggacggagtgtggtgtgctccgacgtagagcagcaggttatcgtaatcgaggaggagaagaaatttctgaagttgctagaattactgggccactatcaggaatcgggttcagtcattatcttcgtagataagcaggaacacgccgatggcctccttaaggacctgatgagggcctcctacccatgtatgtctcttcacgggggaatcgaccaatatgatagggattcaatcattaacgattttaagaacggaacctgcaagttgttggtcgccacatcagtggcagcgagaggactggacgtgaaacatctcattctggtggtgaactactcatgcccaaatcactatgaggactacgtccatagggccggaaggaccggaagagccggtaacaagggctacgcctatactttcatcacggaagatcaggccaggtatgccggagatatcattaaagccctggaactgtcaggcactgcagtccccccagacctggagaaactttggagcgactttaaggatcagcagaaggccgagggaaagataatcaagaagagttcaggatttagcggaaaaggcttcaaattcgacgagaccgagcaggctctcgccaacgagaggaaaaaactccagaaggccgcactggggctgcaggacagcgatgatgaggatgccgcagtagatatcgatgaacaaatcgaaagtatgttcaattcaaaaaaaagagtcaaggacatggccgcacccggtacctcgtcggtacccgctcccactgccggaaatgcagagaaactggaaattgccaagagacttgcactacgaattaatgctcagaagaacctcggcattgagtcccaagatgtgatgcaacaagccacaaacgctatcctcagaggtggcaccattctcgctcccacagtgtccgccaagaccatcgctgaacaattggccgagaagattaatgccaagctgaattatgtcccattggagaagcaagaagaggaacgccaagacggcggacagaacgagtccttcaaaagatacgaagaggaactggagatcaacgacttcccgcagactgcacgctggaaagtgactagcaaggaggccctgcagagaatcagcgagtattcagaggcagccattactatccgcggaacatattttccacctggaaaggagccgaaagagggtgagcggaaaatctatctcgccatagaatcagccaacgagctcgccgtccagaaagccaaagccgagattactcgattaattaaagaagaacttattcgcctacagaattcttaccagccgaccaacaaaggcaggtacaaggtgctttag

SEQ ID NO: 22747 - DNA, 3099 bp, Artificial Sequence
  Description of Artificial Sequence: Synthetic coding sequence
atgggacgcgagagtaggcactatcgcaagaggtcagcatctcggggacgctcaggaagcaggagtcggtcacggagtccttcagacaagcgaagcaagaggggtgatgaccgacggtctaggtccagggacagagaccgccgaagggagcggagtcgaagccgtgacaagaggcgctctaggtcacgtgaccgcaagaggctgcgcaggtctaggagcagagaacgagacaggagtcgagagcgcagaaggtcaaggagccgggatcgaagacgcagccggagtagaagcagaggtagacggtcacgatcttcctcccctgggaacaagtccaagaagaccgaaaacagatcccgcagtaaggagaagactgacggaggcgaatccagtaaagagaaaaagaaggacaaagacgacaaagaggatgaaaaggaaaaggatgccggaaatttcgaccagaataaactagaggaagagatgcgaaaacgaaaagagcgggtggagaaatggagagaggaacaaaggaagaaagcaatggaaaacatcggagagctgaagaaagagattgaggagatgaagcagggaaaaaaatggagtttggaagacgacgacgatgatgaggacgatcccgctgaagcggagaaggaggggaacgaaatggaaggagaagagttggacccccttgatgcatatatggaggaggtaaaggaggaagttaagaagttcaatatgagatctgtgaagggaggcggaggcaatgaaaagaaaagtggccctacagtcaccaaggtagtcactgtggtcaccacaaagaaagccgtggtggattctgataagaaaaaaggagagctgatggagaacgatcaggatgccatggagtattctagcgaagaggaagaagtagacctccagacagctctgaccgggtaccagactaaacagaggaagctgctagaacccgttgatcatggcaagatcgagtatgaaccttttcggaagaatttctatgtcgaagtgcctgagctcgcgaaaatgtcacaggaggaggtaaacgttttccgacttgagatggaggggatcaccgtcaaggggaaaggatgtccaaaacccataaagtcctgggtgcaatgcggaatctctatgaaaattctgaacagcctgaaaaaacacggctacgagaaaccgacccccattcagactcaggctattccagccatcatgagtggcagggacctcattggtatcgccaaaacagggtccggcaagaccatcgcctttctcttgcctatgtttaggcacattatggatcagcgctccctcgaggaaggtgagggccctatcgccgttataatgactcccaccagagaacttgcccttcagatcaccaaagaatgtaaaaagttcagtaagactctaggtctgagagtcgtctgtgtttacgggggaaccggtataagtgaacagatcgccgagttaaagagaggggcagagattatagtctgtaccccagggcgaatgatcgatatgctggcagccaatagcggccgagtgaccaatttgcggagggtgacctacgtagtgttggacgaggccgacaggatgtttgatatgggctttgagccccaggtgatgcggatcgtggataacgtccgccctgatagacagaccgtgatgttttcggctacatttcctcgagctatggaggcgctcgccagaagaatactgagcaagcctatagaggtgcaggttgggggacgcagcgtggtgtgcagtgacgtcgaacagcaggtgattgtgatcgaggaggaaaaaaaatttctgaagcttctcgaactcctggggcactaccaggagagcggttcagtcattatctttgtagataagcaagaacatgccgacggtctactgaaagacctcatgcgggcttcctatccttgtatgagtctgcacggtggtatcgatcagtacgaccgagattctattatcaatgatttcaaaaacgggacgtgcaaactcctcgttgctactagcgtggccgcaagggggctggatgtaaaacatctcatactagtggttaattattcatgccctaatcactacgaggattatgtccaccgcgcaggacggacagggagggctgggaataagggctatgcctatacctttatcaccgaggaccaggctaggtatgctggagacatcataaaagccctcgagttgtctggaaccgccgtgcctcctgatctggaaaaactatggagcgattttaaggatcagcagaaagcagaaggcaagatcatcaaaaaaagctcaggtttcagcggaaaaggtttcaaatttgacgaaaccgagcaagccctcgctaacgagagaaaaaaactccagaaggccgctctggggctccaggactcagacgacgaggacgctgccgtagacattgatgagcagatagagtccatgttcaatagcaagaagcgtgttaaagatatggcagcccctgggacaagtagcgtcccagcccctaccgcaggtaatgctgagaaattggagatcgcgaagagactcgccctccgcatcaacgcacagaagaatctgggaattgagtctcaggtggacgttatgcagcaggcaactaacgccatccttcgtggtggaaccattctcgcgcctaccgtgagcgctaaaacgattgctgaacagctagccgagaaaattaatgccaagctaaattacgtcccactggagaagcaggaagaggagcggcaggacggcggacagaacgaatccttcaagaggtatgaggaagagctagaaatcaatgattttccacaaacagccagatggaaggtcactagcaaagaagcactgcagcgaatatcagagtactcggaggctgcaattacaatcaggggaacgtacttcccaccagggaaagagcccaaggagggcgagaggaaaatctaccttgctatagaaagcgctaacgagctggctgttcaaaaagccaaagcagagattacccgcctgattaaggaagaactcatcaggttgcagaattcctaccaacccaccaataaaggtaggtacaaggtcctgtag

SEQ ID NO: 22748 - DNA, 780 bp, Artificial Sequence
  Description of Artificial Sequence: Synthetic coding sequence
atgggacgggaatcccggcactatcgaaagcgctcagcctcgaggggaaggtccgggagccggtcacgctccaggagcccatccgataagcgcagcaaacgcggagatgaccgccgaagccggtcacgcgatagggaccggagacgcgaacgcagtaggtccagagataagagaaggtctcgctcacgtgaccgcaaaaggcttcgcagaagccggagcagggaaagggatcggtctcgagagcggcgacgtagccgatcacgtgatcggagaaggagtcgaagtcgctcacgcggtcggagaagccgatcctcctcacctgggaataaaagcaagaagactgagaatcgctcgcgctcaaaagagaagaccgacggcggagagtcaagcaaagaaaagaagaaggacaaggacgacaaggaggacgaaaaagagaaggatgcgggaaattttgatcaaaataaactcgaagaagagatgaggaaacggaaggaacgagttgaaaagtggcgggaggaacagcgcaagaaggcaatggaaaatatcggagaactgaagaaggagattgaggagatgaaacaggggaagaagtggtcattggaagatgatgacgacgacgaagatgatcctgccgaagcggagaaagaaggtaacgagatggagggcgaggagctagatcctcttgacgcatatatggaagaggttaaagaggaggtgaagaaatttaacatgcggagcgtgaaagcagttagtaaaaagaagaaaaaaaagaagaagtag

SEQ ID NO: 22749 - DNA, 1221 bp, Artificial Sequence
  Description of Artificial Sequence: Synthetic coding sequence
atggctgccccagaagagcacgacagccccacagaggccagccaacctattgtggaggaggaggagactaaaacatttaaagatctcggggtgacagacgtgttgtgtgaggcatgtgatcagctcggatggactaagccgaccaaaatccagatcgaagcaatcccactggctctgcagggcagggacatcatcggcttggctgagactggcagtggtaagactggagctttcgcactaccaattttaaatgccttgctggagacgcctcagaggttgttcgctctcgtgttaacccctacaagagaactggctttccaaatttctgaacaattcgaggctctaggctcctccatcggggttcagtcggcagtgatcgtggggggaatcgacagcatgtctcaatcccttgcattggccaagaaaccgcatattattatcgcaacccctggtaggctgattgaccacctggaaaataccaaagggtttaacttgagagccttgaaatatcttgtgatggacgaagctgatcgaatcctgaacatggacttcgagaccgaggtggacaagatcctaaaggtgattcccagggataggaaaaccttcctgttcagtgctaccatgactaaaaaagtccagaagctgcagagagctgcactgaaaaaccccgtaaagtgtgcggtgagtagcaagtaccagacagttgagaaactgcagcagtactacatattcatcccatcaaagtttaagtcaaaacggttgggtagtctgaataagtttaaagcaaaagctagatcgatactactggcgacagatgtcgcctctcggggactggacataccgcacgtagatgttgtcgttaactttgatatcccgacccactctaaggactatatacatcgcgtcggcaggacagctcgtgcagggcgatctgggaaagccatcacttttgtaactcaatacgacgtggagctgtttcagcggatcgagcacctgatcggaaagaaactcccgggtttccccacccaggacgatgaagtgatgatgcttaccgagagagttgcggaggcgcagcgcttcgcacgcatggagctgcgggaacatggtgagaaaaaaaagcgctcacgggaagacgctggggataacgatgataccgagggggctatcggcgtacgaaataaggtggcgggaggcaaaatgaaaaagcgtaagggcaggtag

SEQ ID NO: 22750 - DNA, 1368 bp, Artificial Sequence
  Description of Artificial Sequence: Synthetic coding sequence
atggctgccccagaagaacacgactctcccactgaggcctctcaaccaatcgtcgaagaagaggagacgaagacatttaaggacctgggggtgactgatgtcctgtgtgaggcctgtgaccagctgggctggaccaagccaacaaagattcagattgaagcaattcccctggcactccaaggaagagatattatcggactggccgaaacagggagcggaaagactggagcatttgccctcccgatactcaatgccttattggagacaccccagcggcttttcgccctggtccttactccaacccgcgaacttgcgttccagatttcggagcagttcgaggctttgggctcttcaattggcgtgcagtcggctgtgattgtcggtgggattgatagcatgagtcagtcactggctcttgcgaagaaaccccacatcatcatagccacccctggcagactgattgaccatctggagaacacaaaaggtttcaatctcagggctctcaagtaccttgtcatggatgaagccgacaggatcctgaacatggatttcgagacggaggtggataagattctgaaggttatccctcgtgaccgcaagacatttctgttctccgccactatgactaaaaaggtccagaaactccagcgagcagctttgaagaaccccgtgaaatgcgccgtatcctctaaataccagacagtggagaaattgcagcaatactacatctttattccgtcgaagtttaaggacacctaccttgtgtacatcctgaacgagttggccggtaactctttcatgattttttgtagcacctgtaacaacacccagaggacagcactcctcctccgcaatttgggttttactgcaatccccttacacggccagatgtcgcagtcaaagcggctgggcagtttgaataagtttaaggctaaagcacgtagtattttgctggctaccgacgtggcttctcggggtctcgatataccccacgtagacgtcgtagttaatttcgacatccctactcactccaaagattacatacatagagttggacgtactgcccgtgcaggacgctctgggaaggcaattacatttgttactcagtacgatgtggagctctttcaaagaattgaacatcttattgggaagaaacttccaggatttcctactcaagatgacgaagtgatgatgctgactgagcgcgtggcagaggcccagcgcttcgcccgtatggaacttagagagcacggagaaaagaaaaagcggtcgagagaagatgcgggtgataatgatgacactgagggcgcaattggagtgcgaaataaagttgctgggggtaagatgaaaaagcggaaaggcagatag

SEQ ID NO: 22751 - DNA, 2214 bp, Artificial Sequence
  Description of Artificial Sequence: Synthetic coding sequence
atgccaggcaaacttctctggggagacatcatggagctggaggctcctctggaagagagcgagtcgcagaagaaggaacgccagaagtccgaccgccgaaaatccaggcatcactatgacagcgacgaaaagtccgaaacccgagagaatggtgtgactgacgaccttgatgcgccaaaagcaaaaaaatctaagatgaaggaaaagctgaacggcgatacagaggaggggttcaaccggctgagcgatgagttctctaagtcacataagagtagacgcaaggacctgcctaacggcgacatcgacgagtacgaaaagaagagcaagcgtgtctcaagcctggacacatccacacacaaaagcagcgataacaagttggaggaaactctcacccgcgagcagaaggagggagctttttcgaacttcccaatatccgaggagactattaaacttcttaaagggcgtggagtcacatacctttttcctattcaggtgaagaccttcgggcctgtgtatgaaggtaaagatctaatcgcacaggccaggactggaactggcaagactttctcgtttgctatacccctaatagaaaggctgcagaggaaccaagagactatcaagaaaagtaggtccccaaaagtactggtgcttgcaccaacaagagagctggcaaaccaggtggcgaaggacttcaaagatatcacaagaaaactgagcgtagcgtgcttctacggtggtacatcctaccagtcccagataaaccatatcaggaatggcatagacattctggtgggaacaccaggacgcatcaaggaccacctgcagtctggacgactggatctttctaagctcagacatgtggtgctcgacgaagtggatcaaatgctagatcttggattcgcagagcaagtggaggacataattcatgagagctacaaaacggactcagaagacaatccccagactctcctgttctccgccacatgcccacaatgggtctataaggtggcaaagaagtatatgaaatcgaggtacgagcaagtggacttggtcggcaagatgacccaaaaagctgccactaccgtagaacacctcgcaatccaatgccactggtcccagagacctgcagtcattggagacgtcctgcaggtctattccggttcagaggggcgtgccattattttttgtgaaaccaagaagaacgtaactgagatggcaatgaacccccatatcaagcagaacgcgcagtgtcttcacggcgatattgcccagtcccagagggagatcactctgaagggcttccgcgaagggtcttttaaggttctggtagcgaccaacgtggctgcaagaggcctggacataccagaagttgacctggtaatacagtctagccctccacaggacgttgagtcttacatccaccgttctggcaggacagggagagccggtcgcaccgggatttgtatttgcttttaccagccccgtgagagggggcagttaagatatgtcgagcaaaaggcaggtattactttcaagagagttggtgtgcctagcacgatggacttagtaaaatccaagagcatggacgcaattcgcagcttagcctctgtctcctacgctgcagtggatttctttagaccaagtgcccagaggctcatcgaagaaaaaggagcagttgacgccttggctgcagccctcgcccacatttcgggcgcaagttctttcgaacctagaagcctcatcacctctgataagggctttgttacgatgactttggaatctctggaagaaatacaggatgtttcatgcgcctggaaagaactgaacagaaagctgagcagtaacgctgtctctcagataacgaggatgtgcctcctgaagggcaatatgggcgtctgttttgatgtccccaccacagaatcagagcggctgcaggcagagtggcacgattctgattggattttgagcgtacccgcaaagctccccgagattgaggagtactacgacggaaataccagctccaacagcagacagcggagcggctggtcttccgggaggtccggccgtagtggcaggtctggaggacgatccggcggtcggagcggacgacagagcaggcaagggtcacgatctgggtctcgccaggatggaaggagacgctccggaaaccggaatcggtcccgttcgggcggtcacaagaggtcgttcgactag

SEQ ID NO: 22752 - DNA, 2136 bp, Artificial Sequence
  Description of Artificial Sequence: Synthetic coding sequence
atgcctggaaaactgctatggggcgatattatggagcttgaggcaccgctggaggaatctgagtcccagaagaaagaacggcagaagagcgacagaaggaagagtcgtcaccactatgattctgacgagaagtccgaaactcgggagaatggcgtcacagacgatctggacgccccaaaagcaaagaagtctaagatgaaggaaaagctaaacggagacacagaggaaggctttaataggttgtcggacgagttctctaagagtcacaagtcacgccgtaaggaccttccaaatggggatatcgatgagtacgaaaaaaaaagcaagcgagtgtcctccctggacactagcacccacaagagcagtgacaataagctcgaggagacattaacaagagagcaaaaagagggggcttttagtaactttcccatctccgaggaaactatcaaattgctgaaggggcgtggagtcacataccttttcccgattcaggtcaaaaccttcggccctgtttacgaaggcaaggatctcatcgctcaggccaggacagggaccgggaagacattttcctttgccatacccctgattgagaggctacagcgcaaccaagaaacaatcaaaaagagccgatcacctaaggtgcttgtgttggccccaacaagggagctggccaaccaggtggcaaaggactttaaagatatcacaaggaagttgtccgtcgcatgtttctacgggggaactagctatcagagccagatcaaccatatcagaaatggaattgatattttagtcggaacgcctggtcggataaaagaccaccttcagtcaggaaggcttgacctgtcaaagctccgccacgtcgtgcttgacgaagttgaccaaatgctggatctaggtttcgctgaacaggtggaggacattatccatgagagctacaagaccgacagcgaagataatccccagacgttgttgtttagcgctacgtgtccccagtgggtctacaaagtcgctaaaaaatacatgaagagtcgatatgagcaggtggatcttgttggtaaaatgacccagaaagctgcaacgactgtggagcacttggctattcagtgccattggtcacagaggcccgctgtcatcggagacgtgttgcaggtgtactccggaagcgaaggaagagcgataatcttctgcgaaaccaagaaaaatgttaccgaaatggccatgaatccccatattaaacagaatgctcagtgcctccacggcgatattgcccaaagtcaacgcgaaattaccctaaagggatttcgagagggatctttcaaagttttggtggctactaacgttgctgcgagaggattggatatcccggaggtcgatctggttatccaatcatcgccaccccaggacgtggagagctacattcaccggtcagggcgtactggtagggccggacgcaccgggatttgcatctgcttctaccaaccacgcgagcgtgggcagctccgctatgttgaacagaaggctggcataacattcaagagggtgggagtaccctccacaatggaccttgtcaagagcaaaagtatggacgcaatacgaagcctagccagcgtgtcctacgctgccgtggatttctttcggccatctgcccaaaggttaatcgaagagaaaggagcagtcgacgccctggctgcagccttggcccacatttctggggcttctagcttcgaaccacgatctctcataacatccgacaagggatttgtaaccatgaccctggaaagccttgaggaaatccaggatgtgagctgcgcctggaaggaactgaaccgcaaactatcctctaacgctgtgagccaaattacaagaatgtgtctcttgaagggcaacatgggggtgtgtttcgatgttcccacaacggaatctgagagactgcaggctgaatggcacgatagcgattggatcctgtccgtgcctgccaaactgccagagatcgaggaatattacgacggtaacactagctccaattcaagacagtcacgccagggctcaaggtcgggttcaaggcaagatgggcgtaggaggtccgggaatcggaatcgcagtcggagtggcggacacaagcggagcttcgactag

SEQ ID NO: 22753 - DNA, 2001 bp, Artificial Sequence
  Description of Artificial Sequence: Synthetic coding sequence
atggctctcttttatgtggcgagataccccggacctgatgcagccgcagccgctgggccagaaggagccgaggcaggggctcacgggagagctcgagctctcctcgagaggttgcaaagccgggcaagggaaagacaacaacagcgtgaacccgcacagacggaggcggcagcgagcacagaaccagccacccggaggcgccgtcgccctaggcggaggaggcgcgttaacgacgccgagcccggttcccccgaagcccctcaggggaaacgacgtaaggccgatggagaagatgccggtgccgagtcaaacgaagaagctccgggtgaaccatctgcgggttcttcagaggaagccccaggggaaccgagcgcaggttctagtgaagaagcgcctggcgaaaggagcactagtgcttcagctgaagccgcacccgatggtcctgcattagaggaagcggctgggcctcttgtccccggactcgtccttggcggttttggtaaacggaaggcacctaaggtccaacctttcctgccacggtggctcgctgagcccaactgcgtgagacggaacgtgacagaggatctcgtgccaatcgaagatatcccagacgtgcatcctgatcttcagaaacagctgagagcccatggaatcagttcatatttcccggtgcaggctgccgtcatcccagctctgctggaatctgctgcttgcggcttcctcgttgggagggggggataccggccatctgacctgtgcgtttcggcgccaaccggatcgggcaaaacgctcgcatttgttatccccgtggtgcaggctctgctgagtcgtgtcgtttgccacatccgggctctcgtagtgctgcctacaaaagagctggctcagcaggtgagtaaagtgttcaacatttacaccgacgccactccactgcgcgtctccctcgtgacgggacagaagtcattggcgaaggagcaggagagcttggtgcaaaagaccgctgatggttatcggtgcctggctgacatcgtcgtggccacacccggtcggctggtggatcacatcgaccagacacctggcttttccttacagcagctgcgcttcttaattatcgacgaagctgaccggatgattgactctatgcatcagtcatggctgccgagggtcgttgccgctgctttccagtctgaggatcctgccgatccatgtgcactgctgcaacggagacaggcccaggcagtgaccgccgcaagcacatgctgccctcaaatgccactgcagaaacttctctttagcgccactctaactcagaatccagagaagttacagcagctcggtttgcatcaacctaggctgttttccactggcctagctcatcggggactcgaggatactgacggagatggcgacagcggcaagtacgcctttcccgttggattgacccatcattacgtcccgtgctcccttagttcgaagccactagtcgtactgcatctggtcctcgaaatgggattctcccgcgtactgtgtttcacaaacagcagggagaactcacacaggctgttccttcttgttcaagcgttcgggggtgtagacgtagcggagttctcgagtaggtacgggccaggacagcggcgtatgatacttaaacagttcgagcagggaaaaattcagttgctgattagcaccgacgcaacagccaggggcatcgatgtccagggcgtcgaattggtagtgaactatgatgccccacaatacttgcggacatacgtgcatcgcgtagggagaactgccagggcgggtaagaccggtcaggccttcacccttctgctcaaagtgcaggagcggcgttttttgcgcatgcttacagaagctggtgcccctgagttacagagacacgaactttcgtccaagctcctgcagcctctcgtgccacggtacgaggaagccctgagtcaactggaggagtcagtgaaagaggaacgcaagcagagagctgcttag

SEQ ID NO: 22754 - DNA, 1896 bp, Artificial Sequence
  Description of Artificial Sequence: Synthetic coding sequence
atgtctcactgggcccctgagtggaagagagctgaggctaatccaagagacctgggcgctagttgggatgtgcggggaagtcgagggtccggctggtcagggccttttggacatcagggtccgcgagccgctggaagtcgagaaccccctctttgttttaagataaaaaacaacatggtgggagttgtgatcggctattccggaagtaaaataaaggacctccagcacagcactaacactaagattcagataattaacggggagtctgaggctaaggttagaattttcggtaacagggagatgaaagctaaagctaaagcagctattgaaactctgatccgcaaacaagaatcctataatagtgaaagcagtgtggacaatgccgctagtcagaccccgattgggaggaaccttggcagaaacgacatcgtcggcgaggcagaaccactgagtaactgggatagaatccgcgctgctgtcgtggagtgtgaaaaaaggaaatgggccgatcttccacccgtgaaaaagaacttttacatcgagagtaaggccactagctgcatgagtgagatgcaggtcattaactggcgtaaggaaaactttaacatcacatgtgatgacctaaagtcaggcgagaagagacttatacccaagcccacttgccggttcaaggacgccttccagcaataccccgacctattgaagtcgattattcgcgtcgggattgtgaagcccacccccatccagtcacaggcctggccaatcattcttcaggggattgatctcatcgtcgtggcccagacagggaccggcaaaacactgtcttacctgatgcccggattcatacatctggactctcaacctatctcgcgggagcaacgcaatggccctggcatgctggtgctgacgcctacaagggaactcgccctgcacgtggaggcagaatgctcaaaatatagctacaaggggctgaagtcaatctgtatctatggagggaggaacaggaatgggcagatcgaggacatttctaagggcgtggacatcattatcgccactcccggaaggctcaacgacctccagatgaacaacagcgttaacctaagatccataacatatctggtgatcgatgaagctgacaagatgctggatatggaattcgagccccagatcagaaagatcttgttggacgtgcgcccagatcgccagacagtgatgacttccgctacttggccagacacagtaaggcagctggctctgtcttacctaaaagaccctatgattgtttacgtcgggaatctgaatctcgtcgctgtcaacacggtcaaacagaacatcatcgtgaccactgaaaaagagaaacgagcactcacacaggagtttgttgagaatatgtcaccaaacgacaaagtcattatgtttgtgagccagaaacatattgccgatgatctctccagcgactttaatatccagggcatcagcgccgagtcgctccatgggaatagcgagcaatcggatcaggaaagggcagtggaagacttcaagtctggtaatattaaaatattgatcacgaccgacatcgtatcacggggactggacctgaatgatgtaactcacgtctataactacgatttcccaaggaatattgatgtgtacgtgcaccgagttggctacatcggtagaaccggcaaaaccggtacctcagtcacccttatcacacagcgagattccaagatggcgggagaactgatcaaaatcttggaccgtgcaaatcagtccgtgcctgaagatctggtggtgatggctgagcagtataaactgaatcaacagaagcgccatcgggaaacacgctcccgcaaaccaggccagagaaggaaagagttttactttctcagctag

SEQ ID NO: 22755 - DNA, 1644 bp, Artificial Sequence
  Description of Artificial Sequence: Synthetic coding sequence
atggaggattctgaggcattggggtttgagcacatgggcctggacccacgcctgctgcaggcggtgacagaccttggttggtcccgccctacgttaattcaagaaaaagctattccgctggcactagaggggaaagacctgctggccagagcacggacaggcagcggaaagacagccgcttatgcgatccccatgctccagctgcttctacaccgcaaagctactggccctgtcgtcgagcaggcagtgagggggctggtgctggtccctacaaaagagctggcaagacaggcccaatccatgatccagcagctcgctacatattgtgcccgagacgttagggtcgcaaacgtgagcgcagctgaagattccgtgtcccagcgggcagtgctcatggagaagccagatgtcgtcgtcggtaccccttccaggatattaagtcatttacagcaggatagccttaaattaagagacagtctggagctgttagtggtagatgaggcagaccttctatttagcttcggctttgaggaagagttaaaaagtttgctgtgccatctccccagaatttaccaagctttccttatgtcagcaacatttaatgaagatgtgcaggccctcaaggagctcatcctgcacaatccagtgacactgaagcttcaggagtctcaactgccaggaccggaccagctacagcagtttcaggttgtctgtgagaccgaggaagacaaattccttctgctgtacgccctgctgaaactgagtttgatccgcggaaaatctctgctgtttgtcaacacgctggaaaggtcctaccgcctgaggctgttccttgagcaattcagtattcctacatgtgttttaaacggggagcttcccctccggtcacgctgtcatataatttctcagttcaaccagggtttttatgactgcgttatcgccacggacgccgaagtcctgggagcacccgtaaaagggaaacgcaggggacgtggtcccaaaggtgataaggccagtgaccctgaagccggtgtcgccagggggatcgatttccaccacgtgagcgcagtacttaactttgacctccctccgactccagaagcttacattcacagggctggacgtacagcacgggctaataatcccggtatcgtgctgactttcgtattacccaccgaacagttccatctaggtaagatcgaagaactcctgtccggcgagaaccgcggtcctatccttttgccttatcagttcagaatggaggagattgaaggtttcaggtaccggtgtcgagacgccatgagatctgtaaccaaacaggcaataagagaagccagactgaaagaaatcaaggaggaactcctccattcagagaagctgaaaacctattttgaagacaacccaagggacctgcagttgttacggcacgacctgccattacaccccgctgttgtaaaaccacacttgggtcacgttcctgactatctggtgccacctgccctcagaggcctcgttcgcccacacaaaaaacgaaagaaactttcatcaagctgccgaaaggccaagagagctaaatcacagaaccccttgcggtcttttaagcataaggggaaaaaattcagacctacagctaagccttcttag

SEQ ID NO: 22756 - DNA, 2112 bp, Artificial Sequence
  Description of Artificial Sequence: Synthetic coding sequence
atggcggctcctgtgggcccagtcaagttctggcgccctggcacagaggggcctggcgtttctatctccgaagagcgccagtctttggctgaaaactccggcacaacagtggtgtacaatccttacgctgccctgagtatcgaacagcagcggcagaagctccctgtgtttaagcttcggaatcacattctgtacctcatcgagaactaccaaaccgttgtcatcgtcggcgaaacaggatgtggcaagtctacgcagattccgcagtacctggccgaggcaggatggactgccgaagggagagtggttggcgtaacgcagcctcgacgggtagcagctgtgacggtggctggcagagttgcagaagaacgtggggcagtcctgggccacgaagtcggttactgtattcggtttgatgattgcactgaccagctcgcaactagaataaagtttctgactgacggcatgttggtccgcgaaatgatggtggatccactgctcaccaagtattccgttataatgctagacgaagcccatgagcgcactctttataccgacattgctattgggctgttgaaaaaaatccagaagaaaaggggagatctgcgactgatcgtggcttctgccacgctggatgcggacaaatttcgggattttttcaaccagaatgagacgtccgacccagctagagatacatgtgtcatccttacggtcgaggggaggactttcccagtggatatattttatctacaaagtccagtgccagactatatcaaaagcacagtggaaactgttgtaaaaatccaccaaaccgagggtgacggggatgtgcttgccttcttgacagggcaggaggaggttgagaccgttgtgagtatgttgatagaacaggcacgcgcactggctaggaccggcatgaagcgtcacctacgggttttgccgatgtacgccggactgccctccttcgagcagatgaaagtctttgaacgggtcagtcggtccgtccggaaggtaattgtcgcaactaacgttgccgagacctccatcaccatcagcggaattgtttatgtaatagattgtgggtttgtcaagctccgcgcttataatccgcgtacggcaattgagtgcttggtcgtggtgcccgtgagccaggcaagcgcaaatcaacgagccggacgcggaggtaggtctcgcagcgggaaatgttatcggttgtataccgaggaggcattcgataagctgcctcagtcaacggtgcccgagatgcaacggtccaatttggcccctgtgatcttacagttgaaagccttgggcatagacaatgtcctgcgcttccactttatgagcccaccccctgcacaaagtatggttcaggctctggagctcctctacgcgttgggtgggctcgataaggactgcagactgactgaaccactgggaatgcgaatcgctgagtttccattgaatccaatgtttgctaagatgctcttagagtccggaaatttcggttgcagtcaagagatcctcagtatcgcagccatgatgcaaatccagaacattttcgttgttcccccaaaccagaaatctcatgccatcagggtgcaccgaaaatttgcagttgaggagggcgaccaccttactatgctcaatatttatgaggccttcatcaagcataacaaggactcgaaatggtgccaggaacatttcctgaattataagggcctcgtccgagcagcgaccgtccgcgagcagctgaagaaattactggtcaaatttcaagtcccaagaaaaagcagcgagggagaccccgacctagttcttagatgtattgtcagcggattttttgctaatgccgcacgatttcacagcacgggcgcttatcgaaccatcagggatgaccacgaactgcacatccatcctgcttctgttctgtatgccgagaaacccccacgttgggtcatatacaatgaggtaatacagacctcaaagtattacatgagagatgtcaccgctattgagagtgcatggttgctggagctggcccctcatttttaccagcagggcactcatctttccctaaaagctaagcgtgcaaaggtgcaggacccctag

SEQ ID NO: 22757 - DNA, 552 bp, Artificial Sequence
  Description of Artificial Sequence: Synthetic coding sequence
atgttactggagtccggaaactttggatgttcccaggagatcctttcgatcgccgcaatgatgcaaatccagaatatttttgtggtgccgccaaaccagaagtcacatgctcataacaaggattcgaagtggtgccaggaacattttctgaattacaaaggtttggtccgcgcagctaccgttagagagcagcttaaaaagctactcgtgaaattccaagtgcccaggaagagctctgagggggacccagatctggttttaaggtgtattgttagcggatttttcgcaaacgccgctagatttcacagcaccggtgcttatcggaccatcagagacgatcatgagctccatatacatcccgcttcagtgctgtatgccgaaaagccgcctcgctgggtgatttataacgaagtgatacagaccagtaaatactacatgcgggacgttacagctattgagtcagcttggctgctcgaactagcccctcacttttatcagcaggggacccacctctctctcaaggctaaacgagcgaaagtacaggatccatag

SEQ ID NO: 22758 - DNA, 2019 bp, Artificial Sequence
  Description of Artificial Sequence: Synthetic coding sequence
atggccgctcctgtcggacccgtgaagttttggcgcccaggcaccgagggccctggagtgtccattagcgaggaaagacagtctctcgccgaaaactctggaactaccgtcgtgtataatccctacgccgctttatccatcgagcagcaacgccagaagctgcccgtatttaaatatctagccgaggcagggtggaccgctgagggaagggtcgtgggggttacacaaccgaggagggtcgcagcagtgaccgtcgcaggcagggtcgccgaggaacgcggagccgttctgggtcacgaagtgggctactgcattcgatttgatgattgcacggaccagcttgctactagaattaagttcctcactgacggaatgttggttagagaaatgatggttgacccactgctgactaagtatagtgtgatcatgctggatgaggcccatgagagaacactgtataccgacatagccataggtctccttaaaaaaatccagaagaagaggggtgatctgagactcatcgtggcaagcgcaaccttagacgcggataagtttcgtgacttttttaatcagaatgagacctctgatccagctcgggacacctgtgttatcctcacagtggagggcagaaccttccctgtggatattttctacttgcaatcccccgttcctgattacatcaagtccaccgtcgagactgtggtgaagatacaccaaaccgaaggcgatggcgatgttcttgccttcctaaccggccaagaggaagtcgaaaccgtggtgtctatgttaattgaacaggcgcgtgctttagctagaaccggcatgaagcgccacctccgagtacttccaatgtacgctggcttaccctcgttcgaacagatgaaagtctttgaaagagtcagcaggtccgtgcggaaggttatagtcgctactaacgtagctgaaacgtcaatcacgatctcaggcatagtgtacgtcatcgattgtgggtttgtcaaacttcgggcatacaacccacgtacagcaattgagtgtttagtcgtggtgcccgtgtcgcaggcaagcgctaatcagagagccggacgcggaggacgtagccggtctggtaaatgttaccgcctctacacagaagaagcatttgataagctgccacagtctactgtgcctgagatgcaaagatcaaatctcgccccagtcatcttacagcttaaggccctgggcattgataacgtgcttaggtttcactttatgtcaccacccccagcccagtcaatggtacaggccttggagctgctctacgctctgggtggcttagacaaagattgtaggcttacagagccactcggaatgcgcatagcagaatttcctctcaatccaatgtttgctaaaatgctcctggagagtgggaactttggctgttctcaggagatcctctccatagctgctatgatgcaaattcaaaacattttcgttgtgccgcctaaccagaagtcacacgcgattcgggtacatagaaaatttgctgtagaggaaggcgatcatctgaccatgctaaacatttacgaggcctttatcaagcataataaagatagcaagtggtgtcaggagcatttcctgaactacaagggactggttagggctgctacagtgcgcgaacagctcaagaaattgctcgtgaagtttcaggtgcctcgaaagagttcagagggcgaccctgatctcgttctgaggtgcatcgtgtcagggtttttcgcaaacgcggctcggtttcacagtaccggtgcgtacaggacaatacgagacgatcacgagctacatattcatccggctagcgtactgtatgccgagaagccgcctaggtgggttatatacaacgaagtgatccagaccagtaagtactacatgagggacgtaacggctatcgaatccgcctggttgctggaactggcccctcacttttaccagcaaggaactcacctgtccctgaaagcaaagagggcaaaggtccaagacccgtag

SEQ ID NO: 22759 - DNA, 2154 bp, Artificial Sequence
  Description of Artificial Sequence: Synthetic coding sequence
atgacctcccagccacttcggctggccgaagaatatggccctagcccaggtgagagtgagctggcagtgaatccctttgatggcctccccttcagttcgcgctactatgagctactgaagcagcgtcaggctcttccaatttgggctgccagattcacctttctggagcagttggagagtaatcccactggggtggtgctggtgtctggcgagcccggttctgggaaatcaacccaaatccctcagtggtgtgctgaatttgctctggccagagggttccaaaagggccaggtgacagttacccagccctaccctctggccgcacgctccttggcccttagagtggccgacgagatggatttgacactcggacatgaggtcggttactctatcccgcaagaagattgcactgggcctaacacactgcttcgcttctgttgggatcggctgttgttacaggaggtggccagcacccggggaacaggggcttggggtgttctcgtcttggacgaagctcaggagagatcagtggcctctgacagcttgcagggtttgctccaggatgccagacttgagaagctacctggagatctgcgggtggttgtggtgacagaccctgcgctggaacccaaactcagagctttctgggggaacccacctatcgtgcatatcccacgcgagcctggagaaagaccatccccgatttattgggacaccattcctcctgatagggtggaagcagcttgtcaggctgtcctggaactgtgccgcaaagaacttcccggagacgtgctcgtgtttcttcccagcgaagaggaaatttcactatgttgtgagagtctcagtcgcgaggtggaaagtctcctgttacagggcctgccccctagagtgctgcccctacacccagactgcggcagagccgtgcaggccgtctatgaggacatggatgcccgtaaggtggtggtcacacactggctggcagacttctctttctctctgccttcaattcagcacgttatcgactcgggattggaactgcggagtgtgtacaatcccaggattcgagccgagttccaagtcctacgaccgatctcgaaatgccaggccgaggccaggcgcttgagagcaagaggcttccctcccggatcctgcctgtgtctttaccctaagtctttcctcgagttggaagctccaccactaccccagccgagggtgtgcgaggagaatctgtcctcactagtgctgctcctgaagagacggcagattgctgagcccggagagtgccacttcctggatcagccggcacccgaagcattaatgcaggcattggaagatttggattacctcgccgcactggacgatgatggagacctctccgacttgggggtcattctgagcgaatttcctctggccccagaattggctaaggcactcctggcatcatgcgaatttgattgcgttgacgagatgctcactttagccgctatgcttacagcagcacctgggtttacccgcccaccgctgagcgccgaggaggccgctctgaggcgagcactggaacatacagacggggatcacagtagcctgatacaagtctacgaagcgttcattcagagcggggcagatgaggcatggtgccaggcaagaggattgaattgggccgcattgtgccaggcacataaattgcgtggggaactccttgagttaatgcagcggatcgaactgcccctgtctcttcccgcattcgggtctgaacaaaaccgtagagatctgcagaaagctctggtctcaggctacttcttgaaggtagcccgagacacagatgggacaggcaactatctcctgctcactcacaaacacgtcgctcaactcagtagctactgttgttacaggtcaagacgggcacccgcaagaccacccccatgggtgctttaccacaacttcaccatcagcaaggacaattgcctttcgatcgttagcgaaatacagccacagatgcttgtggagctggccccaccgtacttcttgagcaatctcccgccttctgaaagtagagacttacttaaccagctgcgagaaggcatggccgattcaaccgcaggaagtaaaagctctagcgcacaagaatttagggacccctgtgtcctgcagtag

SEQ ID NO: 22760 - DNA, 2154 bp, Artificial Sequence
  Description of Artificial Sequence: Synthetic coding sequence
atgacatcccagcccctgcggcttgcagaggaatatggcccaagtcctggagaatccgaactggccgtgaatcctttcgatgggctgcctttcagctctcgatactacgaactcctgaaacaaagacaggctctgcctatctgggctgcaagattcacctttctggagcaactagagagcaaccctactggcgtagtattagtttctggcgaacctggatcaggaaagagcacccaaatcccacagtggtgcgcagaatttgcattggccagaggcttccagaaaggccaagtcaccgtaacccagccctaccccctggccgctcggtctctggcactacgagtcgctgacgagatggatctcacccttggccacgaagtgggctacagcatcccccaggaggactgcactggtcctaatacactactgagattttgttgggacagattgcttctgcaggaagtggcttcaacccgcggaaccggagcctggggtgtactggtgttagatgaagcgcaggagagaagcgtggcgagtgacagcttgcaggggttactgcaagacgctcggctggagaagttgcctggggatttgcgcgtggtggtggtcacggacccagctttagaacccaagttgagagccttctggggtaatcccccaatcgttcatatcccgagagagcccggagaacgaccctcccccatttactgggacaccatcccacctgaccgagtagaagccgcatgtcaagccgtgctggaattgtgtcggaaagagttgcccggagacgttctggttttcctcccatcagaggaggaaatctcgttgtgctgtgaatccctgtcacgtgaagtggaaagcttactgttgcaggggctgcctcctcgagtcctccccctgcatccggattgtggacgcgcagtgcaggccgtgtatgaagacatggacgcacgcaaagtcgtggtgacccactggctggccgacttctctttctcactgccttccatccagcacgttattgactctggactggagcttcgctccgtctataacccaaggatccgggcagaatttcaggtcctgagacctatctctaagtgtcaagctgaagccaggcgcctacgggctcggggattccctcctggctcctgtctgtgcttgtaccctaaaagctttctggaactggaggctcctcccctgcctcaacccagagtttgtgaggagaacctctcttctctggtgctgctcctgaagaggcgacagatcgccgaaccaggcgagtgccatttcctggatcagcccgctccagaagccctgatgcaggctctagaggatctcgactatttggcagcgttggacgatgacggagacctttctgaccttggcgtgatcctgagcgagttccccctcgcacctgagcttgctaaggcgctgctggcatcttgtgaattcgactgtgttgatgagatgcttactctagcggcaatgctgacagccgcacccggatttacccgccctccactgtccgccgaagaagcggcattgagacgcgcacttgagcacaccgacggcgatcactcatcattgattcaagtgtacgaggcctttatccagtccggagcagacgaagcttggtgccaggccagaggacttaattgggctgcgctgtgccaggcgcataaactaagaggggaactgctggagctgatgcagagaatcgagctacctctgagtctcccagctttcggaagtgaacaaaaccgcagggacttgcagaaggccctcgtctctggctattttctaaaagtggcaagagatactgacgggacaggtaactatcttttactgacccacaaacatgttgctcagctaagcagctattgttgctatcggagccgccgtgcacccgcacgacctcctccctgggttctgtaccataattttaccatttctaaagacaactgtctgagcattgtcagcgaaatccaacctcagatgctcgtcgagctggcacccccatattttctgtcaaaccttcctcccagtgagagtagagacctcctcaaccagctgagagaaggcatggcggactctaccgcagggagtaaaagctcctctgctcaggagtttcgtgacccctgcgttctgcagtag

SEQ ID NO: 22761 - DNA, 981 bp, Artificial Sequence
  Description of Artificial Sequence: Synthetic coding sequence
atggcattgtccggatcaaccccggcaccctgctgggaagaagacgagtgtctggactactacggaatgctttctctacaccgaatgtttgaggtcgtgggaggccagctgactgagtgtgaactggagctgttagcgtttcttctggacgaggcacctggtgcggcagggggtctggcacgggcacgctcaggactggagttgctacttgagctggaaaggcgcggtcagtgcgacgagagcaacctccggctactcggacagctgctcagagtgctagccaggcacgacctgttaccccacctggctcgcaagcgacggagacctgtaagcccagaaaggtacagttatggaactagcagctcgtcgaagcggaccgaaggaagctgtcggagacggaggcagtcgagcagtagcgcaaactcacaacagggccagtgggagacagggagccctccgacaaaacgccagcgccgttccaggggacgcccatcgggaggtgcaagacgtagacgcagaggggctccagccgcaccccagcagcagtctgagcccgctcgaccctctagcgaaggcaaggtcacttgtgatattcgcttgagagtacgagccgagtactgcgagcatggccctgccctcgagcaaggagtagctagtaggcgcccacaggctttggcgcgacagttggatgtgtttggtcaagccacagctgtgcttcgatccagagacttggggtctgtagtatgtgacatcaaattctccgaattgagttacctcgatgctttttggggcgactacctcagtggagcattgcttcaggccctgcgtggagtgtttctgactgaagccctgcgggaggctgttggtcgcgaggccgttcgattacttgtcagcgtggacgaggcagactacgaagcaggtcggagacggttattattaatggaggaggagggaggaaggaggcccacggaggcttcatag

SEQ ID NO: 22762 - DNA, 981 bp, Artificial Sequence
  Description of Artificial Sequence: Synthetic coding sequence
atggctctgtctggatctactcctgcgccatgttgggaggaggatgagtgcttagactactatggaatgctttcactgcacagaatgttcgaggttgttgggggacaacttactgagtgcgagctcgaactccttgcgtttcttctcgacgaggcccctggagcagccggtggactggcaagagccaggtcagggctcgagcttttgctggagcttgagcgccgagggcagtgtgacgagtctaacctgagactgcttggccagctgctgcgcgtgctggctcgacatgaccttctgccacatctcgctcgcaagaggcgaagacctgtatccccagaacggtattcttatggcacctcctcctcgtccaagcgcaccgagggaagctgccgcagaagacgacagagttcctctagcgccaactcccaacaagggcagtgggagaccggttcccctccgacaaagcgccagagaagatcacgaggaagaccttccgggggagcacggagaagaagacgcggtgctccagctgctcctcagcaacaatcagaacctgctcgcccatctagcgagggaaaggtcacgtgcgacatcagactccgcgtgagagccgagtactgtgaacacggtcccgctctagagcagggtgtagctagccgcaggccacaagcattggctagacaattggatgtgttcggtcaggcaacagccgtgcttagatctagggatctgggtagtgtcgtgtgcgatattaaattttccgagctgtcctacctcgacgctttttggggcgactatctgtcaggcgctcttctgcaggcactcagaggcgtcttcctgactgaagcgcttagagaggcagtaggcagggaggccgtgcgactgctggtgtccgtagatgaggccgactacgaagccggtcgcagacgcctcttgctcatggaggaggaggggggacgcaggcccaccgaagcctcctag

SEQ ID NO: 22763 - DNA, 1635 bp, Artificial Sequence
  Description of Artificial Sequence: Synthetic coding sequence
atgcgcgtcgcggtggcgggatgttgccacggcgagctggataagatatacgagacacttgctctggcagagagaagagggcctgggcctgtcgaccttctcctgtgttgcggcgattttcaggcagtgcgaaacgaagcagacttgagatgtatggccgtgccacccaaatatagacatatgcagacattctatcggtattatagcggcgagaagaaagccccagtcctcaccctgttcattggaggtaaccatgaggccagtaatcacctgcaggaattaccttacgggggatgggtggctcccaatatctattacctggggttggccggagtcgtgaaatatcgaggggtacgcatcggcggaatcagcggtatcttcaaatctcatgactatcgcaaaggccatttcgagtgtccaccctataatagctctaccatccgtagcatttatcatgtgaggaatatcgaagtgtacaagctgaagcaactgaaacagcccatagatatttttctgagccatgactggcctaggagcatatatcattatggaaacaaaaaacagttgctgaagacaaaaagtttcttcaggcaggaggtggagaataatacacttggcagccctgccgcaagcgagcttttagaacatctgaaaccaacctactggttttccgcccatctgcatgtgaaattcgctgctttgatgcagcaccaagctaaggataagggtcagacagctagggcgactaagtttcttgctctggacaagtgcctccctcatagagactttttgcaaattctggagatcgagcacgatcctagcgctcccgactacttagaatacgatattgaatggcttaccatcctccgggctaccgacgatctgattaatgtgactgggagactgtggaatatgcctgagaacaatggcctccatgccagatgggactacagtgcaactgaagaaggcatgaaagaggtcctggagaaattgaatcatgatttgaaagtcccatgcaatttttccgtgacagccgcatgttatgatccaagtaaaccacagacccagatgcagttaattcaccgcataaatccacagaccactgaattctgtgcacaattggggatcattgacattaatgtcagactacagaaaagcaaagaggagcatcatgtgtgcggcgaatatgaggagcaggacgatgttgagtccaatgatagcggggaggatcaatctgagtataacaccgatacatctgccctcagcagcataaatcccgatgagatcatgttggatgaagaagaggacgaagattcgatcgtaagtgcccattctggcatgaatacgccctcagttgaaccctcagaccaggcctctgagttttccgcgtccttctcagacgtgcgaatcctgcctgggtctatgatagtctctagtgatgacacggttgattcaaccattgacagagaaggcaagcctggcggaacagtcgaatcaggtaatggcgaagacctgaccaaagtcccgctgaagcggctttcagatgagcacgaacccgagcagcggaagaagattaaacgaagaaatcaggccatttatgcagcggtggatgatgatgacgacgatgcagcctag

SEQ ID NO: 22764 - DNA, 933 bp, Artificial Sequence
  Description of Artificial Sequence: Synthetic coding sequence
atgcagcaccaggccaaggacaagggacagaccgcacgcgctacaaaattccttgctctggataagtgcctgcctcacagagacttcttacaaatcttagagattgagcacgaccccagtgctcctgactatctcgagtacgacattgaatggttaaccatcctgagagctacagatgaccttatcaatgttaccggtcggctctggaacatgcctgaaaacaacggattgcatgccaggtgggactactctgcaaccgaggaagggatgaaagaagttctcgagaagctcaatcacgacctcaaggttccctgcaacttctctgttactgcagcgtgctacgatcctagcaagccccagacacagatgcaattgatccataggatcaatccacaaactacggagttctgcgcacagctgggaataatcgatatcaacgtccggttgcagaaatctaaggaggaacaccatgtgtgtggcgagtatgaagagcaagacgatgtcgagagcaacgacagcggggaagaccagtcggaatataacacagacaccagcgccctgtctagcatcaacccagacgaaatcatgctcgatgaggaagaggacgaagacagcatagtgtcagctcactcaggaatgaacacaccgagcgtggaaccatccgaccaggcctccgaattctctgcgagctttagtgatgtcaggatactccctggctctatgattgttagttccgatgataccgttgattcaaccattgaccgcgaaggcaaacccggaggcacggtcgagtcaggtaacggcgaggatctcacaaaagtacctttgaagcgcctgagtgacgagcacgagccagagcagaggaaaaagatcaagcgacgcaatcaggccatttacgccgctgttgatgacgatgatgacgacgccgcttag

SEQ ID NO: 22765 - DNA, 1653 bp, Artificial Sequence
  Description of Artificial Sequence: Synthetic coding sequence
atggaccaccatgtgagcaccatcaagcccaggcgaatacagaaccagaatgttatacatcgcctggagcggagaagaatttcctctggtaaggccggaacccactggcatcaagtgcgcgtctttcatcagaacgtctttcctaatttcactgtcgtcaatgtggagaagcctccatgcttcctgaggaagttcagccccgacgggagatactttattgcgttttcgtccgaccagacaagccttgagatttacgaataccaaggctgccaagctgcagaagatctgctgcaaggttacgaaggggagatccttagcaatggcaatgaccagaggagtgttaacatcagggggagattgtttgagcgattcttcgtgctgctacacattacaaatgtggccgctaatggagaacacctcaacagagagtgctcactgttcacggacgactgccgatgtgtgatcgtgggctccgctgcatatctgcctgacgaaccacaccccccttttttcgaggtatatcgcaattcggagtcagtgacccccaatccgagatcccctcttgaagactactcactccacattatagaccttcataccggcagactgtgtgacaccagaaccttcaagtgcgacaaggtggtcctctctcataaccaaggtctgtacctctacaaaaacatactagcgatcttgtctgtacagcagcaaacaatacacgtgtttcaggttacaccggagggaacattcatcgacgtgcggactatcggcagattttgttatgaggatgacctcctgaccgtgtctgcggtatttcccgaagtacaacgggattcccagactggcatggcaaatcctttcagggatccctttattaactcactcaaacacaggctcctggtttatctttggcggagagccgagcaggatggctccgcgatggccaagcgcaggttctttcagtacttcgaccagcttagacagctgcggatgtggaagatgcagctgctggacgagaatcatctcttcattaaatatacatccgaggacgtggtaacactgcgagtgacagacccatcccaagcatcattctttgtcgtttataatatggtgacaactgaggtcatagccgtgttcgagaacacttcagatgaactccttgaactgttcgaaaatttttgcgacctgtttaggaatgccaccctccatagcgaagtgcagttcccttgcagcgccagctctaacaactttgctagacaaatccaacgccgttttaaggatacaataataaatgcaaagtacggcggacatactgaagccgtgcgcagactattgggccaattacctatctccgctcagtcctactcaggctccccctacctcgacctttcactctttagctatgacgataaatgggtctccgtgatggaacgccctaagacttgcggtgaccaccccatccggttctacgccagggacagtggactgctgaagttcgagatacaggctggccttcttggcaggcctattaatcacacagttcgtcgcctagttgcttttacgttccatccgtttgagccgttcgccataagcgtgcagcgcacgaatgccgaatacgtggtcaatttccatatgcgccattgctgtacctag

SEQ ID NO: 22766 - DNA, 1686 bp, Artificial Sequence
  Description of Artificial Sequence: Synthetic coding sequence
atggtcggtcagatcttaaagcgtgacgtgattatggaccatcacgtcagcacaataaagccccgaaggatccagaatcagaacgtgattcataggctcgaaaggcgccgtatctccagtggcaaagcgggaacgcactggcaccaggtgagggtttttcatcagaatgtgtttccgaactttacagtagttaatgtagaaaagcccccatgctttctgagaaaattttccccagatggacgctacttcatcgccttctcatctgaccagacttcccttgaaatttatgagtatcaaggttgccaggccgctgaagacctgctgcaaggatacgagggtgaaattctaagcaacggcaacgatcagcgctctgtgaacatccgaggaaggttatttgaaagattctttgttctgctgcacataaccaacgtcgccgctaacggcgagcatctgaacagagagtgttccttgtttacagacgattgtagatgcgtaatagtcggctctgcagcctatctccctgacgaacctcacccaccgtttttcgaggtatacaggaactcagagtcagtcacaccaaacccaagatctccactggaggactattctttacacatcatagatttgcatacaggtaggctgtgtgacacacgcacattcaagtgtgataaggttgtgctctcccacaatcaaggtctctatctgtataagaatatactggccattttatccgtccagcaacagacaattcatgtttttcaggtgacgcctgagggaacatttattgatgtgagaaccatcggaagattttgctacgaggacgacttactcacagtgtccgccgtcttcccggaagttcagcgcgactctcagacgggcatggcaaatccgttcagggatccattcatcaactctctcaaacacaggttactggtgtacctctggaggagggcagagcaagatgggagcgccatggccaaaaggcggtttttccagtactttgatcagttgcgccagcttagaatgtggaagatgcagttgctggatgagaatcacctgtttataaaatacacatctgaggatgtggtgacgctaagagtcaccgacccatctcaagcatccttctttgtggtctataatatggttacaacagaagtgatcgcggtgttcgagaacaccagtgatgaactgctggagttgttcgagaatttttgtgacctgttcagaaacgcgaccctacatagtgaggtccaatttccgtgctccgcttcatccaacaatttcgcaaggcagatccagcgaagatttaaagacacaatcatcaatgccaagtacggcggacataccgaggccgtgcgcagattactggggcagttgcctatctctgcccaatcctattctggcagtccctatcttgacctgagcctgttctcctatgacgacaagtgggttagtgttatggagcggcctaagacttgcggagaccacccgatccgcttctacgcacgggacagtgggctgttgaagttcgagatacaggccggtctgctcgggagacccatcaaccacacagttcggcgacttgtagccttcacttttcacccgtttgagccattcgccatttcagtgcaacgaactaatgccgagtatgtcgttaactttcatatgaggcactgctgcacttag

SEQ ID NO: 22767 - DNA, 1686 bp, Artificial Sequence
  Description of Artificial Sequence: Synthetic coding sequence
atggtgggccaaatcctcaaaagggatgtgattatggatcatcacgtgagtacaattaaaccaagaagaattcagaatcagaatgtcatccatcgcctcgagcggcgtcgcatttcctcaggcaaagccggaacccattggcaccaggtaagggtgttccatcaaaacgtcttccctaacttcactgtggttaatgtcgaaaaacctccatgctttcttaggaagttctcccctgatgggagatacttcatcgcattctcgtcagaccagactagtcttgaaatttacgaataccagggttgtcaagcagcagaggatctcttacagggctatgagggggagatcctcagcaacgggaacgatcagagatcagtcaatattagaggccgtttgttcgagcggttttttgtgctgcttcacattacgaatgtggctgcgaacggagagcaccttaatagagagtgttccctgttcaccgacgattgcagatgcgtgatagttggctccgccgcatacctccccgacgaaccccatccaccttttttcgaggtctatagaaatagcgaaagtgtcacgcctaatcccagatctcctctggaagattactcattgcatataatagatctccatacgggacggctatgcgataccagaacgttcaaatgtgacaaggtggtactatcccataatcaagggctctatctgtacaaaaacattctggctattctgtctgtgcagcagcaaaccatccatgtattccaggttacacctgaagggacattcattgatgtcagaacgatcggcaggttttgttatgaggacgatcttctaactgtgagtgcggtgtttccagaggtgcagcgggactctcagacaggcatggccaatccctttagggacccattcattaactcccttaagcacagattgctggtctatctctggagacgagctgagcaggacggatcggcaatggccaagcggcgtttcttccagtattttgaccaattacggcagctccgtatgtggaaaatgcaactgcttgacgaaaaccacttgtttatcaaatacacctcagaagatgtggtgaccttgcgggtgaccgatcctagtcaggctagctttttcgttgtgtacaatatggttaccactgaagtcattgctgtgttcgagaatacttctgatgaattgctggaactgttcgaaaatttttgtgacctgttcagaaacgccactctccattctgaggtgcagtttccctgttctgcaagtagcaataacttcgcacgccagattcagaggcgcttcaaagatactattatcaatgcaaaatatggaggacacacagaggccgttcgtagactgctcggccaacttcctatcagtgcccagagttacagtggctctccttacctagacctgagtttgttttcatacgacgacaaatgggtatctgtgatggagcgtcccaagacatgcggggatcacccgatccgcttttacgcccgtgattctggcctcctcaaatttgaaattcaggctggtctccttggccgaccaattaaccacacagtgcggcgtcttgttgccttcaccttccatccatttgaaccatttgccatctctgtccaacgcaccaacgctgagtacgtggtgaatttccacatgcgacactgctgcacatag

SEQ ID NO: 22768 - DNA, 5591 bp, Artificial Sequence
  Description of Artificial Sequence: Synthetic coding sequence
atgatcgaagacaaggggccaagggtcgccgactattttgtggtcgccggtcttaccgatgtgtccaagccactcgaggaggaaattcactttaatgatgcctgccacaaggtcgccaagccaaaagagccaatcacagacgtgagcgtgataatcaaatcgctgggggaggaggtgcctcaagattatatatgtatcgatgtcacacccaccggtttgagtgctgacctgaataatggcagcttagtgggccctcagatctacctgtgctaccgccgtggcagggataagcccccactgacagacttgggcgtgctgtacgattggaaggaaaggctgaaacagggctgtgagatcattcagagcactccatacggaagacctgcaaacatttctgggtccacctcctctcaacggatttacatcacatatcggagagcatccgagaatatgacacagaataccctcgcagtaacggacatatgtattataatcccatccaagggagagtccccgccacatactttttgcaaagtggacaaaaatctgaataattctatgtggggatctgctgtctacctctgttataaaaagagcgtggcaaagactaataccgtatcctataaggctggactgatatgtcgctatccccaggaagattacgaatccttctccctccccgagtccgtgccactgttctgtctccctatgggggcaaccattgaatgttggcccagcaactccaaatatcccctgccagtcttttcaaccttcgtgcttaccggggcatccgccgagaaggtctatggggcagctattcagttctatgagccatactccgaggagaatctgacagaaaaacaaagattattactgggattgacatctgccgacggcaagagcgacagtagcaagacgatccacacgaataagtgtatttgcctattgagccactggccgtttttcgatgccttccgcaaatttttgacattcctgtaccgctacagcatttcgggtccccacgtgctgcctatcgaaaaacatattagccacttcatgcacaaagtgcctttccccagcccacagcggccacgaatcctggtgcagctgtcaccccacgacaatttaatcttgtcgcagcctgtgagttcgcctctccccctttccggcggaaagttctccacattacttcaaaacttaggcccagaaaatgctgtcactctgctggtgttcgcggtgaccgagcataaaatcctgattcatagtctgaggcccagtgtgctaacatctgtcaccgaggcactggtatcaatgatcttcccatttcattggccctgcccctacgtgcccctgtgtcctcttgcattagcagatgtgttatccgccccttgcccctttatcgttggcattgattcaaggtattttgacctgtacgacccgcctcccgacgtgagttgtgtcgatgtcgacactaacacaatctcacagattggagataagaaaaatgtggcctggaagattttgccaaaaaaaccatgtaaaaatctcatgaatacactgaataacttacatcagcagttagcaaaattacagcagagaccaagagacgatggactgatggacctggctatcaacgactatgattttaacagcggaaaacgactgcacatgattgacttagagatccaggaggcttttctctttttcatggcgtcaatccttaagggctatcggtcctatctgagacccatcacacaagccccaagcgaaaccgccacagacgccgctagcctatttgcccttcaggctttcctcagaagtcgggatcgctctcatcagaagttctataacatgatgacaaagacccagatgtttattcgcttcattgaagagtgcagttttgtctccgataaagacgctagcctggcctttttcgacgattgcgtcgataaggttgatatggataagtcgggtgaagtgagactcatagagctcgatgagtctttcaagagtgaacacactgtgtttgtcacacccccagaaatccctcatctcccaaacggtgaagaacctccattgcagtattcctataatggcttccccgtcctgcgcaataatctttttgagcggccagaaggctttctgcaggcgaaaaagaacaagctaccgtctaagagttctagcccgaattctccactgcctatgtttcggaggacaaaacaggagataaagtctgcccataagatcgccaaaaggtatagttcgatcccacagatgtggagtcgctgcctgctgaggcattgctatggcctgtggttcatatgcctcccagcctacgtgaaggtctgccattccaaggtcagagcccttaagacggcttatgacgtgctgaagaaaatgcagagcaagaagatggatcctcccgatgaagtgtgctacaggattctgatgcagctgtgcggccaatacgatcagcctgtactggccgttcgggttctgtttgagatgcagaaggcagggattgaccccaatgccatcacatatggctactacaacaaggccgtgttggaatcgacatggccttccaggtcccggagcggctatttcctatggactaaggtcaggaatgtcgtgctgggcgtcacgcagttcaagagggcattgaagaaacacgcgcacctgtcgcagacaacactctctggtggccagagcgacctgggatataattccctgtcgaaggatgaggtccggaggggggacacaagcactgaggatatccaggaagaaaaggacaagaaaggctctgactgcagctctctctccgagagcgagagcacaaaagggtccgctgactgcctccccaaactgtcatatcagaatagctctagcattgttagactgacaggaacaagcaacaatagcgcagggaagattagtggggagtctatggaaagcaccccagaactcctactgatctcatctctggaggacacaaacgagaccagaaatatccagtcccggtgctttagaaagcgtcacaaaagcgataatgagactaatcttcaacagcaggttgtgtgggggaaccggaatcgaaacctctcaggcggagtcttaatggggtttatgcttaaccgaatcaatcaggaagcgacccccggagatatagtagagaagttgggggctgacgccaagatcctgtccaacgtgatctctaaatctacccgtcccaataccctggacatcggaaaacctcctctgagatcgaaacgtgattctttggaaaaggagtcttccgatgatgacactccattcgacggctctaactatttagcagataaagtggacagtccagtcatctttgatttggaagatctggacagcgaaacggacgtttcgaaggctggatgcgtcgccacccagaaccccaagcgaatccaaaggatgaactcctcctttagcgttaagccgttcgagaagaccgatgtggccacagggtttgaccccttatcattgctcgtggcggaaacagaacagcagcagaaagaggaggaagaagaggacgaagacgacagcaaaagtatctccacacctagcgcgagaagagatctcgccgaagaaattgtcatgtatatgaataatatgtcctcacccctgacaagtcggacaccaagtatagatctccaacgtgcgtgcgacgataagcttaacaaaaagagtcctcccttagtaaaggcatgtcgacggagctcattgcctcctaactccccaaaacccgttcgattgactaaatcaaaatcatacacgaagagcgaagagaaaccgagagacaggctttggtcctcaccagccttcagcccgacatgtccatttcgggaagaaagccaagatacgctgacccattcatctccaagcttcaacctcgatacacttctggtgcctaagctggatgtgttacggaacagcatgttcacggccggaaaaggcgtcgccgaaaaggcctcaaaatggtactctcgctttacaatgtacacaacttctagcaaggaccagagctccgatcgtactagcctgtcttccgttggcgctcaagatagtgaaagcacttcactgaccgacgaagacgtctgtcacgaactcgaaggacccattagtagccaggaaacttctgccacatctggcactaagcggatcgacctcagccgcatctcgctggagagttctgcgtccttggaaggatcactgtcaaaattcgcactgcctggtaaaagtgaggttacaagtagctttaatgcttcgaacacaaatattttccagaattatgcgatggaagtcctcatctcttcatgcagccgatgtaggacctgtgactgcctggtgcatgatgaggagatcatggccggttggacagctgacgactcgaaccttaataccacatgtcctttctgtggtaatatttttcttccttttctcaatattgaaatcagggacctgcgcagaccaggccgttactttctgaaaagcagtccgtccaccgaaaacatgcactttccatcttccatttcttctcagactagacagagttgcattagcactagcgcctcgggactcgatacaagcgctcttagcgtgcagggtaactttgacctgaattcaaaatctaagctgcaggagaacttttgcacccgctcaatccagattccagcgaacaggagcaaaaccgctatgtcgaagtgtcccattttcccaatggcgaggtctatatccactagtggtcctctggataaagaggacaccggtcggcagaaactcatctctacggggagcctccctgcaactctgcagggggcaaccgatagcctgggactggagtggcatttaccatctcctgaccccgtgacagtgccatacctgtcccccctcgtggtctggaaggaattggagtccctcttggagaatgagggggaccatgctatcacagttgcagattttgtagaccaccatccgatagtcttctggaacctcgtctggtacttccgaagactagatctccccagtaatctacctggcctgattctgtccagcgaacactgcaacaaatacagcaagatacctaggcactgtatgtctgaagattctaaatacgtcctgattcaaatgttatgggataatatgaagctgcatcaggaccctggtcaacctttgtatatactttggaacgcacacacacagaagtacccaatggtgcacctgctgcaaaaatccgataacagctttaaccaagagctgttgaaatctatggttaagagcatcaaaatgaatgacgtgtatgggcctatgtctcaaatcctagaaactttaaataagtgccctcacttcaaaagacagaggtcactgtacagagaaatccttttcctgagtctggtggccttggggagggagaatattgacatcgacgccttcgacaaagagtacaagatggcatatgacaggcttacgccaagtcaggtgaaaagcacccacaattgcgacagaccaccatctaccggcgtgatggaatgtcgcaagacattcggcgagccttatctata

SEQ ID NO: 22769 - DNA, 5720 bp, Artificial Sequence
  Description of Artificial Sequence: Synthetic coding sequence
atgatagaggataaagggcctagggtggctgattacttcgtcgtcgctggtctgacagacgtctctaagcctctggaggaagaaattcacttcaacgatgcgtgtcacaaagtggccaaacccaaagagccaatcactgatgtgagcgtgatcatcaagtcccttggggaagaagtgcctcaagattatatttgcattgacgtcaccccgaccgggctcagtgcagatctgaacaatggatcactcgtgggccctcagatatatctgtgttatcgaaggggacgggacaagccaccattgacggatcttggggtcctatacgattggaaagaaaggctcaaacaagggtgcgaaattatccagagcacaccttacggtaggccggctaacatttccggtagcacttccagccagcgaatttatattacttatcggcgagcctctgagaacatgactcagaatacgttggctgtgaccgacatttgtatcattatcccctctaaaggcgaaagccccccacacaccttctgcaaagttgacaagaacctgaacaactctatgtgggggtccgccgtttacctgtgttacaagaaaagcgtggctaagaccaacaccgtgagttataaggccggtctgatttgcagatatccccaggaggactatgaatctttctctctgcccgagagcgtccccttgttctgtttgcctatgggagcgactattgaatgttggcctagtaattcgaagtacccactccctgtgttttccacctttgtgcttactggagcttcggcggaaaaggtctacggagcagccattcagttttatgagccgtattccgaggaaaacttgactgaaaagcaaagactgctgctgggcctgacatctgcggacggtaagtcggactcctctaagaccatccacaccaataagtgcatatgtctcctttctcattggcccttcttcgatgcgtttcgtaagttcctgacattcctgtaccgctattctatcagcgggccacatgtgttaccaattgaaaaacacatcagtcacttcatgcacaaagtcccattccccagcccacagcgccctcgaatcctggtccaacttagcccccacgacaacttaattctctcccaacccgtgagcagtccactgccactctccggcggaaagtttagcactctgctccagaacttggggccagaaaacgctgtgaccctgcttgtgtttgctgtgactgagcacaagatcctgatccacagcctgcgcccaagtgtgctaacgagtgtgacggaggcgctggtcagtatgatctttccatttcattggccatgcccttatgtgcctctgtgccccctcgcattggcagacgtgctttcggctccctgcccatttattgtcggcatagacagtaggtactttgacttgtacgacccaccacccgatgtgagctgtgtagacgtcgacactaataccatttcacagattggagataagaaaaacgtagcctggaaaatcctccctaaaaagccctgtaaaaacctgatgaacacactgaacaatcttcatcagcagctggccaagcttcagcagcgcccacgcgatgatggccttatggatcttgctatcaatgactatgacttcaacagcggcaaaaggctgcacatgatcgatcttgaaattcaggaggcgttcctgttttttatggcatctatacttaagggttaccggtcctacttgcggcctatcacacaggccccaagcgagaccgctacggatgccgcaagtcttttcgccctgcaggcattcctaaggtccagagaccggtcccatcaaaagttctacaatatgatgactaaaactcagatgtttatccgcttcattgaggagtgtagtttcgtatcagataaggatgcaagcctggcctttttcgatgactgtgtggacaaagtggatatggacaagagcggtgaggtccgattgatcgagttggacgaatcattcaaatcagagcacacagtgttcgtgacacccccagagatccctcatctgcctaatggagaggagcccccactccaatactcctacaacgggtttccagtcctaaggaacaacctgttcgagaggcctgagggtttcttacaagccaagaaaaacaagctgcctagcaagagttcctctcccaattcaccactgcccatgtttagacgcacgaagcaggaaataaaatcagctcataagatcgcaaaacgttactcctccatcccccagatgtggtccagatgcctgttacggcactgttacgggctctggtttatatgtctgccggcttatgttaaggtgtgtcatagcaaggtccgcgcactgaagactgcttatgacgtgctgaaaaagatgcagtccaagaaaatggatcctcctgatgaggtatgctacaggattctgatgcagttgtgtgggcagtacgaccagcccgtgctcgcagtaagggtgctgtttgaaatgcagaaagccggtatcgaccccaatgccatcacttatggctactacaataaagcagtgctcgagtccacttggcctagcagatctcggtcagggtactttttatggactaaggttagaaacgttgttctgggtgtaacgcaattcaaacgagcactgaagaagcacgcacatctgagccaaacaacgttaagcgacggttcagacctggatgctgtctcacatggatccatggactccggtcatggcacccataccgtggagcaagccccatttaacacagggctgatcaaagtctacgcgacggacgaccggtcctccacagggggacagtccgatctgggctataactctctcagcaaggacgaggttcgcaggggagacacgtccactgaagatatccaggaggagaaggataaaaaggggagtgattgcagcagcctgagcgaatcagaatccactaaggggagtgcagattgcctgcccaagttaagttatcagaactcctcgagcattgtccggttgaccggtacttccaataatagcgctggcaaaatctcaggtgagagcatggagtcaactccggagctcctcctgatttcttctttagaggatacaaacgaaacaaggaacatccaatcacgctgctttagaaaacgccacaaatcagataacgaaaccaacctgcaacagcaagtagtgtgggggaatagaaaccgtaacttgagcgggggagtgctgatgggctttatgctcaatcgtatcaaccaggaggccactcctggagacattgtggagaagcttggcgctgacgcaaagatcctatctaatgtgatctcaaaatctacacggcctaatacactggacatcggcaaaccccctctgagaagcaagcgggatagtttggagaaagagtccagcgacgacgatacaccatttgatggatctaactatcttgctgataaagttgattctccggtaatattcgacctggaggatcttgatagcgagacggatgtgtcaaaggccggatgcgtcgccacccaaaatcctaaaaggattcagcgcatgaactcaagtttcagcgtcaagcccttcgagaaaaccgacgtcgctactgggttcgatccactttctctgttagtggcagagaccgaacaacaacagaaggaggaggaagaggaagacgaggacgacagcaaaagcattagtacccctagcgctcggagagaccttgcggaggagattgtcatgtatatgaataacatgtcgagccccctgacatcgagaacacccagtatcgatcttcagcgggcttgtgatgataagctgaacaagaagtccccccctctggtgaaagcttgccgtcggagctctttgccccctaacagtcctaagccggttagactcaccaagtcaaagagttacacaaaatcggaagagaagccacgggaccggctttggtctagccctgcatttagcccaacctgtcctttcagggaagagagccaggacaccttgacccactcttcaccatcttttaatctggatacgctgctcgtcccgaagttggacgtgcttagaaatagcatgtttacagccggtaagggcgtagccgaaaaagccagtaagtggtattccagattcacaatgtataccacttccagtaaggatcagagttctgaccggacatctctgtcttccgttggagcacaggattctgaatccacatcacttactgacgaagacgtctgtcacgaacttgagggaccaatctccagccaagagacctccgctacatccggtacaaagagaatcgatttatctaggatctctctagaatcttcagcctccctcgaaggctcactttcgaagtttgccctcccaggaaagtcggaggtcacctcatcgtttaatgcttcaaacacaaatatcttccagaattacgccatggaggtgctgatctctagctgttcccgatgccgcacctgcgactgtttggtgcacgatgaggagataatggctggatggacggcagacgatagcaacctgaatactacctgtcccttttgcggtaatatcttcttgccttttctaaatattgagattagggacctccgtcgccctggtaggtacttcttgaagtcatccccttctactgagaacatgcacttcccctcctctatttcgtcccagactagacaatcatgcattagtacttcagcaagtgggctcgacactagcgctctgagcgtgcagggcaattttgacttgaattctaaatccaaattgcaagaaaacttctgcacaagaagcatccaaattcccgcaaatcgttccaaaaccgccatgagcaagtgtcccattttccccatggcacgctctatttccacatccggtcccctggacaaagaagatacaggccgacagaaactgatttcaaccggtagccttcccgctacccttcagggagcaactgactctctcgggctagagtggcatctgcctagtcccgaccctgtgaccgtcccctaccttagtcctctggtcgtatggaaggagttggaaagccttttggagaatgagggtgaccatgcaatcactgtcgccgattttgtggaccaccatccgattgtgttctggaatctcgtttggtactttcgacgtttggacctgccaagcaatctgcctgggctgattctttcttcggagcattgcaataagtattctaagatccctcggcattgtatgtccgaggactccaagtatgttttgatacagatgctttgggataacatgaagctccaccaggaccccggacagccactctacattctctggaacgcgcatacacagaaatacccgatggtacacctgctgcagaaatcagacaactcattcaaccaggaactcctgaaatctatggtgaagtccatcaagatgaacgacgtgtatggccctatgagccagatcctcgagacattgaacaaatgccctcacttcaagagacagcgatcactctatcgagagattctttttctctctctggtagcactgggcagggaaaacatcgacattgacgcctttgataaggagtacaagatggcctatgatcgcttgacacctagccaggtgaagtcaacccataactgcgatcgacctccatccacgggcgtcatggaatgccgaaaaacattcggagagccgtatctcta

SEQ ID NO: 22770 - DNA, 102 bp, Artificial Sequence
  Description of Artificial Sequence: Synthetic coding sequence
atcatcaagtatcttttgctgtactcctttctatgtgttctgatcaaatgccaagacagtttcaagatatattgttttccctgctaccctttctacaactag

SEQ ID NO: 22771 - DNA, 990 bp, Artificial Sequence
  Description of Artificial Sequence: Synthetic coding sequence
atgggcgcaacaggggacgctgagcagcccagaggcccttccggcgctgaaagagggggtctggagctgggcgatgccggtgcagcaggccagctcgtactcaccaatccatggaatatcatgattaagcaccggcaggtacagcgccgtggccgaaggtcccagatgacaacatcttttacggatcccgcaataagtatggatttactgagagcggtgctccagccaagcatcaacgaggagatccagaccgtcttcaacaaatacatgaaattttttcagaaggccgcactgaacgtgagagataacgttggcgaggaggtcgatgcagaacagctcattcaggaggcctgtagatcatgcttggaacaggccaaactgctgttctctgatggggaaaaggtgattcctcgactcacccacgaactgcctggaatcaaaagaggccgacaggcagaagaggaatgcgcccatagggggagcccattaccaaagaagaggaagggaagaccgccagggcatattctgtcttccgatcgcgcagctgccggaatggtttggaaacccaaatcttgtgagccaattaggcgcgaggggccaaagtgggatcctgctagattgaatgagtccaccaccttcgtgctcggatcacgggcaaacaaggcattgggaatgggtgggacacgcggacgcatatacatcaagcacccacatctgtttaaatacgctgcagaccctcaggataaacattggctggccgaacagcatcacatgagagcaaccggcggaaagatggcgtacctcttgatcgaagaggacatccgagatcttgccgctagcgatgactatagaggctgtctagatctaaagcttgaagagctgaaaagctttgtcctaccaagctggatggtggaaaaaatgcgtaaatatatggaaacattacggaccgaaaacgagcaccgggcagtcgaggcccctccccagacttag

SEQ ID NO: 22772 - DNA, 2271 bp, Artificial Sequence
  Description of Artificial Sequence: Synthetic coding sequence
atggtggttacaaggtctgcaagggccaaggccagcattcaagccgcatctgcagaatcctcaggccagaagtccttcgcggcaaacgggatccaggcccaccccgagagttccactggatccgatgccaggactacggccgaaagtcagacaaccgggaaacagtccctgatcccacggactcctaaggccaggaaaagaaaatcccggaccaccgggtccctccctaaggggaccgagccttctactgacggcgagacctcagaggcggagtctaactattccgtgagcgagcatcacgacacaatactgcgcgtgacaaggcgcaggcagatcctgattgcctgttcccctgtgtcctctgtacgcaaaaagccaaaagtgacacctacaaaggaatcatacactgaggagatcgtctcagaggccgagtcccatgtgagtggtatttccaggatcgtcctgcctacggagaagacaactggcgctcggcgaagcaaggctaaatctctgaccgatcctagccaggagtcccataccgaggcaatctcagacgccgaaacgtcctcctccgatatctctttctctggcatcgccacgcgcagaacccgcagtatgcagaggaagttgaaggctcagacagagaaaaaagattctaagatagtgcctggaaatgagaagcagatcgttggtacacccgttaactccgaagattccgacactaggcaaacatcacacctgcaggctcgttccctaagtgagatcaacaaaccaaatttttacaataatgactttgatgacgattttagccacaggtcttccgaaaacatattaaccgtgcatgaacaagcaaacgtagagagcttgaaggagaccaagcagaactgcaaggacctggatgaggacgcgaatggtatcaccgatgaaggcaaagaaattaacgagaaatcctctcagttgaagaacctttctgaattgcaagatactagtttgcagcaactggtctctcaacggcactcgactcctcagaataagaacgccgtatcagtgcattcaaatctcaacagcgaagcagtgatgaaatctctgacgcaaacctttgccactgtggaagtggggcgttggaacaacaacaagaagtctcccatcaaggccagcgaccttacaaagtttggggactgtggtggctcagacgatgaagaggagtccacagtaattagtgtctcggaagatatgaattcggagggtaatgtggattttgagtgcgacaccaagctctacactagtgcgcctaacacaagccaaggcaaagataattctgtccttcttgtgctctcatccgatgagtctcagcagtccgaaaatagcgagaacgaggaagacaccctgtgttttgtggagaacagcggccagcgggaatccctgagcggggacaccggatcactgtcctgtgacaacgctctcttcgtgattgacaccacgccgggaatgagcgccgacaaaaacttctatctggaggaggaggataaggcatccgaggtcgccatagaggaagaaaaggaggaggaagaagacgaaaaatcagaggaagattcatccgaccatgacgaaaatgaggatgaattttccgatgaagaagatttcttaaattccactaaggcaaaactgctcaaacttacgtctagctctatcgaccctggtctgtcgatcaagcagctgggtggcctttatattaactttaacgccgacaagttacagagcaacaagaggaccttgacacagattaaggaaaagaaaaagaacgagcttctgcagaaggcggttatcacacctgatttcgaaaaaaatcactgcgtgccaccttactctgagtccaaatatcaactgcagaagaaacgacgaaaggagcgacagaaaaccgcaggcgatggctggttcggcatgaaagctccggagatgacgaatgagctcaaaaatgatctgaaagctcttaagatgcgcgcatcaatggatcctaagcgcttttacaaaaaaaacgatagggatggatttcctaaatacttccagatcgggactattgtggataatccggctgacttctaccatagccgtatacccaaaaaacagcgcaagcgcactattgttgaagaattgcttgctgattctgagtttaggcgatacaacagacgcaagtattccgaaattatggctgaaaaggccgcaaacgctgccggaaagaagttccgcaaaaagaagaagttccggaattag

SEQ ID NO: 22773 - DNA, 1020 bp, Artificial Sequence
  Description of Artificial Sequence: Synthetic coding sequence
atgctcccttcagcagtcgctgcccacgccggagcttactgggacgtggtggcgtcgagtgcattactaaatttacctgcagctccgggatttggcaatctgggaaaaagtttcctgattgaaaacttgctgagggttggcggagcgccaacaccacgcctgcagcctcctgcaccacatgaccccgctaccgccctagcgaccgccggagctcagcttagaccactgccggcttcgccagtgccattaaagctttgccccgctgccgagcaagtctctcctgccggagccccatacgggacacgctgggcatttcaggtgctgagccccagtgcagacagtgccagactgcccggtcgagcccctggtgacagagactgcacattccaaccatccgcacctgcaccaagtaagccctttctcctcagcacacctccattttacagtgcttgttgcggtgggtcatgtagaagacctgcctcttctacggcattcccacgtgaggagtcaatgctcccactcctgacccaggattctaatagcaaagcccgacgcggtatcctcagacgcgcagtttttagtgaggaccagagaaaggccttggagaaaatgtttcagaagcagaaatacatcagcaaaaccgaccgcaagaagctggccattaatcttggacttaaagagtcacaggtcaagatttggtttcagaataggcggatgaagtggaggaacagcaaagaaaaggaggttctgagcaacagatgcattcaggaggtaggcttgcaggaggaccccttatctagatctgccctggggtttccttctccctgtccatcaatttgggatgtcccccagcagcacagctcgccccgatggcgagagaattctcccgaacccagtgagcgcttaattcaggagagtagtggagctcctccgcctgaagccaactcactgcagggagccctgtacctctgctcagaggaagaggctggtagcaaaggagttctcactggggcagtatag

SEQ ID NO: 22774 - DNA, 1134 bp, Artificial Sequence
  Description of Artificial Sequence: Synthetic coding sequence
atgcagcactatggggtcaacgggtactctttgcatgcaatgaacagcttgagtgcaatgtacaacttgcaccagcaggctgcccagcaagcacagcatgcacccgactatcggccatcagtgcatgccctcactctggcggaacggctcgccgacatcattctcgaggcaaggtatggaagtcaacaccgcaaacagcgcagatcaagaaccgcttttacagcgcagcaactggaggccttggaaaaaacctttcagaagacccactatccagatgtggtaatgagagaaaggctcgccatgtgcacaaatctgccagaagccagagtccaagtatggtttaaaaataggagagctaaatttcgaaagaagcagcgtagcctccaaaaggaacagctacagaagcagaaggaggcagagggatcacacggagagggcaaggcagaggcccctactcccgatacccaactcgacaccgaacagcccccaagactgcctggctcagatcctccggctgagctccatttgagcctgtctgagcaatctgcctctgagtctgcacctgaagatcagccagacagagaggaggacccaagggcgggagccgaagaccctaaagccgaaaagtctccaggagcggactctaaaggattaggatgcaaaagggggtccccaaaggcggacagcccaggcagcctgaccatcactccggttgcccctggcggtggccttctgggaccgagccattcctattcttcaagcccactctcgctcttccggctccaggagcagttccggcagcatatggcggcaactaataacctcgtgcactattcaagtttcgaggtcggcggtccggctcctgccgcagctgccgctgccgctgcagtgccctacttgggggtcaatatggctccactgggcagcttacattgccagtcttattatcaatcattaagtgccgcagcagccgcacatcagggtgtttgggggagtcctctgctacctgcacctcccgctggtctggccccagccagtgccactctcaactcaaaaacaaccagtatagagaacctgcggctgcgggcaaagcagcacgctgctagcttgggcctggacacactcccaaattag

SEQ ID NO: 22775 - DNA, 1149 bp, Artificial Sequence
  Description of Artificial Sequence: Synthetic coding sequence
atgcagcactacggggtgaacggctatagtctacatgcaatgaactccctgtctgcgatgtacaatttgcatcagcaggctgcgcagcaggcacaacacgcaccggactatcgcccttctgtacacgcattaactctggctgagagacttgcaggatgtacctttcaggatattatcctcgaggccaggtacggcagccagcacaggaaacagcggagatcccggactgcctttactgctcagcagctggaggctttggaaaagacctttcagaaaacccattaccccgacgttgtcatgcgcgagcggcttgccatgtgtacgaatctcccggaggcgagggtccaggtgtggtttaagaatcgaagggcaaagtttcgtaagaaacagcgctcgttgcaaaaagaacagctccagaagcagaaagaggccgagggcagccatggagagggcaaagctgaggcccctacccctgatacgcagcttgacactgagcaacctccccgtcttccgggatctgaccccccagcagaactgcacttgtctttgtctgaacagtcggctagtgagagcgctcctgaagatcagccagatcgggaagaagatcccagagcaggggctgaggatccaaaggcagaaaaatctcctggggcagactctaaagggctgggctgcaaacgaggcagcccaaaggccgactcacctggtagtctgactataaccccggtcgcacccggtggtgggctgcttggaccttctcactcatactcctcgtctcccctcagtctatttagactgcaggagcagtttcgtcagcacatggcagcaacgaacaatctggtgcactatagctcctttgaagtggggggacccgctccagcggcagccgcagctgctgccgctgtgccctatctgggcgtgaatatggcaccacttggttctctgcactgccagtcttactaccagtctctgtccgctgcagctgcagcccaccagggggtctgggggagtcctctcctgcctgccccaccggcagggctggctcctgcctccgccacccttaattccaagacaacgagcatcgagaacctgcggttgcgcgctaagcagcatgctgcatccctggggctagacacactgccgaactag

SEQ ID NO: 22776 - DNA, 1431 bp, Artificial Sequence
  Description of Artificial Sequence: Synthetic coding sequence
atggagacaccaggtgcctccgcatcaagtctgcttctgcctgctgcctcaaggcctccacggaagcgtgaggcgggtgaggccggtgccgcaacgtccaagcagagagtcctggatgaagaagagtacatcgaaggtcttcagactgtcattcagagagatttcttcccagacgtggaaaagttgcaggcccagaaggagtatctggaggcagaagagaatggcgacctggagcggatgcgtcaaatcgctattaaatttggatcagccctcggcaaaatgagccgcgaaccccctcccccatacgttacgccagctacatttgagacaccagaggttcacgccggaactggagtggtgggcaataaaccccgtccgcgaggtcgcggactggaggacggcgaggccggtgaggaggaggagaaagagccgctgccttccctggatgtctttctgtctaggtacacctcggaggacaatgcatcatttcaagagatcatggaagtcgcaaaggagcgtagcagggcacgacacgcttggttatatcaggctgaagaggagtttgaaaagcggcagaaagacaacctcgagctgccgagcgccgagcatcaggccattgaaagcagccaggccagtgtggaaacatggaaatataaagctaagaattcgctcatgtattaccccgaaggagtgccagacgaagagcagctctttaagaagcctcgccaagtcgtccataagaacacccggtttcttagggatcctttttcccaagctctctcacgatgccagctccaacaggccgcagccttgaacgcccagcacaagcaagggaaagtgggcccagacggaaaggagctcatccctcaggaatcccccagggtgggaggctttggattcgtggccacaccctcaccagctcctggggtcaacgaatcccccatgatgacctggggcgaagtcgagaacacccccctccgtgtggaaggcagtgaaacgccgtacgtcgacaggactcctggccctgctttcaaaatattggagcccggtcggagggagcggttgggcctcaagatggcaaatgaagccgcagctaagaaccgcgctaagaagcaggaggccttacggcgtgtcaccgaaaacctggcctctctcacaccaaaggggttgtcacccgcaatgtcccctgctctgcaaaggctggtttcacgcaccgcatcaaagtacacggatcgagctttacgcgcttcatacacaccatcgccagccagatccactcacctgaaaacgccggcttccggcctgcagactcccacgtccacccctgcccctgggtccgccacccggaccccactgacacaggatcctgcaagtattacggataatctgttgcagttaccagcacggaggaaggctagcgactttttttag

SEQ ID NO: 22777 - DNA, 747 bp, Artificial Sequence
  Description of Artificial Sequence: Synthetic coding sequence
taatgtagcacatggtccttcctggctccactgccccaacagttccacttgaagatcttgtttctgccgctgacaccacttcgactcctgcttctgtcagctcaggtactgatcgtggtccccttccgcgaagccgctctgcgtgtggtacagctgttcatctctttgctggagggagatagtaagaagaagattatcgtgtccaacaagaagcgcttccaaggcgaatatggcagcgatcctgaagagcggccacccaatctaaagcgcccagaggactatgaggctgttttcgtgggcaatatagacgaccatttcagaataggggtagcaatcctgcagaggagcattaggttgtatgccccattctattcttctgacatcctgatcgccagccccctgggtctccggaccatcatcggcggtgaaggggagaagaaacgcgattttgattttctgtcctcaatcgagttgctgatcattgatcaagctgatatttacctgatgcaaaattgggagcatgtcctgcatctgatgaaccacatgaatctgctgcccctggactcacatggcgtggattttagccgcgtcagaatgtggtctctcaataactggtctaaatattacaggcagacacttctgttcggtgccctacaggatgcccagatcaatagtgttttcaacaaatactgcgtgaatatgcaggggcaggtcgggagccgcctagtttcaagcgtgtcaagttag

SEQ ID NO: 22778 - DNA, 2271 bp, Artificial Sequence
  Description of Artificial Sequence: Synthetic coding sequence
atgggcaaaagaggttctcgctctcaaagccagctactgaataccctgactaagaaacagaaaaagcaccttcgcgattttggagaggaacacccattttatgatcgtgtgtctaggaaggaggcaaagccccagatctgtcagctctccgagagtagcgattcttcggattctgagtcggatagcgagtctgaaccacaacaggtttccgggtatcaccggctccttgcgacacttaaaaatgtgagcgaggaagaggaagaggacgaggaggaagaagaagaggaggattctatagtcgacgacgctgagatgaacgacgaagacggtgggagcgatgtctcagtcgaggaagaaatggctgctgaatcaacagagagccctgagaatgttgctttgagcgcagatcccgagggcaaggaagacggcgaggagccgcctggcacttctcaaacaagtccagaggagtttacagatgctaaacacgaatctttattcagtcttgagaccaactttctggaagaagagtcgggagataatagtagtctgaaggcatctcaagacccatttctgcaacacgttaataaagagctgaaagaaaaagcaatccaggccgtagcgaccaacccaaaaactacgcatgagctcaaatggcccattttgggacaattattcttttcttcaaagtttcaaaaactggaaacatttaagccaccgaaggacatagacttgaagtctctgcacttacagaaacccctggaatcaacctggaccaagactaattctcagtttttatccggccctcagaaaagttcctcccctttcacaccactacagaaggagctgtttcttataatgaacagttatagagacttattttatcccgaaaggacggccctcaagaatggcgaagagattcggcacgtctactgcctacatgttatcaaccacattctcaaggccaatgctcaggtgttaggaaataattctagacgtcgcagccaaaagtttggggttggagacgatgatgacttccgtgaccagggactcacccgcccaaaggtgttgattgtggtgccttttcgagaagcggctttgcgggtagtccagctgttcatttccctcttggagggagatagcaaaaaaaagattatcgtatctaacaagaagagatttcagggcgagtacgggtcagaccctgaagagagaccacccaatcttaaacggcctgaagattatgaagccgttttcgttggcaacatagacgatcactttcgaatcggtgttgcaattctgcagcggtcgattcggctttacgcccctttttatagttccgacattctcattgcttctccactgggacttaggaccatcattggaggggagggcgaaaagaaacgggacttcgactttttgtcttccatcgagttactcatcattgatcaggcagacatctatctgatgcaaaattgggagcacgttctgcacttgatgaaccacatgaacctcttgccactggactcccacggcgtcgacttctcgagagtgagaatgtggtctctgaataattggtctaaatattaccgccagacattgctgtttggggctctgcaagacgcccaaataaacagtgtctttaataagtactgcgtgaacatgcagggtcaagttgcggtgagaaacgtacctatgacaggttcaatcagtcacgttctggtgcagctaccacatgtattccaaagaatggaggctgagaaccttgcttctgtgattgatgccaggttcaatttcttcgtgaataagattttgccccagtaccgcgacgccgtaatgtctcacaccctgatttacattccgtcctacttcgatttcgtgcggctacggaactactttaagaaggaagagcttaattttacccacatctgtgagtacacgcagaagtctggcgtgtcgagggctcgacacttttttttgcagggcgaaaaacagttcctactgtttacggaacggtttcatttctataaaagatacacgataaagggcatcagaaacttaattttttacgaactgcctacctacccccacttttactctgagatatgtaatatgctgagggccacaaatcggggagaggaggccacatggacctgtacggtgctatactccaaatatgacgcccaaaggttggctgccgtggtcggcgtcgagagagccgcacagatgctgcagagtaacaagaacgtccacctattcattactggtgagaagtag

SEQ ID NO: 22779 - DNA, 942 bp, Artificial Sequence
  Description of Artificial Sequence: Synthetic coding sequence
atgccgaaggtgaagtccggcgcaatcggcagacgaagaggaaggcaggaacagcgtagggagctgaaatcagcaggcggactgatgtttaacaccggcattggtcagcacattcttaaaaatccgctaatcattaattcaatcattgacaaagcagcactgcgcccaacagatgttgtccttgaagtcggtcctggaacagggaatatgacagtcaaactgctcgagaaggctaagaaagtcgtggcttgcgagttggatcctcgtctggtcgctgagctgcacaaaagggtccagggaacccccgtcgctagtaaattacaggttctggtaggcgacgttcttaagaccgacctgcccttttttgacacttgtgtcgccaatcttccatatcaaatcagtagcccctttgtgttcaagctcctcctccacagaccctttttcaggtgcgccatcttgatgtttcagagagaatttgcgctgcggttagtggccaaacccggagataagttgtattgcagactgtctatcaatacacagttgctcgcgagggttgatcaccttatgaaggtcggcaagaacaacttcaggccaccgcctaaagtggaatcatctgttgtgaggatcgagccaaaaaatccccctccccctattaacttccaggaatgggatggcttggtcaggattacttttgtgcggaagaataaaactcttagcgcggctttcaaatcgtctgccgttcaacagttgttggagaagaactacagaatacactgcagcgtccataacattatcatccctgaggatttctcaattgccgacaagatccagcagattctgacgtctacaggcttctccgacaagcgagcgaggtcgatggacatagacgacttcataagactcttacatgggtttaacgcggagggcatacatttcagttag

SEQ ID NO: 22780 - DNA, 4719 bp, Artificial Sequence
  Description of Artificial Sequence: Synthetic coding sequence
atggccgacagaggatgccctctggaagccgcaccccttcccgcagaagtccgcgaatctttggctgagcttgaacttgaactcagcgaaggcgatatcacacaaaaggggtatgagaagaagagagccaagctcttggctagatacatacctctgatccaggggatcgacccatcgttgcaggccgagaaccgcatccctgggccttcccaaaccaccgctgcggcaccaaaacagcagaagagcaggcctactgcctcacgggatgagaggttccgctctgacgtgcacacggaagcagtacaggcagctctggcaaaatataaggagcggaaaatgccaatgcccagtaaacggcgaagcgtgcttgttcactcatcagtcgaaacatacacgccgcctgacacttctagcgcgtctgaagacgaggggtctttgagacggccaggtcggctcacgtctacaccactccaatctcacagctccgttgaaccatggctcgatagagtcattcaaggctcctccacctccagcagcgcctcgagtacgtcttcgcacccagggggacggcctaccactgcaccttctgctgcagcgacacccggtgcggcagcgacaacagcccttgcgggactggaggcccacactcacattgccgatctgcactcggcgccacctgacgtcactacgggtctggttgagcacagttactttgaaagaccgcaggtcgcatcggtgcggtctgttcctcgaggttgttcggggagtatgctcgagacagcagatggagttccagttaactcgcgagtaagctcaaagatacagcaactgctcaacacactgaagcgtcctaagcggccaccactgaaagaattttttgttgatgactttgaagagctgttagaagttcagcagcccgacccgaatcagcctaaaccagagggatccgagacttcagtgcttcgaggagagcctttgacagctggtgtgcctaggcctccttcgctcctggccacccttcagcgttgggggacgacccagcccaaatcaccatgcctaacagctttggacacaacaggaaaagctgtgtataccctaacgtacggcaagctctggtccagaagtctgaagctcgcgtataccctactgaataaactaacatccaaaaacgaaccgctgcttaagccaggcgacagagtggccctggtcttccctaatagtgaccccgtgatgtttatggtcgcattctatggctgcttgcttgctgagctcgtgcctgtgcctattgaggtaccactgacacgcaaggacgctgggagtcagcaagtaggctttctgctgggctcctgcggcgtcttcctggctctgacaacggatgcgtgtcagaaaggtctccccaaggcgcagaccggagaggtggccgctttcaaaggatggccacccctatcttggttagtcatcgacggaaaacacctcgccaaacctccgaaggattggcatcccttagctcaggatactggaactggcaccgcatacatagaatacaagacttccaaagaggggtctacagtgggcgtcaccgtgtcacatgcgtcattactggcacagtgtagagcactaacacaggcttgcgggtactcggaggctgaaacgttgaccaatgtgcttgacttcaagcgggatgcaggactatggcacggagtgctgactagtgtgatgaaccgcatgcacgtggtgagtgtcccctatgcactgatgaaagcgaacccactatcatggattcagaaggtatgtttctataaagctcgtgcagctcttgtgaaatctcgagacatgcactggagtctgctagcgcagcgagggcagagagacgttagtctcagctctctgcgtatgctgatcgttgctgacggagctaatccctggagtatcagcagttgtgatgcctttctaaacgtttttcagagtagagggctgcgccctgaggtaatctgcccttgcgcatcgagccccgaagctctgactgttgcaattcgcaggccaccagatctgggcggacctcctcccagaaaggcagtgctttcaatgaacggtctgtcctacggcgtcattcgtgtcgacacagaagaaaagctgtcagtcctgactgtgcaagacgtgggacaagtaatgcctggggctaacgtgtgtgtggttaagctggagggaaccccctacctctgtaagactgacgaggtcggggaaatctgcgtgtcgtccagtgccacagggacagcctattacggactactgggcatcacaaagaacgtgttcgaagctgtgccagtcactaccgggggtgccccaatcttcgatagaccctttacacgcaccggtctgttaggatttattggacctgacaacctggtgttcatcgtgggaaagctggacggcctgatggtcacgggcgtgcgacgtcataatgctgatgatgtggtagccaccgctctggctgtggaacccatgaagttcgtatacagagggagaatagccgttttttctgtcactgtgctgcatgacgaccggatcgtgctagtcgccgagcagagacctgatgcctctgaagaggactcctttcagtggatgtcacgagttttgcaggcgattgatagcattcatcaagtgggcgtatattgtctggctctggtgccagccaacacgctgccgaaagcccctctgggaggcatacacatctccgaaacaaagcagcgatttcttgagggcacactgcacccatgtaacgtcctgatgtgcccccacacatgcgtgactaacttgccgaagcctcgccagaaacagcccgaagttggacctgctagcatgatcgtcgggaacctagtggctggcaagagaatcgcacaggcgtctggtagagaactcgcgcatctggaagacagcgaccaggcaagaaaattcctctttttggcagacgttctgcagtggcgtgctcacaccaccccagatcatcccctttttctcctcctgaatgctaaggggacggtgaccagtacagctacctgcgtccaattgcacaaaagggctgagcgagtagccgctgcgctgatggagaaggggaggctgtcagtgggcgaccacgtggccctggtataccccccaggcgtcgacctcatagccgctttttacggctgtctatattgcgggtgcgtgcctgtaacagtgcggccaccgcacccccagaatttgggaactaccttgccgacagtgaaaatgatcgtggaagtcagtaagagcgcttgcgtgctgacaactcaggcggtgacccggctcctcaggtcaaaggaggcggcagcggctgtcgatattagaacttggccaacaattctagacactgatgacattccaaaaaagaagatcgcatccgtgttccgcccaccatcaccggacgtgctagcctacctcgacttctcggtaagtactaccgggatccttgctggtgtgaagatgtcccacgctgccacgagcgccctgtgtagaagtattaaactacaatgtgagctgtacccgtctcgccagattgccatctgcctcgatccttactgtggcctcgggtttgccctgtggtgcctgtgctcagtgtatagcgggcatcagagcgtcttggtgccacccctagaactagagtcaaatgtgtctttgtggttgagtgcagtgtctcagtacaaggccagagtcacattctgttcctatagcgtaatggaaatgtgtacaaaaggcttaggcgcacaaacaggtgtgttgagaatgaaaggcgtcaacttgagctgcgtgcggacatgtatggtggtagccgaggagcggcctagaatagccctaacacagagcttctcgaaacttttcaaagacttgggtcttccagctagggctgtctcaaccaccttcgggtgcagagtcaatgtagccatctgcctgcagggaactgccggtccggatccaactaccgtgtatgttgacatgagggcactcagacatgatcgcgtgcggcttgtggagcgtgggagtcctcactccctgcctctgatggagagtggaaagatactacccggagtcaaggtgatcatcgctcacactgagaccaagggtccgttaggagacagccacctgggggagatatgggtgtcttccccgcacaacgccacaggctactatacggtctatggcgaggaagccctgcatgctgaccatttctccgccaggctgagcttcggagacactcaaacaatatgggcacgtactggctacctgggtttcctgcgacggactgagcttaccgatgccagtgggggacggcacgatgctttatacgtggtgggaagcttagacgaaactttagaactaagagggatgagataccatcctatcgacattgaaactagtgtcatccgagctcatcgaagcatcgccgaatgcgccgtatttacctggacgaatttgctcgttgtggtggtagagctggacggactggaacaggacgccctcgacctggtggctcttgttactaatgtggtcctggaggagcactatctcgtcgttggagtggtcgtgatagtggatccaggtgtgatccctatcaactctaggggggaaaagcagagaatgcacctgcgggatggtttcttagctgatcagttagacccgatctatgttgcctacaacatgtag

SEQ ID NO: 22781 - DNA, 2394 bp, Artificial Sequence
  Description of Artificial Sequence: Synthetic coding sequence
atggcggatagaggctgccctctggaggccgcaccactgcctgccgaagtacgggaaagcttagcagagcttgagctggagctgtctgagggagacatcacccagaaaggctacgagaagaagcgcgctaaactgctggctagatacattcctcttatccaggggatcgatccctctttacaggctgaaaacaggatccccggaccgagtcagactaccgcagccgctcccaagcagcagaagtcaagaccaactgccagtcgcgatgaaaggttcagaagcgacgtccatacagaggccgtgcaggctgctctagcaaaatataaggagagaaagatgcccatgccttccaagagacggagcgtgctcgtacattcttctgtggaaacgtatactcctcctgacaccagcagtgcaagtgaagatgaaggcagcctgaggcgtcccggacgactgacctccactccactccagtcccattcctcagtggaaccctggttagatagggttatccaaggcagttccacatccagttcggccagcagcacaagctctcaccctgggggacgccctacaactgccccttctgccgctgccacccctggcgctgcggcaaccacagctcttgctggcctggaggcgcatactcacatcggagtgcctgtgaattccagagtgagcagtaaaattcagcagctgctcaataccctgaagaggcccaaaagaccgcctctcaaggagttcttcgtggatgactttgaagaactcctggaggtgcaacagcccgatcccaaccaaccaaagcccgaggggtccgaaacgtctgtgctgcggggagaaccgctcaccgcaggcgttccgcgaccacccagtttattagcgaccttacagaggtgggggacaactcagcctaagtctccctgtctcactgctcttgacacaacaggtaaagccgtctacaccctgacctacggaaagctttggtcacgctcattgaagttggcatacaccctcctcaacaagttgacttctaagaacgagcccctgcttaaacctggagacagggtggccctggtgtttcccaattcagatcctgttatgtttatggtcgctttttatgggtgtctgctggccgagctggtccctgtgccaatcgaagtccccttgacgagaaaggatgctggtagtcagcaggtcggatttctgcttggaagttgcggagtattcctggctctgactacagacgcctgtcagaaaggtctccctaaagctcaaactggcgaggtcgcagcattcaaaggttggccccctttatcctggctcgttatcgacggcaagcatcttgctaagccacccaaggattggcatccactggcccaggatacaggcactgggacggcgtacattgagtacaagacctctaaggaggggagcaccgtgggagtcaccgtctcacacgcttccctgctggctcagtgcagggctttgacgcaggcctgtggttactccgaggctgaaaccctgaccaacgtgcttgactttaaacgcgatgccggtctgtggcatggagtactgaccagtgtgatgaatagaatgcatgtcgtgtctgtcccctacgccctcatgaaggccaaccccctgtcctggattcaaaaagtatgcttctacaaggcaagggcggctttggtaaaatcccgggacatgcactggagcctgttggcacagagggggcagcgcgatgtgagcctttcgagtctcaggatgttgatcgtcgctgacggtgcgaatccttggtctatcagtagctgcgatgccttcctcaacgtcttccagagccgcggtttacgtccagaggtcatctgcccctgtgccagctctccagaagcccttacagttgccatccgtcggcctccagatctgggcggaccacccccaagaaaagcggtgttatcaatgaacggcctctcctacggggtcattcgagtggataccgaagagaagctatcagtcttgactgtgcaggatgtcggacaggtcatgcccggagccaacgtgtgcgtggtgaaattagaaggcacaccttatctgtgtaaaaccgacgaagtgggagagatctgcgtgtcctcgtctgccacaggaacagcctactatggacttctggggatcaccaagaacgtcttcgaggccgttccagtgactacaggcggagccccaatattcgaccgtccgttcactaggactggcctcctgggatttattggacccgataaccttgtcttcatcgtgggcaaactggatggtcttatggtaactggagtccggagacataacgctgatgacgtcgttgcaactgctttagctgtggagccgatgaagttcgtatatcgaggctag

SEQ ID NO: 22782 - DNA, 4704 bp, Artificial Sequence
  Description of Artificial Sequence: Synthetic coding sequence
atggccgacagaggatgtcccctagaagccgcaccacttcccgcagaggttagggagtccctagcggagctggagctggaattatccgaaggggacatcacacagaagggctatgaaaaaaagcgcgctaagctgcttgcaagatatatccccctgatccaaggcattgatccttccctgcaagcagaaaatcgtatcccaggcccttcccaaacgacagcggcagcacctaagcaacagaaatcaagaccaactgctagcagggatgagaggtttcggtctgacgtgcataccgaggcggttcaggcagcccttgccaagtataaagagcggaagatgcctatgccgagtaagaggaggtcagttttggtgcattcgtctgttgagacatacaccccgcctgacacatcctccgccagcgaagatgaaggaagtttgcgacgcccaggtcggttgacttcaactcccctgcaatcccattcgagcgtcgagccatggcttgatcgggtaattcaagggtctagcacatcaagctcagctagttctactagctctcacccgggaggcaggcccactacagcccctagcgcggcagccactccgggtgctgccgcaacgaccgccctggctggcctcgaggcgcacacgcacatcgatcttcactccgcccctcccgatgtgacaaccggtttggtcgagcatagctacttcgagcggcctcaagtggcgagcgttagatctgtgccacggggatgctccggctcaatgctggaaactgcagatggggtgcctgttaactcccgcgtctccagcaaaatccagcagctcctgaacactctcaaacgaccgaagcgaccaccactgaaggagttcttcgtggacgatttcgaagaactgttagaagaccctaatcaacccaagccagagggctcagagacttctgttctgaggggagagccactgacagccggtgtcccaaggccaccaagcttgcttgccaccctccagcgctggggcactacccagcctaagtctccctgtctcacggcccttgacaccacaggcaaggctgtctatacactgacctatggcaagttatggtcacgaagtctgaagcttgcctatactctgctcaacaagctcacgtctaaaaacgagcctctgctcaagcccggtgatagagtcgctttggtcttccccaatagcgatccagtaatgtttatggttgctttttacggatgcttgctggccgaactggtgccagtccctatagaggtccccctgactcgaaaggatgcaggctcgcagcaagtcggcttcctgctggggagttgtggcgtgttcctggctctgacaacagatgcatgtcagaagggcctccctaaggcccagactggcgaggtagccgcatttaaaggctggcccccactgagctggctcgtcatcgatggtaaacatctcgcaaagccccctaaggactggcacccccttgctcaggatacggggacgggcacggcttatatcgaatataagacctccaaagagggatctaccgtgggggtcactgtgtcacacgcctcactgctcgcccagtgcagggccctgacgcaggcctgcggctactctgaggccgagaccctgacaaatgtactggacttcaagcgggacgccggtctgtggcacggtgtgcttacatcagttatgaaccggatgcatgtggtctctgtcccctatgcgctcatgaaagcaaatccactctcatggattcaaaaggtctgtttttacaaggccagggctgcactggtgaagtccagagatatgcactggagcctcctagcacagagaggtcagcgggatgtctcacttagctcattaagaatgctaattgtggcagatggagcaaacccctggagcatctcctcctgcgatgcattccttaacgtatttcagtcaagaggcttgcgcccagaggtgatatgtccgtgtgcttcttcccctgaggccctcaccgtggccattcgtaggccgcctgacctcgggggtccaccacctaggaaagcagtgctgagcatgaacgggctgagttatggagtgatccgggtcgacaccgaggaaaaactgagtgttcttacggtccaggatgtgggccaggtgatgcctggggcaaatgtatgtgtggtcaagttggagggcaccccatacctctgcaagaccgacgaggtcggagagatttgcgtgtccagctctgcaaccggaaccgcttattacggactgctagggattaccaagaatgtgttcgaagctgtccccgtcacaacaggcggtgctccaatctttgataggcctttcaccagaacgggcttgctcggatttatcggcccagataatctggtatttattgttggcaaactagacgggctgatggttacgggcgtgaggcgccacaacgccgacgacgttgtggctacagccctggcggtggaacctatgaaatttgtttatcgtggtcggatcgctgtgttcagtgttacagtcctccatgatgatagaattgtcctggtggcggaacagcggcctgatgcgtctgaggaggattcctttcagtggatgagccgggtgctgcaagcgattgattcaatccaccaggttggggtgtactgcctcgccctggtacccgctaacacccttccgaaagctcctcttggaggaatccatatctcagaaactaaacagagattcttggaggggacccttcatccatgtaacgttctgatgtgcccacacacatgcgtaactaacctgcctaagcccaggcagaaacagcctgaagtgggccctgcctcaatgatagtcggaaacctagtggcaggtaagaggatcgcccaggccagcggacgggagctcgcccacttagaggatagtgatcaggctcggaagttcctgtttctggccgatgttctccagtggcgcgctcacaccactcccgaccaccctttattccttttacttaacgccaagggcactgtgacctcaacagcgacctgcgttcagcttcacaagagagccgagagggtcgcagcagccttgatggagaagggtcgcctgagtgtgggggaccacgtggcacttgtctacccccctggcgtagacttaattgccgctttctatggctgcctatactgtggttgcgtgccggttactgtaaggccgccacaccctcaaaatctgggaacaacgctgcccaccgttaagatgatcgtcgaagtgtcaaaatccgcatgtgtcttaactacccaggcagtgacacggctcctgagaagcaaggaagccgctgccgcagtggatattcgaacctggccaaccattctagataccgatgatattcctaaaaagaaaattgcaagcgtgttccgcccaccatcacctgatgtgctcgcttatttagatttcagcgtgtccacaacaggcatcttggcaggggtgaagatgagtcacgctgccaccagcgctctctgtcgaagcatcaagctgcagtgcgaactgtaccccagtagacagattgcaatctgccttgatccgtattgcgggctaggctttgccctctggtgcttgtgttctgtgtacagcggccaccagtccgtactggttccaccactcgagctggaatccaatgtgagtctctggctgagtgcagtgtcacaatacaaagcccgtgtaacattctgttcgtactcagtgatggagatgtgcacaaagggcctgggggctcaaaccggtgtattgcggatgaagggtgtgaacctgtcttgtgtgagaacttgtatggtggttgctgaagaaagacctaggattgctttaacacagtcctttagcaagctgtttaaagacctaggcctacccgcaagagccgtgagcaccacatttggatgccgcgtcaatgtggccatctgcctccagggtacagctggacctgacccaacaacggtgtacgtggacatgcgggctctgaggcatgaccgcgtgcgcctggtcgagcgcggtagccctcacagcctgcccttaatggagtcgggtaagatactgcccggagtgaaagtgatcatagctcacactgagaccaaggggccactaggcgattcacatcttggggaaatctgggtgtcctccccacacaatgccacaggttattacacggtgtatggggaggaggccctgcatgcagatcatttctcagccaggcttagctttggtgatacacagactatctgggccagaacgggctatttgggcttcctacggaggaccgaactgaccgacgcttccgggggaagacatgacgcgctctacgtggtgggaagtttagatgaaacactagaactgagagggatgcggtatcacccgatcgatatcgagacttcagtcataagggctcacaggtcaattgctgaatgcgctgtctttacgtggactaatttgctggtggtcgttgtagagctggacggtctggaacaggatgctctggatctggttgcacttgtgacgaacgtggtgctggaagagcactacctggtggtgggcgttgtggtgatagtggacccaggggttatcccaatcaatagccgcggtgaaaagcagcggatgcatctcagggacgggttcctagccgatcagcttgatccaatctacgttgcttacaacatgtag

SEQ ID NO: 22783 - DNA, 4716 bp, Artificial Sequence
  Description of Artificial Sequence: Synthetic coding sequence
atggctgatcggggatgtccattggaggcggcacccctgcctgctgaggttcgcgagtcgctggccgaactcgagctggagcttagtgagggggatatcacccagaagggatacgaaaaaaagcgggcaaaattactggctaggtatatacccctgattcaaggaatcgacccttccctccaggccgagaataggattcctggtcctagccagactaccgctgccgctcccaagcagcagaaaagtaggccaacggcatcaagagatgaacgctttagatccgacgttcataccgaggcagtgcaagcggcactggcgaaatataaggagcggaaaatgccaatgccatcgaaacgacggtccgttcttgttcacagtagcgtggagacatatacacctcccgatactagcagtgcctcagaagacgagggttctctccgaaggccgggtaggctcacgtccacaccactccagtcccatagctctgtggagccttggctggacagagtcatccaggggagctcaaccagctcctccgcgagtagcacctcttctcaccctggaggaaggcctaccacagcaccaagtgccgctgcaacacccggtgctgccgctaccactgctctggctgggctggaagctcacacacacatcgatctgcacagtgcaccgcctgacgtgacaactggccttgttgaacatagttacttcgagaggcctcaggtggcaagcgtgcgctcagtgccccgtggctgctcaggatctatgctggaaactgcagatggggtgcccgtaaattcacgcgtaagctcaaagattcagcagctgcttaacaccttgaagaggccaaagaggcctcctcttaaggaattttttgttgatgattttgaagaactcctggaggtacagcaaccggacccaaatcagcctaaacctgaaggatccgagacgagtgtgctaagaggtgagccattgacagctggggtgcctaggcctccctcactcctggccaccctgcaaagatggggaaccactcagcctaagtcaccctgtttaaccgccctggacacgacgggcaaggctgtctatacccttacatacggcaagctctggagcaggtccctgaagttggcctatactctgctaaacaagctcacctccaaaaacgagccactgctcaagccaggcgatcgcgtcgctctcgttttccccaacagcgatcctgttatgttcatggtagccttctacggttgcttgctcgccgagctcgtgcctgttcccattgaggtgcccctgactagaaaagatgccggttctcagcaggtaggctttctcctgggatcatgtggcgtgttcttggctttgaccaccgacgcctgtcagaagggtctccccaaggctcagacaggcgaagtggccgcatttaaggggtggccacctctgtcttggctcgtcattgacggaaagcatctcgctaagcccccaaaagattggcatccccttgctcaggacaccggtactgggaccgcttacatagaatacaaaacgagcaaggagggcagcaccgttggcgtgacagttagccatgcgtccctgctggcacagtgtagggccctgacccaagcctgcgggtactcagaggccgagaccctgacaaatgtacttgatttcaagcgagacgctggcctctggcacggagtcctgacttcagtaatgaataggatgcacgtggttagcgtgccctacgcactgatgaaggctaatcccttaagctggatccagaaggtctgcttttacaaagccagggcggcacttgtgaaaagcagagatatgcattggagccttttagcacagcgtggacagcgggacgttagtttgtccagcctgcgcatgctcatcgttgccgacggagctaatccttggagtattagttcttgcgacgctttcttgaacgtgtttcagagcagggggctccgccctgaagtgatttgcccctgtgcctccagccctgaagctctcacagtggcgattcggcgaccaccagacttgggcggaccaccccctagaaaagctgtgctgagtatgaacggactgagttacggcgtgatcagggttgatacggaagaaaaacttagtgtgctgaccgtgcaggatgttggccaagttatgccaggtgctaacgtgtgcgtagtaaagctcgaggggactccgtatctttgtaagactgacgaggtcggcgaaatctgcgtgtcctcctccgctacaggtactgcgtattacgggctcttgggcattactaaaaacgttttcgaggccgtccctgtgaccaccggtggcgcacctatttttgatagaccctttactaggactgggctcctgggttttatcggccctgataatctggtcttcattgtgggcaagctggacggcttaatggtaacaggagtgcggagacacaacgcagacgatgtcgtcgccaccgctttagcagttgaacccatgaaatttgtttatcgcggaaggattgcagtgtttagcgttaccgtcctgcatgatgatcgcatagtgctagtcgcggagcagcgtcctgacgccagtgaggaagactcctttcagtggatgtcccgtgtgctccaggccatagactccattcaccaggtcggagtgtactgccttgcgttagtgccagctaacaccttgcccaaagcgccacttggtggtattcacatctctgagaccaaacagcggtttctcgaggggacactgcatccatgcaatgtcctgatgtgtcctcatacctgcgttaccaatttgcctaagccccgacagaagcagcctgaagtgggaccagccagcatgattgtgggcaatctggtcgcgggaaaaagaattgcccaggctagcgggcgagagctcgcccatctggaggattcagatcaggcgaggaagtttctattcttggccgacgttctgcaatggcgggcacacacgacaccggatcaccccctttttctgctgttgaatgctaaaggcacagtcaccagcaccgctacttgcgtccagctccacaagcgcgctgagagagttgccgctgcgctgatggagaaaggcaggctaagtgtgggagaccatgtggcgctcgtctacccgcctggtgtcgacctgatcgccgctttttatggctgcctctattgtggatgtgtgccagttacggtgaggccgcctcacccacaaaaccttggtaccactctccccacagtgaaaatgattgtcgaggtatctaagagtgcatgtgtcctgacaacacaggctgttacaagattgctccgctcgaaggaagctgctgcagcggtcgatatcagaacgtggccaacaatcctcgacacggacgacattccgaagaaaaaaattgccagtgtgttccggcctccatctcctgatgtacttgcctacctggattttagcgtgtcaacaaccggcatcttggcaggggtgaaaatgagtcacgccgctacatcagctctttgccgctccatcaagctccagtgtgagctctatccatctagacaaatcgccatttgtctggatccctactgcggtctgggattcgccctgtggtgcttgtgcagtgtgtattcagggcaccagtccgttcttgtgcccccacttgagttggaaagtaatgtcagcctctggctttccgccgtcagccagtataaggcaagagtgactttttgcagctacagtgtcatggaaatgtgcactaagggcctaggggcacagaccggagttctgagaatgaaaggcgttaacctgtcatgcgttcggacatgtatggtcgtggccgaggagaggcctagaattgccctgacgcagtcattttcaaaactgtttaaagacctaggcctacccgctagagcggtgtcgactacttttgggtgccgggtcaatgtagctatttgcctgcaaggaactgccggacccgatcccacgaccgtgtatgtggatatgcgtgctctacggcatgaccgggtcagactcgtggagcggggtagcccgcacagtcttccgctgatggaatcgggcaaaattctaccaggagtgaaagtaattattgctcatacggagaccaaaggtccactcggcgatagccatcttggcgagatttgggtgtctagcccccacaacgctacaggttactacaccgtctacggagaggaggccctgcatgctgatcactttagcgccaggctgtcattcggggatacccagacaatttgggctagaaccgggtatctgggattcctgcggaggactgagctcaccgacgcaagcggaggccgacatgatgccctgtatgtggtcgggtccctggacgagactctagagctcagggggatgaggtaccacccaatcgatatcgagacgagcgtgatcagagcacatcgtagcatcgccgagtgcgcagtattcacgtggactaatctgctggttgtggtcgttgagttggatgggttggaacaggacgctttggaccttgtggccctggtgaccaacgttgtcctggaggagcactacctggtggtgggggtcgtcgtcatcgttgatcccggtgtgattcctataaattcacgcggagaaaaacagcgaatgcacctcagggacggattcctggctgatcagctcgacccaatatacgtggcgtacaacatgtag

SEQ ID NO: 22784 - DNA, 3333 bp, Artificial Sequence
  Description of Artificial Sequence: Synthetic coding sequence
atggctgatagagggtgcccccttgaggccgcacccttgcccgcagaagtacgtgagtctctggcagaattagagctggagttaagtgaagatgtgcataccgaggctgttcaggctgctctcgctaagtataaggagagaaagatgcctatgccaagcaaaagacggtcagttcttgtccacagttcagtagagacatacacgcctcccgacacttcgagtgcgtcagaggatgaaggttccctccggaggccaggacgtttgacctctacccctctgcaatcgcattcctcagtcgaaccatggctagatcgcgtcattcagggctcctccactagttcttctgcctcctcgacttcctctcatccaggaggtcgtccgacaactgctccatcagcagctgctacacccggagccgctgcaaccaccgcattagcaggcctcgaagctcacacacatatcgacctgcactctgctccaccagacgttacaactgggctggtagagcactcatatttcgagcggcctcaggtcgcttccgtgcgttccgtgcctcgcggttgctccggttctatgctagagacagcggacggtgtccccgtgaactccagggtcagtagcaaaatccagcagctcttaaacacgctaaagagaccgaagagaccacccctaaaagaattttttgtggatgactttgaagagctccttgaagtccaacagccggatcctaatcagccaaagccagagggatctgagacctctgtcctgagaggtgagccgctgacagccggagttccaagaccaccatcattgttagccactctgcagcgatggggcacaacacagccgaagagtccctgtctgactgctttagacaccacagggaaggcagtttatactctgacctatggcaaactttggagcagaagtcttaaactggcttacaccttgctcaacaagctgacttccaaaaacgaaccccttctaaaaccaggggaccgcgtggctctcgtttttcccaatagtgatccggtaatgtttatggtcgccttttacggctgtttgttggctgagctcgtgcctgtgcccattgaagtacccctgacaaggaaggacgctggttctcaacaagtcggcttcctcctggggagttgcggggttttcctggccctcactaccgacgcatgtcagaagggcctgcctaaggcccaaaccggggaggttgccgcttttaaaggatggccacccctgtcctggttggtaatcgatggaaaacacctggcgaaaccgccaaaggactggcatcctctggctcaagataccggaaccggcaccgcctacattgaatataagacatcaaaggagggctcaaccgtaggcgtcaccgtctctcacgcatctttgcttgcacagtgcagggccctcacccaggcttgtggatacagcgaggccgagaccttaactaacgtcctggactttaaacgggacgctggactgtggcacggcgtactcacctcagtgatgaacagaatgcacgttgtgtccgtcccctacgccctaatgaaggctaaccccctcagctggatccagaaggtgtgtttttacaaggcacgcgctgccctggtcaagagcagggacatgcattggtctctgctggcccagaggggccagcgtgatgtgagcctgagcagcttgcggatgctgattgtggcagatggagcaaacccctggtctatcagtagctgtgatgcatttctcaacgttttccagtcccgtggtttgaggcccgaagtaatttgtccatgcgcctccagccctgaagcacttaccgtggccatccgcaggcctcctgacctcgggggaccccctccaagaaaggccgtgctgagcatgaacggactgtcatacggggttatcagagtcgataccgaggagaagctgtctgtacttaccgtacaggacgtgggccaggttatgcctggagcaaacgtctgcgtagtgaagctagaaggcacaccttacctttgcaagaccgacgaagtaggcgagatctgcgtgtcttctagtgcaactggaactgcttattacggtcttctggggataacaaaaaatgtgttcgaggctgtgccagttaccaccggcggagctccaatcttcgacaggccttttacccgaacaggattgttggggtttataggacctgataacctggtgtttatcgtgggaaaactggacgggctgatggtcacaggagtgagacgccacaatgccgatgacgtggtggcaaccgccctcgctgtagagccaatgaaattcgtgtaccgagggagaatcgcagtgttctctgtgaccgtactgcacgatgaccggattgttctcgttgcagagcaacggcctgatgctagtgaagaggacagctttcaatggatgagcagggtattacaggccatcgactcaattcatcaggtgggcgtctattgtttggccctggtgcctgcaaatactctgcccaaagccccactcgggggaattcacatctctgaaaccaagcaacggtttcttgaaggaaccctgcacccatgcaacgtgcttatgtgtcctcacacatgcgtcaccaatctgcccaagcccaggcagaaacagccggaagttggtccggctagcatgatcgtcgggaacctggttgccggaaagaggattgcacaggcctctgggagggagcttgcacacctggaagactcagaccaagctaggaaattcttatttctggccgatgtgctgcagtggagagcccacactacccccgatcatccactgttcctgctcctcaacgcaaagggcactgtgacgagcaccgcaacatgtgtccagttgcataagagggctgagcgcgtcgccgcagcccttatggaaaaaggaaggctgtctgtgggagaccatgtagctttagtatacccgcctggcgtggacctgattgccgctttttatggctgtctgtattgtgggtgcgtacccgtgactgtgcgtcctcctcacccacaaaatctggggaccaccctgccaaccgtgaagatgattgtggaggtatccaaaagtgcatgtgtcctcactacccaggcagtcactcgactgctgaggagcaaggaagccgctgctgctgtcgatatcaggacttggcctacaatattagacacagacgatattcctaagaagaaaatcgcgagtgttttcaggccaccatctccagatgtgctcgcttacctcgatttctcagtgtcgacaacggggatccttgctggtgttaaggctggtagggggggttccagattatag

SEQ ID NO: 22785 - DNA, 2526 bp, Artificial Sequence
  Description of Artificial Sequence: Synthetic coding sequence
atggccgacagaggctgccccctcgaagctgcaccactccctgcagaggtccgcgagagtttggctgaactggagctggaattgtcagagggggacatcacgcaaaaaggctatgaaaagaaacgagctaagctacttgccagatacattcccctgattcaggggatcgacccctcactccaggcggagaatcggattccgggtccaagtcagactacggcagccgctcccaaacagcagaaatcccggcctacagcttcccgcgacgagcgcttccggagtgatgttcatacggaggcagtccaggcagctctggccaagtataaggaacggaaaatgcccatgccctctaaaagacggtcggtcctggtgcatagttccgtcgaaacctacactcccccagatacaagcagcgcaagtgaagacgagggctcactcaggcggcctggaagactgacctccacacccctgcaatcgcactctagcgtcgaaccctggctcgatcgggttatccagggatcaagtacatcatcatccgccagcagcactagctcccatcctgggggacgcccaactacagcaccaagtgcagcggctacacctggtgccgctgccaccaccgccctggctggattggaggcccacactcatatcgatcttcacagtgcacccccagatgttaccaccgggctcgttgaacactcctacttcgagcgtccacaggttgcctcggtgcggtctgtgccaaggggatgtagcgggagcatgttagaaactgccgatggcgtcccagtcaatagccgggtgtcttccaagatacaacagctgctgaacacccttaaacgcccaaaaaggccccctctcaaggagttttttgtcgatgactttgaagagctgttagaagtccagcagcctgaccctaatcagcccaaacctgagggaagtgagacgagcgtgctccggggtgagccactcactgccggagtccccaggcctccgtccctcctcgcaacgctccagagatggggaactacccagccaaaatcaccgtgtttgacagccctggacacaacaggaaaagccgtgtacacactcacgtacgggaagctctggtctcgcagcctaaaactagcctacacgttattgaataagttaactagtaaaaacgagcctctcttaaaaccaggcgatagagtcgccctggtgttccctaattcagaccctgtcatgtttatggttgccttctatggttgtctgttggctgagctggtccccgttcccattgaggtgcctctgacgcggaaagacgcaggaagccagcaggtgggcttcctgttaggttcttgcggcgtgttcctagcgcttacgaccgacgcttgccagaagggtctcccgaaggctcagaccggcgaagttgcagccttcaagggctggccaccattgtcctggctggtgatcgacggcaagcatcttgcaaagcccccaaaagactggcatcccctggcgcaggatactgggacaggcacggcgtacattgaatataagacttcaaaagaagggtccaccgtgggagtcacagtgagtcacgcctccttgctggctcagtgtagagctctcacacaggcctgtggctacagtgaagctgaaacacttacaaatgtccttgactttaaaagggacgctgggctgtggcacggggtgctgacatccgtgatgaatcggatgcacgtagtttccgtgccctacgcactgatgaaagccaatccactgtcatggatccagaaggtctgtttctacaaggcgagagccgctctcgttaagtcacgggatatgcactggtctcttttggcccagcggggtcaacgagacgtgtcgctgtcatctctgaggatgttgattgtcgccgacggcgcaaatccatggtcaatatcttcgtgcgatgctttcctcaacgtctttcaaagcaggggcctcaggcccgaggtcatatgcccctgcgccagttctccggaagcactgactgtcgcaattagaagaccccctgatctaggtggccctcccccacgaaaggcagtcctttccatgaacggtctttcatatggcgtgattcgcgtggacacagaagagaagctgtcggttctaaccgtacaagatgtgggccaggtcatgcctggtgcgaatgtctgcgtcgtcaaactggagggaacaccctacctttgtaagacggatgaggtgggcgagatctgcgtttcctcttccgcaacagggacagcctactatgggctgctgggcatcactaagaatgtgttcgaggccgtacccgtgacaactgggggagcaccaatctttgaccgcccttttacgagaaccggtctgctgggattcatcgggccagacaatctagtctttatcgtgggcaaactggatggcctcatggtgaccggcgtccgtcgccacaacgccgatgatgtcgtggccacagcccttgcagttgagcctatgaagttcgtgtaccgaggcagatag

SEQ ID NO: 22786 - DNA, 2670 bp, Artificial Sequence
  Description of Artificial Sequence: Synthetic coding sequence
atggccgaccgcggatgccccctggaagctgccccactgcccgctgaagttcgagagtccttggccgaactggaactcgagctctcagaaggggacatcactcagaaggggtatgagaagaaacgcgcaaagttgttagctagatatattccattaatccagggtattgacccttctttgcaagcagagaatcggatccctggcccaagtcagaccaccgcagccgctcctaaacagcagaagtctcggccaaccgccagtcgtgatgaaaggtttcggtctgacgtgcacaccgaagctgtgcaggccgctctggcaaaatacaaggagcgtaaaatgcccatgcccagcaagcgcaggagtgtgttggtccattcctccgtggagacctacactcctcctgacacttcatcagcgagcgaggatgaaggcagtctgaggagaccaggtcgccttacaagcacccccctacagtcgcactccagcgtggagccctggcttgatcgcgtaatccaaggctcatcaacaagtagttctgcatcttccactagctcccacccgggtgggagacctaccacagcgcctagcgccgctgcgacacctggcgcagctgccacaacggcactcgcaggtctggaagcacatacacatattgacttgcacagcgctcctccagacgtgactaccgggctcgtcgagcactcctattttgaaagaccccaggttgcttctgtccgcagcgtccctagaggctgttctgggtcaatgttggagaccgcggacggagtcccagttaacagtcgagtaagttctaaaatccagcaactgctgaataccctgaagcgccctaagaggccaccattgaaggagttctttgtggatgacttcgaggaacttctggaggtccaacaacccgaccctaaccagcccaagccggaagggtccgaaacatccgtgctgcgcggagagccactgacagcgggtgtgcccaggcccccttccctcctcgcaactctgcagcggtgggggaccacacaaccaaagagtccctgcctgacagcactggataccacaggaaaggctgtttacaccctcacttacgggaagctatggtcccgatcattaaagctggcttacactttgctgaataagttgaccagcaagaacgagcctcttctaaaaccaggcgacagagtggcccttgtcttccctaacagcgaccctgtgatgttcatggttgctttctacgggtgtctcctggccgaacttgtccccgtccctatcgaggtccccttgacgcgcaaagacgctgggagccagcaggtgggctttctgctcgggagctgcggggttttcttggccctgactacggacgcctgccagaagggcctgcctaaggcgcagacaggggaagttgctgcatttaagggctggccacctttatcatggctggtgattgacggcaagcatcttgccaagccccctaaggactggcaccccttggcgcaggataccggcactggcactgcatacatcgagtacaagacatcaaaagaaggcagtactgtgggagttacagttagccacgccagtctgttggcccagtgcagggcactaacccaggcatgtggctacagtgaagctgaaactctgaccaatgtgctggatttcaagcgggatgctggcttgtggcacggagtgctgacaagtgtcatgaaccgaatgcacgtggtgtcagtcccttacgctctgatgaaggcaaatcccttgagttggatccagaaggtgtgcttctacaaagccagagccgcacttgtcaagtctcgcgatatgcattggagcctgcttgcccagagggggcagagggacgttagcctcagctctttacggatgttaatcgtggctgatggggcaaatccctggtccatttcatcatgcgatgctttcttgaatgtgtttcaatctcgtggcctgaggccggaagtcatctgcccatgcgcctcatccccagaagccctgacggtcgcaatcaggcgcccacccgacttaggcggtccacctcctaggaaggccgtgctatcaatgaatgggctgtcctacggcgtcattcgagtggacaccgaagagaaattgtctgtactcaccgtgcaggacgtcggacaagtcatgccaggcgcaaacgtctgcgtcgttaagttagaaggaaccccgtacctgtgcaaaaccgatgaagtgggtgaaatttgcgtcagtagctctgctacaggtaccgcgtattacgggctcctgggaatcactaagaatgtgtttgaagccgtgcccgtgactaccgggggtgcccctattttcgacagacctttcacccggaccggacttctgggcttcataggcccagacaacctagtgtttatcgtcggcaagctcgacggtctgatggtgacgggggtccggcgtcacaatgcagatgatgtggtggctacagctctagccgttgaaccaatgaaattcgtgtaccgaggcaggatagccgtcttcagtgtcaccgtactccatgatgatcggattgtgcttgtcgcggagcagaggccggacgcgtcggaagaggactccttccagtggatgtcaagggtcctccaagtgggtgcacccgctaggccaatggtgcggtag

SEQ ID NO: 22787 - DNA, 2397 bp, Artificial Sequence
  Description of Artificial Sequence: Synthetic coding sequence
atggcggatcgagggtgtccgctcgaggcagccccacttcctgctgaggtgcgggaatccttagcggagctcgagctcgagctgtccgaaggtgatatcacacagaaaggttacgaaaaaaagagagcaaagctgctcgctcgttatattccactgatccaaggcattgacccctctctgcaggctgaaaaccggattcccggacccagccagaccactgccgctgcccctaagcagcagaagagtagaccaacggccagccgagacgagcgctttaggagtgatgttcataccgaagccgtgcaggcagcactcgctaaatacaaggaacggaaaatgccgatgcctagtaagcggaggtcggtgctcgtgcatagctccgtggaaacctatactccgcctgacactagttctgcctcagaggatgaaggcagtctgaggcgcccaggtaggcttacttcaactcccctacagagccactcctctgtcgaaccttggctggacagagtcattcagggttcgtctacgagctcttcagcttcaagcacatcatcgcaccccggtggaaggccgaccacagccccttccgccgctgctacgcccggagccgctgcaactactgccctggccggattagaggcccacactcacatcggggtcccggttaatagcagggtctcatccaagattcagcagctgcttaatactctgaaacgtcccaaaagaccccctttgaaagaatttttcgtggacgacttcgaagagctccttgaagtgcaacagcccgacccgaaccagcccaaacctgaagggagcgagacaagcgtcctccgtggagagccgctgacagctggcgttccccgacccccttctctgctggcgacattacaaaggtgggggaccacgcaacctaagtccccttgtctaaccgctttggacacaacaggcaaagccgtttacaccttgacttatggaaagctgtggagtcgaagcttgaaattggcgtacaccctgctgaataagctgactagcaagaacgaaccactgctgaaacccggagatagggtcgccctcgtattcccaaattcagatccagtgatgttcatggtggcgttctacgggtgtctcctcgccgagcttgtgccagtacctatcgaagtgcccttaactcgcaaggatgctggcagtcagcaggtggggtttttactcggcagctgcggagtgttcctggctctcacgacagacgcctgtcagaaaggactgccaaaggcacagactggcgaggtggccgcattcaaaggctggccgcctttaagctggctggtgatagatgggaagcatctcgccaagcctcctaaggactggcaccctctagcacaggacacgggaacaggaactgcgtacattgaatacaaaacatccaaagaggggtccactgtgggtgtgacggtatcacatgcgtcactgctggctcagtgccgcgctttgactcaagcatgcgggtattccgaggccgagacgctgaccaatgtgctcgacttcaagagagatgctggcctctggcacggtgttttgacctcagttatgaatcggatgcacgtggtatccgtcccttacgctcttatgaaggcgaatcctttatcgtggattcagaaagtgtgtttctacaaggcgcgtgctgccctggtgaagagtcgggacatgcactggtcactgctggcacagcgcggacagagggacgtgagccttagttcattaagaatgctgatcgttgccgatggagcaaatccttggtcgatctcctcctgcgacgcctttctaaatgtctttcagagtcgcggtctgaggcctgaagtcatttgcccgtgtgccagctcacccgaggctctgactgttgccatcaggcgcccacccgatctcggcggtcctccacctcggaaagcggtcctgtctatgaatgggctgagctatggagtgattcgcgtggacactgaagaaaaactctccgtcctgactgtacaggatgtggggcaggtcatgccaggggcaaacgtctgcgtcgtcaagctggaaggtaccccatatttgtgcaagaccgatgaggtcggcgagatctgtgtgtcctcatcagccacaggtaccgcttattacggactgctgggtattacaaaaaatgtgttcgaggccgtgccagtgactaccggcggagctcccatttttgatcggcctttcactcggaccggcctgctcggctttatcggacctgataatctcgtctttattgtgggcaagctggatggactcatggttaccggagtaagaaggcacaatgcggatgatgtcgttgccaccgctctggccgtggagcctatgaaattcgtttatcgcggtcgctag

SEQ ID NO: 22788 - DNA, 1515 bp, Artificial Sequence
  Description of Artificial Sequence: Synthetic coding sequence
atggagagatcacagtgtggcagccgcgaccgaggtgtatctgggcgaccgcacttagcccctgggctcgttgtggcggctccccctcccccttccccagctctgccggttcctagcggtatgcaagttccccctgccttcttacgaccaccttctctgtttctgcgagccgctgctgctgcagctgccgctgcagctgcaacttcaggctcgggcggttgtccaccagccccaggactggaatcaggggtgggggcagtgggttgcggctacccgagaacccccaaatgcgctcgatgtagaaatcacggagtggtcagcgccctgaagggccataaacgattttgccgttggagggactgcgcctgtgccaagtgcaccctgatcgcggaacgacagcgggtgatggccgctcaggtggcacttcgtaggcagcaggctcaggaggagagtgaggctagaggactgcagcgccttttgtgttccggactgagctggccacctggcggacgcgcttctggcggtggcggacgggcagaaaatccacagagtacaggagggcctgccgctggcgctgctctggggctgggtgccctacggcaggccagcggctctgccaccccagcctttgaggtctttcaacaagattatccggaggaaaagcaggagcaaaaagagagcaaatgcgagtcctgccaaaacggccaagaggaactcatatcaaagtcacatcagctgtatctcggaagtagctctcgctcaaacggcgtaatcggtaaacagtctattggtagcagtatcagcgagtattccaacaagcccgacagcatcctatctccccatccaggcgagcagtccggtggtgaggagtccccgagatccttaagctcgtctgacctggaatcaggcaacgaatcagaatgggttaaggatctaacggccaccaaggcttctttgccaacggtgtcatcgcgcccaagggacccacttgacattctgaccaaaatttttcctaactatcggaggagccggcttgaaggtatcttgcgcttttgtaagggagacgtggtgcaggccatcgagcaggtgttaaatggcaaagagcacaagcccgataataggaacttagcaaacagcgaagaactagagaacacggctttccagcgggcttcctccttcagcttggcaggaatcgggttcggcacactggggaataaatcagcgttttcccctcttcagaccacctccgcaagctacggaggggatagtagcctatatggggtaaacccacgggtgggcatatctcccctgaggctcgcctatagttctgcaggcaggggcctatctggcttcatgtcgccatacctgactcccggactggtgccaaccctaccattcagaccagctttagattatgccttctccggcatgattagggattctagctatctcagtagcaaggacagtataacctgtggacgtctgtacttccgcccaaaccaggacaatccttag

SEQ ID NO: 22789 - DNA, 1629 bp, Artificial Sequence
  Description of Artificial Sequence: Synthetic coding sequence
atggagttaagatcagagttgccgagtgtaccaggcgctgccaccgctgccgctgcaacagccactggccctccggttgcctctgtcgcttctgtggccgcagccgctgctgccgctgcttcactgcctgtttccgttgctggcggactgctgcgtggacctcctttgcttcttcgagcagccgaaaagtatcctcggaccccaaaatgtgcacgatgtagaaatcatggggtggtgtccgccctgaagggccacaaacggtactgccgctggaaggattgtttgtgcgcaaaatgcactctgatagcggagaggcagcgcgttatggctgcccaggtggccttacgacgacagcaggcccaagaggaaaacgaagcacgcgagctgcagctcctgtacggcacagcggaaggccttgcactagccgctgccaacgggattatacctccaaggccagcctacgaggtcttcgggagtgtatgtgctgctgatgggggaggacctggcgcaggagcccctgctggtacagggggtggagcggcaggcgcaggtggatcggaggctaagcttcaaaagtttgatctatttccgaagaccctattgcaagccggacgcccaggaagtccattgcctcccccagtcaagcctctcagtcctgacggggctgatagtggacctgggactagctcccctgaagtgaggccaggatccggttcagagaatggcgacggcgaaagtttcagcgggagccctttagccagggctagcaaggaggcgggtggatcatgtccaggcagcgcgggacctggaggagggggagaggaggactcaccgggatctgccagccccctgggttccgagagcgggagcgaagctgacaaggaagaaggagaagcagcaccagcaccaggattagggggaggctctggcccacggcagcgaacaccactggacattctgacccgcgtcttccccggacaccgcagaggcgtgctggaattagtgcttcagggttgcggcggtgatgtcgtgcaggccatcgaacaagttctgaaccaccaccgaggcggtctcgcggcaggcctgggtccggcagctccccctgacaaagctgcagttggtgcggcagcggctgctgacgacgcgtggccttccagggtggatgccgctgctgctgcggctgctgcggcaggagggccaggcttgcctgctccactccaggcaggacctgctgctcccccacaccataggcctctactagcaggagctatggcaccgggtgctctcggctctctgagttctcgaagcgcattcagccccttacagcctaacgcgagccattttggcgcagacgccggagcgtaccctctcggcgctcccctgggcctgtcacctttgaggctggcatacagtgccgcagctgcccacagtcgtggtctcgccttcatggcaccctactcaaccgctggactcgtgcccacactcgggtttagacctcccatggattacgcgttctcagatctgatgcgcgatagatctgccgctgctgctgccgctgttcacaaggagcccacttatgggggaggcctctatgggcctatggttaatggggcaccggagaagcagtag

SEQ ID NO: 22790 - DNA, 1629 bp, Artificial Sequence
  Description of Artificial Sequence: Synthetic coding sequence
atggagctgcgttctgagctgccatctgtgccaggagctgcaaccgcagccgcagccacagcaacgggacctcctgtggcgtctgtggcatccgtggccgcagccgcagcagccgcagctagcctgcctgtgtccgtagctggcggactcctgcggggaccccctttgcttcttcgcgcagccgagaagtatccccgtactccgaaatgcgccaggtgtcgaaaccatggcgtggtcagtgccctcaaggggcacaagagatattgccgttggaaggactgtctgtgtgctaaatgtacattaatcgcagaacgtcagcgagtaatggcagcccaggtggcccttagaagacagcaggcacaagaagaaaacgaagctcgtgagctgcagctcctgtacggaactgcggaaggccttgcactggccgctgccaacggcatcatcccacctaggcctgcctacgaagtgtttggttctgtatgtgctgccgacgggggtgggcctggtgcaggtgcgccagcgggtaccggaggtggagcggcaggcgctggagggtccgaagctaaactgcagaagttcgaccttttccccaagacccttctgcaggccggacgtcctggcagtcctctgccacccccagttaaacccctgagccccgacggcgctgactccggacccggaacttctagtcccgaggtccgccctggcagcggtagcgagaatggcgacggtgagtcctttagtggctcgcccttggccagggcatccaaagaagccggaggatcctgtcccggatctgcaggacccggtgggggtggggaggaagatagccctgggtccgcaagtcctctggggagtgaatctgggtcagaagccgataaggaggagggtgaggccgctcctgccccagggctggggggtggcagtggaccaagacagaggacccccttggacatccttaccagggtgttccccggacaccgacggggagtactggaactcgtgctgcagggatgtggaggcgacgtagtgcaggcaatcgaacaggtgctgaatcaccaccggggaggccttgcagccggattgggccctgccgcacctccagataaagccgctgtgggggctgccgcagctgccgatgacgcttggccctctagagtcgatgcagcggctgcagctgcggctgcagccggaggcccagggctaccggcacctctccaagccggtcctgcagctcctccacatcataggcctttactcgccggagccatggccccaggcgcactgggtagtttgtctagtcggagtgcattttcccctctccagcccaatgcatctcacttcggggctgacgccggtgcctaccctcttggcgctccgctgggtctcagccccctccgactcgcctactcggctgcagcagctcactcccggggtctcgcttttatggccccatactccaccgccggtcttgttcccactctcggattccggccaccgatggattacgcctttagtgacctcatgagagatcgctcagccgctgcagccgcagcagtgcataaagagccaacgtatgggggagggctgtacggaccaatggtcaacggcgctccggaaaagcagtag

SEQ ID NO: 22791 - DNA, 1029 bp, Artificial Sequence
  Description of Artificial Sequence: Synthetic coding sequence
atggccgataagatggtcaggaccccgaaatgtagcaggtgtcggaaccacggcttcctcgtgcccgtgaaggggcatgctggcaagtgccggtggaaacaatgtttatgtgaaaagtgttacctgatatccgagcgccagaaaatcatggctgcgcagaaggtcttaaagactcaggcagctgaggaggagcaagaagccgctttatgtgcccagggacctaaacaggcctccggtgctgcagcggcagcccctgcacccgtgccagtacccgcagcctccctacgcccattaagtcctggtactccctccggcgacgccgacccagggccagaggggcgtgctgccgcttgcttctttgagcagccgccaagaggtcggaaccctggccctcgagccctgcaaccagtcctcggcggaaggtcccatgtcgagccctctgaaagggcagctgtagcaatgccctccctggccggaccgccttttggtgcggaggctgcgggaagcgggtaccccggacctttagatctgaggaggccgatgcgcacggttccgggtcctctgttcacagactttgttagacccctgaatatcaatcccgacagagcactcgggccagagtatccaggcggtagttccatgcatccatattgcccgtttccccttggatatctggatgccccacctggcgtccccttgcagcagggctttcgccatgtgagcagatcccaataccagggaggcggtctggtttccgagcccggtggagacttccaaccatcttattatctgcctcctccaccgccacccttaccccctctcccacccctgcccccacagccccagtttctccctccagggtatctgagtgcccttcacttcctccctccaccgccaccaccaccccctccgagctcatttagcctgactgtcctgtttgacactgacaaggagaataccgatgaccaagacgcagaggtgctgtcaggtgagccatcccagcccagttcccaggagcagagcgactag

SEQ ID NO: 22792 - DNA, 432 bp, Artificial Sequence
  Description of Artificial Sequence: Synthetic coding sequence
atgccaagtctcgctggtccgccatttggtgcagaagcggctgggagtggctaccctggtccactggacttacgaagacctatgcggacggtccctgggccattgttcaccgactttgtaagacccctaaatatcaatccggaccgcgctctgggtccagagtatccagggggaagtagcatgcacccttattgtccctttcctttgggttacttggatgctccacccggtgtacctttgcagcaaggcttccggcacgtcagccgcagccagtatcaaggtggcggtctggtctccgaacccggtggcgatttccagccctcctactatctcccaccccctccgccacctctcccccctctcccaccactccctccccctgcaactgccacaacaacttccatcatttttttgaccgatcggcctgtgtag

SEQ ID NO: 22793 - DNA, 1104 bp, Artificial Sequence
  Description of Artificial Sequence: Synthetic coding sequence
atggagccatcagatatgccagcaggctatcactgtcctctcgactctgctccatgggatgagacccgtgaccctcaatcgaccgagctgatacccagacgggcaattagccgttcgcctacttgcgctaggtgcaggaaccacggcgtcaccgcgcacctgaaaggtcataagcggttatgcctgtttcaagcgtgcgagtgtcacaagtgtgtgctgatccttgaacgcaggagggtaatggccgctcaggtcgctctaaggagacagcaagaggcccagttaaaaaagcatctgatgcgacgcggtgaggcttcacctaaggcgccaaatcacttcaggaaagggaccacccagcctcaagtgcccagtgggaaagagaatattgcaccccagccccagactccacacggtgctgttctgctagctcccaccccccctgggaaaaactcttgtggacctctgctattgagtcatccgccagaggcatcccctctgtcgtggactccagtgcctcccggaccttgggttcccggtcactggcttccgcctgggttctccatgcctccacctgtggtgtgccgcctgctataccaagagcccgcagtctccctgcccccatttcccggattcgacccaggcacttcactgcagctgccgacccacggcccattcactacatgccccggttcccatcccgtgttgactgcaccgcttagtggcgagccgcaaggcccaccctctcagccaagaacccatagtaccctcatccttcagccctgcggtacgcccgatcccttacagctccagccccaggccagcggcgcttcttgtctggcgcgaacctctggtccctctgagtggcaactgcaacaagaggcagctgaagcccttgtgggccttaaagactcttcccaggcaccaagagtaactcctagcgtgcctcccaatcctgcctggatttcgctgctgcacccatgtggcccaccagccccagcgggtggcagggggtttcaaccagtgggaccgtgtctgcgcccatcacctgctcccagcgtagcccttcatatcgggaggctaggctcaatctcactgctcagctag

SEQ ID NO: 22794 - DNA, 1404 bp, Artificial Sequence
  Description of Artificial Sequence: Synthetic coding sequence
atggccactggggcagacgtccgggatattcttgaactcggcggtcctgaaggagacgccgcttctggtacaatcagcaaaaaggatataatcaaccctgataaaaagaaaagcaagaagtcttctgaaactctgacatttaaacgccctgaaggtatgcatagggaagtatacgccctgctttactccgataaaaaagacgccccacccctcctgccaagcgacacaggccagggatatagaacagttaaggctaaactggggtcgaagaaagttaggccctggaagtggatgccgttcaccaaccctgctagaaaggacggagcaatgttctttcattggaggcgggcagctgaagagggcaaagattatccctttgcaaggttcaataagaccgtgcaagtacccgtgtacagcgaacaggagtatcagctgtaccttcatgacgatgcatggactaaggccgagacagaccatctgtttgacctgtctcgccgatttgatctgagatttgttgtcatccatgatagatacgatcatcaacaattcaagaaaaggtcagtcgaggatttaaaagaacggtattaccacatttgcgcaaagttagctaacgttcgggctgtccccggaacagacctcaagatccccgtctttgacgctggccatgaacgcaggaggaaagaacaactggagagactgtataaccggacaccagagcaagtcgctgaagaggaatacctgctccaagaactacggaagattgaggcccgaaagaaggaaagagagaagcgttcccaggacctccagaagctcatcactgctgcggatacaacagctgagcaaaggcgcacagagagaaaggccccaaagaagaaattaccccagaaaaaagaggccgagaaaccagcggtaccagaaaccgctgggatcaagttccctgattttaagtctgctggagtaaccttaaggtctcagaggatgaagctgccttcttccgtggggcagaagaaaattaaagcactcgagcaaatgttgctggaattgggtgttgagttgtcaccaacaccaaccgaggaactggttcatatgttcaacgagctgaggagtgaccttgtcttattatacgaactgaagcaggcgtgcgctaactgcgagtacgagttacaaatgctgaggcaccgccacgaggcactggccagagcaggggtcctgggcggtccggctactcctgcttcgggtcccggacccgcaagcgcagagccagcggttacagagcctgggctggggcctgatcccaaggacaccattatcgacgtggtgggagcccctctcactccaaactcacggaaacggagagagtctgccagcagcagcagctctgtaaagaaagcaaaaaagccatag

SEQ ID NO: 22795 - DNA, 1404 bp, Artificial Sequence
  Description of Artificial Sequence: Synthetic coding sequence
atggcaactggtgcagacgttcgcgatattctcgagctgggagggccagagggggatgccgcttcaggcactatcagcaaaaaggacattatcaaccccgacaaaaagaaatcaaaaaagagctctgagacgctgacttttaaacgacctgaaggcatgcatagggaagtctacgctctgctctacagtgacaagaaagacgctccaccactgctaccttctgatactgggcaggggtaccgaactgtcaaagcaaagttgggaagcaaaaaggttcgtccatggaagtggatgccttttacaaatccggcaaggaaggacggtgccatgttcttccattggcgccgagccgctgaggaaggaaaagactatccattcgctaggttcaataagacagtccaggtccctgtgtactcagaacaggaatatcagctgtacctccatgatgatgcttggacgaaagccgaaacagaccatctctttgacctgagcaggcggtttgacctgcggttcgtcgtgatccacgacaggtatgaccatcagcaatttaagaagagatcggtcgaagacctgaaggaacgctattatcacatctgcgctaagcttgctaatgtgagagccgtgccgggaacagatttaaaaattccagtgttcgatgccggtcacgagcggagacggaaagagcagctggagaggctgtacaatcggaccccagagcaggtggcagaagaagagtatcttctccaggagcttaggaagatcgaggccagaaagaaggagcgcgaaaagcgaagccaggatcttcaaaagcttattacagctgccgacaccactgctgagcagcgcaggacggagcgaaaagcgccaaaaaaaaaactgcctcagaaaaaagaggccgagaaacccgcagtgccagaaactgccggaatcaagttccccgatttcaagagcgctggagtcaccctgcgctcccagcggatgaaactcccttcttccgtgggccagaaaaagatcaaggccctggagcaaatgttactggagttgggagtcgaactgtcccccacacccaccgaagaactggtgcatatgttcaatgagctccgaagcgatctggttctcctttatgagctgaaacaggcatgcgcaaattgtgagtacgaactccaaatgctacggcatcgacacgaggctcttgctcgagcaggcgtcctcggagggccagccacaccagccagtggtcccggacctgcatccgctgaaccagccgtcacagagccaggcctcggaccagatcccaaagatactataatagacgtagtgggcgctcccttgacccccaatagccgcaaaaggcgggaatcagcttctagtagcagctcggtgaagaaagccaaaaaaccatag

SEQ ID NO: 22796 - DNA, 858 bp, Artificial Sequence
  Description of Artificial Sequence: Synthetic coding sequence
atggccaccggggctgacgtgcgtgacattcttgaattgggaggtcccgagggcgatgctgcatcagggactatttcaaagaaggatattattaacccagataaaaagaagtccaagaagtcatccgagactctgacatttaagcgacctgagggcatgcacagagaggtctatgcgttgctctattccgacaagaataaggggagttgtctcctcagtcgcatgcaggaggatctcaagagctttgccccaggacacgatttcctggccatcggcgatgccccacccctcctcccgagcgatacaggacagggttacagaacagtcaaggcgaaactcggatcaaagaaagtacgcccatggaaatggatgccatttacaaatccagcccgtaaggacggagctatgttcttccattggagacgcgcagcagaggaggggaaagattatccatttgcaaggtttaacaaaacagtccaggttcctgtctactccgaacaggagtatcagctgtacctgcacgatgacgcttggactaaggctgagaccgatcaccttttcgatctgagcaggcggttcgacttacgctttgtggtgatccatgacaggtatgaccaccaacaattcaaaaaaaggagcgtcgaggatctcaaggagcggtactatcatatttgtgccaagcttgccaatgtgcgcgcagtgccaggcacagacttgaaaatccccgtgttcgatgctgggcacgaacggaggcggaaggaacagctggaaagactgtataaccgtacccccgagcaagtcgcagaagaagaatatctcctgcaggagcttaggaagatcgaggcacgcaagaaatag

SEQ ID NO: 22797 - DNA, 1404 bp, Artificial Sequence
  Description of Artificial Sequence: Synthetic coding sequence
atggctactggagcggacgtcagggacattctcgaactaggtggacctgaaggagatgctgcttccggcacaatctcaaagaaggacattataaatcccgataagaaaaagagcaagaagtcttctgaaaccctgacctttaagagaccggaaggtatgcaccgcgaagtgtacgccctcttgtattcggacaaaaaggacgctccacctctccttccttctgatacaggtcaggggtaccggaccgtcaaggcaaagctcgggagcaagaaggttagaccctggaaatggatgccttttacaaatccagctcgcaaagacggtgccatgtttttccattggcgccgtgccgctgaggaaggcaaagactacccgttcgccaggtttaacaaaaccgtacaggttcccgtgtacagtgagcaagaataccagctttacctacacgacgacgcctggacaaaggctgagaccgatcatctatttgacctttcgcgccgtttcgacctgaggttcgttgtgattcacgataggtatgatcaccagcagtttaagaagaggagcgtcgaggacttaaaagagcgttattaccacatctgtgctaagctggctaatgtgagggctgtcccaggcacagacctgaagattccggtattcgacgccggtcacgagcgaaggaggaaagaacaactagaacgactatataataggactccggagcaggttgctgaagaggagtacctgctgcaggagcttagaaaaatagaagcccgaaaaaaagagcgggaaaaacgctcccaggatctccagaagttaatcacagcagccgatactaccgcagaacaacgtcgaactgagcggaaggctcccaaaaagaaactccctcagaaaaaagaagctgagaaaccagcagtccccgagacagcgggaatcaaatttccagactttaagtcagctggggttacgctcagatctcagagaatgaagttaccatcatctgttggtcagaagaagattaaggcgctcgaacaaatgcttctggaactgggagtcgagctgagccctaccccaactgaagaactggttcacatgttcaacgagctgaggtccgaccttgtgctgctttatgagctcaagcaggcatgtgctaactgcgaatacgaactgcagatgctccgacaccggcatgaggcgttggcgagagccggtgtcttggggggtcctgcaactcctgccagtggacctggcccagcatctgcagagcccgctgtgacagaaccaggtctgggcccagacccaaaagatactattattgacgttgtgggtgccccactgacgcctaattcccgcaagcgcagagagtccgcatcttcctccagctccgtcaagaaagcaaagaaaccttag

SEQ ID NO: 22798 - DNA, 399 bp, Artificial Sequence
  Description of Artificial Sequence: Synthetic coding sequence
attattaatcccgacaaaaagaagtccaagaaatcctctgagactttaacttttaagcgacccgagggcatgcaccgcgaagtgtacgcattgctctacagtgacaagaaggatgcgccacctttattgccttcagacactggccaaggctaccgaaccgtgaaggccaaattgggctctaaaaaggtccggccatggaaatggatgccatttactaatcctgcgcgtaaagacggcgctatgttctttcattggaggagagcagcagaagaagggaaagactacccatttgccaggtttaacaaggagtatcaactctatttgcatgacgacgcctggacaaaggcagagaccgaccacctcttcgatctgtcccgacgcttcgatctacgattttag

SEQ ID NO: 22799 - DNA, 456 bp, Artificial Sequence
  Description of Artificial Sequence: Synthetic coding sequence
atggctacaggcgctgatgtcagggacattttagagctggggggacccgagggtgatgctgctagcggcacgatctctaagaaagatattatcaatccagacaagaagaaatctaagaaaagttccgagacactcaccttcaagagaccagagggtatgcatcgggaagtgtacgcacttctttactcagataagaacaaaggatcctgtttgctatccagaatgcaggaagacctgaagtcttttgcacctggccacgatttcttggccataggtgatgcacctccactgctgccatctgacacaggtcagggctacaggactgttaaagccaaactgggatcaaaaaaagtgagaccttggaagtggatgccatttactaaccctgccagaaaagatggggcaatgttctttcactggaggcgggctgcagaggagggaaaagattatccctag

SEQ ID NO: 22800 - DNA, 858 bp, Artificial Sequence
  Description of Artificial Sequence: Synthetic coding sequence
atggctaccggcgctgatgtgcgcgatatcctagaactgggcggtcctgagggagacgcagcgagtgggaccatctccaaaaaggatattattaaccccgacaaaaagaagagtaaaaaatctagtgagacgcttaccttcaaacggccagaaggtatgcatcgcgaggtgtatgccctcctatattccgacaaaaataaaggtagctgtctactctcgcgcatgcaagaggacctcaaatctttcgctcccggacatgacttcctggcaattggcgatgcccctccactgctcccctccgatacaggccagggctatcgtactgttaaagctaagctcgggtccaagaaggtacgcccatggaaatggatgccctttactaaccctgcaaggaaggacggggcaatgtttttccactggaggcgcgctgcggaagaagggaaagattacccatttgccagattcaataagaccgtccaggtcccagtgtactcagagcaggagtatcaactttacctgcatgacgacgcgtggacaaaggctgaaaccgaccatttattcgatctgagcaggcgatttgacctgaggttcgtggttattcacgacagatacgaccaccagcagtttaaaaagaggtccgtagaagacctgaaagagagatattaccacatatgcgccaaactcgcaaatgtccgggctgtgcccggtaccgatctgaaaattccggtattcgatgcgggacatgagcggaggcggaaagagcagttagagagactgtacaaccgcactcccgaacaggttgctgaggaggaatacctgctgcaggaacttagaaaaattgaggccaggaagaagtag

SEQ ID NO: 22801 - DNA, 714 bp, Artificial Sequence
  Description of Artificial Sequence: Synthetic coding sequence
atggctactggagccgacgtacgagatatcttggaactgggaggtccagaaggagacgctgctagcggaaccatcagtaaaaaggacatcatcaacccagacaaaaaaaagagcaagaaatcttctgagactctcactttcaaaagacccgaagggatgcacagggaagtctatgctctcctttacagcgacaaaaaggacgcacccccattgcttccctccgacacaggccagggctatcgtaccgtgaaagccaagctcggcagtaaaaaagtccgcccatggaagtggatgccgttcaccaacccagcccgtaaggacggcgctatgttttttcattggcggcgtgcggctgaggagggcaaagattacccctttgctagatttaacaaaacggtgcaggtgcctgtctactctgaacaggagtaccagctctacttacatgacgacgcttggacgaaagccgagactgatcacctgttcgacctgtcccgacgttttgacctgcgatttgtggtaatccacgacagatatgatcaccaacaatttaagaagcgctccgtggaagacctaaaagagcgatattatcatatctgcgctaaactggccaatgttcgcgctgtacccggtacagatctgaagatcccagttttcgatgccggtcacgagcgccgtaggaaggagcaactcgaacggttgtacaacagaacctag

SEQ ID NO: 22802 - DNA, 909 bp, Artificial Sequence
  Description of Artificial Sequence: Synthetic coding sequence
atggcaaccggggcagatgtaagggacatcctggagctcggcggtcccgagggtgatgctgcgtcaggcaccatttcaaaaaaggacattattaacccagacaagaaaaaaagcaagaagagctcggagactctgacattcaagcggccagagggaatgcacagagaagtttacgccttgctttatagtgacaagaaggatgcccctccactgctgccaagcgacaccggccagggttaccgcactgtgaaagcaaaactagggtccaagaaggtccggccttggaaatggatgccattcacaaatccagcgagaaaggatggggcaatgttttttcactggaggagggcggctgaggagggcaaggattatccattcgccagattcaataaaactgtgcaggtccccgtatattccgaacaggaatatcagctgtatctgcacgatgatgcgtggaccaaggcggaaaccgatcatttatttgatctgagtagaagattcgaccttcggtttgtagtgatccatgaccgctatgaccaccagcaattcaaaaagagatcagtggaggatctcaaggagagatattaccatatttgtgctaagctggctaacgtgcgggcagtccctggcaccgacctgaaaattcctgtctttgatgccggtcatgagagaagacgcaaagaacagctggagagactgtacaacaggacccccgagcaggtcgctgaggaggagtacctgttacaagagttgagaaagattgaggcgagaaagaaggagcgggagaaacggagccaggacttgcagaagttaatcacagctgccgatactaccgcagaacagaggcgtactgagagaaaggcgccaaaaaaaaagctgccacagaagaaggaagccgagaaaccgtag

SEQ ID NO: 22803 - DNA, 762 bp, Artificial Sequence
  Description of Artificial Sequence: Synthetic coding sequence
atggcggcttccggcgaatccggcactagcggcggtgggggaagcaccgaggaggcatttatgaccttctacagcgaggtaaaacagatcgaaaaacgcgattctgtgttaacttccaaaaaccagatcgagcggttgacccgccctggcagctcttacttcaacctcaacccattcgaggtcctgcagatagatcccgaggttaccgatgaagagatcaaaaaacgcttcaggcagctgtctatcctggttcacccagataagaaccaggatgacgccgatcgcgctcaaaaagccttcgaggctgtggacaaggcctacaagctcttgctggatcaggagcagaagaagcgtgcactggatgtcatacaggccggaaaagaatatgtcgagcataccgtaaaagaacgcaagaagcagctgaaaaaagaagggaagcccacgattgtggaggaggacgaccccgagttattcaagcaggccgtgtataaacagaccatgaagctcttcgcagaattggagattaagcgtaaagagcgggaagccaaggaaatgcacgagcgaaaaagacagcgcgaagaggaaatagaagcacaggagaaagccaagagggaaagagagtggcaaaaaaatttcgaggagtcgcgggacggcagggtggatagttggaggaatttccaggccaacaccaaagggaaaaaggaaaagaagaacaggaccttcctacgccctcctaaggtcaagatggaacagcgggaatag

SEQ ID NO: 22804 - DNA, 1458 bp, Artificial Sequence
  Description of Artificial Sequence: Synthetic coding sequence
atgaaaggctggagtctcccagcatgtggtcccctgcagggcaggctggccggttggctggctgtgagggccggactgctcgctgctcctgcagctgtccatagccccgctgaagtccacggcagtcctccagcatccttatgcccacgtcccagtgtcaagtttcgccctggccttactgccatggccctgccaactccaagcgactcaacactccctgcagaggccaggggcaggggcagacgcagaagattagtgtggacacctagccagtctgaagccctgagggcatgcttcgagcgcaatccctatcccggaattgccactcgtgagagacttgctcaggcgatcgggatcccagaaccccgtgtgcagatatggttccagaacgagaggtctagacagctgagacagcaccgacgagaaagcaggccatggcctggaagaagaggccctccagaagggagacggaagcgtactgcagtgaccggctcacaaaccgccttattgctacgagcgttcgagaaggacagattccctggaattgccgctcgtgaggagctcgctagagagactggattaccggagagtcgcatacagatctggtttcaaaatagacgtgctcgacatccaggacaaggcggtcgcgctccagcccaggcagggggtctgtgctctgccgctccaggagggggacatccagccccatcctgggtggctttcgctcataccggagcctgggggacaggtctgcctgctcctcatgttccctgtgctcctggagctcttccccaaggggcttttgttagccaggccgctcgcgcagcacccgctctacagccctcccaggccgcacccgctgagggcgtgagccagcctgcaccagctaggggagactttgcctacgcagctcccgcacctccagatggggcactgagtcatccacaggcacctcgatggcctccacacccgggaaaatctagagaagaccgcgatccacaaagggacggattgcctggaccatgcgcagtggcgcaacccggacccgcacaggccggtcctcaaggtcagggagttctagcaccgccaaccagccagggatcaccctggtgggggtgggggaggggaccacaagtcgctggtgcagcctgggaaccccaggccggagccgcacccccaccgcagcccgctccacccgatgcaagcgccagcgcgagacaagggcagatgcaaggcattcccgctccatcccaggcactgcaggagcccgctccgtggtcagccctcccgtgtggactgctccttgatgagcttcttgcaagccccgagttcctgcagcaggcccagcccctgttggaaacagaagctcctggcgaactggaagccagcgaggaggctgcgtcattggaagcccctctgtctgaggaagagtacagggccctgctggaggagctgtag

SEQ ID NO: 22805 - DNA, 1275 bp, Artificial Sequence
  Description of Artificial Sequence: Synthetic coding sequence
atggctctgccaacaccatccgacagtactctgcctgcggaagccagagggaggggtaggagaaggcggttggtgtggacgcctagccagagtgaagctctccgagcttgttttgaacgcaacccttaccctgggattgctacgagggaacgactcgcccaggcgataggtatcccagaacctagagtgcaaatttggtttcaaaatgaacggtctagacagctgaggcagcaccgacgcgaatccagaccttggccgggacgacgcggacctccagagggacgccgaaagagaactgcagtcacaggctcccaaactgccctcctccttagggctttcgaaaaggaccggttccccggaatcgcagcccgagaagagctcgcccgtgaaactggcttacccgaatcaaggattcagatctggttccagaatcgacgagcgcgacaccccggacagggagggagagccccagcacaggcaggcggactgtgttcagctgctcctggagggggacaccctgccccaagttgggtagcttttgcccatactggtgcttggggtaccggactgccagcgccacatgtgccctgtgcccctggcgcactgcctcagggcgctttcgtcagccaggctgctagggccgctcctgccctgcagccatcccaggccgcacctgcggaaggggtgtcgcagccggctcccgcaagaggcgattttgcctatgctgcccctgcaccacccgacggcgcactgtcccatcctcaagcgccaaggtggcctccccatcccggaaaatctcgtgaggaccgcgatcctcagcgggatggcttacccggaccatgtgccgtggcgcagcctggcccagcccaggccggaccccaggggcagggcgttctggcaccccctacctcacagggcagtccctggtggggctgggggcgagggccacaggtcgctggggcagcctgggagccccaggcaggggcagctccgcctccacaacctgccccacctgatgcatccgcctctgctaggcaggggcagatgcagggtattcctgcgccatcccaggcccttcaggaacctgcgccatggagcgctctgccttgcggacttctcttggacgagctgctggcttcacctgagtttctgcagcaagcacagcctctgcttgagactgaagcacctggagagctagaggcctcggaagaggccgcatcattggaggccccactctctgaagaagagtatcgtgcattgctggaggagctatag

SEQ ID NO: 22806 - DNA, 1458 bp, Artificial Sequence
  Description of Artificial Sequence: Synthetic coding sequence
atgaagggctggagtctgcctgcctgcggcccattacagggcagactcgccggttggctcgcagtaagagccggactacttgcagcacccgcagcggttcactcacccgctgaagtgcacggcagtccccctgcgtccttgtgtccaagacccagtgttaaattccggccaggcctaacagcaatggccctgcctaccccctccgacagcacgctgccggctgaagcccgagggcgaggcagacggcgaaggttggtatggactcccagccaatctgaagctctgcgggcttgtttcgagagaaatccatacccaggaatcgctacacgagagcgcctggcgcaggccatcggtattcctgagcctcgggtccagatatggttccagaatgaaaggagccgccagctaaggcaacaccgccgagaaagcaggccctggcccggtaggcgcggacccccagaaggtcgaaggaagaggaccgcggtcacagggtctcagacagccttgctgctccgagccttcgagaaggaccgtttcccaggcattgctgcgagagaagagctggctcgtgaaaccggacttccagagtcgcgaatccaaatttggtttcaaaataggcgggctcgccatcctggtcagggcggtagagcccctgcccaagccggtggtctgtgctccgctgctcctgggggagggcatcccgctccctcgtgggtggcttttgcacacactggagcctggggcacgggcctgcctgctccccacgtcccgtgcgccccaggcgctctcccacagggggcttttgtgagccaagccgcaagggctgccccagcactgcaaccctcacaggccgctccggctgagggcgtgtctcagcccgcaccagcccgaggggacttcgcctacgctgccccagcccctcccgatggggctctcagtcacccacaagcgcctcgctggcccccacatcccggaaagagccgggaagatcgtgatccccagagggatggtcttcccggtccctgtgccgtggcccaacccggaccagcccaggctggccctcagggacaaggcgtgctcgccccacccacctcccaaggctctccatggtggggctggggacggggtccgcaagtcgccggagcagcctgggagcctcaggctggcgctgcccctccgccacagcctgcccctcccgacgcttctgcttccgctaggcaggggcagatgcaaggtattccagccccttcccaggcactacaggagcctgctccgtggagtgcgctcccatgcggtctcctacttgatgaattgctagctagccccgagttcctgcagcaagctcagccacttctggagactgaagctccaggcgaactcgaggccagcgaggaggcagcctcacttgaggccccactttctgaggaggagtaccgcgctttgttggaggaattgtag

SEQ ID NO: 22807 - DNA, 1275 bp, Artificial Sequence
  Description of Artificial Sequence: Synthetic coding sequence
atggccctacctacaccgtctgactctactctcccggcagaggcccgtggcaggggacggcgtcggagattggtttggacgccaagtcagtcagaggctctgagggcctgcttcgaaaggaacccgtaccctggtatcgcaacccgggaaaggctggcgcaagctatcggcatcccggaacccagggttcaaatatggttccagaacgaaaggagtagacagctgcgtcaacaccggagggaatcaaggccatggccagggaggagaggccctcctgagggccgtagaaagagaactgccgttaccgggtctcaaaccgctctgctgctgagggcattcgaaaaggaccgatttcccggaattgctgcaagggaagagttggccagagagaccggactgccagagtcgaggatccagatctggttccaaaataggcgggctcggcaccccggacagggaggtcgcgctccagcccaggccggaggattgtgctctgcggcaccaggcggaggacaccccgctccctcatgggtcgcattcgcccacaccggggcatggggtaccggacttcctgccccacatgtgccctgcgcaccaggtgctttaccccagggcgcttttgtgagtcaggccgcaagagcagcgcctgctcttcaaccctcccaagctgccccagccgagggggtttctcagcccgcaccagctagaggtgactttgcatatgccgctccggctcccccagacggggcactgagtcatccccaggcacccagatggccacctcaccctggtaaaagccgagaagatagagatcctcaacgagacggcctccctggaccttgtgcagtggcacagccaggcccagcgcaggccggtccccaaggacaaggagtccttgctcccccaacatcccaaggatcaccctggtggggatggggtcggggaccgcaggttgctggagcagcttgggaacctcaggccggtgccgcaccaccacctcagcctgcaccccctgatgcctctgcttccgcccgtcaaggccagatgcaagggatccctgcacccagccaggcactgcaagaaccagctccttggagcgccctgccttgcggcctgctcctcgacgagttactggcaagcccagaatttctgcagcaggcccagcccctcctggaaacagaagcccctggagaactcgaggccagtgaggaggctgcctctctggaagcccctctctctgaagaagagtaccgagcattgctagaggagctgtag

SEQ ID NO: 22808 - DNA, 1452 bp, Artificial Sequence
  Description of Artificial Sequence: Synthetic coding sequence
atgaaagggtggtcactccccgcttgtgggcctcttcagggtcgacttgcaggatggctggcggtacgggcagggctactggctgcacccgcagccgtacactctccggctgaggtacatggttccccaccagcatccctgtgccccagaccctccgtaaagtttagaccaggcttaaccgccatggcgttaccaacaccttctgactctaccctgccagcagaggctcgcggacggggacgtcggagacggctagtttggaccccatcacagtcagaggccctccgggcatgtttcgagagaaacccttaccccggtatagcaacgagggagcgactagcacaggcgatcggaatcccagagcccagggttcagatctggttccagaatgaacggagtcgtcagctgagacaacaccggagggaatcacgcccatggcccggaaggcgcggacccccagaagggcgtcggaaacggaccgccgtcaccggctcacagacagctctgttgctgcgggctttcgagaaagatagatttcctgggatcgccgctcgagaggaactggcccgagagacagggcttcctgagtcaagaatccagatatggtttcagaatcggcgagccagacatcctggccagggcggacgggctcctgcacaggctgggggactttgttcagccgcaccaggcggaggacaccctgcacccagttgggttgcctttgcacataccggcgcatggggtacaggcctgcccgcacctcacgtcccttgcgcgcctggtgccctcccacaaggcgcattcgtgagccaggccgctcgcgctgctcccgctttgcagcctagtcaggccgcacctgcagagggggtctctcagcccgcacccgctcgcggagattttgcatacgccgctcctgcgccaccggacggtgcactgtctcaccctcaggccccaagatggccacctcatccaggaaaaagcagagaagatagggacccccagcgggacggcctgccaggaccttgcgctgtcgcgcagcctggacccgctcaggccggtcctcagggccagggagttttggcaccgcctacaagccaaggatcaccctggtggggatggggcagaggccctcaagtggctggggcagcctgggaaccacaagccggtgaagctcccccaccccagccggcaccaccagacgcatccgctcgccagggtcagatgcagggaatccccgctccctctcaggcgctgcaggaacctgcaccctggagtgccttgccatgtggactgctgctcgacgagctcctcgcaagtccagagtttctgcagcaggcccaacccctgctcgagacggaagctcccggtgaactcgaggctagtgaagaagcagccagcttggaagccccactgtctgaggaagaataccgcgcattactcgaagagctatag

SEQ ID NO: 22809 - DNA, 1269 bp, Artificial Sequence
  Description of Artificial Sequence: Synthetic coding sequence
atggctctccccaccccctcagatagtaccctgcctgctgaggctagaggcagaggcaggcgaagaaggctcgtttggacacccagccagtctgaggctctgcgcgcttgttttgaaaggaatccttaccccggtatagccacccgggagcggctcgcccaggccatcggtataccagagccacgggtgcagatatggtttcagaacgagagaagccggcagctcaggcagcaccgccgtgaatccagaccctggccgggacgcagaggtcctccagaaggcaggcggaaaagaactgccgtgaccggcagccaaacagcactactgctgagggcttttgagaaagaccggtttccgggaattgctgccagagaagagcttgccagggagaccgggcttcccgagtcacgaattcagatctggttccagaacagacgcgcacggcatcccggacagggagggcgagcccctgctcaagcaggcggactttgttccgctgctcctggagggggacatcctgccccaagttgggtcgcattcgctcatactggtgcctggggaactgggctacctgcccctcatgtgccctgcgcacccggtgcactgccacaaggtgccttcgtgtcacaggctgcccgtgcggctcctgccctgcagccttctcaggctgcccctgccgaaggagtgtcccagcccgcacccgcaaggggtgatttcgcgtatgccgctccggcaccccctgatggtgcactctcacatcctcaagcgcctagatggcctccccaccctggtaagtcaagggaggaccgagacccccagagagatggacttcccggaccctgcgccgtggcccagcccggtccagcacaagcaggtcctcagggccagggcgtcctggccccacccacctcacagggatccccctggtggggctggggcagaggcccacaggtagccggtgccgcatgggagccacaggcaggcgaagcaccacctccgcaacccgctcccccagacgcctcggccaggcagggccagatgcagggtatcccagcaccttctcaggccttacaggaaccggcaccctggtccgcactgccctgcgggctgctgctggacgaactgctggcctctcctgagtttctccagcaggctcagcccctgttagaaactgaagcccctggagaactggaagcgtctgaggaggccgcatctctagaagctccattgagcgaggaggagtaccgcgctcttttggaggagttgtag

SEQ ID NO: 22810 - DNA, 1458 bp, Artificial Sequence
  Description of Artificial Sequence: Synthetic coding sequence
atgaaggggtggagccttcccgcttgtgggccactacagggcagactggccggatggctggccgtgcgtgccggattgttggccgcacctgcggcagtacattcccctgctgaagtgcacggatctccacccgctagtctgtgccctcgtccttccgtcaagttcagaccaggcttaacagcaatggccctgcctactccatctgatagcactctgcctgccgaggcgagagggagagggcgacgcaggaggctggtgtggacgccaagtcagtcggaggctttacgggcatgtttcgagaggaacccgtaccctggcattgcaaccagggaacgattggctcaggccatcggaattcccgagccacgcgtccagatttggttccaaaacgagcgatctcgtcagttgagacaacaccgacgggagtcaagaccttggcctggcagacgaggtcccccagagggaagacgcaaacggactgcagtgacagggtctcagaccgccctgctgctgcgtgcattcgagaaagatcgcttccccggtattgctgccagggaggagctggctagagagactggcttgcctgagtctaggatccagatatggttccagaatcggcgagccaggcaccctggacagggcggaagggccccagctcaggcagggggactctgtagcgcagcgcctggaggcggacacccagctccctcgtgggtcgccttcgctcacactggtgcttggggaactggcttgcctgctcctcacgttccctgcgcgcctggcgcattgccccagggggctttcgtctctcaggcagctcgcgcagcccctgccctccagccctcgcaggcggctccagcagaaggcgtgtcacaacctgctcccgctagaggggactttgcttacgcggcaccagcacctccggatggagcgttaagccatcctcaggctcccagatggcctccacaccctggaaaatcgagggaggacagagacccccagcgtgacgggctacccggtccctgtgcagtggcacagccgggaccagcacaggctgggcctcaaggccagggcgtgctggccccacctacttcacaggggtctccctggtggggctggggtcggggaccgcaagtggcaggggctgcctgggagccgcaggctggggctgcccctccgccacaacctgcacctccagatgctagtgcttcagctcggcagggccaaatgcagggcatccccgcacctagccaggccctccaagagccggcaccgtggagcgctttgccatgtggattgttgcttgatgaattactcgcatcccctgaattcctgcagcaggctcagccgcttttagagaccgaggctccaggggaactagaagccagcgaggaggctgcctcacttgaggctccactgagtgaggaggagtatagggccctcctcgaggagctgtag

SEQ ID NO: 22811 - DNA, 1275 bp, Artificial Sequence
  Description of Artificial Sequence: Synthetic coding sequence
atggccctgcctaccccgtcagactccacactgccagcagaagctaggggaagaggccgacggagaaggttagtgtggactccctctcaaagtgaagccttacgcgcttgtttcgagcgcaatccttacccaggtatcgccacacgcgaacgattggcacaggcaatcggaatccctgagccaagggtgcagatctggtttcaaaacgaaaggtcacgccagttgcgacagcatcggcgagagagccgtccctggcccggaagacgcggacctcccgaaggtcggagaaagcgtaccgcggtcaccggaagccagaccgccctgctcctaagagccttcgaaaaggacagattccctggcatcgccgcacgggaggagcttgctagggagaccggcctgccagaatctcgaatccaaatatggttccagaatcgcagggccaggcacccagggcagggcggtagggctccagcacaggccggtgggctctgtagcgctgctccgggtggtggtcatcctgccccatcctgggttgctttcgcacataccggggcttggggcaccgggttgcccgcacctcatgtgccatgcgcccctggagctctgccgcagggtgcatttgtgtctcaggccgctagggctgccccagcactgcagccatcacaggccgctcccgcagaaggcgtcagtcagccagcgcctgccagaggcgacttcgcttacgctgcgcctgcaccaccagacggcgcactgagccatccacaggctccgaggtggcctccccaccccggaaaatctcgggaggaccgggacccccagagagatggactgccaggtccatgtgcagtagcccaaccgggtccggcacaagcaggaccacaaggccagggcgtgctggcaccgcctacctcccaggggtcaccttggtggggttgggggagagggcctcaggtcgcaggcgcagcatgggagccacaggcaggcgctgcgcctcctcctcagccagcacccccagacgcaagtgctagcgcaaggcaaggacaaatgcagggaatcccagccccatcacaagctctgcaggagcccgctccttggtcggcacttccttgtggccttcttctggacgaactgcttgctagcccagaatttctccagcaggctcagcccctcctggaaaccgaggccccaggcgagcttgaggcgagcgaggaggccgcttcgttagaggcacccctctctgaagaggagtaccgcgcactcctggaagaactatag

SEQ ID NO: 22812 - DNA, 1275 bp, Artificial Sequence
  Description of Artificial Sequence: Synthetic coding sequence
atggcactgcccacccccagtgattccactctgccagctgaggcaagggggaggggtagaaggcgcaggctggtctggactcctagccagtctgaagccctccgtgcttgttttgagagaaacccctatcccggtattgcgaccagagaaagactggctcaggcaatcggaattccagagcctcgagtccaaatctggttccagaacgaaaggtcgcgccaattacggcagcaccggagagagtccaggccttggccaggacgccgaggcccacccgagggccgaagaaagagaacagcagtcactggatcacaaacagcactgcttcttagagcttttgaaaaagatcggttccctgggatcgcggctcgagaggaactcgctcgtgaaaccggcctgccagaatctcgaattcaaatttggttccagaatcgcagggcaaggcaccctggacaagggggtagggccccagctcaggccggagggctttgcagcgctgccccaggaggtggccatcccgctccttcatgggtggcttttgcgcacacgggtgcttggggtacggggctgccggctccacatgttccttgcgctccaggagccctgccccaaggtgcgtttgtatctcaggccgctagagctgccccagctttgcagccatcccaagctgctcccgctgagggcgtctctcagccggctccagcgaggggtgacttcgcgtacgctgcgccagctccaccagatggcgcactgagccatccgcaggcccctcgctggcctcctcaccctgggaaatcacgggaggatcgcgaccctcaacgtgacggattgccaggtccatgtgccgtggctcagcccggacccgctcaggcgggaccccagggtcagggcgtcctagcccctcctacatcgcagggctctccttggtggggatggggaagaggtcctcaggtagctggagcagcttgggaaccccaggcaggcgctgcccctccaccccaacctgctcctcctgatgccagcgcatcagccaggcagggccagatgcaggggattccagcaccaagccaggccctgcaggaaccagccccttggagtgcattgccatgcggactcctgctcgatgagttgctggcctccccggaatttctgcaacaagcacagccactcctggaaaccgaggccccaggagaacttgaagcctcagaagaggccgcttcattggaggcacccttgagcgaggaggaatacagagcactgctggaagaactctag

SEQ ID NO: 22813 - DNA, 1458 bp, Artificial Sequence
  Description of Artificial Sequence: Synthetic coding sequence
atgaagggatggagccttccagcttgtggaccccttcaaggaagactggctgggtggctcgctgtcagggctggtttacttgctgctcccgcagcggttcatagccctgcagaagttcacggttcacctccagcaagcctctgcccacggccatcagtcaaatttcgaccaggcctgaccgctatggccctgcccacgccatctgatagcacactgcctgctgaggcacgcggaaggggaaggcgtcgcagactcgtgtggaccccaagtcagtccgaagcactgagggcctgcttcgagcggaacccctaccctggcatcgccacacgcgagagactggcccaggcaatcgggatccccgagccaagagttcagatctggttccaaaatgaacggtccaggcagttgcgacagcatagaagagaaagtagaccctggcccggacggagaggtcctcctgaaggaagaaggaagcggaccgccgtgaccggttcgcagacggccctcctcttacgggctttcgagaaggaccgctttcccggaattgccgctcgcgaagaactcgccagggagactggcctaccggagagtcgaatccagatctggttccaaaaccgacgagccagacacccaggacaggggggtagggcaccagcgcaggcagggggattatgcagtgctgccccaggagggggtcatcctgcaccctcctgggtcgcctttgctcataccggtgcatggggcacaggattaccagcccctcacgtgccatgcgcacctggcgcacttcctcagggtgccttcgtgagccaagccgcaagggcagcacccgctttacaaccttcccaagccgcaccagccgagggggtgtcgcaacccgctcccgctcgcggagacttcgcctatgccgcacctgccccacctgacggtgccctgtcccatccgcaggcccctaggtggccccctcatccaggtaaatcacgagaagaccgcgatccgcagagggacgggctcccagggccatgtgctgtcgctcagccgggaccagcacaagccggtccacagggccagggagtcttggctccacctactagtcagggctctccttggtggggttggggtcgcggtccacaagtggccggagccgcttgggagccccaagccggagccgctccacctccgcagccagcgcctccggacgctagtgcatccgctcgacaggggcagatgcagggcattcctgcccctagtcaagccctgcaagaaccggctccctggagcgcactgccctgcgggctgctgctcgacgaattgctggcatcccccgaatttcttcagcaggcgcagccccttcttgagaccgaggcaccaggcgagctggaagcttctgaagaggcagcttccctagaggcccctctgtctgaagaagaatatcgcgcactcctggaggaactgtag

SEQ ID NO: 22814 - DNA, 1458 bp, Artificial Sequence
  Description of Artificial Sequence: Synthetic coding sequence
atgaaaggttggagtctgcctgcctgcggcccactgcaggggagactcgccggttggctggctgtgcgtgcagggctcctggccgcacctgcagccgtccattctcctgccgaagtgcacggctccccgcctgctagtctctgtccccgaccgtcagtgaagttccgtcccggactcactgctatggccttaccaactcccagcgacagcaccctacctgctgaagcgagagggcgtggacgacggaggcggctggtctggacccccagccagagtgaggcactgagggcctgctttgaaagaaacccataccccggaattgcaactcgcgagaggttggcacaggccattggcattcccgaaccacgggtccagatctggttccagaatgaacgcagcagacagctgagacagcatcggagagaatcaaggccctggcccggtaggcgaggcccacctgagggacgcaggaagcgcaccgcggtgaccggatcccagaccgccttactgctgagggctttcgaaaaagaccggtttcccggaatagctgctagagaggagctggccagggagactggactgcccgagtctcgtattcagatctggttccagaatcgacgggcacgacatccaggacagggcggtcgggctccggcacaagccggtggtttgtgctccgcagctcccggaggtgggcaccctgccccaagctgggtggctttcgcccatacgggtgcctgggggactgggttgccggcacctcacgtgccttgtgcaccaggggctttgccgcaaggtgccttcgtgtcacaagcggctcgggctgccccagccctgcagccatcccaagcagcaccagcagaaggggtctcacaaccagccccagcacgcggtgatttcgcctacgctgctccggctccccctgacggggcacttagtcacccacaggcacctcgatggccaccccatcctgggaagagtagggaggaccgcgatcctcagagagacgggcttccaggtccatgcgccgtagcacagcccggtcccgcacaggccggaccccaggggcagggcgtcctagctccccctacaagccagggttctccttggtggggatggggacgcggacctcaggttgcgggagcggcatgggagccacaggctggcgcagctcctccccctcagcctgcccctccggatgcttctgcaagcgcccgacaagggcagatgcaggggattcccgcaccctcccaagcccttcaagagccagccccatggagcgccctgccatgcggcctgctgctggacgaacttctcgcgagcccagaatttttgcagcaagcccagccgctcctcgagaccgaggcaccaggtgaactggaggcctctgaagaggccgcaagcttggaggccccactgtcagaggaggaatacagagcccttttggaagagctgtag

SEQ ID NO: 22815 - DNA, 1275 bp, Artificial Sequence
  Description of Artificial Sequence: Synthetic coding sequence
atggcgctaccaacgcctagcgactctacactacccgctgaagccaggggcaggggtcgtaggcgcaggttggtgtggactcctagccagtctgaagctttaagagcctgtttcgagcggaatccttatcctggtatcgccactcgtgagcgcctagcacaggctattggcatcccggaaccgcgagtgcagatttggtttcagaacgagcggtccagacaactccgacagcacagacgcgaaagcaggccctggccaggccgtagaggaccacccgaaggcagaaggaagcgcaccgcggtcactggttctcagactgccctgctgctgcgagccttcgagaaggatagatttcccggtatagccgcacgggaagaattggccagggagacaggccttcctgagtctcgcatccagatatggttccagaacagacgggcaaggcacccgggacaggggggtagagccccagcacaggcaggcggtctctgcagcgccgcacccggtggcggacacccggcaccctcctgggtagcattcgctcacaccggcgcatggggcacgggactgcctgcgccacatgtgccctgcgccccaggcgctttgccacagggggcatttgtgtctcaggccgctcgggctgcccctgccttacaaccctctcaagccgctcctgcagaaggggtctcacagcctgcgcctgctagaggcgatttcgcttacgccgcaccagcgcctcccgacggagccctctcccacccccaggcgcctcggtggcctccccaccctggaaaatctcgggaggatcgtgacccccaacgggacgggctcccaggcccatgtgcagtggcccaaccgggaccagcccaggcgggaccccagggccagggggtgcttgcgcctccaacctcccagggatctccgtggtggggttgggggagagggcctcaggttgccggagccgcatgggagccccaggctggggctgcgcctccgcctcaacccgcacctccagacgccagtgcaagcgctcgccagggacagatgcagggcattcccgcaccgagtcaggccttgcaagaacctgcaccttggtctgctttaccctgtggactgttgcttgatgagctgctggcttctcccgaattccttcaacaagcgcagccattgcttgaaactgaagcacctggcgagctcgaggccagtgaagaagcagcgagtcttgaagcccctctcagcgaggaggaatatcgggctctgttggaggaattgtag

SEQ ID NO: 22816 - DNA, 1275 bp, Artificial Sequence
  Description of Artificial Sequence: Synthetic coding sequence
atggccctacccactccctccgactctactttacccgcagaagcgagggggcgtggtcggagaagacgccttgtgtggactccaagccagtctgaagccttacgggcatgtttcgagcggaatccatatccagggatagcgaccagggaaagactggcccaggcaatagggatcccggaaccaagggtccagatttggttccagaatgaacggtctagacagttgagacagcatagacgcgagtcacggccatggccagggagacgaggccctccagaggggagacgcaaaagaaccgccgtcaccggatctcagacagccttattgctgcgggctttcgagaaggacagattccccggaatcgcagcacgggaggaactggcacgcgagacgggactgccggaaagcagaatccagatttggttccagaataggagagcgcgtcaccctggccagggcggacgcgctcccgcacaggccggtggcctatgctcagccgcaccaggcggaggccacccggctccctcatgggtggccttcgcccacaccggagcatggggtaccggattgcctgcaccacacgtcccttgtgcccctggcgctcttcctcaaggagccttcgtgagccaagccgctagggctgctccggctctgcagcctagccaggccgcacctgccgaaggggtgtctcagccagccccagcacgcggagatttcgcttacgctgcccctgccccacctgatggagctttgagccacccacaggctccgagatggcctccacaccccggaaagagccgggaagaccgcgatcctcagagggatgggctgcctggcccatgcgccgttgcccagcccggacccgctcaggctggaccccaggggcagggagtgctcgcccctccaacgagtcagggctccccttggtggggatgggggcgtggaccacaagtagcaggagccgcatgggaaccgcaagctggcgcagctccccctccccaacccgcacctccggacgcctcagcctccgccaggcaaggtcagatgcagggtattcccgcacccagccaggcattacaggagccagccccttggagtgcactgccttgcggcttgctgcttgatgagctgctggccagccccgagttccttcagcaggcgcaaccccttctagagaccgaagccccaggcgagctggaggcaagtgaggaggcagcctctttggaagctcctctgtccgaggaagaataccgagccctgctggaagaactctag

SEQ ID NO: 22817 - DNA, 1419 bp, Artificial Sequence
  Description of Artificial Sequence: Synthetic coding sequence
atgaatggatacggctcaccctacctgtacatgggcggacctgtgtcacagccaccacgggcaccgctgcagcggacccctaaatgcgctagatgtagaaaccacggcgtcctgtcatggcttaaaggccacaagcggtactgtcgattcaaagactgcacgtgcgagaaatgcatcctgatcattgagagacagcgtgttatggccgctcaggtggccctcaggcgccagcaggctaacgaaagcctggagagtcttattcccgactccctgcgggcactccccggacccccacctcccggagatgcggtcgctgccccacaaccacctccggctagccagccctcacaaccacagcccccaaggcccgcagctgaactcgctgcagccgctgcactgagatggaccgctgagcctcagcccggtgctttacaagcccaactcgccaagccagaccttacagaggagcgcttaggagatgggaaaagcgccgacaacacagaggtgttttctgacaaggatacggaccagcgtagttccccggatgtggccaaaagcaaaggttgttttactcctgaaagccctgagatagtgtccgtcgaggaggggggttatgcggtgcaaaagaatggcggaaatcccgagagccgcccagattcccctaaatgtcatgccgaacagaaccacctgttaatcgagggaccctccgggacagtgtcattacccttctctctgaaagctaaccgccctccactggaggtcttgaagaaaatcttccccaatcagaagccaaccgtcctggaactgatactgaaagggtgcgggggagacctggtctccgctgtggaggttctgttgtcttcgagatcatctgtgaccggcgcagagcgaacgagtgccgaacccgagtcccttgctctcccttccaatgggcatatatttgagcacacccttagtagttaccctatctcttcctctaagtggtcagtgggaagcgcctttcgcgtgcccgatacactgcggttctccgcggacagcagtaacgtagtacccagcccactcgctgggcctttgcagcctcctttcccacagccccctagataccccctgatgctcagaaacactctggctcgcagccagtcaagtccatttcttccaaacgacgttaccctgtggaacaccatgaccctgcagcaacagtaccaactgagaagccagtatgtgtctcctttcccttccaacagcacctccgtgttccgttcctcaccggtcctaccagctcgggcaacggaggaccccaggattagtatccccgacgatgggtgtcctttcgtatcaaagcaatctatctataccgaagatgactacgatgagcgctccgattcctcagattccaggactttaaataccagttcatag

SEQ ID NO: 22818 - DNA, 339 bp, Artificial Sequence
  Description of Artificial Sequence: Synthetic coding sequence
atgcacactcgtaaacgccttacccaactattttgcttccctgatttgacggaagaaaggttgggcgacggcaagtctgcagacaataccgaagtgttctccgacaaggatacggatcagagatcttctcctgacgtcgcgaagtctaaggggtgcttcactccagaaagccccgagattgtcagcgtggaagagggcggttacgctgtgcagaagaacggaggaaaccccgaatcacggcctgacagccctaagtgccacgccgagcaaaaccatctgttaattgagggcccttcgggcactgtgagtctgccattctcattaaaagccaatcgatag

SEQ ID NO: 22819 - DNA, 1701 bp, Artificial Sequence
  Description of Artificial Sequence: Synthetic coding sequence
atggcccttagcgtgccagggtactcccctggatttcgcaagcctcccgaagtggtccggctcagacgtaaacgcgctaggtccagaggcgctgccgcaagccctccgcgagaactgactgaacccgcagcccgaagggctgccctggtggccggtctgccattgagaccttttcctgccgctggaggcagaggcggaggatccgggggaggccctgcagctgcacgcaggaatccgtttgccaggttggataatagaccaagggtggcagccgaacctcctgatggtccagcccgtgaacagcccgaggccccagtgccttttttggattcaaaccaggaaaacgacctactctgggaggaaaaatttccggaacggaccaccgtcacagagctgccccagacctctcacgtctcttttagcgaacctgatatccccagctctaaaagtaccgagcttcccgttgattggtcaataaaaacccgattactctttaccagttcgcagcctttcacttgggcagatcatctcaaggcacaggaggaggcacaggggttggtgcagcattgccgcgctacagaagtcactttgcctaaatcgatacaagatccaaagttatcctcagagttgcgctgcacctttcagcagtcgttgatctattggcttcatcccgctctgtcatggctgccacttttccccagaataggtgccgatcggaaaatggccggaaaaacaagcccttggagcaatgatgccacgctccagcacgttctcatgtccgactggagcgtgtcttttacttctctgtacaatctacttaagactaagctgtgcccatacttctatgtgtgcacctatcaattcaccgtgctttttagggcagccggactcgccggttctgacctcatcactgctcttatctctcctacgaccagagggctgcgggaagcaatgcggaacgaggggatcgaattctcactgcccctgataaaggagtctgggcataaaaaagaaacggcttcagggactagtttgggttatggtgaggagcaagctatttccgacgaagatgaagaggagtctttttcgtggctggaggaaatgggggttcaagacaagattaagaagcccgacatactgtccattaaattgaggaaggagaagcacgaggtgcagatggaccaccgtcccgagtcagtggttttggtgaaaggcatcaatacttttacgctgctcaattttttgataaatagcaagtccctggttgccacgagtggacctcaggcgggtctaccacctaccctgctgagtccagttgcttttaggggtgccactatgcagatgctaaaggctaggtcagtgaatgtgaagacacaagcgctgtcaggctatagggaccagtttagccttgaaatcactggacctattatgccacattccctccatagcctgaccatgttgctaaaaagttctcaaagcggaagcttctccgcagttctctacccacatgagcccacagcagtgttcaatatctgtctgcaaatggataaagtgctcgatatggaggtggtgcacaaggagctcacaaattgtggcttgcatccaaataccctggagcagttaagtcaaattcctctgttaggcaaatcttctttacgcaacgttgtcctccgcgactacatatacaactggcgctcttag

SEQ ID NO: 22820 - DNA, 618 bp, Artificial Sequence
  Description of Artificial Sequence: Synthetic coding sequence
atgccgtcaaagaaaaagaaatataatgccagattccctccggctcgcattaagaaaattatgcagacggacgaagagattggtaaggtcgcagccgcagtgccagtgatcattagccgtgccctggagctgttcctggagtcgctcttgaagaaggcatgtcaggtgacccagtcgcggaatgccaaaacaatgactacaagtcaccttaaacagtgcatcgagctggagcagcagtttgactttctcaaggatctagtggcatccgtgcccgacatgcagggcgatggcgaggacaatcacatggatggggacaagggtgctaggcggggacgaaaaccgggatcgggcggaagaaagaacggcggaatgggcactaaaagcaaggataagaagctgtccggtacagactcggaacaggaagatgagtccgaagataccgacaccgacggagaggaggagacatcacaaccgcctccgcaagctagtcatcctagcgcacacttccaatcaccaccaaccccattcttaccattcgcttccacgctgcctctccccccagcgccacccggaccctccgcccctgacgaagaagatgaagaggactatgattcttag

SEQ ID NO: 22821 - DNA, 750 bp, Artificial Sequence
  Description of Artificial Sequence: Synthetic coding sequence
atgaatcccagccctagcaagattcgaataaacctcgaggacaatgttcagtatgtctcaatgcggaaagctttgaaagtgaagaggccacgttttgatgttagcctggtttatctgacgcggaaatttatggacttagtgcgtagtgcaccaggaggtattctggacctgaacaaagtggcgacaaaacttggagtacgaaaaaggcgggtgtacgatatcaccaacgtcctggacggaattgatctcgtggaaaagaaatctaagaaccacatacgatggatcggctctgatctgagcaactttggagccgttccacaacagaaaaagctccaggaggaattgtctgacctctccgccatggaggatgcactggatgagctgatcaaggactgcgctcagcagttgttcgagcttacagatgataaagaaaacgagcggctggcttacgtcacgtatcaggatatccactcaatccaggcctttcacgaacaaatcgtgatcgccgtgaaagcgccagcagagacgcggcttgacgttcctgccccaagagaagatagtatcactgtccacatccgctccactaacggtccaatagatgtctacctttgcgaagtagaacaggggcagacctccaacaaacggagcgagggcgtgggtacatctagctccgaaagcacacatccggaaggtccagaagaagaagagaaccctcagcaatcagaagagttgctggaggtgtcaaattag

SEQ ID NO: 22822 - DNA, 402 bp, Artificial Sequence
  Description of Artificial Sequence: Synthetic coding sequence
atgagccagcagcggcctgcacgtaagctacctagcctgttacttgatcctacagaggagactgtgagacggaggtgtagggacccaattaatgttgaaggactgctgcctagtaaaattagaattaatttagaggataacgtgcagtatgtctctatgcgcaaggccctgaaagtgaaaaggccaagatttgatgtgtccctcgtctacctgacacggaagtttatggatttggtcagaagcgctcctggaggaattttagacctgaataaagtcgctactaagctgggcgttaggaagaggagagtgtacgatatcaccaatgtgctggacggaattgatctcgtggagaaaaagagtaaaaaccacatcagatggatgacgctgtcacagtgtacatag

SEQ ID NO: 22823 - DNA, 846 bp, Artificial Sequence
  Description of Artificial Sequence: Synthetic coding sequence
atgtctcagcaacgtcccgcaaggaaactgcccagcctgctgttagatccaaccgaagaaactgtgcgaaggagatgtcgcgatccgatcaacgtggaaggattgctcccctccaaaatccgcataaacctcgaagacaacgttcagtatgtttccatgcgcaaagccttaaaggtaaaacggcctcgatttgatgtgtcattggtatacttgactcgtaagttcatggacctggtccgatctgcacccggagggattcttgatctgaataaggtggctacaaagctcggagtacgtaagcggagagtctacgatattacaaacgtgctcgatggtatagacctggtggaaaaaaagtccaaaaaccacattagatggattgggtcggacctcagtaatttcggagcagtcccacagcagaaaaaactgcaggaagagctttcagacctgagtgcaatggaagatgccttggatgaacttatcaaggactgtgcccagcagctgtttgaactgactgatgacaaagaaaacgagcggcttgcctacgtgacttatcaggacattcacagtatccaggcattccatgaacagatcgtgatagctgtgaaggcaccagcagaaacaagactcgacgtgccagcaccgagagaggactcaattacagtgcatattcggagtactaatgggccaattgatgtctacctgtgtgaggtcgagcagggacaaacctcaaataaaaggagcgagggagtgggaacctcctcaagtgagtctacccatcccgagggccctgaagaagaggagaaccctcagcaatctgaagaactactcgaggtgtcaaattag

SEQ ID NO: 22824 - DNA, 621 bp, Artificial Sequence
  Description of Artificial Sequence: Synthetic coding sequence
atggatctcgtgcggtccgcacctggcggtatactagatttgaataaagtggccaccaaactgggtgttaggaagagacgggtgtacgacattaccaacgtattggatggcattgacttagtggagaaaaagagtaaaaatcatataagatggattggcagcgatctaagcaatttcggcgcagtgccacaacagaagaaactgcaggaggagctttccgatctcagtgccatggaagatgccctggatgagctcatcaaggactgtgcccaacaactgtttgaattgacggatgacaaggagaatgagcgcctcgcctatgttacctaccaagatattcacagcattcaagctttccacgagcaaattgtgattgcagtcaaggctcctgccgaaacgcggctagacgtgcccgcaccacgcgaagattccattaccgtgcatatcagaagcaccaatggcccaatcgatgtgtatttgtgtgaggttgagcagggtcagacatccaataagcgatccgagggagtaggtactagttcttctgaaagcacgcaccccgaaggaccagaagaggaggagaatccccagcaaagtgaggaactcctcgaggtgtccaattag

SEQ ID NO: 22825 - DNA, 621 bp, Artificial Sequence
  Description of Artificial Sequence: Synthetic coding sequence
atggacctggttcggtctgccccaggcggaatactcgatcttaacaaggtggctaccaagctgggagtcaggaagagacgagtatatgatatcactaacgttcttgacggtatcgacctggtggagaagaagtccaagaatcatattagatggattggatccgatctttcgaatttcggcgcagtccctcaacagaagaaactccaggaggagctgagcgacctatctgcaatggaagatgcactggatgaactaattaaggactgcgcacagcaactgtttgaactgacagatgacaaggagaatgaaaggcttgcatacgtaacgtaccaggacattcactctatccaagcttttcatgagcagatagtgatcgccgtgaaagcccctgcagaaactaggctggacgtgcctgctcccagggaggacagcattacagtgcacatccgcagcactaacggacccatagatgtctacttgtgcgaggtagagcaggggcagacctccaataagcgctcagaaggcgtgggtacatcttcaagtgaatccacacacccggaagggcctgaagaggaggagaatccacagcaatcagaggaactactggaggtgtctaactag

SEQ ID NO: 22826 - DNA, 1860 bp, Artificial Sequence
  Description of Artificial Sequence: Synthetic coding sequence
atggccgctgtcgtacagcagaatgacctcgtgttcgaatttgcctcaaacgtgatggaggatgaacggcagctcggcgatcctgccatttttcccgctgtaatcgtcgaacatgtgccaggcgcagatattctgaactcctacgccggacttgcttgcgtagaagaacccaatgacatgatcactgaaagcagcctggatgttgctgaggaggagatcattgatgatgatgatgacgacattacattgacagtagaagccagctgtcacgatggcgacgaaaccatcgagacgatcgaagcagctgaagctctgttaaatatggactcccctggccctatgctggacgagaaacgcatcaataacaacatattttcaagccccgaggacgacatggttgtcgcaccagtcacccacgtgtctgtcaccctagatgggatacctgaggttatggaaacgcaacaagtgcaggagaagtacgctgactccccaggcgcaagcagccccgaacagccaaagcggaaaaaaggccgaaagaccaagccaccacggccagactcacctgccaccacgcccaatatcagcgtgaagaaaaagaacaaggacggaaaagggaacacaatatacctttgggagttcctgctggcgctgctgcaggacaaagccacatgccccaagtacatcaaatggactcagagagagaagggaatctttaagctggttgactctaaggcagtgagtcggttatggggaaagcacaaaaacaagcccgatatgaactatgagacaatggggagggcactccgatattactaccagcgaggaatcctcgccaaggtagaaggtcaaaggctagtatatcagtttaaagaaatgccaaaagacctcatttacatcaacgatgaggatcccagctctagcatcgagagtagcgatcccagtcttagttctagcgcaacaagcaacagaaaccaaacctccagaagccgtgtgtcatcctctcctggggtgaaggggggtgctaccaccgttctaaagcctggcaacagcaaggctgccaaacctaaggatccagtcgaagtggcccagccatccgaggtcttaagaacagtccagccaacccaaagtccctacccaacgcagctgtttaggaccgtacacgtggtgcagcccgttcaagccgttcccgagggcgaggctgctaggacgtctaccatgcaggacgaaacactgaacagttctgtccaatccatcagaaccatccaggctcctacccaggtaccagtggtggtgtcccctcggaaccagcagttgcataccgtgacactacagacagtcccattgaccacagtgatcgcctccaccgatccgtctgctggtacaggcagtcagaaatttatactccaggcaatcccctcgtcacagcccatgaccgtgcttaaggagaatgtgatgctgcaatcccagaaggcaggctcacctccatctatcgtactcggacccgcacaagttcagcaggtcctcaccagtaacgtccagacaatctgcaatggcacagtgtctgtggcctcctctccgtcattctcagctactgcacccgtggtcactttcagccccaggagttcccagttagtggcacatccccctggcaccgtaattacctctgtgatcaagacccaggagactaaaactctcacacaagaagttgaaaagaaagagagcgaggatcacctaaaggagaacacagaaaaaacagaacagcagccccagccatacgtcatggtcgtctctagttctaacgggttcacaagccaggtagccatgaagcagaacgaactgcttgagccaaactctttttag

SEQ ID NO: 22827 - DNA, 1086 bp, Artificial Sequence
  Description of Artificial Sequence: Synthetic coding sequence
atgaactatgagactatgggaagagcactgcggtattattatcagcggggtatactggcaaaagtcgagggacagaggttagtctaccaattcaaggaaatgccaaaagacttaatatatataaatgacgaagacccctcgtctagcattgaatctagtgacccgtcattatcctcatcagctactagcaatcgtaaccagacctctagaagcagagtctccagttctcccggtgtgaaagggggagccacaaccgtgctcaagcctgggaatagcaaggctgctaagcccaaagatcccgtcgaagttgcacagccgtctgaggtgctccgcaccgtccaacctacccagtcaccctaccctacacagctgtttaggacagtgcatgtggttcagcccgtccaggctgtgccagaaggagaggccgctaggacatccacaatgcaggatgagacactgaacagttccgtgcagagtataaggacaatacaagcgccaacccaggtgccagtggtggtgtcacctcggaaccaacagctgcacaccgttacgttacagactgtgcccctcaccacagtcatagcctcaacagatccctcagccggaacaggatctcagaagttcattttacaagcaattccttctagccaacctatgactgttcttaaggaaaacgtgatgcttcagtctcagaaagccggtagtcccccaagcatcgttctcggcccagcccaggtgcagcaagtgctcacgtcgaacgtgcagaccatttgtaacggcaccgtcagcgtggccagttcccccagtttcagcgcgactgccccagtggttaccttttctccgaggtcaagccaacttgtggcccacccaccgggaacagtcatcacctctgttataaagacccaggagaccaagactctgacacaggaagttgaaaagaaggaatcggaggatcacctgaaagagaacactgagaagactgaacaacaacctcagccatacgtgatggtcgtgagttcctccaacggctttacgtcacaagttgctatgaaacagaatgaactcttggagccaaactccttctag

SEQ ID NO: 22828 - DNA, 75 bp, Artificial Sequence
  Description of Artificial Sequence: Synthetic coding sequence
atggctgcagttgtacagcaaaatgatcttgtgtttgagttcgcgtccaatgtaatggaagatgagcggcaatag

SEQ ID NO: 22829 - DNA, 1788 bp, Artificial Sequence
  Description of Artificial Sequence: Synthetic coding sequence
atggctgctgttgtgcagcagaacgacctagttttcgaattcgccagcaatgtgatggaggatgaaaggcagctcggcgatcccgctattttcccggctgtcatagtcgaacacgttccgggagccgacatccttaacagctatgcgggactcgcctgcgttgaggaaccgaacgatatgatcaccgagagtagcctagacgtagccgaggaggagatcatcgacgacgacgacgatgatatcacactgacagtcgaggcctcctgccacgacggggacgagactatagaaactatcgaggcggcagaagctctactgaatatggatagccccggtccgatgctggacgagaaacggatcaacgggattcccgaagtgatggagacacaacaagtccaagaaaaatatgcggacagcccgggagcgagcagccctgagcagccaaagaggaagaaggggaggaaaacaaagccccctcgccctgattctcccgcaacgacccccaatatctccgtgaaaaaaaagaataaagacggaaaaggtaataccatttacctgtgggagttcttactggcactgctgcaggataaagccacttgccccaagtacattaaatggacccagagggagaagggcatcttcaaactcgttgactccaaagcagtgagccgactgtgggggaagcataaaaacaaacccgacatgaactacgaaactatgggaagggccctaagatactactatcaaagaggtatcctcgctaaggtggagggtcagaggctagtataccaattcaaggaaatgcccaaagatctgatatacatcaacgatgaggacccaagctcctctattgagtcttcagacccctccttgtccagctccgcaacaagcaatcgtaatcagacttctaggtcccgggtgagcagcagccctggggtcaaagggggagccaccaccgtgctcaaacccggtaactccaaagctgctaaaccaaaggaccccgtcgaggtggctcaaccgtccgaagttctccggacagtccagcctacccagtctccctacccgacacagctatttcggacagtacacgtggtccagccagtccaagctgtccctgagggggaggcagctcgtaccagcaccatgcaggacgagactctcaattctagcgttcagtcaatacgaaccatccaggctcccacccaggtgcctgttgtggtctctccaagaaatcagcagttgcatacggtcacgctgcagactgtcccactgactactgtgatcgctagcaccgacccgagtgcagggactggctcacagaaatttatcctgcaggcaatcccaagctcccagccgatgacggtcctcaaggaaaatgtcatgttgcaatcacaaaaggcgggatccccacccagcattgtcttaggaccagctcaggtccagcaagtcctgacaagtaatgtgcagacgatctgtaatggcaccgtgtccgtcgccagctccccatctttttcggcgaccgcacccgttgtgaccttcagtccaagatcgtcccagctggtggcacacccacctgggactgtaatcaccagcgtgatcaaaacccaggagacaaaaactctgactcaggaggttgaaaaaaaagagtccgaggatcacctcaaggagaacactgagaaaaccgaacagcaaccgcaaccttacgtcatggtggtcagcagctcaaacggttttacatctcaggttgcgatgaaacagaacgagctgttagagcccaactcattttag

SEQ ID NO: 22830 - DNA, 1776 bp, Artificial Sequence
  Description of Artificial Sequence: Synthetic coding sequence
atgttcggcattcaggagtccatccagcggtctggttcaagtatgaaggaggagcctctcggctctgggatgaacgccgttcgaacctggatgcagggggctggcgttttagacgccaatacggctgcccagtccggggtgggacttgccagagcacattttgaaaaacagcctccatctaacctcaggaagtccaacttctttcattttgttctggcattatacgaccggcagggtcagccggtggagatcgagagaacagcctttgttggctttgtcgagaaggaaaaggaggccaacagcgagaagacaaataacggcatacactaccggttgcaactgctctactcaaatggtatccggacggagcaggacttctatgtccgactgattgacagtatgaccaagcaggccatagtatatgaaggacaagataagaatccagagatgtgccgggtcttgctcacacatgagataatgtgcagcagatgctgtgataagaaaagttgcggtaacagaaatgagacaccttctgatcccgttatcatagacaggttctttctgaagtttttcttaaagtgtaaccagaactgtctcaagaatgccggaaacccgagggacatgagacgatttcaggtggtggtgtccactaccgtcaacgtcgatggacatgtgcttgccgtttctgacaacatgtttgtccataataattcaaagcatggaagacgagctcgacgtctagatccgtctgaggggacgcccagttacctggagcatgctaccccttgcattaaggcgatctccccttcagagggttggacaactgggggtgcaacagttatcatcatcggggacaacttttttgatggcctgcaggttatcttcggtacgatgctggtctggtccgaactaatcactcctcatgctatcagggtccaaactccaccaaggcacattccaggcgtcgtggaggtaacgttaagctacaaatccaagcagttctgtaaaggaaccccaggccgtttcatttataccgcactgaacgaacctaccattgactatggttttcagcgtttgcagaaggtaatccctcgccatccaggagatccagaacgactgcctaaggaggtgattctgaaacgagcagcagatttagtggaggctttgtatggtatgcctcacaacaatcaagagataatcctgaagcgcgctgcggacatagcagaggcattatactctgtccctagaaatcacaatcagctcccagcactggcaaacacctccgtccatgccggtatgatgggagtgaacagcttcagtggccagctggcagttaatgtatctgaggcctctcaagcaactaatcagggcttcacgaggaatagtagctcagtttcacctcatggatacgtccccagcactactccacagcagaccaattataatagtgtaacaacctcaatgaatggctatggttctgccgctatgagcaatctcggcggatcccctacgttcctgaacggttctgctgcgaattccccttatgccattgtaccttcaagccccaccatggcctcctccactagccttcccagcaactgttcaagcagttctggcatattctctttctctcccgctaacatggtgtcagcggttaagcagaagagcgctttcgccccagtggtcaggccccagactagccccccacctacatgcactagtacaaacggtaactcgctgcaggccatttcaggtatgattgtaccaccgatgtag

SEQ ID NO: 22831 - DNA, 1776 bp, Artificial Sequence
  Description of Artificial Sequence: Synthetic coding sequence
atgttcggaattcaggaatcaattcaacgcagtggttcaagtatgaaggaggagcccctgggatcgggtatgaacgccgttaggacgtggatgcaaggcgcaggtgttctcgatgccaatacggctgcacaatcaggcgtgggtctggcgagagcacacttcgaaaaacaaccgccatccaatctgagaaaaagcaattttttccactttgtgttggccctgtatgacaggcagggacagccagtcgaaattgagcgaaccgcttttgtgggtttcgttgaaaaagagaaagaagccaattcagagaagacaaataatggtattcactatcgcctacagctgctgtatagtaatggaatacgcaccgagcaagacttctatgtccggctgatcgacagcatgacaaagcaggctatagtgtatgaggggcaagacaagaacccggaaatgtgccgagtgttgttgactcacgaaataatgtgttctagatgctgtgacaagaagtcctgcggaaaccggaatgaaaccccatccgatcctgtcatcattgacagattcttcttgaagttttttctcaagtgtaaccagaattgtctaaaaaacgcaggaaatcctagggacatgcggagattccaggttgtggtgtctaccacagtcaacgtcgacgggcacgtgttagcagtctccgacaacatgttcgtacacaacaacagcaagcatggccgacgcgcaaggcggctggaccccagcgagggcaccccttcttacctggaacatgccactccttgcataaaggcaattagccccagtgaggggtggacgaccggcggagctaccgtaataataatcggcgacaattttttcgatggactccaagtgatctttgggaccatgctggtgtggagcgaacttattacgccccatgcaattagggttcagacgccccctagacacattccgggagtcgtcgaggtgacactttcatataagagtaaacagttctgcaaaggcacgccaggtaggttcatctacacggccctgaacgaacccacaatagactatggcttccagcgactgcagaaagtaattccacgccatccaggcgatcctgaacggctgccaaaagaggttattttaaaaagggccgcagatttagtggaagccctgtatgggatgccccacaacaaccaggagatcattctgaagagagcagcagacattgcagaagcactatatagcgttccacggaaccataatcagctgcccgcactggcaaacacatcagtacatgctggaatgatgggagttaattcttttagtggtcagctagcagttaatgtctccgaggcttcccaagcaaccaaccagggatttacacgcaattcttcaagtgttagccctcatgggtatgtgccaagtacaaccccgcagcagactaattataattccgtgacaacgagtatgaacggttatggaagcgccgcaatgtcaaatctgggtgggtctcccacattcctgaatgggtctgcagcaaattcaccgtacgccatcgttccgagtagccccaccatggcatcaagcacctcgctcccatcaaactgctctagttctagcggcatattctctttttctcctgccaacatggtctcagctgtgaagcagaagtccgcctttgccccagtggttaggccccagacctcgcccccacccacatgtactagcacaaatggcaatagcctgcaggccatttctggtatgatagttccacctatgtag

SEQ ID NO: 22832 - DNA, 1683 bp, Artificial Sequence
  Description of Artificial Sequence: Synthetic coding sequence
atgtttggaatccaagaaagcatccagcgatctgggtcctcaatgaaggaagagcctctggggtctgggatgaatgccgtgcggacctggatgcagggggctggggttctggatgcaaacaccgctgcgcagtctggagtcgggctggccagagctcactttgaaaagcaacccccaagcaacttgagaaaatctaacttcttccacttcgtgcttgccctgtatgacaggcagggccaaccggtggaaatcgaacggacggcattcgtgggattcgtggaaaaagagaaggaggccaattccgagaagactaacaacgggatccattataggttgcagctcttgtatagtaacggcatccggactgaacaggatttttacgtgcggcttatagacagtatgaccaaacaggctattgtatacgagggccaggacaagaatcccgagatgtgcagagtgctgctaacacacgagataatgtgtcggttcttcctgaagtttttcctgaaatgtaatcagaactgcctaaagaatgcagggaaccctagggatatgcgacgatttcaggtggttgtgagcaccaccgtgaacgtggatggccatgttctggcagtatccgataacatgttcgtgcataataactcaaagcacggccgacgcgctaggcgcctggacccttcggaggccacaccatgcattaaggctatttcccctagcgaagggtggactacaggaggagctacggtgattatcattggagacaacttcttcgatggattacaggtgatcttcggtactatgcttgtttggagtgaattgatcacacctcatgccattcgtgtccagactccacctagacacattcccggtgtggtggaggtgactctaagctacaaaagcaaacagttttgcaagggaactcctgggcgtttcatatataccgccctgaacgagcccaccattgactacggctttcagcgactgcagaaggtcatcccaaggcatccgggagacccagagcggcttcctaaggaggtgatcctcaagcgcgcagctgatctcgtcgaagctctctatggcatgccccataataatcaggaaatcattctgaaacgcgcagccgatattgctgaagctctgtattccgtgcctcgcaatcacaaccagttacccgctctcgcaaatacctccgtccacgctggaatgatgggggtgaattcattctcgggccaacttgccgtgaacgtgtctgaagcctcacaagctacgaatcaggggttcacacgcaattcgtcatccgtttccccccacggttacgtcccctcgaccactcctcagcagaccaactataacagcgtgactactagcatgaatggctatggctcagccgcaatgagtaatctcggtgggagccccacattcctgaacggctcagcggcaaattctccgtacgcgattgtgccttcttcacctaccatggcatctagcacatccctgccaagcaattgttcttcgtctagtggcatcttcagttttagcccagccaatatggtgagtgccgtgaaacagaaatcagcatttgccccagtagtacgccctcaaacttctcccccacccacatgtacatcaacaaatggaaatagcctgcaagccatctcgggaatgatagtgccacctatgtag

SEQ ID NO: 22833 - DNA, 4506 bp, Artificial Sequence
  Description of Artificial Sequence: Synthetic coding sequence
atgtgtaagatggcaattatcccggattggctgcgcagtcaccctcacacacgaaagttcacccatagtagaccgcactcttccccatgtcgtgtatacagcaggaacggctcccccaataaattcaggagttcctccactacagccgtggcaaacccgaccctctcgagcctcgacgtgaagagaatcctgtttcagaagatcacagatagaggtgacgagcttcagaaggcttttcagctgctggatacaggccagaatttgacagtcagcaagtctgagctgcgccgaattatcactgattttttaatgccgctaactagggaacagtttcaggatgtgctggcccagatcccgctctcaaccagcgggacagtgccttatctggcatttttaagcaggttcggcggaattgacctttatattaatgggattaagcgtggaggcggtaatgagatgaactgttgtcgtacattgcgtgaacttgaaatccaggtgggggagaaggtgtttaaaaacataaagaccgtaatgaaggccttcgagctcatcgacgtgaataaaaccggtttggtgcgacctcaggagctcagacgggtattagagaccttctgtatgaaattgagagacgaggaatatgaaaaattcagcaagcactataacattcataaggacaccgcagtcgattataacgtcttcttgaaaaatttgtccatcaataacgacctgaacctgagatactgcatggggaatcaggaagtcagcctcgaaaaccagcaggcaaagaacagcaaaaaggaacgcctactgggcagcgccagtagtgaggatatttggaggaactatagtcttgatgagatcgaacgtaatttctgcctccaactgagtaagtcttatgagaaggtggagaaagccttgtcagctggcgacccttgtaaggggggatacgtgtcgttcaattacttaaagatcgtgctcgacacatttgtgtatcagattcccagacggatattcattcagcttatgaaacgcttcgggcttaaggcaactactaagattaattggaaacagtttctcacaagctttcatgagcctcaggggcttcaggtgtcttccaagggtcccttgacaaagcgtaactcaatcaacagccggaatgaaagccacaaagagaacatcattactaaactcttccgtcacacagaagaccactcagctagtctgaagaaagccctgttgatcattaacaccaaacccgacggacccatcacccgcgaagagttccgttacatcctcaattgtatggcggttaaactttccgatagcgaatttaaggagctcatgcagatgctagacccgggagacactggggttgtaaatactagcatgtttatagatctgatcgaagagaattgtagaatgcggaaaacttctccttgtaccgatgcaaagactccgttcctgttggcatgggatagtgtagaagagatcgtccacgacacgattacaagaaacttacaggcattctacaacatgctgaggagctacgacttgggagacaccgggcgaattggacgcaataacttcaaaaaaatcatgcatgtcttttgcccatttctcactaacgctcattttatcaaactgtgtagtaaaatccaggatattggtagcgggaggattttgtacaagaaactgctggcttgcattggaattgatggcccacccactgtaagccctgtcctggtgcccaaggaccagttgcttagcgaacatcttcagaaggatgagcaacagcaaccagatctgagtgagagaaccaagttgacagaggataaaaccactttgaccaaaaagatgacaaccgaagaagtgatcgagaagtttaagaagtgcatccagcagcaggatccagcttttaaaaaaagatttttagactttagcaaggaaccgaacggtaagataaatgtgcacgatttcaagaaggtcttagaggataccggaatgcccatggacgatgatcagtatgccttgcttactaccaagataggttttgagaaggaggggatgagttacctggacttcgcagctggatttgaggacccacccatgcggggacccgagaccacaccaccgcagcctcctacacctagcaaaagctacgttaacagccactttatcaccgcggaggagtgcctgaagctcttcccaaggcgcctcaaggagtcttttagggacccgtacagtgcttttttcaagacagacgccgacagagatggaatcatcaacatgcacgacctgcacagattgttgctgcacctgctcctcaaccttaaagacgatgagttcgagcggtttcttggactgttgggactccgtctgtccgtgactttgaatttccgcgagttccagaacttgtgtgaaaagcgcccttggagaaccgacgaggccccacagaggttgatccgtcctaaacagaaagtggcagacagcgaattggcgtgtgaacaggcccaccaatacctggttactaaagccaagaatcggtggagcgatcttagcaaaaatttcctggagaccgacaatgaaggaaacggtatcctgaggaggcgtgatataaaaaatgcgctctatgggttcgatatccccttgacccctagggaattcgaaaaactgtgggcccgttacgacactgaaggcaagggtcatattacttaccaagaattccttcaaaagttgggaattaactatagcccagctgtgcacagaccctgcgccgaggattacttcaatttcatgggtcacttcacgaaaccacagcagttacaagaagaaatgaaagagctgcagcagtcaacagaaaaggccgtagccgcaagagacaagctgatggatcggcaccaggatatctcaaaggctttcacaaagacagaccagtccaaaacgaactacatcagtatttgcaagatgcaggaagtgctcgaggagtgcggctgtagtctcaccgagggagagttgacccacctcctgaactcctggggggtgtctcgccacgacaatgccattaattatctcgacttcctacgagccgtcgagaatagcaagtctacaggtgcccagcccaaggagaaggaagagtcaatgcccatcaatttcgccaccctgaatccacaagaggctgtgagaaagatccaggaggtagtggagagctcacagctggcgctgtcaacagcattctcggcgcttgataaggaggacaccggctttgttaaagccaccgagttcggacaggtgctgaaggatttctgttacaaactgacggacaatcagtaccactatttcctgcggaaacttcggatacacctgaccccttatattaactggaaatacttccttcagaacttcagctgcttcctggaagagactgccgatgaatgggctgagaagatgccgaaaggtcctcctccaacgtctcccaaagccacagccgacagagacatattggccagactgcataaagccgtaacttcacactaccacgcgattacacaggaattcgaaaattttgatacgatgaaaactaatactataagccgggaggaattccgagcaatatgcaatcgacgcgtccagattctgacagatgagcaattcgaccgcctttggaacgagatgcctgtcaatgccaagggtagactcaaatatccagattttttatctagattctccagcgagaccgccgctacgcctatggccacaggagatagcgctgtcgcgcagcgcggaagctccgtgcccgacgttagtgaaggcacacgctccgctctcagcttgccaactcaggagctgcgcccaggatcaaaaagccagtcacatccctgcactccagcttctacaactgtgatcccaggtaccccacctctccagaactgtgatcccattgagagtcgcttacgtaagcgcatccaggggtgttggagacaactgttgaaagagtgcaaggagaaggacgtggctcggcagggcgacataaacgcttccgattttctggcactggtcgagaaatttaatctggacatcagcaaggaagaatgccaacagctgatcatcaaatacgatctgaaaagcaatgggaagtttgcctattgcgacttcattcaaagctgcgtgctactgttaaaagcgaaagagagctcactgatgcataggatgaaaattcagaatgctcacaagatgaaggaagccggtgccgagacaccttctttttactccgcactgttaaggattcagcctaagatcgtacattgctggcgcccaatgagacggacattcaaatcctatgacgaagccggaaccggtttactgagcgtggcagacttccggacagttctccgacagtatagtatcaacctttctgaggaagaattctttcacatcctggagtattatgataagacactgtcttcgaagatcagttataatgacttcttaagggcattcctgcagtag

SEQ ID NO: 22834 - DNA, 732 bp, Artificial Sequence
  Description of Artificial Sequence: Synthetic coding sequence
atggttccccagatttcatccgacttgctgcaaataccgctgtccacctccgggacggtgccatatctggccttccttagtaggttcggcggaattgatctttacattaatggtattaaacgcggagggggtaatgaaatgaattgctgccgaactctccgcgagctggaaatccaggtgggagagaaggtgtttaaaaacattaaaacagtgatgaaagcattcgagctgattgatgtgaacaaaacaggcctcgtgaggccacaggagctgaggcgagtcctcgaaaccttctgtatgaaactgcgagatgaagaatatgaaaagttttcaaaacactataacatacacaaggacactgccgtggactataatgtcttcctaaagaacttgtcaatcaataacgacctgaatcttaggtattgtatgggcaaccaggaagtgagtttagagaaccagcaagcgaagaattccaagaaggaacggttgctcggttctgcttcatccgaggatatttggcggaattattccctggatgagattgaacgaaacttctgcctacagcttagtaagagctatgagaaggttgaaaaagccctgtcagcaggtgacccatgcaaaggcggttatgtgtcatttaactatctgaaaattgtgctggatacattcgtttaccagattcctagaaggatctttattcagctgatgaagcgaaatcccatggaccgctag

SEQ ID NO: 22835 - DNA, 4050 bp, Artificial Sequence
  Description of Artificial Sequence: Synthetic coding sequence
atgaactgctgcaggactcttagagagctagagattcaggtcggggaaaaggtgttcaaaaatattaagaccgttatgaaggccttcgaacttatcgacgtcaataagactgggctggtgagaccacaggagctacgccgagtcctggagactttttgcatgaagctcagagacgaggaatatgagaagttttcaaaacactataacatccacaaagatacagccgttgactataatgtctttctgaagaatctgtccattaacaacgaccttaacctgaggtactgcatgggtaatcaggaggtgtctctagagaaccaacaggccaagaattccaagaaggagcgactgctagggtcagcaagttccgaagacatatggcggaactacagcttagacgaaatcgaacggaatttttgtctgcagctaagtaaatcttatgagaaagtagaaaaggctctgtctgctggtgacccatgtaaggggggatatgttagctttaactacctgaagattgtgctcgacaccttcgtatatcagattccacgtcgcatcttcattcaactgatgaagcgcttcggactaaaagccacaaccaagataaattggaagcaatttcttacctccttccacgagccccaaggtctgcaggtgtcttcaaagggccctctgaccaaacggaacagcatcaattctcgcaatgaatcgcataaggagaatatcattacgaaactcttccgccacacagaggatcacagcgcaagcctgaaaaaggctctgctgattataaacacgaaaccggatggtccgattactcgcgaagaatttcgctacattctgaactgtatggcagttaaactgagcgactccgaattcaaagaattgatgcagatgctagacccaggggacactggggtggtaaacacctctatgtttattgacttgattgaggagaattgtaggatgagaaaaacatcaccttgtactgatgccaaaactccttttcttctggcatgggacagcgttgaagagatagttcacgatacaatcacacggaatctgcaggccttctacaacatgttgagaagttatgatctcggcgacaccggcaggattggaagaaataattttaagaaaattatgcacgtcttttgccccttcttgacaaatgctcatttcattaaactgtgttccaagatccaagatatcggatccggaaggatattatataaaaaactcctggcatgtatcggtattgatggcccaccgactgtgtcccctgtgctcgtgcccaaggatcaactgctgtccgaacatctccagaaggacgaacagcagcaaccagacctgagtgaaagaactaagctaacagaagataaaactaccctgacgaaaaagatgaccacagaggaggtgattgagaagtttaagaagtgcatccagcagcaggatccagcatttaagaagcgattcttggacttctcgaaggagccgaatggcaaaatcaatgtgcacgattttaagaaggttctggaggataccggcatgccaatggatgacgaccagtatgccctgctgacaacgaagatcggcttcgagaaggaaggtatgtcttacctagatttcgccgctggctttgaagacccacccatgagaggacccgagaccacaccaccgcagccccctaccccgtccaaaagttatgtcaattctcacttcattaccgccgaggaatgccttaaactcttccctcgtcggctgaaagagagttttcgcgacccatattccgccttttttaaaaccgatgccgaccgggacggtattatcaacatgcatgatcttcacagacttttgttgcacctgttacttaacctcaaagacgatgaattcgagcggttcttgggacttcttggactgcgcctgtctgtgaccttgaacttcagagagtttcaaaacctgtgtgaaaagcggccatggcgaacggatgaagctccccagcggcttataagacctaagcagaaagtagcagactccgaattggcgtgcgagcaagcccaccagtatctcgtgaccaaagctaagaacagatggtctgatctctccaaaaactttttggagaccgataatgagggaaatgggatcttgcgccgtcgagacattaaaaatgctctctacggctttgacatcccactgacaccccgtgaatttgagaagctctgggctaggtatgacaccgagggtaaaggtcacatcacgtaccaggagtttctgcagaaactgggaatcaattactcaccagcagtgcatagaccatgcgcggaagactacttcaatttcatggggcatttcactaaaccccagcaactacaggaggagatgaaggagctgcaacagagtactgaaaaggctgtcgctgctcgagacaagttgatggatcgacaccaggatatctctaaggcatttactaaaactgatcaaagcaaaaccaattacatatccatttgcaagatgcaggaggtgcttgaggaatgcgggtgctcgctgacggagggagaactgacccacctgctaaatagttggggagtgtccaggcatgacaacgccatcaactacctcgacttcctgcgcgctgtggaaaattccaagtccacgggcgctcagccaaaagagaaagaagaatctatgcccattaattttgcaactctaaacccacaagaggccgtccgaaagatccaggaggtggtggaatcatcccagctggccctctcaacagccttttccgctttagacaaagaggatactgggttcgtgaaagcaacagaattcggccaggttctgaaggacttctgttataagttgaccgataaccagtaccactacttcctccgcaaactgagaatacacctgaccccttacatcaattggaaatactttctgcaaaattttagctgctttctagaggagacagccgacgagtgggccgagaagatgccaaaaggtccaccacccacttcccctaaagctactgcagacagggacatactcgccaggctgcataaggccgtgacctcacactaccacgcgataacacaggaatttgagaattttgatacgatgaaaactaacacgattagccgcgaagagttccgggctatttgtaaccgaagagtgcaaattctcaccgacgagcagttcgacaggctttggaacgaaatgcctgtcaatgcgaaaggtcgcctgaaataccccgattttctgtccaggtttagctcagaaactgctgccacacccatggctacgggtgactcagccgtcgcccaacgtggcagcagtgtgccagatgtgagcgaaggaacacggtccgctctttcattgcctacgcaagagctcagaccaggcagtaagtcgcagtcccatccatgcacaccagcctccacaacagtcataccgggaacaccccctctgcagaactgtgatccaatcgaatctcggcttagaaagaggatccagggttgttggaggcaactgttaaaagaatgtaaagagaaagatgtcgctaggcagggagacatcaatgcgtccgacttcctggccctcgtggagaaattcaatttggatattagcaaggaagaatgccagcagctgattatcaaatacgacttgaaatctaacggcaaattcgcttactgcgacttcatccagagctgcgtacttctgctgaaggccaaggagagcagtttgatgcatcgcatgaaaatacagaatgctcacaaaatgaaggaggcaggcgctgaaaccccaagcttttacagtgctctgctccgcatccagccaaagattgttcactgttggaggcctatgcggagaacattcaaatcctacgacgaggctgggacaggtctcctgagcgttgccgacttccggactgttctcaggcagtattcaattaatctttctgaagaagagttctttcatatcttggaatattacgacaagacactctcgtctaagatctcttataatgacttcctgcgcgcattcctgcagtag

SEQ ID NO: 22836 - DNA, 783 bp, Artificial Sequence
  Description of Artificial Sequence: Synthetic coding sequence
atgaactccgcagcagggtttagtcacttagaccgcagggagcgagtgttgaaacttggagagtccttcgaaaagcagccccgttgcgcattccacacggtgcggtatgactttaaaccagcatctatcgatacttctagcgaggggtatctggaagtcggagagggtgagcaggtcacgattaccttaccaaatatcgaaggaagcacccccccagtgacagtttttaagggctcaaagaaaccctaccttaaggagtgcatcctcattattaatcacgacaccggggaatgtcgtctcgaaaagctaagctcaaacataacagtgaagaagacccgcgtagagggcagcagcaagattcagtataggaaggaacagcaacagcaacagatgtggaatagcgctaggactcccaatctggtgaagcactctccatctgaagataagatgagtcctgcttcccctatagacgacatcgaaagggagctgaaagctgaggcatccctgatggatcagatgagcagctgtgatagctcaagtgactccaagtcctcttcgtctagctctagtgaagactccagcagcgattcggaggacgaggattgtaagtccagcacctcagatactggaaactgtgtatctggtcaccccaccatgacacagtacaggatccccgatattgacgccagccataatcggttccgggacaattccggcttgcttatgaacaccctgagaaatgacttgcagctgtccgagagcggaagcgattccgacgactag

SEQ ID NO: 22837 - DNA, 792 bp, Artificial Sequence
  Description of Artificial Sequence: Synthetic coding sequence
atgaattccgccgcaggattttctcacttagaccgacgggagagggtactgaagctcggtgagtcttttgaaaaacagcccaggtgtgcatttcataccgtgaggtatgatttcaaacctgcgtctatcgataccagtagcgaaggctatctggaagtgggggaaggagaacaggtaacaatcacactgccgaatattgagggctcaactccacccgtgacagtgtttaagggaagcaagaaaccctacctgaaggagtgcattctgataattaaccacgacactggagagtgtcggcttgagaagctgagctcgaatattacagtcaaaaagacacgcgttgaggggagctcgaagatccagtatcggaaagaacagcagcagcagcagatgtggaatagcgcccgaacacccaacctggtaaagcactctccctcagaggacaaaatgagtccagctagccccatcgacgacattgagagagaactaaaggctgaagcgagcctgatggaccaaatgtcctcctgcgatagtagttctgattctaagtcaagtagcagctccagttcagaagattcaagctcagacagcgaggatgaggattgtaaatcgtctacctccgataccggcaattgtgtctctggccatcccactatgactcagtaccggatcccagacatagacgcgagccacaaccggtttcgcgacaatagcggattgctcatgaacactctaaacaatctctcatcacattccttttcttccttatatgacccccttctctctcactag

SEQ ID NO: 22838 - DNA, 252 bp, Artificial Sequence
  Description of Artificial Sequence: Synthetic coding sequence
atgggacggagaaagtccaaacgaaagcctccacctaagaaaaaaatgaccgggacgctggaaacacagttcacttgccccttctgcaaccacgagaagagctgcgacgtgaaaatggacagggccaggaacacaggcgtgatctcctgcacagtttgccttgaggagttccaaacccccataacctacctgagcgagcctgtggatgtctattccgactggatcgacgcctgtgaagctgccaatcagtag

SEQ ID NO: 22839 - DNA, 306 bp, Artificial Sequence
  Description of Artificial Sequence: Synthetic coding sequence
atggtagtttcaaagatgaacaaggacgcccaaatgcgcgcagccatcaatcaaaagcttattgaaacaggcgagcgtgagcgcttaaaagaattgctgagggctaagctgatcgagtgcggctggaaggatcagctgaaggcacactgcaaggaggttatcaaggagaaagggttagaacacgtgaccgtggacgatctggtcgctgaaatcactcccaaagggagggccctggtgcccgactccgtgaaaaaagagctactccagaggataagaacgtttctcgcgcagcacgcgtccctatag

SEQ ID NO: 22840 - DNA, 291 bp, Artificial Sequence
  Description of Artificial Sequence: Synthetic coding sequence
atgaacaaggacgcgcaaatgagagcagcaataaatcagaaattgattgagaccggtgaaagagagagattaaaagagctgctgcgggcaaagctgatagagtgcggttggaaggaccagctcaaagcccattgcaaagaagtgattaaagaaaagggactggaacacgtgacggtcgatgatctggttgccgaaattacccccaaaggcagagcactagttcccgatagcgtgaagaaagagctgctacagaggatccgcaccttcctcgcccagcacgccagcctctag

SEQ ID NO: 22841 - DNA, 486 bp, Artificial Sequence
  Description of Artificial Sequence: Synthetic coding sequence
atggctgaacctactggcctgctggagatgtcggagctgccaggagacagttctgtaccacaggtaggcaccgcttccggggtgtcggatgtgctgaggggggctgtaggtggcggagtacgcgtgcaagaggcaagagaaggccctgttgctgaagctgcgagatctatggccagaatgcccggtccggtgcccggtcccataccatcttcagtcccgggtctggcttccgccccagacccccaccagcagctggcttttctggaaataaatagacagttactctttcgcgagtacttggacggctcctcaatgattcccgtgcggttactgcgcgactttgaggaaagacgccgactctttgtggagggttgcaaagcccgagaggcagccttcgatgctgatcctccgcagatggacttcgcggcagttgcgttcactgtggcactgacagcaagtgaagccctctccccccttgcagattag

SEQ ID NO: 22842 - DNA, 2556 bp, Artificial Sequence
  Description of Artificial Sequence: Synthetic coding sequence
atgagctccaagcaggagatcatgtccgaccagagatttagaagagtagcaaaggacccacgattttgggagatgcctgaaaaagataggaaggtgaagatagacaagcggtttcgagcaatgttccacgataagaagtttaagctgaattacgcagtcgataagaggggcaggcctatatcccatagtactaccgaagacctgaagaggttttatgatctaagtgattctgatagcaacttgtcgggggaagactctaaggccctcagtcagaagaaaatcaagaaaaaaaaaacccagaccaaaaaggagattgattccaagaatctcgtagagaaaaagaaggagacaaaaaaggccaaccacaaaggatctgagaataaaacagacctcgacaattccattggaatcaagaaaatgaagacaagttgtaagtttaaaatcgattctaatatttctccaaagaaggatagcaaggagtttacccagaaaaataagaaagaaaagaagaatatcgtacagcacactaccgacagctccctggaggagaagcagcgaaccctggatagtggcacaagcgaaatcgtgaagtccccccgtattgagtgttccaagactcgcagagagatgcagtctgttgtgcagctgatcatgacacgcgatagcgatggctatgaaaattccaccgacggtgaaatgtgcgataaggacgcactcgaggaagattcagaaagcgtatcagagatcgggtctgatgaagaaagcgaaaatgagataacaagtgtgggcagggccagcggcgacgacgacggatctgaagacgacgaggaggaggacgaggatgaggaggaggacgaggatgaagactctgaggacgatgacaagagtgactctggtccggacttagcccgaggaaaaggaaatattgagacctcaagcgaagatgaggacgacaccgctgacctgttcccagaggaaagcgggttcgaacatgcgtggagagagctagacaaagatgccccacgggcagatgaaatcactagacgccttgccgtctgcaatatggactgggaccgtctcaaagcgaaagatctgctagcattattcaatagctttaaaccgaaagggggagtgatcttcagcgtgaaaatttatccctccgaatttggaaaggaacgaatgaaagaggaacaagttcagggcccagttgagctactgtctattccagaagatgccccagaaaaggattggacctcacgcgagaagctccgtgattaccaatttaagaggctaaaatattattacgctgtcgtcgactgcgactccccagaaacggcatcaaaaatttacgaagactgcgatgggctggaatttgagagctcctgtagttttatcgacctccggtttatcccagacgacattaccttcgacgatgagccaaaggatgtggcctccgaggtaaacctgacagcttacaaacctaaatacttcaccagtgctgccatggggacctctactgtggagattacctgggatgagaccgaccatgaaagaatcaccatgctgaacagaaagttcaagaaggaggaattgctagacatggactttcaggcgtatctcgcctctagcagcgaggacgaggaggaaattgaagaagaacttcaaggagatgacggcgttaacgttgaggaggacgggaaaactaaaaaatcccagaaggacgacgaggaacagatcgcgaagtaccgccagctgctgcaagtgatccaagaaaaggagaaaaagggtaaagaaaacgatatggaaatggaaattaaatgggttcccggactgaaggaatctgcagaagagatggtcaaaaacaaactcgagggcaaggacaagctcacaccatgggagcagttcttggagaaaaagaaggaaaaaaaaaggctcaaaagaaagcagaaggccttggcggaagaggcaagcgaagaggaactccccagtgatgtcgatctgaatgacccgtattttgcagaagaggtgaagcagatcgggattaataaaaagagcgttaagtcagccaaggatggcacatcccctgaggaggagattgagattgagcgccaaaaagcagagatggccctattgatgatggacgaagatgaagattccaaaaagcattttaactataataaaattgtggagcaccagaatctctctaagaagaaaaagaaacagctgatgaaaaagaaggagctaattgaagacgattttgaagtaaatgtgaatgacgctcgatttcaagccatgtatacatctcacctttttaatttggatccctctgacccaaactttaaaaaaaccaaagccatggagaagatcctcgaggaaaaggctcgccagagagaacgcaaagaacaggagcttacacaggccattaaaaaaaaagagagtgagattgaaaaggaatcccagcgaaagagcatcgacccggctctttcaatgctcatcaagtccatcaagactaagactgagcagttccaggctaggaagaaacagaaagttaagtag

SEQ ID NO: 22843 - DNA, 333 bp, Artificial Sequence
  Description of Artificial Sequence: Synthetic coding sequence
atgtcctccaagcaggagatcatgtccgatcagcgcttcaggcgagtggctaaagaccctcgcttctgggagatgcccgagaaggatcgcaaagtaaaaatcgataaaagattccgcgcaatgttccacgataaaaaattcaagctgaattacgccgtggacaagcggggaaggcccatctcacattccacaacggaagacctgaaacgattctacgacttatcagatagtgattctaacttatccggggaggactccaaggccttaagccagaagaagattaagaagaagaagacccagaccaagaaaaaaaagaagaagaaaaagaagtag

SEQ ID NO: 22844 - DNA, 1086 bp, Artificial Sequence
  Description of Artificial Sequence: Synthetic coding sequence
atgcactgcagctgcttggctgagggaattcccgctaacccaggcaactggatctcaggcttggccttccctgactgggcctataaagcggagtctagcccaggtagcaggcagatccagctctggcatttcatcctggaactgctacagaaagaggagttccgccacgttattgcatggcagcagggggagtacggcgagtttgttatcaaggatcctgacgaggttgcaaggctgtggggcagaagaaaatgcaagccacagatgaattacgacaaactctcccgggctctgaggtattactataataaacggatcctgcataagacaaaaggcaaaagattcacatataagtttaatttctctaagcttattgtggtaaattacccactatgggaggtgagggccccaccgtccccacatctgctgcttggcgctccagcactgtgcaggcctgccctcgtacctgtgggtgtgcagtctgaacttttacattcaatgctgtttgctcaccaggccatggtagaacagctgacaggacagcagaccccacgtggtccacctgagacgtccggtgataagaagggcagcagctcttcggtgtataggttggggagcgctccaggtccttgtagattgggactttgctgccacttgggaagtgtacaaggcgagctacctggcgtggcctcctttacaccgcctctgccgcctccccttccttccaactggacttgtcttagtggcccattccttcccccactcccttctgagcagcaattacccggagcattcaaacccgacattctattgcctggacctcgatctctgcccggtgcttggcacttccctgggctaccactcctcgccggtctaggccagggggctggagagcgcctctggctattgtccctgaggcctgagggtttggaagtgaaacccgcaccaatgatggaagccaaaggcggactggatccaagagaagtcttctgtccagagacaagacggttgaagacaggcgaggagagtctgactagtcctaacctggaaaatctgaaggctgtctggcccctggacccaccctag

SEQ ID NO: 22845 - DNA, 498 bp, Artificial Sequence
  Description of Artificial Sequence: Synthetic coding sequence
atgagccaggctacaaagaggaagcacgtggtcaaagaggtgttaggagagcacatcgtgcctagtgaccagcaacagatcgtcagagtgctgcgaacacctggcaacaacctgcatgaagtggaaacagcccaaggccaaaggtttctcgtgagcatgccctccaaataccgaaagaacatctggattaagagaggcgattttttaatcgtggatccaattgaggaaggcgagaaagttaaggccgagatcagtttcgtattatgcaaggaccacgtgcgaagcttacagaaggaaggcttctggccagaagccttcagtgaagtggcggaaaagcataacaacaggaatcggcaaactcaaccagaactgcccgctgagcctcaactctctggtgaggagagttcctccgaagatgattccgatctgttcgtaaacactaataggagacagtaccatgaatccgaggaggagagcgaggaagaggaagccgcttag

SEQ ID NO: 22846 - DNA, 498 bp, Artificial Sequence
  Description of Artificial Sequence: Synthetic coding sequence
atgtctcaggcaaccaaacgcaaacacgtggttaaggaggtcctgggcgaacacatcgttccaagtgatcagcaacagattgtccgagtgcttagaacccccggtaataatctgcacgaggtcgagactgctcaagggcagaggtttctggtgagtatgccatctaaatacaggaaaaatatttggatcaagcgcggagactttctcatcgtggatccgattgaggagggggagaaagtgaaggcggagatcagttttgttctgtgtaaagatcacgtgaggagcctgcagaaagagggtttctggccagaggcattttcggaagtggcagagaagcacaacaatagaaacaggcagacacagcccgagcttcctgccgaaccccaactctcaggtgaggaatcgtcaagcgaagacgacagtgacctgttcgtgaataccaatcggagacagtatcatgaatctgaagaggaatccgaggaagaagaagcagcctag

SEQ ID NO: 22847 - DNA, 237 bp, Artificial Sequence
  Description of Artificial Sequence: Synthetic coding sequence
atgtcacaggcaaccaagcgaaaacacgtagtcaaggaggtgttaggagagcacatagtcccctcagatcagcagcaaattgtcagggtcttacgcacgccaggaaacaatctccatgaagtggagaccgctcaggggcagcggtttctggtcagcatgcccagcaaataccgcaagaacatatggattaagcgcggtgattttctgattgtggaccccatagaagaaggcgagtag

SEQ ID NO: 22848 - DNA, 498 bp, Artificial Sequence
  Description of Artificial Sequence: Synthetic coding sequence
atgtcccaggcaacaaagcgcaagcacgtggtgaaagaggttctcggagaacacattgtgccctccgaccagcagcagatcgtacgggtgctgcgcactccgggtaacaatttgcatgaggtggaaactgctcaggggcaaaggttcctggtatcaatgcccagtaaatacaggaaaaatatttggatcaagcggggagatttcctcatcgtggatcccatcgaggagggggagaaggtgaaagccgagatttccttcgtgctttgcaaggaccacgtgcgctcccttcaaaaggaaggattttggccagaagctttctccgaggtcgccgaaaagcataataatcggaatcgccagacacagccagagctgcccgcagaaccccaactcagcggcgaagaatcctcatccgaggatgactccgacctgtttgtgaataccaaccgtcgacagtaccacgaaagcgaggaagaatccgaagaagaagaagctgcatag

SEQ ID NO: 22849 - DNA, 441 bp, Artificial Sequence
  Description of Artificial Sequence: Synthetic coding sequence
atgtcccaggcaacgaagaggaagcatgtcgtgaaggaggttctaggagagcacattgtcccttctgatcaacagcagatcgtcagagttttacgaactcctggaaataatctacacgaggttgagaccgctcagggccagaggttcctggtcagtatgccgagcaaatatagaaagaacatatggatcaaacgaggagactttctaattgttgacccaatcgaggaaggagaaaaagtaaaggctgaaatatcgtttgtgctttgcaaggaccacgtcagaagcctgcagaaggagggcttttggcctgaagctttctcagaggttgcagaaaagcacaacaatcgaaaccgccaaactcagccggagctgccagctgagccacaactatcaggcgaagaaagttcaagtgaagacgactccgacctgtttgttaattag

SEQ ID NO: 22850 - DNA, 345 bp, Artificial Sequence
  Description of Artificial Sequence: Synthetic coding sequence
atgtcccaggcgaccaaaagaaaacatgtggttaaggaggtcttaggcgagcacattgtgccaagtgaccagcaacaaattgtccgagtcctgcgcacccctggcaacaacttgcacgaagttgagaccgcacaggggcaacgcttcctggtctctatgccatccaaataccggaaaaatatttggatcaagcgcggtgacttcctgatcgttgaccccatcgaggagggtgaaaaagtgaaagccgaaatatccttcgtgctgtgcaaggaccatgtgcggtctctgcagaaggagggattctggcctgaagcattcagcgaggtggcggaaaagcataattag

SEQ ID NO: 22851 - DNA, 342 bp, Artificial Sequence
  Description of Artificial Sequence: Synthetic coding sequence
atgagtcaggccacaaaacggaaacacgtagttaaggaggtcctgggtgaacatatcgtaccaagcgaccaacaacagattgttcgcgttctccgtacccctggaaataacttacatgaggtggagactgcccagggccagagatttctagtctccatgccctccaaataccgcaagaatatttggatcaaacgaggagactttctgatcgttgaccctatagaggaaggcgagaaagtgaaggcagaaattagcttcgtcctctgtaaggaccacgtgcggtcacttcagaaagaagggttctggccagaggctttctcagaggtcgccgaaaaacactag

SEQ ID NO: 22852 - DNA, 498 bp, Artificial Sequence
  Description of Artificial Sequence: Synthetic coding sequence
atgagccaggcaaccaaacgcaaacacgttgtcaaagaagttctgggtgaacatattgtgccatctgatcagcagcaaatcgttcgggttctgagaacgccgggtaataatctgcatgaggtggaaaccgcgcagggccagcgtttcctggtgagtatgcctagtaaataccggaagaacatatggatcaaaaggggtgatttcctgatcgtggaccctattgaggaaggggaaaaagtcaaggccgagatcagttttgtgctttgcaaggaccatgtgcgtagcctgcaaaaagagggattctggccagaggccttcagtgaggtggcagagaagcacaacaaccggaacaggcagacccaacctgaactgcccgctgaacctcaacttagcggtgaggagagctcgtccgaggacgattccgacctttttgtgaatacgaatcggaggcagtaccacgagagcgaagaagaatccgaagaggaggaagccgcttag

SEQ ID NO: 22853 - DNA, 1230 bp, Artificial Sequence
  Description of Artificial Sequence: Synthetic coding sequence
atggaaggtgagagtacatctgcagtactgtcaggcttcgtgcttggcgcactggcctttcaacatctgaataccgactctgacaccgagggatttctgctcggcgaggttaagggagaagccaaaaactccattacagactcccagatggatgatgtcgaagtggtatacacgatcgatatccagaagtatatcccatgctaccagctgttcagcttttacaacagctccggggaggtcaacgaacaggcacttaagaagatactgtcaaacgtaaagaagaacgtggtaggatggtacaaattccgtcgacactctgatcagatcatgaccttcagagagcggctgctacataagaacctacaagagcatttttcaaatcaggacttggttttccttctgctaacccctagcattatcaccgagtcatgttcaacgcatagacttgaacactctctctacaagccacagaaggggctgttccaccgtgtaccactggtagtggccaatttaggaatgtcggagcaactggggtacaagacagtttccggatcttgcatgtcaacgggcttcagccgggcagtgcagacccactccagcaaattcttcgaggaggatgggagcctgaaagaagtccacaagatcaatgagatgtatgcgagcctccaggaggagcttaagtccatttgcaagaaagtagaggactcagagcaggccgtggacaagctcgtgaaagatgtcaataggctgaagcgtgagattgagaaacgcagaggcgctcaaatccaggcggctagagaaaaaaacattcagaaggacccacaggagaacatcttcctgtgccaagccctgcgtaccttcttcccgaactcagaatttctccactcatgtgtcatgtcccttaagaatagacacgtcagcaaatcttcctgtaattataatcatcacctggatgttgtggacaacctcactttgatggtggagcacacagacataccggaggcttcacctgcgtcaactccccagatcatcaaacacaaggctcttgacctagacgaccggtggcagttcaagagaagccggctgttggacacacaggataagcgctctaaagccgatactggatcatcaaaccaggacaaagcctccaagatgtcgtccccggaaactgatgaggagatcgaaaaaatgaagggatttggggaatactcacggtcacccaccttttag

SEQ ID NO: 22854 - DNA, 1083 bp, Artificial Sequence
  Description of Artificial Sequence: Synthetic coding sequence
atggacgatgttgaagtcgtctacaccatcgatattcagaagtatattccctgctatcaactctttagcttctacaactcttcaggggaggtgaacgaacaggctctgaaaaagatcttgagtaatgtgaaaaagaacgtcgtggggtggtacaagttcaggagacattccgatcagatcatgacattcagggagaggctgctgcacaaaaatttacaagagcactttagcaatcaggacctggtgttcctactcctgacacctagcatcattacagagtcatgcagcacccacagattagaacatagtttgtacaaaccacagaagggcttgttccaccgcgtccccctcgtcgtggccaacctcggcatgtccgagcagctcggatataagacagtaagcggttcctgcatgtccacaggattctcgcgcgctgtacagacgcactcctcaaagttcttcgaggaagacggctcactcaaagaggttcataagattaatgaaatgtacgctagcctgcaggaggaactgaaatccatctgcaagaaagtggaggacagcgaacaagctgtcgacaagctcgtgaaggacgtcaatcgtcttaaacgcgagattgaaaagcgaaggggcgcacagattcaagccgctcgtgagaagaacattcaaaaggacccacaggagaatattttcttgtgtcaagctctccgaacattcttccccaactccgagtttctccactcttgtgtcatgtcgttgaagaaccgacacgtctcaaaatcatcttgcaattacaatcaccatctggacgtggtggataaccttaccttgatggtggagcataccgacatccctgaggcctcgcctgcgtcgaccccccaaattatcaaacataaagcactcgatctcgacgacagatggcagtttaaacgaagcagactgctggacacccaagataagagaagcaaagccgacacaggctcttccaaccaggataaggcgagcaaaatgagtagccctgaaaccgacgaagagatagagaagatgaaaggatttggggagtacagccggagcccgactttctag

SEQ ID NO: 22855 - DNA, 333 bp, Artificial Sequence
  Description of Artificial Sequence: Synthetic coding sequence
atggacgacgtagaagtggtgtatactatcgacattcagaagtacattccatgctaccagcttttcagcttctacaactcttccggagaggtgaacgaacaggcccttaagaagatactatccaacgtgaagaagaacgtcgtgggttggtacaagttccgtagacacagtgatcagatcatgaccttccgggagcgcctcttgcacaagaacctccaagaacacttcagcaaccaagatttggttttcctcttgctcacgccaagcatcatcaccgagagctgttcaacacaccgactagaacattctctctataagcctcaaaagggctag

SEQ ID NO: 22856 - DNA, 1338 bp, Artificial Sequence
  Description of Artificial Sequence: Synthetic coding sequence
atgtctgaattgaccaaggagctgatggagttagtgtgggggaccaagagttcgccaggtctctctgacacaattttctgtcggtggactcaaggatttgtctttagcgaaagtgaaggtagtgcccttgaacagttcgaaggaggcccatgcgccgtcatcgctcccgtccaggcttttttacttaagaaacttttgttctcttccgagaaatcaagctggagagattgcagcgaagaggaacagaaggaactgctctgtcacactctgtgtgatattttggagtctgcttgctgcgatcactccggcagctactgcctggtctcatggcttcggggaaaaaccaccgaagaaactgccagcatttcagggagccccgctgaatcttcctgccaggtggagcattccagcgctttggcagtagaggaactagggttcgagagattccatgcattgattcagaaaagaagttttagaagtctacctgagctgaaagacgctgttctggaccagtattctatgtgggggaacaaattcggggtgctgttgtttctttattctgtgcttctgacaaaaggtatcgagaacatcaaaaatgaaattgaggacgcctcagagcctcttatcgatccagtatatggacatggctcccagtctctcatcaatctcttattaaccggccacgctgttagtaatgtgtgggatggggaccgcgagtgttcaggaatgaagctactgggcatccacgagcaagccgctgttggttttcttactctaatggaagctctgcggtactgtaaggtcgggtcgtaccttaaatccccaaagtttcctatctggatcgttggttcagaaactcatttgacggtgttcttcgctaaggatatggcccttgttgcccctgaagccccttccgaacaagccaggagggtcttccaaacatacgaccctgaggataatggtttcataccggacagccttctggaggatgtcatgaaggccctcgacctggtctctgacccagagtatatcaatctcatgaaaaataagctcgacccagagggtctgggcatcatacttctaggaccctttctccaggaattctttccagaccagggctcctccggacccgagtccttcacggtatatcactacaatggtctgaagcagtccaattacaatgagaaggtgatgtatgtagaggggactgccgtggtcatgggttttgaggaccccatgctgcaaacggacgacacacccatcaagagatgtttacagacaaaatggccttatattgaactgctgtggacaacagaccgtagcccatccctgaattag

SEQ ID NO: 22857 - DNA, 453 bp, Artificial Sequence
  Description of Artificial Sequence: Synthetic coding sequence
atggccctagtggcccctgaggccccaagtgagcaggccagacgggtgttccaaacgtatgatcctgaggataacggtttcatccccgattctctgttggaagacgttatgaaggcgctcgacctcgtatctgatccagagtatataaacctaatgaaaaacaagctggaccctgaggggttagggattattctactgggtcctttcctgcaagagtttttccccgaccagggcagcagcggaccagaatcatttaccgtgtatcattacaatggtctgaagcagagcaactataacgagaaggtgatgtacgtcgagggcaccgcagtggtgatgggattcgaggaccctatgcttcagaccgatgacaccccaatcaaacgctgtcttcagacaaagtggccgtatattgagctgctatggactaccgatcggagccccagccttaactag

SEQ ID NO: 22858 - DNA, 453 bp, Artificial Sequence
  Description of Artificial Sequence: Synthetic coding sequence
atggccctggtggctcctgaggctccgtctgagcaagcgaggcgtgtgtttcagacatatgatccagaagacaatggctttatacccgacagcctgctggaggatgtaatgaaagcactcgatctggtgtctgaccctgagtatattaacctaatgaaaaacaagctggaccccgaggggctgggcataatccttctgggccctttcctgcaggaatttttccctgaccagggctcctccggtcccgaaagcttcaccgtgtaccactataacggactaaagcagagcaactacaacgagaaggtcatgtatgttgagggtacagccgtggtgatgggcttcgaggatcctatgttgcagaccgatgatacaccaatcaagaggtgtctccaaactaagtggccttatatcgagttattgtggaccacagatcgatccccatcactcaactag

SEQ ID NO: 22859 - DNA, 549 bp, Artificial Sequence
  Description of Artificial Sequence: Synthetic coding sequence
ctgcccgaactgaaggacgccgtgctcgatcagtattctatgtgggggaataaattcggcgtcctgctctttctgtactcagtgttgctcaccaaggggatcgagaatattaaaaacgaaattgaagacgccagcgaacctcttattgatcccgtgtatggacatggtagccagtcacttataaacctgctccttaccggccatgcggtgagtaacgtgtgggacggcgaccgcgagtgcagtggtatgaaactgttgggaatccacgagcaggccgcagtaggctttctgaccctgatggaggcccttagatattgtaaagtcggaagctacttgaaaagtccaaagttccccatctggatcgtggggtctgagacacatctgactgtattcttcgccaaggatatggcactggtggcacccgaggccccatcagaacaggcacgccgagtttttcagacctatgatcccgaggacaatggtttcataccagattccctcctggaggatgtgatgaaggctctggaccttgtatctgacccagaatag

SEQ ID NO: 22860 - DNA, 495 bp, Artificial Sequence
  Description of Artificial Sequence: Synthetic coding sequence
atgaagaggtttcctgccaaaaaacggtcgttcagaagccttcccgagttgaaggacgcagtgttagatcaatacagtatgtggggcaataagttcggcgtcttattgtttctgtacagcgtgctccttacgaagggaattgaaaatattaagaatgaaatcgaagacgcatctgagcccctgattgatcccgtttatggacacggcagtcaaagccttattaacctgttgctcaccgggcatgcagtctcaaacgtgtgggacggggaccgtgaatgctcgggcatgaagttgctaggcatacacgagcaggcagctgttggtttcctgacactaatggaggctctccggtattgcaaagttggcagctacctaaaaagccccaaattccccatttggatcgtgggaagcgagacccatcttactgtgtttttcgcaaaggatatggctctcgtggcacctgaggcaccgagtgaacaagccaggagagtttag

SEQ ID NO: 22861 - DNA, 765 bp, Artificial Sequence
  Description of Artificial Sequence: Synthetic coding sequence
atggacggaggcgacgacgggaatctgatcataaaaaagaggttcgtgtctgaggctgagctggacgagcgcagaaaaagacgccaagaggagtgggagaaagtacggaagccagaggatccggaggaatgccctgaggaagtgtatgatccaaggtctctgtacgagagactccaagaacagaaggatcggaagcagcaggaatacgaagagcagtttaagtttaaaaatatggtaaggggtctggatgaggatgagacgaacttccttgacgaggtgtccagacaacaggaactcatcgaaaagcaacggcgagaggaggaactaaaagagttgaaggagtatcgcaacaacctgaaaaaggtaggcataagccaggaaaacaagaaagaggtcgagaagaaattgaccgtgaaaccgattgagaccaaaaataagttcagtcaggctaagctgctagcaggcgcagtaaaacataagagtagcgagtcaggaaactccgtgaagaggctaaagcccgacccggaacccgacgataagaatcaggaaccttcctcatgcaaaagccttggcaacacctccctctctgggccttcaatccactgccccagtgccgctgtgtgcatagggatcctacccggattaggtgcttactctggaagttctgatagcgagtctagcagcgactccgaggggacaatcaatgccaccggcaagatcgtctccagcatattcagaaccaacactttccttgaggccccttag

SEQ ID NO: 22862 - DNA, 765 bp, Artificial Sequence
  Description of Artificial Sequence: Synthetic coding sequence
atggacgggggagatgatggaaatctgattatcaagaagcgcttcgtttctgaggccgagctcgatgagcggaggaagcggaggcaggaagaatgggagaaggtgagaaagccggaggaccccgaagaatgtcctgaggaggtttatgatccacgcagcctgtatgagaggttgcaagaacagaaagaccggaaacagcaggagtatgaggaacaattcaagtttaagaatatggtaagggggctggacgaagatgaaaccaactttttggatgaagttagtcgacagcaggaactgatcgagaagcaacgcagggaggaggagctaaaagaattgaaggaatataggaataatctcaaaaaggtgggtatttcgcaagaaaacaagaaggaggtcgaaaaaaagttaaccgtcaagcccatcgaaacaaaaaacaagttctcacaagcgaagctactggctggcgctgtaaagcacaagagctccgagagcggtaattcagtaaagcgcctcaagcctgaccctgagccagatgacaagaaccaagagccgtcatcctgcaagtctctagggaacacttctctgagtgggccttctatccattgcccaagtgccgcagtgtgtattggcatcctgcccggtctgggtgcctactccggttcttctgactctgagtcttcctcagattcagagggaaccatcaacgccactggcaagatcgtgagctcgattttccgcactaataccttcctcgaagccccttag

SEQ ID NO: 22863 - DNA, 246 bp, Artificial Sequence
  Description of Artificial Sequence: Synthetic coding sequence
atggacggtggagacgacggcaacctgatcatcaagaagagatttgtgagtgaagcagagcttgacgagcgcaggaagagaagacaagaggagtgggaaaaggttcggaagcctgaagatccagaggagtgtcccgaggaggtgtacgatccccgaagcctctacgaaagattgcaggaacagaaggacagaaaacaacaggaatacgaggagcagtttaagtttagcaaacagtttgacccctag

SEQ ID NO: 22864 - DNA, 1617 bp, Artificial Sequence
  Description of Artificial Sequence: Synthetic coding sequence
atgcggcacgtgcaggccgaaccttcccctagctccgagccagaagcaggcccttcccagccccctgtcaggcagggcgctctccagggaggacttctaatgggatattctccggcagggggtgctactagccccggagtttatcaggtctcaatatttagtccccctgccggaaccagcgaaccgcatagagccttgaaaaggcaggccccaagtaccgagggtcctagggagctcaaacgtggcccaggcctgggtgcacgagaggggcttccacccgaagaaccctctacagttggcttgctcggtccagaagggcctggcctgggcttgggagtggcatcacagcactttagtcatagaggcctatgcgtggtggagcagcgcagtagcgttaccagctcttggacttccggggcttggtccccaccctgtcctccctctaacgccagctgcaacacattacatacccgggactgggctagtccagacccaggagggcaggggtcgctaggcgagtcgcccggacccgctccacccggacagttgcataccctggacacagatctgcacagtctcgcgcaaatcggtggtaaatcccctgtagccggagtaggaaatggaggatctctgtggccgagggagtctcccggtactgctaatggccactcaccagaacatactccgcctggcccaggtcctcctggaccctgtccaacaaaacggaggctgctccccgctggggaagcacctgatgtgtcctctgaagaagaggggccagcacctaggcggaggcggggaagcctcggccatcctacagctgctaacagcagcgacgcgaaagccacgcccttctggagtcacctgctgcccggacctaaggaaccagtgctggatccaaccgactgtggtcctatgggcaggcggctgaagggcgcaaggagactaaagctttcccccctccggtcgctgcggaaagggccaggcctgttatctcctcccagcgcctcgccagtccctacccctgcggtgtctagaacgttgctgggcaacttcgaagagtctctgttacgtgggaggtttgccccaagtgggcacattgaaggatttactgccgaaatcggggcatccggctcctattgtcctcagcacgtgactctccctgtcactgtgaccttctttgacgtgagcgaacagaacgccccagccccattcctgggtatcgtagacctgaacccgctgggcagaaaggggtactccgtgcctaaagttggcacggtgcaggtaactctgttcaatcccaatcagaccgtagtaaagatgttcctagtgacattcgacttttcagacatgcccgcagcccacatgacatttctgcgccacagacttttcctggtgcccgtgggagaggagggtaacgcgaaccctacacatcgcctcttgtgctacttgctccatctacgctttcgaagctctaggtctggtcggttaagtcttcacggagatatcaggttgctcttcagccgcaggagcctggaacttgacaccgggcttccatatgagctccaggccgtgaccgaagccccacataatccacggtattcaccccttccatag

SEQ ID NO: 22865 - DNA, 1329 bp, Artificial Sequence
  Description of Artificial Sequence: Synthetic coding sequence
atgcgacacgtgcaggccgagccctctccaagctccgagcctgaggctggaccaagccagccccctgtgcggcagggggcactgcaggggggacttctgatgggatattcccctgctgggggtgctacatctcccggtgtgtaccaggtgtccattttttcgcccccagccggaacctccgagcctcatagagctcttaaaagacaggctccctctaccgaggggccacgtgagctcaaacggggacccggtcttggcgcaagagaagggctacctccagaggaaccgagcactgtgggtttactgggccctgaaggaccaggactggggcttggcgtcgcatcccagcacttttctcaccgcggactgtgtgtggtggaacagaggtccagcgtaacttcctcttggacttccggagcttggagcccaccatgccccccatccaacgcaagctgtaacactctacataccagggattgggccagtcccgaccccggtggccagggatctctgggcgaaagtcctggacctgcaccccctggccaactgcataccttagacactgatctgcacagtcttgctcaaatcggagggaagtctcctgtggccggagtcggtaacggaggcagcttgtggcctcgggagtcaccaggaaccgctaacgggcattcacctgagcacacacctccaggtccaggccctccaggaccatgtcctacaaagaggagactccttccagccggtgaggctccagatgtgagttccgaggaggaaggtcccgctcccaggaggagacggggaagcttagggcatcctactgccgctaacagctccgacgctaaggccacacccttctggagtcacctacttccgggtccaaaggaacctgtcctggacccaaccgattgcggaccaatgggacgcagactcaagggcgcaagacggctcaaactgagtccccttaggtctcttaggaagggtcctggcctgctaagtcctccctctgccagcccggtgcccacaccagcggtgtctcgcactctcctgggaaacttcgaggagtctctgctgcggggtaggtttgcaccttcaggtcatattgaaggctttactgcagagataggtgcctcaggcagttactgtccgcagcacgtaacccttccagtaacagtcaccttttttgacgtgtcggaacagaatgctccagcaccattcttgggtattgtcgatctcaatcctctagggagaaaggggtacagtgtgcccaaagtgggcaccgtgcaggtcacgctgttcaatcctaatccatttacttctcctacactctag

SEQ ID NO: 22866 - DNA, 1617 bp, Artificial Sequence
  Description of Artificial Sequence: Synthetic coding sequence
atgcggcacgtccaggccgaacctagcccaagttcagaacctgaggccggaccatcccagcccccagttagacaaggtgcactgcaaggaggactattgatgggttactcccccgcaggaggtgccacctctccaggcgtctatcaggtcagcattttcagcccccctgcagggacatccgaaccgcacagagcccttaaacgccaggctccttctactgaaggccctagagaactcaagcggggacctggactgggtgctcgcgagggacttcctcctgaagagccatccaccgttgggcttctgggccctgagggcccaggactggggctgggggtggccagccaacacttcagtcatcggggattgtgtgtcgtcgagcagcgcagtagcgtgacttcctcctggacttctggcgcttggagtccaccatgcccaccaagcaacgcttcctgcaatacattgcatacgagagactgggctagtcctgacccgggaggacaggggtccttgggtgagagccccggtccagccccacccggacagctccacacactggacaccgaccttcattctctcgcccagatcgggggaaaatctccagttgccggagtcggcaatggcggatcgctatggcctcgcgagagcccagggacagcaaatggccattctcccgaacacacaccgcctggtccaggcccacctggaccatgcccgaccaaacgacggctgctgcctgcaggagaagcgccagatgtgtcctccgaggaagagggcccagcccctcgtaggagaaggggttccctgggccatccaaccgccgcaaactcatcggatgccaaagccacacctttttggtctcatttgctccccggacccaaggaaccagtgctggacccaacagactgcggcccaatgggcaggaggctaaagggggcacgaaggctgaagctctccccactgagatccttgcgcaagggaccagggcttctgtcccctccatccgcaagtccagtcccgacgcctgctgtcagccgcaccctgctcggtaactttgaggaatccctgttgagggggaggttcgccccaagtggccacatagaaggttttaccgcagagatcggggcatccggaagttactgcccccaacacgttacactgcccgtgactgtcactttcttcgatgtcagcgagcagaacgccccagcccctttcctggggatcgtagaccttaatcccctgggcaggaaaggctacagtgtccctaaggtgggaacagtccaggtaaccctcttcaacccaaaccagacagtcgtgaagatgttccttgtgaccttcgatttctctgatatgcctgccgctcacatgacgttcctacgtcacagactgttcttggtccctgtgggcgaggaggggaatgccaatccaacccaccgcctactttgttacctgctgcacctaagattcagaagcagcaggagcggcagactgtctctccatggcgatattaggctgctattcagccgaagatccttggaacttgatacgggtctaccgtacgagttacaagcggtgactgaggctccccacaatccaaggtacagcccccttccatag

SEQ ID NO: 22867 - DNA, 1617 bp, Artificial Sequence
  Description of Artificial Sequence: Synthetic coding sequence
atgaggcatgtgcaggcggaaccctctccatcctccgagccagaggcaggacctagccagcctccggtgaggcagggcgctttgcagggtggacttctaatggggtattcccctgccggaggtgccacctccccaggcgtgtaccaggtgtccatcttctccccgccagcaggaacatccgagcctcaccgcgcactcaagcgacaagctccttcaacagagggccctcgagaactgaagagaggcccaggactcggtgccagggaaggcctcccacctgaagaacccagcaccgtgggccttctcgggcctgaaggtcccggacttggactgggagtggcttcccagcacttctcccacaggggcctttgtgtggtcgaacaaagatcttcggtcacaagcagctggacatccggtgcgtggagccccccatgcccgccttctaacgcttcatgcaacacacttcacacaagagattgggcttccccagacccaggaggtcagggctctctcggcgaaagtcctggcccagctccccctggtcagcttcataccctggacactgacctccatagcctagcccagatcggcggaaagtctcccgtggctggcgtgggtaatgggggatctctgtggccacgggagagtcctggaacagccaacgggcactcacctgaacacacgccacccggacccggaccccctggtccgtgccccactaagcggaggctgctgcctgccggagaggcaccagacgtgagctctgaggaggagggcccagctcctaggaggcgtagaggttcccttggccatcctactgctgcgaattccagcgatgcaaaggccaccccgttttggtctcatctgttacctgggcctaaagagcctgtccttgacccgacggactgtggcccaatgggcagacggttgaaaggcgctcgcaggcttaagctctcccctctcagatccctgaggaaagggccaggtttactgagcccacctagcgcttcacctgtgcctactccagctgtcagcaggacactgctggggaacttcgaagagagcttgttgagggggagatttgcccctagtggtcatatcgaggggtttaccgctgagattggagctagcggcagttattgcccacagcacgtcacacttccagttactgtcaccttttttgatgtgtctgagcagaatgcaccagcaccatttctgggaatagtagaccttaatccactcggccgtaaggggtactccgtgcctaaggtagggactgtgcaggtgacactattcaacccaaaccagacagtggtgaagatgttcctcgtcaccttcgattttagtgatatgccagctgctcacatgactttcctgcgccatcgccttttcctggtccccgttggagaggaagggaacgcaaaccctacccacaggctcctttgctacctattacacttacgtttcaggtcttcgaggtcagggagactgtcgctacacggcgatatccgcctgttgttctctcgtagatctctcgagctggataccgggctcccatatgagttgcaggccgtgacagaggctccgcataaccccaggtacagtccgcttccttag

SEQ ID NO: 22868 - DNA, 702 bp, Artificial Sequence
  Description of Artificial Sequence: Synthetic coding sequence
atggggaggcggcttaagggagccaggcgattaaagctgagtccgttgcggtctttacgaaagggacccggtctgttgtcaccgccatcagcaagccccgtccccacacccgctgtgtcaagaacactcctgggcaatttcgaggagtcactcttgcgaggtcggtttgctccttcgggccatatcgaagggttcactgccgaaatcggggcttcaggcagctactgtcctcaacacgtcactcttcccgttacggtgacctttttcgacgttagcgaacagaatgcccctgcccctttcctaggtatcgttgatctcaacccgctgggacggaaaggttactcagtgccaaaggtgggtaccgttcaggtgacattgtttaatcctaatcagaccgtcgtgaagatgttcctggtaacattcgatttttccgacatgcctgcagctcatatgacgttcttacggcatcggttgtttctcgtgcccgtgggggaggagggtaatgctaaccccactcatagactcctgtgctatctgctgcacctgcgttttaggtccagtaggtccgggcgactgagcctgcatggagatatccgcctgttgttctcacgcaggtccctcgaattggataccggcttaccgtatgagttgcaggccgtcaccgaggctccccataatccaagatattcacccctgccctag

SEQ ID NO: 22869 - DNA, 339 bp, Artificial Sequence
  Description of Artificial Sequence: Synthetic coding sequence
atggaagcatatgagcaagtgcagaagggacccctgaaactcaaaggagtggccgagctgggtgtaacaaaacggaaaaagaagaagaaggacaaagacaaggctaaactgctggaggccatgggcacgtctaaaaagaacgaggaagagaagcgcagaggcctcgataaaagaacacccgcacaggccgcatttgaaaaaatgcaagaaaagagacagatggaacgaattcttaagaaagccagcaagactcacaagcagagagttgaggactttaatagacatttagatacactgaccgaacattatgatatacccaaggtaagctggaccaagtag

SEQ ID NO: 22870 - DNA, 639 bp, Artificial Sequence
  Description of Artificial Sequence: Synthetic coding sequence
atggaacctgcggtgggtggacctggtcctttgattgtgaataacaaacaacctcagcccccaccccctcctccccctgctgccgctcaacccccacctggagcgcctagagccgctgcaggcctgttgcccggaggtaaagcacgcgaattcaaccgcaaccagagaaaggacagcgaaggctattccgaatcccccgatctcgagttcgaatacgcggataccgataaatgggctgcggaattatcagagctgtactcctatacggagggacctgagttcctgatgaatcggaaatgctttgaggaagatttcaggatacatgtgaccgacaagaaatggaccgagctcgataccaaccagcatcgaacacacgctatgcggttgctagatggccttgaggttaccgccagggagaagaggctcaaagtcgcccgagcaattttatacgtggcacagggcacatttggcgagtgtagctccgaagccgaggtgcagagttggatgcgctacaatatttttcttctgttggaggtcggcacattcaacgcactcgtcgaactcctcaatatggagattgagcactgctgcgtcagaccagccgtctcagcgctggccggtggccaggcgcaggattag

SEQ ID NO: 22871 - DNA, 2514 bp, Artificial Sequence
  Description of Artificial Sequence: Synthetic coding sequence
atggaacccgcagtgggcggacctggccctctgattgtaaacaacaaacagccgcaacccccaccccctccgcctcctgccgcagcgcagccaccccctggcgctccccgtgcggcagctggtctgctgcctggcggtaaggcgcgagaatttaataggaaccaaagaaaggacagtgaggggtactccgaatcccccgaccttgaattcgagtatgcggataccgacaagtgggccgctgagctgagcgaactctacagctatacggaaggcccagagtttctgatgaataggaagtgcttcgaagaagacttcaggattcacgtcacagataaaaagtggactgaacttgataccaatcaacataggacccatgcaatgaggctgttagatggattggaggttaccgcccgtgagaaacgtctgaaggtcgccagagcaatcctttacgtggctcagggcacgtttggcgaatgcagcagcgaggccgaggttcaatcctggatgagatacaatatcttcctattactggaggtcggaacatttaatgcactagtggagctgctaaatatggaaatcgacaacagtgccgcttgtagctcagcagttcgtaagccagcaatttccttagccgactcgaccgatttgagggtgctcctcaatataatgtacctgattgtcgaaactgtccatcaggagtgcgagggcgataaagcagagtggcgcacaatgaggcagaccttccgagccgagctcggatcgcccctgtacaacaatgaacccttcgccattatgctctttggtatggtgacgaaattctgctctggtcatgcaccccactttcctatgaagaaagtcctattgcttctgtggaagactgttctgtgcacactgggtggcttcgaagagttacagtccatgaaagccgagaagcggtcaatcctgggactcccgccactgcccgaagattccattaaagtaatcaggaatatgagagcagcttcaccaccagcttcagcttcagatctgatcgagcaacaacaaaaaaggggccgaagagaacataaggccctgattaaacaagataacctggatgcttttaatgaacgggatccctacaaggcggatgatagtcgcgaagaggaggaagaaaacgacgacgataacagcctggagggtgaaacctttccactggagcgggatgaggtgatgccaccgcctctccaacaccctcagactgacaggctaacctgtccaaaaggcttaccctgggcacctaaagtcagggaaaaggacatcgaaatgtttctggagagtagtaggagcaagtttataggttataccctgggatcggacactaacaccgtggtcggtttacctcgcccaatccacgaatctatcaagacactaaaacagcacaagtatacgagtattgcagaggtccaggcacagatggaagaagagtacctgcggtccccattgtcagggggagaagaagaggtggagcaagtgccggctgaaacactgtaccaggggttacttccctcgctgccccagtacatgatcgccctgctgaagatactacttgcggctgcaccaaccagcaaagctaaaactgattctatcaacatactggctgacgtgttgcctgaggaaatgcccaccaccgttctgcagagcatgaagctgggcgttgacgttaacagacacaaagaggtgatcgtcaaggccatctccgccgttctcctgctgttgctcaaacatttcaaactgaaccacgtgtaccaattcgaatatatggcgcagcatcttgtcttcgccaattgtattccattgattctgaaatttttcaaccagaacatcatgagttatatcactgctaagaatagtatatccgtactggactatccccactgtgttgtgcacgaactacccgagctcactgcagaaagtcttgaggcaggcgactcaaatcagttttgttggcgcaatctgttttcatgcatcaatctcctgcgaatactgaacaagttgactaaatggaaacactctaggactatgatgctagtggtatttaaatcagcaccaattctgaaacgagcgttgaaggtgaagcaggccatgatgcagctgtatgtgctgaaacttctgaaggtccaaacgaagtatttgggaaggcagtggcggaagtcaaacatgaagacaatgagcgctatttaccagaaggtgagacacaggctgaacgacgactgggcctatggtaatgatctggatgcccgaccatgggacttccaggccgaagagtgtgccctgcgcgctaatatcgagcgcttcaatgcccgacgttatgaccgtgcacattctaaccccgacttcctccctgtagataattgcctgcagtctgtgctgggccagcgtgtggatctgcccgaggatttccagatgaactatgatctctggctggagcgggaggtatttagtaaaccaatcagctgggaagagttacttcagtag

SEQ ID NO: 22872 - DNA, 2229 bp, Artificial Sequence
  Description of Artificial Sequence: Synthetic coding sequence
atgaaccgtaaatgttttgaagaagactttcggatccatgtgaccgataaaaaatggactgaactggacaccaaccagcacaggacacacgccatgaggttgttggacggactcgaagttaccgcacgagaaaaaaggctgaaggtggccagagcaatcctgtacgtggctcaaggcacctttggagagtgtagctctgaggccgaggtgcagagctggatgcggtacaacatcttcctgctgctcgaggtggggacattcaatgccctggtagagctcctcaacatggagattgataacagcgcggcatgcagtagtgcagtgcgtaagcctgcgatctctctggccgacagtactgatttgcgggtgctgttgaacatcatgtaccttatagttgaaacagttcatcaggagtgtgagggagacaaggcagaatggagaactatgcggcagaccttcagagctgaactggggtctcccctgtacaacaacgagcccttcgccatcatgcttttcggcatggtgactaagttttgcagtggccatgcccctcacttccccatgaaaaaggtgttgctattactttggaagaccgttctgtgtacgttgggcggatttgaagagcttcagtctatgaaagcagaaaaaaggtcaattcttggactgcctcctctgcctgaggattcaataaaagtgattcgcaatatgcgcgctgccagtcctcccgcaagtgcctccgatctgatcgagcagcaacagaaaagagggcgtagggagcataaggccctgattaaacaggataaccttgatgcattcaatgagcgggatccatataaagccgatgactccagagaggaagaggaagaaaatgacgacgataatagcttagaaggagagactttcccactcgaaagagacgaggtcatgcctccccctttacagcaccctcagacagacagactgacatgtccgaaaggtttgccatgggcaccgaaagttcgtgaaaaggacatcgagatgtttttggagtcgagcaggtccaaattcattgggtacaccttaggatccgatacgaacacagttgtgggcttacctcggccaattcacgagagcatcaagacactgaaacaacataaatacacttctatcgcagaagtgcaagctcagatggaggaggagtacctgcgctcgcctctgagtggcggagaagaggaagtggagcaagtgcccgctgagactctttaccagggtctcctgcccagtctgcctcagtacatgatcgccctgctaaaaatcttgcttgcggctgccccaacttccaaagctaaaaccgactccattaatatcctggccgatgtcctacccgaagagatgccaaccaccgtgctgcagtcaatgaagctgggcgtggatgtgaatcgtcataaagaggtcatcgtgaaggccatcagtgctgtgctactcctgctgctgaaacactttaagctgaatcatgtttatcaattcgagtacatggcacaacacctggtatttgctaactgcattcctctcattttgaagttcttcaaccagaatataatgagttatatcactgcaaagaatagtatctctgtgctagactacccgcactgcgtggtccatgagttgcccgaactgacagcagagagtcttgaggcgggagattctaatcaattctgttggcggaacctcttcagttgcatcaatttactcaggatcttaaataaacttacaaagtggaaacatagccggaccatgatgctcgttgtctttaaaagtgccccaattctcaagcgtgccctgaaagtcaagcaggccatgatgcagttgtatgtactcaaactgctcaaagtacaaacgaagtacctgggacggcagtggcgaaaaagtaacatgaagacaatgagcgctatatatcagaaggtgaggcatcgtctcaatgatgattgggcatacggcaatgatctagacgcccgaccatgggacttccaggctgaggaatgtgcattgcgggcaaacattgagcgtttcaacgcccgacgctatgaccgagctcatagcaatcccgactttctgcctgttgacaactgtcttcagagtgtactgggacagagagtcgacttgccggaggatttccaaatgaactacgatctttggcttgaacgggaagtcttctccaagcccatctcctgggaggagctgttgcagtag

SEQ ID NO: 22873 - DNA, 783 bp, Artificial Sequence
  Description of Artificial Sequence: Synthetic coding sequence
atgaagtcaaatattgacaagaaattctctgcccactatgatgctgtcgaagcagagctgaagtcaagtaccgtcggtctagtgaccctcaacgacatgaaggcaaagcaggaggctctcgtcaaggagagagagaaacaactggccaaaaaggaacagagcaaagagttgcagatgaaactggagaaactccgtgagaaagagcgcaagaaagaagccaaaaggaaaatttcctcgctgagtttcactcttgaggaggaagaagagggtggagaggaagaagaagaggcagcgatgtacgaagaggaaatggagcgagaggaaataacaactaagaaaagaaagctgggcaagaaccccgatgtggacacctctttccttcccgatcgcgatagggaggaggaggagaatagactgcgagaagagctccgacaggagtgggaggccaagcaggagaagatcaaaagtgaagaaatcgagatcacattctcttattgggacggcagcggacaccggcgaaccgttaagatgaggaagggtaacacgatgcagcagttcctgcagaaggctttagaaatcctgagaaaagatttttccgaattaaggtctgcgggagtagagcagctcatgtacatcaaagaggatctgatcattccacatcaccactccttctacgacttcatcgtgactaaagccagaggtaagtccggacccctcttcaacttcgatgtgcacgatgacgtgcgcctcctgagtgacgccaccgtcgagaaggacgagtag

SEQ ID NO: 22874 - DNA, 1020 bp, Artificial Sequence
  Description of Artificial Sequence: Synthetic coding sequence
atggcccagtacaagggcgcagcttccgaagctgggagggctatgcacctcatgaagaagagggagaaacaaagggagcaaatggaacagatgaaacaacgaatagccgaggagaatatcatgaaatctaatatcgataaaaagttctccgctcactatgatgcagtcgaagccgaactcaagtcttcaaccgttggactagtgacactgaacgatatgaaggcaaaacaggaggccctggtcaaagaacgcgagaaacaactcgcgaaaaaggagcagtcgaaggaactacagatgaaactggaaaaactccgagagaaagagcggaaaaaggaagcaaagcggaagatcagttccttgtccttcaccttggaagaagaggaagaagggggtgaggaagaagaggaagccgctatgtacgaggaggaaatggaacgcgaagaaatcactacgaagaaacgaaagcttggtaagaaccccgacgtggacaccagctttcttcccgaccgggacagagaggaggaagaaaacagacttcgggaagaactccggcaagaatgggaggctaaacaggaaaaaataaaatccgaagagatcgaaattaccttttcatattgggacggctctggccatcggagaacggtgaagatgaggaagggcaatactatgcaacaatttctccagaaagctctggagattcttcgaaaggacttcagcgaattacgatcagccggagtagagcagttgatgtacattaaagaagacctgatcatacctcatcatcatagtttttatgactttatagtcacaaaggcaagggggaagtcggggccactattcaatttcgacgtgcatgacgatgttagattgctgagtgacgcgactgttgagaaagatgaatcccacgccggaaaagtggtcttacggagctggtacgagaaaaacaagcacatttttcccgcaagcaggtgggaaccttatgaccctgaaaaaaaatgggataaatatactatcaggtag

SEQ ID NO: 22875 - DNA, 1197 bp, Artificial Sequence
  Description of Artificial Sequence: Synthetic coding sequence
atggtgacactgattactgagaaactgcagtctcagagtcttgatgatctgacctgcaaagcagaggctggacctctccaatatagcgctgagacgctgaacaaaagcggacgactgtttccattagagttgaatgatcagtcaccatggaaagtgttctctggaggacctccagtgcgctcacaggccgctactggcccagacttttcgttccttccaggactcagtgcggctgcccacaccatgggactgcaatggcaacctcagtcacctcgacctggggctggcctgggtgccgcttctaccgtcgacccttcagaatccactggctcaagtaccgctccccctaccaaaagacactgtcggagcctctctgagcccgaggagttggtcagatgtcggtcaccctggcgcccaggatcaagcaaggtgtggactcccgtctccaagcgtaggtgtgactctggaggctctgccacccgacagggctctccgggtgcagtcctgccaagatccgccgtgtggagcaccggcccaaccagccccgcaacaccacgcccttcgtccgcctcgggaggttttgttgacagcagtgaggggagtgcaggatctgggccactctggtgctctgccgagtcgtgtctccccagcacaagaagaaggccaagtctgtcgcaggagagattagcgggtgctgggaccccacttccctgggctagctcgagtccgaccagcactccagctcttgggggaagacgcggtcttctgcgttgtcggagtcaaccatgtgtgcttagcggtaaacgaagtcgcaggaaacgtaggagagaagaggacgccagatggacaagaccgtcactggattttctgaagatgactcagactcttaagaactccaagagcttgtgctccctgaactacgaagatgatgatgaagatgacaccccggtgaaaactgtgctctccagcccctgcgattcccggggactgcctggcatcacaatgccaggatgttcacagcggggtctcagaacatcacctgttcaccccaacttgtgggcgtccagggagtcagttacttccgatgggagtagacgatcatcaggggatccccgagacggagatagcgtgggcgaggaaggcgttttcccgagggcccgttgggagctggatctggaacaaatcgagaacaactag

SEQ ID NO: 22876 - DNA, 1197 bp, Artificial Sequence
  Description of Artificial Sequence: Synthetic coding sequence
atggtgaccttaatcacagaaaagctgcagtcacagagccttgatgatttaacatgcaaggcggaagccggacccctgcagtatagtgctgagactctaaacaagagcggtcggttgttcccactggaacttaatgatcaatcaccttggaaagtgttcagcggaggcccaccggtacggtcccaggctgccaccgggcctgatttttcattcctgcctgggctgagcgctgcggcacacaccatgggtctacaatggcagccccagagtccaagacccggagctggcctgggtgctgcttcaaccgtggacccttccgagagcactgggtcatctaccgcaccgccaacaaaacgtcattgtcgtagcctctcggagcctgaggaactcgtgcggtgcagaagcccttggcggcctggctcaagcaaggtttggacgcctgtgagcaagaggcggtgtgacagtggaggctccgccactcgacaaggcagccccggagccgtgcttcccagatccgccgtgtggtcaaccggcccaacctcccctgctacaccgagaccatcttccgcttctggcggattcgtggacagttcagaaggctcagcgggatccggccctctctggtgcagtgcagagtcctgtctgccttcaacccgcaggaggccatcactgtcgcaggaaagactggccggagcagggaccccactgccttgggcctcctcaagcccaacctcaactcccgcactcggcggtagaaggggcctgctaagatgtcgctcacagccctgtgtgctgtcgggcaagcggagtcgcaggaaacgccgaagggaagaagatgcacgatggacccgcccttcactcgattttcttaagatgactcagacactgaagaatagtaaaagcctttgctccctgaattacgaggatgacgacgaggatgataccccagtgaaaacagtgctctcatccccttgtgacagcagaggccttccagggatcaccatgcctggatgctctcaacgaggcctgaggacatccccggtgcatcctaatctctgggcctccagagaaagcgtgacctcagatggttcaagacgctctagcggtgatccacgggatggggatagcgttggagaggagggggtatttccccgagcacggtgggaattagatctggagcagattgagaacaactag

SEQ ID NO: 22877 - DNA, 327 bp, Artificial Sequence
  Description of Artificial Sequence: Synthetic coding sequence
atggtgactctcatcacagagaagctgcagagccagtcattggatgatctgacctgcaaggccgaggcaggacccctgcagtatagtgccgaaacactgaacaagtccgggaggctgttccctctagaactcaatgaccagtcgccatggaaggtgtttagcggaggaccgccagtccgttcccaggcagcaacgggccctgatttctcctttctgccaggtctttccgcggcagctcacacaatgggcttgcagtggcagccccagtctcccaggccgggtgcaggtctgggcgctgcatcgactgtggaccctagtgaatcatag

SEQ ID NO: 22878 - DNA, 1197 bp, Artificial Sequence
  Description of Artificial Sequence: Synthetic coding sequence
atggtgacgctcatcaccgaaaaattacagtcacagtccctggacgacctcacgtgcaaggccgaggcaggacctctgcagtacagcgcagaaacccttaacaagtccgggcgattatttccactggagcttaacgatcagagcccttggaaggtattttcaggtggaccacccgtccgctcacaggccgcaaccggcccagacttttcatttctccccggtttatccgccgctgctcatactatggggctccagtggcagcctcaatcgcccagaccgggtgctggtctgggagctgcctccacagtagaccctagcgagagcaccggctcttccactgctccacctacaaagcgacattgtagatccctttctgagcctgaggagctggtaagatgtcgttctccatggcgtccaggttccagcaaagtttggacacctgtcagcaaaagaaggtgtgactccggcggttctgctacacgccaggggagcccaggagcagttctgcctaggtccgccgtgtggtcaaccggtcctaccagccctgccacacccaggccctcatccgcctctggcggttttgttgattccagcgagggatccgccggatctggtcctctgtggtgcagtgccgaaagctgcctacccagcacacggcgaagaccatctttgtcacaggagaggctagccggagccggtacaccactcccttgggctagcagctctcctacctctacccctgccctcggcggacggcgagggctgttaaggtgccggagccagccctgtgtcctttctggaaaacggagtagaagaaagagaagaagagaagaggatgcacgctggactaggccttcgttggactttctgaaaatgacgcaaacactcaaaaatagtaagagcctctgttctctgaactatgaggatgatgatgaggacgatacgcctgtgaaaacagtcttgtcgagcccctgcgatagccgtggcctaccaggcataacgatgccaggctgcagtcagcgtggactcagaacatccccggtacacccaaatctctgggcttcacgggagagcgtgacctccgatggtagtcgccgatcttccggggatcccagagacggtgactccgtgggtgaggaaggtgtatttccccgagctcgctgggagctggacctggagcagatcgagaacaactag

SEQ ID NO: 22879 - DNA, 717 bp, Artificial Sequence
  Description of Artificial Sequence: Synthetic coding sequence
atggcgtcccgatggcagaacatgggtaccagcgtgcgacgtcggagcctgcaacatcaagaacaacttgaggacagtaaagagctccagccggtcgtgtcgcaccaggagactagtgtcggcgctctcggatcactgtgccgccagtttcaaaggcggttgcctctcagagcagtcaatcttaacttgcgggcaggtccgtcctggaagagactggaaaccccagaacccggtcagcagggccttcaggccgcagccagatccgctaagagcgccctgggcgcagtgagccaaaggatccaggagtcatgccagtccgggactaaatggcttgtggagacacaagtgaaggccaggaggcgaaagcgcggtgcacaaaagggcagcggctccccaacacacagcttgtctcagaaatctacacggctttcaggagccgctccagctcactcagccgctgatccttgggagaaggagcatcaccgcctctccgtacggatggggagccacgcccatcccttacgtagaagcaggcgcgaggcagccttccgctctccctacagctcgacagaaccattgtgctcccctagcgagagtgattctgacttagaacccgttggggctgggattcagcatctgcagaagttgtcgcaggaactcgatgaagctattatggcggaggaatccggtgacattgtgagtttaatccacgattag

SEQ ID NO: 22880 - DNA, 747 bp, Artificial Sequence
  Description of Artificial Sequence: Synthetic coding sequence
atggcaagccgctggcagaacatgggcacaagtgtccgccgtaggagcctgcaacaccaggagcaactagaggattctaaagagttgcagcccgtggtgtcccaccaggagacgtcggtcggggctctaggatcactctgtaggcagtttcagagaaggctgccgctccgggctgtgaaccttaatctgagggccggaccctcttggaaacgactcgagacaccagaacccggtcagcagggcctgcaggcagccgcacggagtgccaaaagtgctttaggcgctgtaagccagagaatccaagaaagttgccaatctggaaccaagtggctagtggaaacacaagtgaaggcccgacggcgtaagcgcggtgctcagaagggaagcggttcgcccacacatagcctgagccagaaaagcacccgcctgagtggcgctgccccagcccacagtgctgcagatccctgggaaaaagagcaccaccggttgtcagtacgaatggggtctcacgcccaccctcttagacgcagccggagggaagctgcatttcgatcaccatatagctctaccgaacctttatgcagtccatccgaatcagatagcgacttggaacccgtgggggctggcattcaacacctgcagaaactgagtcaagagctggacgaagcgataatggcagaggagcgcaagcaggctctcagcgacaggcaaggctttattctgaaggacgtatatgcttcaccctag

SEQ ID NO: 22881 - DNA, 717 bp, Artificial Sequence
  Description of Artificial Sequence: Synthetic coding sequence
atggcgtctaggtggcagaacatgggcacaagtgtgagacgacgctcactccagcatcaggagcaacttgaagatagcaaggaactgcagcccgttgtatctcaccaggagactagcgtcggggcacttggcagtctgtgtaggcagttccagcgtcggctcccgcttcgcgctgttaatctgaatctgcgggcaggaccctcgtggaaaaggctggaaacccccgagcctggccagcagggattgcaggctgccgctcgatctgccaaaagtgcacttggggctgtctcacagcgaattcaggagtcctgccagtccggcacaaagtggctggtggagactcaggtcaaagccaggaggcggaagcggggagcccagaaaggtagcggctcgcccacgcatagtctgagccaaaagagcactcgtctcagtggagctgcccctgcccacagcgctgccgatccttgggagaaggaacatcaccgtttgtcagtgagaatggggagccatgcacatcccttacggcgatcccggagggaagccgcatttcgatctccctactcctctaccgagccactctgctctccttctgaatccgattcagacctcgagccagttggggctggtatccagcacctccagaaactatcccaagagttagatgaggctattatggccgaagaatcaggagatattgtgtcactgatccacgattag

SEQ ID NO: 22882 - DNA, 1818 bp, Artificial Sequence
  Description of Artificial Sequence: Synthetic coding sequence
atgtctaacgaaagttgtttgccatattacactgcccatagttattcctccatgtccgcttttaaaacgtcaatgggggacctgcagcgacagttgtacaatcgaggcgaatataacatatttaaatacgccccaatgttcgagtctaattttatacagatcaacaagaaaggggaggtgattgatgtgcataatcgtgtcagaatggttactgttggcattgtctgcacgtcgcccatcctgccattgcctgatgtaatggtgctcgcacaacccacaaagatttgtgagcagcacgtgcgctggggcagatttgccaagggaaggggcagacgcccagttaagaccctagaattaacccgcctgttgccactcaaatttgtcaagatctctatccacgatcacgagaaacagcagcttcgtctgaagttagcgactggaagaaccttctatctgcaactctgccccagctccgacacaagagaggacttattctgctattgggagaaactggtctatctgttgcgaccaccagtggaaagctactgtagcactccaactctgctctcaggggatgcaccgccagaagacaacaaaagcctcgtggcagccgagttgcaccgggagggcgatcaaagtgaaaccggattgtacaaaccctgtgacgtgagtgctgcaacatcaagtgcctacgccggtggcgagggcattcaacacgcttctcatgggaccgccagcgcggcatctccatctacgagcacccccggtgctgccgagggcggtgcagcccgtaccgccggaggaatggctgtagctgggacggcaactggacccagaactgacgtggccatcgctggtgcggcaatgagtcctgcaaccggggcaatgtcaatcgccacaaccaagtccgccggacccggtcaggtgaccactgccctggctggcgcagccattaaaaaccctggcgagaacgagtccagcaagtccatggcaggcgctgctaatatctcttctgaaggaatttctctcgcacttgtgggagctgctagtacctccctcgagggaaccagcacgtctatggccggtgctgccagcctgagccaggattcctcactgtcagcggcttttgctggatccataaccacctccaagtgcgcagcagaacggacagaaggacccgcagtcggacccttaatatccactctccaaagtgaggggtacatgtccgaaagggacggcagccaaaaagttagtcaaccaagtgctgaagtgtggaacgagaacaaggaacgtagggagaagaaagaccgtcacccttcccgcaaatccagccaccaccggaaggccggagagtcacatagacgtagggccggtgataagaaccaaaaagcttcctctcataggtccgccagcggccacaagaacacccgcgatgataaaaaggagaaggggtactctaatgttagggggaagaggcatggatcctcacggaagagttccacccattcttcaacaaagaaggaaagtaggaccacccaggagctgggcaaaaaccagtccgcctcatccacaggggctctacagaagaaggcttccaagattagcagtttccttagatccctgcgggcaactccagggtcaaagacccgtgtgacgtctcatgatcgcgaagtcgatatagttgcgaaaatggtggagaagcagaatattgaggccaaagtcgaaaaagctcagggcggtcaggagcttgagatgatttctggcacaatgacctccgaaaagacggaaatgatagtttttgaaactaagagtatttag

SEQ ID NO: 22883 - DNA, 3054 bp, Artificial Sequence
  Description of Artificial Sequence: Synthetic coding sequence
atgatgtcagagggtaagcctcctgacaaaaaacggcctcggagatccttatcaatttcaaagaacaagaagaaggcttcaaatagtataatatcctgcttcaataatgcacccccagctaaattagcgtgcccagtttgctccaagatggtgccccgttacgaccttaacaggcacctggacgagatgtgcgcaaataatgatttcgtgcaagtagatccaggccaggttggactgattaactctaatgtgtcaatggtcgatttgacgtcagttactctagaggatgtcaccccaaagaagagccccccaccaaagactaatctgacacctggtcagtcggattctgccaagcgggaggtcaagcagaagatctccccttattttaagtctaatgatgtcgtttgcaaaaaccaggacgaattgcggaataggagtgtgaaagtcatttgtctaggcagcctggcatcgaagctgtctcgaaagtacgtgaaagctaaaaagtctatcgacaaagacgaggagtttgccggatcaagcccccagtccagcaaatccacagtcgtaaaatcgctcatcgacaattcatctgagatcgaagacgaagatcagatcctcgagaattcaagtcagaaggaaaacgtattcaagtgcgactctctgaaggaggaatgtatccctgaacacatggtgcgaggatctaaaatcatggaagctgagagtcagaaggctacccgagaatgcgagaaatccgctctcacacccggattttccgataatgccatcatgcttttttcccccgactttactctccggaataccctgaaaagtacctcggaagacagccttgttaagcaagaatgcattaaagaagttgtagaaaaacgtgaagcttgtcactgcgaggaggtcaagatgactgtggcctccgaagccaaaatccagctgtctgattcagaggccaagagccactcatcagccgatgatgcttctgcctggagcaacatccaagaagctccactgcaggacgactcatgtctgaataatgatattcctcatagtattccccttgaacagggctctagttgtaacggcccaggacagaccacgggccacccatactacctcaggtctttcctggtagtcctgaaaaccgttttagaaaacgaggatgacatgttactgttcgatgaacaggagaagggcatcgttactaagttctatcagctgagtgcaactggacagaagctctacgttcgcctttttcaaaggaagctgtcctggattaagatgaccaaactagaatacgaggagatcgcactggacctcaccccagtcatagaagagctgaccaacgcaggtttcctccagactgaatccgaactgcaagagctgtcagaggttctggaactcctatctgccccagagctcaaatccctcgcaaaaacctttcatctcgtaaaccccaacgggcagaagcagcaactcgtcgatgcattcctgaagttggccaaacagcgctctgtttgtacttggggtaagaacaagcccggtattggcgcagtcatcctgaagagggcaaaggccctggctggccagtctgtgcgcatttgcaagggccctagggcggtgttcagccgcatccttttgctcttttcccttacagacagcatggaggacgaggatgcagcatgcgggggacaggggcagctgagtactgtcctgttggtgaatctggggaggatggagttcccatcgtatactattaatagaaagacccatatttttcaggaccgagatgatctaatcagatacgccgctgccacgcacatgctctcggacatatcctccgctatggcaaatgggaattgggaggaagcaaaagagctggctcagtgtgccaagagggattggaacagacttaagaaccatcccagcctccgctgtcatgaagacctcccattgttcctaaggtgttttacagtcggctggatctacacacggatcctttcaaggtttgtggagatactacaacggctgcatatgtatgaagaagccgtgcgggagcttgagtcccttttaagtcagcggatttattgccccgatagtagaggcagatggtgggatcgcctcgctctgaaccttcaccaacatttgaagcgcctcgaacccactatcaaatgtataacagagggactggccgacccagaggtcagaactggccaccggctgagcctctatcagcgcgctgttcgtctgcgggagtcccccagttgtaaaaagttcaaacacctcttccagcagttacccgaaatggcagtgcaggatgtcaagcacgttacaatcaccggcaggctgtgtccacagcggggaatgtgtaagtctgtcttcgtcatggaagctggcgaggccgcagatcctacaactgttttgtgcagcgtggaagagctggccctcgcgcattaccgccgttcgggtttcgatcagggcatacatggggaaggtagtactttcagtaccctctacgggttgctcctctgggatataatctttatggatggcattcccgacgtctttcgcaatgcctgccaggcctttccactagacctgtgcaccgattccttctttacttcgaggaggcctgccctcgaagctagactgcaacttattcatgacgccccagaagaaagcttgagggcatgggtggccgctacctggcacgagcaggaaggcagagtggcatcattggtttcttgggatcggtttacgtctcttcagcaagctcaagatctggtcagctgccttggcggaccggtcctctccggtgtatgccggcacttggcagctgacttcaggcactgtaggggaggcctccctgatcttgtcgtatggaatagccagtccaggcactttaaactggtcgaggtgaaaggtcctaatgataggctctcccacaagcagatgatttggttagccgagttgcaaaagcttggggctgaggtggaggtctgtcatgtggtcgccgtgggtgctaagtctcagtcactgagctag

SEQ ID NO: 22884 - DNA, 1602 bp, Artificial Sequence
  Description of Artificial Sequence: Synthetic coding sequence
atgatgagcgagggtaagcccccagacaagaaacgcccacgcagaagcttatctattagtaaaaacaagaaaaaggcttctaattcgatcatttcatgctttaataatgctcctccggctaaactggcatgccccgtgtgtagcaaaatggtccctcggtacgatttaaatcgccacttagacgagatgtgcgcgaacaacgattttgtgcaggtggatcctggtcaggttggtctcatcaattccaatgtctcgatggtcgacttgaccagcgtgacgctcgaggatgtcacgcctaagaagtccccgccacccaaaaccaatttgacacctgggcagtctgactcagccaagcgagaggtgaaacagaagatttccccgtactttaagtcgaacgacgtggtctgcaaaaatcaggacgaattgcgaaatagaagcgtcaaggtgatctgcctgggatctttggcgagtaagctttccaggaagtacgtgaaagctaagaagagcatcgacaaagatgaagaattcgcaggcagcagtccacaatcctcaaagtccacggtggtaaagtcgctgatcgataacagtagcgagattgaggacgaagatcagatcctggagaacagctcacagaaggaaaatgtctttaaatgtgactccttgaaggaggagtgcattcctgagcacatggttagaggtagcaagatcatggaggccgagagccagaaggcaacaagggaatgcgagaagtccgcgttgactcctggtttttcagacaatgccatcatgctgttctctcccgactttacattgagaaatactctgaagtcaacctccgaggactcgcttgtaaagcaagaatgcatcaaagaggtggtggaaaagagagaagcatgccactgcgaggaggtgaaaatgacagtagcctccgaagctaagatacaactgtccgatagcgaagccaaatcacactcctccgctgacgacgcaagcgcttggtctaacatacaggaagcgccattgcaggatgactcatgtctgaacaatgatatcccacatagtatccccttggagcagggcagttcctgtaacgggccaggccagactacgggacatccatactacctgcgttcattcctcgttgtactcaagacagtgctggagaatgaggatgatatgctgctgtttgacgagcaggaaaaaggtatcgtgaccaaattttatcagttatccgcaaccgggcagaaattgtacgtgagactgtttcaacgtaagctgagttggataaagatgaccaagctggaatacgaggagattgcccttgatctgaccccagtgattgaagagctaaccaatgctggcttcctgcagaccgagagcgaactccaggagctgagcgaggtgctcgaactgctatctgcgcctgagctgaagtccctggcaaaaacctttcacctggttaacccaaatgggcagaagcaacaactggttgatgcatttctgaaattggccaagcaacgctcagtctgtacttggggcaagaacaagccaggtattggagcggtgatcctgaaaagattctgttggctgcttttgcagtag

SEQ ID NO: 22885 - DNA, 1719 bp, Artificial Sequence
  Description of Artificial Sequence: Synthetic coding sequence
atggccgaactagtccagggacaatcagcacccgttggtatgaaggcagagggattcgtggatgccctgcacagggtaagacagatagccgcaaagattgattccatcccccatctcaataacagtaccccccttgtcgatccctccgtctatggatacggagtgcagaaaaggcccctggacgacggcgttggtaatcagctgggtgctctagtgcatcagcggaccgtgatcaccgaagagtttaaggttccagacaaaatggtaggattcatcatcggtcggggtggggaacagatctctcgaattcaagccgaatccggatgcaaaatacaaatcgctagcgagtctagcgggataccagaaaggccatgcgtgctaacaggaactccagagtctatcgagcaggccaagcggttgctggggcaaattgttgatagatgccgcaacggaccaggctttcacaacgacatagactctaattctaccatccaggaaatcttgatccccgcttccaaggtggggctcgtaataggcagaggaggggagacaattaaacagcttcaggagagaactggcgtcaagatggtcatgattcaggacggcccactccctactggtgcagacaagcctctgcgcataaccggagacgcgtttaaagtgcagcaggccagagagatggtactcgagatcatccgggaaaaggaccaagccgacttccgcggagtgagaggcgatttcaattcgcgtatggggggtggatccatcgaagttagtgtgcctaggtttgccgttggtatcgtcatcggacgaaacggcgaaatgatcaagaaaattcagaatgatgccggagtgaggattcagtttaagcctgatgacgggatctctccagagagggcagcgcaggtgatgggcccacccgaccggtgccagcacgccgcacatattatttctgaactgattctgaccgcacaggaaagggacggatttgggggtctagccgctgcgagaggtcggggtcgcggacgaggagactggtcggtgggtgctccaggaggagtgcaggaaattacttatactgtccctgctgataaatgcgggctagtgatcggaaagggtggggagaatatcaagtctattaaccagcagagtggagcgcatgtcgagcttcagcgaaatccccctcccaattcagaccctaatctgcgtcggttcactattcgcggtgtcccccagcagatcgaagtggctcggcaactcattgatgagaaagtgggaggtactaacctcggtgcacccggtgccttcggacagagcccttttagccaacccccagcgccaccccaccagaacacattcccacctaggagtagcgggtgcttcccaaatatggctgctaaagtcaatggcaacccccactcaactccggtatctggcccacccgcttttctgacgcagggctggggatcaacctaccaggcctggcaacaacccactcaacaggtcccgtcacagcagagtcaaccccagtccagccaacctaattacagcaaagcctgggaggactattacaagaagcagtcccatgccgctagcgccgcaccacaggcttcctctcctccggactacactatggcctgggccgaatactaccggcaacaggtcgctttttatggccagaccttggggcaggcccaggcccacagccaggaacaatag

SEQ ID NO: 22886 - DNA, 927 bp, Artificial Sequence
  Description of Artificial Sequence: Synthetic coding sequence
atgaaagctgaagggttcgtcgatgcattgcacagggtacggcaaattgcggcaaagatcgatagtatcccacatttaaacaactcaacacccctggtggatcccagcgtgtatggctacggcgtccagaaaagaccactcgacgacggggtcggcaaccaactgggcgcactggtgcatcaacgcacagtgattacagaggaattcaaagttccggataagatggtaggtttcatcatcggtagggggggagagcaaataagtagaatccaggctgaaagtggctgcaagatccaaatcgcttcagaatcatccggcatcccagagagaccatgcgtgctgacaggaacccctgagtccatagagcaggcaaaacggcttctcggccagatcgtggatcggtgcaggaatggccctggtttccataatgatatcgactctaactcaacaatccaagaaatcctcatcccggctagcaaggttgggctggtaattggacggggtggtgaaactattaagcagctgcaggagcggacaggagtcaagatggtgatgattcaagatggaccactgccgaccggggcagataagccactgagaatcacaggggacgctttcaaagtgcagcaggcccgtgaaatggttctggaaatcataagagagaaggaccaggccgattttaggggagtaaggggcgatttcaactctagaatgggaggtgggtccatagaagtgagcgtccccaggtttgctgttggcatagtcatcggcagaaacggcgagatgataaagaaaatacagaatgatgccggtgtgaggattcagtttaagcctgatgatggaattagtcctgagtattataggcagcaggtggctttttacggacagactttaggccaagcccaagcccactctcaggacgagtag

SEQ ID NO: 22887 - DNA, 786 bp, Artificial Sequence
  Description of Artificial Sequence: Synthetic coding sequence
atgcctccaataggcaaccagcttggggctctcgtgcaccaacggactgttatcaccgaagaattcaaagtgccagacaagatggtggggttcattatcggcagaggaggcgaacagatttcacggatccaagctgaatcagggtgcaagatccagatcgcaagcgaaagctccgggattcctgaacgtccttgcgtgttaacgggaaccccggaaagtatagagcaagcaaaaaggcttttgggacagatagttgatcgctgtagaaatggacctggattccacaacgacatcgatagcaattcgacaattcaagagatcctgataccggcttcaaaagtggggctcgttataggccgagggggagagaccatcaagcagttacaggaacgcacaggggtcaaaatggtgatgattcaagatgggccactaccaacaggcgcagacaaacccctgcgaattactggagatgccttcaaagtccagcaggcacgggagatggtactggaaatcatcagagaaaaagatcaggccgatttcagaggagtacgaggagatttcaactcaagaatgggcggtggcagtatcgaggtcagcgtgcctcggttcgctgtcggaattgtgattgggagaaatggagagatgattaagaagattcaaaacgatgcaggagttcgcatccaattcaaaccagatgacggcatttctccagaatactatcggcagcaggtggccttctacgggcagactctcggacaggcccaggcccactctcaggagcagtag

SEQ ID NO: 22888 - DNA, 597 bp, Artificial Sequence
  Description of Artificial Sequence: Synthetic coding sequence
atgggaaaacagaagaaaactaggaagtatgctaccatgaagaggatgctctctctgcgtgaccagcgccttaaggaaaaagacagattaaaacctaaaaagaaagagaaaaaagatccatcagcgctaaaggaaagggaggtgccacagcatccttcttgcttgttcttccagtacaatactcagctgggtcccccttatcatatcttggtggatactaatttcatcaatttctcgataaaggccaagttagacctcgtccagtctatgatggactgcctgtacgccaagtgcatcccctgtatcacagactgcgtgatggccgagatcgagaaactgggacaaaaatatcgcgttgccttgcgtattgccaaagacccacgatttgagaggttgccctgtactcataagggcacctatgcggacgattgtctcgtacaacgcgttacccaacacaaatgctacatagttgctaccgtggaccgcgacctcaagaggcgcatcaggaagatccctggcgtgcctataatgtatatctctaatcaccggtataacatcgagaggatgccagatgattatggggcacccaggttctag

SEQ ID NO: 22889 - DNA, 501 bp, Artificial Sequence
  Description of Artificial Sequence: Synthetic coding sequence
atggcagcttacccggagtcttgcgtggataccacagtattggattttgtcgccgatctgtccttggccagcccccgtaggccgttgctgtgcgatttcgcccctggggtgtctcttggcgatcccgcattggctctgagagaaggaaggcccaggaggatggctcgtttcgaggagggagatccggaggaggaggagtgtgaggtggaccagggagacggagaagaagaagaggaggaagagcgaggtagaggtgtgtcactccttggccgtcccaagagaaagagagtcatcacttacgctcagcgtcaggccgcaaacattcgggagagaaagaggatgttcaacctcaatgaggctttcgaccagttgagaaggaaagtgcctactttcgcctacgagaaacgcctctctagaatcgaaaccctgcgcctggccattgtgtacatctctttcatgaccgagctgttggagagttgcgaaaaaaaggaatccgggtag

SEQ ID NO: 22890 - DNA, 2280 bp, Artificial Sequence
  Description of Artificial Sequence: Synthetic coding sequence
atgatttcctctacaagcgtatacggattaaaaatgcagtggactcccgagcacgctcagtggccagagcaacactttgacatcacttctactacgaggagtcctgctcacaaggtggaagcgtaccgtggacacctgcagcgtacctaccagtacgcctgggcgaatgacgatatttcggcgctgaccgcctccaatctgctcaaaaaatatgcggaaaagtacagcgggatcctcgaagggccagttgatcggccagtgttaagtaattactcagatacccctagcggactagtgaatgggagaaaaaatgaaagcgaaccatggcagccatcccttaatagtgaggctgtgtaccccatgaattgcgtccctgatgtgattacagccagtaaggctggcgtttccagcgcattgccaccagcagacgtcagtgcatctattgggagttctccaggtgtggccagtaatctgacagagccctcctattcatcctctacatgcggctcccataccgtaccaagcctccatgctgggctccccagtcaggagtacgcacccggatacaatggaagctaccttcactccacctattcttcacagccagcgccagccctcccctcccctcacccatcgccattgcactctagcgggctgttgcagccaccccctcctcccccacccccacctgctcttgtgcctggctacaacggcacctctaacctgagtagctactcttacccttctgcatcgtacccccctcagactgcagtggggagcggatacagcccaggcggtgcacctccacctcctagcgcctatctccctagcggtataccagccccaaccccactcccaccaacgaccgtgcctgggtatacctatcagggtcacggactcacccccatcgcccctagcgcactcacgaacagcagcgcctccagccttaagagaaaggccttttacatggctggtcaaggcgatatggactcatcgtacggcaattacagttacggccaacagcgtagtacccagtcgcccatgtacagaatgcccgacaattctatatctaatacaaatagaggtaacggctttgatcggtcagctgagacttcctctttggccttcaaaccaacaaaacagttgatgagcagcgaacagcagcggaagttttcgtcccaatcctccagggcgctcacccctcctagttacagtacagctaagaattccctgggctccagatcgagtgagtccttcggaaagtatactagcccagtcatgtctgaacacggggacgaacacaggcaattgctttcccatccaatgcagggccctggcctgcgagctgcgaccagttcaaatcactctgtggacgagcaactcaaaaacacagacacacacctcatcgacctggttacaaatgaaattattacgcaggggccacccgtggattggaatgatatcgccggactggatctggttaaggctgtaatcaaggaagaggtcctgtggcctgtgctgagaagcgatgcttttagcgggttaactgcattgccgcgaagcatccttctcttcggacctcgagggacgggtaagaccctgctgggacgttgcatcgccagccagctcggcgctactttctttaaaatcgcaggatccggactggtggccaagtggctgggcgaggccgagaagataatccacgcatcttttctggtggcacgatgtcgccagccctccgtcatctttgtctctgacattgatatgctgcttagctctcaggtgaacgaagagcacagcccagtgtctagaatgcggacagagttcttgatgcagttggacactgtgctgacgagtgctgaagatcagatcgtggtcatttgtgctacgagtaaacctgaagagatcgatgagtcactccggaggtacttcatgaagaggctcttgatacctctcccggacagcacagccagacaccaaattatcgttcagctgctcagtcagcacaactattgtcttaacgataaagagttcgctctgctcgtgcagcgcactgaaggtttcagtggactggacgttgcccatctctgccaggaggccgtcgtcgggccattgcatgctatgccagcgaccgacctctccgcaatcatgccgtctcaattgagaccagtgacttaccaagattttgagaatgcgttctgcaaaattcagccttccatcagtcagaaggagctcgacatgtacgtcgaatggaacaagatgttcggctgctctcagtag

SEQ ID NO: 22891 - DNA, 1050 bp, Artificial Sequence
  Description of Artificial Sequence: Synthetic coding sequence
atggaaacccctccagtgaacacaatcggtgagaaggatacatctcaaccgcagcaggagtgggagaagaacctccgagagaatctggattccgtgatccagattagacaacagcctagagacccccctactgagacactggagctcgaggtgtcaccagatcctgcctcgcagattctcgagcacacgcagggggctgaaaagctggtggcggaactggagggagatagtcacaagagtcatggaagcacttcccagatgcctgaggccctgcaagcttctgacctatggtattgccctgacggaagcttcgtaaagaagatagtgattcgtggccacggactggacaagcctaagctaggatcctgttgtagagtgcttgccctggggtttcctttcggaagcggaccaccagagggctggacagaactgactatgggggtgggcccttggcgcgaggaaacatggggtgagctaatagaaaaatgtttagagagcatgtgccagggcgaggaggctgagttgcagcttcctggccattccggaccacccgtgcgactgacattagcctcatttacccagggcagagattcttgggagctggagacctccgaaaaggaagcgcttgcacgggaggaaagggctaggggaaccgaactgttccgcgctgggaatccagagggggcagcgagatgctacggacgggctctaaggctgttgcttaccctgcccccaccaggtccgcctgagagaaccgtgttgcacgccaacttagctgcttgccagcttcttctggggcagccacagttggcagctcagagttgtgaccgcgttctcgagcgtgagccagggcatttgaaggccttgtatcgtcgcggtgttgctcaggccgcactgggtaacttagagaaagcaaccgccgatctgaagaaagtccttgccatcgatcctaagaacagagctgcccaggaggagctgggaaaagtggtcatacaaggcaagaaccaggatgccggactcgcacagggacttcgcaagatgttcggatag

SEQ ID NO: 22892 - DNA, 1050 bp, Artificial Sequence
  Description of Artificial Sequence: Synthetic coding sequence
atggagactcctcctgtcaacaccattggggagaaagatacatcacaacctcagcaggaatgggagaagaaccttagagaaaacctcgattcggtcatccagatacgccagcagccccgagacccaccaacagagacgctggaactggaagtctccccggatcctgccagccaaatcttagaacatacccaaggagcggagaagctggtggcagagcttgagggagacagccacaagagtcacggaagcaccagtcagatgcctgaggcacttcaggctagtgacctctggtattgtcccgatggatcctttgtgaagaagatagtgataagaggacacggacttgataaacccaagttaggctcttgttgtcgagtactcgctctaggctttcctttcggatctggtccaccagagggctggacagaattgactatgggcgtgggtccctggcgggaagagacctggggggagctgattgagaagtgcctggaatcgatgtgtcaaggcgaagaggctgaactgcaactccctggccatagcggaccaccggtgcggcttacactggcaagttttactcagggacgggactcatgggaactagagacgagcgaaaaagaggcactcgcacgtgaggagagagcacgtggaaccgaactgtttagagctggcaatccagaaggcgctgcacgatgttatgggagggccctgcggctgctcctaacactccctccacctggccctcccgaaagaaccgttctccacgctaacctcgcagcgtgtcagctgctgctaggccagccacagctggcagcacaatcatgcgacagagtcctggagcgtgagcctggtcacctcaaggcactgtatcgacgtggtgtcgcgcaggctgccttggggaacctagaaaaggccaccgcagatctgaaaaaggtattggccatcgaccctaagaacagggctgcgcaagaagagttggggaaagtcgtcatccagggaaagaatcaggacgcagggctcgcccagggcctgcgcaagatgtttggttag

SEQ ID NO: 22893 - DNA, 1050 bp, Artificial Sequence
  Description of Artificial Sequence: Synthetic coding sequence
atggagactccacctgtgaacacaataggcgagaaggatactagccagccccagcaggagtgggagaaaaaccttagagaaaatctggattcagtaatccagattaggcagcagccgagagacccccctactgagaccctggagttagaggtgtccccagatcccgcttcccagattctggagcacacccagggcgctgagaaactggtagccgagctggagggtgactcacacaaatcccatggttctacatcacaaatgcctgaagcactgcaagcctccgatttgtggtattgccccgacggtagttttgttaaaaagattgtgatccggggacacggacttgataaaccaaagctcggtagttgttgccgtgtcttagccctgggattcccatttggctccggccctcctgagggatggactgagttaaccatgggtgtgggcccatggagagaagagacatggggcgagttaatcgaaaaatgcctggaatccatgtgtcagggggaagaagccgagcttcagctcccgggacattccggcccaccagtacgccttacactcgcttcgtttacacaggggagggattcatgggagctcgagacttcagagaaggaggcccttgctcgggaggaaagggcacggggaaccgagctcttccgcgctgggaacccagagggcgcagccaggtgttatgggcgtgctctcagacttctgcttacattgcctcctcccggtccacctgaacgcacagttttacatgctaatctggctgcctgccagttactgctgggtcaaccacaacttgctgcccagagctgcgacagggttctggagagagagccaggccatctgaaggcactttacagacgaggggtggcacaggccgctctgggcaacctggaaaaagcaacagcagatcttaagaaggtcctggcaatagaccccaagaatcgagccgcacaagaggagctcggaaaagttgtcattcagggtaagaaccaagacgcgggattagcccagggactgagaaagatgtttggctag

SEQ ID NO: 22894 - DNA, 2151 bp, Artificial Sequence
  Description of Artificial Sequence: Synthetic coding sequence
atgccgctgcccgagccttcggaacaggaaggcgagtcagtcaaagcaggacaagagccgtccccaaaacctggcacggatgtgatcccggctgcaccaaggaagccgcgagagttttcaaaattagtgctgttaacggcttctgatcaggatgaagacggggtaggtagtaagccacaggaagtacactgcgtgctgtccctcgaaatggcagggcctgccaccctggcctctaccctgcagatccttcccgtagaggagcagggaggcgtggtccagccagcgcttgaaatgccagagcagaagtgctctaagcttgacgctgcggctccacaatctctggagttcttgcgcaccccctttgggggacggctgctcgtgctcgaaagttttctctacaagcaggagaaggctgtgggtgacaaggtgtattggaaatgtcgacagcatgccgagctcggctgtaggggacgcgcaatcacgagaggcctgagagcaactgtgatgcggggtcattgccatgcacccgacgaacagggactcgaggctcgaaggcagcgcgagaagctccctagcctcgccctgccggagggcttgggagaaccacagggaccagaaggtcctggcggacgcgtggaggaacccctggaaggcgtgggaccttggcagtgccccgaggagcccgaacccacccctgggctcgtgctgagtaagcctgcacttgaggaagaagaagccccacgagccctgagtctcctctccctgccccctaagaaacggtccatcctcggtctcggccaagctaggccgttggaattccttagaacctgctatggcggatctttcctggtacatgagtcctttctatataagagagagaaggccgtgggggataaggtgtactggacctgtagagatcacgcactccacggttgtcgcagtagggctatcacacagggacagcgcgtgacagtgatgagggggcactgtcaccagcctgacatggagggcttagaggcccgtaggcagcaggaaaaggctgtcgaaactctgcaggccggacaggacgggccagggtcccaggtagatacacttctgaggggcgtcgacagcctcctgtaccgcagagggcctgggccactcactctgactcgacccagacctcgaaagagagcaaaagtggaggatcaggagctacccactcagcctgaagccccagatgagcaccaggacatggacgctgatcctggaggccctgagttcttaaagactccgctggggggatccttcctggtctatgagtccttcctttatcgacgcgagaaggccgctggagaaaaggtgtactggacctgtcgagatcaggctcgcatgggctgtagatcacgcgcaattacacaggggaggagagtcactgtgatgcgcggtcattgccatccacccgatctcggagggctcgaggccctgagacaacgggagaagcgacctaacactgcccagagaggatctcccggaggaccagaattcctgaaaacccctctgggtggctccttcctggtctacgagagctttctgtatcggcgagagaaggcagctggtgagaaagtctattggacatgcagagatcaagctcgcatgggatgcagatctagggccattacccaaggaaggcgcgttatggtgatgaggaggcactgccaccctcctgatttaggaggcctcgaggcactgcgccagcgagaacacttccccaatctcgcccagtgggacagccctgacccattacggcctttggaattcttgagaacctccctgggtggtcgatttctggtccacgaatcctttctctaccgtaaagagaaggcggctggcgaaaaggtgtattggatgtgtcgggaccaggctcgtcttggttgtaggtctcgggcaataacacagggccatcgcattatggtaatgcgctctcattgccatcaacccgaccttgccggattagaggccctccgccagcgggagcgcctgccaaccactgcacaacaggaagaccctgaaaagatccaagtgcagttgtgcttcaaaacgtgctcccctgagtcacagcagatctatggggacatcaaggacgtgcgcctcgacggggagtcacagtag

SEQ ID NO: 22895 - DNA, 987 bp, Artificial Sequence
  Description of Artificial Sequence: Synthetic coding sequence
atgccacaagccacctctccaccactgtggccgctgagtttgcacggcggaaagggcatcttgtgggctcgtcacagccatcctccaggccctccatcacatcatatccaggactccggccgttgcagtctgcctctgcctcagagcccaggcgtgacaccgctaccagctagactgtccggcgctacacctctatcccccatccgcctgctgagcagctttgtccccagaggacctagagtgatcccactcacaaaccaggcaagacggaccttgcacgcctctctcggaggctgctggggacgcacctcggacgccgcagacaccgcctccctcaaggcctggcagggcggaccggaatttctgaagactcctctgggtggaagttttctcgtctacgaaagtttcctgtatcgaagggagaaggccgctggcgagaaggtgtactggacctgccgcgaccaggcgcgtatggggtgcaggagtcgggctatcacacaggggcgtcgagtcatggtgatgaggagacattgccacccaccagacctgggtggcctggaggctctccgccagcgagagcacttccccaacctggcacagtgggattctcccgatccattgcgtcccctagagtttctccggacctcccttgggggtcgcttcctggtccatgaatctttcctgtaccggaaagagaaggccgctggggaaaaggtctactggatgtgccgggaccaggctcgcttaggatgtcggtcgcgcgctattacacaaggccatcgcattatggttatgagaagccattgccatcagcccgacctggccggtcttgaggctctgcgtcaaagggaaagactgccaaccacagcccagcaggaggacccagagaagatacaagtgcaactctgttttaaaacctgttcaccagaatcccagcaaatatatggcgacataaaagacgtgaggctggacggcgaatctcaatag

SEQ ID NO: 22896 - DNA, 2298 bp, Artificial Sequence
  Description of Artificial Sequence: Synthetic coding sequence
atgcctctgcctgaaccttccgagcaggagggggaaagcgttaaggctggccaagagccatcgcctaaacccggaaccgacgtgattcccgctgcccctcggaagccgcgagagttttcaaagcttgttctgctcactgcgtccgatcaggatgaggatggagtggggagtaaaccccaggaagtgcattgtgtcctctccctcgagatggcaggcccagctactctagcgtccacattgcaaatcctcccagtggaagagcagggtggagtcgtacagccggcattggaaatgcccgaacagaagtgcagcaagctcgatgccgcagctccgcaatccctagaatttctgcgcaccccctttggagggagactactggtcttggagtctttcctgtataaacaagaaaaagccgtcggagataaggtctactggaagtgtcggcaacacgcggagctggggtgtagggggcgtgcaattacaagaggcctgcgggcaacggtgatgcgtgggcattgccacgcaccggacgagcaggggctggaggctagaaggcaacgcgagaaattgccatctctggctctgcccgagggcctgggtgaacctcagggtcctgaaggccctggcggaagggttgaagagcctttagaaggggtgggtccttggcagtgcccagaggaaccagagcccacacctggtttagtgttaagtaaacctgctctggaggaggaagaggccccaagggccctctcacttctgtccctaccaccaaagaaaagaagtatcctgggtcttgggcaggctcgccctttggagttcctgagaacatgttacggaggctctttcctggtgcatgagagcttcctgtacaagcgcgaaaaagccgtgggagataaagtatactggacctgtagggaccatgctttgcatggctgcagatctcgggctattacgcagggacagcgagtgacggtgatgcggggacattgccaccagcccgatatggagggcctcgaagctagaagacagcaggaaaaggcagtggaaacgctgcaggccggacaggacggccctggttctcaagtggacactctccttcgtggagtggattcactgttatatcgcagaggtcctggtcccctcaccctgacacgcccacgccctcgcaagagagccaaagttgaagatcaggagctgcctacacaacccgaggccccagacgaacaccaagatatggatgctgatcccggtgggcctgagtttctgaagacccctctgggcggtagttttttggtatacgagagctttctgtaccggagagaaaaagcggcaggggagaaagtttactggacttgtcgcgaccaggcacgaatgggttgccgcagtcgtgctatcacccagggcaggcgcgtgactgtcatgcgcggtcactgtcacccccctgatctagggggattggaagcactgaggcaaagagaaaagaggcctaatactgcccaacgcggtagcccaggagccggtctatcattccagtggttgtttcggatattacaactcctgggtcacgcaccggtgctgctgtgccccagcggcagctcatgtttgccatcactccctgccccacacggcccatgccccgcactgagtattccgttggagggtggtcctgaatttcttaagactccactgggcggatctttcctggtgtacgagtcatttctgtaccgacgggaaaaggccgctggagagaaggtttactggacttgtagggatcaggctcgtatgggctgtcggagtagagctattactcagggtaggagagtcatggtgatgagaaggcattgccatccccctgacttaggcggactggaagccctgaggcagcgggagcactttccgaatctggcccagtgggattcacccgacccactaaggccactggagttcctgcggacatccctcggaggcagatttctggtgcatgaaagtttcctgtacagaaaggagaaggcagctggggagaaggtgtactggatgtgtcgggaccaggctcggctgggctgccggagtagagccataacccagggacaccgtattatggtcatgaggagccattgccatcagcccgacctagctggcttagaggcccttcgacagcgcgagcgccttcccaccactgcacagcaggaagatcctgaaaaaatccaggtgcagctgtgcttcaagacttgcagccctgagtcccagcagatttatggagacataaaagatgtgcgtctcgacggggagtcccagtag

SEQ ID NO: 22897 - DNA, 2148 bp, Artificial Sequence
  Description of Artificial Sequence: Synthetic coding sequence
atgcccctgccagaaccttcagagcaagagggcgagtcagtaaaagccggacaggagccttctcccaaacccggtacagacgttatccccgctgctccacggaaacccagggagttcagcaagctcgtcctgctgaccgcctcagatcaagatgaagacggtgttgggagcaaaccacaagaagtacactgtgtattgtctctggagatggccggacctgctactctggccagcacactacagattctacccgttgaggagcagggcggagtggtgcagccggctctggagatgccagaacaaaagtgctcgaaattggacgccgcaccccaatccctggagtttcttagaactccttttggcggacggttgctcgtcctggagtcctttctgtataagcaagagaaagctgtcggagacaaggtgtactggaaatgtcgacaacacgcggagctgggatgtcgcggtcgggcaatcacgcggggacttcgtgccaccgtgatgcgagggcactgtcatgcgcctgatgagcagggcctcgaggccaggcgtcaaagagaaaaattgccaagtctggccctgccagaaggcctaggtgagcctcagggccctgaggggccaggcggaagagtcgaggagcctttggagggagtcgggccatggcagtgcccagaggagccagaacctacaccaggtctggtgctgagcaagcccgctctggaggaagaggaagctccaagggcactgagtctgttatcactgccgcctaagaaaagaagcatcctgggattaggacaggccaggcccctagagttcctgcggacctgttatgggggtagttttttggtgcatgaatccttcctctataagcgggagaaagcagtaggtgacaaggtgtactggacttgtcgggatcacgccctgcatggttgtaggtctcgtgctattacccagggtcagcgggttaccgtcatgcgcggacattgccaccagccagatatggaaggcctggaagcaaggagacagcaagaaaaggcagtcgagactctacaggcaggccaagatggcccagggtctcaggtagacacactgcttcggggagtggacagcctgctctatcggagaggccctggtcctctgactctcacccgaccccgtccgaggaagcgagccaaagtggaggatcaggaattgccaactcagccagaggcccctgacgagcaccaggacatggatgccgatccaggcggacccgagttccttaaaactcccttaggagggtcattccttgtatatgagtcattcctatatcgcagggaaaaagctgcgggtgagaaagtctactggacttgcagggaccaggctaggatgggctgccggagccgggctatcacacagggtagacgggtgaccgttatgcggggacactgccatccccctgatttgggagggctcgaggccctgcgccagcgggagaaacggcctaacacagctcaacgcggatccccgggtggccctgaatttctgaagaccccgttgggcggttcatttctcgtatacgaatcttttctatacagacgcgagaaggccgctggcgagaaggtgtactggacatgcagggaccaagccagaatggggtgccggagcagagcaattacccaaggtaggcgcgtcatggtgatgcgacgccactgtcacccccctgatttaggaggcctggaggccctccgtcagagggaacattttccaaacttagcccagtgggatagtcctgaccccctacgtccacttgagttcctgagaacctctcttggagggcgattcttggtacacgagagcttcctgtatcgcaaggagaaagctgcaggggaaaaggtttattggatgtgtcgcgaccaggctcggctcggctgcaggtcacgtgccattacacagggacaccggatcatggtgatgcgatcccactgccatcagcccgacctagccggactggaagcactgcggcaaagggagcgcttgcccactactgcccagcaggaagatcccgaaaagatccaggtacagttatgtttcaagacttgtagcccagagtcccagcagatctacggcgacatcaaagatgtgcggctggatggggagtctcagtag

SEQ ID NO: 22898 - DNA, 978 bp, Artificial Sequence
  Description of Artificial Sequence: Synthetic coding sequence
atgcccaggcccggaagaaatacgtattcagaccagaaacccccttacagttacattagtctgacagccatggccatccagtcctcaccagagaaaatgctccctctgtctgagatttataaattcatcatggaccgattcccttattatcgagaaaatacacagagatggcaaaacagcctgcgacataacttgtccttcaacgattgctttatcaagatccctcgaagacctgatcaacccggaaagggctccttctgggctttgcacccaagctgcggggatatgtttgagaacggttccttcctgaggaggagaaagcggtttaaagtgctcaaaagcgatcacctggcaccatccaaacctgcggatgctgcccagtatctgcagcaacaggcgaagttacggttatccgccctcgctgcgagcggcactcacctgccccagatgccagccgcagcttacaacctggggggagttgctcaaccttcaggcttcaagcatcccttcgcaattgagaatattattgccagggaatacaagatgcccggtggcctggccttttctgctatgcagccagtacccgctgcgtatccacttccaaaccaacttacaactatggggtccagcctgggtacaggctggccccacgtatatggctcagccggtatgatcgattcagccaccccaattagcatggccagcggagattacagcgcttatggcgtgccactgaaacctctctgtcatgctgctggacagacacttccggctattccagtgccaataaagcctacccctgccgctgtgcccgcattgccagccctgcctgcccctatccctaccctgcttagtaactcaccgccaagcctgtcgcccacctcttcacagaccgctacttcacagtcctcccccgcaacaccgagcgaaactctgaccagtcctgctagcgcattgcactccgtggctgtgcactag

SEQ ID NO: 22899 - DNA, 1299 bp, Artificial Sequence
  Description of Artificial Sequence: Synthetic coding sequence
atgcctcggcctggcaagagcagctatagcgatcagaagcctccgtactcctacatcagcctcacagcgatggctatccagcacagcgccgaaaagatgctccccctgagtgatatttataagttcataatggagcgctttccatattatcgcgaacacacccagcggtggcagaacagcctccgacataatctcagctttaacgattgcttcatcaaaattccgaggcggcctgaccaacccggaaaaggcagcttctgggcacttcacccagactgtggcgatatgttcgagaatgggagctttttgaggcgcagaaaaaggtttaaggtcctgcgagcagaccatacacatctgcacgccggttcaacgaagtcagccccaggcgctggccctggtggacatttacacccacaccaccaccatcatccccaccaccatcatcaccatcatgccgcagctcatcaccatcatcaccaccacccaccccaaccccctcccccacccccaccgcctccacctcatatggtgcactattttcatcagcagcctcccactgcaccccaaccgccacctcacctccccagccaacctcctcagcagcctccgcagcaatcccaacctcagcagccctcccatcctggcaagatgcaggaagctgcagccgtcgctgcggctgcagcagcagccgctgctgctgccgtcggaagcgtggggaggctttctcaattccccccttacggcctcggaagtgccgcagccgctgccgcagctgccgctgcgtctacaagtggtttcaaacacccctttgcgatagaaaatattatcggaagggactataaaggcgtgctgcaggctggagggttaccccttgcctcagtgatgcaccacctgggttatcctgtgcctggccagttaggaaacgtagtttctagcgtgtggcctcacgtgggggtcatggactccgtggctgctgccgctgccgctgctgccgcagccggagtgccagtggggccagaatatggcgcatttggcgtgcccgttaaatctctatgccattccgcctcgcagagccttccggctatgcccgttcccatcaagcccacccctgctctccctccagtgtccgccttgcaacccggactgaccgtgcccgcagccagccagcaacctcccgctcccagtactgtttgctcggcagccgctgcaagtccggtggctagcctcttagagcctactgcacctactagcgcagagtcaaaaggcggatcccttcatagtgtgttggtccactcatag

SEQ ID NO: 22900 - DNA, 1251 bp, Artificial Sequence
  Description of Artificial Sequence: Synthetic coding sequence
atgaatctgcccagagctgaacgacccagatcaacacctcaaaggagccttcgtgacagcgacggcgaagacggaaaaatcgatgtgctgggcgaagaggaggatgaggatgaggtggaggacgaggaagaggaagctcggcagcagtttctcgagcagtctttacagccaggcctgcaagttgccagatgggggggtgtggccttacctcgtgaacacatcgaaggcggaggcggaccttctgaccccagcgagtttggtaccaaatttcgggctcctcctagatcagcggcagcaagtgaggatgcgagacagccagctaaacctccctattcctacatcgctctgattactatggcaattctccaaaatccgcacaagcgcctcactctcagcgggatttgcgccttcattagtggcagatttccttattatcggagaaagtttcccgcatggcaaaacagcattaggcacaacctgtccctgaatgactgcttcgtgaagatccccagagaaccaggccacccgggaaaagggaactactggtctctggatcccgcttctcaggatatgtttgataacggcagcttcctgcgcagaagaaaacgctttaagcggcaccagttaactccaggcgctcatttgcctcatccctttccactgcctgccgcacacgctgcactgcacaacccccaccctgggcctttgctgggcgctccagctccaccccagccagtgcctggagcgtaccccaacaccgctccaggcaggaggccgtatgcactcctgcatccgcatccactgcggtatctactgctgtcggccagagtgtacgccggtgcaccaaagaaggccgaaggcgcagatctggccacccctgccccttttccctgttgttcccctcatcttgtgttatcccttggacgaagggctagagtgtggcggaggcatcgggaggcagatgcaagcctttctgcgctgcgcgttctgtgtaagggctcaggtgagagagtccagggattgaggagagtgtgccccagacctcgtggagcaacggccacctgtagtagcgaccatcaggcctgttgcatcccaaagccattgccactttgttgcaagtgccctccacccctcctgttaggccagttctgctcaaactcatcctccatacgtagaactgccccaacggccgctctcccgcctcgagccagatgctgggccggaacttgcagaccacgacggcgatgttag

SEQ ID NO: 22901 - DNA, 1251 bp, Artificial Sequence
  Description of Artificial Sequence: Synthetic coding sequence
atgaacctgccccgtgccgaaagacccaggtccacaccacagaggagcctcagggatagtgatggcgaggatgggaagattgacgtgctcggtgaggaagaggacgaggatgaggtggaagacgaagaggaggaggctagacagcagtttctcgagcagtcccttcagcctgggctgcaagtggccaggtggggaggcgttgcactgccacgcgaacacatcgaaggaggcggtggcccttccgaccctagcgagttcggcaccaagtttcgggctccccctcggagcgcagccgcaagcgaagacgccaggcagccggctaaacctccgtattcatacatcgctctgatcaccatggcgatcctgcagaacccgcacaaaaggcttacgctgtccgggatatgtgcctttatcagcggacgttttccctattacagacgaaagttccccgcttggcaaaacagtatcaggcataatctcagtctgaatgattgctttgtgaagatacctcgggaacctggccatccaggcaaaggcaactattggtccctggatcctgcctctcaggatatgtttgataatgggtcctttctcaggcggagaaaaagattcaaacggcatcagttgacccctggtgcccatctgccacacccttttccactgcctgccgctcacgctgcactccacaacccacacccagggcctttactgggagctccggcaccaccacagccagtgcccggagcttatccgaacaccgcgccaggacggtgcccctacgccctcctccatccccatccactgcgttatttgcttctcagcgcacccgtttacgcgggagcccctaaaaaagcggagggggctgacctggccacacccgcaccctttccctgctgcagcccgcatctggtgctgtccctgggcaggcgcgctagggtgtggagacggcaccgggaagccgatgcgagcctctctgccctccgggtgctttgtaaaggcagcggcgaaagggtgcagggcctgaggagggtgtgccccagacctcgaggagcaaccgcgacatgcagttcagaccaccaagcgtgttgcatcccaaaacccctgcccctctgctgcaaatgtccccctcctcttctattaggacagttctgttccaactcttcatcaatacggagaacggccccaacagcagctctcccaccccgtgcccgttgttgggctgggacatgtaggcccagaagacgctgctag

SEQ ID NO: 22902 - DNA, 1254 bp, Artificial Sequence
  Description of Artificial Sequence: Synthetic coding sequence
atgaatctcccccgtgctgaaagactgcggtccacgccgcagaggagtcttcgtgactctgacggagaagacggaaaaatcgatgtgctgggtgaagaagaggatgaagatgaggttgaagatgaggaggaggctgcttcacagcaattcctagaacagtccctccaacctggactccaagtggccagatggggtggtgtggcgctgccacgagaacatattgagggtgggggagggccatctgatcccagcgagtttgggactaaattcagagcccctccccgttccgccgcagcttcggaggacgcgcgacaaccggcaaagcctccctactcctacatcgcactgatcaccatggctattctgcagaatcctcacaaaagattgaccctgtcaggaatttgcgcgtttatatctggaaggttcccttattatcggaggaagttcccggcatggcagaattccatacgacacaacctcagtctgaatgactgcttcgtcaagatccctcgagaaccaggccaccccggaaagggcaactattggtctttggaccctgcctcccaggatatgttcgacaacggaagctttctccgcaggcgcaagagattcaaacgccaccaactcacgcctggagcacacctgcctcatccatttccattacccgctgcccatgccgctctccacaatccacatcccggacccctcctcggcgcacctgcacccccacaacctgttcctggtgcataccccaatactgctcctgggaggagaccgtacgctcttttacaccctcatcccctgcgatacctgttgttgtcagctccagtctacgccggagcacccaaaaaagccgaaggcgctgcactggcaacaccagcaccatttccttgctgcagtccccatcttgtgctttcacttggcagacgcgcacgagtgtggaggcggcaccgagaagccgacgcgtcactgtccgctctgcgggtgttgtgcaaaggaagcggggagagggtccaggggctgaggcgggtatgccccaggccgcgaggggcaaccgcgacatgttcctctgaccaccaggcctgctgcatcccgaggcccctaccactatgttgcaagtgcccccctcctcctctgctcggacagttttgttccaactccagttccatccggagacgcaccgccccaactgcagctctcccaccacgcgctcgctgctgggcaggcacctgtcgtccgaggaggccttgctag

SEQ ID NO: 22903 - DNA, 1140 bp, Artificial Sequence
  Description of Artificial Sequence: Synthetic coding sequence
atgtccagcgctcctgaaaaacagcagcccccacacggaggaggcggagggggaggcggtggtgggggagccgctatggatcctgccagtagcggcccatccaaggcaaagaagactaacgctggcatccggagacccgagaaacctccctattcctacatcgccctcatagtgatggctattcagagttcacctacaaagagattaaccctctcagaaatataccagttcctgcagagtcggttcccattcttccgcggttcctaccaggggtggaagaattcggtcagacataatttgtccctgaacgaatgctttatcaagctgccgaaaggcctagggcgacccggtaagggacattattggacaatcgacccggcaagtgagtttatgttcgaggagggctccttccgacgaaggccgcgtggatttcggaggaaatgccaggccctgaaaccaatgtactccatgatgaacggattgggtttcaaccacctccccgacacatacggtttccaggggtccgcgggtggcttgagctgccccccaaacagcctagcattagagggtggtctgggaatgatgaatggacaccttccgggaaatgtagatggaatggccctcccctcacactcagtgccacacttaccctcaaacggcggtcatagttacatgggcggatgcgggggtgctgcagctggcgagtaccctcatcatgattcaagcgtgcccgctagccccctgttgcctactggagcaggtggcgtcatggagcctcatgctgtttattccggtagcgccgcagcgtggccaccttcagccagcgccgctctgaactcaggggcaagctatatcaagcaacagcctctctctccgtgtaatcctgccgcaaaccctctgagcggctccttaagtacacattccctggaacagccttacttgcaccagaatagccataacgcccctgcagagttacagggcattcctagataccatagccaatcaccttccatgtgcgacaggaaggaatttgtgtttagcttcaatgctatggccagttcgtctatgcactccgccggagggggtagctattaccaccagcaggtgacataccaggatatcaagccatgcgtgatgtag

SEQ ID NO: 22904 - DNA, 765 bp, Artificial Sequence
  Description of Artificial Sequence: Synthetic coding sequence
cctgccctgccttctacactgccgcacagaccggcaccttctaccagacccggtccgtgcccaaggtgtctgccttccaggatgggcccatgtagcggcagccggctcggacctccggaagccgagagcccctcccagcccccaaagaggaggaaaaaaaggtacctgaggcacgataaaccgccatacacttatctggcaatgatagcgcttgtcattcaagctgctcccagccggaggctgaagttggctcagattattcggcaggtgcaggctgtgttcccctttttccgcgaggactacgaaggctggaaggacagtatccgacacaatctcagttcaaacaggtgcttccgaaaggtgcccaaggaccctgccaagcctcaggctaagggaaatttttgggccgtggatgttagcctcatccccgctgaggccctgcgccttcagaatacggccctgtgccgccgttggcagaatgggggagcaagaggagccttcgctaaggaccttggcccatacgtcctccatgggcgaccatatcggcctccgtctccaccaccaccaccaagtgaggggttctctatcaaatcattgctaggaggctcaggggaaggcgctccttggcctgggctggctccgcaatcctctcccgtgccggcaggcaccggcaattccggcgaggaggccgttcctactccaccgcctccaagtggagggagctgtcctccgccaacatgcctgtcgactctgccaatgtggtag

SEQ ID NO: 22905 - DNA, 1098 bp, Artificial Sequence
  Description of Artificial Sequence: Synthetic coding sequence
atgggcccttgcagcggtagccgcttaggccctcccgaagctgagagcccgtcacagcctcctaagcgcagaaagaaaagatacttgaggcacgacaaacccccatacacctacctggctatgattgccttggtaatacaggccgctccttcaaggagattgaagttggcgcagattattcggcaggtgcaggctgtgtttccattctttcgggaagactatgaggggtggaaagactccatcaggcataatcttagttctaatcgctgcttccggaaggtcccaaaggatccagccaagccacaggccaaaggaaacttctgggcagtggatgtgagtctaattcctgctgaagccctgcggcttcagaacacggctctgtgccggaggtggcagaacgggggagcgcgaggagcattcgccaaggacttgggaccatatgtgcttcatggcaggccatatcgccctccatcccccccaccacctccgtccgaaggcttttcgattaagtctctgcttggcggaagtggcgaaggcgcaccctggcctggattagcaccacaatccagtcccgtgccagccggtacagggaattcaggcgaggaggcagttcccacacccccacttccctcctccgagcgacccttgtggcctctatgtcccctaccgggaccgactcgggtcgaaggagagactgtccaggggggtgcaatagggccatccacactgtctcccgagccacgagcatggcctctgcatcttctgcaaggcaccgcagtcccagggggaagaagctctggaggacatagagccagcctgtggggacagctgccaacatcctacctccctatttacaccccaaacgtggtgatgcccctcgcgccaccccctacttcctgcccacagtgccccagcacgtccccagcctattggggcgtggcacctgaaacaagaggtccccctggcctattatgtgatttggacgccctttttcagggcgtaccaccgaacaaatctatatatgacgtgtgggtgtcccatccaagagacctggcagcaccaggacctgggtggttattaagctggtgctccctttag

SEQ ID NO: 22906 - DNA, 957 bp, Artificial Sequence
  Description of Artificial Sequence: Synthetic coding sequence
atggcgacttattgcgatgatctcggccctagtagcgcgccacctggccaggcccaagcaactgcccacccacctggttatgaacccggtgaccttggggctgtgggtggcggacccctgctatgggtcaacgcccctgccctctcccccaagtcttatgcatccggaccaggaccagcccctccttatgcagcccctagttatggagctccaggacccttgctgggggcaccaggtggcctggctggcgctgacttagcctggctttccctctccgggcaacaggaactgctccgacttgtgagacccccatatagctactcggctctgatcgcaatggcgatccagagtgcaccgttgagaaagctcacactgagccagatctaccaatacgtagccggtaatttccccttctataagcgcagcaaagccggttggcagaattccatcaggcataacttaagtctcaacgactgttttaaaaaagtgcccagagacgaagatgatcccggaaaagggaattactggacgctcgaccccaactgcgagaagatgtttgataacggcaactttcgcaggaagcggaagaggcgtgccgaggcctcagccgctgtaaggtcaggcgcacgaagcgtgggcggagctgaagcccctgccctggaacccccttctgcagcttgtctggatctgcaagcatcaccctccccctctgcccctgaagctgcgacatgtttctccggtttcgcctccgccatgtcggccctggccggaggattaggtaccttccccggaggactcgccggagactttagctttgggcgacgtccgccaaccgtggcaacccacgcacctcagactctcaatccctcacctgggtttgcccctggtcaccagactgccgcagccggttttcggctgagccatctcctgtactcccgggagggcaccgaagtgtag

SEQ ID NO: 22907 - DNA, 1725 bp, Artificial Sequence
  Description of Artificial Sequence: Synthetic coding sequence
atggccagtgatctagagtcctcattaacttcaatagactggttgcctcagctgaccctccgtgccaccattgagaaattgggctctgcttctcaggcagggcctcctggatccagcaggaaatgctcccccggtagccctaccgatcctaacgccaccctctccaaggatgaggcagccgtgcaccaggacgggaagccaaggtacagctacgccactcttattacctatgccatcaacagttctcctgctaagaagatgaccctcagtgagatttatcgatggatctgcgataattttccatattacaaaaacgcaggaatcggttggaaaaacagcatccggcacaacctctccttgaataaatgctttcgaaaagtcccccgtcctagggacgatcccggtaagggcagctactggaccattgatacctgccctgatatctcgcgaaaaagaagacatcctccggacgatgacctgagccaggattcccccgagcaggaggcttctaagagcccacgcggtggagtcgcaggttctggcgaagcttctcttccacctgaagggaaccctcagatgagcctgcagagtccgacgagtatagcatcatacagtcagggaactgggtccgtcgacggcggagcagtcgccgcaggcgcatcgggaagggaaagtgctgaaggccctccccctttatacaacacgaaccatgactttaagtttagctacagcgagatcaactttcaggacctgtcttggtcttttcggaatctctataagtcaatgcttgagaaatcctcatctagcagccaacacggcttttcatcattgctcggcgacattccacccagcaataactactatatgtaccagcagcagcagccacctccaccccagcaacagcagcagcagcagcagcctccccaacctccccctcagcagtcacaaccccagcaacagcaggcccctgcccagggacccagtgccgttggcggagcccctcctcttcatacgccgtccactgacgggtgtactccacccggtgggaaacaggccggtgccgaaggttatggtccaccacctgtgatggctatgcatcccccacccttgcaacatgggggttatcaccctcaccaacaccaccctcatagccacccagctcagcagcctccacctccacagcctcaggcgcagggccaggcccctattaataacactggctttgcctttccttcagactggtgtagcaacatcgattctttgaaggaatctttcaaaatggtgaacagattaaactggtcgtctattgagcaatctcagtttagcgagctcatggaaagccttagacaggctgagcaaaaaaattggaccttggatcagcaccacattgcgaacttatgtgattccctgaatcacttccttacacagacgggacatgtgccacctcaagggggaacgcacagacccccagcccctgccagaatagccgatagttgcgccttaactagcggcaagcaggaatccgctatgagccaggtgaattcgtacgggcaccctcaagcaccacacttataccctggtcctagtccgatgtaccctatccccacgcaggacagtgcaggctacaatagacccgctcaccatatggtccctcggccaagcgtgccccctccaggggctaacgaggaaatccccgacgactttgactgggaccttatcacatag

SEQ ID NO: 22908 - DNA, 1581 bp, Artificial Sequence
  Description of Artificial Sequence: Synthetic coding sequence
atggccagcgatctggaatcaagccttaccagtattgactggttgcctcagctgaccctgagagctactatcgaaaaactgggatccgcaagccaggcagggcctcctggaagttccaggaagtgttcccccggatcccccacagaccctaacgctacgctgtcaaaggacgaagcagccgtgcaccaagatgggaagcctcggtatagctacgcaactctgattacctacgccatcaacagctctcccgctaagaagatgacactgagtgagatatatcgctggatctgcgataatttcccctactacaagaacgcaggaatcggctggaagaactccatccgccataatttgtctctcaataagtgcttcagaaaggtaccgcgaccccgtgacgacccgggaaagggaagctattggactatagacacctgcccagacatcagcagaaagagaagacaccctccggacgacgatctctctcaggattcgcctgagcaggaagcttccaagtccccgcgtggcggtgtcgcgggttctggagaggcatctctccctccggagggaaacccccagatgagtcttcaatctccaacttcaattgcctcttattcgcaggggaccggaagcgtggacggcggagctgtcgccgctggcgctagtgggagagagtccgcggagggacccccacctctgtataacacgaaccacgacttcaaattttcctacagcgaaattaacttccaagatcttagctggtcgttcagaaatctgtacaagtctatgctagagaagtcatcaagctccagccagcacggcttctcctctcttcttggggatattcctccttcaaacaattactatatgtaccagcagcagcaaccaccgcctccccagcagcaacagcaacagcaacagccacctcagccccctccgcagcagagccaaccccagcagcagcaggctcccgctcaaggaccctccgccgtgggtggtgcaccccctctgcacaccccctcaaccgacggctgcacccccccaggcggtaagcaagcgggagctgagggctacgggccacccccagtgatggcaatgcaccccccaccactccagcacggagggtaccaccctcaccagcatcacccgcattcccacccagcacagcagcccccacctccacagccgcaggcccagggccaagccccaatcaacaatactggtttcgcctttcccagcgattggtgcagcaatattgatagcctcaaggagtccttcaaaatggtgaaccgcttaaattggtctagcattgaacagtcacagttctccgagctcatggaatccctccggcaagccgagcagaaaaactggacgctcgatcagcaccacatcgctaatctctgtgattccctgaatcatttcttaacacagaccggccacgtacctcctcaaggtggaactcaccgacctcccgcacctgccaggatcgccgactcttgtgccctgacctcgggaaaacaagaaagcgcaatgtctcagggcaccgctcctagccagctcccgtggcgatggcgcctctgctag

SEQ ID NO: 22909 - DNA, 1869 bp, Artificial Sequence
  Description of Artificial Sequence: Synthetic coding sequence
atgggattatatggtcaggcttgcccctctgtaacttccctccgcatgactagtgagctggagtcctccctgaccagcatggactggttgccccagttgaccatgcgagctgcaattcagaagagtgacgcaacacagaacgcccacggtactggcatttctaagaaaaacgccctcctggaccccaatacaactctggaccaagaggaggttcagcagcataaagatggcaagccaccgtatagctacgccagtttaatcactttcgctattaactcctccccaaagaaaaagatgaccctctctgaaatataccaatggatttgcgacaactttccgtactatagggaggccggatctgggtggaagaattctattcgtcacaatctttctttaaataagtgttttttaaaggtccctcgctctaaggatgaccctggtaaaggatcctactgggccatcgatacgaaccccaaggaagacgtcctccccacacggccaaagaagcgcgcaagaagtgtagaacgggcatctacgccatactcaatagatagcgattctcttgggatggagtgtatcatcagcgggagtgctagccccacgctggcgattaacaccgttactaacaaagttacgctgtacaatactgaccaggacggctctgattctccaaggagttcacttaacaattcactgtccgaccagagccttgcttctgtgaacctgaatagtgtaggctccgtacacagctacacacccgtgacgtcccaccccgagtctgtgtcccaatccctgacgcctcaacagcagccacagtataatctccccgaacgagacaagcaactgctgttctccgagtataactttgaagacctgtcagcctcttttaggtccttgtacaagtctgtatttgaacagtctctttcccagcaaggcttgatgaacattccttcagagagctcgcaacagtctcatacaagctgcacatatcagcactccccttccagtaccgtttcaactcacccacatagcaatcagtcttctctgtctaattctcacggctcaggactgaacactacaggtagcaattctgtagcgcaggtgagcctgagtcatcctcagatgcatacccaaccctcaccccatcccccacaccggccacatggcttgccccagcacccccagcgcagtccccacccagctccacacccacaacaacatagccaactgcagtcaccgcacccgcaacacccatccccacatcagcatatccagcaccacccaaatcatcagcaccagaccctgactcatcaagctcccccaccccctcagcaagtgtcatgtaattccggagtttctaacgactggtacgctacactggacatgctcaaggaatcctgccgcatcgcaagttcagtaaattggtctgatgtcgatctaagccagtttcagggccttatggaaagcatgcgacaggcggatctgaagaactggagcctcgaccaggtacagtttgccgacctttgctccagcctaaaccagtttttcacacagacaggactgattcacagtcagtctaatgttcaacagaacgtttgccatggtgctatgcaccccacaaaaccaagtcaacatatcggcacaggtaatctctatattgactctagacaaaacttgcccccaagtgtgatgcctcccccaggctacccacatataccgcaggccctgtccacacccggaactaccatggctgggcatcatagggccatgaatcagcagcacatgatgccaagtcaggctttccagatgagaagaagtctccctcccgacgatatccaggacgacttcgactgggattcaatcgtgtag

SEQ ID NO: 22910 - DNA, 1767 bp, Artificial Sequence
  Description of Artificial Sequence: Synthetic coding sequence
atggggctgtacggccaagcctgcccgtccgtgacgtcacttaggatgacgtctgaactcgagtcatccttaaccagtatggattggctcccacaactcaccatgcgggcagccatccagaagagcgacgccactcagaacgctcatggcacagggatatccaagaagaatgctcttttagaccccaataccactcttgatcaggaagaagtgcagcaacataaggatgggaaacctccatatagctacgcttcattgataaccttcgccattaattcctcccctaaaaagaagatgaccctttcagagatctaccaatggatctgcgataacttcccctattaccgggaagccggatctggatggaaaaactccattcggcacaacctttctctgaacaagtgctttcttaaggtacccagatccaaggacgaccccggtaagggaagctattgggcgatagatacaaaccctaaggaggacgtccttccaacacggcctaagaaacgggctcgaagtgtcgagagagtgacactgtacaataccgaccaggacggaagcgattcccccagatcctcactgaataattcactgtccgaccaaagcctcgcgtctgttaacctcaacagcgtgggatccgtgcattcttacacccctgtaactagccaccccgagagtgttagccagtctctgaccccccaacagcagccacaatataacttgcctgagagagataaacagctacttttctcagagtacaactttgaggacttatcggcctcattcaggagtctctacaaaagtgtctttgagcaatccctgtcccagcaaggcctgatgaacatcccgtctgagtccagtcagcagtcccacacatcatgcacataccagcacagtccctcatccacagtgtcgacacacccacactctaaccagtcttcgctgtcaaatagccatgggagcggactgaacacaactggttctaattctgtggcgcaggtatcattatcgcacccacagatgcatactcagccctctccccacccaccgcatcgacctcacggtctgccgcaacacccacagagaagtccccacccagcccctcacccccaacaacacagtcaactccagtcacctcacccgcagcatccatccccccatcaacatatccagcaccaccctaatcaccagcaccagaccctgacccatcaagctccacccccaccccagcaggtgtcttgtaattcgggggtgtccaacgactggtatgccacactggatatgttgaaggagtcttgcaggatcgcctcaagcgtaaattggtccgacgtggatttgagtcaattccagggcctgatggagtctatgcgtcaggcggacctgaagaattggtctctcgaccaggtccaattcgctgacctgtgcagttctctaaatcagttcttcacgcagaccggactgatccacagccagagtaatgtccagcagaacgtgtgccacggagccatgcacccaaccaagccgtctcaacatatagggacgggtaatttgtacatcgatagtaggcagaacttgccgccttccgtgatgcccccaccaggctatccccacatacctcaagccctctccacgcccggaacaacaatggccggacatcacagggccatgaaccagcagcatatgatgccgtctcaagctttccaaatgcgtagatccctccctccggatgatatacaggacgacttcgattgggacagcattgtgtag

SEQ ID NO: 22911 - DNA, 411 bp, Artificial Sequence
  Description of Artificial Sequence: Synthetic coding sequence
atggaaagcatgcggcaagccgacttaaaaaactggagcttggatcaagtgcagtttgctgatctgtgctccagcctgaaccagttctttacccagacaggattgatccacagtcagagtaacgtgcagcaaaacgtgtgccacggggctatgcatccgactaaaccgtcacagcacataggcaccggtaatctctacatcgactcacgacagaacctgcctcccagcgtgatgcctccaccaggatacccacatatcccccaagccctgtccacaccagggacgaccatggccggacaccaccgcgctatgaatcagcagcacatgatgccatctcaggccttccagatgcgaaggtccctaccaccggacgacatccaggatgactttgactgggacagtatcgtgtag

SEQ ID NO: 22912 - DNA, 1869 bp, Artificial Sequence
  Description of Artificial Sequence: Synthetic coding sequence
atgggcctttacgggcaagcctgtccaagtgtaacatccctgcgtatgacctccgagctcgagtcttccctcacgtctatggactggctcccgcagctgacaatgcgggctgctattcagaagtcggatgcaactcagaatgcacacggcaccggtatcagcaagaagaatgccctgcttgatcccaataccactttggaccaggaggaggtccagcaacacaaggacggaaagccaccctattcttacgcttccctcattacttttgcaataaattcttcacccaagaagaagatgactctgtcagagatctatcaatggatctgcgataacttcccttattaccgagaggccggatccggctggaaaaattctatccggcataacttgtccctgaacaaatgtttcctgaaggtacctcggtcaaaggacgacccagggaagggcagttactgggccattgatacgaatccaaaggaggacgttctacccacgaggcctaagaagagagcacggagtgttgagcgcgcaagcaccccatattcgattgattcagattcgctgggcatggagtgcatcattagtggtagcgcttcaccaaccctggcgattaacactgtcaccaataaagtgacactctataacacagatcaagacggctcagacagtccacgaagtagcctcaacaactccttgtctgaccagagtctcgcgagtgtaaacctgaactcagtgggcagcgtccactcctatacgccagtgacgtctcaccccgaaagcgtatcccagagtctgaccccccaacagcagccacaatacaacctgcctgagcgtgacaagcaactgctattttctgagtacaattttgaagatttgagcgccagcttcagaagcctctataaatcagtcttcgagcagagtctgagtcagcagggtctgatgaacatcccatcagagtctagtcagcagtctcatacaagctgcacttatcagcatagcccatcaagcaccgtatccacccacccccactcaaaccagagctcgcttagcaactcccatggctcaggcctgaacacaactggatcaaacagcgtggcccaagtctccctatcccatccgcagatgcacactcaaccttccccccatccccctcatcggcctcatggcctcccccagcacccacagcggtccccgcatcctgcaccccaccctcaacagcatagtcagctgcagtcaccgcatccgcagcatccctctccacatcaacacattcaacaccacccaaaccatcagcaccagacgcttacccaccaggcccctccacctccacagcaggtgagttgcaactccggggtcagcaacgattggtacgctacactggatatgctaaaggaatcgtgcaggattgcctcaagcgtgaactggtccgatgtcgatctgtcccagtttcagggccttatggagtccatgcggcaggctgatctgaaaaattggtccttggatcaggtgcaatttgccgatctttgctcatccctaaatcagttctttacccagactggcctgatccatagtcagtccaacgtccaacagaacgtgtgtcacggtgcgatgcatcccaccaaacccagccagcacatcggaaccgggaacctttatatcgattctcgccagaatctgccaccatccgtgatgcccccacccggatacccccatattcctcaagccttatccaccccgggtactacgatggctgggcaccacagggctatgaaccagcaacacatgatgcctagccaagctttccagatgagaaggtccctgcctcctgacgatatccaggatgactttgactgggatagcattgtgtag

SEQ ID NO: 22913 - DNA, 1869 bp, Artificial Sequence
  Description of Artificial Sequence: Synthetic coding sequence
atgggcctgtacggacaggcttgcccctccgtcacgtccctacggatgacgagtgaactggagagtagtttaacaagcatggactggctgccgcagctaaccatgcgagccgcaatccaaaaaagcgatgccacacaaaacgcacacggtactggaattagtaaaaagaacgctctgctggatccaaatactaccctggatcaggaggaggtccagcagcacaaggacggcaagccaccttacagttacgcttcccttattacatttgcaattaactccagtccaaagaagaagatgaccctgtccgagatctaccagtggatttgtgataattttccctactaccgcgaagccggttccggttggaagaacagcattaggcataacctgtcacttaataagtgcttccttaaagtgcccagaagcaaggacgatcccggaaaaggctcatactgggctatcgatacaaaccccaaggaagatgtgctgcctactaggcctaagaaaagggctcgctccgtggaaagggcttcgaccccatacagcattgactcagacagcctgggcatggaatgcatcattagcggatctgcatccccaactctggctatcaacacagtaaccaacaaggtcacactctacaacaccgaccaggacggctccgactcaccgagatccagcctcaataacagtctctcagatcagagtctcgcatccgtgaatctgaactctgtcggcagcgttcactcctatactccagtgactagtcaccccgagagcgtgagtcaatccctgacgccacagcagcaaccgcagtataatctaccagagagagacaaacaactgctcttctccgaatacaatttcgaggacctcagcgcatctttcagatcactatataagagtgtgtttgaacagtctctgtctcagcaaggacttatgaacatccctagtgagtcaagtcagcaaagtcataccagctgcacctatcaacatagcccctcctccacagtcagtacccatcctcacagtaaccagagctccttgtctaatagtcacggaagcggtctcaacaccaccgggtcgaatagcgttgcccaagtgtccctcagtcatcctcagatgcacactcagccatcaccccatccccctcaccgaccccatggcttgcctcagcacccccagagatcccctcacccagccccacatccccagcagcacagccaactgcagtcccctcatccacagcatccatctcctcaccagcatatccaacatcaccctaaccaccagcaccagacacttacacaccaagctcccccaccacctcagcaggtttcctgcaatagcggtgtttccaatgactggtacgccacacttgatatgctcaaggaatcttgcaggattgccagtagtgtaaattggtccgacgtggacctgtcccagttccagggcctcatggaatctatgcggcaagccgatctgaagaactggtcactggaccaagtgcaatttgccgacttgtgtagcagcttgaaccaatttttcacccagactggcctgatccactcacagtcaaatgtgcaacagaacgtatgccacggcgctatgcatccaaccaaaccctctcagcatataggaaccggcaatttatatatcgattctcggcagaacctcccacctagtgtgatgccccctccgggatatcctcacatccctcaggcgctgtcaactcccggaacaaccatggccggacaccaccgagctatgaaccagcaacacatgatgccttctcaagctttccaaatgcggaggagtctgcctccagacgacatccaggacgacttcgactgggactccatagtctag

SEQ ID NO: 22914 - DNA, 264 bp, Artificial Sequence
  Description of Artificial Sequence: Synthetic coding sequence
atggagtgtattatcagcggctctgcttcacctaccctggctattaacaccgtaaccaacaaggttaccctttacaatacagaccaggacggcagcgatagtccaaggtcaagccttaataatagcctttcagatcaaagcctggcttcagtgaacctgaactcagtggggtcggtgcactcctatacgccagtcacatctcatccagaaagtgttagccagagtctgactccccagcagcaacctcaatataatctgccttag

SEQ ID NO: 22915 - DNA, 1149 bp, Artificial Sequence
  Description of Artificial Sequence: Synthetic coding sequence
atgggcttgtacggtcaagcttgcccttcggtgacgtcacttcgtatgaccagcgagttggagagttcactcacttccatggattggctcccacagctgacaatgcgggcagcaattcagaagtccgacgcgacacagaacgcacatggcacaggtataagtaagaagaacgccctgctagatcccaacactacgctggatcaagaggaggttcaacagcacaaggatggaaaaccgccttacagctatgccagcctcattactttcgcgatcaacagcagtccaaagaagaaaatgactctgtcagagatttatcagtggatttgcgacaattttccatactaccgggaggcaggcagtggctggaagaatagcatcaggcacaacctgagtctgaataaatgtttcctgaaggtacccaggtcaaaggacgaccccggaaaaggtagctactgggccattgataccaatccgaaggaagatgtactcccgacccgaccaaagaagcgcgctcgttctgtcgagagggtgacactgtataatactgaccaggacggatcggactcaccccgaagtagcctgaataacagcctcagtgaccagtcccttgccagtgtgaacctgaatagcgttgggtccgtccacagttatactccggtcacctcccaccccgagagtgtgagccagtctctgaccccccagcagcagccacagtacaacctgcccgaaagagataaacagctcctgttcagcgagtacaatttcgaggacttaagcgcaagcttcaggagtctgtataaatcagtgttcgagcaatccctatcccaacagggtctcatgaacattccctcggaatctagccagcagtcccacaccagctgcacataccagcactctccaagtagcaccgtaagcacacatcctcattcaaatcagagttctttgagtaacagccatggaagcggcctgaatactacaggaagtaacagcgtcgctcaggtctccctgagccacccccagatgcatacacagcctagcccccaccctccgcaccggcctcatggactcccacagcatcctcagcgctctccacaccctgcgcctcatcctcagcagcatagccaacttcagagtccccatccacagtag

SEQ ID NO: 22916 - DNA, 378 bp, Artificial Sequence
  Description of Artificial Sequence: Synthetic coding sequence
gctactcagaatgcccatggtaccggcatatctaaaaaaaacgctttgctggatccaaacaccactcttgatcaagaagaagtgcagcagcacaaagatggcaagcctccttacagctatgctagccttatcacctttgccataaattcctctccgaaaaaaaaaatgaccttatctgagatttatcagtggatttgcgataactttccctactacagggaggcgggtagtggatggaagaattcaattagacataatctgagcctgaataagtgcttcctgaaagttcccaggtctaaagatgaccctgggaaagtgggtttcattttccttaaacagcttaactcttctgtgtgtcacttaagctgtctgaattag

SEQ ID NO: 22917 - DNA, 1869 bp, Artificial Sequence
  Description of Artificial Sequence: Synthetic coding sequence
atgggtctgtacggccaagcttgcccaagcgtaactagcctgagaatgacttcagagctcgagtcttcactcaccagtatggattggctgccccagcttacaatgagggccgctatccagaaatcggacgcgactcagaacgcacacggcactgggatcagtaagaaaaacgccctgctggatccaaacacaactctcgaccaagaagaggtgcagcagcacaaagacggaaaaccgccatactcctacgcgtccctgatcacatttgcgataaactcatcaccaaagaaaaaaatgacactgagtgaaatctaccagtggatctgtgataattttccctactatagggaggctggatccggctggaaaaacagcatccgacataacctaagcttgaacaagtgcttcctgaaggttcctcgcagcaaggacgaccccggaaagggctcatattgggccatcgacaccaatcccaaggaggacgtactacccacaagacccaagaaaagggctagaagtgtcgagcgcgcaagtaccccttatagtatagacagtgattcgctcggtatggagtgtattatttcaggctcagcctcccctaccctggctatcaataccgtcaccaataaagtaaccctatataacacagatcaagacggcagtgacagtcccaggagctctttgaataatagtctctccgaccagtcgttggccagcgtgaatctgaactcagttggtagcgtccactcctacacaccagtaacatcccacccggagagcgtgagccagtcactaacacctcagcagcagccccagtataaccttccggaaagggataagcaactgttattctctgaatataattttgaagacctgtctgcatctttccgcagcttatataaaagtgtgtttgaacaaagtctgagccagcagggcctcatgaacatccctagcgaatcatcacagcaatctcacacgtcctgtacctatcaacactcaccctccagtactgtcagcacacatccgcactcgaatcaaagcagcctctctaacagtcacggatcagggctcaacaccaccggctctaactccgtggcccaggtcagtctgagccaccctcaaatgcacactcaaccaagcccccaccctccccacaggccgcacggattgccccagcacccgcaaagaagccctcatccagcccctcaccctcaacagcacagtcagctccaatcacctcacccacagcaccctagtccccaccaacatatccagcaccacccaaaccaccagcaccagaccttaactcatcaagcccctcctccaccccaacaggtctcatgcaattctggagtgagcaacgattggtatgcgacactggacatgctcaaggagtcctgtcggattgcctcatccgtgaactggtccgacgttgatttatctcagtttcaggggctgatggagagtatgaggcaggccgaccttaaaaactggagtttggaccaagttcagttcgccgacctctgctctagcctgaaccagttcttcactcaaaccggcttaatacatagtcagtccaacgtgcaacagaacgtgtgtcacggcgcaatgcacccaacaaaacccagccagcacatcggcacaggcaacctgtatattgacagcaggcagaatctccctccgtcggtaatgccacctcccggatacccacatatccctcaggctctttccacaccaggcacaacgatggcaggacatcatagggccatgaaccagcagcacatgatgccctctcaggctttccagatgcggcgtagcctgccacccgacgacatacaggatgacttcgactgggatagtattgtgtag

SEQ ID NO: 22918 - DNA, 1023 bp, Artificial Sequence
  Description of Artificial Sequence: Synthetic coding sequence
atgatgtgccaccccctggaccagctggcaactcggactcagaaaaaaagtgcaaccagcaagccgccttatagtttcagcttgttaatttacatggcaatcgaacactcccctaataagtgcttgcctgttaaagaaatttactcctggatcctggatcattttccttacttcgccacagctcctactggatggaagaattctgtcaggcacaacctgtccttgaataagtgcttccagaaggtggagaggagccacgggaaagtgaacggcaaaggttccctttggtgtgtagatcctgaatacaaaccgaatctgatccaagctcttaaaaagcaacccttctcctccgcatcctcacagaatgggtccctctctccccactacctttccagtgtgatcaagcagaatcaagtgagaaacctcaaggagtctgatattgacgctgctgccgctatgatgctgctgaacacctccatcgagcaggggattctcgaatgtgaaaaacccttgcccttaaaaaccgccctgcagaaaaagagatcctatggaaatgcctttcatcatccgagcgctgtccgccttcaggaaagcgacagtctggctactagtatcgatcccaaggaggaccataactactctgcatcctccatggctgcccagcggtgcgcatctcgcagctccgtgtcatcattaagctccgtggacgaggtgtatgaattcataccaaaaaatagccacgtcggatccgacggctccgagggattccattccgaagaagacacggatgtcgactacgaggacgacccactcggagacagcggctacgcctctcagccctgcgcaaagattagtgagaaagggcagtctggaaaaaagatgcggaagcaaacatgtcaggaaatcgatgaagagcttaaagaggctgcaggcagtctgcttcacctggccggaatccgcacttgtctcggctctctaatctccacagcaaaaactcagaatcaaaagcagaggaagaagtag

SEQ ID NO: 22919 - DNA, 1296 bp, Artificial Sequence
  Description of Artificial Sequence: Synthetic coding sequence
atgggacccgtgatcgggatgactcctgataagcgagcggaaactcctggagccgaaaaaatagcaggcctgagccagatttataagatgggaagtttgccagaggctgtagacgctgccagaccaaaggcgactctagtagacagcgaatcagcggatgatgaactcaccaatctgaactggctgcatgagagcaccaacctgctcactaacttctcactcgggagtgagggactgcccatagtgtcgcccctgtacgatatagagggcgatgatgtgccgtcattcggccctgcctgctaccaaaatccagagaagaaaagtgccacttcaaagcccccatattccttcagcctgctgatatacatggcaatcgaacattcacctaataagtgcctccctgtgaaggaaatctactcgtggatattggatcacttcccttacttcgccaccgctcctaccggctggaagaactcagtgagacacaatctcagtcttaacaagtgtttccaaaaggtagagcgatctcacggcaaggtcaacggcaaggggagcctgtggtgtgtggaccccgagtacaagccaaacctgattcaagccttgaaaaagcagcctttctctagcgcttcatcccagaacgggagcctttcaccgcactacttaagcagtgtaattaagcagaaccaagtgcgcaacctcaaggagagcgatattgacgctgccgctgctatgatgctgcttaatacctccattgagcaaggcatcctggaatgtgaaaagccattaccgctgaagaccgcgcttcagaaaaagcgcagctacgggaatgcgttccatcatccctccgctgttagactgcaggaaagtgactctctcgcaacatctatcgatccgaaggaggaccataactactcagcctcatccatggccgctcaaaggtgcgcgtctcgctcaagcgtaagtagtctgtcctcagtggacgaggtctacgagttcatccccaaaaactcccacgtcggatccgacggcagtgaggggttccactcggaggaagacactgatgtggattacgaagatgatcctcttggagacagtggttacgccagtcagccttgcgctaaaatcagtgagaaaggccagagcggcaaaaaaatgaggaaacaaacctgccaagaaattgacgaggaactcaaggaggccgctgggtcccttttacatttggctgggatccgcacatgcctcggctcactgatctcaacagcaaagacacagaatcaaaaacagcggaaaaagtag

SEQ ID NO: 22920 - DNA, 741 bp, Artificial Sequence
  Description of Artificial Sequence: Synthetic coding sequence
atggggcctgtcatcggaatgactcctgacaagcgcgctgagacacccggtgccgaaaagattgcaggtttaagccaaatctacaaaatgggcagtctccctgaggctgttgacgcggcaaggcccaaggccacattagtggatagcgaaagtgcagacgacgagttaacgaacctcaattggctgcatgagagtaccaacttactcacgaatttcagccttggcagtgagggtctgcctattgtgtctcctttgtatgacatagagggcgacgatgtcccgtcttttgggcctgcatgctaccaaaaccccgagaagaagagtgccacctctaaacctccatacagtttttctcttctgatttacatggccattgaacattccccgaacaaatgcctgcctgtaaaggagatatattcgtggattctagatcacttcccttacttcgcgaccgcgccaacaggctggaagaactctgtgcgtcacaatctctcccttaataagtgcttccagaaggtggagcggtcccacgggaaggtaaatggaaaggggtcactctggtgcgtggaccctgaatacaaaccaaaccttattcaggccctgaaaaagcagccctttagctctgcctctagtcagaacggaagtctgtctccgcactacctgagctctgttatcaagcagaatcaggtgcgaaacctcaaagagtctgatattgacgccgctgccgcaatgatgctgtag

SEQ ID NO: 22921 - DNA, 879 bp, Artificial Sequence
  Description of Artificial Sequence: Synthetic coding sequence
atggggaacgaactcttccttgcatttaccacctcacacctgccgctggcagagcagaagttggctcgatacaagctccgcattgtcaaaccaccaaagttgcctctggagaagaaacccaaccccgataaggacgggcctgactatgagccaaatttgtggatgtgggtgaatccaaacatcgtgtaccctccaggaaagctggaagtgagtggtaggcgtaagagagaagatctaactagcacgttaccaagcagccagcccccacaaaaagaggaagacgccagctgcagcgaggcagcaggtgtggagagcctgtcccaaagttcctccaagcggtcccctcccaggaaaaggtttgccttttccccctctacttgggaacttacggaagaggaggaggccgaggaccaggaggactctagctctatggctctgccttccccccacaaacgggctcctcttcagtcccgacgcttgcggcaagcttcatctcaagcaggtcgactttggtctcgacctcccctcaattactttcatctgatagccttggcccttaggaatagctcaccctgcgggttgaacgtgcagcaaatttactcttttacccgtaaacacttccctttcttcaggactgctcctgagggatggaaaaataccgtgcgtcacaatttatgctttcgagattcctttgagaaggtgcccgtgtcaatgcaaggaggcgcatcaacccgaccgcgtagttgtctttggaaactgaccgaagagggtcacagacggttcgccgaagaagcccgagcactcgcctctacccgcctcgagtcaatccagcagtgtatgtctcagccagacgttatgccgtttcttttcgatctgtag

SEQ ID NO: 22922 - DNA, 936 bp, Artificial Sequence
  Description of Artificial Sequence: Synthetic coding sequence
atggacctgaaattaaaggattgcgagttctggtactcgctgcacggccaggtgcctgggttgctcgactgggatatgaggaacgagctgttcttgccgtgtacgacggaccaatgcagcctggcagaacagattttggctaagtacagggtcggcgtcatgaagccacccgagatgccacagaagcgtagaccatctcctgatggagatggcccaccatgcgagccaaacttatggatgtgggtcgaccccaacatcctttgccctctcggtagccaagaagcacccaaaccatctggaaaagaggatctgacgaacattagccctttcccgcagcccccacaaaaggatgaaggatccaactgcagtgaagacaaagtagttgagtccctgcctagttcctcgtctgagcagtcacccttgcagaagcaaggcattcacagtccatctgatttcgagttaaccgaagaagaggccgaggaacctgacgacaacagcttgcaatcacccgagatgaaatgctatcaaagtcagaaactgtggcagatcaacaaccaggaaaaatcttggcagaggccaccactgaattgttcccatttgatcgccctggctttaagaaacaacccgcattgtggattgtcagtccaggagatttacaatttcacgcgccagcattttccctttttctggacagcccctgacggttggaaatccaccatccactacaacttgtgttttctcgatagttttgagaaggtgcccgattcactgaaagatgaggacaatgctcgtccccgtagctgcctgtggaagctcacaaaggagggtcacaggcgcttttgggaagagactagggtgctcgctttcgcacaaagagagcgcattcaggaatgcatgtcacagcctgaactattaacctctctgtttgatctgtag

SEQ ID NO: 22923 - DNA, 993 bp, Artificial Sequence
  Description of Artificial Sequence: Synthetic coding sequence
atgcagcaacagccgcttccaggaccgggagccccaacaactgaacctaccaagccgccttacagctacatcgctctgattgctatggccattcaatccagccccggacagagggccaccctcagtggaatttaccgatacattatgggccgattcgcgttctatagacataaccggcctggctggcaaaactccattcggcacaatctgagcctgaatgaatgcttcgttaaagtcccacgggacgatcgtaaaccagggaaaggcagctattggactctggatccagattgtcacgacatgttcgagcacggctcatttctccgccgacgtcgcagattcactagacaaactggcgcagaaggaacccggggaccagcaaaagcgcgacggggacccctcagggccactagtcaagatcctggggtgccaaacgcaactaccggtaggcagtgttctttccctcccgaattacctgaccctaaaggcttaagtttcggtgggctcgtcggagctatgccagcctctatgtgtcctgcaactaccgacgggaggccgcgaccacccatggaaccgaaagaaatcagtacgcctaagccagcctgtcccggtgaacttcccgttgctaccagctccagcagttgtcccgcttttggttttcctgctggtttttccgaggcagaatcattcaataaggccccaactccagttctgtcgccggaatccggaatcgggagcagctaccagtgcaggttgcaggccctgaacttctgcatgggggctgatcctggtctcgagcacctgctggcttctgccgcaccatcccctgccccaccgactcccccaggaagtcttcgtgctccccttccactccctaccgaccataaagagccttgggttgcaggtggtttccccgtccaggggggtagtggatacccactgggacttacgccctgcctgtacaggacgcccggaatgttcttctttgaatag

SEQ ID NO: 22924 - DNA, 957 bp, Artificial Sequence
  Description of Artificial Sequence: Synthetic coding sequence
atgaatcggtttgggacgcgcctggtgggagcgaccgccacgtcatcgccgcctccaaaggccagaagtaacgaaaatctggacaagattgatatgagtctcgacgatatcatcaagctgaataggaaagaggggaagaagcagaacttcccaagacttaaccgtcgcctgttgcagcaaagcggagcccagcagtttcggatgagagtccggtgggggatacagcagaactcggggtttggaaagacctctcttaaccgcaggggcagggtgatgcccggaaagcggcgtcccaatggggtcattacaggcttggcggctaggaagacaacagggatcaggaaggggatatcccctatgaaccgtccaccgctgtcagacaagaacatcgaacagtactttccagtgcttaagcgaaaggctaatctgttgcgacagaatgagggtcagagaaaacccgtggccgttctgaaacgtccttcacagttgagcagaaaaaacaacatccctgccaatttcacacgctccggaaataaactgaatcaccagaaggacacccgccaggcgactttcttattcaggagaggacttaaagtgcaagcccaactgaacaccgagcagcttctggacgacgtggtcgctaagagaacgcggcaatggaggacgtccaccacaaatggtggaattctgacggtgtctatagacaatcccggagccgtacagtgcccagtgacgcaaaaaccacgcctgacccgtacggcggtgcccagctttctgactaaaagggagcagagcgacgtcaagaaggttcccaagggcgtgccgctgcagtttgatattaacagtgtcggtaagcagacaggtatgacactgaatgagcgctttgggatcttgaaggagcagcgtgctaccctgacctacaataagggaggctcccgctttgtcacagtcggctag

SEQ ID NO: 22925 - DNA, 684 bp, Artificial Sequence
  Description of Artificial Sequence: Synthetic coding sequence
atgccgggtaaaagacgtcccaacggagtaataacaggactcgcagcacggaaaactacagggattagaaagggaatcagtccaatgaatcgccctcccctatccgacaagaacatcgaacagtacttccccgttctgaaaagaaaagctaatcttcttaggcagaatgagggccagcgtaagcccgtggcagtgctcaagcgaccctcccaactgtcccggaagaataacatcccggctaactttactaggtccggcaacaaactaaatcaccagaaggatactcgtcaagccacttttttgtttcgcaggggcctcaaagtgcaggcacaactaaataccgagcagctattggacgacgttgtagcaaagagaactcggcagtggagaacgagtactacaaacggaggcatactcaccgtgtcaatcgacaatcccggtgcggtccagtgtccagtcacacagaaacctagactaacccgtacagctgtgcctagcttcctgacgaagcgagagcagagtgacgtgaaaaaggtgccgaagggcgtgcctcttcaatttgacattaactcagtggggaagcagacaggaatgaccctgaacgagagattcgggattctcaaagagcagagggcgaccctgacgtacaacaaagggggtagcaggtttgtgactgtgggctag

SEQ ID NO: 22926 - DNA, 879 bp, Artificial Sequence
  Description of Artificial Sequence: Synthetic coding sequence
atggaaccgagtgtgatcatgggtaatgatatcattaagcttaatcgcaaagaaggtaagaagcaaaactttccacgactgaaccgccgtctgctgcagcagagcggagcccaacagtttcgcatgcgagttcgttggggtatccagcaaaattctgggttcgggaagaccagcctgaaccggagagggagagtcatgcctggtaagcggcgtccaaatggagtgattactggccttgccgcacgcaagaccaccggcattcggaagggcatttctccaatgaacagacctccattgtccgataagaacattgagcaatacttccccgttttaaaaagaaaagccaatctccttagacagaatgagggacagagaaaacccgtagcagtgctcaagagacctagccaattaagtcggaagaacaacatcccagccaattttaccagaagcggtaacaaactcaaccaccagaaggataccagacaggcaacattcctgttcagacggggtctcaaggtgcaggcccagctgaacacggaacagctcctggacgacgtggtggctaaaagaacacgccagtggcggacaagtaccaccaacgggggtattctgaccgtgagtatcgataaccccggagccgtgcagtgccccgttacccaaaagccgaggctcacaagaaccgctgttccatctttcctcacaaaaagagagcaaagcgacgtgaagaaggtccccaagggtgttcccctgcagttcgacattaactccgtcggcaagcagactggaatgacgctgaacgagcggttcggcatcttaaaggagcaacgagctaccctgacttacaacaagggcggttccaggttcgtgacggtggggtag

SEQ ID NO: 22927 - DNA, 837 bp, Artificial Sequence
  Description of Artificial Sequence: Synthetic coding sequence
atgggaaaggggaatgaagaccccgatctgcactgctcttctattcaatgttccaccgatcaacccccttttcagcaaatctctttcaccgaaaagggtagcgacgagaaaaagcctttcaaggaaaaaggtaagactgcgttttcacattcatccgagaaacatatccaacgccaggggtctgagccgaaccccaataaggaaaattccgaagagaccaaacttaaagcaggcaacagtaccgccggtagtgagccagagtcatccagctaccgcgagaactgtagaaagcggaaaatgagctcgaaagacagttgccaggacacagccggaaactgtccagagaaggaatgtagcttatcactgaataagaagtccagaagcagcacaccagtgcataatagcgaaattcaggagacctgtgacgcacaccatcggggacgcagccgcgcatgcaccggacggtccaagagacaccgctcccgcgctctcggcgttcaaactccgagtatcagaaaatctttggttaccagtgtacgggctatgtcggaagcagtttatcaagacctggcccaagtctgggctcagcaaatccattctcctcttacttgcgagcagttaaccctccttacaagactgcgaggcccattgtgcgcacaggtgcagacgttatacagcatggcaactcaggcggcatatgtttttcctgccgagagttggcttgtcccggcaaccctgcccggacctggcgaaagtgcgttggacagagaggcgcatccttttcctgggcaggagatcaccgagaccgtaagtgggtccgatgaggcaaagctgtag

SEQ ID NO: 22928 - DNA, 840 bp, Artificial Sequence
  Description of Artificial Sequence: Synthetic coding sequence
atgggtaaggggaacgaagacccagacctgcactgcagttctattcaatgttccacagatcagcccccatttcaacaaatatcctttactgagaagggatccgacgaaaagaagcccttcaaggaaaagggtaaaactgctttttcccactctagcgagaaacacattcaacggcaggctggatcggaacccaacccaaacaaagagaattctgaggagaccaagctcaaggccggaaacagtactgccggttccgagcccgagagctccagctatagagagaactgccgtaagagaaaaatgtcatccaaggacagctgccaagacactgcaggcaattgtccggaaaaggagtgtagcctgtcgcttaataagaaaagcagatcatcaactcctgtacacaacagcgaaattcaggagacatgtgacgcacaccaccggggacgttcccgtgcttgtactgggagatccaaacgtcatcggtctagggccctgggcgtccagactccgtccatccgtaaatccctggttacgagtgttagggccatgtctgaagctgtatatcaggatttagcacaggtctgggcccagcagatccactctcctctcacgtgtgagcagctgaccctgctaacccgcctccgcggacccttgtgcgctcaggtccagacactttattccatggctacgcaggcggcttacgtgtttcctgcagagtcctggcttgtccctgcaaccctgccagggccaggagaatcagcactggacagagaagcccacccttttcctggccaggaaatcacagagactgtgtcgggcagcgatgaagctaaactttag

SEQ ID NO: 22929 - DNA, 2544 bp, Artificial Sequence
  Description of Artificial Sequence: Synthetic coding sequence
atgggaaaaaagggaaaagtcggaaaaagcaggcgggataaattttaccatctggctaaagaaacgggatataggtcaagaagcgccttcaagttaatccagcttaatcgcaggtttcagttcctgcagaaggcccgagctctgctcgacctatgtgccgcacctggcggatggctgcaggtggccgcaaagttcatgccggtctcctcactgattgtgggtgtagacctagtccctatcaagcctctgcccaatgttgtaacactccagcaagacattacaaccgaacggtgccgacaggctctgagaaaagaactcaagacttggaaggtggacgtggtgctcaatgacggagccccaaatgtcggagcgagctgggtacacgacgcatattcccaagctcacttaactctgatggctttgagactagcttgcgactttctggctcgcggtggaagcttcattaccaaagtgtttcgctcccgagattatcagcctctgttgtggatcttccagcagctgtttcgacgggttcaggcgacaaagcctcaggcctcaaggcacgagagcgcagaaatcttcgttgtttgccaaggattcctggcgcctgataaagtggactccaagttcttcgatccgaagtttgcctttaaagaggtagaagttcaggccaaaaccgtaactgaattggtcaccaagaagaagccgaaagcggagggctacgcagaaggggatctaactctgtatcacagaacttcggtgaccgactttcttcgcgcagccaatccagtggatttcttgtccaaggcttcagaaataatggtggacgacgaagagctggctcagcaccctgctaccaccgaagatatccgggtgtgctgccaggatattcgggtgctgggtcggaaggaactaaggtcgttgctgaattggcggacgaagcttcggagatacgtggccaaaaaactaaaggagcaggccaaagcacttgatataagcctgtcaagtggtgaggaagacgagggtgacgaggaagatagcacggccggtacaaccaagcagcccagtaaggaggaggaggaggaggaggaggaagaacaacttaaccagaccctcgccgagatgaaggcccaggaggtggctgagttgaaacgtaagaagaaaaagctcctgagggagcagcgaaaacagcgggagagggtggaactcaagatggacctgccaggcgtgagtatcgctgatgagggggaaaccggtatgtttagcctctccacaatcagagggcaccagctgctggaagaggtgactcagggtgatatgagcgccgcagatactttcctctcggacttgccacgcgacgacatttacgtaagcgatgttgaagacgacggtgatgatacaagtttggactcagacctcgatcctgaagagctggctggggttcgcggacaccagggattaagggaccaaaaacgtatgaggctcaccgaggtgcaggacgacaaggaggaggaggaggaggagaatccgctccttgtaccgctggaggaaaaggctgtcctccaggaggagcaggcgaacctgtggttttcaaagggttctttcgcgggtatcgaggacgatgccgacgaagccctcgagatctcacaagcacagttattgtttgaaaataggcggaaaggcaggcagcaacagcagaagcagcagctaccgcagacgcccccttcctgtctcaagactgagattatgtcacctctgtatcaggacgaggcgccaaagggcaccgaggcctctagcggcaccgaagctgcaaccggcttggaaggggaagagaaagatgggatctctgattccgatagctcaactagttctgaagaggaagagtcatgggagcctctccggggtaaaaagagaagccgtggcccaaagagtgatgatgatgggtttgagatcgtgccaatcgaggaccctgctaagcatagaatcctggaccccgaaggactggccctaggcgctgtcatagcttctagtaagaaagccaagcgagacttgatcgacaacagcttcaacaggtacacctttaacgaggacgagggagagctgccagaatggtttgtccaggaggaaaagcagcatcggattcggcagcttcctgttggtaagaaagaagtggagcactatcgcaagagatggagggagattaatgcgcgtccaattaagaaggtggcagaagctaaggccaggaagaaacgaagaatgctgaagaggttagaacagactcgcaaaaaggctgaggcagttgttaatacggtcgatattagcgagagggaaaaggtggcacagttgagaagtctgtacaagaaagcaggtctggggaaggagaaaagacacgtgacttatgtggtcgcgaaaaagggggtgggtaggaaggttcggaggcccgctggagtccgaggccacttcaaagtcgtagattcacgcatgaagaaagaccaacgcgcacagcagaggaaggagcagaaaaagaaacacaagcgcaagtag

SEQ ID NO: 22930 - DNA, 1431 bp, Artificial Sequence
  Description of Artificial Sequence: Synthetic coding sequence
atggccgattccaaagaaggagtgttacctttaacagccgcttcaaccgctcctattagctttggcttcactcggacgtcagcaagacggaggctcgccgattcaggggacggagctggcccttcaccggaggaaaaagactttctcaaaaccgtggaaggacgcgaactgcaatccgtgaaaccccaggaagccccaaaggaactcgtcatacccctaatccagaacgggcatcgacgccagccacccgctcggccacccggacctagcaccgacaccggcgctctggccgacggtgtggtgagccaggcggttaaggagttgattgccgagagtaagaaaagtctggaagagcgggaaaacgcaggggtagatccaacacttgctatccccatgattcaaaagggatgcactcctagtggagagggagccgacagcgaaccgagagctgagaccgttcccgaagaggctaattatgaggccgtaccggtcgaagcttacgggttggctatgctgaggggcatgggctggaagcccggagagggaattggtcgtacatttaatcaggtcgtgaagccacgagttaacagcttgcggccaaaaggcttaggtcttggagctaatcttactgaggcacaggcactcactcccacaggacctagcaggatgcctcggcctgacgaggagcaagaaaaggataaggaagaccaacctcagggacttgtcccaggaggcgctgtcgttgtgctttccgggcctcaccggggtctctatggaaaggtagaaggtttagaccctgacaatgtgcgcgctatggtgcggttggcggtgggcagcagggtggtcacagtgtcggagtattatctgcgccctgtcagccagcaggagtttgacaagaacaccctcgatctgaggcagcagaatggtacagcttccagccgtaaaactttgtggaaccaggaactatatatccagcaggataattctgagaggaaaaggaaacatctacctgatcgccaggacggccctgcggcaaagtcagagaaggctgcgccacgctctcagcattggctgcaccgtgacctccgggttcggtttgtggacaatatgtacaagggaggtcagtactataatacaaaaatgatcatagaggatgtgctctcgcccgacacatgcgtgtgtagaaccgatgagggccgtgtcctggagggcttgagagaagacatgctggagacccttgtgccaaaagccgaaggggacagagttatggtcgtgctcggccctcagactgggagagtaggacatctactgtcccgtgaccgggctaggagtcgagctttagtacaactcccaagggaaaatcaggtggtggagctgcattatgatgcgatttgtcagtacatggggccatccgatactgacgacgactag

SEQ ID NO: 22931 - DNA, 2796 bp, Artificial Sequence
  Description of Artificial Sequence: Synthetic coding sequence
atggccgctagagacagcgatagtgaggaggacctcgtaagctatggtaccgggctggagcccctggaagagggggaaagacccaagaaacctatccctttacaggaccagacagtcagagatgaaaaaggccgatacaagcgcttccacggagcgttcagcgggggttttagcgcaggttatttcaacaccgtcgggagcaaagagggctggaccccaagcaccttcgtctcgagtagacagaatcgggctgataagtccgtcctcgggcctgaagatttcatggacgaggaggacctgtcggaatttgggattgctccgaaggccatcgtgacgacggatgactttgcttctaaaacaaaggaccgcattagagagaaagccagacagctggccgcagccacagccccaatccccggtgctactttgttggacgatttgatcactccagcaaagttatccgttggcttcgaactgctgcgcaagatgggctggaaagagggccaaggcgtgggccctagggtgaagcgcagacctagaagacagaagccagacccaggagtgaagatttacgggtgcgctctacccccaggttcttcagaggggtctgaaggcgaagatgacgattatttgcccgataatgtcacctttgcacctaaggacgtcacgcccgtcgatttcactcctaaggataacgtgcatggtcttgcttacaagggcttagatccacaccaggccctctttggcacctcgggtgaacacttcaatctcttcagcggcggttcagagagagctggtgatctgggagagatcggtctgaacaaaggaagaaagctcgggatctccggtcaggctttcggcgtgggagccctcgaggaagaggatgacgatatctacgccaccgagaccctgagtaagtatgatacagtgcttaaagacgaagagcctggggacggtctgtatggatggactgctcctcggcagtacaaaaatcaaaaagagagcgagaaagacctgagatatgttggcaaaattttggacggattctctctcgcctctaagccgctttccagtaaaaagatatacccccctcccgaactgcctcgcgactaccgcccagttcactatttccggcctatggttgccgcaacatccgagaactcacatctgctccaggtcctgtcagagtccgcgggaaaggccaccccagatcccggaacacattccaaacatcaactcaatgctagtaagagagctgagctccttggtgagactcccatccagggctccgcaacaagtgttctcgaatttctgagtcagaaagacaaagaacgcattaaagagatgaagcaggctaccgatctgaaggcagcccagctcaaagcgagaagcctagcccagaacgcacaatcctcccgtgctcagctgtcccccgctgccgctgccggacattgttcatggaacatggctttgggtgggggaaccgctacccttaaggcctcaaattttaaacctttcgcaaaggatcctgaaaaacaaaaaagatatgatgaatttctggtacacatgaagcagggacagaaggacgctctcgagcggtgcttggatcccagcatgaccgagtgggaaaggggtcgcgaacgagacgagttcgcccgtgccgctctgctgtacgcatcttcgcatagcacactctcaagcaggttcactcacgccaaagaggaagacgattccgaccaggttgaggtgccaagagatcaggaaaacgacgtgggagacaaacagagcgccgtcaaaatgaaaatgtttggaaagctgactagagacactttcgaatggcacccagacaaactgctgtgcaaaagatttaacgttcccgatccttacccagactctaccctggtgggattgccccgtgtgaaacgggataaatattcagtgtttaatttcctgaccttgcctgagacagctagcctaccgacgacccaggcctctagtgagaaagtcagccaacaccggggaccagacaagtctcgtaagccctcacgctgggatacttccaagcatgaaaaaaaagaagattccatttccgagtttctcagcctggctagatcaaaagccgagcctcctaagcagcagtcatccccattggtcaacaaagaagaggaacatgctcccgagctgagcgctaatcaaacagtaaataaagatgttgacgcacaggcggaaggagaggggtcgcgacctagtatggatctgtttcgggcaatcttcgcaagctcctccgacgaaaagtccagcagcagcgaagatgagcagggggactctgaggatgatcaggccggatctggcgaggctaacttccagtccagtcaagacacagacttgggagagaccagctcagttgcacatgctctagtccccgctccacaagagccccctccgagctttcctatacaaaagatgcaaatagatgagcgggaagagttcggtcccaggctgccacccgtcttctgtcccaatgcacggcagactttagaggtgcctcagaaagagaaacataagaagaataaagacaagcacaaggccaaaaaggagcataggcgtaaaaaggaaaagaaaaagaagcatagaaagcacaaacataaaggaaaacagaaaaacaaaaagcctgaaaagagttcaagcagtgagtcaagcgactccagcgacagccagtctgacgaagagaccgccgatgtgtctcctcaggaactccttcggagacttaagtcgctccccttgaggcggcaatag

SEQ ID NO: 22932 - DNA, 984 bp, Artificial Sequence
  Description of Artificial Sequence: Synthetic coding sequence
atgccggcactgttggagcgcccaaaactttcaaacgccatggccagagctctccataggcatatcatgatggaaagagagcgaaaacggcaagaggaagaggaagttgataaaatgatggaacagaagatgaaggaggagcaggaacggcgaaaaaagaaagagatggaggagcgcatgtccctggaggaaacaaaggagcagatcctgaaacttgaagaaaagcttcttgctcttcaggaggaaaaacatcagttattcctccagctgaagaaagtgctgcacgaggaggagaagcggcgacgtaaggaacagtctgatctgacaaccctaacgtcggccgcttatcagcagtctctgaccgttcacaccggaacgcaccttttaagcatgcagggcagccccggaggtcacaaccgccctggaaccctcatggcggctgacagagctaagcaaatgtttgggcctcaagttttaacgacacgccactatgtgggttccgccgctgcattcgccggtaccccggaacacggacaattccagggtagccctgggggtgcttatggcaccgctcagccccctccgcactacggtccaacccagcctgcctactctccaagtcaacagcttcgggctcccagtgcctttccagcggtgcagtatctgagccagccacagccccagccctatgcggtgcatggacatttccagcccacccagactggattcttacagcccggaggggctctgtcgctccagaaacaaatggagcacgctaaccagcaaacaggcttcagtgactcctcttccctacggcctatgcacccccaagctctgcatcctgccccaggtctgctggctagcccccaactccccgtccaaatgcagccagctgggaagtctgggttcgctgcaacaagtcagcctggcccaagattaccatttattcagcacagccaaaacccacggttttatcacaagtag

SEQ ID NO: 22933 - DNA, 984 bp, Artificial Sequence
  Description of Artificial Sequence: Synthetic coding sequence
atgccggctttgctagaaagacccaagctaagcaacgccatggctcgggcactgcacaggcacattatgatggagcgggaaagaaaacgccaagaagaggaagaggtagataagatgatggagcagaaaatgaaagaggagcaggaacggagaaaaaagaaagagatggaggagcgtatgtcccttgaagaaaccaaggagcagatcctgaagctggaagaaaaactgttagcattgcaagaggaaaaacaccaactgttcttacagctgaaaaaggtcctgcatgaggaagagaagcgcaggagaaaggagcagagtgacttgactacgctgacctctgctgcctatcaacagagcctgactgtccataccggcacccatctactcagtatgcagggcagcccgggtggacataatcgccctggtacacttatggccgcagaccgggctaaacagatgttcgggcctcaggtgctgactacacgacattatgtcggatcagcagctgcctttgccggaactcccgaacacgggcaattccagggctcacccggaggcgcatacggcactgcacagccaccaccccactacgggccaacgcaacccgcatattctccttcccaacagttgcgggctcccagcgcattcccagctgtgcagtacctgtcacaacctcagcctcagccctacgccgtgcatgggcacttccaacctacccagaccggattcttacagccaggcggtgccctgtccctccagaaacaaatggagcacgctaatcaacagaccggattctccgattctagctcgctccggccaatgcacccccaagcactgcaccctgcacctggactcctggcgtccccccaactcccagtgcagatgcagcccgctggaaagtctggctttgcagctacctcgcagccagggccaaggctgccttttatacaacatagtcagaacccgagattttaccacaaatag

SEQ ID NO: 22934 - DNA, 984 bp, Artificial Sequence
  Description of Artificial Sequence: Synthetic coding sequence
atgcctgctctcctcgagaggcctaaacttagtaatgcaatggccagggcactgcatcgtcacataatgatggagcgcgaaagaaaaagacaagaagaagaagaggttgataagatgatggaacagaaaatgaaagaagagcaggaaaggcggaagaagaaagaaatggaggagcggatgtcacttgaggagactaaggaacaaatcctgaaactggaagagaagctgctcgccctccaagaggagaagcatcagctattcttgcagctcaagaaagtgctacacgaagaggagaagagaaggaggaaagaacagagtgatctgacaaccctgacatccgctgcctatcagcagtccttaactgttcacactggaacacatctgctttcaatgcagggctctccgggtggacacaaccggcctgggactctcatggccgctgaccgagcaaaacagatgtttggtccacaggtacttaccacacgtcattatgtgggctctgccgctgcctttgcaggcacccccgaacacgggcagttccaggggtcccccggtggcgcttacgggaccgcgcagccccctccccattatggcccaacacagccagcctactctccatcgcagcagcttcgagcaccgagcgcattccctgctgtgcagtacttgtctcaacctcagccccagccatacgccgtccacgggcactttcagcctactcagacaggcttcttgcaaccaggcggagcactctctctgcagaaacaaatggagcacgctaatcagcaaacgggcttctccgacagttcatctctgaggcctatgcacccccaggccctgcaccctgcccctggtcttctggcttcaccacagttacccgtgcagatgcagcctgctggaaaatctgggtttgcagcaaccagtcagcccggtcccaggcttccattcatacagcacagtcaaaacccccgtttttaccataagtag

SEQ ID NO: 22935 - DNA, 912 bp, Artificial Sequence
  Description of Artificial Sequence: Synthetic coding sequence
atgcctgccctgcttgaacgtcctaagctaagcaacgcaatggcccgagccttgcatcggcacataatgatggaacgagagaggaagcggcaggaagaagaagaggtggataaaatgatggaacagaagatgaaggaggagcaggaacgccgaaaaaaaaaagagatggaggagaggatgtcactagaggagaccaaagagcaaatcctcaaactggaagagaaactactggcgcttcaggaggaaaagcaccagctgttcttgcagctaaagaaagtgctgcatgaggaggaaaagaggaggcgaaaagaacagagcgatctgacgaccctgacatcagcagcatatcagcagagtctgaccgtccacacaggcactcatctgctttccatgcaaggttcacctggtggccataacagacctggtaccctgatggccgcagaccgtgcaaaacaaatgttcgggccacaggtccttaccactaggcactacgtgggatccgccgctgcctttgccggaactcctgaacacggacaatttcagggatccccaggaggcgcttatggcacggcacagcctccaccccattatgggcctacgcagccagcttacagtccaagtcagcaactcagagctccgagcgcattcccagctgttcagtacttatcacagccacagccccagccttacgccgtccatggccatttccagcccacccagaccgggttcctgcagcccggaggcgctttgtccctgcagaagcagatggaacacgctaatcagcagacaggattcagtgattcttcctcgctccgccctatgcatccacaggctctgcaccctgctccgggactgctggcaagcccgcagctgcctgtccagatgcagccagccggtaaaacggcaccctag

SEQ ID NO: 22936 - DNA, 1986 bp, Artificial Sequence
  Description of Artificial Sequence: Synthetic coding sequence
atgtccaaaaggttgcggagttctgaagtgtgcgctgattgttcaggtccggacccgagctgggcatctgtcaatagaggaacttttctgtgtgatgagtgctgctccgttcaccggagtcttgggcgacacatttctcaggttcggcatctgaagcacacgccatggcccccaacgctgcttcagatggtggaaacactctacaacaatggagctaattccatttgggagcactccctgttggatccagcttctattatgagcggacgcagaaaagccaatccccaggataaagttcatccgaataaggctgagttcatacgggctaaataccagatgctggcctttgtacacagactgccctgccgggacgacgacagcgttacagctaaagatctctcaaagcagctacatagctctgttcgaaccggtaatcttgagacttgtctcagattgctctccctgggcgctcaggcaaacttttttcacccagaaaagggaaatacgccactgcatgtggcctctaaagcaggccagattcttcaggccgagctccttgccgtgtatggggctgacccgggtacacaggattcctccggcaaaacaccagtagactatgccagacaagggggtcatcacgaactggcggagcgcttggtcgagattcagtatgagcttaccgacaggttggccttctatctgtgtgggagaaagcccgaccacaaaaacggccagcattttataatccctcagatggcagattcctctctcgatttatcggagctggccaaggcggctaaaaaaaagttgcagagcttgtccaatcatctgtttgaagaactggcaatggacgtgtatgacgaggttgacaggagagagaccgacgctgtgtggctcgccactcagaatcatagcgccctagtgactgaaacaaccgtagttccctttctgcccgttaatccagagtactcttcaacacgaaatcaggggagacaaaaactggcccgatttaatgcccacgagttcgccaccttggtcattgatattctatccgatgcaaaaaggcggcagcagggcagctcactgagcgggagcaaggacaacgtcgaactcattttgaaaacgattaataaccagcattcagtggagagccaggacaacgaccaacctgattacgactctgttgcaagtgatgaggacactgacttagagacaaccgctagcaaaaccaatcgacagaagtctctcgactccgatctgagtgacggacccgttaccgtgcaggagttcatggaagtcaaaaacgccttagtcgccagtgaagccaaaattcagcagttgatgaaaataggtcgatctgctctggttaccagctcatcatccttgccatcctttccgtcaacgcttagctggagtagggacgagtccgccagacgagcatctcggcttgagaagcagaacagcacccccgaatccgattacgacaacactccaaatgacatggagccagacggcatggggagttcaaggaaggggaggcaaaggtctatggtgtggcccggagacgggcttgtccccgatactgcggagccccacgttgccccttctcctaccctgcctagcaccgaggatgtgatcaggaagactgagcaaataactaagaatatccaagagctcctgcgagccgcacaggaaaacaaacatgattcatacatcccttgttctgaaagaattcatgtcgctgtgactgagatggcagcgttattccctaagaagcccaagagtgacatggttcggacaagcctacgtctgttgacgagctctgcatacagactccaatccgagtgtaagaaaacgctccctggcgatccagggagccctactgatgtgcagctggtcacacagcaagtcattcaatgtgcctatgatatcgctaaagctgctaagcaactggtcacaatcaccaccaaggagaacaataactag

SEQ ID NO: 22937 - DNA, 1950 bp, Artificial Sequence
  Description of Artificial Sequence: Synthetic coding sequence
atgagcaagagactgcggtcgtcggaagtgtgcgcagactgctctggtccggacccgtcatgggcaagcgtgaataggggaactttcctgtgcgacgaatgttgctctgtccatcgctccctcgggaggcatatctcccaggtaaggcacctgaaacataccccttggccccctaccctgctccagatggtggagactctgtacaataatggagccaattccatctgggaacactctctgctcgaccctgctagtattatgagcggtcgcagaaaagctaatccacaggacaaggttcaccctaacaaggcagagtttatccgagccaagtaccagatgttggcctttgtacaccgcctgccctgtcgagacgatgactctgtgacggctaaggacctcagcaaacaactacatagtagcgtcaggaccggcaaccttgaaacatgcctcagactcctgagcttgggcgcacaagcaaacttctttcatccagaaaaaggcaatacccctctgcacgtggcttccaaggccggtcaaattctccaggcggagctgctggcagtgtacggcgctgaccctgggacacaggattcctctgggaagacacctgttgactatgcacggcagggtggacaccacgaattggccgagagacttgtagaaatccagtacgagctgaccgataggcttgctttctacctatgtggacgcaaacctgatcataagaacggccagcattttattattccccagatggccgactcctctcttgacctgagcgaacttgccaaggccgctaagaaaaaactgcagtcactatctaatcatttgtttgaagagctggcaatggacgtgtatgacgaggtagaccggcgagagactgacgccgtctggttggcaactcagaatcatagcgctctggtcaccgaaacaacagttgtgcccttcctgccggtcaatcccgaatattcatcaacccgcaaccagggtcagcctaaaaagagcctggattcggacctgagcgatggtcccgtgaccgtacaagagtttatggaggtcaaaaatgcgcttgtcgcctcagaagccaaaattcagcaacttatgaaggttaacaacaatctgtcagatgagctgagaataatgcagaagaagcttcagacacttcaatctgaaaatagtaatctcagaaagcaggctactaccaatgtctaccaggtgcagaccggatcagagtatactgatacttcgaaccacagctcattgaaacggaggccctccgcaagaggttcccggccaatgagcatgtatgaaaccggatccggccagaaaccgtacttacccatgggcgaggcatctaggcccgaggaaagccgcatgagattacagccctttccagcccatgcttcacggcttgagaaacaaaacagcacaccagaatccgattacgacaacactccaaatgacatggaacccgatggcatgggctccagtagaaagggcaggcagcggtccatggtctggccgggagacggcctcgtaccggacaccgcagagcctcacgtggccccatcccccaccctgccgtccacggaggatgtaattcggaagacagagcaaatcaccaagaacatacaagagctgctacgcgctgctcaagagaataaacatgactcctacatcccttgcagtgagcggattcacgtggcggtcaccgaaatggcagccctgtttccaaaaaagcccaaatctgatatggttaggacttctctgcgtctgcttacaagcagtgcttatcggctgcagtctgagtgcaagaaaaccttacccggtgaccccggaagcccgactgacgtccagctggtcacccagcaggttattcagtgcgcttacgacatagccaaggcagccaaacagcttgtgaccataaccacaaaagagaacaataattag

SEQ ID NO: 22938 - DNA, 2046 bp, Artificial Sequence
  Description of Artificial Sequence: Synthetic coding sequence
atgagcaaaaggctgaggagctctgaagtctgtgccgattgttcgggcccagatccaagctgggccagcgtaaaccgcggaaccttcctctgcgacgagtgttgtagtgtgcacagaagcttgggtcggcatatatcccaggttcgacaccttaaacacactccttggcctcctaccttgctgcagatggtggagaccctgtataataatggcgcaaacagtatttgggaacatagcctgctggaccccgctagtattatgtccggtcgcagaaaggcgaacccgcaagacaaggtccaccccaataaagcagagttcatccgagcaaagtatcagatgctggcatttgtgcatcgcttgccttgtagggatgatgattccgtgaccgcaaaagatctgagtaaacagttacacagttctgtccggacgggcaatctggagacctgtcttcgcctgctctcattaggagcgcaggcaaattttttccaccccgagaagggtaacaccccactacatgtagccagtaaggcgggacaaattctacaggcggaactgttggccgtctacggcgctgatcccggtacccaggatagttcaggcaaaactccagtagactatgctaggcaaggagggcaccatgagctagccgaacgtttggtcgagatccaatacgaactcacagatagacttgcattctacctttgtggtcggaaaccggaccacaagaatggccagcacttcatcatcccccagatggccgatcggagatcctccctggatctgtcagaattggcaaaggccgctaagaagaagttgcagtcactttcaaatcacttgttcgaggaattggccatggatgtatacgatgaggtggatcgcagggaaactgacgccgtatggctcgctactcagaaccattcggctctggtgaccgagacaaccgtcgtaccattcttgccagtcaaccctgagtatagtagcaccagaaatcagggtcggcaaaaactcgcacgctttaatgcccacgagttcgcaaccttagtaatcgacatcctatcagacgctaagcgccgtcaacaaggatcatccctctctgggtccaaagacaacgtggaattgatactgaagacaatcaataaccagcactctgtggaatcccaggataacgaccagcctgattatgactcagttgccagtgatgaagataccgacctggaaaccacagcctccaaaacaaaccgacaaaaactgcagacactgcaatctgaaaatagtaacctgagaaagcaggcaacaacaaacgtgtaccaggttcagacaggatccgaatacaccgacacctcgaatcactcctctctcaagcggcgacccagcgcacgcggatctcgccctatgtcaatgtacgaaacagggtccggccagaagccctacctcccaatgggagaggccagtagaccagaagaatcgcggatgcgactccagccttttcccgctcacgcttcaaggttagaaaagcaaaatagtactcctgagagtgattacgacaatacacctaacgacatggaaccagacggtatgggttctagtagaaagggcaggcagaggagcatggtctggcctggagatgggctcgtgcctgacactgctgagccccacgtcgctccaagccctaccctcccatccacagaggatgtgattcggaagacagaacagatcaccaagaacatacaggagctgctcagggctgcacaggagaataaacacgactcctatatcccctgttctgaacggatccacgtggcagtgacagaaatggccgctttattcccaaaaaagccaaagtccgacatggtccggacctcactcagattactcacctcctcggcctaccgactgcaatccgagtgcaaaaaaactcttcccggagacccaggatctccaaccgacgtccaactggtgactcagcaggttatccagtgcgcctacgatatcgcaaaagccgcaaagcagcttgtgaccatcaccaccaaagaaaacaacaactag

SEQ ID NO: 22939 - DNA, 2280 bp, Artificial Sequence
  Description of Artificial Sequence: Synthetic coding sequence
atgtcaaaaagactcagaagttccgaagtttgcgctgattgcagcggccctgacccttcttgggcatcggtgaaccgcggtaccttcctttgtgatgaatgctgttccgttcaccgtagcctgggtcgccatatttcccaagtcaggcatctgaaacacaccccttggccaccgaccctgttgcaaatggtcgagacactctataataacggggcaaattccatctgggagcactcactgctcgatcccgcatctatcatgagtggaaggcgcaaagccaatcctcaagacaaagtccatcctaataaagctgagttcatcagagccaagtatcaaatgctggcattcgtgcacagactgccctgcagggacgatgatagcgttacggccaaagacttgagtaagcagctgcacagttccgtccgaactggcaacctggaaacttgcttgagactactgtctctgggagcgcaggctaatttcttccatccagaaaagggcaacacccctttacacgtggcatctaaggccggacaaatcctgcaagccgaattgctggctgtgtatggcgcagacccaggcacacaggacagttccggtaaaacaccagtggactatgcacggcaagggggacaccacgaactggccgaaagactggtggagatccagtacgaacttaccgaccgactggctttctacctgtgtggcagaaagccagatcacaaaaacggccagcactttatcattccacagatggcagactccagcctggatctgagcgaacttgcgaaggctgcaaaaaaaaagctgcagtctctgtctaatcatttatttgaagagcttgccatggacgtgtatgatgaagtggaccgaagagagaccgacgccgtgtggctggccacccagaaccatagcgctcttgtcaccgaaacaactgtggttcccttcctgcccgtgaacccggaatactcctccactagaaaccagggtcggcagaaactagccagatttaatgctcacgagttcgctactcttgttattgacatcctcagcgacgcgaaacgcagacaacagggatctagtctcagcggctctaaggacaacgttgagctgatcttgaagactatcaacaaccagcacagtgtggaatctcaggacaacgatcagcctgattacgatagtgtggcatctgatgaagatacagacctggagacaactgcttcaaagacaaatcgtcagaagtcactcgacagtgatttatctgatggacccgtgactgtgcaggagttcatggaagtaaaaaacgctctggttgcgagtgaggcgaagatccagcagctgatgaaggtcaataataatctatccgacgaattgcgtattatgcagaagaaactgcagacattgcagtctgaaaactctaacctcaggaaacaggcaacaaccaacgtgtaccaggtccagaccggcagcgaatatactgatacaagcaatcacagcagtctgaaacggcgtccctccgcacgcggaagccgccctatgtctatgtatgaaacaggaagtggccagaagccatatttgccaatgggggaggcatcccgcccagaggagtcaagaatgcggctccagccctttccggctcatatcggccgaagcgcgttagtgactagcagctcaagtctgccaagtttccccagcactttgtcatggagcagagatgaaagcgcaagacgggcaagccgtttggagaaacagaattcgactcctgagtctgactatgacaatacacccaatgacatggagcccgacggtatggggtcatccagaaagggcagacaaaggtctatggtgtggcctggcgacggtctagtgccagatacggcagagccccacgttgcaccgagtcccaccctgccgtcgacagaggacgtgattcgcaagacggagcagattactaagaatatccaggaacttttacgcgctgcacaggaaaataagcatgacagctatattccctgttctgagaggatccacgtggcagttaccgagatggccgcattgtttccgaagaagccgaagagcgacatggtgcgcacatctttgcgcctcctaaccagctcagcgtataggctccagagcgagtgcaaaaaaacactcccaggcgatccgggttcacctaccgatgtgcaactggtcacacaacaggtaattcaatgcgcctacgacatcgcgaaggccgctaagcagctggtgactatcaccaccaaagaaaacaacaattag

SEQ ID NO: 22940 - DNA, 1941 bp, Artificial Sequence
  Description of Artificial Sequence: Synthetic coding sequence
atgagtaagcggctgcgctcatcagaggtctgcgcagactgcagtgggccagacccctcttgggccagcgtgaaccgcggaacctttctttgcgatgaatgctgttcagtccaccggtccctgggccgacacatttcccaggtgcgtcatctgaaacacactccatggccgcctacgctcctgcagatggtggaaacactctacaacaatggagctaattccatttgggagcactctctcttggatccagcatccataatgagtggacggaggaaggccaatccgcaggacaaagtgcatcccaataaggcagagttcattagagcaaagtaccaaatgctcgcttttgtacaccgtctgccatgtcgggacgatgattcagtgaccgctaaggacctctcaaaacagttgcacagctcagtccggactggaaacctggaaacctgtctgaggctgctttctttaggtgctcaggccaactttttccatccagagaaagggaacaccccactccacgtggcctccaaggccggtcagattcttcaagccgaattgctagctgtgtatggggctgatccgggaactcaggattcttctggcaagaccccagtggattacgctcgtcagggtggtcatcacgaactggctgagcggctggtggagatccaatatgaacttaccgacaggctggccttctatctctgcgggagaaagccggaccataagaatgggcagcacttcataattcctcaaatggctgactcaagccttgacctttcagaacttgctaaagctgccaaaaaaaagctccagtcgctgagtaatcacttgtttgaagaacttgcgatggacgtgtatgacgaggtagatcgcagagagactgatgcggtctggctggcgactcagaatcactcggcactagtgacagagaccaccgtcgttccatttctgccagtcaaccccgagtactctagcaccaggaatcagggccgacagaagcttgccagatttaatgcccatgagtttgcgacgctagtgattgatatactgtccgacgcgaagcgacgccagcaggggtcctctctatccggctccaaggacaatgtcgagctcatcctgaagaccattaacaatcagcatagcgtggaatcccaggacaatgaccagcccgactatgactcagtggctagcgacgaggacacggatctggagacaactgcttctaagacaaatagacagaaatctctggattcagatctctcagacggccctgttaccgtgcaggagttcatggaggttaaaaacgccctggtcgccagtgaagccaagattcaacagcttatgaaagtaaataacaacttgtctgatgagctgaggattatgcagaaaaaggcttcacggttagaaaagcaaaattccacccccgagtctgattatgataatacacccaacgacatggaacctgatggcatgggctcctcccgcaagggacggcagcgcagtatggtgtggcccggtgatgggttggttcctgatacagccgagccacatgtagcgcctagcccaaccttgcccagtactgaggatgtgatccgcaaaactgaacagattaccaagaatattcaggagctgttaagagctgcacaggagaacaagcatgactcatacatcccatgctccgagcggatccatgtcgccgttaccgaaatggctgcgctgttccccaagaaaccgaaatccgatatggtccgtaccagtctgcgcctactcactagcagtgcataccgactgcaatctgagtgcaaaaagacattacctggggacccgggtagtcccacagacgtacagctggtaacgcagcaagtgatccaatgtgcctacgatatcgcgaaagctgctaagcagctggtcacaattaccaccaaggagaacaacaactag

SEQ ID NO: 22941 - DNA, 2130 bp, Artificial Sequence
  Description of Artificial Sequence: Synthetic coding sequence
atgtcgaagagattgaggtcttccgaggtctgtgctgactgctctggacccgacccatcttgggcttcagtcaaccgcggaacatttctttgcgacgagtgttgtagcgtgcaccgcagcctgggcagacatatctcccaggtgcgtcacctcaagcacactccttggcccccaacacttttacagatggtcgaaactctgtacaacaacggagccaacagtatttgggagcacagtttactcgaccccgctagcattatgagtgggcgaagaaaggctaatccccaggacaaagtgcaccctaataaagcggaatttataagagctaaataccagatgctggcatttgtgcacagactgccttgtagggatgacgattccgttactgccaaggacttaagtaaacagctgcactcaagcgtcaggacaggaaacttggagacctgcctgcgcctgctctctttaggagctcaggccaatttcttccaccctgagaaaggtaacacacctctccatgtagcctccaaagccggtcaaatcctgcaggctgaacttctggcagtgtatggcgcagacccaggaacacaggatagctccgggaagacccctgtggactacgcccgtcaaggtggccaccatgaattagctgagagactagtggagatccagtacgagttgacggatagacttgccttttacctgtgtggcagaaaaccagaccacaaaaatggccaacattttatcatccctcagatggctgactcctcactggatctctcagaactagcaaaagccgcaaagaagaagttacagagtctcagcaaccatttattcgaagaactggctatggatgtctacgacgaagtggaccggagggaaactgacgccgtttggcttgccactcaaaaccatagcgccctcgtgactgaaacgactgtagtgcccttcctgcctgtcaatcccgaatatagttccactaggaaccaaggacgccagaagttggccaggtttaatgcccatgagttcgctaccttagtcattgatatactgagcgacgcaaagagacgccagcagggctccagtctctctggttcaaaagacaatgtggagctgatcctcaaaaccatcaataaccagcattccgtggagtcacaggataacgatcagccagactacgatagtgtggcttcagatgaagacaccgacctggagactactgcctcaaagacaaatcgtcagaagctccagaccctgcagtcagagaactctaatttaaggaaacaggctacaacgaacgtttatcaggtgcaaaccggcagcgagtacacggatacaagcaaccattcctctctgaaacgccgtccgtctgccaggggtagccgaccaatgtcaatgtacgagacaggtagtggccagaagccatacttgcctatgggggaagcgagccgcccagaagagtcccggatgagattgcagccctttcctgcacacatcggtagatctgcactggtgacgagtagcagctcactgccatcttttccatccaccctatcatggagcagagatgagtcagctcgtagggctagtcgcctggagaagcaaaacagtacccccgagagtgattacgataacacaccaaacgatatggaacctgatggcatgggaagtagtaggaagggcagacagagatcaatggtttggcccggagacggtctagtgcctgacacggctgaaccccatgtcgcaccaagcccaaccctgccctcaacagaggatgtgattcgaaagacagaacagataactaaaaatatccaggagctgctgcgagcggcacaggagaataaacatgactcatacatcccgtgctcagagaggatccatgtggctgtcactgagatggctgcattattcccgaagaagcctaaaagcgacatggtacgtacctcactgcgccttctcacatcatccgcttacagactccagagtgaatgcaagaagactctgcctggcgatcccggatctcccactgatgtacagttggttacacagcaggtcatccagtgcgcatacgatattgccaaagcagcaaagcagctcgtcactatcacaacaaaggaaaataataattag

SEQ ID NO: 22942 - DNA, 2190 bp, Artificial Sequence
  Description of Artificial Sequence: Synthetic coding sequence
atgtctaagagactcaggtcctctgaagtctgtgcagattgcagcggacccgatccctcttgggcctctgtgaaccgaggcacattcttgtgcgacgaatgctgctcggtccaccggagcctgggaagacacatttcccaggtccgccatttgaagcatactccgtggcctcctaccctgctccaaatggtggagactctgtataataatggggctaatagcatttgggagcactccctgctggatcccgcatcaattatgagcggtagacgcaaagccaatcctcaggataaagtgcaccccaataaagctgaattcatccgcgcaaaataccagatgcttgcttttgtgcaccgactgccttgccgtgacgatgactctgttacagctaaggatctcagtaaacagttgcactcatccgtgcgcacgggaaacctcgaaacctgtctaaggctcctgagtctgggagctcaagccaacttcttccaccccgagaaggggaacacaccgctgcacgtggcgtcaaaggctgggcagattctgcaggccgagcttttagctgtatatggcgcagatccgggaacacaagattctagcgggaaaactcctgtcgactacgcccgacaagggggtcatcatgagttggctgagcggctggtggagattcaatacgagcttacagatcggctcgctttttacctctgcggaaggaagccagaccacaagaatggtcagcatttcatcattcctcagatggccgactcttctctggaccttagcgaactcgctaaggccgcaaagaaaaaactgcagtcactttctaaccacctattcgaggaactggccatggatgtgtacgacgaggtggatagaagggagactgacgccgtttggctggcaactcagaatcattcggcacttgtgactgagacaaccgtcgtgcccttcctaccggtgaatcctgaatactcgtccacgcgtaatcaggggcgtcagaagctggcgaggtttaacgcccatgaattcgccaccctggttattgacatcctgagcgacgccaaacgcaggcagcaaggttctagcctttcgggctccaaggacaatgtagagcttatcctgaagacaattaataaccagcacagcgttgagagccaagacaacgatcagccagattacgattccgtggcatctgacgaagatacggacctagagaccacagccagcaaaactaatcggcaaaagagtctggattctgatctttccgatgggccagtcacggtacaagagtttatggaggtcaagaacgccttggtcgcctccgaggctaagatccaacaactaatgaaagtgaacaacaacctttctgatgagcttagaataatgcagaaaaaactccaaacgctacagagcgaaaactcaaacctgcggaagcaggctaccaccaatgtttaccaggtgcagacaggcagtgaatatactgacacatctaaccatagcagcctcaaacgaaggcctagtgcccgaggaagccgcccaatgtccatgtatgagactggctcaggtcagaaaccctacctgcctatgggcgaggcctcaaggccagaggaaagccgaatgcgactgcagccctttcctgcccacgcctcacgtctcgaaaagcaaaattccactcccgagagtgactacgataatacacccaacgacatggaaccagacggcatgggctccagccgcaagggcagacaacggtccatggtgtggcctggcgacgggctcgttccagatactgcagagcctcacgtggccccatccccgactctgccctcaaccgaagatgttatacggaagacagagcaaatcacgaagaatattcaggaactcttacgggcagctcaagagaataagcatgactcatacataccctgttctgagcgcatacatgtcgccgtcacggaaatggcagcactgttcccaaagaagcccaagagtgatatggtgcggacaagccttcggttgttgacctcaagtgcctaccgactccagagtgagtgtaagaagactctgccgggtgacccagggtcccccaccgacgtccagctggtgacacaacaggtgattcagtgcgcatacgacattgcaaaagcagcaaaacagctggtgacaatcaccacgaaagagaacaacaattag

SEQ ID NO: 22943 - DNA, 2046 bp, Artificial Sequence
  Description of Artificial Sequence: Synthetic coding sequence
atgagcaagagactgaggtcgtccgaggtttgcgcggactgttccggacccgatccaagctgggcgagtgtgaaccggggtacatttctgtgcgacgagtgttgctccgttcatcggagcctgggcaggcacatttcgcaggtgaggcatttgaagcacactccgtggccccctacgctcctgcagatggtggagactctctacaacaacggtgcaaacagcatttgggaacacagcctactcgacccagccagtattatgagtggcaggaggaaggccaacccccaggacaaagtgcatccgaataaagctgagtttatccgggctaagtaccagatgcttgccttcgtgcatagactcccttgtagggatgatgactcagttactgccaaggacctctctaaacaactgcactcctcggtccgcacaggtaacctggagacttgcctgcgcctgctttcgttgggcgctcaggccaatttcttccaccctgagaagggcaacacccctctgcacgtcgcatccaaagctggtcagatcctccaggccgagctcctggccgtgtacggcgcagacccagggacccaggactccagcggaaagactcccgtcgattatgcccgtcaggggggtcaccacgaactggccgaacgcctggtcgaaatccagtatgagctgaccgataggcttgccttctacctctgcggtaggaagcccgatcacaagaacggccaacactttataatccctcaaatggccgatcgacgcttgagcttggatctctcggaattagccaaagctgctaagaagaagttgcagagtctgtccaatcaccttttcgaggaactggccatggatgtgtatgacgaagtggacaggcgcgagacagacgccgtctggctggctacccaaaaccattccgccctggtaactgagaccacagtcgtgcccttcttgcccgttaatcccgaatattctagcacgagaaatcaggggcgtcaaaagctggctcggtttaatgctcatgagtttgctacactggttatagacattctgagtgacgccaagcgccgacaacagggaagttccctttctggatctaaagataatgtagagctgattctgaagacaatcaacaatcagcattcagtggagtctcaggacaacgatcagcccgactacgacagcgtggcaagtgatgaggatactgatctggagaccaccgcgtctaagaccaaccggcaaaaactacaaacccttcagtcagagaattcaaacctgaggaagcaggcgaccaccaatgtgtatcaggtccagaccggctcagagtataccgatacttctaatcacagttctctaaaacgcagaccaagtgctagaggctctcggcctatgagcatgtacgaaacaggaagcgggcagaaaccgtaccttcctatgggcgaagcctctagacccgaagaatctcggatgcggctacaacccttccctgcccatgcgtctaggctggagaaacagaattctacccccgagtcagattacgataatacgcccaatgatatggagccggacggcatgggctcatctaggaagggaagacaacgaagcatggtctggcctggagatggtctggttccagatacggcggagcctcatgttgcaccctcaccaactctcccttcaactgaggacgtcatcagaaagacggaacagattaccaaaaacatccaggaattgctccgggctgcccaagagaacaaacatgattcatacatcccctgctctgagagaattcatgttgccgtgactgagatggcagcgctctttcctaagaagcccaaatccgatatggtgcgaacaagcctaaggcttctgacgtctagcgcatacaggcttcagtccgagtgtaaaaagactctgcctggtgaccccggatcaccaactgacgtccaattagttactcagcaggttatacagtgtgcttatgatatcgcaaaggcagcaaagcagctggtgactatcactactaaagaaaacaacaattag

SEQ ID NO: 22944 - DNA, 1806 bp, Artificial Sequence
  Description of Artificial Sequence: Synthetic coding sequence
atggtagaaacactttataataatggagccaattctatctgggaacacagcttgcttgatcccgcatccattatgtctggcagacggaaagcgaatccacaggacaaagtacacccaaataaggctgagttcatcagagctaaataccagatgcttgctttcgttcaccgactgccctgtcgtgatgatgactctgtaacggcaaaggacctgagcaagcagttgcatagcagtgtcaggactggcaacttagagacatgtctcaggctgttgtccttgggcgcacaggctaattttttccatcctgagaaggggaacacacctctgcatgttgcctcaaaagcgggtcagattctccaagcggagcttcttgcagtctacggcgcagaccccggtacccaagactcttcaggcaaaacgccagttgattatgccaggcagggcggtcaccacgaactcgccgaacgcctcgttgaaatacagtacgagctgaccgaccgacttgccttctatctctgtgggcgaaagcctgatcacaagaacgggcagcattttattatcccgcagatggccgacagtagcctcgacctctccgaactggcaaaagccgctaagaagaagctgcagtctctgtccaatcacttgtttgaggagcttgccatggatgtctatgacgaggtggaccggagggaaaccgacgctgtctggctcgctacccagaatcatagcgcactcgtcacagaaactacagtggtgccctttttgcccgtcaatccggaatatagttccacacgcaaccagggaaggcagaagctcgcgcgttttaatgcccacgagttcgcaacactggttatcgatatattgagtgacgctaagcgccgacagcaggggtcctcactttccggctctaaagacaatgtggaactgattttaaagacgataaacaaccagcacagtgtcgaatcacaggacaacgaccagcccgactacgattctgtcgccagtgatgaggacaccgatttggaaacaaccgctagcaagaccaacagacagaaaagcttggattctgatctgtccgacggccctgtcacagttcaagaatttatggaagttaagaatgccctagttgcgtccgaggctaagatccagcagctgatgaaagtcaataataacctctctgacgaactgaggataatgcagaaaaagctgcagactctgcaaagtgaaaattcaaatctgcgcaagcaggccacaacaaacgtgtaccaggtccaaacagggagcgaatatacggacacatccaaccacagcagcctgaaacggcgaccgtccgcacgtggatcccggcctatgtcaatgtacgagacaggctctggtcaaaaaccttacctgccgatgggggaagctagcagacccgaagaaagccgaatgcgactccaacctttccctgctcacgccagcaggctggagaagcaaaactctacgcctgagagtgactacgataacactcctaatgacatggaacctgatgggatgggaagcagcagaaaggggagacagagatccatggtgtggccaggtgacggcttggtacctgatacagctgaaccccatgtcgcaccctctcctaccctcccttcaacagaagacgtaatacgtaaaacagagcagataacaaaaaatatccaagagctgctgcgggctgcgcaagagaacaagcatgactcttacattccgtgcagtgaaagaattcacgtggctgtcaccgaaatggccgcactttttcccaaggagacgcaggtgtag

SEQ ID NO: 22945 - DNA, 1416 bp, Artificial Sequence
  Description of Artificial Sequence: Synthetic coding sequence
atgagcaagaggctccgctcttccgaggtatgtgcagactgcagcggaccagacccctcctgggcatccgtcaatcgcggaactttcctgtgcgacgagtgctgtagtgtacaccggagcttgggaagacacatcagtcaggtccgccatctgaaacacacaccctggccacccaccctcctacagatggtggagaccttgtacaacaatggcgcaaattcaatatgggagcactctcttcttgaccccgctagcatcatgagcgggcgtcgtaaggctaatccccaggacaaggtgcatccaaataaagcagagttcatccgcgcaaaataccagatgctcgcatttgtgcacagactgccttgcagggatgacgactccgtgacagcaaaagatttatctaaacagttacatagctcggtgaggacaggaaacctcgagacttgcctcaggttgctgagcctgggcgctcaggcaaattttttccatcctgagaaaggaaatacacctctgcatgtggcctcaaaggccggtcagattctgcaggctgagctgctcgcagtttatggtgctgatccaggcacgcaggatagcagtggaaagacacctgtggattatgctcgacaaggaggacatcacgagctggctgagcggcttgttgagattcaatacgagctgactgatcggctagctttctatttatgtgggagaaagcccgatcacaaaaacgggcagcacttcatcatcccccaaatggcggacagtagtctggatttgtccgaacttgccaaggctgccaaaaagaagttgcagtccttatccaatcacctgtttgaagagttagcaatggatgtatatgacgaggtagaccgcagggaaaccgacgctgtttggctggctacacagaaccactccgcactcgtgacagaaactaccgtcgtcccttttctccccgttaatccagagtattctagcacgcggaaccaggggagacagaagctggctcggttcaatgctcacgaattcgcgactctcgttatcgacatcctttccgacgctaaaaggagacagcagggaagtagcctatctggaagcaaggacaacgtggagttaattctaaagacaatcaacaaccaacacagcgttgaatctcaagacaatgaccagcctgactacgattccgtggcgagcgacgaagacaccgatctcgagactaccgcatctaagacaaatcgtcagaagagcttggattctgacttaagcgacggccctgttaccgttcaggagttcatggaggtgaaaaatgcattagtggcgagtgaggcgaaaatccagcaactcatgaaagtgaataataatctatcagacgaactaaggatcatgcagaaaaagctgctgggcaaagacgcgaattag

SEQ ID NO: 22946 - DNA, 1896 bp, Artificial Sequence
  Description of Artificial Sequence: Synthetic coding sequence
atgtcgaagaggttgcgctctagcgaggtctgtgcagattgtagcgggcctgacccgtcatgggctagcgtgaatcgaggaaccttcttatgcgacgagtgctgttctgttcataggagcctgggcagacacatatctcaggtccgacatttgaagcacacaccttggcctcctacactgctgcaaatggtggagacactttacaacaacggggctaatagcatatgggagcatagcttgttagaccctgcgtcaattatgtccgggagaaggaaagccaatccacaggacaaggtgcacccaaacaaggccgagttcatcagagctaagtaccagatgctggccttcgttcaccggctcccctgcagagacgacgattccgtgacagccaaagatctgtccaaacagctccactccagtgtgcggaccggaaatctggaaacttgtttacgactactgtcgctgggcgctcaagctaatttctttcaccccgagaagggtaatacccccctccacgtggcgtctaaggccggacagattctacaggccgagttgcttgccgtgtatggggctgatcctggcacgcaggattcatctggtaagactccggtcgattacgcaagacagggcggacatcatgaattggccgagaggctcgttgaaatccagtatgagctcaccgataggctggctttctacttgtgcggccgtaagcccgatcacaagaatggccaacacttcattattccgcagatggccgatagctcgcttgacctctccgaactcgccaaagcagccaaaaagaaactccaatcactgagtaatcacctgtttgaggagctcgccatggacgtgtatgatgaggtggacaggagggagactgatgcagtttggctggctacgcagaaccatagtgcactagttacagaaacgaccgtcgtaccattcctgcccgttaatcctgaatatagcagcacccggaatcagggaagacaaaaactcgcgaggttcaacgcacacgagttcgccaccctggtgatcgacatcttgagtgatgctaagaggcgacagcagggctctagtctgtccggctcaaaagacaatgtagagctgatcctcaagaccattaataaccagcacagtgtggaatcccaggacaatgatcagccagactatgattcagtggcatccgacgaggacactgacctcgagacaacagcctctaagaccaatagacaaaagagcctcgactcagacctttcggatggccctgtcactgttcaggagtttatggaagtgaaaaacgcactcgttgcgtcagaagcaaagattcagcagctcatgaaagcttctcggctggagaagcagaatagcacccccgaatcagactatgacaatactcctaatgacatggaaccggacgggatgggcagttcccggaaaggaagacagcgctcaatggtttggcccggagatggactggtgccggatacagccgaaccacacgttgcccctagtccaacccttccaagtacggaggacgtgattagaaagacagaacagatcaccaagaatattcaagaactcctgcgcgctgcccaggaaaacaagcacgacagttacatcccttgcagcgagaggatccacgtggcggtcacagaaatggctgctctctttccgaagaagccaaagtcggacatggttcgcacatccttgagactcttgacgagttctgcctaccgcctgcagtccgaatgtaagaaaactctgccaggagaccccggatcgcccactgacgttcagctagtgacgcagcaggttatacagtgtgcgtatgacatagcgaaagccgctaaacagcttgtgacaatcaccacaaaagaaaacaataattag

SEQ ID NO: 22947 - DNA, 1233 bp, Artificial Sequence
  Description of Artificial Sequence: Synthetic coding sequence
atgtctttggttgatctcggcaaacggctattagaggccgcacgtaaaggccaagacgatgaagtgcggactctgatggcaaatggggctccattcaccacggattggctgggaacttctccgttacacttggccgcacagtacgggcattactcgacagcggaggtgctcttacgtgctggcgtctcaagagacgctcggaccaaggttgaccgaacacccctgcacatggccgctgccgacgggcacgcccacatcgttgagctgcttgtcaggaatggtgctgacgtcaacgctaaagacatgctgaaaatgacagctttgcactgggccacagagagacaccaccgcgatgtggttgaactcctcatcaagtatggagcggacgtccatgcctttagcaagtttgataagtccgcgttcgacattgccttggaaaaaaataacgctgagatactggtcattcttcaggaggcaatgcaaaaccaggtcaacgttaaccccgagcgagcaaatccggttactgatccagtgagcatggccgctccattcattttcacatccggcgaggtggtgaacctcgcctcactaatctcaagtacaaatacaaaaaccacctcagccaacacagaggaaataattgagggaaattccgtggacagttctatccagcaggtgatggggtctggaggtcagagggtgattaccattgttactgacggcgtccccttgggaaacatccaaacctcaataccaacaggtggtataggccagccattcatcgtgacagtccaagacggtcagcaagtcttaaccgtacccgctggcaaggtcgccgaggaaaccgtgatcaaggaagaggaagaagagaaactcccactaactaagaaacctcgcatcggggagaagacaaattcagtggaagaaagtaaggaaggcaatgagcgcgaactcctgcagcagcagctacaggaagcgaaccgaagagcacaagaataccgtcatcagcttctgaaaaaggaacaggaggctgagcagtatagattgaaactagaggcaatagcccgacagcagcccaacggagtggatttcactatggtggaggaggtggcggaagtcgacgccgtggtggtgaccgaaggagagctggaggaacgtgagaccaaggtgaccgggagcgccggaactaccgaaccccatacacgggtgtctatggctacagtgtcctcctag

SEQ ID NO: 22948 - DNA, 1233 bp, Artificial Sequence
  Description of Artificial Sequence: Synthetic coding sequence
atgtcactggtcgacctgggcaagcgcctgctcgaggcagctcgtaaaggccaagatgacgaggtgagaactctgatggccaacggcgcacccttcacaaccgattggctcgggaccagtcctcttcacctggctgcccagtatggacattactctaccgccgaggttttgctacgggcaggggtgtcacgagacgcccgtaccaaagtagaccggactcctctacacatggcagccgcagatggacacgctcacatagtcgaactccttgttcggaacggagccgatgtcaatgccaaggatatgctgaaaatgacagccctgcactgggctaccgaacgacatcaccgtgatgtcgtagaactgctcattaagtacggagccgacgtccatgcattctcgaaattcgacaagtctgccttcgatatagctcttgaaaagaacaacgctgaaatcctggttatcctgcaggaagccatgcagaaccaggtgaatgttaacccagagagagcaaatcccgtgaccgaccccgttagtatggccgcacccttcatcttcaccagtggcgaggttgttaatctggcaagtctcattagcagcactaataccaaaaccacaagcgccaacacagaggagattatcgagggcaattcggtagactctagcatccagcaggtcatgggatctggtggtcagcgcgtgatcactattgtgaccgatggggtgcccctcggcaacatccagaccagcattccgactggaggcatcggacagccatttattgttaccgttcaagacggccagcaggtcctcacagtgcctgctggtaaggtcgcagaggaaacagtgatcaaggaagaggaggaggagaagctccccctgacaaagaagccacggatcggcgaaaaaaccaatagcgtcgaggaaagtaaggagggcaacgagagagagctcctgcagcaacagcttcaggaggcaaatcgaagggcccaggagtacagacaccagcttctcaagaaggaacaggaagcagagcagtataggctaaaactcgaggccatcgcccgacaacagccaaacggggtggattttactatggttgaggaagtggccgaggtagacgccgtggtggtgaccgaaggtgagttggaggagcgggaaactaaggtaactggatctgccggtaccaccgaaccacatacccgcgtgagcatggccacggttagttcatag

SEQ ID NO: 22949 - DNA, 1347 bp, Artificial Sequence
  Description of Artificial Sequence: Synthetic coding sequence
atgtccctagtcgacttgggaaaaagactgctggaggccgcacgaaaagggcaggacgacgaggtccgcacgttgatggcgaatggggctccttttacaactgattggctggggactagccccctccaccttgccgctcagtacggtcactactccaccgcagaagttctgcttagggctggagtttcccgagatgcacggacaaaggtcgacagaacccctttgcatatggctgccgcagacgggcatgctcacattgtagagttactggtcagaaatggggctgacgtgaacgctaaagacatgttgaagatgacagcgttacactgggcgacggagagacatcaccgcgatgtagtggaactcctgatcaaatacggagctgatgtacacgcctttagtaagtttgataaatctgccttcgacatagcactcgaaaaaaacaacgctgaaattctggtaattctacaggaggctatgcaaaatcaagtcaacgtcaatcccgagagggccaatcccgtaacggatcctgtcagcatggcggcaccattcattttcacaagcggcgaagtggtgaacctggcgtctctgatcagctccactaataccaagaccaccagtggcgacccccacgcttccaccgtgcagttctcgaacagtactacgtctgtattagctacgcttgccgcactcgcagaggccagtgtgcctctgtctaatagccaccgtgccaccgctaatacagaagaaattatcgagggtaacagcgtcgattccagtatacaacaagttatggggtcaggtggccagagggtcatcacaattgtcaccgacggtgtgcccctaggaaatatacagactagcatccccacagggggtatcggccagccgttcattgtgaccgttcaggacggtcagcaagttttaacagtccccgcaggtaaagttgccgaggagactgtcattaaagaagaagaggaagagaaactacctctgactaagaagcctcggattggtgaaaagaccaattccgtggaggagagcaaggagggaaatgagagggagctgctgcagcagcagttgcaggaggccaacagaagggcccaggagtaccgccaccaactgctgaaaaaagagcaggaggcagaacaatacagacttaagctggaagccattgcacgccagcagcctaatggcgtggatttcactatggttgaagaggtcgccgaggttgatgctgtggtagtaacggagggggagctggaggaacgcgagaccaaagtcacgggaagcgcagggacaacagaacctcacacacgggtgtcaatggccaccgtctcttcctag

SEQ ID NO: 22950 - DNA, 1188 bp, Artificial Sequence
  Description of Artificial Sequence: Synthetic coding sequence
atgtcgctcgtggatctgggtaagagactcttggaagccgcacgcaaagggcaggatgacgaggtgaggacacttatggctaacggggcaccattcacaacggattggttcagcaagctgagagtttcctgtggctacataggcgacaactgtaagttaggcaccagcccgctgcacctggccgcacagtacgggcactacagcacagctgaggtacttctccgcgctggagtctctagggacgcacggacaaaagtggaccgaaccccgctgcacatggctgctgcagacggccacgcacatatcgtggaactcctggtgagaaatggagcggacgtcaacgcaaaggatatgttgaaaatgacagcattgcattgggcaactgaacgacaccaccgtgacgtggtagaactcctgattaaatatggggcagacgtgcatgccttttcaaaatttgataaatcagccttcgacattgctcttgagaaaaacaatgcggagattttagtgatcttgcaggaagctatgcagaatcaggtgaacgtgaatcccgaacgcgcaaatcctgtgaccgacccagtgtccatggcagcaccatttattttcaccagtggagaggtggtcaatctcgcctctctgatttcctccaccaacaccaaaacaactagcggtgatccccacgctagcacggtgcagttcagtaactcgactacctccgtgttggctaccctagcagccttggcagaggcttcagtacctctgagcaactctcatagggcgaccgccaacaccgaggagacggtcattaaagaggaagaggaagagaaattgccacttactaagaagccaagaataggcgagaagacaaactctgtggaggaatccaaggaagggaatgagcgcgaactactccagcagcagcttcaggaagcaaatcggagagcccaggaataccggcaccagctgctcaagaaagaacaggaggctgagcagtaccgtctgaagttggaggcaattgctagacagcagcccaatggcgtggacttcacaatggttgaagaggttgccgaggtagacgccgtggtcgtgaccgaaggagaactggaggagcgagagacaaaggttactgggtctgcagggacaacagaaccacacacccgagtgtctatggccaccgtctccagctag

SEQ ID NO: 22951 - DNA, 1827 bp, Artificial Sequence
  Description of Artificial Sequence: Synthetic coding sequence
atgacggaggaggcctgccgcacgcgatcacaaaaaagagctctggagcgggacccaaccgaggacgatgtcgagtctaagaaaatcaaaatggagcgcggacttttggctagcgatttgaataccgacggggatatgagggtcaccccagagcctggtgctggccctacacaggggcttttacgagccactgaagctaccgcgatggccatgggtaggggcgaagggctggttggtgacggaccagttgacatgcggacctcccattccgatatgaaaagtgaaaggcggcctccaagtcccgacgtgattgtattgtctgataacgaacagccaagctccccccgtgtgaatggcctgaccacggtagcccttaaagagacatccaccgaggccctgatgaaaagctctccagaagaaagagagagaatgattaaacaactaaaggaggagctgcgcctggaagaggccaaactcgtcttgctgaaaaaactgagacagagtcagattcagaaagaagccactgcccaaaaaccaactggaagtgtaggttccactgtgactaccccacccccattggtccggggaacacagaacataccagctggtaaaccttctctgcagacaagttctgccagaatgccgggaagcgtgatcccaccaccccttgttcgcggtggccaacaagccagcagcaaactgggtcctcaggcttcaagccaggtagtgatgccgcctctggtgagaggcgcacagcaaatccattctatccggcagcacagtagcaccggaccaccccctctgttactcgctcctcgagcttcagtccccagtgtacaaattcagggccagcggatcatccagcaggggttaattagggtggccaacgtccccaatacgagcctcttagtcaacatccctcagcccacaccagcctcattgaagggcactacggccacttcagcccaagctaactcgacccccacatcagtggcatcagtcgtgaccagcgccgaatcgcctgcatcacgccaagcagcagcgaagctggctcttcggaaacagcttgaaaagaccctgctggaaatccccccaccaaagcctccagctcccgaaatgaactttctaccttccgctgccaacaacgagtttatttacttggtgggcttggaagaagtggtccagaatctgctcgagacacagggcagaatgtccgctgctactgtgctgtcccgagagccttacatgtgcgcccagtgtaaaacggacttcacatgtaggtggcgggaggaaaagtcaggggctataatgtgcgaaaattgtatgaccacaaatcagaagaaagctctcaaagtggaacacacttcgaggttgaaagccgctttcgtgaaagccctccaacaagagcaggaaatcgaacagcgcctgctccagcaaggaacagccccagcccaggcaaaggccgagcctacagccgctcctcaccctgttctgaagcaggcaagcagccagctgagtagagggtcagccactactcctcgtggggtgttgcacacatttagcccctctcctaaactgcagaacagtgcctccgccactgcccttgttagtcggactggccgacattccgaacggacggtatctgctggaaaagggagcgccacctctaattggaagaaaactccattgagcacgggaggtacccttgcattcgtctccccatctctggcggtccataaaagctcctcggccgtggatagacagagagagtacctactcgacatgatccccccacgctctattcctcagtctgctacctggaagtag

SEQ ID NO: 22952 - DNA, 1902 bp, Artificial Sequence
  Description of Artificial Sequence: Synthetic coding sequence
atgactgaagaggcatgtcggaccaggtcccagaagagagcacttgagagggatcctacagaagatgacgtggaaagcaaaaagattaagatggaaagaggactgctggcaagtgacctgaataccgacggagacatgagagtgacccccgaaccgggtgccggtccaacacagggcctgctgagggccactgaggctaccgccatggcgatggggagaggagaaggtctcgttggcgacgggccagtcgacatgagaacgagccatagcgacatgaagagcgagcgcaggcccccttcccccgacgtgattgtgcttagtgataacgagcaacccagcagtccccgagtcaatgggttgacaactgtcgcgttaaaggagaccagcaccgaggctttgatgaaaagctcccctgaggaaagggaacggatgatcaaacagctgaaggaggaactccgactagaggaagcaaaacttgtgctgctcaagaagttaagacaaagccaaattcagaaagaggcaacagcccaaaaacctacagggtcggttggctcaaccgtgacaacgccgccacccctcgtgcggggtacccagaatatcccagctggcaagccatcgctacagaccagttcagcccgtatgccagggtcagtaatcccacccccactcgttcgaggcggacaacaggcatcttcgaagctgggccctcaggcctcctcccaggtcgtgatgccccctcttgtccgcggagcacagcagatacactctatcaggcaacattcatcaacagggcctccccctctcctgctcgcaccacgtgcctctgtcccgagtgtgcagattcaggggcagagaatcatccaacagggccttatacgggtggccaatgtcccaaacacctcactgctcgtcaacatcccccaaccaacaccagcctcattgaagggaaccacagccactagcgcccaggccaattctactccaacctctgtcgcaagcgtggtcactagcgcagagtctcccgcaagccgacaagccgctgctaagcttgcccttcggaaacagttggagaaaacgttactggaaataccccctcccaagccgccagctcccgaaatgaatttcctgcccagcgccgctaacaacgaatttatctatctggtcggcctggaagaggtggtccaaaacctgctagaaacccagggtaggatgagcgccgctaccgtattatctcgggagccatacatgtgtgcccagtgtaagactgacttcacttgtagatggcgggaagagaagagcggagcgatcatgtgtgagaattgcatgacgaccaatcaaaagaaggccctaaaagtggagcatacaagcagactcaaggctgctttcgttaaggctctccaacaagagcaggaaatagagcaaagactcctgcaacagggaaccgcccctgcccaggcaaaggctgaacccactgccgcacctcatcctgtgctcaaacaagtgatcaaacctcgcaggaagttagcattccgcagcggagaggcacgtgactggtctaatggcgctgtgctccaagcctcctcacagctgagcaggggatccgccaccactccgaggggtgtgttgcacacgtttagcccttctccaaaactgcagaatagcgctagcgcgactgccctggtctcaaggacgggtcgacacagcgaaagaaccgttagcgcaggtaagggcagcgccacatcaaattggaaaaaaaccccactctcaaccggaggcacccttgcctttgtcagtccaagcctggccgtccataagagttcatcagcagtggatagacaacgggagtatcttttggacatgatacctcctagaagcatcccccagtcggcgacctggaaatag

SEQ ID NO: 22953 - DNA, 1902 bp, Artificial Sequence
  Description of Artificial Sequence: Synthetic coding sequence
atgaccgaagaggcgtgtagaacacgatctcagaaacgagccctagagagagatcctactgaagatgacgtggaatccaaaaagattaagatggaaagggggctgctggcgtccgacctgaataccgacggtgacatgcgggtaacaccggaaccgggtgccggaccaacccagggcctgctcagggctacagaggcaacggccatggccatgggaagaggagagggactcgtgggtgacggccctgtagatatgcgaacatcccacagcgatatgaaaagcgagcggaggcctccctcccctgacgtcatagtactctcagataacgaacagcccagcagtcccagggtcaacggactaaccactgtggccttgaaggaaacttctaccgaggccctgatgaaatcctcacctgaagagcgggagcggatgattaagcagctgaaggaggaactgaggttggaggaggccaaactggtgttgctgaagaaactcagacaaagtcagattcagaaagaggccacggcccagaaacctaccgggtccgtgggctcgacagtcacaactcccccaccgctagtgagggggacgcagaacattccagcaggcaagccaagcctgcagacttctagcgcacggatgcctggttctgtaatccctccacctctggtccgcggtggccaacaagcgagctctaaactagggcctcaggcttcaagccaggttgtgatgccacccttagtgcgcggtgctcagcaaattcacagcattaggcagcacagctccaccggccctcctccccttctgcttgcccctcgggcatctgtcccttccgtgcaaattcaggggcagcgaataatccaacaggggctaatcagagttgccaatgttcctaatacctctctgctggtaaatatcccccagcccacacctgcttctttaaaaggcacaacagctacttccgcacaggcaaactctacccctacgtccgtggcttcagtggtaacctctgctgaaagtcctgcatctcgacaggcagccgctaagctcgctctgcgaaagcagctggagaaaactctgcttgaaatccctccgccaaagccccctgcccctgaaatgaacttcctgccaagcgcagccaataacgagtttatatacctagtgggacttgaggaggtggttcaaaacttactggaaacacaagggagaatgagcgcggctaccgtgctgtcacgcgagccttatatgtgtgcacagtgcaaaaccgacttcacatgccgttggcgtgaggaaaagagcggtgctattatgtgtgagaactgtatgactacgaatcaaaagaaagctctgaaagtcgaacatacctcccggctgaaagcggcatttgtgaaagcattgcaacaggagcaggaaatagagcaacggcttctgcagcaagggactgcccctgcacaggccaaagctgaacctactgctgctccccatccagttctcaaacaggtgatcaaaccaagaaggaaattagcatttcggtccggagaggcgagggattggagcaacggggcagtcctccaggcctcatcacagctgagcagaggatccgccacaacaccgaggggggtgctacacacattctcacctagccccaagctgcagaattcagctagtgccactgcgcttgttagcagaacgggcagacactcagagagaactgtgtctgcgggaaaggggagtgccacaagtaactggaaaaagaccccactgtccaccgggggtacactagcatttgtctccccttctctggccgtgcataagtcaagctcagcggtagatagacagagagaataccttctggatatgatcccccctaggagcatccctcagagcgcaacatggaagtag

SEQ ID NO: 22954 - DNA, 534 bp, Artificial Sequence
  Description of Artificial Sequence: Synthetic coding sequence
atgacagaggaagcatgccgcactcgatcccagaaacgcgctctggagcgtgaccccacggaggatgacgtagagtctaaaaaaattaagatggaaaggggcctgctcgctagtgatctgaacaccgacggagacatgcgggtgactccggagcctggcgctgggcctactcagggactgctgagagcaaccgaagccaccgccatggctatgggccgaggcgaggggctggtgggcgatggaccggtggatatgcggacatcccacagtgacatgaagtccgaacgccgacccccttctcctgatgtgatagtcctcagtgataatgaacaaccttcgtcaccaagggtgaatggactgaccacagtggcactcaaggagacctcaacagaggccctgatgaaaagctcccccgaagaacgggaaaggatgatcaagcagcttaaagaagagcttcggctagaggaggctaagcttgttctgctgaaaaaactacgccagtcacagatccagaaggaagcgaccgctcagtag

SEQ ID NO: 22955 - DNA, 381 bp, Artificial Sequence
  Description of Artificial Sequence: Synthetic coding sequence
atgacagaggaggcctgtagaactcgcagccagaaaagggccctcgagagggatcccactgaagacgacgtggagtcaaaaaagatcaagatggaaagagggctccttgccagcgatctgaatactgacggcgacatgagagttacccccgaacctggagccggaccaacgcagggcctgctgcgcgcaaccgaagcgacggcaatggcaatgggacgaggtgagggtttggtgggcgacggccctgtcgacatgcgcacaagtcattctgacatgaagtctgagcgcaggcccccttccccagatgtgattgtgctctctgacaatgagcagccaagttctccacgggtgaacggtctaaccacagtagccctgaaatag

SEQ ID NO: 22956 - DNA, 1311 bp, Artificial Sequence
  Description of Artificial Sequence: Synthetic coding sequence
atgatcaagcagctgaaagaagagttgaggctcgaggaggccaaactcgtattgttgaagaagttgaggcagagccagattcaaaaggaagccaccgctcagaaaacgagttcagcccgaatgccaggtagcgtgattcccccaccactagtccggggaggacagcaggccagttccaaactgggtccccaggcttcttctcaagtggttatgccacctttggtgcggggagcgcagcagattcattcgatccgacagcacagtagcaccggtccccctcctttgcttctggcacctagagccagtgtacctagcgtgcagatccaggggcagcgtattattcagcaggggttgatacgggtggccaacgtgcctaataccagcctgctggtgaacatcccccagccaacccctgcatccctgaaggggaccacagcaacttcggcacaagcaaatagtactccgacctccgttgccagcgttgtcacaagcgcagaaagtcccgcatcccgacaggcagcagccaaactggccctcagaaagcagcttgagaagactctgctggaaattcccccaccgaagcctcctgcccctgagatgaacttcctcccttcagccgctaacaacgagttcatttacctcgtcggcttagaagaggtcgtccagaatttgctggagacgcaggcaggcagaatgtccgccgctacagtgctgtcccgggagccctatatgtgcgcacaatgtaagacagactttacctgcagatggcgggaagaaaaaagcggagctattatgtgcgaaaattgcatgacgaccaaccaaaagaaggcattgaaagtcgaacacaccagtcgcctcaaagctgctttcgtcaaggccctgcagcaggaacaagaaatcgagcagaggctgttgcaacaaggaactgcacccgctcaagccaaggccgagccgaccgccgctcctcaccctgtccttaaacaggcatcatcacaactcagccgaggctcagccacaacacctaggggggtgctgcacaccttttccccttccccgaaactgcagaacagcgcttctgctactgccctggtgtcacggacgggaaggcacagcgagcggaccgtgtccgctggaaaaggctcagcaactagcaattggaaaaagaccccccttagtacgggtgggacgctggctttcgtcagtccctccctcgctgtacacaaaagttcgtccgccgttgacaggcagcgcgaatatctgttggacatgatcccaccgaggtccattccccagagtgccacgtggaagtag

SEQ ID NO: 22957 - DNA, 420 bp, Artificial Sequence
  Description of Artificial Sequence: Synthetic coding sequence
atgacggaggaagcttgcaggacgaggtcccagaagagggctctggagcgagacccaaccgaggacgatgtggagtcaaagaaaatcaaaatggagcggggattgctcgctagcgacctgaatacagatggcgacatgcgcgtcacgcccgaaccgggagctggacctacccagggcctgctgagggctacagaggcaactgcgatggctatggggagaggcgagggactagtgggggacgggcctgtagatatgagaactagccacagcgacatgaagtccgaacgacggcctccatcaccggatgttatcgtcctaagcgataacgaacagcccagctcaccgagagtcaatgggctgaccacggtcgccctaaaagagacaagcactgaggccttaatgaagagctcccctgaatag

SEQ ID NO: 22958 - DNA, 282 bp, Artificial Sequence
  Description of Artificial Sequence: Synthetic coding sequence
atgacggaagaggcctgtaggacacgcagtcagaaacgtgcattggagcgagatcccacggaggatgacgtcgaaagcaagaaaatcaaaatggaaagaggactcctcgcttccgatctcaacaccgatggagatatgcgggtgacgccagaacccggagccggaccgactcagggactcttgcgcgcaacggaagccaccgctatggctatgggtaggggggagggattggtgggagacgggcctgtggacatgcgcaccagtcattcagacatgaaatag

SEQ ID NO: 22959 - DNA, 57 bp, Artificial Sequence
  Description of Artificial Sequence: Synthetic coding sequence
atgtcactttggccctggccaaccggaagaactagtacaccctatccagaagcttag

SEQ ID NO: 22960 - DNA, 507 bp, Artificial Sequence
  Description of Artificial Sequence: Synthetic coding sequence
atgaccgaggaagcatgcaggacacggagccaaaagagggctttagaacgggacccaacagaggatgatgtggaaagcaagaagattaagatggagcgcggattactggcgtcggatctgaataccgacggcgatatgagagttacccccgagccaggcgctgggccaacacagggcctgctcagagcgaccgaggccacagctatggccatgggcagaggcgagggactggtgggcgatggccctgtcgacatgaggacaagccattccgacatgaagagtgagaggaggccgcctagccccgatgtaattgtgctgtccgataacgagcaaccttcaagtccaagggtcaatggtttgactacagtggccctgaaagaaacatctacagaagccctcatgaaatcctctcccgaagaacgggagaggatgatcaagcagttgaaggaagagctaagactcgaggaggctaagctggtgctgctcaagaaactgagacagtcctag

SEQ ID NO: 22961 - DNA, 789 bp, Artificial Sequence
  Description of Artificial Sequence: Synthetic coding sequence
atgaacttcttgccatccgcagccaacaacgagttcatctacctcgtggggctagaggaggtcgtgcagaacctgcttgagacccaggcgggtcgtatgtctgcagctacggtcctaagtcgcgagccttacatgtgcgcccagtgcaagacggatttcacttgtaggtggcgggaagagaagtcaggagccataatgtgcgaaaattgcatgacaaccaatcagaagaaggctctgaaggttgaacatacatctcgcctcaaagcggcttttgtgaaggctctgcagcaggaacaggaaatcgagcaaagactactgcagcagggtacagccccagcccaagctaaagccgagcctacagcggcacctcacccagttctgaagcaggtcattaagccacgacgcaagttagcattccggtcgggtgaggccagggactggtcgaacggcgcagtgctacaggcctcttcccaactgtccaggggctcagctaccacacctcgaggagtattacacaccttttcaccgtctcccaaactgcagaactcagcctctgcaacagccttggtgtctcgcaccgggcgtcacagtgaacggaccgtcagtgccggaaagggctccgctacgtctaactggaaaaagaccccactgtccacgggaggcaccctggccttcgtcagccccagcttggctgtacataaaagttcatccgcggtcgatcgtcaacgtgaatatctattggatatgatcccgccacggagcataccccagagcgccacctggaaatag

SEQ ID NO: 22962 - DNA, 1782 bp, Artificial Sequence
  Description of Artificial Sequence: Synthetic coding sequence
atggacagaatgacagaggatgcactgcggctgaaccttcttaagcgctccttggacccagcagatgagcgtgatgacgtattggcaaagaggctcaaaatggagggtcatgaggccatggagcggttgaagatgttagctttactcaagcggaaagatttagcaaatttggaagtgccccacgaacttcctaccaagcaggacggatcaggcgtcaagggttatgaggaaaaactaaatggcaacttaagaccgcacggggacaacagaaccgcaggtcgacctggaaaggaaaatatcaatgacgagcctgttgacatgagtgcaagacgatcggaaccagagcgaggcagactgacacctagtccagatattattgtgctgtccgacaatgaggccagctcaccgcgtagttcaagtcggatggaggagcggctgaaggctgctaatctggaaatgtttaaaggaaagggcattgaagagcgtcaacaacttattaaacagcttcgtgatgaactccgattggaggaggcacgactggtgctcctgaagaagctacgccagtcacagttacagaaagagaatgtggttcaaaaaaccccagtcgtccagaatgcggcttcaattgtgcagccgagccccgctcatgtaggccaacaaggcctgagcaaactgcctagcaggccaggagcccagggggtggaacctcaaaatctgcggacgcttcagggccactccgttatcagatccgcgaccaataccactctgccccatatgttgatgtcgcaaagagtcatcgcaccaaaccccgctcagctgcagggtcaacgcggaccaccaaaacccggattggtgcggaccacaactcccaatatgaatcccgcaatcaattatcagccccagagcagctcgagtgttccttgtcagagaaccacttcgtcagcaatttacatgaaccttgcgagccacatccagcctggaactgtcaaccgcgtgtcttcacctctcccatctccaagcgctatgactgacgctgctaacagccaagctgccgcaaagcttgcactgaggaagcagctcgaaaagaccctgctggagatccccccacccaagccgcctgctcccttgttgcacttcctgccttccgcagcaaactctgagtttatttatatggtggggctcgaagaggtggttcaaagtgtgatagactcccagggaaagtcctgtgctagtctgcttagggtggagcccttcgtgtgtgcacaatgcaggaccgattttacccctcactggaagcaagaaaagaatgggaagatcctatgcgagcagtgcatgacctctaaccagaagaaagccctaaaggctgaacacactaacaggctgaagaatgcctttgtgaaagccttgcagcaggaacaggagattgagcaacgactccaacaacaggcagcacttagtccaacaactgcaccggcagtctcgtccgtaagtaagcaggagaccattatgcggcaccatactctgagacaagccccacaaccccaatcgtccctacagcgcggtatccccacttccgcgcgaagcatgctttctaattttgcccaggcccctcaattatccgttcccggtggtctattgggaatgccaggggtaaacattgcttacctgaatacaggcatagggggacacaagggacctagcttggcggatcggcagcgtgaatacctccttgacatgatcccgccaaggtctattagtcagtctatctccggacagaagtag

SEQ ID NO: 22963 - DNA, 1425 bp, Artificial Sequence
  Description of Artificial Sequence: Synthetic coding sequence
atggcacagcatgattttgtcccggcttggcttaacttttcaacgccccagtcagccaaatcacccactgccacgtttgaaaagcatggcgagcacctccctcgcggtgagggacgctttggggtctccagaaggcgccataactcatcagacggattcttcaataacgggcctctccgcactgccggagattcctggcatcagccctcattatttcgtcatgatagcgttgatagcggcgtgtctaagggggcttacgctggaatcactggaaaccctagcggatggcacagctcatctcggggtcatgatggcatgagtcaacggtcggggggtggaacaggcaaccatcggcattggaatgggtccttccacagcagaaagggctgcgccttccaagaaaaacctcccatggaaatcagggaagaaaaaaaagaagacaaggtggaaaagttacagtttgaggaagaagatttccccagcctaaaccctgaagctggaaagcagcaccaaccttgcagacccatcggcaccccctccggcgtgtgggagaatcctcctagtgctaagcaaccaagtaaaatgctggtcataaagaaggtctctaaagaggatccagccgctgcgttttcggctgcgttcacctctcccggatcccaccacgctaatggcaacaagctatccagcgtcgtgcctagcgtgtataagaatctcgtgcccaagcctgtgccaccgccttccaagcccaacgcctggaaggctaaccgcatggagcacaaatccggttccctatccagttctagagagtcagctttcacgtcccccattagcgtgaccaagcccgttgttcttgcttccggagcagcattatcctctccaaaagagagccctagcagcaccactccccctattgaaatcagttcgtcccggctgaccaagttgacaaggcgcacgacggatagaaagagtgaatttctgaaaacgctgaaggacgaccggaacggcgacttttcagagaatagagactgtgacaaactggaagatctcgaggataattccacgcctgaaccaaaggaaaacggcgaagagggatgtcaccaaaatggcctggcactgcctgtggttgaggagggggaagtgttatcgcactcgctagaggctgagcatcgccttctgaaagccatgggatggcaagaatatcctgagaacgacgaaaattgcttaccacttactgaggacgaactaaaggagttccacatgaaaaccgaacagctgagaaggaacgggttcggcaaaaacgggttccttcaatcacgcagctcttcgcttttttcaccatggaggtcaacttgtaaggccgagtttgaggattccgacacagagacttcaagtagcgaaacctccgatgatgatgcctggaaatag

SEQ ID NO: 22964 - DNA, 1425 bp, Artificial Sequence
  Description of Artificial Sequence: Synthetic coding sequence
atggcgcaacacgattttgtcccagcatggctgaacttctcaacacctcaatcagcgaaatcccctactgctaccttcgaaaagcacggagagcatttgcccaggggagagggccgtttcggggtctcgcgccgacgacacaactcatccgacggtttctttaacaacggaccactccgtactgctggcgactcatggcaccagccatccctcttcaggcacgactctgtggattcgggagtgagcaaaggagcttacgccggaatcaccggcaacccgagcggttggcattccagttctcgcggacatgacgggatgtcccagcggtcggggggagggaccggaaaccatcgccactggaacgggtcctttcactccagaaaagggtgcgcgttccaggaaaagccccctatggagatacgggaggagaagaaagaagacaaagtggagaagctgcagtttgaggaagaagactttccctctctcaaccccgaagcaggtaagcagcaccagccctgccggccaatcggcaccccatcaggagtctgggaaaacccaccaagcgcgaaacagccatctaaaatgctggtgatcaaaaaagtgtctaaagaggacccagccgcagcgttcagtgccgcattcacgagccctggttcccatcatgccaatggaaataaattgagcagcgtcgtacccagcgtatataagaatctagtgcccaaaccagtcccccctccgtctaaaccaaacgcatggaaggctaacagaatggaacacaaatctggtagtctctcttcttcccgggagagtgcctttacttctccaatctccgtgacgaagcccgtggtccttgccagtggtgccgctctgagcagccctaaggaatcacccagcagcacaactcctccaatcgagatttccagctctagattaacaaagctgacgagacggactacagatcgaaagtctgagttcctgaagaccctgaaagacgaccgcaacggagatttcagcgaaaatcgagactgcgacaagctggaagacttggaggataacagtaccccagagcccaaagagaatggagaggaagggtgccatcagaatgggctcgcgcttccagtggttgaggaaggcgaggtattgtcccactcactcgaagcagagcacagactgctgaaagcaatggggtggcaagaataccccgagaacgacgaaaattgtctccctttgaccgaagacgagctaaaagagttccatatgaaaactgaacaactgaggcggaatgggtttggcaagaacggattcctccagagcagatccagcagtctgttcagtccttggagatcgacgtgtaaggccgaatttgaggactctgacacagagacaagttctagcgaaacttcggacgacgatgcatggaagtag

SEQ ID NO: 22965 - DNA, 2448 bp, Artificial Sequence
  Description of Artificial Sequence: Synthetic coding sequence
atgttcagaaaggcccgtagagttaatgtcaggaagcgcaacgacagcgaggaagaggaaagagagagggatgaagaacaggagccaccacctctcctaccgccaccagggacaggcgaggaggccggtcctgggggtggcgacagagccccagggggtgagtctctgctggggccaggccctagcccaccatcagcgttaacaccgggtcttggtgctgaggctgggggaggctttccaggaggcgctgagccgggtaacggtctcaaacccaggaagcgccctagagaaaataaagaggtgcctcgagcctctctgctgagcttccaggacgaggaggaggagaatgaggaggtctttaaggtgaaaaaaagttcctacagcaagaaaatcgtaaagctcttaaagaaagagtacaaggaggatttggagaaaagcaaaatcaaaactgaactaaattcgtcagcagagtccgaacagcccctcgataaaacaggacatgtgaaagacaccaatcaggaagatggagtgataatttctgagcacggcgaagacgagatggacatggagagcgagaaggaggaagagaaacccaaaaccggaggcgctttcagtaacgcgctgagctccctgaatgtgctgcgacctggggagatccctgacgccgctttcatccacgcggctaggaagaagagacagatggccagggaattgggtgatttcacaccccacgacaacgaaccaggaaagggaaggttggtccgcgaggatgagaacgacgccagtgacgatgaggatgacgacgaaaaaaggcggattgtttttagcgtgaaggagaaaagtcagcggcagaagatcgcggaagaaataggcattgaaggatctgatgacgatgctttggtgactggagagcaggatgaggagctgtcccgttgggagcaggaacagatcagaaaaggaatcaacatacctcaggtccaggcttcccagccagcggaggttaacatgtattatcaaaacacataccagacaatgccttatggttcctcgtatggaatcccctattcatacacagcctacgggtcgtcagatgcaaagtctcaaaaaaccgataatactgtgcccttcaagaccccctcaaacgagatgactccagtgacaatcgatttagtgaaaaagcagctgaaagatcggctggatagcatgaaggaattgcacaaaaccaacaggcagcaacatgagaagcatttgcagtcaagagtggatagcacaagagccatcgaacggctggagggcagttcaggaggcattggggagcgctataagttcctacaggagatgaggggatacgttcaggatctgctcgaatgtttctccgaaaaggtgccgttgatcaatgagttggagtccgcaattcaccaattatataagcagcgagcgagccgactcgtacagaggcggcaagatgatatcaaagacgagtcctccgagttttccagccactcaaacaaagccctgatggcacccaacctggacagctttggccgagatcgcgctttgtatcaggagcacgcaaagcgcagaatcgcggagcgcgaggccaggagaactcgtcgacggcaggcacgggaacagactggcaaaatggctgaccacctggagggactgagttcagacgacgaagagacgagcactgacatcaccaattttaatctcgagaaagaccggatctccaaggagtccggaaaggtattcgaggatgtgcttgagagcttttattctatcgactgcataaaatcacagttcgaagcatggagaagcaaatattatacctcttacaaggacgcctacattggcctctgcctgcctaaactgtttaatcctctgatcaggctgcagcttctgacgtggactcctctggaagcgaaatgtagggattttgaaaacatgctctggttcgagtctctgttgttctacgggtgtgaagagagagaacaggagaaagatgacgtggatgtcgcactcctccccaccatagtggaaaaggttatcctgccgaagcttactgtgattgccgaaaatatgtgggacccattctcaaccacacaaacaagtagaatggttgggatcacattgaaactgattaatggatatccatccgtggttaatgccgagaacaagaatactcaggtatatctgaaggccttgctgctaaggatgcgcaggaccctggatgacgacgtgtttatgcccctttatcccaaaaatgtgctcgagaataaaaattctgggccatacctgttctttcagaggcagttttggtcctccgtgaaagtaatcaaaccccctttccagaggggaagctgcccaatccccaggagaaaagaatgctgcagcgagagaccccgaagaatctggacggatagaccttgcgtcgttttttcttag

SEQ ID NO: 22966 - DNA, 2754 bp, Artificial Sequence
  Description of Artificial Sequence: Synthetic coding sequence
atgttccggaaggctcgacgcgttaacgtgcgcaaacggaacgacagcgaggaggaggagagggagagggatgaggagcaggagcctcctcctttgcttccgcctcccggaactggtgaggaggctggacctgggggaggagacagggcacctgggggtgagtctctcttagggcctggaccctcacctccaagcgccctgacccctggcttaggtgccgaggctggcggtgggttcccaggcggagcggagccaggcaacggccttaaacccagaaagaggccacgtgaaaacaaagaggtgcctcgtgcatctctgctgtcctttcaagatgaggaggaagaaaatgaggaagttttcaaagttaagaagagtagctatagcaagaagattgtaaaactgctgaaaaaggagtacaaggaggaccttgagaagtctaagatcaagacagagttgaactcatccgccgagtctgagcaacccttggacaagaccggacacgtgaaggataccaaccaggaagacggcgtgatcatctccgaacatggcgaggatgaaatggacatggagtccgagaaggaagaagagaaaccaaagacgggcggtgcctttagcaatgctttatcaagtctgaatgtgcttagacctggagaaatcccggacgcggctttcatacacgccgctcgcaaaaagagacagatggctcgggaattgggtgactttacccctcacgacaatgaacccggtaaggggagattagttagagaggacgagaatgatgcttctgatgacgaggatgacgacgaaaaaaggcgcatcgtgttctctgtgaaggagaagagtcagcggcagaagattgccgaagagatcggtatagagggctccgacgatgacgccctggtcacgggcgagcaggacgaagaactgtcacgctgggaacaggagcagatcagaaaggggatcaatatcccacaagtacaggccagccagcctgcagaggtcaatatgtattaccaaaacacttatcaaaccatgccttacggaagcagctatgggatcccatattcatacaccgcctatggaagctcagacgccaagtctcagaagaccgataacaccgtaccgtttaaaacgccctcaaacgagatgaccccagtgactatcgacctggtcaagaaacagctgaaggatcgcctggattccatgaaggagttacataagactaatcggcagcaacacgaaaagcacctgcagtcccgcgtggacagcactcgcgcaatcgagcggttggagggctcctcaggcggaataggcgaacgctacaaatttcttcaggagatgcgaggctacgtccaggacctgcttgaatgcttcagcgaaaaggttccccttatcaacgaactggagtctgctattcatcagctctacaagcagagagcatcaagactcgtccagcggcgacaggatgacatcaaggatgagtcttcagaattctctagtcactccaataaggccttaatggccccaaacctcgactcgtttggtagggatagagccctttatcaggaacatgccaaaaggaggatagcagaacgggaggcacgcaggacccggcgtcggcaggcaagggagcagactggaaaaatggccgaccatcttgaagggctgagcagtgatgatgaggaaacgtcaactgacattactaactttaatcttgagaaggacaggatcagtaaggagtcgggaaaagtgttcgaagacgtgctcgaaagcttttatagtatagactgtattaagtctcaatttgaggcctggcggagcaaatactatacctcctataaggacgcttacatcggcctctgtttacctaagctgttcaatccacttatccggttacagctcctcacttggacacccctggaggcaaagtgtagagattttgaaaatatgctttggttcgagtcattgctgttttatgggtgtgaagagagagaacaggaaaaagacgatgtggatgttgcattgctacccacaatcgtcgagaaggttattttaccaaagttgaccgtcattgcagaaaacatgtgggaccccttctcaactacccagacatcacgtatggtgggtatcaccttgaaactaattaacggatacccttccgtagtgaacgccgagaacaagaatacccaggtttacctgaaagcactgctgcttcgcatgcgccgaactctggatgacgatgtgttcatgccgctctaccccaagaacgttcttgagaataagaattcggggccttatctgtttttccaacgtcagttttggtctagcgttaaattgctggggaacttcctgcagtggtacggtatcttctctaacaagactctccaggaactgtcaattgatggtctgttgaaccggtatattctgatggcattccaaaacagcgaatatggtgatgactctattaagaaagcccagaatgtgattaactgtttcccgaaacagtggtttatgaacctgaaaggcgagagaactattagccaactggagaatttttgccggtacctcgttcaccttgcagacacgatataccgaaatagcattggatgctcagacgtggaaaagaggaacgccagagagaacattaagcagattgtaaagcttctggcttctgtcagagcccttgatcatgccatgtcagtggcctcggatcacaacgtcaaagagttcaagagcctaatcgaaggtaagtag

SEQ ID NO: 22967 - DNA, 2346 bp, Artificial Sequence
  Description of Artificial Sequence: Synthetic coding sequence
atggcacataggccaaagaggacgtttcgtcaacgggctgcagattcctctgacagtgatggagcagaagagagtcctgctgagcccggagcccctcgagaactgcccgttcctggatcagcagaagaggagcccccaagtggaggcggaagagcccaggtggctggtctgccccatcgtgtccgcggacctcgcggtaggggcagagtgtgggcaagcagtaggagagcaacaaaagccgctccacgcgctgacgagggctccgagtctagaacgcttgatgtgtccaccgacgaggaggacaagattcatcacagtagcgagtctaaggacgaccaaggcctcagttcggatagcagtagcagcctgggcgagaaggagctttctagcacagtgaagatcccagacgccgcatttatccaagccgcacgtaggaaacgcgagttggctcgcgctcaagatgactacatttccctcgatgtgcagcatacctccagtatttccgggatgaagcgagagagtgaggatgaccccgaatcagagcccgatgaccacgagaaaagaatcccattcacactgagaccacagaccctgcggcagcggatggccgaggaatccatctctaggaatgaagagaccagcgaagaatctcaggaagatgagaaacaagacacctgggaacagcagcagatgaggaaagctgttaagattatagaagagcgtgacatcgatctgtcttgtggtaacggcagttcgaaagtgaaaaaattcgacaccagtatttcctttccacccgtgaatctggagataatcaaaaagcaactgaacaccaggcttacccttctgcaggagacacataggagccatcttagagagtacgagaagtatgtgcaggacgtcaaaagctccaagtccacaatccagaatctcgagtcaagctcaaatcaagccctgaactgtaagttttacaaatctatgaagatctacgtggagaatctgatcgactgtctgaatgaaaaaattattaatatccaagagattgagtcttcaatgcacgctctgctgttgaaacaggcgatgaccttcatgaagaggaggcaggacgagctaaagcatgaatcaacgtacctccagcagcttagtagaaaagacgagaccagcacatcgggaaacttttccgtggacgaaaaaacacaatggatactcgaagaaatcgagtcgcggagaacaaagaggagacaggctcgcgtcctgagtggtaactgcaaccaccaagaaggaacctctagcgacgatgagcttccaagtgccgagatgatcgatttccagaaatctcagggagatatccttcagaagcagaagaaggtgtttgaagaggtacaggatgatttctgtaacatccagaatattctcctgaagtttcagcagtggcgggaaaaattcccggattcctactacgaggctttcattagtttatgcattcctaaactcctgaatccactgattagagtgcagctcatcgattggaacccgctcaaactagagtccaccgggctaaaagagatgccctggtttaaaagtgttgaggagttcatggatagcagtgtcgaagactcaaagaaagaaagttcatctgacaagaaagtacttagcgcgattatcaacaagactatcataccccgactgaccgacttcgtcgaatttctatgggatcccttaagcaccagccaaacaacctccctcattactcattgtagagtgattctggaggagcacagcacatgcgaaaacgaggtaagcaagagtaggcaggacctactgaagtctatcgtcagtagaatgaagaaggcagtggaggatgacgtctttattcccctgtacccaaagtccgccgtggaaaataaaacaagcccccactcaaagtttcaggagcggcagttctggagcggcttaaagctgttccgaaacatactgctatggaacggtctgttgaccgacgataccctccaagagctcgggttaggcaaactgttgaataggtacctgattattgccctgctcaacgcaaccccaggcccagacgtcgtcaaaaagtgcaatcaagtcgctgcctgcttacctgagaagtggtttgagaacagcgccatgcgaacctccattccgcagttggagaacttcattcagttcctgctccaatccgcccataaactctccagatcagagtttcgtgatgaggtggaggagatcatcctgattctcgtcaaaattaaagctctcaatcaagccgaaagtttcatcggggaacaccacttggaccacctcaaatctctgatcaaggaagactag

SEQ ID NO: 22968 - DNA, 2232 bp, Artificial Sequence
  Description of Artificial Sequence: Synthetic coding sequence
atggcacatcggccaaaacggactttccgccagcgagcagcagattcatcggattccgacggcgcagaggagtcccctgcggagcccggagctcccagagagttacccgtcccaggctcagcagaagaagaacccccttcaggcggtggtcgggctcaagtagctggtttgcctcatcgtgtgaggggccctcgaggtagagggagagtgtgggcctcatccaggagagccactaaagccgctcccagggcggatgaaggttccgagtctcgaacgctggacgtcagtacagacgaggaagacaaaatccaccattcatcggagagcaaagacgatcaaggtctgagtagtgacagttctagctccctcggcgagaaagagctgtcttctaccgtaaagatcccagatgcggcttttattcaagcagccagaagaaaacgcgaactggctcgggcacaggatgactatattagtctcgacgtccagcacacttcctctatctccgtgtcaagaaacgaggaaaccagtgaagagtcgcaggaggatgaaaagcaggacacgtgggagcaacagcagatgaggaaagcagtcaaaattatcgaagagcgcgacatagacctctcctgcggcaacgggtcgtctaaagttaaaaagttcgatacttcaattagtttcccgcctgtgaacttggagattataaagaagcagctgaacacacgcttaacccttcttcaagagacacataggagtcatctccgggagtacgagaaatacgtacaagatgtgaagtcatcgaaatccacaatacaaaatttggaaagttctagtaaccaggctctgaactgtaaattctataagtctatgaagatttacgtagagaacctgattgactgcctgaatgagaaaataatcaacattcaggagattgagagctctatgcatgcgctgttactcaaacaggccatgacttttatgaagagaagacaggacgagctgaagcacgagtccacatatctgcaacagctcagtcgaaaagacgagaccagcacaagcggcaatttttctgtggacgagaagactcagtggatcctggaggagatcgaatcgcgcaggacaaaacgcaggcaggccagagtcctgagcgggaactgcaaccaccaggaaggcacctcctcagatgacgagctgccgtccgcggagatgatcgattttcagaagtcccagggtgatatcttgcagaaacagaagaaggtctttgaagaggtgcaggatgatttctgtaacattcagaatattctactaaagtttcaacaatggagagaaaaattccccgacagttattacgaggcctttatatctctctgcatccccaagcttctcaaccccttaattcgtgtgcagctcatagactggaacccactcaagctagaatctactggtctgaaggagatgccttggtttaaatctgtggaggaattcatggacagttctgtcgaggactccaagaaagaaagctcttccgataaaaaagtgctgtcagcaataattaacaagaccatcataccaagacttaccgattttgtagagtttctctgggaccctctcagcacatctcagacgaccagcttaatcacacattgtagggtcatcctagaggagcattctacctgtgagaacgaggtctccaaatcaaggcaggatctgttgaaatcaatagtgtctcgaatgaagaaggccgtcgaggacgacgtctttatccctctgtaccctaaaagtgccgtagagaataaaacctctccgcattctaaattccaggaacggcagttctggtcaggtctgaagttgttcagaaatattctgctctggaacgggttgttgacagatgacacactccaggagcttggcctcggaaagctcctgaacaggtatctcatcatcgcactcctgaatgcaactcccggacccgacgtggttaaaaaatgcaaccaggtagctgcatgcctcccagagaaatggtttgagaatagcgccatgcgcactagtattccccagcttgaaaatttcattcagtttctgctacagagtgcccacaaactcagccggtccgagtttagggacgaggtggaagagattatcctgatccttgtcaaaatcaaggccctaaaccaagcggagtcttttatcggcgaacatcatctggatcatctcaaaagtctgatcaaagaggactag

SEQ ID NO: 22969 - DNA, 765 bp, Artificial Sequence
  Description of Artificial Sequence: Synthetic coding sequence
atggctcaccgaccaaaacgcacatttcgccagcgtgccgcagattcttcagactctgatggggcagaagaaagccctgcggaacccggagctccgcgagagctgccagtgcccggatcggcagaggaagagcccccttccggcggaggcagagctcaagttgcgggactaccgcaccgcgtgcgtggccctcggggaagggggagggtctgggcctccagccgacgtgccaccaaggctgctccaagagctgacgagggatccgagtcgcgaacgcttgatgtctccacggatgaagaagataagattcaccattcaagcgagagtaaagatgatcaggggttatcgtctgacagtagctcctctcttggcgagaaggagctgtctagcactgtaaagatcccggatgccgcattcattcaggccgctcggaggaaacgcgaactcgccagggcccaggatgactacatcagcctggatgtgcagcacacatccagtatttctgggatgaagagagagtccgaagacgacccagagagcgagcccgatgaccatgagaaacgaatcccttttaccctgaggccccaaacactgagacagcgaatggctgaagaatctatctcacggaatgaggaaacaagcgaggaatctcaggaggacgagaagcaagatacttgggagcaacagcagatgcgcaaggcagtgaagatcatcgagattaatatcactactggaaattcaccactaaccccggaaggcgtttag

SEQ ID NO: 22970 - DNA, 504 bp, Artificial Sequence
  Description of Artificial Sequence: Synthetic coding sequence
atgtccgaatggatgaagaagggccctctcgaatggcaagattacatttataaggaagtacgtgtgactgctagtgagaagaatgaatataagggttgggtcttgaccaccgatcctgtctccgcgaatatagtactggtcaacttcctcgaggatgggagcatgagcgtcaccggtatcatgggacacgccgtccaaacagtcgagactatgaatgaaggggatcatcgagtgcgggaaaaactcatgcacctgttcacatctggagattgcaaggcctactcacctgaagatctcgaggagagaaaaaattccctgaaaaaatggctcgagaagaaccatattcctattaccgagcagggagacgctccacgaactctctgcgtggccggagtgttgactatcgatccgccatacggtccagagaattgctcttcgtctaatgaaattatcctgtcacgcgttcaggatctgatcgagggtcatctcaccgcgtctcagtag

SEQ ID NO: 22971 - DNA, 336 bp, Artificial Sequence
  Description of Artificial Sequence: Synthetic coding sequence
atgtctgaatggatgaaaaaggggccactggagtggcaggactacatctataaggaggtcagggtaacagctagcgagaagaacgagtataaagggtgggtgctgacaactgacccagtaagcgctaaagtgttactgtcacctcgactggaatgcagcggagaaatctctgccctttgtaaccttcatctggccggttcatcagactcaccagctctggcaagcagagtggctggtactacaggtatatgccatcacgtctggttgatattcgtgtttttcgtcgagaccggactgagacacgtagcccagtattgtccatgcgaactgccttag

SEQ ID NO: 22972 - DNA, 330 bp, Artificial Sequence
  Description of Artificial Sequence: Synthetic coding sequence
atggcatatcagctgtacaggaatactactttgggcaactctctccaggagtcactagatgagctgatccaaagtcagcagattacaccgcagctcgccctgcaagtactgctgcagtttgacaaagctattaatgccgcacttgcccaacgcgtcaggaaccgtgtaaatttcagaggctcccttaacacttaccggttctgcgacaacgtctggaccttcgtcctgaacgacgtcgaatttcgagaagtaactgaactgatcaaggtggacaaagttaaaatcgtggcctgtgatgggaaaaacacaggctctaacactactgagtag

SEQ ID NO: 22973 - DNA, 330 bp, Artificial Sequence
  Description of Artificial Sequence: Synthetic coding sequence
atggcttatcagctttaccgcaacacgaccctgggtaactctttacaggagtcgttggacgaactgattcagtctcagcaaatcactccccagctcgcgttgcaggttcttctgcaattcgacaaggctattaatgcagcactggctcaacgcgtgcgtaatcgtgttaattttcggggatctctgaatacatatcgcttttgtgataacgtgtggacattcgtgctcaatgacgttgagttcagagaggtgaccgaattaataaaggttgataaggtgaagatagttgcatgcgatgggaagaacacagggtcaaacactaccgagtag

SEQ ID NO: 22974 - DNA, 330 bp, Artificial Sequence
  Description of Artificial Sequence: Synthetic coding sequence
atggcctaccagctttaccgcaatactaccctgggaaacagtctacaagaaagcctggacgaactaatacagtcccaacagatcacacctcagctggcactccaggttttgctgcaattcgataaggcaataaacgcagcgttggcccagcgcgtgaggaatagagtgaactttcgcggatctctgaacacataccggttttgcgataatgtctggacgttcgttttaaacgatgttgagttcagggaggtgaccgagttaatcaaagtggacaaggtcaagatagttgcttgtgatgggaagaacactgggagcaatacaaccgagtag

SEQ ID NO: 22975 - DNA, 1320 bp, Artificial Sequence
  Description of Artificial Sequence: Synthetic coding sequence
atggctgatcccgacgtgctcaccgaagttcctgccgctttgaagcgattggccaaatacgttattcgaggcttctacgggatagagcacgctctagctctagacatcttaattcgaaattcttgcgtgaaggaggaagacatgctcgagttgctcaagtttgatcggaagcagctgaggagtgtgttgaacaatctcaaaggagacaaattcatcaaatgtcgtatgcgcgtggaaacggcagcggatggaaagacaactaggcacaactactactttattaattaccgcacattggtaaatgtagtcaaatacaaactggaccacatgcgcagacgcattgaaacagatgagcgcgattcaactaatcgggcatcctttaaatgtcctgtgtgtagctctaccttcaccgacctggaggccaatcagctgtttgatcccatgacaggaacatttcgttgtactttttgccacactgaagtggaggaggacgagagcgccatgcccaagaaagatgctcggaccctgctggccaggtttaatgagcaaattgaacctatttacgcactgcttcgcgagaccgaggatgtgaacctggcatacgaaatcctggaaccggagccaaccgaaattcctgccctgaaacagagcaaagatcacgctgcaaccacggccggagcggcatcgcttgccggtgggcatcacagagaagcttgggcgacaaaaggcccttcttatgaggacttgtatacacaaaatgtggtgatcaacatggatgatcaggaagacctccaccgcgcatctctggagggaaagagcgctaaggagcggccaatttggctcagagaaagcaccgtgcagggagcctacggcagtgaggatatgaaggagggaggtatcgatatggacgctttccaagagagagaggagggccacgcgggtcctgatgacaacgaagaagttatgcgtgccctgttaatccatgagaaaaaaacctcatctgctatggcgggttcagtcggggcagctgcccctgtgacagccgcaaacggctccgactcagaatccgagacgagcgagagcgatgacgacagtccacctcggcctgctgcagtggccgttcacaagcgggaagaggatgaggaggaggacgacgaatttgaggaggttgcagacgaccctatcgtgatggtggccggaagacccttttcctatagtgaggtctctcaacggcctgagttggttgcccagatgacaccagaagagaaggaggcttatatcgcaatggggcagcggatgttcgaagatttgtttgagtag

SEQ ID NO: 22976 - DNA, 150 bp, Artificial Sequence
  Description of Artificial Sequence: Synthetic coding sequence
atggccgatcctgatgttcttacagaggtccctgctgccctcaagaggcttgccaaatatgtgattaggggattttacggcatcgaacacgcactggctttggatatcctgatacgcaactcctgcgtaaaggaggaggacatgctttag

SEQ ID NO: 22977 - DNA, 369 bp, Artificial Sequence
  Description of Artificial Sequence: Synthetic coding sequence
atggccgaccctgatgtgctgacggaggttccagccgctctgaagcgtctggcgaagtatgttatacgcggattttacggaattgaacacgctttggctctcgatatcctgattaggaattcctgcgtcaaggaagaggacatgctggagcttctaaagttcgacaggaagcagctgcggtcagtgctcaacaacctgaagggcgataaattcataaaatgtagaatgcgggtggagacagctgctgacggaaagactacccgacacaattactacttcatcaattacagaacgttggttaacgtggtaaagtataaactggatcacatgcgacgaagaattgagaccgatgagcgcgattcaacttag

SEQ ID NO: 22978 - DNA, 1188 bp, Artificial Sequence
  Description of Artificial Sequence: Synthetic coding sequence
atggacgaagagcccgagcgcaccaagagatgggaagggggatacgagcggacttgggagatactcaaagaagacgagagcggaagcctcaaagctaccatcgaggacattctgttcaaggctaagcgaaagagagtgtttgaacatcacggccaggtcagacttgggatgatgagacatctgtacgtggtagtagatggttctagaaccatggaggaccaggatctgaaacccaatcgcttaacttgtactctcaagctcctagagtattttgtggaagaatactttgatcagaaccccataagccaaatcggaataatcgttacaaaatctaagagggcagaaaagttgactgaactaagcgggaatccacgcaagcatattacctccctgaaagaggctgtggacatgacttgccacggtgagcccagcctgtataattcactgtcaatggctatgcagactctcaaacatatgccagggcacactagccgagaagtcctgatcatattttcctccttgacaacctgcgacccctcgaatatatatgacttaatcaagacccttaaggccgctaaaatccgtgtttccgttatcgggctgagcgcagaggtgcgggtgtgtacagtgcttgctagagagactggcggtacctatcacgtgatcctcgatgagagtcactacaaagaactgctcacgcatcacctctccccaccccctgcctcgtcaagtagcgaatgctccctcattaggatgggcttccctcaacacacaatcgcgagtctgagcgatcaggacgcaaagccatccttcagcatggcacaccttgatggaaacacagaaccaggactgacactggggggttatttctgtccacagtgtagggccaaatactgcgagctgccggtggagtgcaaaatctgtggtctgactctcgtttcagccccacatctggccagaagctaccaccacctgttccccctcgacgcatttcaggaaatccccctggaagaatacaacggggaaagattctgttatggttgccaaggagaactgaaagaccaacatgtgtatgtatgtgctgtctgtcaaaatgtgttctgcgtggattgtgacgttttcgtgcatgatagtcttcattgctgccccggatgcattcataaaatccctgccccaagcggtgtgtag

SEQ ID NO: 22979 - DNA, 1017 bp, Artificial Sequence
  Description of Artificial Sequence: Synthetic coding sequence
atgagacacctttatgttgtcgtggatggttctaggacaatggaggaccaggatcttaagccgaatcggttgacttgcactctgaagctcctcgagtacttcgtcgaggaatacttcgatcagaatcctatatcccagattggcatcatcgtgacaaagagcaaaagggccgaaaagctgacagagctgagcgggaatccccgaaagcacatcacatcgctcaaagaggcagttgacatgacttgtcatggagagccctccctttataactcactgtccatggctatgcagaccttgaagcatatgcctggccacacgtcgcgggaggtgctcattatcttctcctcattaaccacttgcgatccctccaatatatatgatttgattaagaccctgaaagctgccaaaatccgcgtgtcggtcataggactttctgccgaggtgcgtgtgtgcacagttctcgctagggaaaccggcggaacctatcatgtcattctagacgaaagccattacaaggagctactgacccaccacctctccccaccaccagcttccagctccagtgagtgctcccttatcagaatgggattccctcaacacactattgcgtctctatctgatcaggacgccaagccgtccttttctatggcccatttggatggtaatacagagcccggtttgaccctgggtggatacttttgccctcagtgcagagcaaagtactgcgagctccctgtagaatgcaaaatttgcggccttaccttagtctccgccccacacctcgcccgtagctatcatcacttattccctctcgacgccttccaagaaatccctctggaggagtacaatggcgagaggttctgctatgggtgccagggagaactgaaggaccagcatgtatacgtctgcgcggtgtgtcaaaacgtgttctgcgtcgactgcgacgttttcgtccatgattcactacattgctgtccaggatgcattcacaaaataccggcacctagtggggtctag

SEQ ID NO: 22980 - DNA, 1188 bp, Artificial Sequence
  Description of Artificial Sequence: Synthetic coding sequence
atggacgaggagcccgagcgcaccaaacgatgggaaggcggatatgaacgaacatgggagattctgaaggaagacgagtctggcagcctcaaggctacaattgaggacattttgttcaaagcaaagcgaaagcgggttttcgaacaccacggccaagtccgtctcggcatgatgagacatttatacgtggtggtcgacgggtcacgcaccatggaggaccaagatttaaagccaaataggctgacttgcacactgaaactattggagtatttcgtcgaagaatatttcgaccagaatccgataagccagatcggcatcatagtaacaaagagcaagagagcagagaaattgaccgagctctcaggtaatcctagaaagcacatcaccagcctgaaagaagctgtcgatatgacatgccatggggaaccctcgttatacaattcactgagtatggccatgcagacactgaaacatatgcccggacatacttcccgagaggttcttattatctttagctctttgactacgtgtgatccgtcgaatatctacgacctgataaagacactcaaagccgcaaaaattagggtgtcagtgatagggctttcggccgaagtgagggtttgcaccgtgctcgcgagagagactggtggtacgtaccatgttatcctggacgagtcccactataaggaacttctcacacaccacctctcaccaccccctgccagcagctccagtgagtgcagcctgatacgtatgggctttccccaacacacaatcgcgtctttgagcgatcaggacgccaagccatctttctctatggcccacctcgatgggaacaccgagcccggtctgactctcggcggatacttttgcccacagtgccgagcaaaatattgtgaattgcctgtggagtgtaagatttgtgggttaacactggtgagtgcccctcacctcgcccgtagctatcaccacttgtttcctctggacgcttttcaggagatacccctggaggaatacaatggagagcggttctgctacgggtgccagggtgagctgaaggaccagcacgtgtacgtttgtgccgtctgccagaacgtgttctgcgtcgattgcgacgtgtttgtacacgactcgctgcattgttgccctggatgtatccacaagatccctgctccttcaggggtgtag

SEQ ID NO: 22981 - DNA, 606 bp, Artificial Sequence
  Description of Artificial Sequence: Synthetic coding sequence
atgacagaaaaggctccagaaccccacgtggaggaagatgacgacgatgaattggactcaaagctcaactacaagcctccaccgcagaagagcttgaaggaactccaggagatggacaaggatgatgaatccctgattaaatataaaaagacgcttctgggcgacggacctgtggttaccgaccccaaggctcctaatgtggtagtcacgcgccttactttagtttgcgagagcgcaccgggacccatcaccatggacctcaccggggacctggaagccctgaagaaggaaactatagtgctgaaggagggaagcgagtaccgcgtgaagatccacttcaaagtcaatagggacattgtctccggcctcaagtatgtccaacatacatacagaacaggggtgaaagtggataaggccaccttcatggttgggtcctacgggccacgcccagaagagtacgagtttcttacgccagttgaagaggcacccaaaggaatgctggcacgcggaacctaccacaataaaagcttcttcacagatgatgataaacaagatcatctcagctgggaatggaacttaagcatcaaaaaggagtggacggagtag

SEQ ID NO: 22982 - DNA, 777 bp, Artificial Sequence
  Description of Artificial Sequence: Synthetic coding sequence
atgaatcggagcaacaagttggctgtgatcgccagccacattcaggagtcgcggttcctgtatcccggtaaaaatggacgcctcggtgatttctttggcgatccaggcaacccgccagaatttaaccctagcgggtcaaaagacggaaagtacgaattgctcacatccgcaaatgaggtaattgtagaggagattaaagatttgatgaccaaatctgatatcaaaggacagcataccgagactctcctcgcgggatcgcttgcgaaggccctttgttatattcacaggatgaataaagaggtcaaagataaccaggagatgaaatcacggattctggtgatcaaagctgccgaagactcggctctgcagtatatgaacttcatgaatgtgatcttcgccgcacagaaacagaacatcttgatagacgcatgtgttctggacagtgactccggtctgctccagcaggcctgcgatattacaggagggctctatctaaaggttcctcagatgccgtctctgcttcaatacctgttatgggtattcctgcccgaccaggaccaaagatctcagttgatactgcctcccccagtacacgtcgattacagggccgcttgcttctgccatagaaacttgatagagatcggctacgtgtgtagcgtctgcctctcaattttttgcaacttcagcccaatatgcaccacctgtgagacggcctttaagatctccttgccgccagtacttaaggccaaaaaaaagaagcttaaggtgtctgcgtag

SEQ ID NO: 22983 - DNA, 927 bp, Artificial Sequence
  Description of Artificial Sequence: Synthetic coding sequence
atggtcagcgatgaagatgaattaaacctgctcgtcatcgtcgtggatgccaaccccatctggtggggcaagcaagccctgaaagaatcccagttcacattgtccaagtgcatcgacgcggtgatggtgctgggaaattcccatttatttatgaaccgctcaaacaaactggccgtgattgcatcacacatccaggagagccgatttttgtatcccggtaaaaacggacgactgggcgacttctttggcgatcccggaaatccccctgagtttaacccgtccggctccaaggacgggaagtatgagctgctaactagtgcaaacgaagttattgtggaggagattaaagatctaatgaccaagagtgacatcaaggggcagcataccgaaacgctccttgccggaagcctggctaaggcattgtgttacatacaccgtatgaacaaggaagtgaaggacaaccaggagatgaaaagtcgtatccttgtgatcaaggccgctgaagattctgccctgcagtatatgaattttatgaacgtcatcttcgctgctcagaaacagaatattctgatcgacgcatgtgtactggactccgactcagggctcctgcagcaggcatgcgatatcactgggggactgtacctgaaagtccctcagatgcccagtttgctgcagtatctcctttgggtattcttgcccgaccaagaccagcggtctcagctgatcctgcctccaccagtgcatgtcgactacagagcagcgtgtttttgtcaccgaaatctgatcgaaattggttatgtctgctccgtgtgtctaagcatcttttgtaacttttctcctatctgcactacatgcgagacggcattcaagattagtttaccacccgtgctgaaagccaaaaaaaagaagctcaaggtaagcgcctag

SEQ ID NO: 22984 - DNA, 6330 bp, Artificial Sequence
  Description of Artificial Sequence: Synthetic coding sequence
atggacgctctagagtctctgctagacgaggtggctctggagggcctagacggcttatgtctcccggcactctggtctagattagaaactcgtgtgcctccatttcccttgccactggagccctgtacacaggaattcctgtggcgggctttagctactcaccctggcatctctttttatgaagagccacgcgaacgccctgacctacaattgcaggaccgatacgaggaaatagatcttgagactggaatcctcgaaagcagaagggaccccgtggccttggaggatgtttacccaattcatatgattctcgaaaacaaagacggcatccagggatcatgtagatattttaaggaaagaaaaaacattacaaacgacatcagaacaaagtctctgcagccgaggtgtactatggtggaggccttcgacagatggggcaaaaaattgattattgtcgcatcgcaggcaatgagataccgagccctgatcggtcaggagggagatccagatttaaaactacctgacttcagctattgcattctcgagaggctcggacggtcccgttggcagggcgagctgcagcgcgatttgcacacgacagcatttaaagtcgatgccggaaaattgcactaccatcgtaagatcctcaacaaaaacggtttaattacaatgcagtctcatgtcattagactgcccacaggtgcacagcagcattcaatcttgctcctgctcaatcgttttcacgtcgatcgaaggtctaaatacgatatcttaatggaaaaattgtctgttatgttatcgacaaggactaatcatattgagacccttggcaagcttagggaggagcttggcctctgtgagcgtacctttaagcggctgtatcagtacatgctgaatgccggactggcaaaggtggtgagtctgaggctgcaggaaatccaccctgagtgtggaccttgtaagacgaagaaaggtacggacgtaatggtcagatgcctcaagctgctgaaggaatttaagcggaacgatcatgacgatgacgaagacgaggaagtgatctccaaaactgtgcctccggttgatatcgtctttgagagggatatgctgacccaaacatacgatctaattgaacgacgcggaactaagggaatttcgcaggccgagataagggtggcaatgaatgtgggaaagctggaagctcggatgctgtgcagacttctgcaacggtttaaagtcgttaaaggctttatggaagatgaaggcaggcagcgaaccactaaatatataagctgcgtcttcgccgaggagtctgacttgtcaagacagtatcagcgagaaaaagctaggtcggagctgctgaccaccgtgagcctggcgtccatgcaggaggaatccttgcttcccgaaggtgaagacacttttctatcggagtcggattcggaggaagaacgctcttccagcaaacggagggggagagggtctcagaaagacacaagagccagtgccaatctgcggcctaagacgcaaccccatcactctactccaaccaagggagggtggaaggtggtaaacctgcaccctctcaaaaagcaaccaccttctttccccggagctgcagaagaaagagcatgccagtcacttgcgagtagagattcattattggacaccagctctgtaagcgagcctaacgtatccttcgtctcccactgtgcagacagcaactctggtgatatcgctgtgattgaagaggtacgtatggaaaacccgaaggaaagctcatcttccttaaagaccggcaggcattcaagtggccaggacaagccccatgagacctataggttactaaaaaggcggaatctcataattgaggccgtgaccaatctcaggcttatcgagtccctgttcacgatccagaagatgataatggatcaggaaaaacaggagggtgtgtccacaaagtgctgcaaaaagagtatcgtaaggctggttcgcaacctgtccgaggaaggcctgcttagattgtatagaaccaccgtcatccaggacggaattaaaaagaaggttgacctggtggtgcatccttcaatggaccaaaacgatcccctggtacgcagtgctatcgaacaggtgaggttccgtatatctaattctagtaccgccaacagagtaaagacttcccagccacctgtgccacagggtgaagcagaagaggactcacagggtaaggaaggtccttctgggtctggagactcccagctcagcgcgtcttcgaggtccgagagcggcaggatgaagaaaagtgacaacaagatgggtatcaccccattgcggaactaccaccccattgtggtgccaggactaggcaggtccttaggtttcttacctaaaatgccgagactcagagtggtgcatatgtttttatggtatctcatctacggccatcccgcttctaacaccgtggaaaaaccttccttcatttctgaaaggagaaccattaagcaggaaagtgggagggccggtgtccgaccatcaagtagcggttctgcctgggaagcctgctcagaagccccatcaaagggttcccaggacggcgttacatgggaagcagaagtagagctcgctaccgaaaccgtctatgttgatgacgcctcctggatgcgttatattccacctatacccgttcatagagactttggcttcggatgggccctggtgagcgacatcttgctttgtttgcctctcagcatcttcatccagattgtccaagtcagttacaaagtagacaatctagaagagttcctcaacgacccactcaaaaagcacacgttgattaggttcctgcctaggccaattcgccagcaactgctgtacaaacgaaggtatatatttagcgtggttgaaaacctgcaacggctttgctatatgggcctcctgcagtttggtcctaccgagaagttccaggacaaagaccaggtctttatcttcctcaaaaagaacgccgtgatcgtggacactacgatttgtgatccgcactacaatctggccagatcatccaggccatttgagcggaggttatatgtactgaatagtatgcaggacgtggagaattattggtttgatcttcaatgtgtgtgtttgaacacacccctgggggtggtccggtgcccaagagtaagaaagaactcttccacggaccaggggagtgacgaagaaggctccctccagaaagagcaggaaagcgccatggacaaacataacctagaaaggaaatgcgcaatgctggaatacaccactgggagcagagaggttgtggacgagggacttattcccggtgatggcctgggggctgcagggctggacagcagtttttacggccacctgaaacggaactggatctggaccagctacatcataaaccaggcgaaaaaggagaacacggctgcagagaacggcctgaccgtgcgtttgcaaacattcctgtccaaaaggccaatgcctctgtccgccaggggtaattccagactgaatatctggggcgaggccagagtagggtcggagctgtgcgccggttgggaagagcagttcgaagttgatagagaaccctctcttgatcgaaatcggagggtgagaggagggaaaagccagaaaaggaagaggctgaagaaggaccccggaaagaaaattaagcgcaaaaagaaaggcgaattccccggagaaaagagcaaacgacttcgctaccacgatgaagctgaccagtccgcgttgcagcgcatgacgcgcctacgggtaacttggtcaatgcaagaagatggtctcctcgtcctctgcagaattgcctccaacgtgctaaataccaaagtgaaaggacccttcgtgacctggcaggtggtccgcgatattctccacgctacgtttgaggagtcactggataaaactagtcacagtgtgggaagacgcgctcgttacattgtgaagaaccctcaggcctatctgaattacaaagtgtgtctcgctgaggtttatcaggacaaagcactggtgggtgactttatgaaccggagaggcgactacgacgaccctaaggtgtgtgccaatgaatttaaagagttcgttgagaaactcaaggaaaagtttagctcagcactacggaatagcaatctcgaaatccccgacaccctccaggaactttttgcccgttatcgtgtgctggccattggcgacgagaaggatcagacgagaaaggaagacgaactgaactcagtcgatgatattcactttttggtgctccagaatttaatccagtcgacgcttgcgttatcagatagccagatgaagagttatcagagcttccagacctttcggctgtaccgagagtacaaggaccatgtcttggtaaaagcctttatggagtgccagaagcggagcctggttaaccgtaggcgtgtaaaccatacgttgggccctaagaagaaccgtgctttgccattcgtgcccatgtcttaccagctaagccagacctactataggatctttacctggcgctttccttcgacgatctgcacagagtccttccagtttttggataggatgagagcagccggtaaactggaccaaccagatcggtttagttttaaggaccaggataacaatgagcctactaatgatatggtggcattcagtctcgatgggcctggcggaaattgcgttgcagtattaacgctcttcagcttgggcctgatttccgtggatgtgcggatccctgaacaaatcattgttgttgacagcagtatggtggagaatgaagttataaagagtctcggcaaggatggctccctcgaggacgacgaggacgaggaggatgatctggatgaaggagtgggtggaaagagacgtagtatggaagtgaaaccagcacaggcctctcatactaactatttactgatgcgcggttactactcaccgggtatcgtgtccacaaggaatttgaacccaaatgattcaatagtggtaaactcctgtcaaatgaaatttcaactccggtgcacacctgtgccagcacggcttcgcccagccgcagctccactcgaggaactgacaatgggtactagctgtctcccagacacatttactaagctgattaacccccaggaaaacacatgtagcttggaggagttcgtgctacaactggaactttccggatactcaccggaagaccttacagcagcgttggaaattctcgaagccattattgccactggatgcttcgggatcgataaagaggagctgagaagacgtttctccgctttagaaaaggcaggcggagggcgtacccgcacattcgccgactgtatccaggctctcctggagcagcatcaggtgctggaagtcggaggaaacacagccagactcgtcgccatgggttccgcatggccttggttgcttcactcagtgaggctaaaggaccgtgaagatgcagatattcagagagaagatccccaggccaggcccctggagggatcttcttctgaggacagcccaccggaggggcaagcgccaccttcccatagccccaggggaactaagaggagggccagctgggctagtgagaatggcgagactgacgcagaggggacccagatgacaccagcgaagcgccctgccctccaagatagcaacctcgccccatcattaggcccaggtgctgaagatggcgctgaagcccaggcaccttccccgccacctgcccttgaggacaccgcagcggctggagcagcccaggaggatcaagagggagtcggcgaattctcttctcccggtcaagaacaactttccgggcaagcccagcccccagaaggatcagaggatccgaggggcttcaccgagtcctttggagctgccaacattagccaggccgctcgggagcgggactgcgagtcagtgtgcttcatcggtcgcccatggcgggttgtggacgggcatctcaacttgccagtatgtaaggggatgatggaggcaatgctttatcacattatgacaaggccagggatccctgagagttcactcctgcggcactaccagggtgttctccagcccgtggccgtgttggagctgctccaagggctggaaagcctggggtgtatacgcaagaggtggctgagaaaaccacggcctgtctctctgttcagcacacctgtggtcgaggaggtggaggtccccagctctttggatgaaagccctatggcattttatgagcctaccctggactgcacgttaagattgggtcgtgtgttcccacacgaagtgaactggaataagtggattcacctatag

SEQ ID NO: 22985 - DNA, 5063 bp, Artificial Sequence
  Description of Artificial Sequence: Synthetic coding sequence
atggatgccctggaatcactgctggatgaggttgcccttgaaggcctagatggcctatgtctccctgcgctttggtcaagacttgagacacgcgtgccaccgtttccactccccctcgagccatgtacacaagagtttctgtggcgagccctggccacacaccccggtattagcttctacgaagagcctcgcgaacgacctgaccttcagctgcaggacaggtacgaggagatagacttggagacaggcatattggagagccgtcgtgatccagtagctctggaagacgtttaccccatccacatgatccttgagaataaagatgggatacagggctcttgtcggtactttaaagagcgcaagaatattaccaatgacattcggacaaaatccctgcagcctcgctgcactatggtggaggccttcgaccgctggggcaagaagctaataatttgtctgccagggcacgccgttcaagggctggaccgacctggtgggggttccaggcctgaagcagctcgtttactgctgctgcatcccggtactgctagaccggttcagcagggggagcttcagcgagatctccatactaccgcctttaaggtcgatgctggcaagctacactaccacaggaagatcctgaacaagaacggcctcattactatgcaatcccatgtgatccggttaccgacgggggctcaacaacatagcatcctactgctgctcaaccgctttcacgtggacagacgcagcaaatatgatattttgatggaaaaactgtctgtgatgctgagcaccagaactaaccacatagagactctcggtaagctgagggaggaactgggcctgtgcgagagaacattcaaaagactttatcagtacatgctgaacgctggactggcaaaagtcgtgtccttgaggttgcaggaaatacatccagagtgcggcccttgcaagaccaagaagggcaccgatgtcatggtacggtgtctgaagctcttgaaggaattcaaacgcaacgaccacgatgacgatgaggacgaggaagtgatttccaagaccgttcctcccgtggacatcgttttcgaaagggatatgctgactcagacctatgatcttatcgagcggaggggcaccaagggaattagccaggccgagatcagggtagctatgaacgtcggtaaacttgaggccagaatgttgtgtagattgcttcagaggtttaaggtagtaaaaggcttcatggaggatgagggccgtcagcgtacaaccaagtacatcagttgcgtgtttgccgaagaatcagacctaagccgtcagtaccagcgggagaaagccaggagcgagctgctaactactgtcagtctggcttctatgcaagaagagtccctgctcccagagggagaggacactttcctttctgaatctgattccgaagaggagcggtctagcagtaaacgccgaggcagggggagtcagaaagatacccgggcttccgctaatctgcgtcctaaaacccagccacatcatagtacacccactaaaggaggctggaaggtcgttaacctccacccactgaagaaacaacctccttccttccctggtgcggcagaggaaagggcttgccagtcactggcatctagagactccctgctggatacatctagtgtaagcgaaccgaacgtgtcctttgtcagccattgtgcagattctaactcaggagacattgctgtcattgaagaagtccggatggagaatccgaaagaatcctctagctccctcaaaacaggacgccactcctcaggtcaggataagccccacgagacatatagactgcttaagcgcaggaacctgatcatcgaagctgttaccaacctccgcctcatagaatccctgttcacgattcagaagatgatcatggatcaggagaagcaagaaggcgtgtccacaaagtgttgtaagaaatctattgtgcgactggtccggaatctgtccgaagagggactgctgagactgtacagaaccacagttatccaggacggaataaaaaagaaagtcgatctggtcgtgcacccctctatggatcagaatgacccacttgtcagaagcgccatcgagcaagtcagattcaggatttcaaattcgagtactgccaatcgtgtgaagacgagccagccacctgttccgcagggagaggccgaagaggacagccaggggaaggaagggccatctggttcaggagatagtcagctctccgcatccagtcgatccgaatccgggcgaatgaagaaatctgataataagatgggcatcaccccgctgcgcaactaccacccaatcgttgtgcctggtctggggcgaagtttgggatttctacctaagatgcctcgcttgcgtgtcgtgcatatgttcctctggtacctaatttacgggcatccagccagcaacactgtcgagaagccctccttcatcagcgagagacgaacaatcaagcaggagtccggtcgagccggtgttcgcccttcatctagtgggtctgcctgggaggcctgcagcgaggcaccatccaagggatctcaggatggtgtcacatgggaggccgaagtggaactggcaactgaaacagtctatgttgatgatgcatcgtggatgcgctacatcccccctatcccagtgcacagggacttcggctttggatgggccctggtctctgatatacttctctgtctacccctgtcaatatttatacagatagtccaagtgtcatataaggtcgataacttggaggagtttctaaatgatccactgaagaaacacaccttaatcagattcctacccaggcccatcagacagcaacttctgtacaagcggaggtacatcttcagcgtcgttgagaatctgcagcgcctttgctacatggggctgctgcagttcggcccaactgaaaagtttcaggataaggatcaggtgtttatctttctaaagaagaacgctgtgatagtggataccacgatctgtgatcctcattacaacttggccagatcttccagaccctttgagcgcagactctacgtcttgaattccatgcaagacgtcgaaaactattggttcgacctacagtgcgtctgtctgaacactcccttaggagtcgtccgatgccctcgtgttagaaaaaacagtagcactgatcagggctccgatgaggaaggatccctccagaaagagcaggagtcagccatggataaacacaatttggagcggaagtgtgccatgctggagtatacaacagggtctagggaggtggtggatgaggggctgataccaggtgacgggctgggagcaggtagcatccctgcatctacggacacttcgagcgctaccgggtccggcccagccacaagttcaacaaggcccaaaaggaggacattgccacagcggatggatacggttcgtttgcagacctttctttcaaagagaccaatgcctctgtcggcccgtggcaattcgcggctgaacatttggggtgaggccagagttggttcggagctgtgcgcaggctgggaggagcagtttgaggttgatcgcgagccgtctctggacagaaaccgcagggtgaggggaggcaaaagtcaaaagcgaaagagattaaaaaaagaccctggcaagaagattaaaagaaaaaagaagggggagtttcccggagagaagtctaaacggttacggtaccacgacgaggcagatcagagcgctttgcagaggatgactcggctgcgcgtgacctggagtatgcaggaagatgggctgctggttctgtgccgcatagcaagtaacgtgctgaataccaaggtaaaaggcccatttgtgacctggcaggtggtccgtgatatcttgcacgctacattcgaggaatcactggacaaaacctcccactcagtgggcagacgggcacggtacattgtgaaaaatccacaggcatacctgaactacaaggtttgcctcgccgaggtttatcaggacaaagccttggtaggtgatttcatgaaccgcaggggcgactatgatgatcctaaagtgtgtgccaatgagttcaaggagttcgttgaaaaactgaaagaaaagttctcaagcgcactccggaatagtaatcttgagattcctgacaccctgcaggaactgtttgcaagatatagagttttggctattggcgatgaaaaagaccagacacggaaagaggatgagttgaattcggtagatgatattcacttcctggtgcttcaaaacctgatccaaagtactctggcgctctctgacagccaaatgaaaagttaccaaagtttccagacatttcggttgtaccgggagtacaaggatcatgtactggtgaaggcattcatggagtgccaaaaaagaagcttggtgaaccgtcgcagagtgaatcataccctgggcccaaaaaagaatcgagctcttccctttgtccccatgtcatatcagttgagccagacttattatcgaatcttcacctggaggtttccctcgaccatatgcactgagtcatttcagttcctggatcgcatgcgcgcagctgggaaattggatcagccggatagattcagctttaaagatcaagacaacaatgagcccaccaatgacatggtggccttttctcttgatggtccgggtggtaactgcgtggctgtcctcaccctcttcagcctcgggctgattagcgtggatgtcaggattcctgaacagattattgtggtggactcttctatggtggaaaacgaagtgattaaaagcctcgggaaagatggctccctagaggatgatgaagatgaagaggacgacttagacgaaggggtaggaggaaaacgccgaagcatggaggtgaaaccagcccaggccagccatacaaactatctattaatgcgtggctactactctcccggaattgtatcaacccgcaacctgaacccaaatgactcgatcgttgtgaacagctgccagatgaagtttcagctgcggtgtacccctgtcccagctaggctccgcccagctta

SEQ ID NO: 22986 - DNA, 2736 bp, Artificial Sequence
  Description of Artificial Sequence: Synthetic coding sequence
atggatacctgcggagttggctatgtggccctgggggaagccggtcccgtggggaatatgacagtggtggattctccaggacaggaggtcctcaatcagctagacgtcaagacatcaagcgagatgacctccgctgaggcctctgtggagatgagtctgcctaccccattacccggattcgaggatagccccgaccagaggcgcctgccaccggaacaggagtccctgagcaggctggaacaaccggacctgagcagcgagatgagcaaagtcagtaagcccagagcctcaaagcccggaaggaaacgcggagggagaacccgcaagggcccaaaaaggccccaacagccaaaccccccaagcgcaccactcgtcccaggcctcctcgaccagtctaatccactctctactcccatgccaaagaaacgaggcagaaaatcaaaggccgaactgctattgctcaaattaagcaaggatctggacaggccagagagccagtcaccaaagcgtccacctgaagacttcgagacacctagcggcgaacggccaagacgtcgtgctgctcaggtggctctgctgtatctccaggagctcgccgaggaactcagtactgcactccctgcaccagtgtcctgcccagaaggacctaaggtcagttcacccactaagcccaaaaagatccggcaaccagccgcatgtccaggaggggaagaggtagatggcgcaccacgagacgaggacttttttttgcaggtggaggccgaggacgtcgaggagtctgaggggccaagcgaaagctcttccgagccagagcccgtggtgccccgatccacaccacggggttctaccagcggtaagcagaaaccgcactgccggggaatggcacctaacggacttccgaatcatatcatggccccagtgtggaagtgtctccatcttactaaggattttcgcgaacaaaaacacagttactgggaattcgcagagtggatacccctggcctggaagtggcacttgttgtctgagctcgaggccgctccatatctacctcaggaagagaaaagccctctattttcagtacagagggagggtttgcccgaggacggaactctctacagaatcaatcgcttcagtagcattacagcccaccctgagcgttgggatgtgagctttttcacagggggtccgctgtgggctctcgactggtgtcccgtgccggaaggtgccggtgccagtcaatatgtggccctcttttcttcgccagacatgaatgagacccacccactgtcacagttacacagcggcccaggccttcttcaattatggggccttggaacactgcagcaggaatcttgtcctgggaacagagcccatttcgtctacggcattgcatgcgacaacggttgcatctgggacttgaaattctgcccctctggagcttgggaactccccggtactccgagaaaggcacctctcctccccaggttgggccttctcgcgctggcatgcagtgacggcaaggtgctgctctttagtctgccacacccggaagcactgctggcacagcagccacctgacgccgtgaagcctgccatctataaggtacaatgtgtggccacacttcaggtcgggagcatgcaggcaactgaccccagtgaatgtggacaatgtctgtccttggcttggatgcctactcgacctcaccaacacctcgcagctggctattacaatgggatggtcgtgttttggaacttgcccactaacagcccgctccagaggattcgcctgtccgatggttccctaaaactgtacccattccagtgtttcttggcgcatgatcaggctgtgaggacccttcagtggtgtaaagctaattctcatttcctcgtgtctgcgggatctgacagaaagattaagttttgggacttgcgcagaccgtacgaacctatcaacagcattaagcgatttctcagtactgagctcgcctggctgctgccatacaacggggtgactgtcgcacaggataactgctatgcttcatatggactatgtggtatccactatattgacgcgggatatctgggtttcaaggcatacttcaccgcccctagaaagggcacagtctggtctctctccggctccgactggctcgggaccattgccgcaggggatatatcaggcgagctcatcgcagccatcttaccagatatggcccttaacccaattaatgtgaagcggccagtggagaggaggttccctatctataaggcagacctcataccctatcaagactcccccgagggccctgatcattcatccgcgagcagtggcgtacccaacccccctaaggctcgtacctacaccgagactgtgaatcatcactatcttctctttcaggataccgatctgggtagtttccatgatcttctgagacgggaaccgatgctccgtatgcaggaaggcgagggacatagccagttatgtctcgaccgcctccagctggaagcaatacacaaagtccggttctccccaaatctggactcctatggctggctcgtatccggcggacaatccggcctggtccgaattcattttgtgagaggacttgccagtccactcggccatagaatgcagctggagtctagagcccacttcaacgcgatgtttcagccatccagcccaacccgaaggcccggattttctccgacctcccatcgtttacttcccacaccgtag

SEQ ID NO: 22987 - DNA, 2736 bp, Artificial Sequence
  Description of Artificial Sequence: Synthetic coding sequence
atggacacgtgcggcgtcggctatgtcgcgttgggtgaagccggaccagtgggcaacatgactgtggtggactctcccggacaagaggtgttaaaccaactggatgtgaagacaagcagtgaaatgacatcagccgaggcaagtgtggaaatgtcactcccgacgccgctgcctggatttgaagattcgcccgatcaaaggcgcttacctcccgaacaggaatccctgagccgcctcgaacaaccagatttatcctctgagatgagtaaggtgtccaagccgcgagcatcgaaacccggacgtaaaagaggcggaagaacacgcaaaggtcccaagcgtccccaacaacctaaccccccaagtgctcccctggttccaggcttacttgatcagtctaatccactgtctacacctatgcccaaaaagaggggcaggaaatccaaagcggagctgctcctcctcaaactgagtaaagatctcgaccggccagagagtcaatctcccaagcgcccacccgaggatttcgagactccgagtggagagcgccctcggcgaagagccgcacaagtggcactgctgtacctgcaagagctcgccgaggagctgagcactgcattgccggctcccgtgagctgcccggaggggccaaaggtctcaagcccaaccaaacctaaaaaaatccggcagcctgccgcatgtcctggaggggaggaggtggacggcgcacctcgcgacgaggacttctttttgcaggtggaagcagaggatgttgaagagagcgagggcccttcagaatcttcaagtgagcccgagcccgtcgtccctcggtcaactcctagaggatctaccagcggcaaacagaagccacactgcagaggaatggccccaaatggcctgcctaatcatatcatggccccagtctggaaatgccttcatctgactaaagactttagagaacagaagcacagctattgggagtttgcggaatggattccgctggcttggaaatggcatctgctcagcgagctggaggccgctccttaccttccccaggaagagaagtccccgcttttttctgtgcaacgagaggggctccccgaggatgggacactgtaccgcatcaacagattctcctctatcaccgctcatccggagaggtgggacgttagtttcttcacggggggaccgctctgggcgctggattggtgccccgttcccgagggggcaggggcaagccagtacgttgcactgttctcatctcctgatatgaacgagactcatcctctgtcacagctgcactccggcccaggcttgttacagctgtggggcttagggaccctccagcaggaatcatgccccggaaatcgtgcacatttcgtgtatggaatcgcttgcgataatggctgtatttgggacctgaagttttgtccctctggggcttgggagctgcctggaactccccgaaaggctcctttacttcctagacttggcctcctggccctggcttgctcagatggaaaagtcctgctgtttagtctgccacatccagaggctctgctggcccagcagccaccagacgccgtgaagcctgcaatttacaaggtccagtgcgtcgctaccctgcaagtcgggagtatgcaggccacagaccccagcgagtgtggacagtgcctttcactggcctggatgcctactagacctcatcagcatctggcagcaggatactataacggaatggtggttttctggaatcttccaacaaactcgccactgcaaagaatccgtttgtctgatggaagcctcaaattgtatccattccagtgtttcttggcacacgaccaggccgtgaggactttacagtggtgtaaggccaacagccactttctggtgagcgctggcagcgataggaaaatcaagttttgggatctgcgcagaccgtatgaaccgataaactccatcaaacgattcttgagcaccgaacttgcctggctcctgccttataatggagtaaccgtggcccaagacaactgttacgcctcatacggcctttgcggtatccactacatagacgcaggataccttggattcaaggcgtactttacagctcccaggaagggcactgtttggtctttgtccggttctgactggctcgggacgatcgctgctggtgacatatccggcgagctgatcgctgccatattgcctgacatggcacttaaccccattaacgtaaagcgaccggtcgagaggaggtttccaatttataaggcagacctgatcccataccaggactctccagaaggcccagatcattcaagcgcctctagtggagtgccaaatcctccaaaagccaggacgtacactgaaacggtgaatcatcactacctgctgttccaggacacggacctggggagcttccacgatttattacgtagagaacctatgcttagaatgcaggagggagagggccatagccagctctgtcttgacaggctgcaacttgaggctattcataaggtgcggttcagtcccaacctggacagctacgggtggctagtgagcggcggacagtccggcttggtgcgcattcatttcgttcgcggactggcctccccactcggccaccggatgcagctagagagcagagcgcatttcaacgcaatgtttcagccctctagtccgactaggagacctggtttttcgcctactagccaccggttactgcctactccatag

SEQ ID NO: 22988 - DNA, 225 bp, Artificial Sequence
  Description of Artificial Sequence: Synthetic coding sequence
atggatacctgtggggttggatatgttgccttaggagaggccggacctgtgggcaacatgacagtggtcgattccccaggtcaggaggtgctcaaccaactggatgtgaagacgagctccgagatgacatccgctgaggcctcagtcgaaatgtctttaccaactccattgccgggttttgaggacagcccggaccaaaggcgtttaccacctgagcaggagtag

SEQ ID NO: 22989 - DNA, 408 bp, Artificial Sequence
  Description of Artificial Sequence: Synthetic coding sequence
atggatacatgtggcgtgggctacgtggccttgggcgaggcaggccctgttggcaacatgaccgtcgtggactcccccggacaagaggttctgaaccagctggatgttaaaacttcatcggagatgacttccgctgaagctagtgtcgagatgtcactccctactccactcccaggattcgaagattccccggaccaacgacgtctgcccccagagcaggagagccttagtcgcctcgagcaacccgatcttagttccgaaatgagcaaggtgagcaaacccagagcgagtaaacccggaaggaagcgaggaggacgaacaagaaagggccctaaaaggcctcagcagccgaaccccccaagtgcccctcttgttcctggccttctcgaccagagtaaccccttatag

SEQ ID NO: 22990 - DNA, 2661 bp, Artificial Sequence
  Description of Artificial Sequence: Synthetic coding sequence
atgagtggtttttctcccgaacttatagactatctggaggggaagatctcttttgaagaatttgagagacgacgcgaagaaagaaagacccgtgaaaaaaagagcctccaggaaaagggcaaactttctgcagaggagaaccctgacgactccgaagttccctcatcatctgggataaatagcaccaaatcacaggacaaagatgtgaacgaaggtgaaaccagtgatggggtgaggaaatcagtgcataaggtgttcgcttccatgttgggagaaaatgaggatgacgaggaggaagaagaagaggaggaggaggaggaagaggaggaagagactcccgaacaaccaactgccggtgatgtttttgtgctggaaatggtgctcaaccgggaaactaagaagatgatgaaagagaagcggcctcgcagcaaacttcccagagccttgcgcggattgatgggcgaggcaaacattcggtttgctcgcggtgagcgtgaggaggccattctcatgtgcatggagattattcgccaagccccactggcctatgaaccattttcgacgctagccatgatttatgaagaccagggggatatggagaaatcgctgcaatttgagctgattgccgcacacctcaatcctagtgacaccgaagaatgggtgcgcttggccgaaatgtcgctggagcaggataacataaagcaagccatcttctgttacactaaggccttaaaatatgagcctaccaatgtaagatatctttgggagcgctcctccctctacgaacagatgggtgatcacaagatggctatggatggttatcggagaatcctgaatctcctttcccccagcgacggggaaagattcatgcaactggcacgcgacatggccaagtcttactatgaggccaacgacgtgacctccgcaatcaatattatagacgaggcattcagcaagcaccaggggctagtttccatggaagacgtgaatattgccgcagagctctacatatcaaataaacagtatgacaaagcactcgagatcattacagatttttctggcatcgtcttggaaaaaaaaaccagcgaggagggaacttcggaggagaacaaggctccggagaacgtcacctgcacgatacccgacggagtgcccattgatattactgtgaagcttatggtttgtctcgttcacctgaacatcctcgagcccttgaacccgctcttgactacgcttgttgaacagaaccctgaagacatgggcgatctgtatctggatgtggccgaggcttttttggacgtgggagagtacaactccgcactccctttgctgtcggccctcgtgtgcagcgagcggtacaatctggctgtagtctggctccggcatgccgagtgtttgaaagctcttgggtacatggaacgggctgcagagtcttacggtaaggtcgtggatttagcccctctgcacctggatgctcggatctcactgtccacgctccaacagcaactgggtcagcctgaaaaggcgctggaggccctggagccgatgtatgaccctgacaccttggcacaggacgctaacgctgcacagcaagaactaaaattgctgctgcaccgctctaccctgctgttcagtcagggcaaaatgtacgggtacgtggataccctcctgaccatgttggctatgttattgaaggtagctatgaacagggcccaggtgtgcctgatttcctctagtaagtctggagaacgccacctgtatcttattaaggtgagcagagacaaaattagtgatagcaacgaccaggagtccgctaattgtgacgcgaaggctatattcgcggttcttacctctgtgctgaccaaggatgattggtggaacctcctgctgaaggctatttactctctgtgcgacctgtccaggttccaggaggccgaactcctcgtcgattcgtccctggagtactactcgttttacgatgatcgccagaaaaggaaggagctcgagtactttggactcagcgcagcgattctggacaagaatttccgcaaggcttacaattacatccgaatcatggtgatggagaacgtcaacaagcctcagctttggaatattttcaaccaggttactatgcacagccaggacgtccggcatcacaggttctgccttaggttgatgttaaaaaatcccgagaaccacgcactttgtgttcttaacggccacaatgccttcgtctcaggttcttttaagcatgccctcgggcagtacgtgcaggcgtttagaactcaccctgacgaacctctctacagtttttgcatcggactcactttcatccatatggcatcacaaaaatatgtcctgcgtaggcatgcgctcatcgtccagggcttcagttttttaaacaggtacctgagccttcgcggaccctgccaagagtccttttacaacttgggtcgcggtcttcatcagctggggctaattcacttagctatacactattatcagaaggctctcgagctgcctccgctggtggtggaagggatagagctggaccagctggatttgaggcgtgacatagcttacaatcttagcctgatatatcagtcgagtggcaacacgggtatggcacaaacgttgctgtatacctactgcagcatctag

SEQ ID NO: 22991 - DNA, 1242 bp, Artificial Sequence
  Description of Artificial Sequence: Synthetic coding sequence
atgagtggcttctccccagagttaattgactatttggaggggaagatttcatttgaggagtttgagagacgtcgcgaggagaggaaaaccagagagaagaaaagcctgcaggaaaaggggaaactcagcgcagaggaaaatccagacgactctgaggtcccgagctcctccgggattaatagtaccaagtcacaggacaaggacgttaacgagggggagacttcagatggtgtacggaaatcagttcataaagtatttgcatctatgttgggtgagaatgaggatgacgaggaggaagaggaagaggaagaagaggaggaagaggaggaagagactcctgagcagcccaccgccggagatgtgttcgtcctggaaatggtgttgaaccgcgagactaagaagatgatgaaggaaaagcggcctcgcagcaagctgccaagggcactccgaggcctgatgggcgaagccaacattaggttcgcaagaggggagcgagaggaagccatactgatgtgcatggagatcatccgccaagctccactcgcctacgaacccttcagcaccttagccatgatatatgaggaccagggggacatggagaagtcacttcagttcgaactgattgccgctcacctcaatccgtcagacacagaagaatgggtacgtctcgctgaaatgtccctggagcaagataatatcaagcaggccatcttttgttataccaaagccctgaagtacgagcctacaaatgtgaggtatctgtgggaacgaagcagtctgtatgaacagatgggtgaccacaaaatggcaatggatgggtaccgccgaatcctgaatctcctaagtccaagcgatggagagcgattcatgcagctcgctcgtgatatggccaagtcttattacgaggcgaacgacgtgacctctgcaattaacattatcgacgaggctttcagcaaacatcaaggactcgtgagcatggaggacgtaaatatagctgcagagctgtacatctctaacaagcagtatgataaagcactggagatcattaccgacttctcaggtattgttctggaaaagaaaacttctgaagaaggcaccagtgaggaaaataaagctccggagaatgttacctgcaccatccctgacggcgtacccatcgacattacagttaaacttatggtgtgcctggtccacctgaacatattggagcccttaaacgtgtgtaataaaatctgcacctag

SEQ ID NO: 22992 - DNA, 2469 bp, Artificial Sequence
  Description of Artificial Sequence: Synthetic coding sequence
atgaatacggcagatcaagctagagtcggtcccgctgacgatggcccagccccttcaggcgaggaagaaggcgaggggggaggcgaggccggagggaaagagcctgccgcagacgccgcacccggtccaagtgctgcattcaggctcatggttactaggcgggagccagcggtgaagttacagtacgccgtttctggcctagaacctctcgcttggtctgaggaccatcgcgtcagtgtgagcaccgcacgttcgattgcagtgctcgaactgatctgtgatgtgcacaaccctggacaggacctagtcattcatagaaccagcgttcccgcaccactgaactcctgcctgctgaaggtaggatctaagactgaagtggctgaatgtaaagaaaaattcgccgctagcaaggatccaacagtgtcacaaacgttcatgcttgaccgcgtgtttaatccagaaggcaaagccctgccaccaatgaggggcttcaagtacacgtcatggtcccccatgggctgtgatgctaatggtcgatgcttgctagctgccctcacgatggataatcgcctgacaatccaagccaatttgaatcgccttcagtgggtccagttagttgacctcactgaaatttacggtgaacgcctgtatgagacctcatataggctttctaaaaacgaggcccctgaggggaacctgggcgacttcgccgaatttcagcgcagacacagcatgcaaacccccgttagaatggaatggagcggaatctgcactacccagcaggttaagcataataatgagtgtcgtgacgtggggagcgtgctcctggccgtgctgtttgagaacggtaacattgccgtgtggcagtttcagctgcctttcgtgggcaaggaatcaattagcagttgtaacacaatcgagagcgggataacttctcccagtgtactcttttggtgggagtatgagcataataacagaaaaatgtcgggcttaatcgttggatctgccttcgggcctatcaagatcttacccgttaacctgaaggccgtgaaaggttacttcaccctgaggcagcctgtgattctgtggaaagagatggaccagctgccagtacactccatcaagtgcgtgccactgtaccatccctatcaaaaatgctcatgctccctggtggtggccgcaagggggtcttacgtgttctggtgtttgttgctaatttctaaggctggattgaatgtgcataatagccatgtgaccggtctgcattccttacccatcgtttccatgacagccgacaagcagaatgggacagtctacacgtgctcctcagacgggaaagtcagacagctcatccccatatttactgacgtagctcttaaattcgagcaccagctgatcaagctgtcagatgtgtttggcagcgtgaggacgcatggtatagccgtgtccccttgtggggcatatttggcaattataaccaccgaaggtatgatcaatggacttcatccggtgaacaagaactaccaggtccaattcgtgaccctcaaaactttcgaagaggcagctgctcagttactcgaatcaagcgtgcagaatctgtttaaacaggttgacctgatagatttggtccgctggaaaatcctgaaggacaagcacattcctcagttccttcaggaggcccttgagaaaaagatagagtcgtccggggtgacctacttttggcgcttcaagcttttcctgctcaggatcctgtatcagagtatgcagaagactcccagtgaggccctgtggaagcctacacatgaggattcaaagattctgttggtggatagccccggaatggggaatgccgatgacgagcagcaggaggagggaacgagctctaaacaggtggttaaacagggcctgcaggaaagaagcaaggagggggatgtagaagaacccactgatgactctctgccaacaactggcgacgccggaggacgcgagccaatggaggagaagctgctggaaattcaggggaagatcgaggccgttgagatgcacctaactagggagcatatgaaaagagtactcggagaagtctacctccacacttggatcaccgaaaatacgtctattcccacccgcggtttgtgcaactttctcatgtctgatgaagaatacgacgatcgaacagcacgagtgctaatcggccacattagcaaaaagatgaacaagcaaacgtttccggagcactgctctctctgtaaagaaatcttgccttttaccgaccggaaacaggccgtctgctctaatggccatatctggctgcgatgtttcctaacctaccagagctgccagtccttgatctatagaagatgtctgctgcatgatagcatagccagacatccagccccagaggacccggactggatcaagcggttactgcagtctccttgccccttttgcgactcccctgtcttttag

SEQ ID NO: 22993 - DNA, 1374 bp, Artificial Sequence
  Description of Artificial Sequence: Synthetic coding sequence
atggccgcagaggccgcagatctgggcctgggcgcagccgttcccgtggagctgcgacgcgaaagaaggatggtgtgcgtggagtacccgggtgttgttcgcgacgttgcaaagatgctgcccacgctgggcggagaggagggagtgagcagaatctacgccgaccccacaaagcgcctggaattgtatttcagacccaaagatccatattgtcaccctgtgtgcgctaatagattcagcacaagctcactgctgctccgcattcgaaaaaggacaaggagacagaaaggcgtccttgggaccgaggctcactcggaggtgacattcgatatggaaattctcggaatcatcagtactatttataagtttcagggcatgagcgactttcaatatctggctgtgcacaccgaagccggtggcaaacatacatccatgtatgataaagttctcatgttgagacctgagaaagaggctttttttcaccaggagcttcctctttacatcccaccccctatcttctcccgtctcgacgccccagtggattacttctacagacctgaaacccaacatcgtgaggggtataacaatccaccgatatctggagaaaatcttataggattgagtcgggcacgccgacctcataatgcgatattcgtcaattttgaagatgaagaggtgcccaaacatctctggattcgcttcgggtacgatccgcgaaagaatcctgacgccaagatttaccaggttctggactttaggattcgatgtggcatgaagcacgggtatgcaccttctgatcttcccgtgaaagccaagagatccacatataactattctctgcccattacggtgaagaagacgtcatctcagctggtgacaatgcatgacctcaagcaggggctgggtccgtccggcacctccggtgcacgaaagccagcgtcctccaaatacaagctcaaagtgtcgctgcagacgctgagagactctgtctatatcttccgagaaggcgcacttccaccctataggcaaatgttttaccagctgtgcgatcttaacgtcgaggagttacagaagatcatacacagaaacgatggagccgaaaactcttgcacagagcgcgatgggtggtgtcttccgaaaaccagtgacgagctgagggatacaatgtcactaatgattagacagactattagatcaaagcgacctgccctgttttcctcatcagcaaaagcagacggcggtaaagagcagctgacgtacgaatctggtgaagatgaagaggacgaggaagaagaagaagaggaggaagaggacttcaaaccctccgatgggagcgagaatgagatggaaaccgagatcctggactacgtatag

SEQ ID NO: 22994 - DNA, 834 bp, Artificial Sequence
  Description of Artificial Sequence: Synthetic coding sequence
atgctgcgccctgagaaagaagcgttttttcaccaggagcttcccttgtacatcccccctccaatctttagccggcttgatgctcctgtcgattatttctaccgcccagagactcagcaccgcgaggggtataacaatcctccaatttccggcgagaaccttatcgggctctcacgagcaagaagacctcacaacgccatcttcgtcaacttcgaagatgaagaggtccctaagcagccgcttgaggccgcagcccagacatggcgacgggtctgtactaacccggtcgacaggaaggtggaggaggagctgcggaagctgtttgacatccgcccaatttggagtcgcaacgcagtgaaggctaacattagcgtgcaccccgataaactcaaggtcctgcttcccttcatagcctactacatgattactgggccatggcggtctctttggattagattcggctacgatccgaggaagaaccctgacgccaaaatttaccaagtgctggactttcggattcgctgcggaatgaagcatgggtatgcaccgtcagacctgcccgttaaagccaaacggtctacatataactattctctgccgataaccgtgaaaaagacaagtagccaactggtgactatgcatgatcttaaacagggtcttggaccttcaggaacctccggggctcgcaagccagcctcatccaaatacaaactgaaagtttcactgcagactacttcgggtgaagaagttgtcacctccctgcgggaggtttggcatcagcagctgcatgtggtggtgctgctggaaccattcgggtccctgggaccccattag

SEQ ID NO: 22995 - DNA, 1239 bp, Artificial Sequence
  Description of Artificial Sequence: Synthetic coding sequence
atgtcggatttccaatacctggcagtacataccgaagccggaggcaaacacactagcatgtacgataaagtactgatgcttcgccctgaaaaagaagcttttttccatcaggagctaccactgtatattccaccgccaatcttcagccgcctggatgcccctgtagattacttctatcgccctgaaactcagcacagagaaggctacaataacccgccaatctccggggagaacctcataggtctatcacgagccagacggcctcacaatgccatctttgtgaactttgaagatgaagaggtcccgaaacagccacttgaggcggctgcacagacatggaggcgggtatgtactaatcctgtcgaccgaaaggttgaggaggagctcaggaagctgttcgacatccgccctatttggtctaggaacgctgtcaaagcaaacatcagcgtgcacccagacaagctgaaagtcctcttgcctttcatcgcatactatatgattacaggcccttggagatccctgtggattcgcttcggatatgacccgaggaaaaatcctgacgccaaaatttaccaggttctggactttcggattcgttgtggcatgaaacacgggtatgccccaagcgatctccctgtgaaggctaagcgaagcacatataattattccctgcctatcacagtgaagaagacctccagtcagcttgtcacaatgcatgacttgaaacagggactcggaccctccggcacgagcggtgctcgaaagcctgcttcctctaagtataagctgaaggtgtcactccagaccttacgggtacgtacgcgcgtccagtcccccagagctgtctgtgttggcgacatttggcggcgagggggagacaagagtcagggcagccttgctcccgcagccgcatgcggctgcccaagccgggcattatgggagcccggtccaccgctatctcacgtgaccactccaggtatgatcgggatcggacacactcaggaagacagggctcgagcaggacacgtggggtgtagctgcggacggtcactaactgggagccggtttcgccagtgcgggtgtcctgctggcgtgggtgggttccaatcctgttcgcatatccaggctcctgcctctaggtctacagccctgggcgaagccgaaaagggggcttcgcgcaccgtcgagtcccccgcagagggagtgggtggcagagacgaatgttcccgcgacggctag

SEQ ID NO: 22996 - DNA, 1560 bp, Artificial Sequence
  Description of Artificial Sequence: Synthetic coding sequence
atggcggctgaggccgcagatctggggctgggtgccgcagttccagttgagctgcgacgtgaaagacgaatggtgtgcgtggagtaccctggcgtagtcagagatgtcgcgaagatgcttcctaccctcgggggagaggagggggtatcaagaatttacgctgaccctacaaagcgcctcgaattatacttccgcccaaaggacccttactgtcatccagtctgtgccaatcgcttttcaacaagctctctgcttctgcggattagaaaacggactaggaggcagaagggtgtgctcggcacggaggcccactccgaagtgacttttgatatggaaatactgggcattataagtactatttacaaatttcagggcatgtccgacttccaatatttggctgtgcacacagaggccggagggaagcacacgagcatgtacgacaaggtgctgatgctaagacccgaaaaggaagctttttttcaccaggaattaccgctatatatccctccccctatcttttcccgtctcgacgcacctgtggactacttctaccgtcccgaaactcagcaccgcgagggctataataatccccctattagcggagagaacctgataggcctgtccagggcaagaaggcctcacaacgccatctttgtcaacttcgaggacgaagaggtgccgaaacaaccactggaggccgcagcacagacctggcgtcgtgtgtgtacaaaccctgtggaccggaaggtcgaggaagaactacgcaagttgttcgatatacgacccatctggtctcgcaacgccgtgaaggcgaatattagcgtccaccccgataaattaaaagtattgctccctttcatcgcctactatatgataactgggccatggaggtcgctgtggattaggttcggttatgacccaaggaaaaatcctgacgctaagatttaccaggtacttgatttcaggattcggtgcggcatgaagcacggctacgctccctccgatcttcccgtcaaagcaaagcgctctacttacaactactccttgcccatcacggtgaagaaaacttccagtcagttggttaccatgcacgaccttaagcagggtctggggccttcaggtaccagcggagccaggaagccagccagtagcaagtacaagctgaaggactccgtttatatttttagggaaggcgcattaccgccttaccgtcagatgttttatcagctctgcgatctgaacgtcgaagagcttcagaaaataattcaccgtaacgacggggcagaaaattcatgtacagagcgagacggatggtgtctgccgaagacaagcgatgagcttagagacacaatgtctctcatgatcaggcagaccattcggtccaaacggcctgcactcttttcgagttctgctaaggccgacggcggtaaagaacagctcacgtatgagtccggtgaagatgaagaagacgaagaagaggaggaagaggaggaggaggacttcaaaccatcggatggcagcgaaaatgagatggaaacggagatcctggactatgtgtag

SEQ ID NO: 22997 - DNA, 1533 bp, Artificial Sequence
  Description of Artificial Sequence: Synthetic coding sequence
atggctgctgaagcagccgatctgggattgggggcagccgtgccagtggaacttcgtcgtgagagaagaatggtctgcgttgaatatcctggagttgtgcgagacgtcgccaagatgctgcctaccctcggcggagaagaaggtgtcagtcggatctatgcggaccctccaaaagatccgtactgccacccggtatgtgctaatcggttcagcaccagctcactcttgctgagaatccgaaaacgcactcgcaggcaaaagggagtcctcgggaccgaggctcattcagaggtgacattcgatatggaaattctcggcatcatatcaaccatctacaagtttcaagggatgtccgactttcagtacctggctgtacataccgaagcgggaggcaagcacacgagcatgtacgataaggtgctcatgctgagaccagagaaagaggcattctttcaccaagagctgcccctctacatcccgcctcccattttctcaaggcttgacgcaccagtggactacttttatcgccctgaaacccagcatagggaagggtacaacaaccctccaattagcggggagaatctcattggactttccagagcacgtcgaccccacaatgccatattcgtgaattttgaggacgaggaagtacccaaacaacctcttgaggctgcagcgcagacatggaggcgcgtgtgcacaaatccagtggaccgcaaggtcgaagaagagctccgcaagctttttgatattcggcctatttggtcccgtaatgccgtgaaggctaatataagtgtacacccagacaaattgaaggtgctgctcccgttcattgcctactacatgataaccggaccatggagatcgctgtggattaggtttggctatgatcctaggaagaaccccgacgctaaaatctaccaggttttagattttagaatcagatgcggaatgaaacatggttacgcccctagtgacttgccagtgaaagcgaagcgaagtacatacaactattctctgcctattaccgtgaagaaaacctcctcgcagctggtcacaatgcacgacctgaagcaggggcttggcccttcagggacctctggagcacggaagccagccagttccaaatacaagttaaaggatagtgtgtacatattccgagagggggcactccctccttatcggcaaatgttctatcagctgtgtgacttgaacgtcgaggagctccaaaagatcattcacaggaatgacggggcagaaaattcctgtacagaacgggatggatggtgcttaccaaaaacctcagatgagttgcgggacaccatgtcccttatgatacgccagaccattaggtcgaaacgaccagccctgtttagttcttcagctaaggctgatggcggaaaggagcaactaacatacgaatcaggcgaggatgaggaggatgaagaagaggaggaggaggaggaagaggacttcaagccctccgatggctccgagaacgagatggaaaccgaaatcctggattacgtctag

SEQ ID NO: 22998 - DNA, 1581 bp, Artificial Sequence
  Description of Artificial Sequence: Synthetic coding sequence
atggccgctgaagctgccgatctcggcctgggcgctgcggtccctgtggagctgcgtagggaaaggaggatggtgtgtgttgaataccccggagtggtgagggatgttgcaaagatgttacccaccctcgggggagaagagggcgtctcaaggatctacgccgaccctaccaaaagacttgaactgtacttccgtcccaaggacccgtactgtcatcccgtctgtgctaacaggttttccacttccagcctgctcttgaggataagaaaaaggactcgacggcagaaaggcgtcctaggaacagaggcgcactcagaggtgacattcgacatggagattctgggcattatttcgacaatctataaatttcagggaatgtcagactttcagtatctcgccgtgcatacagaggcgggaggtaaacatacgtccatgtacgataaagtgctcatgcttagaccggaaaaagaagccttcttccaccaagaacttccactgtatattccgccacctatcttttcacgactggatgcccctgtggattatttttacagacctgagactcagcacagagaaggttacaataaccctccaatctcgggtgagaacctaattggtttgtcacgggcacgtcgtcctcataacgcgatttttgtcaactttgaggatgaggaggttcccaaacaaccactggaagcagcagctcagacctggcgacgggtttgtacaaaccccgtcgaccggaaggtggaagaagaattaaggaagctctttgacatcagacccatatggagccgcaatgccgtgaaggccaatataagcgtccacccagacaaactgaaagtgttgttgccttttattgcctattacatgataaccggaccatggaggagcctttggattcgtttcggttatgatcctcggaaaaatccggacgcaaaaatctatcaagtacttgacttcagaattaggtgcggtatgaagcatggctacgctcctagtgacctacctgtgaaggcaaagaggtccacttataactattcacttccaatcactgtaaaaaaaacaagctcgcagcttgttaccatgcatgacctgaaacaagggcttgggccatctggcacatccggcgctcgtaagcctgcatcctccaagtacaaactgaaggtctcccttcaaacacttcgtgacagtgtgtacatctttagggagggcgcattacccccttaccggcagatgttttatcagctgtgtgatcttaacgtggaggagctgcagaagattatacaccgaaatgacggtgccgagaactcatgtacagagagagacggatggtgcctgcctaaaactagcgatgagctcagggatacaatgtccctgatgattcgtcagaccatacggtctaaacgtcctgccctcttcagctcttccgccaaagcagatgggggaaaagagcagctcacttacgagagtggggaagacgaagaagatgaagaagaagaagaggaggaggaagaagattttaaacccagcgacggaagtgagaacgagatggagacggagattttagactacgtgtag

SEQ ID NO: 22999 - DNA, 597 bp, Artificial Sequence
  Description of Artificial Sequence: Synthetic coding sequence
tgaccactcgaggcagccgctcaaacatggaggagggtttgtacaaatccagtcgatcggaaggtggaagaggagctgagaaagttgttcgacatcagaccaatatggtcgcgaaacgccgtgaaggctaatatttctgtgcatccggacaagctaaaagtcttgcttcctttcattgcctattatatgattactggcccttggagatctctctggattaggtttgggtatgatccacggaagaatccggatgctaaaatttaccaagtgctggatttccggattagatgtggaatgaagcacggttatgccccttccgatctgcccgtcaaagccaaacggtccacctataactactccctaccaattacggtaaagaagacctcttcccaactggtgactatgcacgacctgaaacagggattgggtcccagtggtacgagcggagccaggaagcccgcatcttcaaagtataagttaaaggtctcactgcaaaccagcggggaggaggtcgttaccagcttgcgtgaggtatggcatcagcaactgcacgtggtggtactgctagagcccttcggaagcctaggcccacactag

SEQ ID NO: 23000 - DNA, 273 bp, Artificial Sequence
  Description of Artificial Sequence: Synthetic coding sequence
tgaatccgctgcggcatgaagcatggatacgccccaagcgacctgcctgtgaaggccaaaaggtccacttataattattcccttcctataactgtcaagaaaacctcttctcagttggttacaatgcatgatttaaaacaaggtctgggaccctcaggaacctcaggtgccagaaaaccggcttcatcaaaatacaaattaaaggtcggggctcccggaggccaggagtggaggggtggcttgccttcctggggcagggccccttgcggctag

SEQ ID NO: 23001 - DNA, 675 bp, Artificial Sequence
  Description of Artificial Sequence: Synthetic coding sequence
atgagtgactttcagtatctggctgttcacacagaggccggagggaaacatacaagcatgtatgacaaggtcctcatgcttcgtccagagaaagaggccttttttcaccaggaattacctttgtacatcccaccgcctatcttctcccggttggacgctccagttgattatttttatcggcctgaaacccaacacagggagggttataacaatccaccaatctccggcgagaacctaatagggctgtccagagctcgcaggccacacaatgccatattcgtgaacttcgaagacgaggaggttccaaaacaaccgctggaggccgcagcccagacatggagacgggtgtgtaccaaccctgttgacaggaaagtggaggaagaactgagaaagttattcgacattcgccctatctggtctcggaacgctgtcaaggccaacatctccgttcaccctgataagctgaaagttctgctaccctttatcgcatactacatgatcactggtccctggaggtctctgtggatccgctttggctacgatccgcgtaaaaatcctgatgctaaaatctatcaggtgctcgactttaggatccggtgcgggatgaaacatggatacgccccttccgatctgccagtaaaggccaagagaagtacttataactatagtctgtag

SEQ ID NO: 23002 - DNA, 735 bp, Artificial Sequence
  Description of Artificial Sequence: Synthetic coding sequence
atgacccgggctatctacgccgaccccacaaaacgactagagttgtattttaggccaaaggatccttattgtcaccccgtgtgtgctaaccggttcagtacatcgagccttctcttaaggattcggaaaaggacacgacgccagaagggtgtgctgggaactgaggcccactcggaggttaccttcgatatggagatcctgggaattatttccacaatatacaagttccaaggaatgtctgattttcagtacctggccgtgcacacagaagccggtggcaaacatacatcaatgtacgataaagtgctgatgctgcgacccgagaaggaggcctttttccaccaggagctccccttatatatcccccctcctatattctctaggctcgacgcgccagtggattacttctatagacctgaaacacaacatagagaaggctataacaacccccctataagcggggaaaacttgatcggcctcagtcgagcccgtaggccgcataacgcgattttcgtgaacttcgaagatgaggaagtgccaaaacaaccactcgaagcagcggctcaaacgtggcgaagagtatgtacaaatcctgttgaccggaaggtcgaggaggagctgcgcaagctctttgacataagacccatatggtcccgaaacgccgtgaaagctaatataagcgtgcacccggataagctgaaggtgctgctcccgtttatcgcgtattatatgtag

SEQ ID NO: 23003 - DNA, 1548 bp, Artificial Sequence
  Description of Artificial Sequence: Synthetic coding sequence
atggggtccctgagtagccgggtgcttagacagcccaggccagctctagcacaacaggcccagggggctcgtgcgggtggctcagctcggagaccagacacaggtgacgatgcagcaggccacgggttctgttactgtgccggatcacacaagcggaagcgctccagcggaagcttttgttattgccatccagattctgaaactgatgaggacgaggaagagggagatgagcagcagagattgctaaatactcctcggaggaaaaagttgaagagcacctctaaatacatctaccaaaccctgttcttgaatggcgagaactcagatatcaagatatgcgcattgggagaagagtggtctctgcataaaatctacctatgccaaagcggttactttagttcaatgttctcgggaagctggaaagaatctagcatgaacatcatcgagttggaaatccccgatcaaaatatcgacgtggaagccctgcaggtcgccttcggaagcctgtacagagatgatgtgctgatcaagcctagcagggttgttgcaattttggcagcggcttgcctcctgcaattggatgggctgatccagcagtgcggcgagaccatgaaggaaactgtgaatgtgaagaccgtttgcggttactatacgtctgcaggaacatatggattggattcagtgaagaagaagtgtttggaatggctgcttaataatctgatgacccaccaaaatgttgaactctttaaggagctttcgatcaatgtgatgaaacagctgattggttctagcaacctgttcgtcatgcaagtagagatggacatctacaccgcgctgaagaagtggatgttccttcagctggttcctagctggaacggctccctgaagcaactgctgaccgaaacagatgtttggttttccaaacagcgcaaggacttcgaggggatggccttcctggagacagagcagggaaagccgttcgtgtcagtgtttcgtcatctgcgcctgcagtatatcataagcgaccttgcaagtgctcgaatcatcgagcaggatgccgtcgtccccagcgagtggctctccagcgtgtataaacaacagtggttcgcgatgcttcgagccgagcaggacagtgaagtggggcctcaggaaatcaataaggaggaactcgagggcaacagcatgcgatgtgggagaaagctagccaaggacggcgagtattgctggagatggaccggctttaattttggttttgacctactggtgacctacaccaatagatacattattttcaaacgaaatacgctcaatcaaccctgcagtggtagcgtgtcattacagccaaggaggagcatcgccttccgactcaggctggcatccttcgactcctcgggcaaactgatttgcagtcggacaactggctaccagatactgacccttgagaaagatcaagagcaagtcgtcatgaacctggactccaggctccttattttccctctgtatatctgctgcaactttctttatatctcaccagaaaaaaagaattag

SEQ ID NO: 23004 - DNA, 1311 bp, Artificial Sequence
  Description of Artificial Sequence: Synthetic coding sequence
atggagccagatgattttgactctgaggacaaggaaatactaagctgggacataaatgatgttaagttgccgcagaatgtgaagaagacagattggtttcaggagtggccagactcttacgctaaacatatctattcctctgaggacaagaatgcacaaaggcatctttcatcctgggccatgaggaatacaaacaatcataactcgcgtattttaaagaagtcatgtttgggagtggtggtgtgcggtagggactgccttgccgaagagggccgaaagatttatttacggccagcgatttgcgataaggccaggcaaaaacagcagagaaaacgctgccctaattgcgatggcccactcaagctgataccatgtcggggacacggtggattcccggtgaccaatttttggcgacacgacggacggtttatcttttttcaaagcaagggcgaacatgatcatcccaagcccgagactaagctggaagccgaagctcgtcgtgccatgaagaaagtcaacacagctccatccagcgtctcattgtccctaaaggggagtacagaaacgagaagcttgcccggagagacacagtctcagggatccctacctttgacctggtctttccaggagggggtgcagctgcccggatcttacagtggtcacttaattgccaatacgccccagcagaattctctgaacgattgtttcagcttctccaagagctatggactggggggtattaccgacctgaccgaccaaaccagtactgtcgatcccatgaaactgtacgagaagagaaaactgtcctcctcgcggacgtacagttcaggagacttgctgcccccaagcgcctccggggtctacagcgatcacggagacctccaggcatggagcaaaaatgcggctctggggaggaaccacttagccgataattgctattcgaactatccttttcctctcaccagttggccatgttcctttagcccatctcaaaattcgtcagaacccttctaccagcaactgcctctcgaaccgcctgccgctaaaaccggctgcccacctctttggcctaaccccgctgggaacctctacgaagagaaagttcatgttgacttcaatagttacgtacaaagtccagcttatcactcaccacaagaggacccctttctgtttacctacgcttcgcacccacatcagcagtacagtttgccctctaaatcaagcaaatgggatttcgaggaagaaatgacttacctaggtctggaccactgcaataatgatatgctgctgaatctgtgtcctctccggtag

SEQ ID NO: 23005 - DNA, 1521 bp, Artificial Sequence
  Description of Artificial Sequence: Synthetic coding sequence
atgcctgccgcagctgtacaggaggccgtgggggtgtgctcgtatgggatgcagttaagctgggatataaatgatccgcagatgcctcaggaactggcccttttcgatcaattcagagaatggccagatggatatgtgcgatttatctatagctcagacgagaagaaggctcaaaggcatctgagtggctgggccatgagaaacactaataatcataatggacatattctaaaaaagagttgtttaggcgttgttgtatgtacacaggcctgcactctccccgatggttctagacttcagctccgccctgcaatttgtgacaaggctaggctgaaacagcagaagaaagcatgcccaaattgccatagtgcactcgaactgattccatgtcgcggacactccggataccctgtgacaaacttttggcgactggatggcaatgcaatcttttttcaggctaagggagtccacgaccatccacgacccgaatccaaatctgagacagaggctcgtcggtctgccatcaaacggcaaatggcttccttctaccagcctcagaagaagcgcattagagagagcgaagcagaggagaatcaggattcgtccggacattttagcaatattcctccccttgaaaaccctgaggatttcgatatagtgacagagactagtttccccattccgggtcagccgtgcccaagcttcccaaagtcagatgtctataaggccacctgcgatctggctacctttcaaggagataaaatgcccccatttcagaaatactcatccccacggatttacctgccgcgtccaccatgcagctacgagctcgctaaccctggctacacaaacagcagtccttacccaaccctgtacaaggactcaacaagtatccccaatgatacagactgggtacacctgaataccctccaatgcaatgtaaacagttacagctcatacgagcgcagttttgatttcacaaacaagcagcacggttggaaacctgcactgggcaagccctccctggtcgagcgcactaaccatggtcagttccaagcaatggcaaccagaccatactataacccagaactgccatgtcgatacctgacaactccgccaccgggtgcccctgccttgcagacagtaataaccacaacaacgaaggtatcctaccaggcttaccagccacccgcaatgaagtactccgattcagtgcgcgaagtgaagagcctttcatcttgtaattacgcccctgaagacaccggtatgagcgtttacccagagccatggggccctcctgttactgtcacccgtgccgcttccccttccgggcctccacctatgaaaattgcaggcgattgtagagcaatccggccaactgtggcgattccccatgagcccgtgagctctcggaccgacgaggccgagacttgggacgtgtgtctgagcggcctggggtctgccgtgagctacagcgatcgggtggggccttttttcacttacaacaacgaggatttttag

SEQ ID NO: 23006 - DNA, 1863 bp, Artificial Sequence
  Description of Artificial Sequence: Synthetic coding sequence
atggcagaggctcgcacctcactgagtgctcattgtcggggtcctcttgccactggcctgcatcccgatctggatctgcctggacggtccctggccacccctgctccctcctgctaccttctgggatctgagccctccagtggtcttggtctccagccagagacacacctgcctgaaggtagcctcaaaagatgttgcgtgctcggcctccctcccaccagtcccgcttcttccagtccctgcgcctcttctgatgttacgagcattataagaagctcacagacctcacttgtgacctgcgtgaatggccttcggagtcctccgcttaccggcgatctcgggggaccgtctaaacgggctagacctgggccagcgtccaccgatagtcacgaaggaagccttcagttagaggcttgcaggaaggccagcttcctcaagcaggaacccgcagacgaattttccgagctctttggcccacaccaacaggggcttccccctccataccccctttcacagttgccccctgggccttcacttggcggtttaggcttggggctggcaggcagagtggtggcaggacgtcaggcgtgtcgatgggtggactgttgtgctgcctatgagcagcaggaggagctggtgcgccacatcgaaaagtctcacatagatcagaggaagggggaagacttcacatgtttttgggctggttgtgtgcggagatacaagccctttaacgcacgatacaagctgctgattcacatgagggtgcactcaggtgagaaacctaacaagtgcatgtttgaagggtgttctaaggcctttagtcgattagaaaatttgaagatccaccttcggagccacacaggggaaaagccttatctttgtcagcacccaggatgccaaaaagcgtttagcaattcatcagatcgcgctaaacaccagagaacgcacctggacaccaaaccctacgcatgtcaaattcccggttgttcaaaacggtacactgacccgagtagcttaaggaagcacgtgaaggcacatagtgccaaggagcaacaggtgagaaagaaactccacgccggaccagataccgaggccgacgttttgactgagtgtctggtgttacagcagctgcacaccagcactcagcttgctgcaagcgatggaaaggggggttgtggtcttgggcaggagttgttgccaggagtttatccaggctccattactccccataatggtttagcctctggactgctgccccctgctcacgatgttccaagcagacatcatccactggacgctaccactagctctcaccatcacctttctccccttcctatggctgaaagcactcgcgacgggctcggaccaggactgctcagccctatcgtgagcccgctgaaggggctcggaccaccccctctgccccctagctcacaatcgcactctccaggcggacagccgtttccgaccttgccttccaagcctagttaccctcccttccaaagcccgccacccccaccgcttccttcaccccagggctaccagggcagcttccacagcattcagtcatgctttccctacggagattgctatcgaatggctgagcccgcagctggtggggacggcctggtgggagagactcacggatttaatcctctgaggcctaacggataccacagcctcagcacaccactccccgctacggggtatgaagccttggcagaggcctcctgccccactgccctccctcagcaaccctccgaagatgtcgtcagctccgggccagaagactgtggattcttcccaaatggggctttcgaccactgcctgggtcacattccatccatctatacagacacatag

SEQ ID NO: 23007 - DNA, 1662 bp, Artificial Sequence
  Description of Artificial Sequence: Synthetic coding sequence
atggccgctgttagcctgcggcttggggatctagtgtggggcaagctgggacgctatccaccctggcccggaaaaatagttaacccacccaaggatttgaaaaagccccgaggaaaaaaatgtttcttcgttaaatttttcggcaccgaagatcacgcctggattaaggttgagcagctcaaaccgtaccacgcccacaaggaggagatgataaaaattaataaaggtaaaagattccagcaggctgtagacgccgtggaggagttcctgagacgtgcaaaggggaaggaccaaacctcaagccacaacagtagtgacgacaaaaatagaaggaatagttctgaggaaagatcgcgacctaactccggggatgagaaacggaagctttccttgagtgaaggcaaggtgaaaaagaacatgggagagggaaagaagagagtaagtagtggctctagcgaaagaggctcaaagtctcccctgaagagagctcaggagcagtcacctagaaagcgcggaagaccaccaaaggatgaaaaagatctgacaatccccgagtcctcaacggtgaaaggtatgatggcgggaccaatggctgccttcaaatggcagcctacagcctccgaaccagtgaaggacgccgatccacatttccatcatttcttgctctctcagaccgaaaagccggctgtttgctaccaggcgatcaccaagaagctgaaaatctgcgaggaagaaacggggtccacatcaatccaagccgcagattccacagccgtaaacggctcgattacaccaacggacaaaaagattggattcttgggcttgggcctgatggggtctggtatagtgtcaaacctcttgaaaatggggcacactgttacagtttggaataggacagctgagaagtgcgatctctttatccaggaaggcgctagactcggcaggactcctgcagaggtcgtttccacctgtgacatcaccttcgcgtgcgtgtccgaccctaaagctgccaaagacctggtgcttggaccctctggagtcctgcaaggtattcgacccggtaaatgctacgtggatatgtctactgtagacgccgacacggtcaccgaactggctcaggtgattgttagtcggggaggcaggtttctcgaagcccctgtgtcgggcaatcagcagctgtctaatgacggaatgctggtgattctggctgcaggagatcggggactttacgaggactgctcttcatgctttcaggcaatgggaaaaacgtctttcttcttaggagaggttggtaatgctgccaaaatgatgcttatagtgaacatggtgcagggatctttcatggccactatagccgagggcctgacactggcccacgttacaggtcagtctcagcaaactctactagacattctgaaccagggtcagctggcaagtattttcctggatcagaagtgccagaatatcctgcaaggcaacttcaagccagacttctacctcaaatacattcagaaggatctgagacttgccatagccttgggcgacgcagtgaatcatcccacgcccatggcagcagccgcaaacgaggtgtataaaagagcgaaagctctggatcagagtgacaatgacatgtcggccgtttatcgggcttacattcattag

SEQ ID NO: 23008 - DNA, 1611 bp, Artificial Sequence
  Description of Artificial Sequence: Synthetic coding sequence
atggccgcagtctcactgcggctcggggaccttgtgtggggcaaactggggagatacccaccgtggccaggtaaaatcgtgaaccctccgaaagacctgaaaaagcctcggggtaagaagtgcttcttcgtcaaattctttggtactgaggaccacgcctggataaaggttgaacaactgaaaccatatcacgcgcataaagaagaaatgatcaaaataaacaagggcaaacggttccagcaagcggtcgatgctgtagaggagttccttagacgtgccaagggaaaagaccagacctcttcccacaattctagtgatgacaaaaatcgcaggaattcttctgaggagcgatccaggcccaactcgggagacgagaagcgaaagctgagcctgtctgagggcaaggtgaagaagaatatgggggagggaaagaaaagagtgtcctcaggaagtagcgagcgcggatctaaaagcccattgaagcgagcccaagaacaatccccacgaaagaggggacggcctccaaaggacgaaaaagacttgactatccccgagtcctcaactgtaaagggaatgatggctggcccaatggccgcattcaaatggcagcctactgccagcgaacctgttaaggacgccgatccacacttccatcatttcttgctgtcccaaactgagaaggagaccggctctaccagcattcaggcagctgacagtaccgccgtgaatggttccatcactcccacagataagaagattggttttttaggtctcggactgatgggctctggcatagtgtccaacctactcaaaatgggacatactgtaacagtgtggaaccgtactgccgaaaaatgcgatctctttattcaagagggtgccaggctcgggagaacccctgctgaggtggtgtctacctgcgacatcacttttgcatgcgtctctgatccgaaggctgccaaagatcttgttctaggcccaagcggcgtcctgcagggaatcaggcctggaaagtgttacgtagacatgtctacggtggacgctgatacagtcaccgaacttgcacaggtcatagtctccagaggaggccgtttccttgaggctccggtaagcggtaatcagcaacttagcaacgacggcatgcttgtgattctcgcggcaggagaccgaggcttatatgaggattgttcttcctgcttccaggcaatggggaagacctcattcttcctcggggaggtgggcaatgcggcaaagatgatgcttatcgtcaatatggtacagggaagcttcatggctaccatcgcggagggcttaactttagcccacgttacaggccagtcgcagcagacgctgttggacatcttaaatcaagggcagcttgcaagcattttcctggatcaaaaatgccagaacatcctgcagggtaacttcaagccggatttctacctgaagtatattcagaaagacctaagactggccatcgcgctgggtgacgccgtgaaccatccgacccccatggccgcagctgccaacgaggtgtacaaaagggctaaagctctggatcaaagcgataatgacatgtctgcggtgtacagggcttacattcattag

SEQ ID NO: 23009 - DNA, 1419 bp, Artificial Sequence
  Description of Artificial Sequence: Synthetic coding sequence
atggcagctgttagtttgcgcctgggagatctagtatgggggaaactggggaggtatcctccatggccgggtaaaatcgtgaatcccccaaaggacctgaagaaaccgagggggaaaaaatgtttcttcgtgaaatttttcggcacagaggaccatgcttggatcaaggtcgaacagctgaagccatatcatgcccataaggaggaaatgatcaagatcaataagggcaagcgattccaacaagcggtcgacgcggttgaggaatttttgagaagagctaaaggtaaggaccaagatcttaccatacctgaaagctccactgttaagggaatgatggctggccctatggcagcgttcaagtggcaaccgacggcaagcgagcccgtgaaggatgcggatcctcattttcatcactttttgcttagccagaccgaaaaaccagctgtctgctatcaagccatcacaaagaagctgaaaatttgtgaggaggaaactggcagtacctccatccaggccgctgacagcaccgctgtcaacggcagtatcacgcccacagacaagaagatcggctttctggggctaggcctcatgggatctggcatcgtttcaaatttactgaagatggggcacaccgtgaccgtatggaatcggacagctgagaaatgcgacctatttatccaggagggcgctagacttggcaggactcctgctgaggtagtctccacatgtgatattacgtttgcatgcgtgagtgaccccaaggccgcaaaggatttggtgctgggcccaagtggggtgcttcaagggatacgaccaggtaaatgctacgtcgacatgagtactgttgatgctgacacagtcactgagctcgcacaggtgatcgtttcacggggtggtagattcctcgaagcacctgtgtccgggaatcagcagctctctaatgatggaatgctggtcattttggcagctggtgacaggggcctgtatgaagactgctcttcctgcttccaagctatggggaagacctctttctttctgggcgaagtgggcaacgcagctaaaatgatgctaattgtgaatatggtccagggaagcttcatggctaccatcgctgaaggtctgaccctagcacacgtgacaggccaaagccagcagacactattagacattctgaaccagggacagctggccagtatctttcttgaccagaagtgccaaaacatacttcagggcaattttaagcccgatttttatctgaagtatattcagaaagatctgaggcttgcgatcgcgttgggggacgccgtgaatcaccctacacccatggcagccgcagccaacgaggtgtacaagagagcgaaggccctggatcaatctgataacgatatgtccgccgtatatcgcgcttacattcactag

SEQ ID NO: 23010 - DNA, 6723 bp, Artificial Sequence
  Description of Artificial Sequence: Synthetic coding sequence
atgttaccttgtaagaaaagaagaacaacagtgacggagagccttcaacacaaaggaaatcaggaagagaacaacgtagatctggaatctgccgtgaaacccgagagcgatcaggttaaggatctaagtagcgtttctctgtcttgggatccatcccacggcagggtcgcaggatttgaagtgcagtccttgcaggatgccggtaaccagctaggcatggaggatacttccttgagctccggaatgctcactcaaaacaccaatgtgcccattcttgaaggagtggatgtggccattagtcagggaataaccctcccctctctcgaatcttttcaccccctcaatatccacatcggcaaaggcaagttgcatgcaaccggaagcaaaaggggaaagaagatgaccctgcgccctgggcctgtgacccaggaagaccggtgcgatcaccttacactgaaggagccattctctggcgagccaagcgaagaagtgaaagaagaggggggaaagccacagatgaacagtgagggtgagatcccatcactgcctagtggctcccagtccgccaaacctgtgtcccagcccaggaagagcacccagcctgacgtctgtgcttccccacaggaaaagccgctgcgcacactgttccaccagcccgaggaggagattgaggacggtgggctcttcatccccatggaggagcaagataatgaggaatctgagaagcgaagaaaaaagaagaaaggcacaaagagaaagcgcgatgggagagggcaagaagggacattagcctatgatttgaagcttgatgatatgctggataggaccctggaagatggggctaagcagcataatttaactgctgtgaacgtcagaaatatactacatgaggttataaccaacgaacacgtagtggccatgatgaaggccgcaatttctgagacagaagatatgcccatgttcgaacccaaaatgacccgctctaaactgaaagaggtggtggagaagggcgttgtcatccccacatggaacatttctcccatcaagaaggccaatgagataaaaccccctcagtttgtggatatccacctagaggaggacgattctagtgacgaggaataccaacctgacgatgaggaagaggacgagactgctgaggaaagcctgctcgaatcagatgtggaatccactgcctccagccccagaggggctaaaaagtcacggctccgtcagtcaagtgagatgacagaaactgatgaggagtcaggcatactatcagaagccgagaaagtcaccaccccagctattcggcacatttcggccgaagtggtcccaatgggtcccccacctccacctaaacctaagcaaactcgggattctacgttcatggaaaagctccatgcagtggacgaggagcttgcttcttcacccgtgtgtatggattcttttcagcccatggatgactcactgatcgcattccgaacacgctccaagatgccactgaaagatgtgcccctgggccagctggaggccgaactccaggctccagatatcacacccgacatgtatgatcccaacacagccgatgacgaggactggaagatgtggctaggtggcctgatgaatgatgatgttggcaatgaggatgaagccgacgatgacgacgatcctgaatacaactttttagaagaccttgatgagccagacaccgaggactttaggaccgaccgggctgttaggattaccaagaaggaggtaaacgagctcatggaggagctctttgaaacattccaggacgagatggggttttccaacatggaggatgatggccctgaggaagaggagtgtgtggctgagccccgtcctaatttcaacaccccccaggctctgaggttcgaagaaccgctcgcgaacttattgaatgagcagcaccgcacggtgaaggaactctttgagcaactgaagatgaagaagagttctgcaaaacagctgcaggaggtggaaaaagtgaagccccagtccgagaaagtgcaccagactctgatcctggacccggcacaacgcaagagactgcagcagcagatgcagcagcacgtacagttgttgacccaaatacacctactggcaacatgtaatcctaacctcaatccggaagccactaccacccgaatattcctcaaggagctcgggacgtttgcccagtcatccatagcactccatcaccagtacaatccaaagttccaaacactcttccagccttgtaacctaatgggagccatgcagctgattgaagatttcagcacacatgtttccattgactgcagcccccacaaaaccgtgaagaagactgccaatgagttcccatgcctccccaaacaggtggcatggatcctcgccacctcgaaagtatttatgtacccagaattattacctgtgtgctcacttaaggccaagaatccccaggataagatcgttttcactaaagccgaagacaatctcctcgcactgggtctcaaacacttcgaagggactgagtttccaaaccctttaatctcaaagtatctcttgacctgtaagactgcgcatcagcttactgtgcggattaagaatcttaatatgaatcgggctcccgacaatataattaagttttacaaaaagacaaaacaactgccagtgcttgggaagtgctgcgaggaaattcagccccatcaatggaagccgccaattgagcgggaggaacatcggttacctttctggctcaaagcctccctgcccagcatacaggaggaactccgacacatggccgacggagcacgtgaggtcggtaatatgaccgggaccaccgaaataaactctgacagatctctcgaaaaagacaacctggagctgggctctgaaagcagatacccactcctgctgcccaagggggtggttcttaagttaaagcccgtcgccacaaggttcccacgcaaggcctggagacagaaaaggagctctgtactgaaacctctactcatccagccatctccatctctgcagccctcctttaatcctggaaaaacaccagctcgaagcacacacagcgaggcgccaccctcgaagatggttcttcgtattcctcatcccattcaacctgccaccgtgttacaaaccgtcccaggagtgcccccacttggggtcagcggcggagagtcctttgaatctcctgccgcacttcctgccgttccacccgaggctaggactagtttccctctgagcgagtcccaaacactgctgagcagcgcccctgtgccaaaagtaatgcttccgtccttggccccaagtaagttccggaagccctacgtgcgaagaagacccagcaaacgccgaggggtgaaggccagcccttgcatgaaacccgctcccgtgattcatcacccagcgtcggtgatatttactgtgccagctaccacagtcaagatcgtcagtctgggaggtggctgcaacatgatccagcctgtgaatgccgcagtggctcagagccctcagactattccgattacaactttactggttaacccaacaagctttccctgtcccctgaaccagagcctcgtggctagttccgtctcacctctcatcgtgagtggcaactcagtgaatctccccataccatctacccctgaagacaaggcgcacgtgaacgtggacatcgcttgtgcagtggctgacggcgaaaatgccttccaggggctggaacccaaactggagcctcaggagctttcccctctaagtgccactgtcttccccaaggtggagcacagccccggtcccccattggccgatgccgagtgtcaagaggggctctccgaaaacagtgcctgccgatggaccgtggtgaagacagaagaggggcgacaggcgctcgagcccctgccacagggaatccaggaatctctgaataatcccaccccaggcgatttagaggagattgtgaaaatggagcctgaggaggcccgagaagagatctcaggctctccagagagggacatctgcgatgatatcaaggtcgagcatgcagtggagcttgataccggggctccaagcgaggagttgtcaagcgcaggggaagtgacaaaacagacggtgttacagaaagaggaagagcgttcccagccaactaaaacaccgtcaagctcccaggagcctccagacgaagggactagcggaactgatgtcaataagggcagttcaaaaaacgctctttcaagtatggaccccgaggtgcgcctttcctccccacccggtaagccagaagattcatctagcgttgacggccaatccgtggggacacccgtggggcctgagacaggtggggagaagaacgggcctgaagaagaagaggaggaagattttgacgatctaacacaggatgaggaagatgaaatgagttccgcatcggaggagagcgtgttatccgttcccgaactacaggagactatggagaagctgacctggctggcatctgaacggcgaatgagccaggaaggggagtcagaagaggaaaattcccaagaggaaaattccgaaccggaggaggaggaggaagaagaggctgaaggcatggaatcactgcagaaagaggacgaaatgacggacgaagcagttggggattcggcggaaaaaccccctacattcgccagtccagaaaccgccccagaggttgaaactagtcgcacgccacccggtgaatcgattaaggccgctggcaagggcagaaataaccatagagccaggaacaagcggggttctcgggcacgcgcaagtaaggacacatctaaacttctgctgctatatgatgaagacattctggaacgggatccactacgggaacagaaagatctggccttcgcccaggcttacctgacccgggttagagaggcactgcaacacattcccggaaaatacgaagacttcctccaggtgatttacgagttcgagtcaagcacccagagacgcaccgcggtggatctttataagagcctgcagatcctgcttcaggattggccccaattgttgaaagacttcgctgcgtttcttttgccagaacaggctctcgcttgcggtctgtttgaggaacaacaggcatttgagaaatcacgaaagttcctccggcaactcgagatttgtttcgctgagaacccctcgcatcatcagaaaatcatcaaggtcctgcaggggtgtgccgattgtctcccccaagagatcactgagttgaaaacacagatgtggcagctgttaaaaggacatgatcacctgcaggacgagttttccatttttttcgaccacttacgccctgcagcttcccggatgggagatttcgaagaaatcaattggaccgaggaaaaggagtatgagtttgacggcttcgaggaagtagcgctgcccgatgtagaagaggaggaagaaccccctaaaatccctacagccagtaagaacaagagaaagaaagaaattggcgtgcaaaatcacgacaaggagacagagtggccggatggcgctaaggactgcgcctgctcatgtcacgaggggggacccgattccaaattgaagaagtccaagcgccgaagctgcagtcactgttcttctaaagtctgcgactctaagtcatataagtctaaagagccacacgaactcgttggatccagccctcaccgcgaagcctcccccatgcctggtgctaaagaggcgggtcagggaaaggacatgatggaagaagaggcacccgaggagcgagaaagtactgaggccacccagtcacggacagtcaggacaaccaggaaaggggaaatgccagtgagtggcctggctgtcggaagcaccctcccctcccccagagaagtgaccgtgaccgaaaggctgcttctggacggtcccccaccccattctcctgagaccccacagtttccacctaccacaggtgccgtcctgtatactgtgaagcggaaccaggtcgggccagaggtaaggtcatgccccaaagcatctccaagactgcaaaaggagcgggaaggacagaaggctgtgtccgagagtgaagctttgatgttagtgtgggatgcgagtgagacagaaaagctgcccggaactgtcgaacccccagcttcgttcctcagcccagtgtcttccaaaacgcgggacgccggacggaggcatgtttccgggaaacccgatacccaggaaaggtggttgcctagttcccgagccagggtgaaaaccagagatcgcacatgtcctgtacatgaatctccaagtggaattgataccagcgaaacgagccctaaagcccctcgtgggggtctggctaaggactctggaacccaagcaaaaggcccagagggagagcagcagcctaaggccgcagaggcaaccgtttgtgccaacaatagtaaagtgtctagcacaggggaaaaagttgttctgtggacgagagaagccgatcgtgtgatcctcacaatgtgccaggagcaaggtgcccagcctcagacgtttaacattatttcacagcagctcggtaataagacacctgcggaagtcagccaccgcttccgggaactgatgcagctgtttcataccgcttgtgaggcctcctctgaagacgaggatgacgctacaagtacgtcaaacgcggatcagctttcagaccatggagaccttctgtccgaggaagagctggacgaatat

SEQ ID NO: 23011 - DNA, 4590 bp, Artificial Sequence
  Description of Artificial Sequence: Synthetic coding sequence
atgctgccgtgtaagaagcgcagaactacagttacagagtctcttcagcacaaagggaaccaggaggaaaataatgtagaccttgagagcgccgtgaagccggaaagtgaccaggtaaaagacctgagctccgtatccctcagttgggatccatcgcacggccgagttgctgggttcgaagttcaatctcttcaagatgcgggaaatcagctgggaatggaggatacctcattaagcagcggaatgctgacccagaacaccaacgtgcccatcctggaaggcgttgatgttgccattagtcaggggattaccctcccgtctttagaaagcttccatccactaaatattcatataggtaaaggaaaattacacgcaaccggctccaaaagaggcaagaagatgaccctgcggccaggccctgtaacgcaggaagatagatgtgatcacctgaccctcaaggagccgttttcaggcgagcccagcgaggaggtgaaagaggaaggtgggaagcctcaaatgaactccgagggcgagatcccctccctacccagcggcagtcagtccgctaaaccagtctcacagccgagaaaatccacccagccagatgtttgcgccagccctcaggagaagccgttgcgaacccttttccatcagcctgaggaagagatcgaagacgggggactgtttattcccatggaggagcaggataacgaggagtcagaaaaacgtcgtaagaagaaaaaaggcactaagcggaaaagagacggtcgcggtcaggagggcacgttagcctacgatctgaaactggatgacatgctagatagaaccctggaggacggggctaaacaacataatcttactgcagttaacgtccgcaacattctgcatgaagtgatcacaaacgagcacgtggtggccatgatgaaggctgctatatccgaaaccgaggatatgcccatgtttgagcctaaaatgacgaggagtaagttaaaggaagtggtcgaaaaaggggtagtcatacctacatggaatatttctcctattaaaaaggctaacgaaattaaaccccctcagttcgtggatattcacctggaagaggatgatagcagcgatgaagagtatcagcctgacgacgaggaagaagatgaaactgccgaggagagtctgttggaatcagacgtggagtcgacagcttcaagccctcggggtgcgaaaaagtctcgcttaaggcagagctcggaaatgaccgaaaccgatgaagagagcggcatactttccgaagcggaaaaggtgactacccctgccatcagacatatttctgctgaagtggtccccatgggtccaccgccacctcccaaacctaaacaaacaagggatagcacattcatggaaaagttgcacgccgtcgacgaggaactcgcctcaagcccagtctgcatggactctttccagccgatggacgactccttgatcgcatttagaacccgctccaagatgccactgaaggacgttcctcttgggcagctcgaagccgagctgcaggcacccgatataacccccgatatgtacgatccaaatactgccgatgacgaagactggaagatgtggctcgggggacttatgaacgacgacgtagggaacgaggacgaggctgacgatgatgacgatcctgagtataacttcttggaggatctggacgagcctgatactgaggatttccgcactgacagggccgtccgaatcaccaagaaggaggtaaacgagttgatggaggaactttttgagaccttccaggacgaaatgggcttttccaacatggaagacgacggaccagaagaggaagaatgcgtggccgagccaaggcctaacttcaatacgcctcaggctcttcgatttgaggagccactcgccaatctcctgaacgaacaacatcgaacagtgaaggaactatttgagcagctgaagatgaaaaagtcaagcgctaaacaactacaggaggttgagaaggtgaagcctcagtcagaaaaagtgcatcagacgcttattctcgacccggcacagcgcaagaggttacagcagcagatgcagcagcatgtccagcttctgacgcagatacacctgctggccacctgcaacccgaatctcaacccggaggctacaaccacacgtatcttcctgaaagaactgggaactttcgcacagagtagcatcgccctgcatcaccagtacaaccctaagtttcaaaccctctttcagccgtgtaacttaatgggagcgatgcaactcatcgaagatttctcaactcatgtctctatcgactgttcaccacacaagacagtgaaaaaaaccgccaatgaatttccctgcttgccaaaacaggtcgcatggattcttgctaccagcaaggtgtttatgtatcccgagctgctgcctgtttgtagcctgaaggctaaaaatccacaagacaagattgtttttacgaaggctgaggataatctcctggccctgggcctgaaacattttgaaggcacagaatttcccaatcctttgatttctaaatatttgttaacgtgcaagaccgctcaccagctcacagtccgcattaaaaacctcaatatgaacagagccccagataacatcatcaagttttacaaaaagacaaagcagctgcctgtgctcggcaaatgttgcgaggagatacagcctcaccaatggaagccaccaatcgagagggaggaacatagactgccgttctggctgaaggcgagtctaccctcgatacaagaggagctgcgccatatggcagacggggctcgcgaagtcgggaacatgactggaacgacagaaattaatagtgataggtccctggaaaaagataatctggagttgggatctgagtcccggtacccgctgctgttgcccaaaggagtcgtgctgaagctgaagccggtcgccaccaggttcccaagaaaggcttggcgccaaaagcgttcaagcgttctgaagccgctgctgatccagccctcccccagtctgcagccaagtttcaaccccggaaaaacaccagccaggtccactcattctgaggctcccccatcgaagatggtgctgcgaattccacaccctatccaacccgcaaccgtgctccagactgtgcccggtgtcccccctctgggggtgtcagggggagaatctttcgagtcccctgcagccctgcccgctgtcccaccagaggccagaacctcgtttccactatcggagtcgcaaaccctcttgtcctcagcgccagtccctaaggtcatgttgccctccctcgccccaagcaagtttcgtaagccctacgttagacgcagaccctccaagcgcagaggtgtgaaggcttctccatgtatgaagccggctcccgtgatccatcatcctgcttccgtaattttcaccgtgcctgctactacagtgaagatcgtgagcctgggaggcggatgtaatatgatccagcccgtgaacgcggctgtggcacagtctccccaaacgattccaattacgactctcctcgtcaaccctacttcatttccctgtcccttgaaccaaagcttggtcgctagctctgtatcaccgcttatcgttagtggaaactcagtaaatttacctatcccctccactcctgaggataaggctcatgtgaatgtggacattgcgtgcgccgtggccgacggtgagaatgccttccagggcctcgagccgaagctggaacctcaggagctgtcccccttgtccgccactgtgtttccaaaggtagaacattcaccaggcccacctcttgccgatgctgagtgtcaggagggtctttccgagaattccgcgtgccgctggaccgttgtgaaaactgaagaaggaaggcaggcgctggagcccctccctcaaggtattcaggagtcgcttaacaatccgactccgggagatctggaggagatcgtgaagatggaacctgaggaagctagggaggagatttctggcagtccagaaagggacatctgtgacgatatcaaggtagaacacgcagtggagctcgacacaggagccccttcagaagagctatcttcagcaggcgaggttaccaagcagactgtcctccaaaaggaggaagaacggagccagcccaccaagactccaagttcatctcaggaacctcccgacgagggcacttcagggaccgacgttaataagggttcctccaaaaatgcattatccagtatggaccctgaagtgcgattatccagtccccctggaaagcccgaagactcatcttccgtggacggccagtccgtgggaactcccgtgggccctgagaccggaggggagaaaaatggaccagaggaagaggaggaagaagactttgatgacttaacccaggacgaggaagatgagatgtcctcggcctccgaagagagtgtactctcagtcccagagctgcaggtacgagctggcgaatactctcaggttttcaggggcttatccaatatgtaccatctactcatctgtcacctgctggcttgttgcactatggactctcccaagattatctgcatctag

SEQ ID NO: 23012 - DNA, 726 bp, Artificial Sequence
  Description of Artificial Sequence: Synthetic coding sequence
atgtatgaccctaatacagcagacgatgaagattggaagatgtggctcgggggactcatgaatgacgacgtcggcaacgaggatgaagcagatgatgatgacgaccctgagtacaactttctcgaggatcttgatgagcccgacacagaggacttccggacggaccgtgcagtgagaattacaaagaaggaagtaaatgagctgatggaggagctttttgaaacattccaagacgaaatgggctttagcaatatggaggacgacggtcctgaggaggaggaatgtgttgcagagcccagaccaaacttcaacactccacaggcattaagattcgaggaaccgctggccaacctgctaaatgaacagcataggactgtgaaagagctctttgagcagctgaaaatgaaaaaaagcagtgccaaacagttacaggaagtcgaaaaggtaaagccgcagtccgagaaggtccaccagactctgattctagatccagcccagagaaagcggctgcagcagcagatgcagcagaaagagctcggcacctttgcacagagttccatcgctttgcaccaccaatacaatcctaaatttcagaccctgttccagccatgtaatctgatgggcgcaatgcaactgatcgaggatttcagcactcatgtgagcatcgactgttcgcctcataagaccgtcaagaagaccggtagacgtcagatgtgccagctgtag

SEQ ID NO: 23013 - DNA, 6725 bp, Artificial Sequence
  Description of Artificial Sequence: Synthetic coding sequence
atgctgccatgtaaaaaacggcgaacaaccgtgactgagtccctccagcataaggggaaccaggaagaaaacaatgtagacctggagtctgccgttaagccagaaagtgaccaggtcaaggaccttagcagcgtcagcctgtcatgggacccaagtcatggacgggtcgcagggtttgaggtgcagtccctccaggatgcaggaaatcagctaggaatggaagatacatctttatcttctggaatgctgactcagaatacaaatgtacccattctggagggagttgatgtggcgatctcccaggggatcactcttccatcgcttgaatccttccatccactgaacattcatataggaaaggggaagctccatgcaactggatccaagaggggtaagaagatgactcttcggcctgggccagtgacgcaggaagacagatgcgaccatctgacactgaaagagccattttctggggagccctccgaagaggtgaaggaggagggcggaaagcctcagatgaattccgagggagaaatcccctcacttcccagcgggtcacagagtgctaagcccgtatcccaaccaagaaagtcaacccagcctgatgtctgtgctagcccgcaggagaagccactgcgaacactcttccatcagcctgaagaagagattgaggatggaggtttatttattcctatggaagaacaggacaatgaggaatccgagaagaggcggaagaagaagaagggcactaagcgtaaaagagacggcaggggccaggagggcaccttggcatacgatctcaagttggatgatatgctggaccggacactcgaggatggtgccaaacaacataacctcactgcggtgaatgtgcgcaacattctgcatgaggtgattaccaacgaacatgtggtggcaatgatgaaggccgcaatctctgaaaccgaggatatgccaatgttcgaacctaagatgacaaggagtaagctgaaggaagtcgtcgaaaaaggcgtagtgatccccacttggaatatcagccccatcaaaaaggctaatgaaattaagcccccacaatttgtcgacattcatctggaagaagacgatagttccgacgaagaatatcagcctgacgatgaggaagaagacgaaacagctgaggagagtctgctggagagcgacgttgaatcgacggcctcaagccctcgcggtgcgaaaaagtccagactcaggcagtcaagcgaaatgaccgagactgatgaagaatcagggatcctgagcgaggctgagaaggtgacgactcctgccatcaggcacatctcggctgaggttgtgcccatggggcctccgcctccacccaagcccaaacaaaccagagactccaccttcatggagaagcttcatgccgtcgacgaagaacttgcatcatctcccgtctgtatggattctttccaaccaatggatgatagcctcatcgccttccgcacaagaagtaagatgcctctcaaggacgttcctttgggtcaactggaagcggaactacaggcgccagatattactcctgacatgtacgatcctaacactgccgacgacgaggattggaaaatgtggctcggcggactgatgaacgacgacgtgggcaacgaggatgaagcagatgatgatgacgaccctgaatataacttcctggaggatcttgacgagccagatacagaagacttccgaacagaccgagccgtacgtatcacgaagaaggaagtaaacgagttgatggaggaactgtttgaaacattccaggacgagatgggcttctctaatatggaagacgacggacctgaagaagaagagtgcgtagccgagccccgaccgaattttaacacaccccaggccctgcggtttgaggaacccctcgctaacttgctcaacgagcagcataggaccgtgaaagaactgttcgagcagcttaagatgaaaaagagttccgctaagcagttgcaggaagttgaaaaggtcaaaccgcagagcgagaaggtgcaccagacactaattctggatcccgctcagcgcaagcgattacagcagcagatgcagcagcacgtgcagctgctaacccagatccatcttctggctacttgcaaccctaatttgaacccggaagcgacaacgacacggatcttcctgaaagaactgggtacttttgctcagtcatcaatcgcactccaccatcaatacaatcctaaattccagaccctgttccagccatgtaaccttatgggcgctatgcagctcatcgaagacttctctacacacgtctccatcgactgttcacctcacaagacagttaaaaagactgccaacgagttcccctgccttcccaaacaggttgcatggattctggccacttccaaagtgttcatgtaccccgaattgctgccagtttgtagccttaaggcaaagaatccacaggataaaatcgtcttcacgaaagccgaagacaatcttcttgccttagggctcaaacactttgagggcacagagtttccaaatccccttatcagcaaatatcttttgacgtgcaagactgcccaccagctgacagtcagaattaagaatctgaatatgaacagagcgcctgataacattataaagttttataagaagaccaaacagcttccagttctgggcaagtgttgtgaagaaatccagcctcatcagtggaagcccccaattgaaagagaggagcaccggttgcccttctggttgaaagcttctttgccatctattcaggaagagcttcggcatatggcggacggggcacgggaggttgggaacatgaccggtacaaccgagataaactctgaccgctcccttgaaaaggacaatctggagctgggctccgaatcccgttaccccctgctgttaccgaaaggtgtggtgttaaagctcaaacctgtggcgacccgcttccccaggaaggcgtggagacagaaacggtcatcagtgttaaagccgcttttaatccagccctctccatcgttacagccatcttttaacccgggaaagaccccggctcgaagtacccactccgaagcgcctccttccaaaatggttctcaggattccacatcctatccagcctgccaccgttctgcaaaccgtgccaggagttcctcccctcggggtaagcggcggtgagagtttcgaaagccctgccgcacttcccgctgtacctcccgaggccagaacaagcttcccactgtctgaaagtcaaaccctactcagctccgccccagtgcctaaggtaatgctgccaagtttggcaccctcgaaatttaggaaaccctatgtgcgcaggagaccctccaagcgccgaggcgtcaaggccagcccttgtatgaagccggctcccgtcattcaccatcctgcatctgtcatcttcacagtaccagctacgactgtgaagattgtttctctcggtggcggatgtaacatgattcagccagtgaacgctgccgtggcccagagtccacagacaatcccaattacaacgctgttggtgaaccctaccagctttccttgtcctctgaatcaatccctcgtggcctctagtgtgagccccctgattgtgtccggaaattctgtgaatctgcccattccatcaaccccggaagacaaggctcacgtcaacgtggatatcgcctgtgctgtggcggacggtgagaacgccttccaaggattagagcctaagcttgagccacaggaattatctcctctcagtgctaccgtctttcctaaggttgaacattcaccgggtccgcctctggcagacgctgaatgccaggaaggactctctgagaattctgcctgtcggtggacagtggtgaaaactgaggaagggagacaggctctggagccccttcctcagggaattcaggagagcctcaacaaccctacgcctggggacctggaggaaattgtcaaaatggagcctgaggaagccagagaggaaatttcaggatcccccgagagagatatttgcgatgacattaaggtcgagcacgcggtggagctggacacaggcgctccctccgaggagctctcctccgccggagaggtgacgaagcagactgttctgcaaaaagaggaggagagatcacagcctacaaagactccgtcttcttcgcaggagcctccagacgaaggaacttccggcactgatgttaataagggatctagcaagaatgcactttcatcaatggatccggaagtccggctctcctcccctcccggaaaacctgaggactcctccagcgtggacgggcaatccgttggtactcccgtaggaccagagacagggggtgaaaaaaacggacctgaggaggaggaggaggaagatttcgacgatctgacccaggatgaggaggacgagatgagcagtgcctccgaggagtccgtcttaagcgtgccagaactccaggagacaatggaaaagctaacttggctggcttctgagagaagaatgtcccaggaaggtgaatccgaggaggaaaactcccaggaggagaactctgagcctgaggaggaggaggaggaggaagctgagggtatggagagcctgcaaaaagaggacgagatgactgacgaagccgtgggagactcagctgagaagccccctacctttgcctcccccgagacagcccctgaagtcgagacatccagaactcccccaggcgaatccatcaaagccgctggtaagggtaggaacaatcatagggcacggaacaagcgaggctcccgggctcgcgcttcaaaggatacatccaagttactgttgttgtacgatgaggacatactggaaagggacccgttgcgcgaacaaaaagatctggcattcgcacaggcatacttgaccagggttagggaggccctgcaacacatacccggtaagtacgaagatttcttacaggtaatctacgagtttgaaagctccacacagcggagaaccgcggtggacttgtacaagtcactgcagatcctgctgcaagactggcctcagctgctgaaggatttcgccgcttttctgctgccagagcaggcactcgcctgtggtctttttgaagaacagcaggccttcgaaaaatctcggaagtttctgagacaactggagatctgttttgccgagaatccttcccatcaccagaaaatcattaaggtgctccagggatgtgcggattgcttaccccaggaaattaccgagctgaagactcagatgtggcaactgcttaagggacatgaccacttgcaggacgaatttagcattttctttgaccatctccgacctgctgcctcaaggatgggagatttcgaagagatcaattggactgaggagaaggagtacgaatttgacgggtttgaagaagtggcactgccagatgtggaggaagaggaggaacccccaaaaatccctaccgcaagtaagaataaaaggaaaaaagaaatcggggttcaaaaccacgataaagaaactgaatggcctgacggagcaaaagattgcgcctgctcgtgccacgaagggggtcctgatagcaagcttaaaaagagcaagagacgctcctgcagccactgttcatccaaagtctgtgattcaaaatcatataagtcaaaagaaccacatgaacttgtaggcagctccccacaccgagaggcctcaccgatgccaggcgctaaggaggctgggcagggcaaagacatgatggaggaggaggctccagaggaaagagagtccaccgaagctacgcagtctaggacagtccgtaccactaggaagggagaaatgccggtttctgccggtctggctgtaggatcaaccctgccgtcacctagagaagtgaccgtaaccgagcgactcctcctggacgggcctccgccacatagtccggagacaccacaattcccaccgaccactggtgctgtgctgtacaccgttaagcgcaaccaggtgggccctgaggttagaagttgtcccaaggcctccccccgactccaaaaggaacgagaaggtcagaaagctgtctccgaatctgaagctctgatgcttgtgtgggacgcctccgagaccgagaagttacccggaaccgtcgaacctcccgcttccttcctgtccccggtctcatctaagacccgcgacgctggaagacggcacgtgtcagggaaacctgacacacaggagcggtggcttcccagttctcgtgctagagttaaaacccgcgaccgcacatgtcctgtccatgagtccccgagcgggatcgacacatctgagaccagcccaaaggcacctcgtgggggtctggctaaggattccggaacccaagctaaaggccctgaaggggaacagcagcccaaggcagccgaggccactgtctgtgctaacaacagcaaggtgtcctctactggcgagaaagttgtgttgtggacacgagaagctgacagagtgatccttaccatgtgtcaggaacagggggcacagccacagacttttaacataatctcccaacagctggggaataagacacctgccgaggtgagccacagattccgcgaattaatgcaattgtttcacactgcctgcgaggcttccagtgaagatgaggatgacgccaccagcacctccaatgcagatcagctctctgaccatggtgacctgctctcagaagaagaactagatgaata

SEQ ID NO: 23014 - DNA, 6722 bp, Artificial Sequence
  Description of Artificial Sequence: Synthetic coding sequence
atgctgccctgtaaaaaaagaagaacaacagtcactgagagtctccaacataagggtaatcaggaagaaaacaatgtcgatctagagagcgccgttaagcccgaatcagaccaggtgaaagatctgagcagtgtgtcattatcttgggaccctagtcatggcagagttgccggtttcgaagtgcagtccctccaagatgccggaaatcagctgggtatggaggacacctcattgtctagcggtatgttaacccagaacactaatgtaccgattttggaaggtgtcgatgtcgctatttctcagggcatcacactgccttccctcgagtctttccaccctctcaatatccacatcggcaaggggaagctgcatgcgaccggttccaagcgaggtaagaagatgactctgcgcccaggtcccgtgactcaggaggatcggtgtgaccacctgactctaaaggagccattttctggagaacccagcgaagaggtcaaagaggagggtggcaagccccaaatgaatagcgagggggaaataccctccctcccgagcggtagtcagagcgctaaaccagtcagccaacctcggaagagcacccaaccggacgtgtgcgcatcaccacaagagaagcctctacgcactcttttccaccagcccgaggaagagattgaggatggcggactgttcatccccatggaggagcaggacaatgaagaatctgagaaacgtcggaaaaaaaaaaagggaaccaagaggaagagagatggaagaggacaagagggcactctagcatacgacctgaagctggatgatatgctggatcggaccctggaagatggagccaaacagcacaatcttaccgccgtaaacgtgaggaatatattgcatgaggtgattaccaacgaacacgttgttgcaatgatgaaagcagccatcagcgagactgaggacatgcccatgtttgagcccaagatgacgcgatctaagctaaaggaagtggtggagaaaggagtagtcatacccacctggaatatttctccgatcaaaaaggcgaacgagatcaaacctcctcagttcgtggacatccatttagaggaagacgacagctcagacgaagagtatcaacccgacgatgaggaggaagacgaaaccgcagaagagtcactgctcgagtccgatgtcgaaagcacagcgtccagtccacggggagcaaaaaaaagtcgtttgaggcagtcctcagaaatgacagaaactgacgaggaatccggtatactgagcgaagcggagaaagtgaccacaccagccatacgccatattagcgccgaggtcgtgcccatggggccacctcccccacctaagccaaagcaaacacgggactctactttcatggagaaacttcatgccgttgacgaggaactggccagctcacccgtgtgcatggatagctttcagccaatggacgattctcttattgctttccgtactaggtctaaaatgccgctaaaagacgtccctctgggtcagctagaggctgaattgcaggccccagacattacacccgatatgtacgatcctaacaccgcagacgacgaagattggaagatgtggcttggaggcctgatgaacgacgatgtgggaaatgaggacgaagctgatgacgacgatgatcccgagtacaattttctcgaggacctcgatgaacctgatacagaggacttccgcacagaccgcgcagtgcgtatcacaaaaaaggaagtcaatgaactgatggaggagttgttcgagacctttcaggatgaaatgggattttcaaatatggaggatgacggtcctgaggaagaagaatgtgtcgcagagccgaggccgaacttcaatacaccacaagccctcagattcgaggaacccttggcgaacctgcttaacgagcagcaccggacggtaaaggagctgtttgagcagttgaagatgaaaaagtccagcgcaaaacaacttcaggaagtggagaaagttaaaccacagtccgaaaaggtgcaccagacacttattcttgatcctgcacagagaaaacgcctccagcagcaaatgcagcaacatgttcagctgctaactcagattcatttgctggctacttgcaatcccaatctcaatcctgaggccaccactacacggatttttctcaaagaactcggaaccttcgcacagtcttctatcgccctccatcatcaatacaaccccaagttccaaacgctgtttcaaccttgcaacctgatgggcgctatgcagctaatcgaagatttcagcacccacgtgagcatcgattgctctccacataaaaccgtaaagaaaaccgctaacgagttcccctgtctgcccaagcaagtggcgtggattctggctacttccaaagttttcatgtatccagaacttttgcccgtttgttcccttaaggctaaaaatccccaggataaaatagtgttcacaaaggcagaggacaatttactggctttgggcctcaagcactttgaggggaccgaatttcctaatcctctgatcagtaaatatctgctcacctgtaaaacagcccaccagctcaccgtaagaatcaaaaacctcaatatgaaccgggcaccggacaacatcattaagttctataagaaaacaaagcagttaccagtactggggaagtgttgcgaggagattcagccccatcagtggaagccccctattgagcgggaggagcaccgtctccctttctggctgaaggcaagcctcccgagcattcaagaagagctgaggcatatggccgacggcgcacgagaggtcggaaatatgaccggcacaaccgagattaactccgaccggtcgcttgaaaaagataatctggaacttggatccgagagtcgatatccactcctactccctaaaggggttgtgctaaaactgaagccagtagccacacgatttccccgtaaagcatggcgtcagaagagatcttctgttctgaaacctctactaatccagcccagccctagcttgcagccctcttttaacccaggcaagacacccgctcggtctactcatagcgaggcacccccaagtaaaatggtcttgcgcatcccacatccaattcaacctgccacggtcctgcagacagtgcccggagttccacctcttggggtgagcgggggtgagtctttcgaatcccccgctgcactccccgcagtgcctccggaggctaggactagtttccccttatccgaatctcaaacactgctgtcgagtgcaccagtgcctaaggttatgttacccagcctggcaccttcgaagtttaggaagccatacgtgcggagaaggccttcaaagagacgcggtgtaaaggcatctccctgtatgaagcccgctccagtgatccatcatcctgctagcgtaatctttactgtgcctgccaccaccgtgaaaatagtgtcccttgggggtggttgtaacatgatccagcctgtcaatgcagcggttgcccaaagccctcaaactatccctatcacaactctgctggtcaatccgacatctttcccatgtccactgaaccagtctctggtggcttcgagtgtgtctcccctgatagttagtggtaattccgtcaatctgccaatcccgagcactcccgaggacaaagctcatgttaatgtggatatcgcttgtgccgtagcagacggagagaacgcctttcaaggattggaacctaaactcgaaccccaggaacttagccccttatccgcaacagtcttccctaaggtggagcactcccccggaccgccactggccgatgctgaatgtcaagagggactgtcagagaattccgcctgccggtggacagtcgttaaaacagaagagggcagacaggcactagaaccacttccgcagggtatccaggagagcttgaataatcctacgcccggagatttagaggagattgtaaaaatggaacccgaggaggctcgagaggagatatcggggtcgcccgagagagatatatgcgatgacatcaaggtagagcacgcagtcgaacttgacacaggagccccatccgaggaactcagcagcgccggtgaagttaccaagcagacggtgctgcagaaggaagaagaacgaagtcagcctaccaagacgcctagctctagtcaggagccgcctgacgagggcacctcaggaacggacgtgaacaaaggcagttcaaaaaacgctctgtcatcgatggaccctgaggtgaggctgagctctcccccaggaaaacctgaggacagctcttccgtggatgggcagtcagtcggcacgcccgtgggacctgagacggggggtgagaaaaacggacctgaagaagaggaggaggaggattttgacgacctgacacaggatgaagaggacgagatgtcttccgcctctgaggagtctgtgctgtccgtgcctgaactgcaggagactatggagaaactaacctggctggcatccgaacgacgcatgagccaggagggcgagagcgaggaagagaatagccaggaggagaattcagagccagaggaggaggaggaggaagaggcagagggcatggagagtttgcagaaggaggatgagatgacagacgaagcggttggggacagtgcagaaaaacccccaacgttcgccagccccgagacggctccagaggttgagacgagccggaccccgcctggagaatccataaaggccgctgggaagggcagaaataatcatcgtgcaaggaacaaaagaggttcaagagcacgggctagtaaagacacatccaagttgctgcttttgtacgatgaagatattctggagcgggatccgctcagggagcagaaggaccttgcattcgctcaagcatacctcacccgggttagggaagccctccaacacatccctgggaagtatgaggatttcttacaggtgatttacgagttcgagagctcaacacagcgccgtaccgccgtagacttgtataaaagtctgcagattttgctccaagattggccgcagttactgaaagatttcgccgcatttttactccccgaacaagcactggcgtgtggactgttcgaggaacagcaggcatttgagaagagtagaaaattcctgaggcagttggaaatctgcttcgctgagaatccaagccaccaccagaagattattaaagtactgcaggggtgcgccgattgcctgccacaggaaattaccgagctcaagacacagatgtggcagctgctgaaaggccatgaccatcttcaggacgaatttagcatctttttcgaccaccttaggcccgcagcgtctcgaatgggggattttgaggaaatcaattggacggaagagaaagagtatgagtttgacggcttcgaggaggtcgctctgcccgatgtcgaggaagaagaagagcccccaaagatacccacagcaagcaaaaataagagaaaaaaagaaattggcgtccagaatcatgacaaagagacagagtggcctgacggtgcgaaggactgcgcatgctcttgtcacgagggaggacctgattccaagctcaagaagtctaagcgtagatcctgcagtcattgttcaagcaaagtatgcgactccaaaagctacaagagtaaagaaccacatgagctcgtgggcagctctccgcacagagaggcaagtcctatgccaggcgctaaagaggccggtcagggcaaggacatgatggaggaggaggcccctgaagagagagagtctaccgaggctacccagagccggaccgtacgcactacacgcaagggcgagatgccagttagcggactagccgtaggtagtaccctgccatctccacgggaggtgactgtgacagaaagacttctgctggacggacccccacctcatagcccggaaactccacaattcccacccactaccggtgccgtgctgtatactgtgaaacgaaatcaagtaggcccagaggtaaggtcttgccctaaagcctcccccagattacaaaaggagagagaaggccagaaggccgtttcagagtctgaggctctgatgctggtgtgggacgcctccgaaacagagaaactacctggcactgttgagccacccgcatcgtttttgtcccccgtctcaagcaagactcgcgatgctgggaggagacacgtgagtggcaagccagatactcaggaacggtggcttccatcctcccgggcacgcgtcaagacccgtgacagaacctgccccgttcacgagagcccttccggcatagacactagcgagacttctcctaaggccccaagaggagggctcgcgaaggattccggaacacaggccaagggaccagaaggggagcagcaaccaaaagcagccgaagcgacagtctgtgccaataatagtaaagtctctagtacaggggaaaaagtggtactatggactagagaggccgatagggtgatacttaccatgtgtcaagagcagggagctcagccacagacgttcaatatcatttctcaacaactgggaaacaagacaccggcagaggtgtctcataggttccgtgagctcatgcagctgttccatacggcgtgtgaggcaagtagcgaggatgaggacgatgccacctcgacatcgaatgccgaccagctgtccgatcacggggacctcttgagcgaagaggaactggatgaata

SEQ ID NO: 23015 - DNA, 2913 bp, Artificial Sequence
  Description of Artificial Sequence: Synthetic coding sequence
atgctgccctgcaaaaagaggagaacgactgtgactgagagcctgcagcacaagggcaatcaagaggaaaataacgtcgatctggaatctgctgtcaaacccgagtctgaccaggtgaaagacctcagctcagtctcactgtcctgggacccttctcacggacgcgttgcgggatttgaagtacagtcattacaggatgccggaaatcagttgggtatggaggacacctccctgagcagcggaatgttaacccagaatacaaatgtcccaatcctggaaggagtcgacgtagcaatcagccagggtataaccctcccctcattagagagcttccacccgctgaacatccatattgggaagggcaagctgcatgctaccggaagtaaaagaggtaagaagatgactctcagaccgggacctgtgacccaagaggatcgttgtgaccacttgacactcaaggaacctttctctggggagcctagcgaggaagtcaaggaagaaggcggaaagcctcagatgaacagcgaaggtgaaatcccaagtttgccatccggctctcaatcagccaaaccagtgtcacagcccagaaaaagtacccaacctgacgtttgcgcttctccacaggaaaagccgctaagaacccttttccaccagccagaggaggagattgaggatgggggactgtttatacccatggaagaacaggataatgaggaaagtgagaaacgcaggaagaagaagaagggaaccaagcgtaagagggatgggaggggtcaagaaggaactctggcgtatgaccttaaactcgacgacatgcttgatcggaccctggaagacggcgctaaacagcacaatctcacggctgtgaatgtccgaaacatcctgcatgaagtgataacaaatgagcatgtggtggccatgatgaaagccgcaattagcgaaaccgaggatatgcctatgtttgagcccaaaatgactcgctccaagctgaaggaggtcgtcgaaaagggtgtggtgattcccacatggaacatttctcccatcaagaaagcaaatgaaatcaagcccccacaattcgttgatatccatctggaggaggacgactcctcagacgaagaatatcagccagatgatgaggaagaagatgagacagcagaggagagtctgttggagtcagacgtggaatccacagcaagttcacctcgcggtgcaaaaaagtcccggctgcgacagtcctcggagatgactgagaccgatgaggagtcaggcatcctgtcggaggccgagaaggtcactactccggctattcgccacatctcggccgaagtagtacccatggggcctcctccgccaccaaaacctaagcaaaccagggatagcacttttatggaaaaacttcatgctgtggatgaggagctagcctcctctcctgtgtgtatggactcctttcagcctatggacgattctctgatcgcctttaggaccagatctaagatgccccttaaggatgtgccgctgggccagcttgaggccgaattacaggctcctgacattacacctgacatgtacgacccaaataccgcggatgatgaagactggaagatgtggctaggcggattgatgaacgacgacgtcgggaacgaggacgaggcagatgatgacgacgatccagaatacaactttcttgaagacctggatgagcccgacactgaagacttcaggactgatagagctgtacggataaccaagaaagaggtcaatgaactgatggaagagctctttgaaacctttcaggacgagatgggtttcagtaatatggaagacgacggcccagaagaggaagagtgtgtcgcagagcccagaccaaatttcaacacgcctcaagccctccgctttgaggagcccctggcaaatctgcttaatgaacagcaccgcaccgtgaaagaactgttcgagcagcttaaaatgaagaagagctcagctaagcagttgcaagaagttgagaaggttaagccccaatcggagaaagtgcaccagaccctgatccttgatcctgcacagcggaaacgcctccaacagcagatgcagcaacatgtgcaacttctgacacagatacacctcttagccacttgcaatcctaacctcaacccggaagccaccacgacacggatcttcctgaaggagttaggtacttttgctcagtcgagcatcgctttgcaccatcagtacaatccgaaattccagactttgttccagccctgcaacttgatgggggctatgcagttgatcgaggacttttctactcatgtttcaattgactgcagcccgcataaaaccgtaaagaagaccgctaatgagtttccctgcctccctaagcaggtggcatggatccttgccacatccaaagtattcatgtacccagaattacttcctgtgtgtagcctgaaggccaaaaatccgcaggacaaaatcgtgtttacgaaggcagaggacaacctgctggccttaggcctcaaacattttgagggaactgagtttcctaatcccctgatcagcaagtacctcctaacatgcaagactgcacaccagctgacagtccgaatcaagaatctcaatatgaacagggcgcctgataacatcattaaattctataagaagacaaaacaactgcctgtcttgggcaaatgttgcgaggagatccagccgcaccagtggaagcccccaatagaacgggaagaacataggctgcccttctggttgaaagcctcactgcccagtattcaagaggagctgcggcacatggccgatggtgcacgccagagttataggcgaaaacggaggggagtttcccagttaaaaccattgcatttgcttaaatcccccctgatgaaggagccacaggggcaaatgtag

SEQ ID NO: 23016 - DNA, 618 bp, Artificial Sequence
  Description of Artificial Sequence: Synthetic coding sequence
atggcggcagcggcagggggagccgcttcccgcaggggcgcaggtcggccatgcccattcagcattgagcacatcctcagctctcttcctgaaaggtccttgcccgctagagcagcctgcccacctcagccggctgggagacagagtcctgcgaagcctgaggaacctggagcacccgaggccgcaccttgtgcatgttgttgttgttgcgggcctagagccgctccctgtgggcctcccgaagccgcagccggacttggtgcacgcctggcttggccactacgcttggggccagccgtaccattgagcctgggagcccctgccggagggagtggggctctaccaggggctgtaggaccagggtctcagagaagaactcgtagacaccggaccatcttctctgaagaacaactgcaagctcttgaagccctgttcgtgcaaaaccaatatcctgacgtctccacacgcgagaggctggccggtagaattcgactgcgggaggagagagtcgaagtctggtttaagaatcgcagggccaagtggcgccatcaaaaacgggcaagcgcctctgccagactactgcccggtgtcaagaagtcccctaagggctcatgctag

SEQ ID NO: 23017 - DNA, 1824 bp, Artificial Sequence
  Description of Artificial Sequence: Synthetic coding sequence
atgtggatgaattccatcctacccatcttcctttttcgcagtgtgaggttgctgaaaaatgacccagttaatttacagaagttctcatacacgtcagaagacgaagcctggaagacctacctggagaaccccctgactgcagcgaccaaagccatgatgagagtgaacggagatgacgattcggtcgcagctctgtcatttctttatgactactatatgggaccaaaagagaagcgcatcctgagcagtagtacagggggtcgcaacgatcagggcaaaaggtactatcacggcatggagtatgaaaccgatctgaccccccttgaatcacccacccacttgatgaaattcctgaccgagaatgtgagcgggacccccgaataccctgaccttttaaaaaaaaacaacctgatgtccctcgagggcgctctgcccacacccggaaaggccgctcccctgcccgcagggccaagcaagctggaagctggaagtgtagactcttacctacttccaactacggatatgtacgacaatgggtcactcaacagcctgttcgagtccatacacggcgtgcctcccacccagaggtggcagcctgactctacctttaaagatgatccccaggaaagtatgcttttcccagacattctgaaaacttcaccagagcccccttgtcctgaggactaccccagtctcaagtccgacttcgagtatactctggggtcaccaaaagcgatccacataaaatcaggagagtcccctatggcttacctcaataagggccagttctacccggtgactcttaggacaccggcagggggaaagggcctcgcgttatctagcaataaagtaaaaagcgtggtcatggtcgtgtttgataatgagaaggttcccgtagaacagctgaggttctggaagcattggcactctaggcagcccactgcaaaacaaagagtgattgatgtggcggactgtaaggaaaatttcaacaccgtggagcacatcgaggaggtggcatacaacgcccttagctttgtgtggaacgtgaatgaagaggccaaggtttttattggggtgaactgtctgtccactgatttctcttctcaaaagggtgtgaaaggagtgccgctcaatttacagatcgatacatatgattgcggactcggtacagaaaggctcgttcacagggcagtctgccagattaagattttctgcgataagggagcggaaagaaaaatgagggatgacgaacggaaacagttccgacggaaagtgaagtgtcccgatagctctaatagcggcgttaagggctgtctgctaagcggtttcagaggtaatgagacgacatacctgagaccagagaccgatctggagacaccacctgtgctgtttatccccaacgtgcatttttcttccctccaacgcagtggcggtgcggctccatctgcgggaccaagctcttccaatagactgcccctcaagcggacttgtagtccattcacagaagaattcgagccactgccctccaaacaggctaaagagggagatttgcaacgggtgctgctttacgtgcggcgagaaacagaggaagtttttgacgcactgatgctcaaaacacctgacctcaaaggccttcgcaatgccatctcggagaagtacggctttccggaagagaacatatacaaagtgtacaaaaagtgcaagcgagggattcttgttaatatggacaacaatattattcaacactactcaaatcacgtcgcatttcttctggatatgggggaattagacggcaaaatccagatcatacttaaagagttatag

SEQ ID NO: 23018 - DNA, 1530 bp, Artificial Sequence
  Description of Artificial Sequence: Synthetic coding sequence
atggaatacgagactgacctgactcccttggagtcaccaacccatcttatgaaattcctgacagagaacgtctctgggacccctgaatacccagaccttttaaaaaagaacaacctaatgagcctcgaaggcgcactcccgacccctggaaaggcagccccacttccggcaggccctagtaagttagaggctggatctgtggactcctaccttctcccaaccaccgacatgtacgacaacggatccctgaacagcctgtttgagtccattcacggcgtgccaccaacacagaggtggcagccagattcaacattcaaagacgatccccaggagtcaatgctgtttcccgatatcctgaagacatcacctgagccaccttgtcccgaggattatccctctctaaaaagcgactttgaatacaccctgggaagcccgaaggcaattcacataaaatctggggaaagtcctatggcttacctcaacaagggtcagttttatcctgttacactaaggacacccgctgggggtaagggcctggcacttagcagtaacaaagtcaagtccgtggtgatggtggtgtttgataatgaaaaagtgccggtggagcagctgcgattctggaagcattggcacagcagacaacccaccgcgaaacaacgggtaatcgatgttgcagattgtaaggaaaattttaatactgtcgaacacatcgaagaagtggcctataacgcactatctttcgtctggaatgtcaacgaggaggctaaggtgttcatcggcgtgaactgcctaagcactgacttctcctctcaaaagggcgtgaaaggcgtacctctgaacttgcagatcgacacctatgattgcgggctgggaactgagcgcttggtacatcgtgctgtctgccagatcaagatcttttgtgataaaggcgcagagcggaaaatgcgtgatgacgaaagaaagcagttcagaaggaaagtgaaatgcccagatagttccaacagcggggtaaaggggtgtctccttagcgggttccgagggaacgagacaacttatttgcgcccagagaccgacttggagacaccccctgtgttgttcatcccaaacgtccattttagtagtcttcagaggtcaggcggagccgctccgagcgctgggccttcctcatcaaaccggctccccttgaaaaggacgtgctccccatttaccgaggagttcgaaccgctccccagcaagcaggccaaggaaggcgatctgcagagagtcctcctttacgtgcgacgggaaacagaggaggttttcgatgcactgatgcttaaaaccccagatctgaagggactgcggaacgctatttcagagaagtatggctttcctgaagagaatatttacaaggtgtacaaaaagtgcaagcggggaattttggtgaatatggataataatataatccagcactacagcaatcacgtggctttcctgctggacatgggcgagctggacggcaagatacaaatcattctcaaagagctttag

SEQ ID NO: 23019 - DNA, 1881 bp, Artificial Sequence
  Description of Artificial Sequence: Synthetic coding sequence
atgagcaacgaattagactttcggagcgttcgcttgcttaaaaacgatccagttaacctccagaaattctcgtacacctcagaagatgaagcatggaagacgtacctggaaaacccactgactgctgcgacgaaggccatgatgagagttaatggagatgacgacagtgtcgctgcccttagtttcctgtacgactactatatgggcccaaaggagaaacgaatcctgagctcatctacaggcggacgcaacgaccaggggaaacgctattaccatggaatggaatatgagaccgacctgaccccattggagagcccaactcacctgatgaaatttctgactgagaatgtaagcggcactcccgagtatcccgatcttttaaaaaagaacaatctcatgtcactagagggcgcactcccaacacctggtaaagccgctccactccccgctgggccaagcaaacttgaagccggtagtgtagactcgtatctactcccaacaacagatatgtacgacaacggcagcttgaactccttattcgagtcaattcatggcgttccccctacccaaagatggcagcccgacagcacgtttaaagacgacccgcaagagtccatgctgttcccagacattctgaagacatcccccgagcccccatgtcctgaggattatcccagtttgaagagtgacttcgaatacacattagggtctcccaaagctatccatattaaatccggcgaatctccgatggcttatctgaacaaggggcagttttatccggtgactctgcgaacccccgctgggggaaaggggctggcactttcatcaaacaaagtgaaaagcgtcgtgatggttgtttttgataatgaaaaggtaccggtggaacaactacgcttttggaaacactggcattcaaggcagcccaccgctaaacagagggtgattgacgtggctgactgtaaggagaattttaacactgtggaacacattgaagaggtcgcatacaatgctctctcgtttgtgtggaatgttaatgaggaggccaaagtgttcatcggagtgaactgcttgtccacggatttctcaagtcaaaaaggggtgaaaggcgtgcctctgaatttgcagatagatacctatgactgcggcttgggcaccgagaggctggtgcaccgcgcagtgtgccaaatcaagatcttctgcgataaaggcgctgagaggaaaatgcgcgatgacgaacgtaaacagtttcgcagaaaagtaaagtgccctgacagctccaactccggggtcaaagggtgcctgttgtctggtttcagaggcaatgagacaacctatttaagaccagagaccgatttggagactcctccagtcctatttatcccaaacgtgcacttcagtagccttcagcgcagcgggggtgccgcaccgagcgctgggcctagttcaagcaaccggctccctctcaagcgcacttgctctccgtttactgaagaattcgagcccttacctagtaagcaggcaaaagagggcgaccttcagcgggtgctgctgtacgtgcggagggaaacggaggaagtatttgatgccctgatgctcaaaacccctgatcttaaaggactgagaaacgcaatcagcgagaaatacggatttcctgaggaaaacatttacaaagtttataaaaaatgcaagaggggagaaaccagcttactgcaccctagactgagtcggcaccctccacctgactgcctggagtgcagtcatcccgtgacccaggtgcggaatatgggctttggagacggtttctggcggcagcgagacctggactcaaatcccagcccaactaccgtgaactctctgcacttcactgtcaacagtgagtag

SEQ ID NO: 23020 - DNA, 1671 bp, Artificial Sequence
  Description of Artificial Sequence: Synthetic coding sequence
atgatgcgcgtgaacggggacgacgattccgtggctgcgctgtctttcctctatgactactatatgggaccgaaggagaagcgtattttgagctctagtactggaggacgcaatgatcaaggtaagcgatattaccatggtatggagtatgagaccgatctgaccccactggaatcacctactcacttaatgaagtttctgactgagaatgtgtccggaactcccgagtacccagatctcctaaaaaaaaacaacctgatgtccctagagggagctctacccacccccggaaaggccgcaccgctgccagctggcccaagcaagctcgaggctggatccgttgactcttatctgctgcccacgaccgacatgtatgacaatggctccctcaatagcctgtttgaatctattcatggcgttccgccaacacagagatggcagcctgactcgaccttcaaagatgacccccaagaaagcatgctctttcccgacatcctaaagacttccccggaacctccttgtccggaagactacccgtcactgaagtcagactttgaatataccctgggtagccccaaggcaatccacattaaatctggggaaagtccaatggcatacctaaacaagggccaattttatccggttacactgcggacacctgccggaggaaagggtcttgctctgtcctcaaataaagtgaagtccgtcgtcatggtcgtctttgacaacgagaaggtcccagtggagcagttgaggttttggaagcactggcatagtcgccagcccaccgctaaacagagggtcattgatgtcgcggactgcaaagagaacttcaacaccgttgaacacattgaggaagttgcatataatgcgctgtctttcgtctggaatgttaatgaggaggctaaagtgttcatcggcgtcaattgtctgtctacagacttcagctcgcagaagggcgtcaagggagtaccgttgaacttgcaaatcgacacatacgattgtggtctcggcactgagcggttggtacatcgtgccgtgtgccagattaagattttttgcgacaagggcgctgagagaaagatgcgagacgatgaacggaaacagttccggcgaaaagtcaaatgccccgatagttccaatagcggggtaaaggggtgcctcctaagcggcttcagaggtaacgaaaccacatatttgcgtcctgaaactgatctcgagaccccacctgtactgtttatacccaacgttcatttctcatccctgcagagaagcggaggcgctgcaccctctgcaggtccgtcaagtagcaatcggctccctttaaaacggacttgctcccccttcactgaggaattcgagccgctgccatcaaagcaggcaaaggaaggtgatctccagcgagtgctgctatacgtaaggcgggaaaccgaggaggtctttgatgcattgatgctgaagacccccgatttgaaggggctgagaaatgcaattagtgaaaagtatggcttccctgaggagaatatttataaggtgtacaagaagtgcaagagggggatcctggtgaatatggataacaatatcatccaacattactctaaccacgtagcctttctactggatatgggcgaacttgatggcaagatccagattattctgaaggaactgtag

SEQ ID NO: 23021 - DNA, 1809 bp, Artificial Sequence
  Description of Artificial Sequence: Synthetic coding sequence
atgagcaacgagctagattttcgaagcgtacgcctgctgaagaacgatcccgttaacctccaaaagttttcttatacctctgaggatgaggcatggaagacttatctagagaacccccttactgccgcaactaaagctatgatgagggttaatggggacgacgacagcgtagcagccttatccttcctctatgattattacatgggcccaaaagagaagcgaattctcagcagcagcaccggcggacgcaacgaccagggtaagcgttactaccacgggatggagtacgaaaccgacctgacgccgttggagtctccaacccacctcatgaaattcttgacagaaaacgtgagcgggactcccgagtatcctgacttactgaaaaagaataacctgatgtctctggaaggcgcacttccaacaccaggaaaggcagctccactgccggctgggcctagcaagctggaggctgggtcagtggattcctatctactccctactacagatatgtatgataatggcagcttgaacagcctctttgagtcaatacatggcgttccccctacccagcggtggcagcctgattcaacatttaaagatgacccccaggagtcgatgctatttcccgatatcttgaagacatcccccgagcctccctgccccgaagactatccaagtctgaaatctgatttcgaatacacacttggtagccccaaagcgatccacattaaatccggggagagtcccatggcttacctaaataaggggcagttttaccctgttactctgcggacaccagcgggtggtaagggactggccctgtccagcaataaagttaagtctgtagttatggtggtgtttgacaacgaaaaggtgccagtagaacaactgagattttggaaacactggcactctcgccagcctaccgctaaacagcgcgtgatcgatgtggcagactgcaaggagaactttaacacggttgaacacatagaggaggtagcctacaacgctttatcctttgtctggaacgtcaatgaggaagctaaggtttttattggagtcaactgcttgagtaccgatttcagctcacagaagggcgtgaaaggggttcctctcaatctgcaaattgacacgtatgattgtggtctcggcacggagcgacttgtccatcgggcagtttgccagataaagattttctgcgacaaaggggcagaacggaagatgcgtgacgacgaacgaaagcagtttcgtcgcaaagtcaagtgtcctgattcttctaacagcggagtcaaaggatgtctcctgtctggtttccgtggcaacgaaacaacatatctccgccctgagacagaccttgaaacaccccctgttctgtttattccaaatgtccactttagttctcttcagaggtctggcggagctgcccctagcgcaggcccaagtagctctaacagattacctctcaagcgcacctgcagcccctttactgaagaattcgagccgctaccaagcaaacaagctaaggaaggggatctgcagcgcgtgctgctgtacgtgaggagggaaaccgaagaagttttcgacgccctaatgctgaagacacctgatctgaaaggattgcgtaatgcaatctcagagaaatacggattccctgaggaaaacatttataaggtgtataagaaatgtaagagggggatcctggtcaacatggacaacaacatcatccagcactacagtaatcacgtagccttccttctggacatgggggaattggacggtaagatccagatcatcctgaaagagctttag

SEQ ID NO: 23022 - DNA, 795 bp, Artificial Sequence
  Description of Artificial Sequence: Synthetic coding sequence
atgcctaggagcttcttggtggacagtctcgttcttagagaggctggtgaaaaaaaagctcccgaggggagtccccctccactgttcccttacgctgtccctcccccacatgcccttcacgggctgtctcctggcgcttgtcacgccagaaaggccggtctcttatgcgtatgtccactgtgtgtgaccgcctcacagctgcacggaccccctggccctccggctctgcctcttctgaaagcgagcttcccgccttttgggagtcaatattgtcatgcgccactgggaagacagcactccgctgttagtcccggagtggcacacggaccggctgccgcagccgcagctgctgcactttatcagacatcctatcctctccccgatccacgacagttccactgcatcagcgtggattcaagtagcaaccagttacctagcagcaagaggatgaggaccgctttcacgtctacgcaactcctggaactggagcgcgaattcgcttctaatatgtacctctccaggctgagacggatagaaatcgccacttaccttaacctgagtgaaaagcaagtcaagatctggtttcagaatcggagagtgaaacacaagaaagaggggaaagggagtaaccatcgagggggtggagggggaggcgcaggcggtggcggttctgccccacagggatgtaaatgcgcctcactctcatccgctaaatgctcagaggacgatgacgaactccctatgtccccctcaagcagcggcaaggatgaccgcgacttaaccgtgacaccctag

SEQ ID NO: 23023 - DNA, 915 bp, Artificial Sequence
  Description of Artificial Sequence: Synthetic coding sequence
atgtcaaggtctttctacgtcgactcccttatcataaaagatacatctcggcctgctcccagtttaccggagcctcacccaggtccagacttcttcatccctttgggcatgcccccaccattggtgatgtccgtcagtggtcctggctgtccaagtcggaagtctggagccttttgtgtgtgcccactctgcgtgactagccacctgcactcctccagaggatccgttggcgctggatccgggggagccggtgccggagtgactggtgccggaggcagtggcgtcgcaggggctgccggtgccttaccacttctgaaaggccagtttagttcagcacccggagatgcacagttttgtccacgggtaaaccatgcccaccatcaccaccaccctcctcaacatcatcatcaccatcatcagcctcaacaaccaggctcagcggctgctgcagcggctgctgccgcagccgcagcagctgccgcagccctcggccacccacagcaccacgctcccgtgtgcaccgctacaacgtacaacgtcgcggatcccaggagatttcactgcctaactatgggaggcagtgatgcctctcaggtgccaaacggaaagcgtatgcgtactgcattcacaagcacccagcttctcgaactggagagggaatttagcagtaatatgtacctcagtcgcctcaggagaatagaaattgcgacgtacctaaaccttagcgaaaaacaggtgaaaatatggtttcaaaaccgaagagtgaagcataagaaggaggggaaagggacccagcgcaactcacatgctggctgtaagtgcgtgggctcacaagtccattacgctcgctctgaagatgaggacagcctgagccccgcttctgcaaatgacgacaaggagatctcacccctctag

SEQ ID NO: 23024 - DNA, 2850 bp, Artificial Sequence
  Description of Artificial Sequence: Synthetic coding sequence
atggctcaggttgccgtatctactctcccagttgaagaagaatcatcttctgagacccgaatggtcgtcaccttcctggttagtgctctcgagtccatgtgcaaggagttagccaagtctaaagcagaggtggcatgtatcgcagtctatgagaccgacgtattcgttgtgggcaccgagcgaggttgcgcatttgtgaatgcccgaaccgatttccagaaggacttcgcgaaatactgtgtggctgagggtctctgtgaagtgaagccaccttgtcctgtcaacggcatgcaggttcactcaggcgagacagagatactacgaaaggcagtggaggattacttttgcttctgctatggcaaagccctgggcacaactgttatggtaccagttccatacgagaaaatgttgagagaccaaagcgcagtggttgtgcaaggactgcccgagggcgtggcgttccagcacccagagaattacgacctcgccactctgaagtggatccttgagaataaagccggtatcagttttatcattaaccgtccgtttctcggcccagaaagccaattgggtgggcctggaatggtcacagatgctgagaggtcaatcgtctccccgagtgaaagttgcgggccaattaatgttaaaaccgaaccaatggaggattccggcatctcactgaaggctgaagctgtttctgtgaaaaaggagagtgaggacccaaattactatcagtataatatgcaggggagccatcctagttccaccagcaacgaggtcatcgagatggagttgcccatggaggatagtacccccctagtcccctctgaggagcccaatgaagatcccgaagccgaggtgaagattgaagggaatactaatagcagctctgtcactaacagtgccgcaggagttgaggatttaaacattgtccaagtcaccgtcccagataacgaaaaggagaggctctcctccatagaaaagattaaacaactaagggagcaggtaaatgacctgttctctcgcaagttcggtgaggctattggcgtcgattttcccgtgaaggtcccataccgtaaaatcacgtttaaccctggttgcgtggtgattgacggcatgccacccggtgtggttttcaaagcgcctggatatttggagattagctccatgcggaggattctagaggctgccgagttcatcaaattcactgttattcgcccattgccaggactggaactgagcaacgttgggaagaggaaaattgaccaggaagggcgagttttccaggaaaagtgggagagagcgtactttttcgtagaggtacaaaatatcccgacctgcctgatctgtaaacagtctatgagcgtctcaaaggaatacaatttgcgccgacactaccagactaatcatagcaagcactacgaccagtatatggaaaggatgcgagacgaaaagctccacgaattaaaaaaggggctgcgaaagtaccttttgggactgagtgataccgaatgccccgaacaaaagcaggttttcgcacacccctctcctacccagaagagtccagtgcaaccagtggaagacctggcgggaaacctgtgggaaaagctaagggagaagatacgctcattcgttgcctacagcatcgctatcgacgagataaccgatataaacaacacaacccaactggccatctttatcagaggggtcgacgagaatttcgacgtgagtgaagaactgctagacaccgtccccatgacaggaaccaaatctggtaacgagatattttccagagtggaaaagagtcttaagaagttttgtatagattggtccaagctcgtgtctgtggcatctaccggaacccccgctatggtcgacgcaaacaacggtcttgtgacgaaactgaaaagtagggttgctaccttttgcaagggggcagaacttaagagcatatgctgcatcatccacccagaatccctgtgcgcgcagaaactcaaaatggatcacgtcatggacgtggtagtcaaaagcgtgaactggatttgtagccgaggacttaaccactccgaattcactacgctcttatatgaattggactcgcaatatggaagtttactttactatactgagattaagtggctctcacgtggtcttgtcttaaagaggttctttgaatcattggaagagatcgactcctttatgagctcacgaggtaaacctttgcctcagctctcctctatcgattggatccgagatctagcgtttttagtggatatgaccatgcacttaaatgcgctgaacatatctctgcagggtcatagccaaatcgtcacccagatgtatgacctaattcgggcttttctggcaaagttgtgtctgtgggagacacatctgacaaggaacaacctggcccattttcctaccctgaagctggcgtccagaaatgagtcagatggcctaaattacatccccaaaattgccgaactgaagaccgaatttcagaaaagactgtcagattttaagttatacgagtccgagctgacactcttctcctcaccattcagcaccaaaatagatagcgtacacgaagaattgcagatggaagtgatagatctgcagtgcaacacagtgttgaaaaccaaatacgataaagtcgggattccggagttctataagtacctttggggctcttatccgaaatataagcaccattgcgctaaaatcctgagtatgttcggaagcacttatatttgtgaacaactcttttctattatgaagctgtccaaaaccaaatactgctctcagctaaaagattcgcaatgggattccgttttgcacattgcaacatag

SEQ ID NO: 23025 - DNA, 1491 bp, Artificial Sequence
  Description of Artificial Sequence: Synthetic coding sequence
atgtctgtgtctaaagagtacaacttacgaaggcactatcagacaaaccacagtaaacactacgatcaatatatggagcgaatgcgggatgaaaaactccacgagctgaagaagggattaaggaaatatctgctgggcctatctgacaccgagtgtcctgagcagaagcaagtgtttgcacacccctcacccacccaaaagtcaccggtgcagcctgtggaggatctggctgggaatctgtgggagaagttgcgcgagaagatccgaagctttgttgcatattccatcgctatcgatgagatcaccgatatcaacaacaccacacagcttgccatttttatccgcggtgtggatgaaaactttgatgtttccgaagagctgcttgacaccgtccccatgacaggaacaaagtcgggaaacgagatcttctccagggtcgagaagagtctgaagaaattttgcatagactggagcaagctggtatctgtggcttcaacgggcacaccggctatggtcgatgctaacaatggactggttacaaagctgaagtctagagtggcaaccttctgcaagggggcagaacttaagtcgatctgttgtatcattcaccccgaatccctttgtgctcagaaattgaagatggaccacgtgatggatgtcgttgtcaagtctgtgaactggatatgctccagaggcctgaaccatagcgagtttacaaccctcctgtacgagctcgactcccaatatggcagtctcctatattataccgaaatcaagtggctgtctagagggctggtactgaagaggttctttgaatccctggaggaaatcgattcctttatgagctcaaggggtaagccactgccacagctcagcagtatcgattggatcagagacctggctttcttagtcgacatgaccatgcatctaaacgcactcaacattagcctgcagggccactcacagatagtgactcaaatgtacgacctgatccgagcctttctcgcaaagctctgcctgtgggagacacatctcacacgaaacaacctggcacacttccccacgctaaaactggcctccaggaatgagtccgatggtctcaactatatcccaaaaatcgccgaattgaaaacagagtttcaaaaaagactgagtgacttcaaactgtacgagtcagagctgactctcttcagctccccgttctcaaccaaaattgattccgtgcacgaggaactgcagatggaggtgatcgatttgcagtgcaacacagtgctcaaaaccaaatatgacaaagttgggatccctgaattttacaagtacctctggggctcatatcccaaatataaacaccactgtgctaaaatactgagcatgttcggatcaacgtacatttgcgagcagctgttcagcattatgaagctgtctaaaacgaagtattgttcccagctgaaagatagccagtgggattccgtgctgcacatcgccacttag

SEQ ID NO: 23026 - DNA, 681 bp, Artificial Sequence
  Description of Artificial Sequence: Synthetic coding sequence
atggctcaggtggcggtctctaccctgcccgtcgaggaggagtcaagttcagaaactcgaatggtggttacctttctggtgtccgccttggagtccatgtgcaaagagctcgccaagagcaaagcggaggtcgcctgcatcgccgtctacgagaccgatgtcttcgtcgttgggaccgaacgaggatgcgcgtttgtgaatgcgcgaactgacttccagaaggacttcgccaagtattgtgtggccgagggcctctgcgaggtcaaacccccatgcccagttaacgggatgcaggtgcactctggcgagaccgagatccttcgcaaggcagtcgaggattatttctgtttttgctatgggaaggctctgggaacgacagtaatggtcccagtcccttatgagaagatgcttcgagatcagagcgcagtggtagtgcagggccttcctgagggtgtggccttccagcatccggagaattatgatttggcaaccctcaagtggatcctagaaaacaaggcaggcatttctttcattatcaatagaccgttcctgggcccagagtctcagctcgggggaccaggcatggtaacagacgcagaacgcagtatcgttagccccagtgagagacactttactgaatcacgctcatgcctctcccaggagaggattcgtcgatcatag

SEQ ID NO: 23027 - DNA, 2850 bp, Artificial Sequence
  Description of Artificial Sequence: Synthetic coding sequence
atggcccaggtggcggtgtcaaccctgcccgtcgaggaggagtccagttctgaaactcggatggtcgtgacttttcttgtctctgccctggaatcaatgtgcaaggagctcgccaaatccaaagcggaggtggcatgtatcgcagtttatgaaactgacgtattcgttgtggggactgagcggggttgtgcatttgtgaacgccagaacagattttcagaaagacttcgcaaagtactgcgtcgctgagggtctgtgcgaagtgaagccaccatgtcccgtcaacggcatgcaggtccattctggggagacagagattttaaggaaagcggttgaggactatttttgtttttgctatgggaaggctctggggactactgtcatggtgccagtgccttatgagaagatgcttcgcgatcagtcagccgttgtggtgcaggggctccccgaaggcgtggccttccagcacccggagaattacgacctcgcaacactcaaatggattttggaaaataaggctggcatctcatttataataaatagaccatttctgggaccagaaagccagctagggggaccgggtatggtgacagatgctgagcgatcaatcgtgtctcccagtgagagctgcggtccaatcaacgttaagaccgagcccatggaagactccggaatctccttaaaagcagaggctgtgtccgttaagaaagagtctgaggacccaaattattaccagtataatatgcaagggtcccacccctctagtactagcaacgaggttatcgaaatggagctgccaatggaggacagcacccctctggtaccctctgaggaacccaatgaggacccagaagccgaagttaagatcgagggcaacaccaattcttcaagcgttactaactctgctgccggagtcgaagacctaaatatcgttcaagtcactgtgcctgataacgaaaaagagcggctatctagtatcgagaaaataaaacagcttagggaacaggtgaacgacctgttcagcaggaaattcggggaggcaattggagtggacttcccagttaaagttccttacaggaaaatcacatttaaccccggatgcgtggtaatagacggtatgcctcctggagtagtgttcaaagcgccaggctacctagagatcagctccatgcgccgtattctcgaagccgctgaatttattaaattcactgtcatccgcccattacctggccttgagctctctaacgtcggcaagaggaagattgaccaggaaggtcgggtgtttcaggaaaaatgggaacgggcatattttttcgttgaagtccagaatattccaacttgtctcatctgcaagcagtcaatgtcagtgagcaaggagtacaacctaagaaggcattatcagacaaaccactcaaagcattatgatcaatacacagagaggatgagggacgagaaactgcacgagctgaaaaagggactccgcaaatacctcctcgggagctccgacacggagtgtcccgagcagaagcaagtatttgccaacccctcaccaactcagaaatcgccagttcagccggttgaagaccttgctggaaatctttgggagaagttaagagagaaaattcggtccttcgtggcatattccatagccattgatgaaataactgacatcaataatacgacccaactggccatcttcattcggggtgtggacgaaaacttcgacgtctccgaagagctacttgatacggtgcccatgacaggcaccaaatctggcaacgaaatcttcctccgggtcgagaagtccctgaaaaaattttgcatcaattggtctcggctggtgagtgtcgcctccacaggaaccccagccatggtcgatgctaataacggactagtcaccaaactgaagtcacgggtggccactttttgcaagggcgcagagctgaagtcgatttgctgcataatccatccagagagcttgtgcgcgcagaagctgaaaatggatcacgtaatggacgtggtggtgaaaagcgtgaactggatctgctctcgcggtctcaaccacagtgagttcactacactcctgtatgagctggactctcaatatggatcattgctgtattatacagagataaagtggttgagtagggggctcgtcttgaagagattcttcgagtctcttgaggaaatagattccttcatgtcttcccggggaaagccactgcctcagctctcttccatcgattggatccgcgacctcgctttcctcgtcgacatgaccatgcatctgaatgcgctgaacatttccctccaggggcacagtcaaatcgtgacacaaatgtatgacctgattagagccttcctggcgaaactttgcctgtgggagacgcaccttactaggaataacctggcccacttccctacccttaagttggtgtctagaaacgagtctgacggactcaactatatcccaaagatcgccgaattaaaaaccgaattccagaagagattgagcgatttcaaactctacgaatccgaattgactctcttcagtagtccattctcaactaaaatagacagtgtacacgaggaactgcaaatggaagtcattgacttgcagtgtaacacagtgttaaaaactaaatacgataaagtaggaatccccgaattctataagtacctctggggaagttaccctaaatacaagcaccactgcgctaagatcctctcaatgttcggtagtacgtatatttgtgaacagctcttttcgatcatgaagctctctaagaccaaatactgctcacagctcaaggactcacaatgggactccgttttgcatatcgcaacgtag

SEQ ID NO: 23028 - DNA, 1095 bp, Artificial Sequence
  Description of Artificial Sequence: Synthetic coding sequence
atgaccgggactaagtcaggtaacgaaatctttctgagggtggagaagtccttgaaaaaattctgtatcaattggtctagactggtgtccgtagcctcaactgggacacctgctatggtggacgctaacaacgggctggtgaccaaattgaagtcacgggtggcgaccttctgcaagggcgctgagctgaaaagtatttgctgcataatacacccagagtccctatgcgcccagaagctcaaaatggaccatgtgatggacgtggttgtgaagtctgttaactggatctgcagccgaggcctaaatcattccgaattcacgaccctcctctatgagctcgatagccaatatggctcgctcctgtattacaccgagatcaaatggttatctagggggctcgtgttaaagaggttttttgagtcgctagaagaaatagattcattcatgtcttcacgaggcaagcctctgccacagctgagctctattgattggatcagggaccttgcttttttggtcgatatgacgatgcatttgaacgctcttaatatcagcctgcagggccactcacaaatcgtgacgcagatgtatgatttaatacgggcatttcttgccaaattgtgtctttgggagacccatctcacacgtaataacctggctcattttcccaccctgaaactagtgtctcggaatgagtcagatgggctaaactacatccccaagatcgccgaactgaaaactgaatttcagaaaagactcagcgatttcaaactctatgaatccgaattgacactgttcagttcaccattcagcaccaaaattgacagcgtccatgaggagttacaaatggaggttatcgatctgcagtgtaacaccgttcttaagaccaagtatgataaggtggggattccggagttctacaagtacctgtggggatcctatccaaaatacaagcatcattgtgccaagatcctgagcatgtttggttccacatatatctgcgagcagctcttctcaattatgaagctctctaaaacgaaatactgttcacagctgaaggattcccagtgggatagcgtactgcatattgccacatag

SEQ ID NO: 23029 - DNA, 1491 bp, Artificial Sequence
  Description of Artificial Sequence: Synthetic coding sequence
atgagtgtttcaaaggagtataacctaagacgtcactaccaaactaaccattccaagcattacgatcagtatactgagcggatgcgagatgaaaagttacacgagctaaagaagggcctgagaaaatatcttctgggtagttccgatactgagtgccctgaacaaaaacaggtctttgcaaacccttcgcctacccagaaatccccagtccaacctgttgaagacctggcaggaaacctctgggagaagctcagggagaaaattcgttcgtttgtggcctactctatcgccattgacgagatcaccgacatcaacaataccacacagcttgcaattttcatccggggagtggatgaaaacttcgatgtgagcgaggagttgctggataccgtgccgatgactgggacaaaatctggtaatgaaatcttcctaagagtcgaaaagtcactgaaaaagttttgcatcaattggtctcggttggtaagtgtagcttccaccggaacgcccgctatggtggatgccaacaacgggctggtcacgaagctaaagtcacgagtcgccaccttctgtaagggagcagagctgaagtccatttgctgcatcatacaccctgagagcctgtgtgcacagaagctgaaaatggatcacgtgatggatgtggtcgtgaagtccgtcaactggatctgctcacggggtctgaatcacagtgagtttaccaccctgctatacgagttggactcgcagtacggctctttgctctactacaccgaaataaagtggctcagccggggactcgtgctgaagcgcttctttgagagcctggaggagatcgactctttcatgtcctcaagagggaaacccctcccccaactatcatccattgattggatccgagacctggcctttttggtggatatgacaatgcacctcaatgcactgaacatcagccttcagggacattcccagattgtcacacaaatgtacgatttgataagagctttcttggccaagttatgcctgtgggaaacgcacctgacaaggaataaccttgctcacttccccactttaaaacttgtatcaagaaatgaaagcgatggcctcaactacattccaaaaatagccgagttgaagaccgagtttcagaagcgactctcggacttcaaactttatgaaagcgagctcaccctgttttcgagcccatttagcaccaagattgactctgtgcacgaggagttgcagatggaggtcatcgatttacagtgtaacaccgtgctgaagaccaaatacgataaggtagggatcccagagttttataagtatctgtggggctcctatccaaagtacaagcatcactgcgccaagattctgtctatgtttggtagcacatatatttgcgaacaactgtttagtatcatgaaattgtctaagactaaatactgctcacagctaaaggatagccagtgggactccgtgctgcatatcgctacttag

SEQ ID NO: 23030 - DNA, 681 bp, Artificial Sequence
  Description of Artificial Sequence: Synthetic coding sequence
atggcacaggtggcagtctccacgctcccagtggaagaagagtcgtcctcagaaaccagaatggtcgtgacatttctggtgagcgctctcgaatcaatgtgtaaagaactggccaaaagcaaagcagaggtggcctgcattgcagtctacgaaactgatgtgtttgttgttggaacagagcggggatgcgccttcgtcaatgctaggacagatttccagaaagattttgccaaatattgcgttgctgagggcctatgcgaggttaaaccgccatgtccagttaacggtatgcaggtacattctggagagactgaaatcctaaggaaggcggttgaggattatttttgtttttgttacggtaaggccctgggtacaacggtcatggttccagttccctatgagaagatgttacgtgatcaatcagccgtagtggtgcaggggttaccggaaggagtggcattccagcatcctgagaattatgacttagctaccctaaagtggatcctggagaataaagccggtatttcatttatcattaatcgccctttcctgggcccagagtcccagcttgggggacccggaatggttaccgatgccgaaaggagcatagtctctccaagcgaaaggcatttcaccgagtctcggtcgtgcctctcacaggaacggatccggagatcttag

SEQ ID NO: 23031 - DNA, 768 bp, Artificial Sequence
  Description of Artificial Sequence: Synthetic coding sequence
atggagcaagcactgacaggtgaggcccagtcaagatggcctcgccgtggcggatctggcgcaatggccgaagcaccaggcccatccggagaaagcagggggcacagcgcaactcagctcccagccgaaaagaccgtaggcggaccaagtaggggctgcagtagttcggtgctccgggtaagtcagctcgtcttgcaggcaatcagtacacataagggtcttaccctggctgccctgaagaaagaattacgaaacgccggatatgaagtgcggaggaaaagtggcaggcacgaggcccctcggggacaggctaaagccaccctcctccgggtctctggatcagatgccgcaggctactttagagtgtggaaagttccaaaacccagaagaaagcctggtcgcgctcgccaggaagagggaacccgggctccgtggagaacacccgctgccccacggtcttccaggcgccgaagacagcccctgcggaaagctgcgagaaaggcacgtgaggtgtggcgacgaaacgccagggctaaggccaaggctaacgcacgtgcacggaggacgcgcagggctcggccaagagccaaggagcctccgtgcgcacgcgctaaggaagaggcaggtgctacagctgcagatgaaggaaggggtcaggctgtgaaggaagatactactcctcgctctggaaaggacaagagaagatcttcaaaaccgcgagaagagaagcaggagccaaaaaagccagcccagcgcaccatccagtag

SEQ ID NO: 23032 - DNA, 642 bp, Artificial Sequence
  Description of Artificial Sequence: Synthetic coding sequence
atgtccgtagaacttgaggaggctctgcccgtgacaaccgccgaaggcatggctaagaaggtgacaaaagccggtggctccgcggcactatccccctcaaaaaaacgaaagaacagcaagaagaaaaatcagcccggaaagtactcccagctggtggtggaaacaattcgcaggttgggtgaacgcaacggcagcagtctggccaaaatatataccgaggctaagaaagtgccttggttcgatcagcaaaacggtagaacgtacttaaagtatagcattaaagcactggtgcagaacgatacactgcttcaagttaagggtaccggggctaacgggtcttttaagctaaatcggaagaagctggaagggggtggggaacgtcgcggagctcccgctgccgctaccgcaccggctcccactgctcacaaggctaaaaaggcggcacccggagccgcaggctctaggagagctgataaaaagccggcaaggggacaaaaacctgaacagaggtcacacaagaaaggagccggagccaagaaggacaaggggggtaaagctaaaaagaccgccgcagctgggggtaaaaaggttaaaaaggccgcaaagccttccgtgcccaaggtgccaaaggggaggaagtag

SEQ ID NO: 23033 - DNA, 1467 bp, Artificial Sequence
  Description of Artificial Sequence: Synthetic coding sequence
atgtttgccgcaggtctcgccccattttacgcctccaatttctcgctgtggtcagccgcatactgcagctccgctgggccaggcggttgttcttttccactggaccctgcggctgtcaaaaaaccatcattctgcattgctgacatactgcacgctggcgtcggggaccttggagcagctcccgaggggctggccggtgcttccgctgccgctctcacagcacatctggggagtgttcacccccatgcttcttttcaagctgcagccaggtctcctttgcgaccaacaccagtggtggccccaagtgaggttcctgccggatttccccagagattgtcccctcttagcgccgcatatcaccatcatcacccgcagcaacaacagcagcagcagcagccacagcagcagcaacccccaccgcctccacgcgctggcgctttgcagccacccgcttctggaacaagggtagtcccgaacccacaccattcgggctcagctccagcaccctcaagcaaggacctcaagttcggaatagacaggatcctatccgcagagttcgacccgaaggtgaaagagggtaatacgcttcgtgatttaaccagtctgctgaccggtggacgaccggctggagtgcatctctccgggttgcagccatcagccggtcagtttttcgccagccttgatcctatcaacgaagcttcggccattttgtcaccactcaatagtaatccacggaacagtgttcaacatcagttccaggacacctttccaggcccttacgcagtacttactaaggatacgatgccacagacctataagcgcaagcggtcctggagtagggctgtcttctcaaatctccaaaggaagggactggagaagcgctttgagattcagaagtacgtaaccaaacccgatagaaaacagttagccgctatgttgggtcttacggacgcccaggtcaaggtgtggttccagaatcgcagaatgaaatggcgtcacagcaaggaggctcaggcacagaaggacaaagataaggaggccggagagaaaccaagcggcggagccccagcagccgacggagaacaagatgagcgcagccccagccgatcagagggcgaggctgagagcgagtcgtccgatagtgagtcgctggacatggccccttcagatactgagcggaccgagggatccgagcggagtttgcatcagacaacagtgatcaaggctccagttactggcgcactcataacggccagcagcgctggatccggaggctcatccgggggaggaggcaactctttctcgtttagctcggcttcaagcctttcgtcttcgagcacatctgccggatgtgcttcttcccttgggggaggtggggcaagcgaacttctccctgctacacaacccaccgcctcatccgcccctaaaagcccagagccggcacagggtgccctgggatgcctttag

SEQ ID NO: 23034 - DNA, 1116 bp, Artificial Sequence
  Description of Artificial Sequence: Synthetic coding sequence
atgtcaagcaggggtggcaaaaaaaagtctacgaaaactagccgctctgccaaagccggagtgatcttccccgtcggacgaatgctgaggtacatcaaaaagggccacccaaagtatagaattggtgtcggtgcacccgtgtacatggcagccgtactcgaatatcttaccgctgaaattctcgagctcgccggtaacgctgccagggataataaaaagggacgcgtgaccccaagacacatacttttggctgtggccaacgatgaagaactcaaccagctcctgaaaggggtgacgatcgccagtggcggtgttctccctaacattcacccggaactgctcgccaaaaaacgtggcagcaaaggcaaactggaagctatcatcaccccacctcctgcgaaaaaggctaaatcgccaagtcagaaaaagcccgtaagcaaaaaggcgggtggcaagaaaggcgcaagaaagtcgaagaagcagggcgaggtgtcgaaggccgcttcagccgactccactacagaggggacaccagctgatggctttaccgtactttcaacaaaatcactctttctggggcagaagctaaatttgatacattccgaaatttctaatctggctgggtttgaagtagaggctatcataaaccccaccaacgccgacatcgacctcaaagacgatctcggaaacaccttggagaaaaagggagggaaggaattcgtggaagcagtactggaactgcgaaaaaaaaatggccctctggaagtagctggggctgctgtgagtgcaggccatggactcccagctaagttcgtcattcattgtaacagcccggtctggggcgctgataagtgcgaggaactactagagaaaacagtgaagaactgtctggcgttagcggatgacaagaagcttaaatctattgctttcccatcaattggttccggccgtaacggtttccctaagcaaactgccgctcagctcatccttaaagctatctcttcttattttgtttcaacgatgtcctcctccatcaagactgtttactttgttctctttgacagtgaaagcatagggatctatgtacaggagatggctaagctggacgcgaactag

SEQ ID NO: 23035 - DNA, 348 bp, Artificial Sequence
  Description of Artificial Sequence: Synthetic coding sequence
atgcccagacggaggaggagacgcggaagctccggagcaggcggacggggacggacttgctcaagaaccgtacgggctgagctgtcttttagcgtgtcgcaggtggaacgaagcctccgcgagggtcattacgcacagaggctgagtcgcactgctcctgtgtaccttgcggcagtcattgaatacctaaccgccaaggtgcctgagttggctggtaatgaggcccaaaatagcggggaaagaaatattacgcctcttctcctggatatggttgtccacaatgatagactgctgtcaactctgttcaacacaaccactatcagtcaagtagcgcctggcgaagactag

SEQ ID NO: 23036 - DNA, 348 bp, Artificial Sequence
  Description of Artificial Sequence: Synthetic coding sequence
atgcccagaaggcggcgaagaagaggtagcagcggagccggaggaagaggcagaacctgttcacggactgtgagggcagagctcagtttctccgtgtcacaggtggaacgctcattaagagagggacattatgcccagcgcttgtcacgaacagcccctgtgtatcttgccgctgtgatagagtatctgacggccaaggtactcgaacttgcaggaaatgaggcccagaactcaggcgaaaggaatatcacccccctgctgttggacatggttgtgcacaatgataggcttctttcaacactatttaataccacaaccatttcgcaggtggcacccggtgaagactag

SEQ ID NO: 23037 - DNA, 348 bp, Artificial Sequence
  Description of Artificial Sequence: Synthetic coding sequence
atgcctagaagacggcgaagaagagggtcctccggggcaggtggcagaggacggacctgtagccgaaccgtgcgtgcagagctgtcctttagcgtgtcccaagttgaaagatccctgagggaaggccattatgcgcagcggcttagccggacagctccggtctatttggccgctgtgatcgaatacctgactgctaaagtgctggagctcgcagggaacgaggcacaaaactcgggtgaacgcaatattacccctctgttattggacatggtggtccataatgataggttgctctccacactgtttaatacaacaacaatctcccaggtggcgcctggggaggattag

SEQ ID NO: 23038 - DNA, 3264 bp, Artificial Sequence
  Description of Artificial Sequence: Synthetic coding sequence
atggacctctacagtacaccagcagccgctttggacagattcgtcgcccgacgtctgcagcccagaaaagagttcgtcgaaaaggcgaggagagcattgggggcactagcagccgctttgcgagaacgcggtggtagacttggcgctgcggcaccacgggtgcttaaaaccgtcaagggaggaagcagcggcagaggaactgccctgaaagggggttgtgatagtgagctcgtgatctttttggactgtttcaaaagctatgttgatcagagagcacgcagagcagaaattctgtcggaaatgagggcaagcctggagtcatggtggcagaacccggtgccagggctgcggcttactttccccgaacagtcggtgccaggcgcactacagtttagacttacttctgtagatctcgaggactggatggatgtcagtcttgtcccagcattcaacgtgctcggccaggcaggatccggagtgaaacccaagccacaggtttattcgaccttgcttaactctggctgtcagggaggagaacacgctgcatgcttcaccgagctgaggcgaaatttcgtgaacataaggcccgctaaactgaagaacctgattttgctggttaaacattggtaccaccaggtctgtttacagggcctttggaaggagaccctccctccagtctatgctctggagctactgactatattcgcgtgggagcaggggtgtaagaaagatgccttttctcttgcagaggggctcagaaccgtccttggcctgatccagcagcaccagcacctttgcgtgttttggactgtgaattatggtttcgaagaccctgccgtcggacaattcctacagcgacagctcaagcgcccacggcctgtgatcttagaccctgcagatcccacctgggacctcggcaatggtgccgcttggcactgggacctcttggcacaggaagccgcttcctgctacgatcacccttgttttcttaggggcatgggagatcccgtacagagctggaaggggcctggcctgccaagagcagggtgcagcggcctggggcacccgatccaacttgatccaaaccagaaaaccccagagaactccaaaagcttgaatgccgtttaccctagggccggatctaagcccccttcatgtcctgcgccaggcccaacaggtgcagcttcaatcgtgcctagtgtaccaggaatggcattagatttgagccagataccaaccaaggagttagacagatttatacaggaccatctgaagccctcccctcagttccaagaacaggttaagaaagccatcgacatcattctccgctgcctgcatgagaattgtgtgcacaaggcaagccgcgtgtctaaaggtggaagttttgggagaggaaccgacctgcgggatggatgtgatgtcgaactcattatctttcttaactgctttacagattacaaggaccagggcccaagacgagctgagattctcgacgaaatgagggcccagttggagagctggtggcaagatcaggtgccgtcccttagcctgcagttcccagaacagaatgtcccagaggctctccagttccaacttgtcagcaccgccctgaagtcttggactgatgtgagcctcctgcctgccttcgatgcggtgggacaactctcaagtggcaccaagccaaacccgcaggtctactcgcgacttttgactagtgggtgtcaggagggcgaacacaaagcgtgcttcgcggagctcagacgaaactttatgaacatccgcccagtcaagctgaagaatcttatcctgttagttaaacactggtacaggcaggtggccgctcagaacaaagggaaggggcctgcacccgcttcactaccccctgcttatgctctggagctcctgactattttcgcatgggaacaaggttgccgccaagattgcttcaacatggcccaagggttccggacagtcttaggtctcgttcagcagcatcaacagctctgcgtgtattggactgttaattattctacagaggatcccgctatgagaatgcatctactgggtcagctcagaaagcccaggccgctggtgctggacccagcagatcctacatggaatgtcggccatggctcgtgggagctgcttgctcaagaagccgctgccctggggatgcaagcatgtttcctttctcgcgacggcacatccgttcaaccctgggatgtcatgcccgctctcctttatcaaacacccgcaggggacctggataagttcatatctgaatttttgcaacccaaccggcagttcttggcccaagttaacaaagcagtggacaccatttgttccttcctgaaggagaattgttttagaaactctcccattaaagtcatcaaagtagtgaagggcggttcgagtgcaaaaggaacggcactgagaggacggtctgacgctgatctggttgtatttctgagctgcttctcgcaattcacagaacagggtaacaagagagcggaaattatctctgagatacgggctcagctggaggcatgtcagcaggaacgccagttcgaggtgaagtttgaggtgtctaagtgggagaatccacgtgttttgtcgttttcactgacctcccagacaatgctggaccagtccgtcgattttgatgtcttgccagcctttgatgccctggggcagctggttagcggcagcaggcctagctctcaagtatatgtcgacttgatacattcctacagcaacgctggcgaatactcgacgtgctttacggaactccagagggatttcatcatttcacggcctactaaattgaaaagcctgatacgactggtcaaacattggtaccagcagtgcactaagatctcaaaggggcgtggcagcttaccaccgcagcatggcctggaacttctaaccgtttacgcttgggaacaggggggaaaggactctcagttcaacatggcagaaggttttcgcacagtactggaactggtaacccagtatcgtcaactctgtatttactggacaatcaactataatgcgaaggacaagactgtgggcgactttttaaagcagcagctgcagaaaccgcgacccatcatcttggaccccgctgaccccacagggaacctcgggcacaatgcccgttgggatctgctcgcaaaagaagctgcagcctgtacatccgctctctgttgcatgggtagaaatggaattcctatccaaccttggccagtgaaggccgcagtttag

SEQ ID NO: 23039 - DNA, 390 bp, Artificial Sequence
  Description of Artificial Sequence: Synthetic coding sequence
atgagcggccgaggcaagcagggaggtaaagtgagggccaaagcgaaaagtagaagctcgagagccggactacagttccctgtcggaagagtgcaccgactgctgcgaaagggaaattacgcagagcgcgtgggcgcaggtgccccagtgtatttagcagctgtgttggagtacctgaccgccgaaattctggagttggctggcaacgctgctagagacaacaaaaaaaccagaattatccctcgtcatcttcagcttgcaatcaggaatgatgaagagcttaacaaactgctggggaaggtgacgattgctcaaggaggcgtgctgcccaacattcaagctgtgctgctccccaaaaagactgaaagtcaaaaaactaagtccaagtag

SEQ ID NO: 23040 - DNA, 390 bp, Artificial Sequence
  Description of Artificial Sequence: Synthetic coding sequence
atgtccgggcgagggaaacagggaggcaaggttagagccaaagctaaatctagatcttcacgcgctgggttgcagttcccagttgggagagtacatcgacttctgcgcaaaggtaactatgcggagcgtgttggagccggagctcctgtttacctggccgctgtactggaatacttgactgctgagattcttgaactggcaggcaacgccgctcgcgacaataagaagacgagaataattccccgacaccttcagcttgctatccgcaacgatgaagagctcaacaagctgctaggaaaagtgactatcgcacagggaggagtgttgcctaatattcaggctgtactgctgccaaaaaagacagagtcccagaaaacaaagagcaaatag

SEQ ID NO: 23041 - DNA, 591 bp, Artificial Sequence
  Description of Artificial Sequence: Synthetic coding sequence
atggaaattatcagtagcaaattgtttatcttactaactctcgcaacttcctcactgcttacctctaacattttctgcgctgatgagctcgtgattagcaatctgcactcaaaggagaactacgataaatatagtgagcctcgaggctatccaaagggcgagcgctccttaaattttgaggagttgaaagattggggccctaagaacgtcattaagatgtccactcccgcagtcaataaaatgccccatagctttgcaaacctcccattgagattcggcaggaatgtccaggaggaacgctctgccggagccaccgccaatctcccattgaggtctggacggaatatggaagtcagcttggttcgtcgggtgccgaacttacctcagcgcttcggccgtactactactgccaaaagcgtgtgtcggatgctgtcagatctttgtcagggttctatgcatagcccctgcgctaatgatttattctattctatgacttgccagcaccaggagatccaaaaccccgaccaaaaacagagtagacggcttctatttaagaagatcgatgacgccgaattgaagcaagagaaatag

SEQ ID NO: 23042 - DNA, 387 bp, Artificial Sequence
  Description of Artificial Sequence: Synthetic coding sequence
atggccggaggtaaagctgggaaagattctgggaaggcgaaggcgaaggccgttagtcgctcccagcgcgctggactacagtttcccgtggggagaatacataggcacttgaagacccgaaccacttctcacggacgtgtcggtgcgacggctgccgtttattcggcagccatcttagagtacttaactgccgaagttctagagctggctggcaacgcatctaaggacctcaaagtcaaacggatcacccccagacacctgcaattggctatacgcggagacgaagagctggactccttgattaaggctacaatcgccggtggaggagttatcccacacatacacaagtcactgatagggaagaaggggcagcagaagaccgcctag

SEQ ID NO: 23043 - DNA, 273 bp, Artificial Sequence
  Description of Artificial Sequence: Synthetic coding sequence
atggctgggggtaaagcagggaaagatagcggtaaagcgaaggcaaaagccgtctctcgttcgcagcgcgctggattacaggtgttggaactggccggaaacgcaagcaaggacctgaaggtcaaaagaatcacccccagacatctgcagcttgcaattagaggagacgaggagctggactcgcttataaaagcgacgattgccggtgggggtgtgatccctcatattcacaaaagcctcattggcaaaaaggggcagcagaaaacagcctag

SEQ ID NO: 23044 - DNA, 309 bp, Artificial Sequence
  Description of Artificial Sequence: Synthetic coding sequence
atgttccctgttgggcgtatccacaggcatctgaaaacaagaaccacctcccacggacgagtgggagccaccgctgccgtgtacagtgcggcaatcctagagtatcttactgcagaagttctggaactcgccggaaatgccagtaaagacctcaaggttaagaggattacccctaggcatttgcaactggctattagaggtgacgaggaactggacagcttgatcaaagcgacgatcgccggtggaggggtaattccccacattcacaaatcgttaattggaaagaaaggacagcagaagactgcttag

SEQ ID NO: 23045 - DNA, 201 bp, Artificial Sequence
  Description of Artificial Sequence: Synthetic coding sequence
atggctggtggcaaggccggaaaagattctggcaaggccaaggccaaagcagtctcaaggtcccagcgggctggacttcagttcccggtgggcagaattcaccggcatctcaagaccaggactacatctcatggtagggtgggagcaaccgctgcagtatacagcgccgctatcctggagtatttgacagccgaggtgtag

SEQ ID NO: 23046 - DNA, 1110 bp, Artificial Sequence
  Description of Artificial Sequence: Synthetic coding sequence
atgtcctctcgcggaggtaaaaagaagtccaccaaaacctctcgatcagctaaagccggagtcatttttcccgtgggcaggatgctgaggtacataaaaaagggccatcctaaataccggattggcgtgggggcacctgtttacatggctgctgtcctagaatatcttactgccgagatcctggaactggccggaaacgctgcacgggataataaaaagggtcgggttacacctcgtcacattcttctggccgtggctaatgatgaggagctgaaccaacttttgaagggcgtgaccatcgcttcaggaggtgtcttgcccaacattcaccccgagctattggcaaagaaacgagggagtaaaggaaaacttgaggccatcattacccccccacccgcaaagaaagcaaagagcccttcccagaagaagcccgtgtccaagaaggcgggagggaagaaaggtgcacgcaagagcaaaaagaaacagggcgaagtgtcaaaagcggcatccgctgacagtacgacagagggcactcctgctgacggattcacagtattgagcaccaagagcctctttctgggccaaaagttacaagtcgtgcaggcagacattgcgtccatcgactccgatgctgtggtccatccaaccaacacagatttctacattggcggtgaggttgggaacacattagagaagaaaggtgggaaggagtttgtagaggccgttctggagctgcggaagaaaaacgggcctctggaagttgctggcgctgcagtctccgctggacatggactgcccgcaaagttcgtgatccactgcaattcccccgtttggggggctgacaaatgtgaagaattactggaaaagacggtgaaaaactgtttagcacttgccgacgacaagaagcttaaaagcattgccttcccctcgatcggttcagggagaaacgggttcccaaagcagaccgccgcacaattgattctgaaggcgatcagcagctactttgtttctaccatgtccagctcaattaaaacggtctactttgtcttgttcgatagcgagtcaatcgggatttatgtgcaggaaatggctaaactggacgcgaattag

SEQ ID NO: 23047 - DNA, 603 bp, Artificial Sequence
  Description of Artificial Sequence: Synthetic coding sequence
atgtcttctcggggaggaaaaaagaagtcaaccaaaacctctcgaagcgcaaaggcaggcgttattttccccgtggggcgtatgctgcggtatatcaaaaaaggccaccccaaataccgaattggtgtgggggctcctgtctacatggctgcagtgctggagtacttgacaggaaacacactagagaagaaaggcggaaaggagtttgtggaggctgttcttgaactgcgaaaaaagaatggtccactggaagtcgccggagcggctgttagtgccggacatggcctccccgcaaaatttgtgattcattgtaacagtccagtgtggggcgcagacaaatgcgaggagcttctggaaaagaccgtaaagaattgtcttgccttggctgacgacaaaaagctgaagtccattgctttcccgagcatcgggtctggtcgaaacggattcccgaaacagaccgctgctcagcttatactgaaagccattagttcatattttgtaagcactatgtcctcttcgataaagaccgtgtattttgtgctctttgacagtgagtccatcggcatatacgttcaggagatggcaaagctggacgcaaactag

SEQ ID NO: 23048 - DNA, 1119 bp, Artificial Sequence
  Description of Artificial Sequence: Synthetic coding sequence
atgtcctctagagggggaaaaaagaagtcaacaaagacatcccggtccgcaaaggcaggagtcatatttcctgtgggcaggatgctgcgctacattaagaagggccacccaaagtatagaatcggagtcggcgctcctgtgtacatggcggcagtgctagaatacctgacagctgaaattctggagctcgctggtaacgccgctagggataataagaagggcagagtcacacctcgccacatcttgctggcagtggccaatgacgaggaattaaaccaactcctgaagggcgtgacgatcgcctctgggggtgtgttgcctaatatccatccggaactgttggcgaagaagcggggtagcaagggaaagctggaagccattataacccccccacccgcaaaaaaggccaagtctccttctcagaagaaacccgtatcaaagaaagcaggcggtaagaagggggctcgtaagtcaaaaaagaagcagggagaggttagtaaagcagcctcagccgactctaccaccgaaggaacaccagctgacggcttcactgtcctgagcactaagtccctgtttctggggcaaaaacttaacttgatccacagtgagatatctaacctcgccggattcgaagtcgaggcgatcatcaaccctacaaatgcagacattgatttaaaggatgacttggggaacacattagaaaaaaagggcggaaaagagtttgtagaggctgttcttgagctccgtaagaaaaacggcccactggaggtggctggggctgccgtgagtgctggccatggcctcccagctaagttcgtgattcactgcaattctccagtttggggggctgacaagtgcgaagagttattggagaagacagtcaagaactgtctggcccttgccgacgataaaaaattgaagtccatcgctttcccaagcatcggtagtggaaggaatggcttccccaaacagactgctgcccaattgatcttaaaagcaattagttcttactttgtttctacaatgtcctcttcaatcaagaccgtctatttcgtactctttgattcagagtcgatcggtatctacgtccaggagatggccaagctcgacgccaactag

SEQ ID NO: 23049 - DNA, 1119 bp, Artificial Sequence
  Description of Artificial Sequence: Synthetic coding sequence
atgagctcaagaggcggaaagaagaagagcacaaaaacaagccgttctgctaaagcaggagtcatttttcctgtgggaaggatgctgagatatatcaaaaagggccatcctaagtaccgcataggagtgggcgcacctgtctatatggctgcagttttagagtacttgaccgctgagatcttggaactcgccggtaacgcagcacgagataataagaagggccgagttactcccaggcacatccttctggccgttgcaaatgacgaagagctcaatcagctgctcaagggcgttacaatcgccagtggtggagttctgcccaacatccaccctgagctactcgccaaaaagcgaggaagcaagggaaaacttgaagcaattataacccctcccccagctaaaaaggcaaaatcgccaagccaaaaaaagcctgtgtcaaaaaaggccggtgggaagaagggcgctcgcaaatcaaaaaagaagcagggggaagtctcaaaagccgcttctgcagattccactactgagggaacacccgctgatggatttacagttctgtctaccaaaagcctgtttctcgggcagaagctgaacctcattcactccgaaatttccaatcttgcaggattcgaggtagaggctatcattaaccctacaaatgccgacattgacctgaaggatgatctggggaacaccctggaaaagaaaggtggaaaagagtttgtggaagctgtcttggagctgcggaagaagaacggccctctggaggtggccggagcggctgtgtctgccggtcatggcctgcctgcaaagtttgtgattcattgtaattcacctgtttggggggctgataaatgtgaagagttgctggagaagacagtaaaaaattgtttagctctcgccgacgacaaaaaactgaaatccatcgctttccccagcatcgggtccgggcgaaacggcttccccaagcagacagctgctcagctgatcctcaaagccatttcttcatacttcgtctctacaatgagctcttcaattaaaacagtgtacttcgtcctgtttgactccgagtccatcggcatttatgttcaggagatggccaagttagatgccaactag

SEQ ID NO: 23050 - DNA, 1119 bp, Artificial Sequence
  Description of Artificial Sequence: Synthetic coding sequence
atgtccggaaggtccgggaaaaagaagatgtcaaaactctctcgaagcgctcgtgcaggagtgatctttccggtcggacgactaatgcgttatctcaaaaagggaaccttcaaatacaggatttcagtcggcgcaccagtctacatggcagccgtgatagagtatctggctgccgagatcctggagttagcaggcaacgcagcaagggataacaaaaaggcacgaattgcacctcgacatatcctgcttgccgttgcgaatgatgaagagctgaaccaactgctcaagggcgtcaccatcgcatcagggggagtgctgcctagaatccatccagaattgctcgctaagaagcgtggcacaaagggaaaatcagaaacaatactttcaccaccccctgagaagaggggcagaaaggccacgtcaggtaaaaagggagggaagaaatccaaggcagcaaaaccgagaacatccaagaaaagtaaacccaaagacagcgataaagaaggtactagcaatagcacctcagaggacggacctggcgacgggttcaccattctcagttccaagagtctagtgctaggacagaaactgtcgttgacacagtctgatatctctcatatcggatctatgagggtcgaggggattgttcatccaactaccgccgagattgacctgaaggaggatataggtaaggccttggaaaaagcaggcggaaaggagtttttggaaaccgtgaaagaacttagaaaaagccagggacccttggaagtggctgaggctgctgtgtcccagagttctggcctagcggcaaaatttgtaatacactgtcatatacctcagtgggggtccgataagtgcgaggaacagctggaggaaacaattaaaaactgcctgtccgcagcagaagacaagaagttaaaaagcgtggcatttcctcctttcccatctggcagaaactgctttccaaagcagactgcggctcaggtcacgctgaaggcaatctcagctcattttgacgatagctccgcaagcagtctgaaaaatgtttattttttgctgttcgattccgaatctatcggaatctacgttcaggagatggccaaactggatgcaaagtag

SEQ ID NO: 23051 - DNA, 732 bp, Artificial Sequence
  Description of Artificial Sequence: Synthetic coding sequence
atgtccggacgttcaggtaagaagaaaatgagcaaactcagcaggtcggccagggccggtgtgatcttcccggtggggaggttaatgcgctacctgaagaagggaacatttaaatatagaatatctgtgggggctcccgtctatatggccgcagtcatagagtacctcgcggcagagatcctcgagctcgccggtaacgccgcacgtgataataaaaaagcgcgtattgcccctcggcacatacttctggcggttgcaaacgacgaggagctcaaccagtctaagcctaaggattcagacaaagagggtacctcaaacagtaccagtgaagatgggcctggcgatggctttactattctgtccagcaaatcactggtgctggggcagaagctgtcgctcacacagtctgatatatcccacataggctcaatgagggtcgaggggattgtgcaccctacaaccgcggagatagacttaaaggaggacatcggaaaggctctggagaaagctggaggtaaggagttcctggagactgtcaaggagctgcgaaaatcccaagggccactggaagtagcagaagccgcagtgtctcagagcagtgggctcgccgctaaattcgtgatccattgtcatatccctcagtgggggtccgacaagtgcgaggaacagctcgaggagactatcaaaaactgcttgagcgccgcagaggacaaaaagttaaaatctgtttag

SEQ ID NO: 23052 - DNA, 732 bp, Artificial Sequence
  Description of Artificial Sequence: Synthetic coding sequence
atgagcggcaggtccgggaagaaaaagatgtcgaagctgtcacggtcggctcgcgctggtgttatttttcctgtgggccgtcttatgcgctatttgaaaaaaggcaccttcaaataccggattagtgtaggcgctcccgtgtacatggcggctgtaatcgaatacctcgcagccgagatactggagctcgcaggcaatgcggctagggacaacaagaaggcaagaatcgctcctcgtcatatcctgcttgctgtagcaaatgatgaagaattgaaccagtctaagcctaaagacagtgacaaggaaggcacctccaactccacgtccgaggacgggccaggggacggattcacaatcctctcctctaagagcttagtcctgggacagaaactgtcactaactcagagcgacatcagtcatattggaagcatgcgagtggagggtatagttcaccctactactgccgagattgacctgaaggaggacatcggcaaggcattggagaaggctggaggaaaagagtttcttgagactgtgaaggagctgcgcaaatcccagggtcccctggaagtcgctgaggccgctgtgtcccaaagttccggactcgcagccaaattcgttattcactgccacatcccgcagtggggcagcgataagtgtgaggaacagctcgaggagacaattaaaaattgcctttccgcagcggaggataaaaagcttaaaagtgtttag

SEQ ID NO: 23053 - DNA, 387 bp, Artificial Sequence
  Description of Artificial Sequence: Synthetic coding sequence
atggccggaggtaaggccggtaaagattctggcaaggccaagaccaaagctgtcagcaggtcacaaagagccggactgcagttcccagtagggagaatacatcgtcacctgaagagcagaacaacatcccacggcagagttggtgccaccgccgcagtgtattctgccgcaatcctggagtacctgaccgccgaagtcctcgagttggcagggaacgcttccaaggacttgaaggtgaagcgcataacaccacgccacttgcagctggccattcgaggcgacgaagagctcgattctctgattaaggccacaattgccggaggtggtgtgatccctcatatacacaaaagtctgattgggaaaaagggtcagcagaagacggtctag

SEQ ID NO: 23054 - DNA, 774 bp, Artificial Sequence
  Description of Artificial Sequence: Synthetic coding sequence
atgaaatgccacgctgggtctctgtctgcaaacctcccagccctcaaggtgaccgggtggtcaaggtgcgtggcttcaagacagcctattactgtgggcgtttgtggcccaaaaagacctctgtggccctccagcgaaaaacctttcaacttccataccttagctaaattgcatgacattggactcggcaatgacttccttgacatgactttaaaagcccagcaacagaagcagaagtcgcatgctactatccccaaatgtccgccactcccttggtcaccgacggtaacactgtgtagctgctatctgatggccgcagcctcagctatggccgaagcaagctccgaaaccacatctgaggaaggtcagtcgattcaggaacctaaggaggccaacagcacaaaggcccagaagcagaagcggaggggctgcaggggctcacggcgtcgccatgcaaacagacgaggggacagctttggcgactcctttactccttatttccccagggttctgaagcaggtgcatcagggcttatccctgagtcaggaagctgtcagcgtcatggattctatgatacacgatatactggacagaattgccactgaagccggacagttggcacactacactaaaagggtcaccataacgagtagggacatacaaatggcggtgcgacttttactgcccggaaaaatggggaaattggctgaagctcaaggaactaatgcagcactgagaaccagcctttgcgctatctggcagcaacgaaagtag

SEQ ID NO: 23055 - DNA, 465 bp, Artificial Sequence
  Description of Artificial Sequence: Synthetic coding sequence
atggccgcagcctctgccatggcggaggccagctctgaaaccacttcagaagagggccagtcgatccaggagcccaaggaagctaactccacgaaggcccagaagcagaagagaagaggctgtcgtggatcacggagaagacatgccaataggagaggagacagttttggtgactccttcactccttactttcccagggttctcaaacaagtccaccaaggcctgagccttagtcaggaagcagtctcagtcatggactcaatgatccacgatatacttgaccggatcgccacagaagcaggccagctggcacactacaccaagagagttactataacaagcagggatatccaaatggcggtccgcctgctgttgccagggaagatgggaaaactggcagaggctcagggtaccaacgcagccttacggacatctctctgtgcaatctggcaacagagaaaatag

SEQ ID NO: 23056 - DNA, 1026 bp, Artificial Sequence
  Description of Artificial Sequence: Synthetic coding sequence
atggccacctggagaagagacgggcgtctcacaggaggccaaagactgctgtgcgcaggactagccggaacactttccctgtctctgacagctcccttggaactggccaccgtactggcccaggttggggtagtgaggggccacgcacgtggaccctgggcaactggacatcgcgtctggcgcgcagaaggacttagggcattgtggaagggcaatgccgtagcgtgtcttagattgtttccttgttctgctgtccagctagctgcttatcgtaaattcgtcgttctgttcactgatgatctagggcacattagccagtggtccagtattatggccggaagcctggcgggtatggtaagtacaatcgttacctacccaacggacctgataaaaacccgcctgattatgcagaacattttagagccaagctatagaggcctgctgcatgccttttctacaatctaccaacaggagggcttcctggctctgtatcggggagtgagtctgacagtggtgggagccttgccttttagcgcgggttctctgcttgtgtacatgaacctggagaaaatctggaatggccctcgcgatcagttttcactgcctcagaatttcgcgaatgtctgcttagcagccgctgtgacgcaaacactgagcttcccatttgagaccgttaagcgtaagatgcaggctcaatccccttacctgccccatagcggaggtgtagacgtccacttcagtggagccgttgactgtttccggcagatcgtgaaggctcagggcgtcctggggctctggaatgggctgaccgctaacctcctcaaaatcgtgccttattttggtattatgttcagcacgttcgagttttgcaaacgcatttgtttgtatcagaatggttacattctctccccactgagctacaagctcaccccaggagttgatcaaagtttacagccccaggagttacgagaactgaagaaatttttcaaaaccaggaagcccaagccaaagaagccgaccctgtag

SEQ ID NO: 23057 - DNA, 408 bp, Artificial Sequence
  Description of Artificial Sequence: Synthetic coding sequence
atggccagaactaaacagaccgctcggaagtccacaggagggaaagccccacgaaagcagctcgccaccaaggccgcaaggaagagtacacctagcacctgcggggtgaaaccgcaccggtacagacctggaacagttgcactgcgagaaattaggcgctaccagaaatctactgaactcctgatccgaaagctaccttttcagagactagtccgcgagattgcgcaggattttaacacagatctcaggttccaatccgccgctgttggcgcactgcaggaggcatccgaggcctatctggtcggactactagaagacacaaatctatgtgctatccatgcaaagcgggtgaccattatgcccaaagacatccaacttgctcgccgaatcagaggagagcgcgcatag

SEQ ID NO: 23058 - DNA, 363 bp, Artificial Sequence
  Description of Artificial Sequence: Synthetic coding sequence
atgactagcctcgcccagcagctgcaaagactcgcgttgccccagagtgacgcaagtctcctctctagagatgaggtcgcgtcgctgctcttcgatcctaaggaagctgcaaccattgaccgggatacagcatttgctatcggctgtacggggctggaagaactcctgggcattgacccgtcttttgagcaattcgaagcccctctgttctcacaacttgctaaaacgcttgaacggagcgtgcaaactaaggccgttaacaagcaactggatgagaatatctccctttttctgatacacctgtccccttattttctccttaaacccgctcagaaatgcctggaatggttgatacacagatag

SEQ ID NO: 23059 - DNA, 6191 bp, Artificial Sequence
  Description of Artificial Sequence: Synthetic coding sequence
atgactagtctcgctcaacagcttcagcggctggcattgccccagagcgacgccagcctcctatctcgagatgaagtggcctctcttttatttgatccgaaggaagcggcaactatagatcgcgatacagctttcgcaatcggctgcacaggactcgaggagttgttgggaatagacccatccttcgaacagttcgaggcccctctgttctcacagctggctaaaactctcgaacggtctgttcagactaaggcagtgaataagcagctggacgaaaacattagcctgttcttaattcatctgtcgccatactttctcctaaagccagcccagaagtgcctggagtggcttatccacaggttccacattcatctctacaatcaagattccttgattgcatgcgtccttccatatcacgaaaccaggatcttcgtgagggtgatccagttgcttaagatcaataatagtaaacaccgctggttttggcttctgccggtcaagcaatctggcgttccactggccaaagggactttaataacacactgttataaagatctgggctttatggactttatctgtagtctcgtgacgaagagcgtgaaagtgttcgccgaatacccaggaagttccgctcagttgcgtgtcctgctcgcgttctatgcatccactattgtcagtgctctcgttgccgctgaggacgtgtcggataacattatcgcgaaactgttcccatacattcagaaagggctgaagtcctctctcccagattatcgtgcggcaacgtacatgatcatctgtcagatttcagttaaagtgactatggagaacaccttcgtaaattccttagcaagccagattattaagactttgacaaagattccttcgctgatcaaggacgggctgtcttgtctgatcgtcttattgcaaagacagaagccagaatcgctgggaaagaaacctttcccccacttgtgcaatgtacctgatctgattaccatcctgcacggcatcagtgagacctatgacgtctcacccctgctacactacatgctgccccatctcgtcgtgtcaatcatccaccacgtgaccggtgaggaaacagagggcatggatggtcaaatatacaagaggcatctcgaagcgattctcaccaagatcagtcttaaaaacaatttggaccatctgctggccagtctcctctttgaggaatatatttcttatagttctcaggaagagatggattcaaacaaggttagcctcttgaatgagcagtttctcccactgatcagactgctggaaagtaagtacccacggactctggacgtcgtgctagaggagcatcttaaagagatcgcagatctcaagaagcaggagcttttccaccaatttgtgagcctgagcacttctgggggaaaataccagttcctggcagattcggatacttccttaatgctcagtctgaaccacccattggcaccagtgaggatccttgccatgaaccaccttaagaagattatgaagacttctaaagagggtgtggatgaaagctttataaaggaggctgtgctcgcccgattgggcgacgacaacatcgatgtagtgctcagcgccattagtgcatttgaaatattcaaagaacacttcagctccgaggttactatatcgaatctgctgaatcttttccaaagagcggagctctctaagaacggagaatggtatgaagtactcaaaatagccgcagacatcctgattaaggaggaaatcctgtcagagaatgatcagctttccaaccaagtggtggtgtgtctcctaccttttatggtaatcaataacgatgataccgagtctgccgagatgaagatcgccatttatctgtccaagagtgggatttgttccctgcacccgctcctccggggatgggaggaggctttggagaacgtaatcaaaagcacaaagccaggcaaactgatcggagtggctaatcagaaaatgatcgagttgctcgcagacaacattaatttgggggatccgtcgagcatgctgaaaatggtggaggatcttatcagcgtgggggaggaagagtcctttaacctgaaacaaaaggtcaccttccatgtgatcctatcagtgctcgtcagctgctgctcaagcttaaaggaaacccattttcccttcgctattcgcgtattcagtttactccagaaaaagatcaagaagctagaatctgttataaccgccgtggagatcccctcagaatggcacatcgaactcatgctcgatcgcggtattcccgtagagctttgggcgcattacgtggaggagttgaactcaacccaacgcgtggctgttgaggattcagttttcttggttttttcgcttaagaaattcatttatgccctgaaagctcccaaaagcttccctaaaggcgacatttggtggaacccagagcaactgaaagaagatagccgcgattacctccacttgttaatcggactgtttgagatgatgctgaacggggcagacgctgtccacttcagagtgctaatgaaactgtttatcaaggtgcaccttgaggatgtgtttcagctgttcaagttttgctccgtgctgtggacctacgggtcctccctgagcaaccctctgaactgcagcgtcaagaccgtgctgcagacacaggccctgtacgtgggttgcgcaatgctcagttctcagaaaacacagtgcaaacaccaactcgcctccatcagttctcccgttgtgacctcgttgctcatcaaccttgggtcaccagtgaaggaggtgaggagagcggctatccagtgtctgcaggccctcagtggagtggcatctcctttctacttgatcattgatcatctcatttctaaggcggaagagattacatccgatgctgcctacgtgattcaggatctggctacactgtttgaagagttgcagagagagaaaaagttgaagtctcaccagaaactcagcgagaccttgaagaacttattgtcttgcgtgtatagttgtccctcgtacatagcgaaagatctgatgaaagtactccagggggtgaacggagaaattaccaagcctttttttgctgccatctccgatgagaaggttcagcaaaagttgcttcgcatgcttttcgacttgttggtgaattgcaaaaactcccactgtgcacaaaccgtgtccagtgtatttaagggcatctctgtgaatgcggaacaggtcaggatcgaactggaacccccagataaggcaaagccactcggaaccgtccagcagaaacgtcgccaaaagatgcaacaaaagaaatcccaagatctcgagtctgtgcaggaggtaggtggaagttattggcagcgggtcacattgatactggagttgctccagcacaaaaagaagctccgaagtccacagatactggtgccaactttgttcaatctgctgtcaaggtgcctcgaacctctccctcaggaacaggggaatatggaatatacgaagcaactgatcctgtcctgcctcctcaacatttgtcagaagctgtctcccgatggaggcaagattcccaaggacatcctggacgaggagaaatttaatgtggaactcatcgttcagtgcatcaggttaagcgagatgccacagacccaccaccacgccctgctgctcttaggaaccgtagcaggtattttcccggataaggtattgcacaacattatgagcatctttacgttcatgggcgctaatgttatgcgtttggatgatacttattcttttcaggtgataaacaagacagttaagatggtcatcccagcactgatccagtctgactccggagactctatagaggtgagtaggaacgtggaggaaatcgtggtgaagatcatcagcgtctttgttgacgccctgccccacgtcccagagcaccgacgactgcccatcctagtccagctggtcgacacattgggtgccgaaaaatttctttggatcttgttgattctcctgttcgaacagtatgtcaccaagacagttttagcagctgcttacggggaaaaggatgctattctcgaagctgacacagagttctggttttctgtttgctgcgagttttcagtgcagcaccagatccagtctctgatgaatatactacagtatctgttgaaactccccgaagaaaaggaggagactattccaaaggccgtgagtttcaacaagtcagagagccaggaggagatgctgcaggtgttcaacgtcgagacacacacatcaaagcagctgcgccacttcaagttcttgtcagtctctttcatgtcccagctcctgagttccaataatttccttaaaaaggtggttgaaagcggcggtccagagatactgaaaggactcgaagagcggcttctggaaaccgtgcttgggtacatctcagcagtggcgcagagtatggagcgcaacgcagataagctgactgtgaagttctggagggcgctgctgagtaaagcttacgacttgctggataaagtgaatgctctcctgcctactgaaacttttatccccgttattagagggctggtcggcaatcccctgccttcagtcaggcgaaaggcgctggatctcctgaataataagcttcagcaaaatatctcatggaagaaaaccattgtgacaaggttcttgaaactcgtgcccgatttgctggccatcgtgcagcgcaagaagaaagagggcgaagaagaacaggcaattaatagacaaacggctctatatactctgaaactgttatgcaaaaactttggggctgagaacccagatccattcgtgcccgttctgaatacagccgtcaaacttatcgccccagagcgaaaagaagaaaagaacgtgctcgggtcagccttgctttgcatcgctgaagtcacatccaccctcgaggcgctggcaataccacagttacccagcctgatgccttccctactaactacgatgaagaacacctcagaattggtgtcgtcagaggtgtacctgctatccgcactggccgcactccagaaagtggttgagactctgcctcacttcatttccccctatctggaggggatcctttcccaggtaatacaccttgagaaaataacaagcgagatgggtagtgcctcacaagccaacattaggctgacaagtttgaagaagacactggccacgaccctggcaccacgcgtgctcctgcctgctatcaaaaaaacatataaacagattgaaaaaaattggaagaaccatatgggaccttttatgtcaattttacaagagcatattggtgttatgaagaaagaggagctgacctcacaccagtcccagttgaccgcctttttcctcgaggcacttgattttagggctcagcatagcgaaaatgatttggaggaagtcggcaagactgagaactgtattattgattgcttggtagctatggttgtgaaactttctgaagtcactttccgtcctctgttcttcaagctgtttgactgggcgaaaactgaagatgcccctaaggaccgtctcttaaccttctacaacctagcagactgcattgccgagaagctgaaaggactgttcacacttttcgcaggtcatctggtaaaaccatttgctgacacgctgaatcaggtgaacatttccaagacagatgaggccttcttcgacagcgagaacgacccggagaaatgttgccttctactgcaattcatcctgaactgtctctacaaaattttcttgtttgatactcagcactttatatctaaggagcgggcagaggctctgatgatgccattggtggatcagctagagaatagactcggtggagaagaaaaatttcaggagagggtgaccaagcacctgatcccttgtattgcccaattctccgtggccatggcagatgacagcctgtggaaacccttaaattaccagattctcctcaaaacacgggactctagtcccaaagtcagatttgccgctttaatcacagtgttggcgctggctgagaaactgaaggagaattacatcgtgttgctccccgagtcaataccttttctcgctgaactgatggaggacgagtgcgaggaagtcgaacaccagtgtcagaagaccatccagcagttggagacggtgctgggggagcccctgcagagttattttta

SEQ ID NO: 23060 - DNA, 6434 bp, Artificial Sequence
  Description of Artificial Sequence: Synthetic coding sequence
atgacgagcctcgcacagcaactgcagagactggctttgccccagagcgacgcgtcgctgcttagcagggacgaggtcgcatcactgcttttcgatcctaaggaggctgccacgattgaccgcgacacagccttcgcaattggttgtacaggcttggaagagctgttgggcatcgatccctccttcgaacaatttgaagctccactttttagtcaattggcaaaaaccctggaacggtctgtccagacaaaggccgtgaataagcagttagacgaaaatatctctctatttttgatccatctgtctccctactttttgctgaaacccgctcagaagtgtctggagtggctaatccatagatttcacattcatctctacaaccaggactcgctcatcgcctgtgtcttgccataccacgagactcgcatctttgtgagggttatccagctgctaaagatcaataactctaagcaccgatggttctggctgctgccagtgaaacagagtggcgtcccacttgcgaaggggacactgatcacccactgctacaaggatctcgggttcatggattttatatgctccctggttaccaagagtgtgaaagtttttgcggaataccctgggtcttctgcccagttgcgagttctcctagcattttatgcatctactattgtttctgcgctggttgctgccgaggacgtctctgataatataatcgccaagctctttccctacatacagaaagggctgaagtcttccctgccggattaccgcgcagccacgtacatgatcatttgccagatttctgtgaaagtgacgatggaaaacacctttgtgaattccctggcctctcaaatcattaagacgctgaccaaaattccctctttgataaaagacgggctttcatgcttgattgtgctattgcagcggcagaagcccgaaagtttgggcaaaaaaccgttcccccatctatgtaacgtcccggatctcatcaccatcctccacggtattagtgagacctacgacgtctcaccactgctccattatatgctgccccatctagttgtttcaataatacatcacgtgacaggggaggagaccgaggggatggatgggcaaatctacaaacgccacctggaggctattctgaccaaaatctccttgaagaacaacttggaccacctgctggctagcctccttttcgaggagtatattagctattcctctcaagaggaaatggactctaacaaagtatctctgctgaacgaacaatttttgcccctgatccggttgctcgaatctaagtacccccgaactctcgatgtggtgctggaagagcacctcaaggagattgctgacctcaaaaaacaggagctcttccatcagttcgtgtctctgtctacctctggagggaaataccaatttttagcagatagtgacacatcactgatgttaagtttaaatcacccactggccccagttagaatcctggccatgaaccatcttaagaaaattatgaaaacctccaaggaaggagtggatgagagtttcattaaagaggcggtcctggcccgtctcggggacgataatattgacgtggttctctcggccatcagcgcttttgaaatattcaaggagcacttttcctccgaagtcacaatttcaaacctccttaatctcttccagcgagccgagctgagcaaaaatggcgaatggtatgaagtgttgaagattgcagctgacattctcatcaaagaggaaatcctctccgaaaacgatcagctatctaaccaagtggtggtgtgtctgttgccgtttatggtgattaacaatgacgatactgagtctgctgaaatgaaaatagcgatctacctctctaaatccggcatttgctcactgcatcctttgctgagaggatgggaggaagcactggagaacgtcattaagtctaccaaacctggtaaattgattggcgtggcgaaccagaaaatgattgagctgttagcagacaatattaacctaggcgatcctagctctatgttaaaaatggtggaggacctaattagcgttggggaggaggagtcgttcaacctgaaacagaaggttactttccatgtgatcctatccgtactggtctcctgttgctctagtctgaaggagactcacttccccttcgctatcagggtattctccctattgcagaagaaaattaagaaactcgagagtgtgatcaccgccgtggaaataccttcagagtggcatattgaactgatgctcgatcggggaattccagttgagttatgggcccactacgtggaagagctgaattccacacagcgtgtggccgtggaggattccgtgtttctcgtatttagcctgaaaaaatttatctacgcgctgaaagcgcctaaatctttccccaagggcgatatttggtggaatcctgagcagcttaaggaggatagccgcgactacctccatctcttgatcggcctgttcgagatgatgctcaacggcgcagatgccgtgcactttcgcgttttgatgaagctattcatcaaagttcatcttgaagatgtgttccaactgtttaaattctgctctgtattatggacttacggatcttcattgagcaaccctcttaactgtagcgtaaaaactgtgttgcagacacaagcgctgtatgtcggctgcgccatgctgagctctcagaagacgcaatgtaaacaccagctggcaagcatctcctcgcctgtggttaccagtctcctaattaatctgggtagtcccgtcaaggaagtgaggagggcagcgatacagtgcctgcaggccctgagcggcgttgcctccccattttaccttatcattgatcatctcatctcaaaggctgaagagattacctctgacgcagcctatgtcatacaagacctcgccaccctgttcgaggagctccagcgggagaaaaagcttaagagccaccagaaattgagtgaaactctgaagaacctattatcctgtgtgtatagctgtccttcctacatcgccaaggacctgatgaaggtgctccagggggtgaatggcgagatggtcctctctcagctgcttcccatggctgaacagctgcttgagaaaatccagaaagaacctaccgccgtactgaaagacgaagccatggtcctccacctgactcttggaaagtacaatgaatttagtgtctctctgcttaatgaagaccccaaatcgctggatatttttatcaaggccgtacacactactaaagaactctacgcagggatgcccaccattcaaattactgccctggaaaagattacaaagcccttttttgccgctatttccgacgaaaaggtccagcagaagttattaaggatgctgtttgacctgctcgtcaactgcaaaaactcacactgtgcacaaacagtttccagcgtgttcaaaggtatcagcgtaaacgcggagcaggttcggatcgaacttgagccacctgataaggccaaaccactgggcaccgtgcagcaaaagcgcaggcagaagatgcagcaaaaaaagtcccaggaccttgagtcggtgcaggaggttgggggaagttattggcagcgggtgacactcattctcgaattgctccagcacaagaagaagttgaggtcgccacagatcctggtccctactcttttcaacctcctgtctaggtgcctggaaccccttcctcaggaacagggcaatatggagtacacaaaacagttgattttgagttgcctgctgaatatatgccagaagctgtcaccggatggtgggaagattccaaaagatatcctggacgaggagaaatttaacgtggaactgatcgtccagtgcatccggctgtcggagatgccgcagacccaccatcatgctctcctgctgctcggcacggtcgctggaatattccctgataaggtccttcataacataatgagcatatttacctttatgggagctaatgtcatgagactggacgatacctactcttttcaggtgatcaataagactgtgaaaatggttattcccgcactgatccagagcgactccggagacagtattgaagtgtctaggaacgtcgaggagattgttgtgaagataattagtgtatttgtcgatgcacttccgcacgttcccgagcacagacgtctacctattttggtccaattggtcgatactttgggcgctgaaaaattcttgtggatcttgctgatcctcttattcgagcaatatgtgaccaagaccgttctggccgcagcatacggtgagaaggacgccatcctggaggcggataccgaattttggttctctgtctgttgcgaattctccgttcagcatcaaatccaaagcctgatgaacatcctacagtatttattgaaactccccgaagaaaaggaggaaacaataccgaaagccgtgtcttttaataagtcggagagccaggaggagatgctgcaagtattcaacgtggagacacacacctcaaagcagctgcgacattttaaattcctctccgtttccttcatgagccaactgctttcctccaataatttcctgaaaaaggttgtcgaaagtggcggacccgaaatcctgaaaggcctggaagagcgcctgcttgagacagtcctgggttatatctccgccgtcgcacagagcatggagcggaacgctgacaaactgactgttaagttctggagggcactcttgtctaaggcctacgatcttcttgataaggtgaatgccctgcttcctaccgaaactttcatccctgtaatacggggacttgtgggcaacccactcccctccgtgcggaggaaggctctggaccttctgaacaataagctgcaacagaatatcagctggaaaaagaccatagtcaccaggtttctgaagttggtaccagacctgcttgcaatcgttcagcgaaaaaagaaagaaggggaggaggaacaggctattaatcggcaaaccgcgttgtacacactaaagctgctgtgtaaaaacttcggggctgaaaaccccgaccccttcgtgccagttctcaacacggctgttaagttgattgccccagaacggaaggaagagaagaacgtactcggatcggcccttttgtgtatcgctgaagtgacttccacactagaagcgcttgcaattcctcagctaccctctctaatgcccagtcttctgactacgatgaaaaacacatccgaactggtctcatcagaggtttacctgctctcagccctggccgctctccagaaggtggtcgaaaccctcccacactttatatctccgtatctggaaggcatcttgagccaggtcatccacctcgagaaaattactagtgagatgggttccgcctctcaggccaatatccggctgacaagtctcaagaaaaccctggccactacgctggcccctagggtcttacttcccgctataaagaagacctataagcagatcgaaaagaactggaaaaaccacatgggccctttcatgagcatcttacaagagcacattggggtgatgaagaaggaggaactaacaagccatcaatctcaactcaccgcattttttttagaggccttagacttcagggctcaacatagcgaaaacgacctggaggaagttggtaagaccgaaaattgcattattgattgtctcgtcgcaatggtggtaaagctcagcgaggttaccttccgaccacttttcttcaaactttttgactgggccaaaaccgaagacgcgccaaaagataggctgctgacattttataacctggccgactgtatcgcagagaaactgaagggcttgtttactctgttcgctggccacctggtgaaacctttcgccgacacgttgaatcaggtgaatatctccaaaacggacgaagccttcttcgacagcgagaatgatccagagaagtgttgtttacttctccagtttatcctgaactgcctgtacaaaatatttcttttcgatacccagcacttcatctccaaggagagagccgaagcgctgatgatgcccttggtggatcaactggaaaatcggctggggggagaggaaaagttccaggaacgcgtcacaaaacacctcatcccatgtattgcccaattctccgttgctatggccgatgattctctgtggaagcccctaaactaccagattctcctcaagaccagagactcaagccccaaggttcgcttcgccgctctaatcaccgttttggccttggcggagaaattgaaagagaactatatcgtcctgctgcctgaatctataccgtttttggccgagctgatggaggacgaatgtgaggaagtggagcaccaatgccaaaaaaccatccaacaacttgaaacagtgctgggcgaacccttacagtcttattttta

SEQ ID NO: 23061 - DNA, 231 bp, Artificial Sequence
  Description of Artificial Sequence: Synthetic coding sequence
atggccgagactgatcccaagacagtgcaagacttgacttcagtagtgcagacgctgctccagcaaatgcaggataagttccagaccatgagcgaccagataattggccgaatcgacgatatgagctcacggattgacgatctggaaaaaaacatagctgacctgatgacccaggctggcgttgaagaactggaatccgaaaacaaaatacctgctactcaaaaatcttag

SEQ ID NO: 23062 - DNA, 1791 bp, Artificial Sequence
  Description of Artificial Sequence: Synthetic coding sequence
atggaagctttgctcagcactccaattaatcccaataacttccccgctaaactgtggcgcttagtgaattcacctcgatacagatcaatccgctgggacgggagaggcgagggtttacttatagaccagccactattcgaagcggagctgctgtcaccccctggcccagggggaggaggtggcaccgccggagcgggagcagagccagaactgtttaagaccacttcttttacttcatttatccggcagctaaatctgtatggcttccgtaaggtcgtcctcggaggccctggaggtgggaagccagccggaaatggacctcttcatcattttcacaacccgcacttcagacgagaccagccccagctgctggttcacttgaagcggctcaccagcgccaataaggctaagctcgctgctggattagaggtcccatgtcgacctcccaacagattccaacgtctcctgatcacttccgcatccgccgctacagcaccactccaacatcagcagccgcctccacccgcagggccacgtcccgagccccacggtccagtggccgtgggtcagtttcaccgctccttcagaagagacagcctgtcaccatatagctgcgtgagcactcccagtcatgatcattctacgtaccccttaaagggcttagaccgcacccctgttccccatcgcatctggcagaactctctaggcatgcatcccggtcaggttgaaaccagccctacattttcggacaagggagtacccttccctgttttgcaaagatttcccacggaggttacttacaccctgcagccgagtaccacatcagtgcatgtgcagcaaggtcctcagacgatggtgtcatccagccaaaagtatagtaattacacacctagcgcacaatactcccaggcttactacccgacagcggtgttgcagtgctgttccccgacgcacatggacgccctctcctcatgtgtgacccccaatgcttctagctacgcgcattgcaactactttcagaaccccagcatgcaaagttcataccctgttgaattcctgccctcaaactggccctgttccacaactgacgagaacacaaaaaccgaggtgaatctggaggcagtgttccagatcgtcgacgagctccactcctctccgaagctggaaatggtgaaggttgagccagtcgagaaccagtgcccaacctcccccagctacaggggtcagcacatcctggcaaactccaataacagcaacccgtgcagcgcttcacaggcctcgcaactcgaaccactgacccccgtcggcagcgacattatgtcattcgtggttggtactgagcaggccgtagcatgcagcctgcctcaaagtcccgaatacatatacaccattcacaccgctcagccggtggagaattccaccatccaggagtccgccgcaattcaacaggcccatgtgaagttgaaagaacacctcaaccataatccatcacccagttctgtggtatttgtgcaggagggtcctcccttttcaacccaccaggtggacgccaacatcaaatgtcagacaagtagtcgggagaacattttgcctagtgagcaaatgggctttctgattagcgagatgggcccagccagtaagccaagcgaggacacgggactggctacacctgctcggtatagagagcaccggtcaaactcccagcaggggaaatctccggatctgcatttattagtggacgtggcctgcaagcaggaaagattccccaaagaggaggagctgaaggaatag

SEQ ID NO: 23063 - DNA, 1491 bp, Artificial Sequence
  Description of Artificial Sequence: Synthetic coding sequence
gggggaatagaaaacggggtgggcgaactcgggtccggcggagaggctcctgcgcgacgaggagacgggggtgctgcgctgcacccccatcagcctcaacagctgccccgacaggcagtcgccccaggtgagcagcctgcattgcccctgcaccccctggggcgaccccgaagaggtgccgcttacagatctgccgcactcagaggaagggcggcacagcctcctgcaggacccagaccggaaccacatggtccagttgcagtcggccaattccaccgaagttttcggagagatagcctgtcaccctattcgtgcgtatctaccccttctcacgaccacagcacctaccccttaaaaggactagaccggacaccggtcccccataggatctggcagaattcactgggcatgcacccagggcaggtggagacctcccctacattttctgacaagggtgtgcctttccctgtgctgcagaggtttcctaccgaagtaacctataccctgcagccatccacaacatcagtacacgtgcagcagggtcctcagacaatggtgtcaagttctcagaagtacagtaattatactccatccgcccagtacagccaggcttattatcctactgccgtgctccagtgttgttcaccaactcacatggacgccttatcctcgtgcgtgacccccaacgcgtcatcatatgcacactgcaattactttcagaacccgagcatgcagtcttcctatccagtggaattccttcccagcaattggccatgcagtacaacagacgaaaatacgaagacagaagtgaatctggaggccgttttccagatagtggatgagctacacagctcacccaaactggaaatggtgaaagtagagcccgttgagaaccagtgccccacatccccttcataccgaggccagcatattctggccaactctaacaattccaatccttgcagcgcgagtcaagcttctcagctcgaaccccttacaccggtaggctcagatattatgtccttcgtggtcggcactgagcaggctgtggcttgtagtcttccccagtcacctgagtatatttatactattcatacagcccagcctgtcgaaaatagtacgatccaggagtctgccgcaatacagcaggcccatgtgaagctcaaagagcacttgaaccacaatccttctccatcttcagtggtttttgttcaggaaggcccaccctttagcacacatcaggtggatgcgaacatcaagtgtcagacaagctcccgagagaatattctcccaagtgagcaaatggggttcctgatctcagaaatgggtccggcaagcaagcccagcgaggatactgggcttgcaacccctgccagataccgggagcaccgcagcaatagtcagcaggggaaatcgcccgatctgcatctcttggtagatgtggcctgcaagcaggaaaggtttcctaaggaggaggagcttaaagaatag

SEQ ID NO: 23064 - DNA, 3264 bp, Artificial Sequence
  Description of Artificial Sequence: Synthetic coding sequence
atggctcgttcttctccataccttcgccagctacaggggccactcctgcctcctcgtgatctcgtggaggaggacgatgactatttaaatgatgacgtcgaggaggatgaagaaagtgtctttattgatgcagaagagctctgctctggtggggtgaaggctggttccttgcctggctgtttgcgagtgagtatctgcgacgagaacactcaggagacctgcaaggtatttggtcgttttcccatcacaggagcctggtggagggtgaaagttcaggtcaagcccgtggtggggtctaggtcataccagtatcaggtgcaaggctttccttcatacttcttgcaaagcgatatgagtccacctaatcagaagcatatatgtgcgcttttcctgaaggaatgcgaggtatcttccgacgatgtgaataagtttctgacatgggttaaagaggtttctaactataagaacttgaactttgagaacctgagggagaccttgagaacttttcataaagagaccggaaggaaggaccagaagcaacctacccagaacggacaggaagaattgtttctcgacaacgagatgagcttaccattagagaacacgattccctttaggaacgtgatgaccgctcttcaattccccaagatcatggagttcctgccagtcttactcccaaggcactttaagtggattatcggcagcggttccaaggagatgctcaaggagatcgaggagatactgggcactcacccttggaagctcggttttagtaagattacctatcgagagtggaaactgctaaggtgtgaagcctcctggatcgcgttttgtcagtgcgagtccttacttcaacttatgaccgaccttgagaaaaatgccttgatcatgtactcccgcctgaagcaaatatgtagggaggacggccacacatatgtggaggtaaacgatttgaccttgactctaagtaaccacatgtcttttcatgccgcaagcgagagcctgaaattcttgaaggatataggtgtcgtgacgtacgagaagtcttgcgtgttcccttacgatctgtatcacgccgaaagagccatagccttctcaatctgtgacctgatgaagaagcccccatggcacctgtgtgtggatgttgaaaaagtgttagcatctattcacaccaccaaacctgaaaactctagtgacgatgccctcaatgagtcaaaaccggatgaagtgcggttggaaaacccggtcgacgtggttgatacacaggacaacggagatcatatatggaccaatggagagaatgaaattaatgccgagatttcggaagtgcagttggatcaggaccaggttgaggtgcccctggatagagatcaggtggccgctctggagatgatatgctccaatccagtgactgtcatatccggaaaggggggttgtggcaaaactaccatagtgagtcgtctctttaaacacatagagcagcttgaggagagggaagtcaagaaagcctgcgaagacttcgagcaggaccagaacgctagtgaggaatggattaccttcactgagcaatcacagttggaagccgacaaggcgatcgaggtcctgttgaccgctcccacaggaaaagccgctgggctgctgaggcagaagacagggctgcacgcttacaccctgtgccaggtgaattattcattctattcctggacacaaactatgatgactactaataagccctggaaattcagcagcgtaagagtattggtggtagacgaagggtccctggtctcagtcggaattttcaagtcagtgctcaaccttctgtgcgagcactccaagttgtctaaactgattattctgggcgacattagacagcttcccagtattgaaccgggaaatttattaaaagatctcttcgagactctgaagtctcggaattgtgcgatcgagctgaagaccaaccacagggctgagagccagttgatcgtagataatgcaacccggatctcccggaggcagttcccaaagttcgacgctgagcttaatatttctgataaccccaccctaccaatcagcattcaggacaaaacctttatctttgttcgcctgccagaagaggacgctagctcccagagttctaagaccaaccaccattcatgcctttactccgctgtgaaaacgctcctgcaggagaataacctacagaatgcaaaaacttcacagtttatcgccttccgaaggcaagattgtgatcttataaacgactgttgctgtaaacattacactggccacctaaccaaagatcatcagtctcgcttggtgtttggcataggagacaagatttgctgtacccggaacgcatatctcagcgacctgctgcccgagaacatctctggctcccagcagaacaatgacctggacgcttcaagcgaggacttctccggtaccctgcctgactttgctaagaacaaacgggacttcgaatctaatgtgagactgtgcaatggggaaatatttttcatcacaaacgacgttacagacgtgaccttcgggaaacggagatcattgaccatcaacaacatggctggactcgaggtaactgtcgacttcaagaagttgatgaagtactgccgcatcaagcacgcctgggctcgcactattcacaccttccaaggcagcgaggaacaaacagtcgtctacgtggtgggaaaggcagggaggcaacactggcagcatgtctacaccgcagtcactcggggacgctgcagggtgtatgtcatcgcagaagaatcacagctgcggaacgcaataatgaaaaatagtttccccagaaagacccggttaaaacacttcctgcagagtaagctgagctcatctggggctccccctgcagactttcctagtcccagaaaatcttcgggagacagtggaggcccatcaacacctagtgcctctcccctcccagttgtgaccgaccacgccatgactaatgatgtaacatggtccgaggctagcagtcccgacgaaaggaccctaacattcgcagagcgctggcagctatcttcacctgatggcgttgacaccgacgatgatctccccaaatcaagagctagtaaaagaacctgcggagtgaacgacgacgaaagccctagcaagatctttatggtgggagaatcaccgcaggtcagctctcgattgcaaaacttgagactcaacaatctgatacccaggcagcttttcaaacctaccgataatcaagaaacatag

SEQ ID NO: 23065 - DNA, 3264 bp, Artificial Sequence
  Description of Artificial Sequence: Synthetic coding sequence
atggcacgaagcagcccataccttcggcaactgcagggaccactgctgcccccacgcgatttggtggaagaggatgatgactatcttaacgacgacgttgaagaggatgaagaatcagtgtttatcgatgcagaggaactttgttcaggaggagttaaggctggatccctgcccggatgtctccgtgtgagcatctgtgacgaaaatacgcaagaaacatgcaaagtctttggaaggttcccaattaccggagcttggtggagagtcaaggtgcaggtcaaacctgtcgttggcagtaggagctatcagtatcaggtccagggctttccatcctactttctacagtccgacatgagtccgccaaaccagaaacacatctgtgccttgttcctgaaagaatgcgaggtcagtagcgatgacgttaataagttcctgacttgggttaaggaagtgtctaactataaaaaccttaatttcgagaatttacgtgaaaccctgcggacttttcacaaggagacaggcagaaaagaccaaaaacagcctactcagaatgggcaggaggaactcttcctagacaacgagatgagcctgccgctcgagaacaccatacccttccggaacgtcatgaccgccttgcagtttcccaaaatcatggagtttctccctgtcttactacctcggcactttaagtggatcattggcagcggatctaaggagatgctgaaggaaattgaggaaatcttgggcacccacccatggaaactcgggtttagcaagattacctacagagaatggaagcttctgcgatgcgaggcgtcttggatcgcattctgtcaatgcgagtccctcttgcaactgatgacagatctggagaagaacgctctcattatgtactccagacttaaacagatttgcagggaagatggacatacatatgtggaggtgaatgatttaacactaaccctgagcaatcacatgtcttttcacgcggcatccgaaagtcttaagtttctaaaggacattggtgtggtgacctacgaaaagtcatgcgtttttccatacgacctgtatcacgccgaaagagctatagccttttccatatgtgatctgatgaagaagcccccatggcatctgtgcgtcgatgtggagaaagttttggcatccatccacacaactaagccagagaactcttccgatgatgcccttaacgaaagtaagcccgatgaagtccggctggagaacccagtcgacgtggttgatacccaggacaacggagaccatatctggaccaatggggagaacgaaatcaatgcagagattagtgaggtgcaactggatcaagaccaagtggaagtgcccctggaccgagaccaggtggccgcattggaaatgatatgttctaaccctgtgacggtgatctctggcaaagggggttgcgggaaaactaccattgtctcgcggctattcaagcacatcgagcagcttgaggagagagaagtcaaaaaggcctgcgaggacttcgagcaggaccagaacgcatccgaggaatggatcaccttcactgagcagagccagctcgaggccgataaggcaatcgaggtgctactcacagctcctacgggaaaagctgctggactgctaaggcagaagactgggctgcacgcttacacattgtgtcaggtgaattatagtttttactcatggacccagactatgatgaccaccaataagccttggaaatttagttccgttagagtcctcgttgtggacgaagggagtctcgtctccgtgggtattttcaagagcgtgctgaaccttctgtgcgagcatagcaagctgtcaaaactgatcatattgggcgatattcgccagctaccttccatcgagccaggaaacctgctgaaggacctgttcgaaactctgaagtctaggaattgcgctatcgagctgaagaccaaccatcgagccgagagtcagctcatcgttgacaatgcaactcgaatttccagacgccagtttcccaagtttgatgcggagctcaacatatctgacaacccaaccctgcccattagtattcaggataaaacatttatctttgttcgcctgcctgaagaagacgcttcgtcccaaagtagcaaaaccaaccaccacagttgtctgtactccgccgtgaagaccctgctccaggagaacaatctccagaacgccaaaacctcacagttcatagcctttcggagacaggactgtgatctgatcaacgactgctgttgtaaacactacaccggtcacctcacaaaagatcatcagagtaggctggttttcgggatcggcgacaaaatctgttgtaccaggaatgcctatctgtcggacttgctgcctgaaaacatctctggaagccaacagaacaatgacctagacgcctccagcgaggacttctctggaacactgccagatttcgctaaaaacaagagggacttcgaaagtaacgtcaggctgtgcaacggcgaaattttctttatcaccaacgatgttacagatgttacctttggcaaacggcgttcccttaccataaacaacatggccggactggaggtgacagtggacttcaagaagttaatgaagtactgcagaatcaagcatgcctgggcacgtactatccataccttccagggctcagaagaacagaccgtggtgtacgtggtcggtaaggcagggaggcagcattggcagcacgtttacaccgctgttaccagaggtagatgccgggtgtacgtgatcgccgaggagtcccagctgcgaaatgccattatgaaaaattcctttccccgaaagacgagactgaagcatttcctgcagtccaagttgagtagctctggggcaccccctgccgactttcccagtcctcgtaagtcttccggagatagtggtggcccatccacccctagcgcctcaccactcccagtggtcacggatcacgctatgaccaatgacgtaacttggtccgaggcttccagccctgatgagcgaaccttgaccttcgcagaaagatggcaactcagcagccctgacggtgttgacaccgatgacgatcttcccaaaagccgggcttccaagaggacttgcggggtgaacgacgacgaaagtccgagcaagatcttcatggtcggcgaatccccccaggtaagcagtaggctccagaacctgcggctgaacaacctcattccccgacaattgttcaagcccaccgacaatcaagagacctag

SEQ ID NO: 23066 - DNA, 3030 bp, Artificial Sequence
  Description of Artificial Sequence: Synthetic coding sequence
atgtcgtggatgttcaagcgagatccggtgtggaagtacttgcagaccgtgcagtacggcgtgcatgggaattttcctcggctctcataccccacttttttccctcgctttgagtttcaggacgtcattcctcccgacgacttcttgacaagcgacgaagaggtggacagcgtgctctttggttctctgaggggtcacgtggtcggacttcgctattatactggcgttgtcaacaataatgagatggtcgcccttcagagggaccccaacaacccttatgataagaacgcaatcaaggttaacaatgtcaatggcaaccaggtcggccaccttaagaaggagttggcgggtgccctcgcgtacatcatggacaataaattggcacaaattgagggagtcgtcccgttcggagccaataacgccttcacaatgcctctccatatgacgttttggggcaaggaagaaaaccgcaaggccgtaagcgaccagttaaaaaagcacggctttaagctggggcctgcaccaaaaactttggggttcaatcttgaatctggctggggttcaggcagagcaggaccaagctactcgatgcctgtgcacgctgccgtacagatgactacagagcagcttaaaacagaattcgacaagctgttcgaggacctgaaggaagacgataaaacacatgagatggagcctgccgaagctatcgagacgcccctcttgccccatcagaagcaggcccttgcttggatggtatctcgcgaaaactcaaaggagctccctcccttctgggagcagcgtaatgatctctattacaacactattacaaacttcagtgagaaggacagacccgagaacgtccatggcggaatcctagctgatgacatgggactgggcaagaccttgactgccattgcagtgatacttaccaactttcacgacgggcgaccactacccatcgagagagtaaagaaaaacttactcaagaaagagtataatgtgaacgatgacagtatgaaattggggggtaataacacttccgagaaagcggacggattatctaaggacgcttctcgatgttcagagcaacctagtatctcagacattaaagagaagagcaagtttagaatgagcgaactcagcagctctagacccaaaagaagaaagacagcagtacagtacatcgaatcaagcgatagtgaagaaatcgagaccagcgagttgcctcaaaagatgaaaggaaagcttaagaatgtacaatcagaaacgaagggcagggctaaagccggaagctcaaaggtgatcgaggacgtggcctttgcatgtgctctgacaagtagcgtaccaacaacaaaaaagaaaatgctcaagaaaggagcttgtgcagtcgaggggagcaagaaaacagacgtggaggagcgcccaaggactactctgataatttgcccactctccgtgctgagcaattggattgatcagtttgggcaacacattaagtcagacgtgcatctgaacttttacgtctactatggcccagaccgcatccgggaaccagccctgcttagtaaacaagatatcgtacttactacttataacattctgacacacgattacgggacaaaaggagattccccccttcatagcattcgctggctgagagtgatcctggatgaaggccatgccatacggaatcctaacgcgcagcaaaccaaggccgtgctcgatctagagtctgagcggaggtgggtgttgaccggcacccccattcagaatagtttgaaggatctctggtccctactgtcattcttaaagctgaagcctttcatcgatagagagtggtggcacagaaccattcagcgcccagtgaccatgggagatgagggtggtctgaggaggctccagagcttaattaaaaatatcactctacggaggactaagacaagcaagattaagggcaagccagtgctcgagctcccagaacggaaggtgtttatccagcacattaccctgagtgacgaggaaaggaagatctaccagtccgtgaaaaatgaagggagggcaactataggtagatactttaatgaagggactgtgctggcccactacgctgacgtgctcggcttgttgctgaggctgaggcagatctgttgccacacatacctcctcactaacgcggtgagttctaatggaccaagcggcaatgacacaccggaggagttgcgcaaaaaactgattagaaagatgaaactgattctgagctcgggtagtgacgaggaatgtgcaatatgtttggacagccttaccgtccctgtgatcacacattgcgcacatgtgttctgtaagccttgtatttgtcaggtcattcaaaatgagcagcctcacgccaagtgccccctttgccgaaatgatattcacgaggacaatctccttgagtgccctcccgaagagttggcgagagattcagagaaaaagtctgacatggagtggacgagctcttccaaaattaatgccctaatgcacgccctgacggacctgaggaaaaaaaaccctaatataaagtctcttgtagtgagccagttcacaacattccttagcctgatcgaaatccctctgaaggcctccgggtttgtgttcactaggttggatggctctatggctcagaagaaacgagtggagtcaatccagtgcttccaaaataccgaggcaggcagcccaacaatcatgctgcttagtttgaaagccggtggcgttggcctcaatctaagcgctgccagccgggtgttcctaatggacccggcttggaaccccgcagctgaagaccagtgtttcgatcggtgccaccgtttaggtcagaaacaggaagtgatcattacaaaatttattgtaaaggactctgtggaggagaatatgctaaaaatccagaataagaaaagagaactggccgctggcgcattcggcacaaaaaagcccaatgccgacgagatgaaacaagctaagataaacgagattagaaccttaatcgacctctag

SEQ ID NO: 23067 - DNA, 3030 bp, Artificial Sequence
  Description of Artificial Sequence: Synthetic coding sequence
atgagttggatgttcaaaagggacccagtgtggaagtacctacagacagtgcaatatggagtgcacggtaattttcccagactatcatatcccacatttttcccacgattcgagtttcaggatgtgataccacctgacgatttcctaacgagcgatgaggaagtggactcagttcttttcggcagcctgaggggacacgtcgtgggactgcgctactataccggagtcgtcaataataacgaaatggttgccctgcagcgtgatccaaataatccatatgataagaatgctatcaaggtgaacaacgtcaatgggaaccaagttggacacctgaagaaagaactggcgggtgcactggcgtatatcatggacaataaactggcccagattgagggtgtggtgccattcggagcgaataatgcttttactatgcctttgcacatgactttctggggaaaggaggagaaccgcaaggctgtttccgatcagctcaaaaaacacggcttcaaactcgggccagcccctaaaaccctagggttcaacttggaaagcggatggggctctggacgggcaggccctagctacagcatgccagtccacgccgcagttcagatgacaacggaacagctgaaaacagagtttgacaaactttttgaagatctgaaggaggacgataagacacatgagatggaaccagctgaagctatagaaactccgctcctgcctcaccagaaacaggcactggcctggatggtgagcagggaaaattccaaggagctccctcccttttgggaacagaggaacgacctgtactacaacactatcaccaacttctccgagaaggatcgccctgagaacgttcacggcggaatcttggctgacgatatgggtctcgggaaaaccctcacagctatcgcagtgatcctgaccaacttccacgatggtaggcctctgcctatagagcgcgtgaagaaaaacttactgaaaaaggaatataatgttaatgatgattctatgaaattggggggaaacaatactagtgagaaagccgatggtctatcgaaagacgcatctaggtgctcggagcagcccagcatttctgatataaaggagaagtccaagtttaggatgagcgagctcagctctagccgacctaaaaggaggaaaactgcagttcagtatatcgaaagtagcgatagcgaggaaatagaaacctcagagctgccgcagaaaatgaaaggtaaactgaaaaatgtccagagcgaaacaaaaggacgtgcaaaggctgggagctctaaggttattgaggatgtggctttcgcttgcgctctcacctcttcagtcccaaccactaagaagaaaatgctcaaaaagggggcatgtgctgttgaggggtcaaaaaagactgatgtggaggaacgcccacgcactactctaattatctgccccctcagcgtgttgagcaattggatcgaccagttcggacagcatattaaatccgatgtgcacctgaacttttatgtctattatgggccagatcggatcagggaaccagctttactgtcaaaacaggacattgttttgactacctacaatattctgacccatgattacggcactaagggtgacagtcccctgcacagcatccggtggttacgagtgatcttggacgagggacatgccataaggaatcctaacgctcagcaaaccaaagctgttctcgacctcgagagcgagcgcaggtgggtgctaaccggtacccctatccaaaacagcttgaaggatttatggagtcttctatcctttctgaaattgaagccatttatcgatcgcgagtggtggcaccgcaccattcagcgaccagtgacaatgggtgatgagggcggactgcggaggttacagtccctgattaaaaatataacacttagacgtactaagacaagcaaaataaagggaaagccggttctggagttgccagagaggaaggtattcattcaacatattacactctctgacgaagagcgcaaaatataccagtcggtcaaaaatgaggggagagcaactatcggacggtactttaatgaggggacagtgctggcacactatgccgatgtccttgggttacttctgaggctgagacaaatttgttgtcatacctacctgctgaccaatgccgttagcagcaacggtccgtcaggaaatgacacacccgaggaactgaggaagaagctcattaggaaaatgaaactaatcttatcgtcaggctccgatgaagagtgtgcaatttgcttagattcactgacagtgcctgtcattactcactgcgctcacgttttctgcaaaccttgcatatgtcaggttattcagaacgaacagccccacgccaagtgtccactgtgtagaaatgatatccatgaggacaatctgctggaatgcccacctgaagagttggcacgcgattctgaaaagaagagtgacatggagtggacctctagctcaaagataaacgcgctgatgcatgccctgaccgatttgcgaaagaaaaatcctaacatcaaatctctggtggtctctcagttcactacctttttatcacttatcgagattccattaaaggcctccgggttcgtcttcactcgcctggatggtagcatggcccaaaagaagcgcgtggaatctatccaatgcttccagaacacagaggccggatctcccactattatgctactgtccctcaaggcgggaggcgtggggctgaatctgtctgctgctagtcgggtgtttcttatggatccagcttggaatcccgcagccgaggatcagtgttttgatcggtgccataggctggggcaaaaacaagaggtgatcataaccaaattcatcgtcaaagatagcgtggaggaaaatatgctgaaaatccaaaacaagaagagagagttggccgcaggagcctttggcacaaagaagcccaacgctgacgaaatgaagcaggccaaaatcaatgagatacgcacattaatcgatctatag

SEQ ID NO: 23068 - DNA, 1179 bp, Artificial Sequence
  Description of Artificial Sequence: Synthetic coding sequence
atgttcaagagagaccccgtatggaagtacctccaaactgtgcaatacggtgtgcacggcaattttcccaggctttcctatccaactttttttcctcgctttgagttccaggacgttatccccccagatgattttctgacctctgacgaagaagtagactcagtgctgtttggctctctgagaggacatgtagtgggcttgcggtactacacaggcgtggtcaacaataacgaaatggtggccctgcagagagatccgaataatccctatgataagaatgcaattaaggtcaataacgttaacggaaaccaagtgggtcatctcaagaaggagttggcaggtgctcttgcatacataatggacaacaagctggcccagatcgaaggagtggtgcctttcggagcgaataatgccttcaccatgcccctgcatatgactttctggggaaaggaggaaaaccgcaaggccgtatccgaccagctcaagaagcatggtttcaagcttggtcctgctccaaagacattgggcttcaacctagagagtggttggggctcaggcagagcaggaccgtcctattctatgcccgtccacgccgcagtgcagatgactaccgagcagctaaaaacagaatttgacaaactctttgaggatttaaaagaagatgacaagacgcatgaaatggaacctgccgaggccatcgagacacccctattaccccaccaaaagcaggcactcgcctggatggtgtccagagagaatagcaaggagcttccaccgttttgggaacagcggaacgatttgtactacaataccattacgaatttttcagagaaggaccgcccagagaatgtacatggtggtatcctggccgatgacatgggcctcggcaagactctcaccgctatagctgtcatcctgaccaactttcacgacggacgtccacttcccattgagagagtaaagaagaatcttttgaagaaggagtacaatgtaaacgatgatagcatgaaattgggaggtaataatacctccgaaaaggccgacgggctgagcaaggacgcctcacgatgtagcgagcagccgagcatttctgatatcaaagagaagagtaaatttaggatgtctgaactgagcagttctagacctaaaagccagaagaaaaagaagaaaagggagtag

SEQ ID NO: 23069 - DNA, 1374 bp, Artificial Sequence
  Description of Artificial Sequence: Synthetic coding sequence
atgttcaagcgagacccagtgtggaaatatcttcagaccgtacaatatggtgtgcatggtaattttccgagactgtcctaccctaccttttttcctcgatttgaatttcaggacgtcattcctcctgacgactttctgacatctgatgaagaagtagacagcgttcttttcggatccctaagaggccacgtcgtcggcctccgatactataccggcgtggtgaacaacaatgaaatggtcgccttgcaacgggaccccaacaatccgtatgacaagaacgccattaaagtgaataacgttaacggtaaccaagtagggcaccttaagaaagaattggcaggggcactcgcctacatcatggataacaaactagcacagattgagggagttgtgccctttggggctaacaacgcgtttaccatgccgctgcacatgacgttttggggtaaggaagaaaaccggaaggccgtatccgatcagctcaaaaaacatggatttaaactcggaccagcaccaaagactctcggcttcaatcttgaaagtgggtggggctcgggcagggccggaccctcatatagcatgcctgtgcatgccgctgtgcagatgacaaccgaacagttaaagactgagttcgacaagcttttcgaggatttgaaggaggacgacaaaacccatgaaatggagcctgccgaggctatcgagaccccactgctcccccaccagaagcaagccctagcctggatggtctcccgagaaaactctaaagaactccctccattctgggagcagaggaacgacttgtactacaatacgatcactaattttagtgaaaaggacagacccgagaatgtgcacggaggcattctcgcagacgacatggggctcggcaaaacactcactgctatcgctgtcatcttgactaattttcacgatggaaggccacttcccatagaacgtgtcaagaaaaacttgcttaagaaggagtacaatgtgaatgacgactccatgaaactgggaggtaataacacatcagagaaagccgatggcctgtcaaaggacgcatcccgctgttccgagcaaccaagtatttctgatattaaggaaaaaagcaagttccgcatgtccgaactgtccagctctcgccctaagagacgaaagactgctgtacagtatattgagagttctgattcagaagagatcgaaacaagcgaactcccccagaagatgaaaggcaagttgaagaacgtgcagtctgaaaccaaaggcagagctaaagccggtagcagcaaggtgatcgaagatgtggccttcgcgtgtgcccttacctcttctgtgcccacgacaaagaaaaagatgctgaagaaggtgaaatag

SEQ ID NO: 23070 - DNA, 3030 bp, Artificial Sequence
  Description of Artificial Sequence: Synthetic coding sequence
atgagttggatgttcaagcgagatcctgtgtggaagtacttacaaacagtgcagtacggcgttcacggcaattttccaaggctgagctacccgacttttttcccgcgatttgagtttcaggatgtgataccacctgacgatttcctgacttccgacgaagaagtggacagcgtcctgtttggctctttgaggggacatgtcgtgggtctgcggtactacaccggcgtcgtaaacaacaatgaaatggtggcactccagagggatcctaacaatccctacgacaaaaacgccatcaaggtgaataatgtcaacggaaaccaggtcgggcacctcaagaaggaacttgctggcgcactggcttacattatggataataagctggctcagatcgagggtgttgttccttttggcgcaaataacgcatttactatgccgttacacatgactttctggggcaaagaagagaacaggaaagcggtgtcagaccaactgaaaaaacacggattcaaactcgggcctgctcccaagactttggggttcaacctggagtctggttggggcagtggcagggccggaccttcttactctatgcctgtgcacgccgctgtgcagatgaccaccgagcagctcaagaccgaattcgataaattatttgaggacctcaaagaggatgataagacacacgagatggaacctgccgaagcaatagaaactcctctcctgccccatcagaaacaggctctggcttggatggtgagtcgtgagaattccaaagagctgcccccattttgggaacagaggaatgatctctattacaacacaattacgaacttctccgagaaagaccggccagagaatgtccacggtgggattctcgcagatgatatggggctgggaaaaacattgaccgccatcgccgtcatactgacaaacttccacgacggaagacccttacccattgagcgagtgaagaagaacttactcaagaaggagtataacgtcaatgacgatagcatgaagctcgggggaaataatacctcagagaaggccgacggccttagtaaggacgccagtcgctgctccgagcaaccttccatctctgatataaaggagaagtccaagtttcggatgtccgagctttcatccagtcgaccaaaaagaaggaaaacagccgtgcagtacattgagtcttcagactccgaggaaatcgagacatcagagctgccccaaaagatgaagggcaaacttaaaaacgtgcaaagcgagaccaaagggcgtgctaaggccggttccagcaaggtcattgaagacgtagcatttgcctgtgcgctcacatcttccgtccccactacaaagaagaagatgctgaagaagggagcatgcgctgtggaagggtctaagaagaccgacgttgaggaacggccaaggaccactctgataatttgtccgctcagtgtgctttcaaattggatagatcagtttgggcagcatataaagtctgatgtccacctgaacttctatgtgtactatgggccagatcgaatcagggagccggcactcctttccaagcaggatattgtactcacgacttacaacatcctgacccacgattatggcactaagggagacagcccacttcactctattagatggcttagagtgatcttagacgaggggcatgctattaggaatcctaatgctcagcagaccaaggcagtgctagaccttgagtccgagcgacgctgggtcttgacgggcactcccattcagaattcattgaaggatctgtggagtctgctctctttcctgaaactcaaacccttcatagatagggagtggtggcaccgcactatccagagacccgtcaccatgggagatgagggcggactgcgacgcctccagagcctgattaagaatattacattgcggagaaccaagactagcaagataaaaggcaagcctgtcctagagctccccgaacgaaaggtgttcatacagcatattacactcagcgatgaggaacggaaaatctaccagtcagtcaagaacgaagggcgagctactattggcaggtacttcaatgaaggaaccgttctagctcactacgcggatgtcctgggtctcctcctcaggctgcgtcaaatctgctgccacacctacctgcttacgaatgccgtatctagtaacggacctagtggtaatgataccccagaagagctcagaaagaagttgatacggaaaatgaagctgattctctcgtccgggtccgacgaagagtgcgccatctgtctcgactctctcacagtgccagtgattactcactgcgcccacgtgttttgtaagccttgtatttgccaagtgattcagaacgagcagcctcatgctaagtgtcctctgtgccggaacgacatacacgaggataatctgctggagtgccctccagaggaactggcaagagactccgagaaaaagagcgatatggagtggacaagcagctcaaagataaacgccctcatgcacgcactcaccgatttaagaaaaaaaaaccccaatatcaagagcctagtcgtttctcaatttaccacgttcctctccctcatcgaaattccactcaaggcctctgggtttgtgttcactagattggacggaagcatggctcagaaaaaaagagtcgagtctatccagtgtttccagaatacggaggccggatcacctactattatgctgctgtctctcaaagcaggaggagttggccttaacttgagcgcggcatcccgagtgtttctgatggatcccgcttggaatcctgcagccgaggaccaatgcttcgaccgctgtcatcgtctcggccagaagcaagaagtgattattacaaagtttattgtgaaggattcagtggaggagaatatgctaaagattcagaacaagaagcgggaactggcagcgggagccttcggcaccaagaaaccgaatgcagatgagatgaaacaggccaagattaatgagattagaactctgattgatctctag

SEQ ID NO: 23071 - DNA, 984 bp, Artificial Sequence
  Description of Artificial Sequence: Synthetic coding sequence
atgtctgataagttaaaggagcgcaaggtgtcccgtttatccccaaatgggacgtgtgctctcgtggtcgaagcatccgattcacccaccaggcacctgggcggaccgatggctggcaaatgcccgcacggcacactctccgtggaggagtcgagggtgaggaccccagtgtcccacaaggtgatagagaaacgaaggcgcgatagaatcaacagatgcctgaatgagctcggcaaaaccgtgcctatggctcttgcaaagcagggcgaaccccaggaagccctggctcagatccggtctcgcgtgaggagcctcgtcctgtcaagcgcaacagtacccgaccagcaggctttgggcaggtgtgaaggacccttcttgctactgcagtcatcaggaaagctggaaaaggccgagatcctcgagatgaccgtccagtacctgagggcgctccacagtgccgattttcccagaggcagagagaaggccgagctgctcgcagagtttgctaactactttcattatggctatcacgaatgcatgaaaaacctggtccactacctgactacagttgaacgtatggagaccaaagatacgaagtatgcccgtattctagcgtttctgcagtcaaaagcgagactgggcgcagaacccgctttcccccctctcgggagcctacccgagcctgacttctcttatcagctccacccagccggacccgaatttgctgggcactcacccggtgaagctgcagtgttcccgcagggttctggggctggaccttttccttggccgccaggagcagctcgatcccccgcacttccctacctgcctagtgccccagtgccgctagcatctcctgcgcaacagcactctccctttctgacacccgttcagggattagaccgccactacctgaacctcatcggccacgcccacccgaatgctctgaatctgcacacaccacagcatccaccagtgctgtag

SEQ ID NO: 23072 - DNA, 726 bp, Artificial Sequence
  Description of Artificial Sequence: Synthetic coding sequence
atgtctgataaacttaaggaaaggaagcgtacaccagttagtcacaaggtgatcgaaaagaggcggagggatcggattaaccgatgcctcaacgaattaggaaagacggtgccaatggccctggcaaagcagagcagcggcaaactggagaaggctgagattttagaaatgacagttcaatacttgagggccctgcacagtgcagattttccccgaggtagggagaaggaactgttagctgagtttgctaattacttccactacggataccacgaatgtatgaagaacttagtccactaccttacaacagtggagaggatggagacgaaggatactaagtacgcccgtattctggcattcctgcagtccaaagcacgactgggtgccgagcccgcttttccgccactgggctccttgcctgagcctgatttttcatatcagctgcatccggctggccctgagtttgcaggtcactcgcccggtgaggctgccgttttccctcagggatccggagctgggccttttccctggccacctggggcagctcggagcccggctctgccatacttgccttccgccccagtgccactggcaagcccagcccagcagcacagcccgttccttactcccgtgcagggactggatcgccattatctcaaccttattggccacgcacatcccaacgctctcaacctgcataccccacagcacccccctgtgctttag

SEQ ID NO: 23073 - DNA, 729 bp, Artificial Sequence
  Description of Artificial Sequence: Synthetic coding sequence
atgtctgacaagctaaaagagagaaaacgaacccctgtgagccataaagtaatagaaaagagacgtcgagaccgtatcaatcgttgcctgaacgagctgggcaaaacggtgccaatggcactggcgaagcaaagttcaggtaagcttgaaaaagccgaaatcttagagatgaccgtccaatacctcagagcactgcatagtgccgactttcccagagggagggaaaaggcagagttgctggcagaatttgccaactatttccactacggatatcacgagtgcatgaagaacctcgtgcattatctcaccaccgtcgagaggatggaaacaaaggacaccaagtatgcgaggattcttgccttcctccagtccaaagctcgcctgggagccgaaccagccttccctcccctgggatctctccctgagcctgatttttcctaccagcttcaccccgctggcccagaatttgcgggacattccccaggcgaagccgctgtcttccctcagggtagcggagcaggtcctttcccctggccacccggagccgcaagatcaccagcccttccgtatctcccgtctgcccctgtccccctagccagtcctgcccagcaacattccccatttttgacacccgtgcagggcctggatcgacactacctgaacctgatcgggcacgcacacccaaacgcgctcaacctacacaccccacagcacccccctgttctctag

SEQ ID NO: 23074 - DNA, 2031 bp, Artificial Sequence
  Description of Artificial Sequence: Synthetic coding sequence
atgccccacgcatttaagccaggcgatctcgtgtttgccaagatgaagggctatcctcattggcccgcacggattgatgacatcgcggatggtgccgttaagcctccaccgaataaatatcctatatttttttttggtacccacgagactgccttccttggcccaaaagacctctttccatacgataagtgcaaggataagtacggtaaacccaacaagaggaagggttttaatgagggcctgtgggaaatccagaacaacccccatgccagttattcagcgcctccacccgtgtcaagtagtgacagtgaagcacccgaggcaaatcctgccgacgggtcagacgccgatgaggatgatgaagatcggggtgtgatggcagttacggccgtaactgctaccgctgcctctgaccgaatggagagcgactcagacagtgataagtcatctgataactccggattgaaacgcaagacaccggcactgaagatgtcagtgtcaaaacgggctagaaaagcctcatcagacctggatcaggctagcgtgagcccatctgaggaagagaattcagagtctagctctgagtccgagaagaccagcgaccaggacttcacgccagagaagaaggctgccgtgcgagccccacggcgtggaccccttgggggacggaagaaaaagaaggctccatccgcttctgattccgattcaaaagccgacagcgacggcgcaaaacctgagcccgtcgcaatggcaagatccgcttcatcatcttcctctagctctagtagttctgatagcgacgtctccgtgaaaaaacctccacggggaaggaagccagctgagaaacccttgccgaagccacgaggtcggaagcctaaacctgaacggcctcccagctcatccagctcggattctgacagcgatgaggtcgatagaattagcgaatggaaaaggagggatgaagcaagaagaagagaactcgaagctcgcagaagaagagaacaggaagaagagcttcggaggctgcgcgaacaggagaaagaggaaaaagaaaggcgcagagaaagggccgacagaggagaagcagagcggggtagcggaggctcctcaggcgacgaattacgggaggatgatgaacctgtgaaaaagcgaggacggaaggggaggggcagggggcctccgtcaagcagcgatagtgagcctgaggctgagctggaacgagaagctaagaagagcgctaaaaagccacagagttcatccactgaacctgcacgtaagccagggcagaaggagaagcgagtgcggcctgaagagaagcagcaggccaagccagtcaaagtcgaacggacaagaaagcggagcgagggcttctcaatggatcgtaaggtcgaaaagaaaaaagaaccgagtgtggaggagaagttgcagaaattgcactcagaaataaagtttgccctgaaagtggatagcccagacgtgaagagatgtcttaatgccttggaggagctgggaacgttgcaagtgaccagccagatcctacagaagaacacagatgtggttgccacgctcaagaagatccgcagatacaaggccaacaaggacgtgatggagaaggccgcagaggtgtacacaagactcaaaagtcgcgttctggggccaaaaatcgaggcagtgcaaaaggtgaataaagccggaatggaaaaagaaaaagcggaggagaagttggccggtgaggagttggctggcgaagaattggctggagaagaggctccgcaggaaaaggcagaagacaaacccagcacagacctgtccgcgccagtcaacggggaggcaaccagccagaagggggagtctgctgaagacaaagagcacgaagaaggacgtgattccgaagagggaccgaggtgtgggtctagtgaagacttgcacgactcagttcgggaggggccagatctagaccggcctggcagcgatcggcaagaacgcgaacgggctagaggagatagcgaagcgctagatgaggagtcctag

SEQ ID NO: 23075 - DNA, 1524 bp, Artificial Sequence
  Description of Artificial Sequence: Synthetic coding sequence
atgaaaggctacccacactggcctgctaggattgacgacattgctgacggtgcagttaagccaccaccaaataaatatcctatcttcttcttcggcacacacgagaccgcctttctgggccctaaggatctgttcccctatgacaagtgcaaagacaaatatggtaaacccaataaacggaagggatttaacgagggattgtgggaaattcaaaacaatcctcacgcatcttattctgccccaccccctgtgtcctcaagcgatagcgaggccccagaagctaaccccgcagacggctcagatgccgatgaagatgacgaagatagaggggttatggcagtcacagctgtgaccgccacggctgctagcgatagaatggaatccgactctgatagtgacaagagttccgacaactcaggcctcaaacgaaagacgcctgccttgaagatgtccgtgagtaaacgcgctcgcaaggcgtcttcagatctggatcaagcgtccgtatctcccagcgaagaagagaactccgagtcatctagcgaaagcgagaaaacaagcgaccaagacttcacgcccgagaaaaaagcggcagtccgggcaccacggaggggcccattgggagggaggaagaaaaagaaagcaccgagcgccagtgactcagacagcaaagcagattcagacggggctaaaccggaacccgtggccatggctaggtccgcctccagcagttcaagctcttcttcaagtagtgatagtgatgtgagcgtgaagaagcccccaaggggtcggaagccggcagaaaagccacttcccaagccacgagggaggaagcctaagcctgagagacccccaagttcttcttcatctgactcagatagtgatgaggtggatcggatatcagaatggaaaaggcgtgatgaggctcgtcggagagagctggaggcacgacggaggagggaacaagaagaggagctgcggagacttcgcgagcaggagaaagaagagaaggagaggagacgcgagcgcgctgaccgcggtgaagctgaacgaggctccggcggttcaagcggtgacgaacttcgggaagacgatgaaccggtcaagaagaggggcagaaaagggcgagggagaggtccaccgtccagctccgactcagagcccgaggcagagctggagcgggaggctaaaaagagtgccaaaaagcctcaaagcagctctaccgagcccgctagaaagccaggccagaaagaaaagagagtgagaccagaggagaaacagcaggccaagctggagtgcaatggcgtgatctcagcccactgcaacctcaggctgccgggaagctctgattctcccgctagcgcattacccagctcctgggattatcgccaccctcctccgaggctggccaatttctgttgtttctccagacacggggtatcctcttgttggccaggctggtcacgtagcccagacccagtgatctgtccgcctcaacccccaaaagtcctggggttacaagtttag

SEQ ID NO: 23076 - DNA, 1662 bp, Artificial Sequence
  Description of Artificial Sequence: Synthetic coding sequence
atggcaacggacaccagccagggggagctggtgcatccgaaggcgctacccctgatagtgggcgctcaactgatccatgcggataagcttggtgagaaggtcgaagactccacaatgccgatccggcgaactgtcaattccactcgggagacacctcccaagagcaagttagcagaaggcgaggaagagaagccagagcccgatatctcttcggaggaatcggtctcaactgtggaggagcaagaaaacgaaactcctcctgccacgagcagtgaggcggagcagcctaagggcgaacccgagaacgaggagaaggaggaaaacaagtctagcgaagaaacaaaaaaagacgaaaaggatcaatccaaagaaaaagaaaaaaaggttaagaagactatccccagttgggccactctttcggcttcacagctcgccagggctcaaaaacagactccaatggcctcttccccgaggcccaagatggatgctatattgactgaggcaatcaaagcctgcttccagaaaagtggcgcttcagtggttgctatccggaaatatatcatccataagtacccatctctggaactggaacgccgtggttatctcctgaaacaggccttaaagcgtgaacttaatcggggtgtcatcaaacaagtgaaggggaagggggcttctggaagtttcgtggtagtacagaagagccggaagaccccccaaaaatcccgcaatcgcaagaaccggtctagcgcagtcgatccagagccccaggtaaagctggaggatgtccttcctcttgccttcactcgcctgtgcgagcccaaggaagccagctactcattgatcagaaagtacgtgtcacagtattaccctaagctcagagtggacattcgccctcagctgctgaagaatgcgttgcagcgggcagtggaacgagggcagctcgagcagattactggcaagggtgccagtggcacatttcagttaaagaaatcaggagagaagccccttctcggcggatctctcatggaatacgctatacttagcgctatcgccgctatgaacgaaccaaaaacatgctccaccactgcccttaagaagtatgtcttggaaaaccatccaggaactaatagcaattatcagatgcatctgctgaaaaaaacattgcagaagtgtgaaaagaacggctggatggagcagatctctggtaaggggttctccgggacgttccaactgtgctttccgtattaccccagccctggtgtcctgtttcccaagaaggagcctgacgacagccgcgacgaagatgaggacgaagacgaaagttccgaggaagatagtgaggatgaggaacctcctcccaaaaggagactacagaagaaaaccccagccaaatctcccggaaaggccgcaagtgtcaagcagcgaggcagtaaacctgcaccaaaagtgtccgcagctcaacgtggcaaagcccgaccgctgcctaagaaggcaccaccaaaggctaagacaccagctaaaaagactaggccctcaagcacggttataaagaagccatctggcggaagtagtaagaagccagctacgagtgccagaaaagaagtgaagttgcccggaaaagggaagtctacaatgaagaaaagcttcagggtgaagaagtag

SEQ ID NO: 23077 - DNA, 402 bp, Artificial Sequence
  Description of Artificial Sequence: Synthetic coding sequence
atggccacagacacctctcagggagagctggtgcatccgaaagcccttccccttatcgtcggagcccaactgatacatgccgataagctaggcgaaaaagtggaggattcaacaatgcccattagacgcacagtaaatagtacaagagagacacctccaaagtccaagttggccgagggggaagaagaaaaacccgagcccgatatctcctctgaagaaagcgtttccacggtggaagaacaggagaacgagactccaccagccacaagctccgaagcagagcagcccaagggcgaacccgagaacgaggagaaggaagagaacaagtcctcagaagagacgaaaaaagagcgggcagattccatacattccaccttattcataattggacagaacagctag

SEQ ID NO: 23078 - DNA, 1206 bp, Artificial Sequence
  Description of Artificial Sequence: Synthetic coding sequence
atggcatccagtccgcgtcccaagatggatgcaattttgacagaggccatcaaagcgtgctttcagaagagcggggcttcagtcgtggcaattcgcaagtatattatacataagtacccatctttggagctggaaagaaggggctaccttctcaagcaggctctgaagcgggagttaaatcgaggggtgataaaacaggtgaaggggaaaggagcaagcgggtccttcgtggtagtgcaaaaatcccggaaaaccccccagaagtcaagaaacaggaagaatcggtcttctgcagtggaccctgagcctcaagtcaaactagaggatgttctccccctcgcctttacccgactatgtgaaccgaaggaggcctcctatagcctcattagaaagtatgtcagccaatactaccccaaactgagagtggatattcgaccgcagctgctgaagaacgccctccagagggctgtggaaagaggccagctcgaacagatcacaggcaaaggcgcatccggcacgttccaactgaagaaaagcggcgagaagcccctgctgggcggaagcctcatggaatatgccattctttcagctattgctgccatgaacgaacccaaaacctgttccactaccgcccttaaaaaatatgtgttggagaatcacccaggaaccaatagtaattatcagatgcacctgctaaagaagaccttgcaaaagtgtgaaaagaacggatggatggagcagatctccggcaaggggttctctggtacatttcagctgtgtttcccctattaccccagtccaggggtgctgtttccgaagaaggaacccgacgatagccgggacgaagacgaggacgaggacgagtccagtgaggaggacagtgaagatgaggagccgccacccaaacggagactgcaaaagaagacaccagccaaaagcccaggcaaggcagcctcagtgaagcaacgcggatcgaagccagcccctaaagtttctgccgctcaacgagggaaagccagacccctgccaaagaaggcaccaccgaaggcaaaaacgcccgcaaaaaaaacccgcccatcctccacagtcataaagaagccatccggcggatctagtaagaagcccgcaaccagcgcgcgaaaggaggtgaagctgcccggaaagggaaaatccaccatgaagaagtcttttcgggtcaaaaagtag

SEQ ID NO: 23079 - DNA, 1548 bp, Artificial Sequence
  Description of Artificial Sequence: Synthetic coding sequence
atgcccatccgcaggacagttaattcaacccgtgagacaccacctaaaagtaagttagcggaaggagaagaagagaaaccagagcccgatattagcagtgaagagtctgtgtctacagttgaagaacaggagaatgaaaccccacctgcgaccagcagtgaagctgagcagccaaaaggcgagccagaaaatgaggaaaaagaggaaaataagagctcagaagaaaccaaaaaggacgagaaagatcagagtaaggagaaagagaaaaaagtgaagaaaactataccctcctgggcaacacttagcgcctctcagctggctagggcacagaaacagactcctatggcctcttcccctagacccaaaatggacgccatccttacggaagctattaaggcgtgctttcagaagagcggggcttcggtggtggccattcgtaagtacataatccataagtaccccagccttgagctcgagcgcagagggtatctgttgaaacaagccctcaagcgagagctgaatcgcggagtcattaagcaggtaaaggggaagggagcgagcggcagcttcgtggtcgtgcagaaaagccggaagacccctcaaaagtccaggaaccgcaagaaccgtagctcggccgttgatccagagccacaggtgaaactggaagatgtcctgcctctagcgtttacacgcttatgcgagcccaaggaagcctcatacagcctaatccgaaagtatgtcagtcagtactatcccaagctccgcgtggatatccgaccccagctgctgaaaaacgcacttcagcgggctgttgaacgaggccagctggaacaaataactgggaagggcgctagcggtacattccagcttaaaaagtctggtgaaaagcccttactgggtgggtcgcttatggaatacgccatcttgtcagccatcgccgctatgaacgagccgaagacctgttctacaaccgctctcaagaaatacgttctggaaaatcatccaggcacgaattccaactatcagatgcaccttctgaaaaaaacgctgcagaagtgcgaaaaaaacggctggatggagcaaatatcagggaagggcttcagtggtacctttcaattgtgtttcccgtactacccctcaccgggagtgttatttcctaaaaaggaaccagacgatagtcgggatgaggacgaagacgaggatgagtccagcgaggaagactccgaggacgaggagcccccaccgaagcgcagactgcagaagaagacccctgctaagtctcccggtaaggctgcttccgtgaaacaaagaggaagcaagcccgcaccaaaagtttctgccgcacagagagggaaggcgagacctttacctaaaaaggctcctccaaaagccaaaacacccgctaagaagactcggcctagctctactgtgattaagaagcccagcggtggatcctcaaagaaacccgcaacatccgctaggaaggaggtgaaattgccaggaaagggaaaatctaccatgaaaaagtccttcagagtgaaaaaatag

SEQ ID NO: 23080 - DNA, 231 bp, Artificial Sequence
  Description of Artificial Sequence: Synthetic coding sequence
atggccacagatacgtcccagggtgaactggttcacccgaaagctctgcccctgatcgttggcgctcagctgattcacgccgataagctgggagagaaggtagaagactccaccatgcccattagaaggactgtgaattctacacgggaaacccccccaaagagtaagcttgctgaaggagaagaagagaagccggagccggatatttcctcagaagaatcggtgtcttag

SEQ ID NO: 23081 - DNA, 375 bp, Artificial Sequence
  Description of Artificial Sequence: Synthetic coding sequence
atggccaccgatacatcccagggcgaactggtccaccccaaggcgctgcccttgatcgtgggtgcgcaactcatccacgccgacaagctgggggaaaaggttgaggacagcacaatgcctatccggagaacggtgaattcaactagagagactccccctaagtcgaaactcgcggagggagaggaggagaagcccgagcccgatatttcatcagaagagagcgtttcaaccgtggaggaacaagaaaatgagaccccgccagccacaagcagcgaagccgagcagcctaagggtgaacctgaaaacgaggagaaggaggagaacaagtcttcggaggagaccaaaaaggacgagaaagatcaatcaaaagagtag

SEQ ID NO: 23082 - DNA, 123 bp, Artificial Sequence
  Description of Artificial Sequence: Synthetic coding sequence
atgcccatcaggagaaccgtgaactcgacaagagagacacccccaaagtccaaactcgcagagggcgaggaagagaaaccagagcccgacatctcgtcggaggagagcgtgtccactgtttag

SEQ ID NO: 23083 - DNA, 762 bp, Artificial Sequence
  Description of Artificial Sequence: Synthetic coding sequence
aaaaaagatgagaaagaccagtcaaaagaaaaagagaagaaagttaaaaaaacgattcccagttgggctactctgagcgcaagtcagctggccagagcacagaaacagacaccgatggctagctcccccaggccaaaaatggacgccatcctcacagaagctattaaggcttgtttccaaaaaagcggtgccagtgttgtggccataaggaaatatattattcataagtatccttccctggagctggagagacggggttatttgcttaagcaggctctaaaacgggaactgaaccgtggcgtcattaaacagaatcgtagctcagccgtcgacccagagccacaggtcaaactcgaagatgtgctgccgctggcttttactcgcctctgcgaaccaaaggaggcatcttattccttgattagaaagtacgtttcacagtactatccaaagctccgcgtggatatcagacctcagctgctgaagaacgcgctccagagggctgtcgagcgtgggcaactggagcagataactggtaaaggcgcatctggaactttccaactgaaaaagagtggtgagaaacctctgcttggcggttctctgatggagtatgctatcttgagcgccatcgccgctatgaacgagccgaagacctgctccacgacggcccttaaaaaatatgttctagaaaaccatccagggacgaactctaattatcagatgcatctgcttaagaagacactccagaagtgtgagaagaactag

SEQ ID NO: 23084 - DNA, 837 bp, Artificial Sequence
  Description of Artificial Sequence: Synthetic coding sequence
atgccgatccggaggactgtgaatagcaccagagaaacccctcccaaaagcaaattggcagagggcgaggaagaaaagccggagcctgacattagttctgaggaatctgtctctacggtggaggagcaggagaacgaaacgccccctgccacctcttccgaggcagaacagcctaagggagagccagagaatgaggagaaagaggaaaataagtcctccgaggagacaaaaaaggacgagaaggaccaatcgaaagaaaaggagaagaaggttaagaagaccatcccttcatgggcgaccctgtccgccagccagctggcccgtgctcagaaacagacgccaatggcctctagccctcgccctaagatggacgctattctgactgaggcaattaaagcatgcttccagaagtccggggcaagcgtcgtcgctatcagaaagtacattattcataagtacccgtcactggagctggaaaggagagggtacctgctgaaacaggcgttaaagagagagctgaatagaggtgtgatcaagcaggtgaagggtaagggcgctagtgggagcttcgtcgtcgtgcagaagtcccgaaagaccccacaaaagtcgagaaacaggaaaaatcggtcttcagctgtggacccagaaccacaagttaaactggaggacgtcctgccgctcgcatttacacgactgtgtgaaccaaaagaggcctcatatagcttaattcggaagtacgtatctcagtactaccccaagctaagagttgacatcagacctcaactgttgaaaaacgcattgcagagagccgtagagagaggacagttggaacaatag

SEQ ID NO: 23085 - DNA, 138 bp, Artificial Sequence
  Description of Artificial Sequence: Synthetic coding sequence
atgcccatcagacggaccgttaacagtacccgagagacaccccctaaatctaaactggcagagggcgaagaggagaaacccgagcctgacatttcttcggaggagagcgtgtccacggtcgaggagcaagaaaattag

SEQ ID NO: 23086 - DNA, 984 bp, Artificial Sequence
  Description of Artificial Sequence: Synthetic coding sequence
atggccacagatacatctcagggggagctagtgcacccaaaagccctgccattaattgtgggcgctcagctaatacatgcagataaactgggagagaaagtcgaggacagcacgatgcctataaggcgtaccgtcaattccacgcgggaaactcccccaaaatccaagctggctgaaggcgaagaagagaagcccgagcccgatatctcttctgaagagtccgttagcaccgtggaggaacaggagaacgaaactccacccgcaacatcgagcgaagctgagcagccaaagggtgagcccgagaacgaagaaaaggaagaaaacaaaagttccgaggagacaaaaaaggacgaaaaggaccagtctaaggaaaaagagaaaaaggtgaagaaaaccattccttcgtgggctacgttatccgcaagtcaactcgccagggctcagaaacagacccccatggcatctagtccacgtcctaaaatggatgcaattctgacagaagcaatcaaggcttgctttcagaagtcaggagcaagtgtagttgctattaggaagtacatcatccataagtatccgagccttgagctggaacggagaggctatctactgaaacaggccctcaagagggagcttaatcggggagtaatcaagcaggtcaaaggcaagggcgcttccggcagcttcgtcgtcgttcagaagagtcggaagacaccacagaagagtcgaaataggaagaatcggagctcagccgtcgatcccgaacctcaagtcaaattggaggacgtgttaccactggccttcacccgactgtgtgagccaaaagaagcgtcttactcactcatccgaaaatatgtatcacagtattatccgaaactgagggtcgacatccggcctcaactgcttaagaacgctctccagcgcgctgttgaaaggggccaactggagcagatcacaggcaagggcgcaagcggcacctttcaatag

SEQ ID NO: 23087 - DNA, 60 bp, Artificial Sequence
  Description of Artificial Sequence: Synthetic coding sequence
atgcctatccgtcggacagtgaatagcaccagagagacgcccccaaagtccaagctgtag

SEQ ID NO: 23088 - DNA, 918 bp, Artificial Sequence
  Description of Artificial Sequence: Synthetic coding sequence
atggagaactcccagctgtgcaaactgttcatcggtggtctcaatgtgcagaccagcgagtccggactccggggtcactttgaagcttttggtacacttactgactgcgttgtggtggtgaatcctcaaactaaacgatcacgatgttttggatttgtgacttatagcaacgtggaagaggcagacgctgcgatggcagcctcaccacatgcagtggacggcaatacagtggaactgaaacgcgctgtatcccgggaagactcagctcggcctggcgctcatgcaaaggtgaagaagctgttcgtgggcggattaaagggagatgtcgctgagggggacctcattgagcatttctcccagtttgggaccgtcgagaaagctgagatcattgcagataagcagtccggaaagaaacgtgggtttggcttcgtgtattttcagaaccatgatgctgccgacaaagctgcggttgtgaagttccaccctattcagggacatcgggtggaggttaagaaagccgtgcctaaagaagatatttatagtggaggtggtggtggcggttccaggagtagtcggggtggccgtggcggacgtggaagggggggagggagggatcagaatggactgtcgaagggcggtggtggcggatataatagctacgggggatacggtggagggggtggcggaggatacaacgcatatggtgggggaggtggaggcagcagctacgggggaagcgactacggcaacggctttgggggatttggcagttactctcagcatcagtccagctatggcccaatgaagtctgggggagggggaggtggtgggggttcctcctggggtggcaggagcaatagcgggccttacagaggagggtacgggggaggaggagggtacggtgggtcctctttttag

SEQ ID NO: 23089 - DNA, 1107 bp, Artificial Sequence
  Description of Artificial Sequence: Synthetic coding sequence
atggggacacccccaggccttcaaacagactgcgaggccttattgtcccgtttccaagaaactgactcggttaggttcgaggattttacagaactgtggaggaacatgaaatttggtaccatcttttgcggtagaatgagaaaccttgaaaagaacatgttcacaaaagaggccttggccctagcatggcggtacttccttcctccatacaccttccagatcagggtcggcgctctctacttgctgtacgggctgtataacacccaactttgtcagccaaagcagaaaatcagagtcgcactcaaggactgggatgaagtgctaaaatttcagcaggacttagtcaacgcccagcactttgacgccgcatatatatttcgcaaactccgtctcgatagggcatttcacttcaccgcaatgccaaagctactgtcttaccgaatgaaaaagaaaattcacagagctgaggtgactgaggagttcaaggacccttccgatagggttatgaaactgataacctcagacgtcctggaggagatgctgaatgtgcacgatcattaccagaacatgaaacatgtaatctcagtagacaagagtaagcccgataaagcactttctcttatcaaagacgatttctttgacaatataaaaaacatagttctggagcatcaacagtggcacaaagacaggaaaaacccatcccttaagtcaaagacaaacgatggcgaggagaaaatggaagggaatagtcaggagactgagcggtgcgagcgggcagagtccctcgcaaagataaaaagcaaagccttctccgttgtgattcaagcctccaaaagtaggcggcatcgacaagtgaagctggacagctccgactctgactccgcgagcggacagggtcaggtgaaggcaacccgcaagaaagaaaaaaaagagagactgaagcctgccggacgaaaaatgtccctgcggaataaagggaatgtgcagaatatccacaaagaagacaaaccgctctctttatctatgccagtgattaccgaggaagaagagaacgaaagtctctcgggaacagagtttactgcctccaagaaacgacgaaagcattag

SEQ ID NO: 23090 - DNA, 921 bp, Artificial Sequence
  Description of Artificial Sequence: Synthetic coding sequence
atggccagtaacgtgactaacaaaactgaccctaggtccatgaacagccgggtgtttatcggcaaccttaatacactggtcgtcaagaaatccgacgttgaagccatcttcagcaaatatggcaaaatcgtgggctgttccgttcacaaggggtttgccttcgtgcaatacgtaaatgagagaaatgccagggctgcggtagcaggggaggacggccgtatgattgccggacaggtgctggacattaatcttgccgcagagcctaaagttaacaggggcaaagccggagtgaaacgaagcgcggctgaaatgtatgggagtgtgacggagcacccatctccctcacccctgttaagctcatccttcgacctggattatgatttccaacgggactactacgacagaatgtactcttaccctgcacgtgtgccacccccaccaccaattgccagggctgtagtgccaagcaagaggcagcgcgtgtccggaaacaccagtcgacggggaaagtcagggttcaactctaagagtgggcaaaggggctcttcaaagagtgggaagctcaagggtgacgaccttcaggccatcaagaaagaactgacccagatcaaacaaaaagtggactctctgctggagaatctggagaaaatagagaaggaacaaagcaagcaggccgtggagatgaaaaacgacaagagtgaggaggagcagagttcatccagtgtgaaaaaggacgaaacaaacgtgaagatggaatccgagggtggagcagacgattccgcagaagaaggggacctgttggatgacgacgacaatgaggacagaggagacgaccagcttgagctcataaaggatgatgaaaaagaggcagaagaaggagaagatgaccgggactcagctaacggggaggatgattcttag

SEQ ID NO: 23091 - DNA, 309 bp, Artificial Sequence
  Description of Artificial Sequence: Synthetic coding sequence
atggcttctaatgtcactaacaaaactgaccctaggtcaatgaactcaagggtcttcatcggcaatctgaataccctggtggtgaaaaagtcagatgtggaggcaatttttagcaagaaagacgagaccaatgtgaaaatggaatctgaaggtggcgctgacgactccgccgaggagggcgacctcctggacgatgatgataacgaggatagaggtgacgatcagcttgaactcataaaggatgacgagaaagaagctgaggaaggcgaagacgaccgggactccgccaacggcgaagatgatagttag

SEQ ID NO: 23092 - DNA, 921 bp, Artificial Sequence
  Description of Artificial Sequence: Synthetic coding sequence
atggcttctaacgtgacaaacaagacagatccacgaagcatgaatagcagagtattcatagggaaccttaataccctcgtagttaaaaaaagtgacgtagaggctattttcagcaagtatggtaaaatcgtgggatgttcggttcacaaaggtttcgcttttgtccagtatgtcaacgaacgcaatgcaagagctgcagtcgcgggtgaggatgggaggatgattgccggtcaggtgctggacattaacttagcagccgaaccaaaagtcaacagaggaaaggctggcgtcaagaggagtgcagccgagatgtacggtagcgttactgaacacccttctcccagcccactcttatcaagctcgttcgacctagattacgatttccagagggactattatgaccgcatgtattcctaccccgcaagagttccacctcctcccccaatcgctcgggctgtagtgcctagcaagcgccaacgggttagtggcaacacgtcacggagggggaagtccggatttaactccaaatctggacagcgaggttcctccaaatcaggtaagctgaaaggagacgacctgcaggctatcaaaaaagagctcacacagatcaagcagaaagtcgactcccttctggaaaacctggaaaaaatcgagaaagaacaatctaagcaagccgtcgaaatgaaaaatgacaagtccgaagaggagcagtcttctagctctgtgaagaaagacgaaaccaacgttaaaatggaatctgaggggggagctgacgacagcgccgaagaaggcgacttgcttgacgatgatgataatgaagacagaggggacgaccagctggagctgatcaaggatgacgagaaagaggccgaggagggtgaggacgatagagacagcgcaaatggagaagatgacagttag

SEQ ID NO: 23093 - DNA, 882 bp, Artificial Sequence
  Description of Artificial Sequence: Synthetic coding sequence
atggccagtaatgtcaccaataagactgatccacgctcaatgaattctcgagtgttcataggaaatttaaatacactggtggtgaaaaaatccgatgtcgaggccatcttcagtaagtatggtaaaattgtcggctgttcagtgcacaagggttttgcgttcgtgcagtacgtgaacgagcgcaatgctagagctgccgtcgcaggtgaagatggacgcatgatagcaggacaagttttggacattaatctggccgctgagcctaaggtcaacaggggaaaggccggagtgaaaaggagcgccgctgagatgtacggttcttcatttgatctggattacgacttccaaagggactactacgaccggatgtacagctatccagccagagtgcctccccctcctcctatagctagagcagtcgtgccaagcaaaaggcaacgagtgtctggcaacacttcacgcaggggaaagtctggattcaactctaagtcagggcagagaggtagctccaagagcgggaaattgaagggcgacgacttgcaggcaattaagaaggagctgactcagatcaaacagaaagttgactcactcctggagaacttggagaagatcgaaaaggagcagtcaaaacaggcggtggagatgaagaatgacaagagtgaggaggagcagtctagcagctccgtgaaaaaggatgagacgaatgtgaaaatggagtcagaagggggagctgatgactcagccgaagaaggggacctcctggatgatgacgacaacgaagaccgaggagatgaccaactggagctgattaaggacgacgaaaaggaagccgaagagggcgaggacgaccgcgattccgctaatggtgaggatgattcatag

SEQ ID NO: 23094 - DNA, 912 bp, Artificial Sequence
  Description of Artificial Sequence: Synthetic coding sequence
atggcctctaacgtcactaataagaccgatccccgaagtatgaattctagagtgtttatcggcaacctgaatacgctggtggtgaagaagagcgacgtggaggccatcttctccaagtacggaaaaatcgtaggatgctccgtccacaaaggattcgccttcgtccagtacgtgaatgaacgcaatgccagagcagctgttgcaggtgaggatggtagaatgatcgctggacaagtactagacatcaacctggccgctgagcccaaagtgaacaggggcaaagccggagtgaagcgtagcgcagctgaaatgtacggatctgtgacagaacacccatcaccatcccctctgctcagttccagtttcgacctggattatgactttcaacgggattattacgatcgcatgtattcatatccagctagagtacctccccctccccctatagcaagagcagtggttccctccaaaaggcagagggtttccggtaatacttcgagaagaggcaaaagcggctttaatagtaaatccggccagagaggctcttcaaaatcgggcaagctgaaaggtgacgatctacaggcaataaagaaggaactcactcagattaaacaaaaggtagactccctgctggagaacctggaaaagatcgaaaaggaacaatctaagcaggcagtggagatgaaaaatgacaagagcgaagaggaacagtcttccagtagcgtcaaaaaagatgagaccaatgttaagatggaaagcgaaggaggggctgatgattcggctgaagaaggagatctgctggacgacgatgataacgaggatcgaggcgacgatcagctcgaactgataaaagatgacgaaaaagaggctgaagagggcgaagatgaccgagactccgccaacggtggctag

SEQ ID NO: 23095 - DNA, 882 bp, Artificial Sequence
  Description of Artificial Sequence: Synthetic coding sequence
atggcctcgaatgtcactaacaaaactgacccaagatcgatgaatagcagagtgttcattggaaacctgaatacgctagtggttaaaaagagcgatgttgaggccattttttctaaatatggaaagattgtgggctgtagtgtgcacaagggcttcgcctttgtgcagtatgtcaacgagcgcaatgcccgagcagccgtcgcaggagaagacgggagaatgattgcaggccaggtgctggacatcaatctcgccgctgagcccaaagtgaacagaggcaaagccggtgttaagaggtccgccgctgagatgtacggctcttccttcgacctggattacgattttcaacgggattattacgataggatgtactcttatcctgctagagtccctccccctccaccaatcgccagagcagttgtgcccagtaaacgacaacgagtgagcggaaacacctctcgcagggggaagagtgggtttaatagtaaaagcggacagcgaggctcgtctaaaagtggcaagctaaagggcgatgacctgcaggcaattaagaaggaacttacgcagatcaaacagaaggtcgatagcctgctggagaatctggagaaaattgaaaaagaacagtctaagcaggccgtcgagatgaagaatgataagtccgaagaggagcagagctcgtcgagcgtcaaaaaggatgaaacaaatgtcaaaatggagtctgaaggcggagccgatgattccgctgaggagggcgacttgttggatgacgatgacaatgaggaccgaggtgacgaccagctggagctgatcaaggacgacgagaaagaggctgaggaaggggaggacgacagagatagcgccaatggggaggatgattcttag

SEQ ID NO: 23096 - DNA, 444 bp, Artificial Sequence
  Description of Artificial Sequence: Synthetic coding sequence
atggcatctaacgtgaccaacaaaacggaccctagaagtatgaactccagagtgttcatcggcaatcttaatacactggtcgtgaaaaaatcagatgtcgaggcaattttctctaaatatggcaaaatagtcggctgctccgtgcataagggcttcgctttcgtacagtacgtgaacgagagaaatgctagagctgccgtagcgggtgaggatggacgcatgatcgcaggacaggtgctggatatcaatcttgcagccgaacctaaggtcaatcgcggaaaggcaggggtaaaaagaagcgccgctgagatgtacggatctgtgaccgagcatccttccccctctcccctgctgagcgtctaccaagagactcttcacgagggggctaaggtagcgtcaattctgagggtggactctggggatttgccaagcctggagtcctag

SEQ ID NO: 23097 - DNA, 882 bp, Artificial Sequence
  Description of Artificial Sequence: Synthetic coding sequence
atggcctccaatgtgacaaataagacggacccccgtagcatgaacagcagagttttcataggaaatttgaatactttggtcgtgaaaaagtctgacgtggaggccatcttcagcaaatacggcaaaattgtggggtgttcagttcataagggatttgcattcgttcagtatgtgaatgaaaggaatgcaagggctgccgtggctggggaggacggacgtatgatagccggacaggtactcgacatcaatctggccgcagagccaaaggtcaacaggggcaaagccggtgtcaaaagatctgccgcagaaatgtacgggagctccttcgaccttgactacgatttccagcgagactattacgataggatgtacagctatcctgcaagggtaccaccaccaccgccaattgccagggccgttgtcccaagcaaacgccagcgcgtatccgggaacactagcagacgcggaaaatctgggttcaacagcaagagcggccaaagaggatctagtaaatcgggcaagctcaagggcgatgatctccaggcaatcaagaaggaactgacgcaaatcaagcagaaggtcgatagcttgctggaaaatttggaaaagattgagaaagagcagtcaaaacaggctgtggagatgaaaaatgataagtcagaagaggaacagtccagcagctccgttaaaaaggatgaaacgaacgtgaagatggagagcgaaggcggtgctgacgatagcgctgaggaaggcgacctgctggatgacgatgacaatgaggatagaggcgacgaccaacttgaactcatcaaagacgatgaaaaagaggcggaagaaggtgaagacgaccgcgattctgctaacggggaagacgactcatag

SEQ ID NO: 23098 - DNA, 789 bp, Artificial Sequence
  Description of Artificial Sequence: Synthetic coding sequence
atggcctctaacgtgaccaataaaacagaccctaggtctatgaattcacgggtttttattggcaatctgaacaccctcgttgtaaagaagtcagatgttgaggccattttcagtaagtacggcaagatcgtgggatgctccgtccataaggggttcgctttcgttcaatatgtaaatgagcgaaatgcccgagccgctgtggcaggtgaagatggcagaatgatcgcagggcaagtccttgacattaacctcgcagctgaaccaaaggtcaaccgtggaaaagctggcgtgaagagaagcgccgctgagatgtacggcagctcctttgatcttgattatgattttcagagggattattacgatcggatgtactcatatcccgcacgcgtaccccctccccctcccattgctagagctgtcgttccttctaagcgccagcgcgtgtccggcaataccagcagaagaggcaagtcgggttttaatagcaagagtggacaacggggaagctctaaaagcggtaaactaaaaggcgacgacctccaagctatcaagaaggaacttacacaaatcaaacagaaagtcgacagtctgctggagaatcttgagaaaattgaaaaagaacaatcaaagcaagccgttgagatgaagaatgataagtccgaggaggaacaatcaagctcctccgttaagaaagacgagacgaatgtgaagatggagtccgaaggcggtgcagacgattccgcggaggagggcgacctcctggacgatgatgataacgaagaccggtag

SEQ ID NO: 23099 - DNA, 921 bp, Artificial Sequence
  Description of Artificial Sequence: Synthetic coding sequence
atggcttcaaacgtgaccaataagacggaccctcgctcaatgaacagtagggtgttcatcggaaacctgaatacgctggtagttaagaagagcgatgttgaagccattttcagcaagtacgggaaaatcgtgggctgcagcgtgcacaagggctttgcattcgttcagtacgttaatgagcgtaacgccagagctgccgtcgccggagaggacggcagaatgatagctggtcaagttttggatataaacttggcagccgagccaaaggtcaaccggggtaaagccggagtcaagcgtagcgctgcagagatgtatggcagcgttaccgagcatccctctccctctccattactttccagttccttcgacctggattacgattttcaacgagactactatgacagaatgtatagctacccggctcgcgtgccccctccaccgccaattgcacgcgctgttgttccttcaaagcgccagagggtctcggggaatacaagtcgccgaggaaagtctggcttcaacagcaaatctggtcagcgtggctcctccaaaagtggcaagttgaagggcgacgatctgcaggcgattaaaaaggaattaacccaaataaaacaaaaggttgactcgctcctggagaacttagaaaaaattgaaaaggaacagtccaaacaagctgtggagatgaaaaatgacaaatccgaggaagagcagtcaagctcgtctgtcaagaaagacgagaccaacgtgaaaatggagagtgaggggggagccgacgattctgctgaggagggcgacctgctggatgacgacgataacgaggatcggggtgacgatcagctagagctaatcaaagacgatgagaaagaagccgaggagggcgaggatgatcgggactcggccaatggagaagacgattcttag

SEQ ID NO: 23100 - DNA, 381 bp, Artificial Sequence
  Description of Artificial Sequence: Synthetic coding sequence
atggccagcaatgtgacaaataagaccgaccctcgatccatgaacagccgcgtgtttataggtaatctaaacactctggtggtgaagaagtcagacgtggaggccattttctctaaatacggtaagattgtgggttgcagcgttcataagggatttgctttcgttcagtacgtaaatgagcggaatgctagagccgcagtcgctggcgaggacggtaggatgatcgccggacaggtgctcgacatcaacttagcggctgaacctaaggtgaaccgcggtaaagcgggagtcaaaagatctgccgctgagatgtacgggtccagttttgacctggactacgatttccaaagagattattacgataggatgtattcgtactag

SEQ ID NO: 23101 - DNA, 882 bp, Artificial Sequence
  Description of Artificial Sequence: Synthetic coding sequence
atggcttccaacgtgaccaataagactgatcctaggtctatgaacagtcgcgtctttattgggaacctaaacacgttagtggtcaaaaagtccgatgtggaggctatctttagcaaatacggaaagattgtcggatgctccgtccacaaaggtttcgctttcgtccagtatgtgaacgagcgtaatgctagagctgctgtggcgggagaagatgggcgaatgatcgccggacaggtgctggatataaatctggcagctgagcccaaagtaaatagaggcaaagcaggagtcaaacgctctgcggctgagatgtacggcagcagctttgatctggactacgatttccagcgtgactattatgatcgcatgtactcatatccagccagagtgcctcctcctccccctatagcaagggctgtggtgcctagtaagcggcaacgggtctctggcaacacttctcggagaggcaaatcagggtttaatagtaagtctggtcagagaggctcgtccaagtctggcaaacttaaaggggacgatctacaggcaatcaaaaaggagctcacacagattaagcaaaaggtagactctctactcgagaatctggagaagatcgagaaggagcagagtaaacaggcagtggaaatgaaaaatgataaatcagaagaagagcagagtagtagctctgtcaagaaagatgaaactaacgtcaagatggagtctgaagggggagcagacgactcagccgaggagggggacctgttagacgacgacgacaatgaagatcggggtgacgatcagcttgaactgattaaagatgatgaaaaagaggcagaggagggagaagacgacagggactcagccaatggagaggacgacagctag

SEQ ID NO: 23102 - DNA, 528 bp, Artificial Sequence
  Description of Artificial Sequence: Synthetic coding sequence
atggccagtaacgtcacaaacaagacagaccccagaagcatgaactcacgcgtgtttatcggaaatctgaatacgttggtcgttaaaaaatctgacgtcgaggctatcttttccaaatacgggaagattgtgggatgctctgtgcataagggattcgcgttcgttcagtatgtgaatgagcgaaacgcacgtgcagcagtcgctggtgaagatggcaggatgatcgcaggacaggtcctggacatcaatcttgctgcagaacctaaggtgaataggggaaaagctggcgtcaaaaggtccgcagctgagatgtacgggtctgtgacagagcacccttccccttcaccactgctttccagttctttcgacctggattatgatttccagagagactattatgacagaatgtactcctaccctgccagggtgccaccaccccctccgatcgctcgggcagtggtcccttcaaaacgacagagagtctcaggaaacactagtcgcaggggcaaatcagggtttaacagttag

SEQ ID NO: 23103 - DNA, 354 bp, Artificial Sequence
  Description of Artificial Sequence: Synthetic coding sequence
atggctagcaacgtaacgaacaagacagaccccaggtcaatgaattcgcgagtctttataggaaacttgaacacgcttgtagtaaagaagtccgatgtggaggccattttctctaagtatggcaagatcgtcggctgttctgtgcataagggttttgccttcgtgcagtacgttaacgagagaaacgccagggccgctgtcgccggtgaggatggacgtatgatcgcaggccaggttttagacatcaatctcgccgcagagcctaaggtgaaccggggaaaagctggcgtcaagagaagcgccgcagagatgtacggctcaagtttcgacctggactatgattttcagaggtag

SEQ ID NO: 23104 - DNA, 564 bp, Artificial Sequence
  Description of Artificial Sequence: Synthetic coding sequence
atggcatccaacgtgacaaataagacggacccgagaagcatgaattctagagtgtttattggcaatctaaatactctggttgtaaaaaagagcgatgttgaagcgattttcagcaagtacggtaagattgtgggctgctctgtgcataaaggattcgcgttcgtgcagtacgtgaacgaaagaaatgccagagccgcagtggcaggcgaggacggtagaatgatcgccggacaggtcttggacatcaacctggctgctgaaccaaaagttaaccggggaaaggcaggagttaaacggagcgccgctgaaatgtatggatccgtaactgagcacccttctccttctcctctcctcagctctagcttcgacctggactacgactttcagcgggattactacgacagaatgtatagttatccagcacgtgttccccctccgccaccaatcgctcgagctgtagttccctcaaaaaggcagagggtcagtgggaatacgtccagaaggggtaagtctggattcaacagtaagtcgggtcagcggggaagtagtaagagcgggaaatag

SEQ ID NO: 23105 - DNA, 753 bp, Artificial Sequence
  Description of Artificial Sequence: Synthetic coding sequence
atggcctcgaacgtgacaaacaagactgaccctaggtctatgaattccagggtttttatcggtaacctaaacaccttggttgtgaagaagtccgatgtggaggccattttctccaagtatgggaaaatcgttggatgttcggttcataagggatttgcctttgtccaatatgtgaacgagcgcaacgccagagcagccgtcgctggtgaggatggacgcatgatcgccggtcaggttctggatatcaatctggccgcagagcctaaggtgaaccgcggaaaggcgggtgttaagcggtccgcagccgaaatgtatggctcaagctttgatctggattacgatttccaaagggactactacgacagaatgtattcctatccagccagggtgccacctccgccacccattgccagggcaattaagaaagaactaacgcaaattaaacagaaggtcgattcattgctggagaacttggagaagatcgagaaggaacagagcaaacaggccgtcgagatgaaaaatgacaagagtgaggaagagcagtcttcaagtagcgtcaagaaggacgaaactaacgttaaaatggagtctgagggtggagcggacgactccgccgaagagggtgatctgctggacgacgatgacaatgaagatagaggggacgaccagcttgagttaattaaggatgacgagaaggaggctgaagaaggcgaggatgatcgcgacagtgccaacggagaggacgattcctag

SEQ ID NO: 23106 - DNA, 366 bp, Artificial Sequence
  Description of Artificial Sequence: Synthetic coding sequence
atggcaagcaacgtgacaaataaaacagaccctcgctccatgaactctcgagtgtttatcggcaatctgaacaccctcgttgtgaaaaagtctgacgtagaagcgatttttagtaagtacggcaagatcgtcgggtgcagcgtacacaaaggtttcgcgttcgtgcagtacgtgaacgagaggaatgccagagctgcagttgcgggagaagatgggagaatgatcgcaggtcaggtcttagatatcaatctggctgccgaacctaaggtgaaccgcggaaaagctggagtcaaaaggagcgcagccgagatgtacggaagcagcttcgatctggactacgacttccagcgagattattacgactag

SEQ ID NO: 23107 - DNA, 681 bp, Artificial Sequence
  Description of Artificial Sequence: Synthetic coding sequence
atggccagtaatgtaaccaacaagactgaccctaggagtatgaacagccgtgtctttattggcaacttgaacacactcgttgtaaagaagagtgatgtcgaagcaattttcagcaatagcagctttgatttggattacgactttcaacgcgattactacgatcgaatgtactcctatccggctcgggtgcccccacccccaccgattgcccgtgccgtggtgccatcaaagaggcagcgggtgagtggcaatacgagccgccgtggaaagtccggcttcaattcaaagagcggtcagaggggaagctctaagtctggcaaactcaagggggacgaccttcaggccattaaaaaagagctcacgcagataaaacagaaagtggatagcctgctggaaaacctggagaagattgagaaggaacaaagcaaacaggctgtggaaatgaagaacgacaagtcagaggaggagcaatccagctcctccgtgaaaaaagacgagaccaatgtgaagatggagtcagagggaggcgctgacgactccgctgaagaaggagaccttctagacgatgacgacaatgaggaccgaggcgacgatcagcttgaactgatcaaggatgacgagaaggaggctgaagagggcgaagatgaccgggatagtgccaatggtgaggatgacagctag

SEQ ID NO: 23108 - DNA, 882 bp, Artificial Sequence
  Description of Artificial Sequence: Synthetic coding sequence
atggcttctaacgtgaccaataagacagaccctaggtcaatgaacagccgagtttttataggcaatctgaacacactggtggtaaagaaatccgacgttgaagctatctttagcaagtatggtaagatcgttggctgcagtgtccacaaaggttttgccttcgtccagtacgtgaatgaacggaacgccagggcagccgtggccggagaggatggtagaatgatcgccggacaagtgctggacatcaatctggctgccgagcctaaggtcaataggggaaaggcaggagtgaaaagaagcgcggcagagatgtatggcagctctttcgatctggactatgactttcaacgggattactacgaccgcatgtactcatatccagccagggtgcccccaccacctcccattgccagagctgtggttcctagcaaacggcagagagttagtgggaatacatccagaaggggaaagagcggctttaatagcaaatcaggtcagcgtggtagcagtaagagcggaaagctgaagggcgacgacttgcaggcaatcaagaaggagctgactcagatcaagcaaaaagttgacagcctgttagaaaacctggaaaaaatcgagaaggaacagagcaaacaggctgtcgagatgaaaaatgataagagcgaggaagagcagtctagctcttcagtgaagaaggatgagacaaacgttaaaatggagtcggaaggcggtgctgatgacagtgctgaggaaggtgatctgctggacgatgacgacaatgaggataggggagacgatcaactggaattgattaaagacgacgaaaaggaggctgaagagggggaggatgatcgggacagcgcaaatggggaggacgattcatag

SEQ ID NO: 23109 - DNA, 921 bp, Artificial Sequence
  Description of Artificial Sequence: Synthetic coding sequence
atggcttcaaacgtgaccaataaaacggatccacgatccatgaatagccgggtgttcattgggaatctgaatacactagtggtgaaaaagtcggatgtggaagctatttttagcaagtatggcaaaatcgttggttgcagcgtccacaagggcttcgcattcgttcagtacgtgaatgaacggaatgcacgggctgctgtggcgggagaagatgggaggatgatagccggacaagtcctcgacattaacctggctgcagagcccaaagttaatcgcggaaaggctggcgtaaagaggtcggccgcagagatgtacggcagtgtgactgagcacccaagtcccagccccctcctctcctcatctttcgacctggactatgatttccagcgtgactattacgacagaatgtattcttacccagcccgtgtgcccccacccccaccgatcgctcgcgctgttgtgcctagcaaacggcaacgagtgtccggaaacacatccaggcggggaaaatctggctttaattcaaagagtggccaaagaggatctagtaaatcaggtaaacttaaaggcgacgatctacaggcaattaagaaagagctcactcagataaaacaaaaagttgattcactgctcgaaaacttggagaagatcgaaaaggagcaatcaaagcaagcggtggagatgaagaacgataagagtgaagaagagcagtccagtagttcagtcaaaaaagacgagactaatgtgaagatggagagtgaaggtggcgctgatgacagcgctgaagaaggagatctcctggacgacgacgataacgaggaccggggagatgaccaattggaactgatcaaagacgatgagaaggaggccgaggaaggagaggatgaccgagattctgcaaacggagaagatgactcttag

SEQ ID NO: 23110 - DNA, 201 bp, Artificial Sequence
  Description of Artificial Sequence: Synthetic coding sequence
atggccagtaacgtgacaaataagaccgacccaagaagtatgaattcgcgggtcttcatcggaaatctgaacacactggtcgtgaagaagtcagatgttgaagcaatcttcagtaaatacggcaaaattgttggatgctcggtgcataagggctttgcatttgtgcagtacgtcaatgagcgtaacgctcgagccgcttag

SEQ ID NO: 23111 - DNA, 444 bp, Artificial Sequence
  Description of Artificial Sequence: Synthetic coding sequence
atggctagtaatgtcacgaacaagaccgaccctagaagcatgaattctcgggtctttattggcaacttgaataccctcgtggtgaaaaagtcggatgtcgaggcaatcttcagtaaatatggcaagatcgtgggttgttccgtgcacaaggggttcgccttcgtgcagtatgtcaacgagcgcaatgctcgcgctgctgtggccggagaggatggaagaatgatagccggacaggttttggacatcaatctggccgctgagccaaaggtcaatcgcggaaaggccggagtgaagcgcagtgctgcagagatgtacgggtctgtgacggaacaccccagcccatcccctctcttatcagtgtaccaggagaccctccatgagggcgctaaggtcgcatcaatacttcgggttgactccggcgacctgcccagcctggaaagttag

SEQ ID NO: 23112 - DNA, 165 bp, Artificial Sequence
  Description of Artificial Sequence: Synthetic coding sequence
atggcatctaacgtgacaaacaaaaccgatcccaggagcatgaatagccgcgtgtttattggaaacctcaacacattggtggtgaaaaagagcgacgtggaggccattttctccaaatatggtaagattgttgggtgcagtgttcataaaggctttgctttttag

SEQ ID NO: 23113 - DNA, 882 bp, Artificial Sequence
  Description of Artificial Sequence: Synthetic coding sequence
atggcctcaaacgtgaccaacaagatggaccctcattctatgaatagtcgggtttttatcggtaacctgaacacgctggtcgttaaaaagagtgacgtggaagctatatttagcaagtacgggaaaatagcagggtgcagcgtgcacaagggcttcgcctttgtgcagtatgacaaagaaaagaacgcccgagccgctgtcgccggtgaggacggcaggatgattgcaagccaggtagtggacattaatctagctgcagagcccaaagtcaaccggggtaatgccggtgtgaagcggtcagccgctgagatgtatgggtcaagctttgacctggattacggttttcagagagactactatgacgggatgtatagtttccccgctagagtgcctcctccacctcccattgcacttgccgtcgtcccaagcaagcggcaaaggctttctggaaatactagcagaaggggcaaatctgggtttaatagcaagagcggaaagagaggcagttctaaaagcggcaagctcaagggcgatgacttacaggccataaagcaggagcttacccagatcaaacagaaggtggacagtctgcttgaaaatttagagaaaatcgagaaagaacaaagcaagcaggaggtggaagtaaagaatgccaaaagcgaagaagagcagagctcttctagcatgaaaaaggatgaaacacacgtgaagatggaatccgaaggcggagccgaagattccgcggaggaaggtgaccctttagacgatgacgtgaatgaggatcagggcgatgaccagctggaattgatcaaagacgatgagaaggaagcagaggaaggggaggacgacagagacagcaccaacggccaggatgattcctag

SEQ ID NO: 23114 - DNA, 1041 bp, Artificial Sequence
  Description of Artificial Sequence: Synthetic coding sequence
atggattgggttatgaagcataacgggcctaacgacgcttcagatggaacagtccgactgcgtgggctgccctttggatgctcaaaagaggaaatagtgcagttcttccagggattggagatcgtcccgaacggtatcactctgaccatggattatcaggggcgaagtacaggagaggccttcgtacaatttgccagcaaggaaattgcagaaaatgcactaggcaaacacaaggagaggattgggcatagatacatagaaattttcaggtcatcccgatccgagattaaaggtttctacgacccccctcggagacttcttgggcaacggccaggcccatatgacaggcccataggaggaagaggagggtactacggggctggcaggggaagcatgtacgatcggatgcgtcgaggtggtgacggctatgacggcggatatggtgggtttgacgattatgggggatataacaattatggctacggaaatgacggctttgacgaccgcatgcgggacgggcgaggtatgggaggtcacgggtatggcggagctggcgacgcctcctctggcttccacgggggacacttcgtgcacatgcgagggcttcccttcagggctactgagaatgacatcgccaacttttttagccctctcaaccctatccgtgtgcacatcgacatcggggcagacggccgtgccaccggcgaagcagatgtcgagtttgtgactcacgaagacgccgtcgccgcaatgtcaaaagacaaaaataatatgcagcacaggtatatcgagctatttctgaattctacccccggagggggtagtggcatgggagggtccggtatggggggatatggaagggacggcatggataatcagggaggatatgggtcagtcgggaggatgggcatggggaacaattacagcggaggatatggaactccagatggcttaggtggatatggcagagggggagggggaagtggcggatactatggccagggtggaatgagcggagggggatggcgaggaatgtactag

SEQ ID NO: 23115 - DNA, 996 bp, Artificial Sequence
  Description of Artificial Sequence: Synthetic coding sequence
atggactgggttatgaaacacaacggccctaatgacgccagtgatggcactgttagactccgtgggctgcctttcgggtgttccaaggaagagatcgttcagttttttcaaggactggaaatagtccccaacggaatcactctcacaatggattaccagggcaggtcgaccggcgaggcctttgtacagttcgcttccaaagagatcgccgaaaatgcccttgggaagcataaggaacgaatcggccatcgctatatagagatattccgttccagtagaagcgagatcaaaggcttttatgatccccctcgccgattactcggtcaaagacctggcccttatgatcgacccattggtgggagggggggatattatggcgctgggaggggaagctacggcggattcgatgattatggagggtataacaactatggctatgggaatgacggctttgacgataggatgagagacgggagagggatgggaggccacgggtatggcggtgcgggtgacgcatcttcgggcttccatggaggtcacttcgtccatatgaggggtcttcctttccgggcaaccgagaatgatattgcaaatttttttagccctctgaatcctatccgggttcatatagacatcggcgctgacggcagggccacaggcgaggcagacgttgagttcgtgacccatgaagatgccgtggccgctatgtctaaagataaaaacaacatgcagcaccgatatatagaactgttcctgaactccaccccaggcggaggaagcggcatgggaggaagcggcatggggggatacgggagagacgggatggataaccagggtggatatggctctgttggcaggatggggatgggaaacaattacagtggaggctatggtactcccgatggtttaggcggatacggtcgcggtggtggaggatcgggagggtattacggtcaagggggtatgagcggcggtggctggcgaggaatgtattag

SEQ ID NO: 23116 - DNA, 717 bp, Artificial Sequence
  Description of Artificial Sequence: Synthetic coding sequence
atggactgggttatgaagcataatggacccaacgacgccagcgatggcactgtgaggctcagagggttgccatttggctgcagcaaagaagagattgtgcagttctttcagggctatgggggtttcgacgactatggcggttataacaactacggctatggtaacgacgggttcgacgatagaatgcgggacggaaggggtatggggggacatggatacggtggggctggagatgccagctcaggctttcacggaggtcattttgtccacatgcggggtttgcctttccgcgctacagaaaatgatattgctaacttcttttccccgctcaatcccatcagggtgcatatcgacataggcgctgacgggcgagctactggagaagcggacgtggagttcgtgacccacgaagatgcagtggcggctatgagcaaggacaaaaataatatgcagcataggtacatcgagctcttcctcaatagtacccctgggggtgggagcggcatggggggatctggaatgggtggctatgggagagacggcatggacaatcaggggggatacggttctgtcggcaggatgggtatgggcaacaattatagcggaggttacggaacgccagacggcctaggcggatacggtaggggcggaggtggctccggagggtactacggccaaggcggaatgtctggcggaggttggcgcggaatgtattag

SEQ ID NO: 23117 - DNA, 1392 bp, Artificial Sequence
  Description of Artificial Sequence: Synthetic coding sequence
atggagacggaacagcctgaagaaacatttcccaacacagagacaaacggcgagtttggaaaaagacctgctgaggatatggaggaggaacaggccttcaaaaggagccgcaatactgacgaaatggtcgagctgcggattctcctgcagagcaaaaacgcgggtgctgtgatcggaaaaggcggaaagaatatcaaggccctcaggacagattacaatgcctcagtgagcgtgccagatagtagcgggcctgagaggattctgagtatcagtgcagatatcgaaaccatcggtgaaattctgaagaaaatcattccaactctggaggaaggactgcagctgccttccccaacggccaccagtcaactcccgttggaaagcgacgcagtagaatgcctgaactaccagcattacaagggaagtgactttgactgtgagctgcgcctgctcatccatcagtccctcgcgggaggaattatcggcgtcaaaggtgctaaaattaaagagcttagagaaaacacgcaaacgactatcaagctctttcaagagtgttgtccacacagtaccgaccgggtggttctgattggagggaagcctgatcgcgtggtcgaatgcatcaagattatcctggatctcataagcgagagccctattaagggcagagcccagccatatgatccaaatttctatgacgagacgtacgactatggagggtttaccatgatgttcgatgaccgcaggggcaggcctgtcggttttcccatgagaggcaggggcggatttgaccggatgccccctgggagagggggtcgtcccatgccaccatccaggcgcgactacgacgacatgtcacccagacggggtcccccaccccctccccctggccgtggcggacgcggtggaagtagggctagaaatctcccgctgcctcctcctcccccaccacgtggcggtgatctgatggcctacgatcggagggggaggccaggcgaccgttatgatggaatggtcggatttagcgccgatgagacgtgggacagtgcaattgacacctggagcccaagcgaatggcagatggcctacgaacctcagggcggatccggctatgactactcctatgctgggggtcgcggatcatatggggacctggggggacccattatcactacgcaagttacaatacctaaagatttggcaggcagtatcattggaaaggggggacagcgcatcaaacagattcgacatgagtccggtgcttctattaagatcgacgagccgctcgagggttccgaggaccgcattattacgattactggaacacaagatcagatccaaaatgcccagtacctgctgcagaactcagtgaagcagtattccgggaagttcttttag

SEQ ID NO: 23118 - DNA, 1392 bp, Artificial Sequence
  Description of Artificial Sequence: Synthetic coding sequence
atggaaaccgaacagcctgaagagactttcccaaacactgagaccaatggcgagtttggtaagcgtccagcagaggacatggaagaggaacaggcctttaaacgatcccgcaacaccgacgagatggtagaattgcgcattctgctccaatccaaaaatgctggggcagtgataggaaaaggtggcaaaaacatcaaagccctcaggacagattataatgcgtcagtatccgtgccggattcatccggcccagaaagaatccttagtatcagcgccgacatcgaaaccatcggggagatcctaaagaaaataatcccgacattggaggaaggtctccagttgccaagccccaccgctacaagtcagctccctcttgagtccgatgcagtggagtgcctgaactatcaacattacaaaggatcagatttcgactgcgaactgcgtctgctgattcaccagtccctggccggtgggattatcggcgtcaagggagccaagatcaaggaactgagagaaaacacacagacaaccattaagcttttccaggagtgttgcccacactcaactgatcgagtggttctgatcggcggaaaacccgaccgggtcgttgagtgcataaaaattattttggacctgattagcgagtctccaataaaaggaagggctcagccatacgatcccaacttctatgatgagacctacgattacggaggctttacaatgatgtttgacgataggcgcggacgcccagtcgggttccccatgcgcggtagaggcggattcgaccggatgcccccaggaaggggtggtaggcccatgccgccaagccgtagagactacgatgacatgagcccaagacgcggtcctcccccacctcctcctggaagaggaggcaggggcggttctcgggctcgaaatttacctttgcctccccctccccctcccagagggggagatctgatggcctatgaccggagaggcaggcctggcgacaggtacgacggaatggtcggtttttcagctgatgaaacttgggatagcgcgatcgatacctggtctccctccgagtggcagatggcctatgaacctcagggagggagcggttatgactactcgtacgctggaggacgcggtagctatggcgacctcggcggaccaattatcaccacgcaggtgacaatccccaaagatctggctggaagcattattggtaagggagggcaaagaatcaaacaaattcgccacgagtccggagcctccatcaaaatagacgaaccattagaggggtccgaggacaggatcattacgatcactgggactcaggatcagattcagaatgcccagtacctgttacaaaattcagtcaaacagtactccgggaagtttttttag

SEQ ID NO: 23119 - DNA, 921 bp, Artificial Sequence
  Description of Artificial Sequence: Synthetic coding sequence
atgcagtataatgcatctgtgtccgtgcctgatagctcagggccagaacggattctctccatcagcgctgatatagagacaatcggagaaatcttgaagaagatcataccaacactggaggagggtctacagctgccgtccccgactgcaaccagtcaacttcctctcgagagtgacgccgttgagtgtctcaattaccagcattacaagggcagcgactttgattgcgaactgcgactgcttattcatcaatcccttgcgggtgggataattggtgtaaagggagcaaaaatcaaggaactgcgcgagaatactcagaccacaatcaaactattccaagaatgttgcccccatagcactgacagagtagtcctaattgggggaaaaccggatagagtggtggagtgtatcaaaatcatactggacctcatcagtgagtcgcccattaaaggcagagcccagccctatgacccgaatttttatgacgaaacgtacgactacggcggtttcacgatgatgttcgatgatagacgtggtcgccctgtaggctttcctatgagaggaagagggggatttgataggatgcctccagggcgtgggggtcgcccaatgccccctagcaggcgcgactatgacgacatgagtccgagacgcggtccacctccgcctcctcccggacgagggggacgaggcggtagcagggccaggaacttgcccctgccacccccacctcctccacgtggtggcgacctgatggcttatgatcgcagaggcaggcccggagaccgttacgatgggatggtaggcttctctgcagatgagacttgggactctgcaatcgatacatggtctccctccgagtggcaaatggcatacgagccacaagtcgagtaccatagctgttcatgtgtataccagtag

SEQ ID NO: 23120 - DNA, 1380 bp, Artificial Sequence
  Description of Artificial Sequence: Synthetic coding sequence
atggagacggaacaacccgaagagacatttcccaataccgagactaacggcgaattcggaaagcgtccagccgaggatatggaagaggagcaagcctttaaacgctccaggaacactgatgagatggtggaactacgcatcctgctccaatcaaagaacgccggtgccgtgattggaaagggcggaaagaatattaaagcactgagaacagattactatctcgtgttcgtcgtatttgattctattctgagcatcagcgccgacatcgaaacaattggtgagattctgaagaagataataccaactctggaggagggcctccagttaccttctcccactgctacctctcagctgcctctggagagtgacgcagtggagtgtctgaattaccaacactataagggaagtgacttcgattgcgagctcaggctactgatacaccaatctctggccggtgggattatcggggtaaaaggcgcaaagataaaggaactgagagaaaacactcagacaactataaaactgtttcaggaatgttgccctcatagtactgaccgggtggtactgatcggcggaaagccagatagagtcgtagagtgcattaagatcattttagacctgatctcagagagccccattaaggggcgagcacaaccctatgatccaaatttttacgacgaaacgtatgattacggagggttcaccatgatgtttgacgacaggagagggagacccgtgggcttccccatgcggggtcggggtggcttcgaccgcatgccgcctggcagggggggtaggccaatgcccccaagcaggcgtgactacgacgacatgtccccaaggcggggtcctcctcctcctccccctgggaggggcggaagggggggatcccgggcacgcaatctaccattaccgcctccacctcctcccaggggaggggacctcatggcctatgacaggagaggacgccctggggataggtacgatggcatggtcgggttctccgctgacgagacatgggattcagctattgacacttggagtccaagcgaatggcagatggcatacgaacctcaaggtggcagcggctacgattatagttatgctggaggcagagggagctacggcgatctaggtgggccaattatcaccactcaggttacgatccctaaagatctagcagggtccattattgggaaaggaggccagcgcataaaacagatccgccatgagtcaggggcatccattaagattgatgaacctctggagggatccgaagatcgcatcattacaataaccggcacacaagatcagattcaaaatgcccagtatctgctgcagaacagtgtgaagcagtatgcagacgtagaagggttttag

SEQ ID NO: 23121 - DNA, 1395 bp, Artificial Sequence
  Description of Artificial Sequence: Synthetic coding sequence
atggagaccgagcagccagaagagactttcccaaatactgaaactaatggggagtttggcaagcgcccagcggaagatatggaggaggaacaggccttcaaacggtctcgcaataccgacgagatggtagaactcagaattctgctccaatcaaagaatgccggagccgtaatagggaagggtgggaagaatataaaggcgcttcggactgactacaatgcctctgtcagcgtccctgactcctcaggacccgaaagaattctctctatcagcgcagacattgagacgattggggaaattcttaagaagatcatacctacactcgaagaggggctgcagctcccttcacctacagctacctctcagctgcccttggagtccgatgctgtagagtgtctgaactatcagcactacaaggggtccgattttgattgtgaacttcgcctgttgattcatcagtctttggctggcggtatcattggcgtcaaaggagcaaagataaaggaattgcgggaaaatacacaaacgaccattaaacttttccaggaatgttgccctcatagtaccgatagggtcgtcctgatcggcggaaagcctgatagagtggtagagtgtattaagatcatcctggatctgatctccgagtcccctattaagggacgcgcacagccgtacgaccctaacttttacgatgagacatacgactatgggggatttactatgatgtttgacgatcgaaggggaaggccagtgggctttcccatgagaggccgaggcggttttgatagaatgcctccgggtaggggaggacggcctatgccaccatcccggagagactatgacgacatgagcccgagaaggggcccaccccctcccccaccaggtagaggcggtagggggggatccagagctcggaacctgccgctcccccctcctcccccaccaagagggggtgacctcatggcctatgatcgacggggtcggccaggcgatcggtatgacggaatggtcgggtttagtgctgacgagacctgggatagtgctatcgacacatggagccctagcgagtggcagatggcatatgaacctcagggaggcagtggatacgattatagctatgcgggagggcgtggctcgtacggagacctgggtggacctatcatcacaacccaagttaccatcccgaaggaccttgcaggttccatcatcggtaaaggaggccagcgaattaaacagattcggcacgagagtggcgcatctataaagatagacgagccactggagggatccgaagatagaattatcaccattaccggaactcaggatcagatccagaatgcccagtacctcctgcagaatagcgtaaaacaatatgccgacgtagagggattctag

SEQ ID NO: 23122 - DNA, 1392 bp, Artificial Sequence
  Description of Artificial Sequence: Synthetic coding sequence
atggagactgagcagcctgaggaaacatttcctaacaccgagaccaatggagaatttgggaagcggccagcagaggacatggaggaggagcaggcttttaaaagaagccgcaataccgacgagatggtcgaactcaggatactgctgcagtctaagaatgctggagccgtgatcggaaaggggggaaagaatattaaagccctgcgcaccgactacaacgcatctgttagtgttccggactcaagtggtcccgagaggatactcagcatatccgctgatattgaaaccataggtgaaattctgaagaagatcattcctaccttggaagagggtctccagctgccatctccaactgccacttcccaattaccactagaaagtgacgctgtggagtgcctgaattaccagcactataaaggttcagattttgattgtgaattgcgacttcttatccatcagtccctggctggcggtatcattggagtgaaaggtgccaaaatcaaggaactgcgggagaacactcagacaaccattaagctgtttcaggagtgttgccctcacagcactgatcgtgtggttctgatagggggaaaaccagaccgggtcgtcgaatgtattaaaataatcctggatctcatcagcgagtccccaataaaggggagggctcagccatacgatcctaatttctatgatgaaacctacgattatgggggttttacaatgatgttcgacgaccggcgtggtcggccagtcggattcccaatgagagggagagggggtttcgaccgcatgcccccagggcgaggcggacgaccgatgcctccctccagacgcgactatgatgacatgagtccgagaagggggccacccccacctcctcctgggaggggcggacgcggtggatctagggcacgaaacctgccactgcctccccctcctccacctagaggaggcgacttaatggcctatgatcggaggggaagacccggagatcgctacgacggcatggttggcttttccgctgacgaaacctgggacagcgcaatcgatacgtggagcccttccgagtggcagatggcctacgaaccccagggtgggtctgggtatgattattcttacgccggaggcagagggagttacggcgatctcggcggaccaattattacaacgcaagtcaccatccccaaagatctggctggatctatcataggcaagggagggcagaggatcaagcagatcagacatgaaagtggcgctagcattaagattgacgaaccgctcgagggctccgaagatcgcattattaccatcacaggcactcaggaccagatccagaatgctcaataccttctgcagaactctgtgaaacagtacagtggtaaattcttttag

SEQ ID NO: 23123 - DNA, 1395 bp, Artificial Sequence
  Description of Artificial Sequence: Synthetic coding sequence
atggagaccgaacagccagaggaaacgtttcccaacaccgaaaccaatggcgagtttggtaagcgccctgccgaagacatggaggaggagcaggcttttaaacgtagccgaaatactgacgaaatggtcgaactcaggatcttactccagagtaagaatgccggagcagtcatcggtaagggtggcaaaaacataaaggctctccggacggattacaacgcgtcagtgtccgtaccagactcttccggccctgaacgaatactgagcatcagcgctgatatagaaaccatcggggaaatcctaaaaaaaatcattccaactctggaggaggggttgcagctgccgtctcctaccgccacaagtcagctgccgttagagagcgacgccgtggagtgtctcaattatcagcactataagggatccgacttcgactgcgagctgcgcttgctcatccatcagagtttagcgggtggaattattggggtgaagggtgcaaaaataaaagaattacgggagaacacgcagaccacgattaagctgttccaggaatgttgcccacacagcacagacagggttgtgttgataggcggaaaaccagatagggtagtggaatgcataaagatcattcttgacttaatctcagagtccccaatcaagggacgagcccagccctacgaccctaacttctacgatgagacttacgactatgggggtttcacaatgatgtttgacgaccgcagaggacgtcctgtcggttttcctatgaggggcagaggaggatttgacaggatgccaccaggtaggggtggtcggccaatgccgccatctcgacgtgattacgatgatatgtctccccgaaggggccctccccctcctcctcccggaagggggggacgaggcggatccagagcccgaaacctgcctctccctcccccacccccacccagggggggagacctcatggcctacgacaggagaggtcggcctggggacagatatgacggtatggttggtttctccgcggatgagacatgggacagcgcaattgacacttggagcccctctgaatggcagatggcatatgagccacagggaggctccggatatgattatagctacgccggaggtaggggatcctatggcgacctgggcggaccaattattactacacaagttactatacccaaggatctggccggatctataatcggcaagggtgggcagagaattaagcagataaggcacgaatcgggcgcttccatcaaaatcgatgagcctctggaaggctctgaagacaggattatcaccatcaccgggacacaggaccagatccaaaatgcacaatatctcctccagaattctgtcaaacagtatgccgatgtcgaaggcttttag

SEQ ID NO: 23124 - DNA, 1395 bp, Artificial Sequence
  Description of Artificial Sequence: Synthetic coding sequence
atggaaacagaacaaccagaggagacatttcccaacaccgagactaatggagaattcggtaagagaccagcagaagacatggaggaggagcaggcctttaagaggtctagaaatacagacgaaatggtcgaacttcgaatcctccttcaatcaaaaaacgccggagcagtgatcggcaaggggggaaagaatatcaaggccctgcggacagactataatgccagcgtctctgtcccagactcgagtgggccagagagaattctgtcaatttctgctgatattgaaacaatcggtgagatcctgaagaagattattcccaccctggaggaagggctgcaacttccatcaccaacagctacctcacagctcccgctggaaagcgatgccgtggaatgcttgaactaccagcattataagggctcagattttgattgtgagttaagattattgattcaccagtcactcgcagggggaatcatcggagtgaaaggggctaaaattaaagagctgcgggagaacacgcagacgactatcaagttatttcaggagtgttgcccacattccactgatagagtcgtgctgattgggggaaaaccagaccgtgtggttgagtgtatcaagataatactggatctgatctccgagagtcccataaaaggtagggctcagccctacgacccgaacttctatgacgaaacatatgattacggaggctttaccatgatgtttgacgatcggagaggcagacctgtgggttttccgatgcggggacggggaggctttgaccggatgcccccaggacgtggtggacgacccatgcccccaagtcgcagggactacgatgacatgtcaccacggaggggtccaccccctcctccacccggtcgaggcggtaggggcggttccagagccaggaatctccctctgccacccccaccaccaccgaggggtggagacttgatggcatatgatagacgcggaagacctggagatcggtatgatggcatggtcggattctccgcggatgaaacgtgggactctgcaattgatacttggtccccctccgaatggcaaatggcttacgagccccagggcggatccgggtacgactatagctacgccggtgggagggggtcttatggtgacctgggcggtccaataattaccactcaagtgaccattcccaaggaccttgctggctccatcatcggcaaaggcggacagcggattaaacaaataagacatgaaagcggcgcttctattaaaatagatgagcccctagagggaagtgaggacaggattattaccatcacagggacacaagatcagatccaaaacgctcaatacctgcttcaaaattctgtcaaacagtacgctgacgtggagggattctag

SEQ ID NO: 23125 - DNA, 1287 bp, Artificial Sequence
  Description of Artificial Sequence: Synthetic coding sequence
atggaaaccgaacagccagaggagactttcccaaataccgagacgaacggcgaattcggtaagagacctgccgaggacatggaggaagaacaagcatttaagcgcagtaggaacactgacgaaatggtggaactgcgcatactcctccagtctaagaatatcaaggcactgcgcaccgactacaatgcttctgtttcagtccctgatagctccggcccagagcggatacttagcatctcagcagacatcgaaacgataggcgagatcttaaaaaagattattcccacgctggaagaataccagcactataaaggttctgactttgactgtgaactgcggctccttatccaccagtctctggccggaggcataattggggtgaaaggggcaaaaataaaggagctgcgcgaaaacacgcaaaccaccatcaaactatttcaggaatgttgtccccattcaactgatcgggtagtgttaatcggcggaaaaccggatcgtgtcgtcgagtgtatcaagattattcttgatttgatctcagagtcacctataaagggaagagctcaaccctatgaccccaatttttacgacgaaacctatgactatggtgggttcactatgatgtttgatgaccggagggggcgaccggtgggtttccccatgcggggtcggggagggttcgataggatgccccctgggcgtggtggcagacctatgcctcctagcagacgtgactatgacgacatgtcccctcgccgaggccctccacctcccccaccagggagaggcggacggggaggaagtagagctcgtaatctgcctttaccgccacccccaccaccacggggaggcgatctcatggcatacgaccggcgtggacgcccaggcgaccggtatgatggaatggtgggatttagtgctgacgagacttgggactccgccattgacacctggagccccagcgaatggcaaatggcttatgaaccacagggaggaagtggatatgattactcatacgccggaggtcgcggttcctatggcgacctgggcggtccaattatcaccacccaggtcaccattccaaaggacctcgctggtagcatcatcggcaaaggaggtcaacgcataaaacaaattcggcacgagagtggcgcaagtatcaaaattgacgagcccctcgaggggtctgaggataggatcattacaatcacaggtactcaggatcaaatacagaacgctcaatatctgctccagaactctgtgaaacagtattccgggaagtttttttag

SEQ ID NO: 23126 - DNA, 1140 bp, Artificial Sequence
  Description of Artificial Sequence: Synthetic coding sequence
atggaaacagagcagccggaggaaaccttccccaacaccgagacaaacggagaatttggcaaaagaccagccgaggacatggaagaggagcaagcctttaaacgcagcagaaataccgatgagatggtcgagttgcgcattctgctccagtcaaaaaatgcaggggctgtcatcggcaaagggggaaagaatataaaggctctgagaacagattataacgcctcagtctcagtgcccgattcttcgggccctgagcgcatcctgtctataagcgctgacattgaaaccatcggggagatccttaagaagattatcccaacactggaagaatatcagcattacaagggaagtgactttgattgcgagctcagactgttaattcatcagtctctcgcagggggaattattggagttaaaggcgctaaaatcaaggaattgagggaaaatacgcagaccaccatcaaattattccaggaatgttgcccccatagtacagaccgcgtcgtcttgatcggaggcaaaccagacagggtggtggaatgtatcaagatcatccttgatctaatttccgagagccctatcaagggaagagcgcagccctatgatcctaatttttacgacgaaacatatgactatgggggattcaccatgatgtttgacgacagacggggtaggccagtgggatttcccatgagaggcagaggcggattcgaccgcatgcctccaggaagaggcggaagacctatgcctccatcacgcagggattatgatgacatgagtccccgacggggaccccctccaccacctccagggcgtgggggtagaggcggttcacgagctaggaacttgccgctgccacctccaccccctcctcgtggaggggatttgatggcctatgaccggaggggaagacccggagatcgctatgacggcatggtgggattctcagccgacgagacatgggactctgctattgacacctggtcaccctccgaatggcagatggcttacgagccccaggggggtagtgggtacgattacagctacgccggaggaagagggagctatggggacctgggagggcctataattacgactcaagtgactatcccaaaagaccttgcgggttcaattatctag

SEQ ID NO: 23127 - DNA, 987 bp, Artificial Sequence
  Description of Artificial Sequence: Synthetic coding sequence
atggccgcaggaattgttgctagccggcgactcagagatctgctcacacgcaggctaaccggcagcaactacccagggcttagcatttcccttcggctcaccggaagctccgcacaggaggaagcctccggcgtggctctcggagaggctccagatcacagctatgaaagcttacgcgtgaccagcgcgcaaaagcacgtgctccacgtgcagctgaacaggcctaataaacgcaatgctatgaacaaggtgttctggagggaaatggtggaatgtttcaataaaatcagtcgggatgccgattgccgtgcagtcgttatcagcggggctggcaagatgtttactgcagggattgatctgatggacatggcaagtgacatcctgcaaccgaagggagacgatgttgctcgaatatcttggtatctgagggacattatcacgcggtaccaggagacgttcaatgtgatcgagcggtgcccaaaacccgtgatcgccgctgtgcacgggggttgcatcgggggtggagtggatctggtcactgcttgcgatatacgctactgcgcccaggacgctttttttcaagtcaaagaagtggacgttgggttagctgcagatgtaggcacgctccaacggctccccaaggtcattgggaaccaatctttagtcaacgagctggcatttacggcaaggaagatgatggctgatgaggcgctcgggtctgggttagtttccagggtctttccggataaggaggttatgctcgatgccgcattagccttggctgcagaaatcagcagcaaatcccctgttgcggtgcagtcaactaaagtgaatctgctgtattcaagggatcacagtgtcgcagagtcactaaattacgtggcctcttggaatatgagtatgctgcagactcaagatcttgtcaaatctgtgcaggcaactaccgaaaacaaagagctgaagactgtcaccttctctaagctgtag

SEQ ID NO: 23128 - DNA, 1371 bp, Artificial Sequence
  Description of Artificial Sequence: Synthetic coding sequence
atgcctaagaagcggcaggcccttgtcgagttcgaagacgtactaggggcttgtaacgcagtgaattacgctgctgataatcagatatacatcgctggccacccagccttcgtgaactactctacttcgcagaaaataagtagacctggagacagcgacgattctagaagcgttaacagcgtgttattgtttactatccttaatcccatctattctataactaccgacgttctgtataccatatgcaatccatgcggccctgtccagaggattgttatctttcgaaagaatggagtacaagctatggtcgagttcgatagcgtgcagtccgcccaaagagccaaagcgtcactgaatggcgctgacatttactcaggctgctgtaccctaaaaatcgaatacgccaagcccactcgcctcaacgtctttaagaatgaccaggacacctgggattataccaatcctaacctaagcggacaaggggatcctggatcgaatccaaataaaagacagcggcagccaccgttgctgggagatcatcccgctgagtacggaggaccccacggcggttaccacagtcactaccatgatgaaggctatgggcctcccccaccccattacgagggacgtcgcatgggtccgccagtcggcggacataggaggggacctagtaggtacggaccccagtatggccatccacccccaccccctccacccccagaatacggccctcacgccgacagcccagtgctgatggtctacggcttagatcagtccaagatgaactgtgatagggtcttcaatgtattctgtctgtatggcaatgtggaaaaggttaaatttatgaaaagcaagccaggcgcagccatggttgaaatggccgacggctatgccgtggatagggcaataactcatttgaataataattttatgttcgggcagaagctgaacgtctgcgtctcaaagcagccagctataatgccgggacagtcatatggcctggaagacggatcctgcagttacaaagacttttctgagagcaggaataatcggttctcgaccccagaacaagcagctaagaaccgcatccagcatcccagtaatgttctgcacttctttaatgcccctttagaggtaaccgaagagaatttctttgagatttgcgacgaacttggggtcaagcggccttcaagtgttaaggtcttttccggtaagtcggaaagaagctcatcaggactgcttgagtgggaatccaagagtgatgctctggagacactgggatttttgaatcattatcagatgaaaaatccgaatggtccatatccctacaccttaaaactgtgcttctccactgcacagcatgcctcttag

SEQ ID NO: 23129 - DNA, 1371 bp, Artificial Sequence
  Description of Artificial Sequence: Synthetic coding sequence
atgcccaaaaaacggcaggcactagtcgagtttgaggacgttttgggcgcttgtaatgctgtgaattacgctgccgataatcagatatatatcgcaggacacccagcttttgtgaattactccacttctcagaaaatatcaagacccggagattccgacgattcccgaagcgtgaattcggttctcttgtttaccattctgaatccgatttactctatcacaactgatgtgttatatactatttgtaacccctgcgggccagtgcagaggatcgtgatatttaggaagaacggggtgcaggcgatggttgagtttgactcagtccaaagcgcacaaagagccaaggcatctctgaacggtgccgacatttactccggctgctgtactttgaagattgagtacgcgaagccaacacgcctcaacgtcttcaaaaacgaccaggatacatgggactacacaaatcctaacttgtcgggccaaggagatccagggagtaatcccaataagagacagaggcaacccccactcctaggcgaccacccagctgagtacggtggtccacacggcggttatcactcacattaccacgacgagggttatgggccacctcctcctcactatgaaggccgacggatgggccctcccgtgggcggacaccgcagaggacctagcagatatggcccacaatacggacatccccctccccctcccccaccgcctgagtacggacctcacgcagattcacccgtgctaatggtatatggcttggaccagagtaaaatgaactgcgatagagtgtttaacgttttttgcctatatggaaatgttgaaaaggtgaaattcatgaaatcgaaacctggcgctgccatggtcgagatggcggatgggtacgcagtggatcgcgctataacacacctcaataataacttcatgtttggccaaaaactgaacgtctgtgttagcaagcagcccgctatcatgcctggtcaaagttacggactcgaagacggctcatgcagttataaggatttttcggagagtcgcaataacaggttttcaacaccagagcaagcagccaaaaaccgcatacagcatccgagtaacgttctacatttttttaatgcccctctggaggtcaccgaagagaacttctttgaaatatgtgatgagttaggtgtcaagaggccatccagcgtcaaagttttttccgggaaatctgagcggtcgtcatctggtctccttgaatgggagagcaaatctgacgctctcgaaactctaggatttctgaaccattaccagatgaagaaccccaatggaccatacccttacactcttaagctgtgcttttccactgcccaacacgcaagctag

SEQ ID NO: 23130 - DNA, 540 bp, Artificial Sequence
  Description of Artificial Sequence: Synthetic coding sequence
atgcccaaaaaacggcaggctctcgtggaattcgaagacgtactgggcgcatgcaacgctgtcaattatgcagctgacaatcagatctacatagcaggtcatcccgcattcgttaattattcaacaagtcaaaagatttcaaggcccggtgatagcgacgacagccgcagtgtgaactccgttctactctttacgattctgaacccgatttactccattacaactgacgtcctgtatacaatctgcaatccctgtggccctgtacagaggattgtaatttttagaaagaacggcgttcaggcaatggtggagtttgattcagtccaaagcgcccagcgggcaaaggccagcttgaacggggcagacatttattccggttgctgcacccttaaaatagagtatgcaaagcctacacgcctgaatgtgtttaagaatgatcaagatacctgggactacacaaacccaaatctaagcggacagggttcgcagtgcatgtttgatggcacaccttcctttcgcactgtgctgacacactgctag

SEQ ID NO: 23131 - DNA, 723 bp, Artificial Sequence
  Description of Artificial Sequence: Synthetic coding sequence
atggtcaaaatggctgctgcgggtgggggaggcggaggcggacggtactacggtggcggtagcgaaggcggacgggctccggcttcccccgtggtacacattagggggctcattgacggtgtcgtggaggccgacttggtggaggccctacaagaattcggaccgatttcgtacgtggtggtgatgccaaaaaagcgacaagcgctggtagaatttgaagatgtgttgggcgcttgtaacgctgttaattatgcggcagacaatcagatttacattgctggacaccccgcatttgtgaactacagcacatctcagaagattagccgacccggtgactccgatgacagcagatccgtaaactctgtgcttctctttaccatactgaaccctatttattcaatcaccacagacgtgctctacactatatgcaacccctgcggtcctgtgcagaggattgttatcttccgaaaaaacggcgtgcaggccatggtggagttcgattccgtgcaaagtgcccagagagccaaagcatccttgaatggcgcagacatatactctggctgttgtacattaaaaatagaatacgctaaacctacacggcttaacgtgtttaagaatgatcaggacacctgggattacacaaatcctaatctatccggacagggctctcaatgtatgtttgatgggactccatccttccgcaccgtcctgactcactgttag

SEQ ID NO: 23132 - DNA, 849 bp, Artificial Sequence
  Description of Artificial Sequence: Synthetic coding sequence
atgagttcgagctcctctagtcccagagaaacttatgaggaggacagagaatacgagtctcaggccaaaaggctcaaaactgaagaaggtgagatagactactcggctgaggagggggagaatagaagagaggctacccccagaggtggaggcgatggcggtgggggaggaagatctttctcacaaccggaagcgggaggctctcatcacaaggtctctgtgtctcctgtggtccatgtgcggggattgtgcgagagcgtggtggaagcagatctggttgaagctctggagaagttcgggaccatatgttatgtcatgatgatgccttttaaaaggcaggccctcgtcgagtttgagaatatagacagcgcaaaggagtgcgttacctttgctgctgacgaacctgtgtacatagcaggccaacaggctttctttaactattccacaagtaagagaatcacgaggcctggcaatactgatgaccccagcggtgggaacaaggtgctattgctgagcatccagaaccccctctatcccatcacagtagatgtactgtacaccgtttgcaaccctgtgggaaaggtgcagcgtattgtcatctttaagcgcaatggtattcaggccatgctgatgttcgagtcagtgctgtgtgcacaaaaggccaaggccgctctcaatggcgcagacatctatgcaggttgctgtacccttaagatcgaatacgccagaccaactcggttgaacgtcatccgcaacgacaacgattcttgggattacactaaaccctacttgggtcgtcggggttgctgctggctgatgctgaagcttctggaaaggagtccactttag

SEQ ID NO: 23133 - DNA, 1527 bp, Artificial Sequence
  Description of Artificial Sequence: Synthetic coding sequence
atgtcctcgagtagcagttctcccagggagacctacgaagaagaccgtgaatatgaatcacaggctaagcgcctgaaaacagaagagggggagatagattactccgcagaggagggagaaaaccggagggaagcaactcccagaggcggtggggacgggggtggtgggggaaggtcctttagtcaacctgaggcagggggatcacaccataaagtttctgtctccccagttgttcacgtgcgcggattgtgtgagagtgtagttgaagcagatttagtggaggcactggagaagttcggaacaatctgttacgttatgatgatgcctttcaagagacaggccctggtcgagtttgaaaacatagacagcgctaaggagtgcgtgacttttgccgctgatgagccagtctatattgccggacagcaggcttttttcaactactccacatccaagagaattacgcggccaggtaacactgatgacccgagcggcggtaataaagtgttattgctgagcattcagaatccactttatcctattaccgtggatgtgttgtacacggtgtgcaatccagtcggcaaagtgcaacggattgtgatctttaagcggaacggcatacaggcaatgccaactaggttgaacgtcatcagaaacgacaacgacagttgggattacactaagccgtatcttgggcgaagagatagaggaaaggggagacagcgccaggctatactgggggaacaccccagctccttccgccatgatgggtatggatctcatggcccactcctccccttgccaagccggtatcgaatgggatcacgcgacacccctgaactcgtggcctaccctctgccacaggcttcttcgtcatacatgcatggcggtaatccaagcggctcagtcgtgatggtttctggcctgcaccaactcaagatgaactgttctcgggttttcaatttgttttgtctatacggaaatattgagaaggtgaaatttatgaaaacaatccctgggactgcgctagttgagatgggggacgaatatgccgtggaaagggcagtgacccatctgaacaatgtaaaactcttcggcaagagactaaatgtgtgtgtgtcaaagcagcattcggtggtgccctcccagatcttcgagctggaagatggcacgtcctcgtacaaggacttcgctatgtccaaaaataacaggttcacttctgcaggacaggcttccaagaacattattcaacctccatcttgtgtactgcactattacaacgtgccattgtgcgtgaccgaggagaccttcactaagctgtgcaatgatcatgaggtactgaccttcattaagtataaagtgttcgacgcaaagccaagtgctaagacgctgtctggtctcctcgagtgggaatgcaaaactgacgcagttgaggccctgacggcgttaaaccactaccagattcgggttcctaatggaagcaatccatacactctaaagttgtgcttctccacatcctcacacctctag

SEQ ID NO: 23134 - DNA, 1527 bp, Artificial Sequence
  Description of Artificial Sequence: Synthetic coding sequence
atgtctagtagctcctcgagcccacgggaaacctacgaggaagatagagagtatgaatctcaggctaaaaggttaaaaactgaagaaggtgaaattgattattctgccgaggaaggagagaatcgccgagaggcaacaccacgcggaggcggtgatgggggtgggggaggtagaagctttagccagccggaagctggcggttcccaccacaaagtgagcgtttcccccgtggtgcacgtgcgcggactttgtgagtctgtcgtagaagccgacctcgtggaggctctggagaagttcggtaccatctgctacgtcatgatgatgccttttaaaaggcaggccctggtagagttcgaaaatatcgatagtgccaaggaatgcgtaacattcgccgcagacgagccagtgtacatcgcaggccagcaagcctttttcaactacagtacctctaagagaatcactagaccaggcaacacagatgatccaagcgggggaaataaggtattgcttttatctatccaaaatccactttatccgatcacagtggatgtgctgtatacagtgtgtaaccctgttggcaaggtgcagcgtatcgtgatattcaaacggaatggcatacaggcgatggtggataggcttaacgtgatcaggaatgacaatgacagctgggattacaccaaaccctatctcggccgaagggacagggggaagggacggcagagacaggcgatcctcggcgaacaccccagctcctttcgtcacgacggttatggatctcatggcccacttttgccgctcccctcccgttaccgaatgggaagtagagataccccagagttagttgcttaccctctgcctcaggcatcctccagttatatgcatggcggtaaccctagtggttccgttgtcatggtgtctggcttgcaccagctcaagatgaattgctctagggtgttcaacctcttctgtctttacggcaatatcgaaaaggtaaagttcatgaaaactattccaggaaccgctctggtggaaatgggggacgaatatgcggtggagagggcagttactcatctgaataacgtgaagctgtttggaaaacgattgaacgtgtgtgtgtccaagcaacatagtgtagtacccagtcagatatttgaactcgaagatgggactagctcatacaaagatttcgcaatgtccaagaataatagattcacaagtgcaggacaggcctccaaaaatattattcagcctccgagttgcgtgctgcactactacaacgtcccactttgtgttactgaggaaacattcaccaaactttgtaatgatcatgaggtcctgactttcatcaaatataaggtcttcgacgcaaaaccttctgctaaaaccctttctggactgctcgagtgggagtgcaagacagatgctgtggaggcccttactgctctgaaccactaccagatcagggttccaaacggctcaaacccctacaccttgaaactgtgcttctcaacatctagtcacctctag

SEQ ID NO: 23135 - DNA, 1614 bp, Artificial Sequence
  Description of Artificial Sequence: Synthetic coding sequence
atgttagcgcgagagacgtacgaggaagaccgagaatacgagagccaggctaaacggctgaagaccgaagaaggcgagatcgactactctgcagaggaaggagagaatcgtcgggaagcaacacctcgaggtgggggagacggtggcggagggggacggtccttttctcagccggaagccggtggatcacaccacaaagtgagtgtgtcccctgtggtccacgtccggggactgtgcgagagcgtggtcgaagccgatcttgttgaggcacttgaaaagttcgggaccatctgctacgttatgatgatgccctttaagcgtcaagcactcgttgagtttgagaacatcgactccgccaaagaatgcgttaccttcgccgcagatgagccggtgtatatcgccggacagcaagccttttttaactacagcacgtcgaaacggataacaagacccggaaataccgacgatccttctggaggtaacaaggttctccttttgagtatccagaatcccttatacccaattacagtcgacgtgttgtacaccgtatgcaacccagtgggaaaagtccagcgcatagtcattttcaagaggaatggcatccaggcaatggtggagtttgagtctgttctgtgtgctcaaaaagcaaaagcagccttgaacggcgctgatatttatgcgggatgctgtaccttgaagatcgagtacgcacggccaacaagactgaatgtcatcagaaacgataacgactcgtgggattacacgaagccttacctaggcagacgggaccggggtaagggccgtcagaggcaagccatactcggagagcaccccagtagcttcaggcatgacggctacgggtcccacggacccctgctgcccctgccatcccgctatcggatgggatctagggacacaccggagctggttgcgtaccccctcccccaggcgtcctccagctacatgcatggaggaaacccatctggtagcgttgtgatggtgagcgggctgcaccagcttaagatgaactgctctagagtctttaatttgttctgtctgtacggcaatattgagaaggtgaagttcatgaaaacgataccaggcacagcactggtggaaatgggagacgagtacgccgtggagcgcgctgtgacgcatctgaacaacgtgaagctttttggcaagagactgaatgtgtgcgtgtccaagcaacatagtgtggtgcctagccagatctttgaacttgaggacgggacatcaagttacaaagacttcgccatgtcaaaaaataataggttcacgagcgctggtcaggcttcaaagaacattatccagcccccaagctgcgtgttacactattacaacgtgcctttatgcgtcaccgaagagacattcacaaagctgtgcaacgaccacgaggttctcacatttattaaatacaaggtcttcgacgccaagccgtctgcaaagacgctgtctggtctgctggagtgggaatgcaaaaccgatgcagttgaggctctcacggcccttaaccattatcaaatccgtgtgcccaatggcagtaacccatatactctcaagctctgcttttctacatcctctcatctgtag

SEQ ID NO: 23136 - DNA, 828 bp, Artificial Sequence
  Description of Artificial Sequence: Synthetic coding sequence
atgctcgccagggagacgtacgaggaagatagggaatacgagtcccaggccaaacggttaaaaaccgaagaaggcgagatcgattacagtgccgaggagggcgaaaaccgcagagaggcgacccctagagggggtggagacggtgggggaggcggtcgttctttctctcagccagaggctggcggaagccaccataaggtgagtgtgtccccagttgtgcacgtcaggggtctgtgtgaaagcgtagttgaggccgatctggtggaagcactcgagaaatttggtaccatttgctatgtgatgatgatgccctttaagcggcaggcgttggtggagtttgagaacatcgactccgctaaggagtgcgtgaccttcgcagcggatgaacccgtatatatcgccggacaacaggccttttttaattatagcaccagcaaacgaataacaagacccggaaacacagacgatccttctggaggaaataaggtgctccttctttccatccagaatccgctgtacccaatcactgtggacgttctgtacaccgtctgcaaccccgtcggcaaagtacagagaatcgtgatttttaagcgtaatggaatacaagccatggtcgaatttgagtccgttctatgtgctcagaaggcaaaggcagcgcttaatggcgcagacatctatgctggctgttgtaccctcaaaatcgaatatgcaagacccacccgactcaatgtgatccgcaatgataacgattcctgggattatacaaagccatacttgggcagaaggggccgttattttatccacttcagaatgtacctgatttgctag

SEQ ID NO: 23137 - DNA, 1629 bp, Artificial Sequence
  Description of Artificial Sequence: Synthetic coding sequence
atgtcctcctcaagttccagccccagggaaacttacgaagaggacagagagtatgagagccaggccaaacgactcaagacagaggagggagagattgactattctgccgaggagggggagaacagacgggaggctaccccaagaggcggaggcgacggcggtggcggaggcaggagttttagtcagccggaggccggtggaagtcaccacaaggtaagtgtgtcaccagtagtccacgttcgtggtctgtgcgaatctgtcgtagaagctgatctggtcgaagccctcgagaaattcgggacgatctgctatgtgatgatgatgccctttaagaggcaagccctggttgagttcgagaatatagattctgctaaggaatgtgttaccttcgccgcagatgagcctgtgtatatcgctgggcagcaggcattcttcaactattcgactagcaaaagaattacgcggcctgggaacaccgatgatcctagtgggggaaacaaggtgttgctgctcagcattcagaatcctctgtatcccatcactgtggatgtcctgtacacggtgtgcaatcctgtcggcaaggttcagcggatagtcattttcaagcgcaatggtatccaggcgatgctgatgttcgagtcagttttatgtgcccagaaggccaaagctgctctgaatggggcagacatttatgccggatgctgcacgctgaaaattgagtatgcaagaccaacccgcctgaacgtgattcggaatgataacgattcctgggactatacaaagccatacttgggcagacgggaccgaggcaagggtcggcagcggcaagccatcctgggcgagcacccctcctccttccggcatgatgggtacggttctcacggccctcttctgccgctaccttccaggtaccggatgggctcacgagataccccagagctggtggcctatcccctgcctcaggcttcctcttcctacatgcacgggggtaaccccagtgggtcagtcgtaatggtcagcggcttgcaccaactgaagatgaactgctctcgtgttttcaacctgttctgcctgtacggcaacatcgagaaggtgaagtttatgaagaccatccctggcaccgcactggttgagatgggtgacgaatatgcagtggaaagagccgtaacgcatctcaacaacgttaagttattcgggaagaggctgaacgtttgcgtatctaagcaacacagtgtagttccttcacaaatctttgaactcgaggacggaacgtcttcgtataaagatttcgcaatgtctaagaacaaccgattcacgtcggcgggacaggccagcaaaaacataatccagcctccctcctgcgtacttcactattataatgtcccgctgtgcgtcaccgaagagacgttcactaagctgtgtaatgatcatgaagtcctgacattcatcaagtataaagtatttgatgccaagcccagtgctaagaccctaagcgggctgctggagtgggagtgtaagaccgacgccgttgaagcactgacggccctaaatcattatcagattcgcgttcccaacggcagcaatccatataccctgaagttatgcttttctacctctagccatttatag

SEQ ID NO: 23138 - DNA, 2244 bp, Artificial Sequence
  Description of Artificial Sequence: Synthetic coding sequence
atggaagtgaagagactcaaagtgactgaacttcggtcagaactgcagcggcgaggcctcgattctcgcggactaaaggttgatctagcccagcggctccaggaggcactcgacgctgaaatgctggaggacgaggccggtggcggtggagctggtcctggcggagcctgtaaggccgagcctaggcccgtcgccgctagcggcggaggcccagggggagatgaggaggaagacgaagaggaggaagaggaggatgaagaggccctcctggaagacgaggatgaagagcctcctcctgcacaggcgctgggtcaggccgcacaacctcctcctgagcccccagaagctgctgctatggaggccgctgccgagcctgacgcgtctgagaagccagccgaagctaccgccggatcggggggtgtgaatgggggagaagagcagggattgggcaagagagaagaggacgagcccgaagagagatccggcgacgagacaccaggtagcgaagttccaggagacaaagccgcagaggagcagggggatgatcaagactccgaaaagagcaaacccgctggaagtgacggggagaggcggggagtgaagcggcagcgcgacgaaaaagatgagcacggccgagcctactacgaattccgtgaagaggcgtaccattctcgctccaagtctcccctgccacccgaggaggaggcaaaggacgaagaagaggaccaaacactggtcaacctggatacttatacttccgatctgcattttcaagtgagtaaagacaggtatggtggtcagccgctgtttagcgagaaatttcctacgttgtggtccggagccaggagtacttatggggtgacaaagggtaaagtgtgcttcgaggcaaaagttactcagaaccttcctatgaaagaggggtgtaccgaggtgagcctgttaagggtgggatggagcgtggatttctcccgcccacagctgggcgaagatgaattttcctacggatttgatgggagaggtctcaaggccgaaaacgggcagtttgaggaatttggacaaacgttcggagagaacgacgtgataggctgctttgcaaattttgagacagaggaggttgagctctccttctcgaagaatggagaggacctgggcgtggccttttggataagtaaagacagtctcgctgaccgggctttgcttcctcacgtcctgtgtaagaactgtgtggtggaactcaatttcgggcagaaagaggagcccttcttcccaccacctgaagagttcgtgttcattcatgcggtgcctgtcgaagagcgtgtgagaaccgccgtcccaccaaagactatcgaggagtgcgaggtgattctgatggtgggcctgcccggaagcggcaagacacagtgggctctgaagtacgctaaagaaaacccagagaaacgttataatgtgctcggcgctgaaaccgttctgaatcagatgcgaatgaaaggacttgaagaacctgaaatggaccctaagtctagagacctgctcgtgcagcaagctagccagtgcctgtccaagctggtccagattgcctctaggaccaagcgtaacttcattctggatcaatgtaatgtgtataattcaggccagcgacgcaaactgctgctcttcaagacattcagcagaaaagttgtggtggtcgtgccaaatgaagaggattggaagaagcggctggagctgaggaaggaagtggaaggggacgatgtgcctgagagtatcatgcttgagatgaaagccaatttcagcttgccagaaaaatgtgactacatggacgaggtcacatatggcgaattggagaaggaagaggcccaacccatcgtgacgaagtacaaagaggaagcccgaaaattgttacccccatcagaaaaacgcacgaatcgccgtaataataggaacaagcgcaatcggcagaaccggtctcgtgggcaaggttatgtcggtgggcagagaagaggctatgacaaccgagcttacggccagcagtactgggggcagcctggtaaccgcggtgggtacaggaatttttacgaccgataccgcggtgattatgaccgattctatgggagggattacgaatataatcgatatcgggactactaccgacagtataatagggattggcagtcttactactaccaccatccccaggacagagacaggtattacaggaactactatggatatcagggttatcggtag

SEQ ID NO: 23139 - DNA, 561 bp, Artificial Sequence
  Description of Artificial Sequence: Synthetic coding sequence
atgggcaaagagattcaactcaagccgaaggcaaacgtgtcatcgtatgtgcatttcttgctcaactaccgcaacaagtttaaggaacagcagcctaacacttatgtagggtttaaggagtttagtcgtaagtgctctgaaaagtggagaagtatatccaaacacgagaaggcaaaatatgaagccctggcgaagctcgacaaggcccgatatcaggaggagatgatgaactacgtgggcaaacgtaaaaagcgacgtaagcgtgatccccaggagccccgaaggcctccctcatcattcctcctgttctgtcaggatcactacgcgcaactgaagagagagaaccctaactggtccgtggtgcaagtagcgaaagccacaggaaagatgtggagtacagctaccgatttagagaagcacccgtatgagcagcgggtcgctctacttcgcgcaaagtacttcgaggaactggaactctacaggaaacagtgcaacgccaggaagaagtataggatgagcgcaagaaacaggtgccgcggtaaacgagtcagacagtcgtag

SEQ ID NO: 23140 - DNA, 561 bp, Artificial Sequence
  Description of Artificial Sequence: Synthetic coding sequence
atgggcaaggaaattcaacttaaacctaaagctaacgtgtccagctatgtgcactttctgttgaactaccgcaacaaattcaaagagcagcagccgaacacatatgtgggcttcaaggagttctcacgaaaatgctcagagaaatggcgaagcatttcaaagcatgagaaggcgaagtacgaggcactggcaaaactggacaaggccaggtatcaggaggagatgatgaattacgtgggaaagaggaaaaaacgaaggaaacgcgacccccaagagccacggagacccccatcgtcattcctcctcttctgtcaagatcactacgcgcagctgaagagagagaaccctaactggtcagtggttcaggtggccaaggcaacaggaaaaatgtggtctacagccacagatttggaaaagcacccatatgaacagagagttgcgctgctgcgcgcaaagtattttgaggagcttgagctgtaccggaaacagtgcaatgcgcgaaagaaatatagaatgtctgccaggaataggtgccgaggaaaaagggtgagacagtcctag

SEQ ID NO: 23141 - DNA, 273 bp, Artificial Sequence
  Description of Artificial Sequence: Synthetic coding sequence
atgccaaagcgaaaggccaagggagacgctaaaggcgacaaagccaaggtgaaggatgagcctcagcgcagaagtgcccgtttgtccgccaagcctgcgcctcccaagccagagcctcgccctaaaaaggcaagcgccaagaagggagaaaagcttccaaagggccgaaaaggcaaagcagacgctggtaaggacgggaacaaccccgcaaaaaatagggatgccagtactctgcaatcccagaaagccgagggaaccggagatgctaaatag

SEQ ID NO: 23142 - DNA, 273 bp, Artificial Sequence
  Description of Artificial Sequence: Synthetic coding sequence
atgcccaagcggaaggctaagggggatgccaagggcgacaaggccaaagtaaaggacgaaccccagagacggtccgctagattgtcggcgaagccagccccacctaagcctgagcccagaccaaaaaaggcttcggcaaagaaaggagagaagctgccaaagggacggaaggggaaagccgacgccggaaaagatggaaacaacccagccaaaaacagagatgcaagcaccctacaaagccagaaggccgaaggtactggagacgccaagtag

SEQ ID NO: 23143 - DNA, 849 bp, Artificial Sequence
  Description of Artificial Sequence: Synthetic coding sequence
atgcccaaaaggaaagctgctggccagggggacatgaggcaggaacccaaaaggagatcagccagactgtcggctatgttggttccagtgacccccgaggtgaagcctaagcgcaccagcagctcccgcaaaatgaagaccaaatccgacatgatggaggaaaatatcgacacgtcggcacaagccgtcgctgaaacaaaacaggaggctgtggtagaagaggactacaacgaaaatgctaaaaacggcgaagctaagattacggaggcacccgcatcagagaaggagatcgtcgaggtcaaagaggaaaacatcgaagatgctacagagaagggaggcgaaaagaaggaggccgtggcggctgaggtcaagaatgaagaagaagaccagaaggaggatgaagaggatcagaacgaggaaaagggcgaagctgggaaggaagataaagatgagaaaggggaggaggacggcaaggaggataaaaatggtaacgagaaaggagaggacgccaaagagaaagaagatggaaaaaagggtgaggatggtaaaggcaatggagaggacggaaaggagaaaggggaagatgaaaaggaagaagaagacagaaaggaaactggggacggcaaggagaatgaggacggaaaagagaaaggtgacaagaaagagggcaaagacgtcaaggttaaagaagacgaaaaggaacgcgaagacggcaaggaggatgaagggggaaatgaggaggaggcagggaaggagaaagaagatctgaaggaggaggaggagggcaaagaggaggatgaaatcaaggaagacgacggcaaaaaggaagagcctcagtccattgtgtag

SEQ ID NO: 23144 - DNA, 486 bp, Artificial Sequence
  Description of Artificial Sequence: Synthetic coding sequence
atgccaaagcgtaaacccaaaaggaggtctgccaggctgtccgcaatgctagtgcccgtcacccctgaagtgaagcccaaacggacctcttcaagccgcaaaatgaagactaaatccgacatgatggaagagaatatcgatacgagcgcccaggccgtggccgaaaccaagcaagaagcggtggtggaggaggactacaatgagaatgccaagaatggggaggcaaagatcacagaggccccagcatctgagaaggagatagttgaagtaaaagaagagaacattgaggacgcaacggagaaggggggagagaaaaaggaggcagtggccgctgaggtgaaaaatgaagaagaggaccagaaagaggatgaagaagaccagaatgaggagaagggcgaagctggtaaagaggataaagacgagaaaggggaagaggacggaaaagaagacaaaaacgggaacgagaaaggtgaagacgccaagtag

SEQ ID NO: 23145 - DNA, 447 bp, Artificial Sequence
  Description of Artificial Sequence: Synthetic coding sequence
atgccaaagcgtaaggccgctggccagggtgacatgaggcaggagccaaaaaggcggtccgccagactctctgctatgctcgtgcccgttacccctgaggtcaaaccaaagaggactagttccagcagaaagatgaagaccaaatctgacatgatggaagagaatatcgatacgagcgcccaagccgtggccgagaccaagcaagaagccgtggtcgaagaggactataacgagaatgccaagaacggcgaagccaagataactgaggcacctgcatctgagaaggagattgtagaagtgaaagaggagaatattgaggacgcaaccgagaagggcggtgaaaaaaaagaggccgtcgctgctgaggtgaaaaacgaggaagaagaccagaaggaggacgaagaagatcaaaacgaagaaaaaggcgaagcgggaaaagaggactag

SEQ ID NO: 23146 - DNA, 309 bp, Artificial Sequence
  Description of Artificial Sequence: Synthetic coding sequence
atgcctaagcgtaaggccgcaggtcagggagacatgcgccaggagccgaagcgcagatcagcccgtctgagcgccatgctggtgcccgtgaccccagaagtaaaacccaaacgcacaagctcctcccgcaagatgaagactaagtccgacatgatggaagaaaatatagatacctccgcccaagccgtagcagaaacaaagcaggaggcggtagtggaagaggactataatgagaacgcgaagaatggggaagctaagattaccgaagccccagcaagcgaaaaggaaattgtggaagtgaaggaatag

SEQ ID NO: 23147 - DNA, 606 bp, Artificial Sequence
  Description of Artificial Sequence: Synthetic coding sequence
atgcctaagagaaaaatgctggtgcccgtcacccctgaggttaaaccgaagaggacctcatccagccgcaagatgaaaactaagagcgacatgatggaagaaaacatagacacatccgcccaggcagtagccgaaactaaacaggaggctgttgtagaagaagattataatgaaaacgccaagaacggagaggccaaaataacagaagctccggcttccgagaaagaaatcgtggaagtgaaggaggagaacatcgaggatgcgacggagaaaggaggcgagaagaaagaagcagtggcggcagaggtgaagaacgaagaagaagatcaaaaggaggatgaggaggaccaaaacgaggagaagggagaagcaggcaaagaggacaaggacgaaaagggtgaggaagacggtaaagaggataaaaatggaaatgagaaaggcgaggatgctaaggaaaaggaggacgggaaaaagggagaagatggcaagggcaacggggaggacggtaaagagaaaggagaagatgaaaaagaggaggaagatagaaaagaaaccggcgacggcaaagaaaacgaagacggtaaggagaagggcgataagaagtag

SEQ ID NO: 23148 - DNA, 270 bp, Artificial Sequence
  Description of Artificial Sequence: Synthetic coding sequence
atgccaaagaggaaggcagcaggacagggcgacatgcggcaggagccaaagcggcgaagcgcgagactgtcagccatgctggtgcctgttacacctgaagtgaagccaaagcgtacatcctcctctcgcaagatgaagacaaagagcgacatgatggaggagaacatcgatacctctgcccaagcagtcgctgagaccaagcaagaggctgtagtggaggaagattacaacgagaacgctaaaaatggtgaggctaagatcacagagtag

SEQ ID NO: 23149 - DNA, 2073 bp, Artificial Sequence
  Description of Artificial Sequence: Synthetic coding sequence
atgaacttaagatctgtctttaccgtggagcaacagaggatcttacagcgctattacgaaaatgggatgactaatcagtcaaagaattgcttccagctcatactacagtgtgcccaggagaccaaactggacttctctgtcgtcaggacctgggtggggaataaacgaagaaagatgtcttcgaaaaacagcgaatccggtaccgccaccacgggcacaagcctcagcgcaccagatattacagtgaggaatgttgtgaacattgccaggccgagcagtcagcagtcctcctggacttcggcaaataacgacgtgattgtgacaggcatttacagcccagcatccagttctagcagacaggggactaacaagcatactgacacacagataactgaggcccataaaattcctattcaaaagactgctactaaaaatgatacagagtttcagctgcacattccggtgcagcgacaagtggcacattgcaagaatgcatccctgctgctaggagaaaaaacaattattctgtcccggcagacatcagtgcttaacgccggtaatagtgtctttaatcacgcgaagaagaattatggcaactcaagtgtccaagctagcgaaatgacggtgccacagaaaccatccgtctgccatagaccttgcaagatcgaacctgtgggtattcaacgttcatacaaaccggagcataccgggcctgccctgcacaacctgtgcggccaaaagcccacaattagggacccatactgcagaacccagaatttggagatccgcgaggtcttttcccttgccgttagtgactacccacaaaggatcttaggcggtaacgcccctcagaagccgagttccgcagaggggaactgcctctctattgcaatggagactggggatgctgaggatgaatatgcccgtgaggaggaactggcatctatgagagcacaaatacccagttattctcggttttatgagagtggcagttctttgagagccgagaatcagtctacaacactccccggacctggtcgcaacatgcctaattcccaaatggtaaatattcgcgacatgtccgacaatgtgctctaccagaaccgcaactaccacctaacaccccgtacctcactccacacagccagctctaccatgtattcgaacactaaccccctcaggtccaatttcagtcctcattttgcttctagtaaccagctcagactgtcacagaatcagaataactatcagatatcaggcaacctgaccgtaccctggattactggatgttctcggaaacgagcattgcaggatcgcactcaattttcggaccgggacctggctacactaaaaaagtattgggacaacggtatgacaagccttggtagcgtatgtagggagaaaattgaagcagtggcaaccgagctgaacgttgactgcgaaattgtgaggacatggatcggcaaccgtcgcaggaaataccgcctcatgggaatcgaggtccctccgcctcgtggtggtcccgctgacttcagcgagcagcctgagagtggcagtctgtcagcactaactcccggtgaagaggctggacccgaagttggagaagataacgaccgcaacgacgaggtcagcatttgcttgagtgagggaagctctcaggaagagccgaacgaagtcgtaccaaatgatgcccgtgctcataaggaggaggatcaccatgctgtgaccaccgataatgtgaagattgaaatcattgatgatgaggagtcagacatgatcagtaattcagaagtggagcaggttaacagcttcctggactacaaaaacgaagaagtaaaattcattgaaaacgaactcgaaatccagaagcaaaaatactttaaactgcagactttcgtccggtctctgatactggctatgaaggccgatgacaaggagcagcagcaggccctcctctctgacctccctccagaactggaagagatggactttaatcatgcgtcacttgagccagatgatacatcattcagcgttagcagcctcagcgagaagaacgtgtccgagagcctctag

SEQ ID NO: 23150 - DNA, 1899 bp, Artificial Sequence
  Description of Artificial Sequence: Synthetic coding sequence
atgtcaagcaagaacagcgaaagcggcactgccacaactggcacaagcctttccgccccagatatcactgtgagaaatgttgtaaatattgccagaccttccagtcagcaaagttcatggacatctgcaaataacgatgtgatcgtgacagggatatattcccctgcttcctcatcaagtcgccaaggaactaacaagcacaccgacacgcagattacagaggctcacaagatcccaatacagaaaaccgccactaaaaacgacactgagtttcaactgcatattccagtccagaggcaagtggctcactgcaaaaatgcttccttattattgggggagaaaacgatcatattgagccggcaaacaagcgtcctcaacgctggcaactccgtctttaaccacgcgaaaaaaaattacggaaactccagcgttcaggctagcgaaatgactgttcctcagaaacctagcgtgtgtcatcgaccctgcaaaatcgagcccgtgggcattcagcgcagctataagccagaacacactgggccagctctgcataatctgtgcggtcagaagccgaccataagggatccttactgtcggacacagaacctcgaaataagggaagtcttctccctggccgtgagcgactatccgcagagaatactggggggtaatgctcctcagaagcctagctctgccgaagggaactgtctttccattgccatggagactggcgatgctgaagacgaatacgctcgggaagaggagcttgcatccatgagagctcaaataccctcctacagccgattttacgagagtggttcatctctccgcgctgagaaccaatccactactttgcctggtcctggcagaaatatgccaaattcccagatggtgaacatcagagatatgagcgacaacgtcctctaccagaacaggaattatcatctgaccccaagaacgtctcttcacaccgccagtagcacaatgtactctaatacaaatcctctgcgcagtaacttctccccacacttcgcctcctctaaccagctgcggcttagccagaatcagaataactaccaaatatccggaaacctgacagtcccatggattactggttgctcaaggaagagagccctccaggatagaacacagttttctgaccgcgatctcgcaacgctgaagaagtactgggacaatggcatgacaagcttgggttcagtatgcagggagaagattgaggctgtcgcgacagaactgaacgtcgattgtgagattgtcagaacatggattggaaatagacggcgtaaataccgccttatgggcatagaagtgccgcctccgagaggtggaccggctgatttctctgagcagccagagagcggaagcctcagtgccctgacccccggtgaggaggcgggacccgaggtcggagaggacaatgaccgcaacgacgaagtgagcatctgcctcagcgagggcagcagccaggaggaacctaacgaggtggtgcccaacgatgcacgagcgcataaagaagaggaccaccacgccgtgaccacagataatgtcaagatagagatcatagacgacgaggaatctgatatgattagcaactccgaagttgagcaggtgaacagctttctggattacaaaaacgaagaagtgaaattcattgagaacgaacttgagattcagaaacaaaagtatttcaagctgcaaaccttcgttaggtcactgatactcgctatgaaggcagatgataaggagcaacaacaggcactcctatcagacttgccacctgaactggaggaaatggatttcaaccacgcctcccttgagcctgatgacacaagtttctccgtgagttctttgagtgaaaaaaatgtgagcgaatccctctag

SEQ ID NO: 23151 - DNA, 624 bp, Artificial Sequence
  Description of Artificial Sequence: Synthetic coding sequence
atgagctcaaagaatagtgagtcgggaaccgccacaaccggcacttcgctcagcgcgccagacataacggttaggaatgtggtgaatatcgccaggccctctagccagcaaagctcttggacctctgccaataatgacgttatcgttacaggaatctactccccagcctcctcctctagccggcaggggacgaacaaacacactgacacacagatcaccgaagctcataagatccccattcagaaaactgctactaagaacgatacagagttccagctccacatcccagtccaacggcaggtcgcgcattgtaagaacgcctccctgcttctcggcgagaaaaccatcatcctgtcacgccagacaagcgtccttaacgccggaaactcagtgttcaaccatgcaaagaaaaattacggaaacagttctgtgcaggcctccgaaatgacggtgccacaaaagcccagtgtgtgccatagaccatgcaaaatcgagcctgtgggtattcagaggtcgtataagccagagcacactgggcctgctctgcacaatttgtgtggacaaaaacccaccattagggacccatactgccggacccagaacctcgaaattagagaggtgtag

SEQ ID NO: 23152 - DNA, 2073 bp, Artificial Sequence
  Description of Artificial Sequence: Synthetic coding sequence
atgaatctgcggagcgttttcactgtcgagcagcaaagaattctccagagatactatgaaaacggcatgaccaaccagagcaagaactgtttccagctgatcctgcagtgtgcacaggagacaaaacttgactttagcgtggtgcggacctgggtgggtaataagcggcgaaaaatgagtagcaagaattctgaatctggcactgcaaccacggggactagcctctcagcacccgacattaccgtcaggaacgttgtgaatatcgccaggccttcaagccaacaatcgagttggacctcagccaacaacgacgtgatcgtaactgggatttatagccctgcttctagtagttcacggcagggcaccaataagcatacggacacccaaattacggaagctcacaagatacccatacagaagacagccaccaagaacgatactgaattccagctgcacatacccgtccagaggcaggttgcacattgcaaaaacgcgtctctgcttctaggcgagaagaccattatcctgagtcgacaaacatccgttttgaacgccggaaactcagtattcaaccatgcaaaaaaaaattacggtaacagttcagtacaggctagtgaaatgaccgtgccacagaaacccagcgtctgccataggccttgtaagatagaacccgtggggatccagcgcagttacaagccggaacacaccgggcctgctctccataacctgtgcggacagaagcccactattcgagatccctactgcagaactcaaaacttagagatcagggaggtgttcagcctggctgtgtccgactaccctcaacgcattctgggaggaaacgccccacagaagccgtctagcgctgaggggaattgcctgtccatcgcgatggaaaccggtgacgctgaagacgagtatgcacgagaggaggaactggcatcaatgagagcccagatcccaagttatagccgattctacgagtctggttcatctcttcgagccgaaaaccagagcacaacactgcctggaccagggagaaatatgccaaactctcagatggtcaacattcgggacatgtctgacaatgtactgtaccagaatcggaactaccacttgacccctcgcacatctctccacaccgctagcagtacaatgtacagcaatacaaaccctctgagaagcaacttcagtccacacttcgcctcctccaatcagctgcggctgtctcagaatcaaaacaactaccagatcagcggtaacctgactgtaccgtggataaccgggtgcagccgcaaaagggccctacaagacaggacccaattttctgaccgcgacttagccaccttgaaaaaatactgggataatggaatgacttcactcggctcagtgtgcagggaaaagatcgaggccgtggcgaccgagctaaatgtggactgtgagatcgtgaggacttggattggcaatagaaggcggaagtataggcttatggggatcgaagtaccccctccgagaggcggaccagccgacttctcagaacagccggagtctggcagtctgagcgccctgacacccggagaagaagccggtccggaggtgggcgaggacaatgaccgaaacgatgaagtctctatctgcttgtccgaaggctcaagtcaggaagagcctaacgaggtggtgcccaatgacgcaagggcccacaaagaggaagaccatcacgcggtgacaaccgacaacgtaaaaatcgaaattatcgatgacgaagaatccgacatgatcagcaatagtgaagtggagcaggtgaactccttcctagactacaagaacgaagaggtcaagtttatagagaatgagctcgagattcagaagcagaagtacttcaagctccagaccttcgtgaggtcactgatactggccatgaaggccgacgataaagagcagcaacaggcactgctgtccgatctgcctccagagcttgaggaaatggattttaaccacgcgtctctggaacctgatgatactagcttctctgtgagtagccttagcgagaagaacgtcagtgaaagcctgtag

SEQ ID NO: 23153 - DNA, 1671 bp, Artificial Sequence
  Description of Artificial Sequence: Synthetic coding sequence
atggctcgagaaaaagaaatgcaggagtttacgcggtcttttttccgaggacggcctgacctgtccaccctgactcatagcatcgtccggagacggtatctggcacatagcggacgcagccacttagagcccgaggaaaaacaagccttaaagagactggtcgaggaagagctgctaaagatgcaggtcgacgaggcagcaagtcgtgaggataagcttgatctgactaaaaaggggaagcggcctcccacaccatgtagcgatccagagaggaagcgtttcagattcaactccgaaagtgagagcggcagtgaggcatcttctcctgactactttggaccaccagctaaaaacggtgtggcagctgaagtgagccccgctaaggaagaaaaccctcggagagcatccaaagcggttgaagagtcctccgacgaggaaaggcagagagacctgcctgctcagcgaggagaagaatcttcagaggaagaagagaaaggatacaagggaaaaacaagaaagaaacctgtggtgaagaaacaagcccctggcaaggctagtgtctcaagaaaacaagcacgggaggagtctgaggagtctgaagccgaacctgtccaacgcacagccaaaaaggtcgagggaaacaagggaacaaagagcctaaaagaaagcgagcaggagtccgaggaagagattcttgcacagaaaaaggagcaacgcgaggaagaggtggaagaagaagagaaggaagaagacgaggaaaagggagactggaaacctaggacacgatcgaatggcagacgcaagtcagctagggaggagaggagctgcaaacaaaagtcccaggcgaaacgcttactgggcgacagtgacagcgaggaagaacaaaaagaagcagcgtcatctggagacgattcaggtcgtgatcgcgaaccacctgtccagcgcaagagtgaagatcgcactcagctcaaaggcggaaagaggctcagcggaagtagtgaagatgaagaagattctgggaaaggcgaaccgactgctaagggaagcagaaagatggcaaggctgggatcgacgagcggagaggaatccgatttagagagagaagtgtctgactcagaggcgggtgggggacctcagggagagcggaagaaccgatccagtaaaaaatcctcaagaaagggtcggacaagaagttcctcctcaagcagcgacggatctccagaggcaaaaggaggaaaagccggaagcgggagacgaggggaggaccacccagccgtgatgaggctcaagcgttacatccgcgcttgtggcgctcacagaaactacaaaaagctgctaggcagttgttgcagccacaaagagaggttgagcattctgcgggcagagctggaagctttaggtatgaaagggactccaagtttgggcaagtgccgggctctgaaggagcagcgtgaagaagccgctgaggtggcctctctggacgtggccaatatcatcagcgggagcggcagaccccgtagaagaacagcgtggaacccactgggagaagctgcaccaccgggtgagctctaccggcgaactcttgactcagatgaggagaggccacgccctgctcctcccgactggtcacacatgcggggaatcatctctagcgacggcgagtccaactag

SEQ ID NO: 23154 - DNA, 732 bp, Artificial Sequence
  Description of Artificial Sequence: Synthetic coding sequence
atggcccgtgagaaggagatgcaggaattcacaagaagcttcttccgcggacggccagatctgagtaccctcactcattcaattgtgagacgacgctacctagctcattccggaaggtctcacctggaacctgaagaaaaacaggctctgaagcgcctggtggaggaagaactgcttaagatgcaggtcgatgaggccgcatcacgagaggacaagctcgacctgacgaagaaaggaaagaggccgccaaccccctgtagtgatccggaacggaaaaggttcaggttcaactctgaaagcgccggatctggaagacggggtgaagatcatcccgcagtgatgaggctgaaaaggtatattagagcctgtggcgctcatcgcaactacaaaaaacttctcggctcatgttgcagccacaaggaacggttgagtatattacgcgcagagctcgaggctctggggatgaaaggaacaccatccctgggcaaatgccgggcactgaaagaacagcgggaggaggcagccgaggtggcatctctcgatgttgcgaacatcatctccggatctggtcggccaaggcgtcgcaccgcctggaacccattgggggaagctgccccacctggagaactctaccgacgaacgctggactctgacgaggagcgacctaggccggctcccccagattggtcgcatatgcgagggatcattagttctgatggagaaagtaactag

SEQ ID NO: 23155 - DNA, 1362 bp, Artificial Sequence
  Description of Artificial Sequence: Synthetic coding sequence
atggagcgggctccaccagacgggccactaaatgcgagcggtgccctggccggagaagcggctgcagccggtggtgcacgtggattctctgcagcctggactgcagtgctcgctgcccttatggcacttctcatcgtagctacagtcttagggaacgccctggtgatgttagcatttgtggcggacagctccttgcgcacccagaataactttttcctcctgaatctggccattagcgacttcctggtgggagccttctgcatccccctctacgtgccatacgttctgacaggtagatggacctttggacggggactgtgtaagctttggttagtcgtggattacctcctgtgcacatccagtgcgtttaacattgtactaatctcttacgaccgtttcctttcagtgacaagagccgtttcctaccgggctcaacaaggggatacaagaagggctgtgcggaaaatgcttctggtctgggtgctcgcgtttctgctgtatggccctgctattcttagctgggagtacctttctggcggttcatccattcccgaaggccattgctacgccgagttcttttacaattggtacttcctgattacggcctctacgttggagttctttaccccttttctctcagtcacattcttcaatctgtcaatctacctcaacattcagcgacgtactcggttgcgcctcgatggcgcacgagaggctgctggccctgagcctcctccggaggcccagcccagccctcctccacctcctgggtgctggggatgctggcagaagggccatggagaggcgatgcccctgcatagatacggggttggagaagccgctgtcggagctgaagccggagaagccacattggggggtggtggaggcggaggctcagtcgcttctccaacctcctcttcgggtagctcttccagggggaccgagcgcccaaggtcgctgaaacgcggaagtaaacctagcgcgtcatctgcctcgctggagaaacggatgaagatggtctcacaatcattcacccagagatttagactctctagagacagaaaagtggcgaaatcactggccgttattgtcagtatattcggcctctgttgggctccgtacaccctgctgatgattattagagcagcctgccacgggcattgtgtgccagactattggtatgagacgtccttttggctgctttgggccaattctgctgtcaaccccgtcctgtaccccctttgtcaccattccttcaggagggccttcacaaagctgctgtgtccccaaaagttaaaaatacagccgcatagcagcctggagcattgttggaaaaaaatgaagaaaaagacgtgcttgtag

SEQ ID NO: 23156 - DNA, 1338 bp, Artificial Sequence
  Description of Artificial Sequence: Synthetic coding sequence
atggagcgcgcaccacccgatgggccactcaatgcttctggcgcactcgccggtgaagccgcagcggcaggaggggctagaggctttagtgccgcttggaccgccgtgctggctgcattaatggccctgctgatcgtggccactgtgcttggcaacgcccttgttatgctggccttcgttgctgacagtagccttaggacccaaaataatttctttttgctgaatctggctatttcagacttcctggtgggcgctttctgcataccactgtacgtcccctatgtgcttactggcagatggacatttggtaggggactgtgtaagctgtggctggtggtagactacttgctgtgcacatcctccgcgttcaatattgtcctgatcagttacgacagatttctctcagtgacacgcgcagtgtcctacagagcccagcaaggggacacaaggagagcagtccggaaaatgctgcttgtatgggtgcttgcatttttgctctatggtcccgcaatcctgagctgggagtatctgtctgggggttcctctatccccgaaggacattgttacgccgaattcttctacaattggtacttcctcatcacagcgtccactttggagttctttacccctttcctgagcgtgactttctttaacctgtcaatctaccttaatattcagaggcggactcggctgaggctggatggggctcgggaagccgcaggaccagagcctccccctgaagcacagccaagtccaccccctccgccaggctgctggggctgttggcagaaaggccacggggaggcaatgcccttgcacaggtatggtgtgggtgaggccgctgtaggagcagaagctggagaggctacactcggtggaggcggtggcggtggcagcgtcgcctcccccacgtcctcttccgggtcatcttcacgcggaacagaacggcctcggtcactaaagcgcggtagtaagccaagcgccagtagcgctagtttagaaaagcgtatgaaaatggtgtctcagtcatttacacaacgattcaggctgtctcgggatcgaaaggtagccaaatccctggccgtgattgtatctatctttggactgtgctgggcaccctataccctattgatgattattagagctgcttgccacggacattgcgttcctgactactggtacgaaacttcgttttggctcctgtgggccaacagtgccgtgaatcccgtgctgtatccgctgtgccatcatagcttccgacgcgcttttaccaagctgctttgtccccaaaaactgaaaattcagcctcactccagcctagagcattgttggaaatag

SEQ ID NO: 23157 - DNA, 1248 bp, Artificial Sequence
  Description of Artificial Sequence: Synthetic coding sequence
atggagcgcgcaccccctgacgggccacttaatgctagcggggcactcgccggagaagccgctgccgcaggtggcgctcgcggtttctcagcagcatggacagccgtactggccgcactgatggcattgttaatagttgccaccgtgctggggaatgctctcgtgatgctcgcttttgtggcagatagtagcctgcggacccagaacaattttttccttctgaacttggctatcagcgacttcctcgtgggcgctttctgcataccactatatgtgccatacgttcttacaggtcggtggaccttcggtcgtgggctttgcaaactgtggctcgtcgtcgattatctgctatgtacctccagcgctttcaacatcgtgttaatcagctatgaccggtttttgtctgtaacacgcgctgtttcctaccgggctcagcagggggatactagaagagcggtaagaaaaatgttattggtgtgggttttggccttccttctctatgggccagccatcctgtcctgggaatacttgtccggcggttcaagcattccagaaggacactgctacgctgagttcttctataactggtacttcttgataactgcctctacccttgaattttttacacctttcctaagcgttacttttttcaatctttcaatctatctcaatatccaaaggagaacacgcctaaggttaaaggggcacggggaggctatgcccctccaccgctacggcgttggggaagctgctgtgggcgctgaagccggtgaagccacactcggtggcggtggcggtgggggaagcgtggcaagtcctaccagttctagtgggtcgagcagcagaggaacagaacgtccccgaagtcttaagagaggttcaaaacctagcgcttcctctgctagtctggagaaaaggatgaagatggtttcgcaatcattcactcagagattccggctcagccgagatcgcaaggtcgcaaagtcccttgcggtaattgtcagcatattcgggctgtgttgggccccttacactcttctgatgatcattagagcggcatgccacggacactgcgtgcctgactattggtacgaaactagtttttggctcctgtgggccaactccgcagtcaaccctgttctataccccctgtgccatcactcatttaggcgcgcattcacaaagctgctgtgcccacaaaaattgaaaatccagccccatagtagcttggagcactgttggaaatag

SEQ ID NO: 23158 - DNA, 396 bp, Artificial Sequence
  Description of Artificial Sequence: Synthetic coding sequence
atgtccggcagaggcaagcagggaggaaaggcgagggccaagtccaagagcaggagtagcagagccggtctgcagttccctgtgggcagaattcaccgtctactgcgtaaaggtaactacgccgagcgaatcggagccggagcacccgtgtatttagccgctgttctagagtacttgacagccgagattctggagttagctgggaacgccagtcgggataacaaaaaaacacggatcatcccccgtcacctgcagctggctatccgaaacgacgaggagcttaataaactgctgggcggagttactattgctcagggcggagtgctccccaacattcaagccgtcctgctgccaaaaaaaaccgagtcccatcatcacaaggctcagagtaaatag

SEQ ID NO: 23159 - DNA, 393 bp, Artificial Sequence
  Description of Artificial Sequence: Synthetic coding sequence
atgagcggacgtggtaagcagggcggtaaggccagagccaaggccaagacaaggtcctcccgggctggactgcaatttccggtcggcagggtacataggctgctaaggaagggcaactacgccgagagggttggagcgggtgcgccagtgtacctggcagctgtgctggagtacctgacggcggaaattctggagttagcgggaaacgctgctcgcgataataagaaaacaaggattatcccccgacatctccagctagcaatccgtaacgacgaggagctgaacaaattgctcgggaaggtaacaattgcccaggggggtgttttgcctaacatccaggccgtgctgttgcccaagaagactgaatcccaccataaggcaaaagggaagtag

SEQ ID NO: 23160 - DNA, 387 bp, Artificial Sequence
  Description of Artificial Sequence: Synthetic coding sequence
atgtccggaaggggcaagcagggtgggaaggccagagcaaaggctaaaaccagatcctcccgtgccggtctccagtttccagtgggacgggtccaccggctcctgagaaagggtaactatgccgagcgcgtgggcgcaggcgctcccgtgtatctggcagccgtattggaatacctgaccgcagagatattagagttagccggaaacgctgctagggacaataaaaaaaccaggattataccccgtcatctgcagctggctatccggaacgacgaggaattgaacaaactcctcgggaaagtgacgatagcccagggcggtgtcctaccaaatattcaggctgtactattgcctaaaaagaccgaaagccatcataaagcaaagtag

SEQ ID NO: 23161 - DNA, 381 bp, Artificial Sequence
  Description of Artificial Sequence: Synthetic coding sequence
atgcctgagcccgcaaaatccgcgcctgcccctaaaaaaggaagcaagaaagccgttactaaagcccagaaaaaggatggcaaaaagcggaaaagaagcaggaaagagtcttactcaatttatgtgtacaaagtccttaagcaagtccaccccgacacaggtattagctctaaagccatgggcataatgaatagtttcgtgaacgacatcttcgagaggatagccggagaggcttccagacttgcccactataacaagagatctacaattacctcacgagaaattcaaaccgccgttcgcctcttgctcccaggcgagcttgctaaacatgccgtgagcgagggcaccaaagccgtgacaaaatatacgagcgccaaatag

SEQ ID NO: 23162 - DNA, 381 bp, Artificial Sequence
  Description of Artificial Sequence: Synthetic coding sequence
atgcccgagcctgcaaaaagtgctcctgcccctaagaaagggtctaaaaaagctgtaactaaagcccaaaaaaaagacgggaaaaaaaggaagcgttcaaggaaggagtcgtatagcatttatgtctacaaggttctgaagcaggtgcaccctgatacgggcataagctcgaaggccatggggatcatgaactcatttgtcaacgacatcttcgaacgtatcgccggagaagcatccagacttgctcactacaataagcgtagcactataacatcgcgcgagattcagactgctgtacgcctgttactgcctggcgagctagcaaagcacgcggtgtccgaagggactaaagctgtgactaagtacacttctgcgaaatag

SEQ ID NO: 23163 - DNA, 381 bp, Artificial Sequence
  Description of Artificial Sequence: Synthetic coding sequence
atgcccgagcccgctaagtccgcaccagccccaaagaagggatccaaaaaggcagttacaaaagcccagaagaaagatggcaaaaagaggaaaagatcgcgaaaagagtcctattccgtgtacgtgtataaggtccttaagcaggtgcatcccgacacgggcatctcatcaaaggcaatggggattatgaactcctttgtgaacgatattttcgagcggatcgctggagaggcttctaggctggctcattacaataagaggtcaaccatcactagcagggagatccagactgcggtgagactgttgttgccaggggaactcgccaagcacgccgtgtctgagggcacaaaggctgtgactaagtatacttcagcaaaatag

SEQ ID NO: 23164 - DNA, 381 bp, Artificial Sequence
  Description of Artificial Sequence: Synthetic coding sequence
atgccagagcccgcaaaatcagcacccgctcccaagaagggatctaaaaaagctgtaactaaggcccagaagaaagatggcaaaaagcgaaaaaggagcagaaaggagtcctatagtgtatacgtgtataaagtgttgaagcaggttcatcccgatacgggcatctcctctaaagctatgggaattatgaactcctttgtgaatgacatctttgagaggatagctggagaagccagtcggctcgctcactacaacaagcggtccacaatcacatctagagaaatccagaccgctgtgcggctcctactgcctggtgagctggctaagcacgccgtttcagaagggacgaaagccgtgactaaatatacctccgctaaatag

SEQ ID NO: 23165 - DNA, 393 bp, Artificial Sequence
  Description of Artificial Sequence: Synthetic coding sequence
atgtcaggcagaggcaaacagggcggaaaggcccgagccaaggctaaatctaggtctagccgggcaggcctgcaattccccgtgggtagggtgcacagactgctgaggaaaggaaactatgctgaacgcgtaggcgcaggggctccagtatacatggctgccgtgctggaatacctgaccgccgagatcttggaacttgctgggaacgccgcacgagataacaaaaagacaaggatcataccaagacacttacagctcgccatcagaaacgatgaggagctgaacaagttgctcggcaaggtgacgatcgcccagggcggtgtgctacctaacattcaagcagtgttgttgcccaagaagaccgaatcacaccacaaggcaaagggtaaatag

SEQ ID NO: 23166 - DNA, 393 bp, Artificial Sequence
  Description of Artificial Sequence: Synthetic coding sequence
atgagcgggagaggtaaacagggagggaaggctagagcaaaggcgaaatctcgctcttcccgggcaggcttacagtttcccgtgggtagagtgcacagactgctgcgcaaggggaactacgcggaaagggtcggtgccggagctcctgtgtacatggcggctgtccttgagtatcttaccgccgaaattctcgagctggctgggaatgcagcaagggataataaaaaaacccgaatcatcccacgccaccttcagctggcaatcaggaacgacgaagagctcaataagctgctgggtaaggtgaccattgcccagggaggggtgctgccaaacattcaggcggtgctactccccaaaaagacggagtctcaccacaaggcaaagggaaaatag

SEQ ID NO: 23167 - DNA, 393 bp, Artificial Sequence
  Description of Artificial Sequence: Synthetic coding sequence
atgagcgggagagggaagcagggtggcaaagctagggctaaggccaaatccagatcctcgcgagcagggctgcagtttccggtagggcgagtgcaccggctgttgcgtaagggaaactacgccgaaagagtaggagcaggcgcaccagtgtacctggccgctgtgctggaatatttaacagcggaaatactggaactggccggtaacgcagcccgtgataataaaaaaaccaggatcattcctaggcatctgcaactggcagtccgaaacgacgaggaactgaacaagctactggggggagtgacaatcgcccaggggggagtgctgccaaatatccaggctgtgttgcttcctaagaaaaccgagtcacacaaaccaggaaagaataagtag

SEQ ID NO: 23168 - DNA, 381 bp, Artificial Sequence
  Description of Artificial Sequence: Synthetic coding sequence
atgcccgacccagccaaatctgcacctgcgcctaagaaggggtcaaagaaagcagtcacaaaggttcagaagaaggacggcaaaaagaggaaacggagcagaaaagagagctattcagtctacgtgtataaggtcttgaagcaggttcacccggacacaggcatctccagtaaagccatgggaattatgaactcgttcgtcaatgatatttttgaacgcatcgccggtgaggccagcagactcgcccactataataaacgatcaactatcactagcagggaaatccagacagctgttcgcctactgctgcccggtgaacttgcaaagcacgcggtaagtgaggggacgaaagctgtcacaaagtataccagctccaaatag

SEQ ID NO: 23169 - DNA, 501 bp, Artificial Sequence
  Description of Artificial Sequence: Synthetic coding sequence
atgccagatcccgcaaaatccgcccctgccccaaaaaaggggtcgaagaaagcggtcactaaggtccagaaaaaggatggcaagaagagaaagcgttctcgtaaagagagctattctgtctacgtgtacaaagtgctgaagcaggtgcatcccgatacggggatctctagtaaggctatgggtattatgaatagtttcgtcaacgacatcttcgagcggatcgcaggcgaagcatctaggctggctcattataataaacgctcaactattaccagcagagagatccagaccgccgtgcgattgctgctgccaggcgaacttgccaaacacgcagtgtcagaaggcactaaagctgtcacaaagtatacctcgagcaatcctcggaacctgtcacccaccaagcctggagggtcagaggaccggcaaccacctcccagccaactatccgctattcccccattctgcctggtccttcgcgctgggatcgccggacaggtatag

SEQ ID NO: 23170 - DNA, 405 bp, Artificial Sequence
  Description of Artificial Sequence: Synthetic coding sequence
atgccagacccagccaaaagcgcccctgctccaaagaagggatccaaaaaagcagtgaccaaggtccaaaaaaaggacggtaaaaaacggaagaggtcccgcaaggagagttatagcgtctacgtgtacaaggtgctgaagcaggtccacccagatacaggaatttcttcgaaagcaatgggtatcatgaattcctttgtgaacgacatattcgagcgtattgctggagaggccagtagactcgcgcactacaacaagcgtagtacaataacaagtcgagagattcagaccgccgtgcgcctgcttctgcccggtgaactcgccaaacatgccgtgagtgagggcactaaggctgtgaccaagtacacatcctctaaattgatcggccctatcttatggaagtag

SEQ ID NO: 23171 - DNA, 411 bp, Artificial Sequence
  Description of Artificial Sequence: Synthetic coding sequence
atggccagaactaagcaaaccgctagaaaatcaaccggtgggaaggccccaagaaagcagctggctaccaaagccgctcggaagtctgccccagcaaccggaggcgtgaaaaaaccacataggtatcgcccaggaacagtggccttgcgcgagataaggaggtaccagaaatctaccgagctgctgattcgcaaactaccattccagaggctagtacgggaaatcgcacaagaatttaaaactgacctgcgatttcagtcatcggccgtcatggccctgcaggaggctagagaagcctacctcgtgggcttgttcgaagatacaaatctctgtgcaatccatgcaaagagagtcaccattatgcctaaagatattcagctcgtgtccaggatacgaggggagcgcgcttag

SEQ ID NO: 23172 - DNA, 393 bp, Artificial Sequence
  Description of Artificial Sequence: Synthetic coding sequence
atgagtggcaggggtaagcagggagggaaagcgcgagccaaggcaaagagtaggtcttcccgcgctgggttacagtttcctgtcgggagagttcacaggctgctgcggaaaggcaactactctgagagggttggcgctggggcacccgtttatttggcggctgtgcttgaatatctcacagccgagatcctggaactggctgggaatgcagctcgggataataaaaagacccggattattccaagacacctgcagctggccatccggaacgacgaggagctgaataagcttctgggcagggtgacaattgcacagggtggagtattgcctaacattcaggctgtccttctgccgaaaaaaacagaatctcaccacaaggcaaaggggaaatag

SEQ ID NO: 23173 - DNA, 381 bp, Artificial Sequence
  Description of Artificial Sequence: Synthetic coding sequence
atgcctgatccatctaagagcgcccctgcccctaagaaaggctccaagaaggcggttacaaaggcccagaaaaaagatggtaagaagcgcaaaagggggagaaaggagtcctacagcatttacgtgtacaaggtgctaaaacaagtacatccagacactggaatatctagcaaggccatgggcatcatgaattcttttgtcaacgatatttttgagcggatagcaagtgaggcttctcgcctggcccattacaacaagcggtcaaccattacttcaagggaggtgcagacggcggtgaggctgcttctgccgggtgaactggccaaacacgcggttagcgaaggtaccaaggccgtaaccaaatacacatccagcaaatag

SEQ ID NO: 23174 - DNA, 1554 bp, Artificial Sequence
  Description of Artificial Sequence: Synthetic coding sequence
atgccccctcctggtaaggtgccaaggaaggaaaatctgtggttacagtgtgagtggggaagttgctcatttgtttgttccaccatggaaaaattttttgaacacgtcacccagcacctacagcagcatctccatggttctggcgaagaggaagaagaggaggaagaggacgaccctctcgaagaggagttcagctgtctgtggcaggagtgtggcttttgctctctggatagtagtgcggatctcattagacatgtgtatttccactgctaccacactaaattgaagcagtggggcctgcaagctctccagtcccaggcagatctgggaccctgtatattagacttccagtctcgcaacgtcatcccggatatacccgaccatttcctgtgcctgtgggagcattgtgaaaactcattcgataaccctgagtggttttacaggcacgttgaggcccattcactctgttgcgagtatgaggccgtagggaaggacaatcccgttgtcctgtgtggatggaaaggctgcacctgtaccttcaaggaccgtagcaagttgagagagcacctcagaagccacacccaagagaaagtcgtggcatgtccgacgtgtggtggaatgtttgcaaacaatacaaaatttttggaccacatacgccgtcagacctcactcgatcagcagcattttcaatgcagtcactgtagtaagcgatttgccactgagagactcttgagggatcatatgaggaaccacgtcaatcattacaaatgcccactgtgcgacatgacctgtccattaccctcctcccttcggaaccacatgcggttccgacactctgaggatagaccctttaagtgcgactgttgcgattattcatgcaaaaacttaatcgatctacaaaagcatttggacacccattccgaggagcccgcttatcggtgcgattttgagaattgcacattttccgccaggtccctgtgttccattaaatctcactaccggaaagttcatgagggagatagtgaaccacggtacaagtgtcacgtttgtgataaatgttttacgcgtggcaataaccttaccgtgcatctgcggaagaagcaccaattcaaatggcctagtggacatcctagatttaggtacaaggaacacgaagacggctacatgcgactgcagctcgttcggtacgagtcagtcgaactgactcagcagctgctgaggcaaccacaggaagggtccggcttgggtacctcactgaacgaatcgtcattgcaaggcattattttggagacggtcccaggagagccgggacgtaaggaagaggaagaagagggaaaggggagcgaaggcactgccttatcagcttcacaggacaacccgagctccgtgatccatgtggtgaatcagacaaacgcgcaggggcagcaggaaattgtgtactacgtgctttcagaggcacccggtgaaccaccgccagcaccagagccgcctagcgggggtataatggagaaactgcagggcattgcagaggaacctgagattcagatggtttag

SEQ ID NO: 23175 - DNA, 1260 bp, Artificial Sequence
  Description of Artificial Sequence: Synthetic coding sequence
atgcctccgcctggcaaggtgccacgaaaagagaatctgtggctgcagtgtgaatggggctcatgttcattcgtttgctccacaatggagaaattttttgagcacgtgacacagcaccttcagcagcacctacacgggagtggcgaagaggaggaggaagaagaggaggatgatcctttggaagaggagttttcatgtctatggcaggaatgcgggttttgtagtctggattcttcagctgacctgattcgccatgtgtattttcattgctatcataccaaactgaaacagtgggggttacaggcactgcagtctcaggccgatctgggcccttgcatcctcgacttccaatctagaaatgtgatcccagacatccctgaccactttctgtgcctgtgggaacactgcgaaaatagctttgacaaccccgaatggttttacagacatgtcgaagcccatagcctttgctgcgagtacgaggccgttggcaaggataacccagtggtcttgtgtggatggaaaggctgcacttgtaccttcaaggaccgcagtaaactgagagaacatctcagaagtcatacacaggagaaagtggtggcctgcccaacctgcggcggtatgtttgctaacaacaccaaattcctggaccacattcgccgacagacatctttagaccagcagcattttcagtgcagccactgctccaaacgcttcgctactgaacgcctgctccgggaccacatgcggaatcatgtgaatcactataagtgcccgctctgcgacatgacctgtcctctgccgagctccctgcgcaaccacatgcgatttcgtcattccgaggaccgacccttcaagtgcgactgctgtgattattcttgcaagaacttaatcgatctgcagaaacatttggatacccactcagaggagcccgcttaccgctgtgattttgagaattgcacctttagcgcacgcagtctctgctccatcaagtcgcactacaggaaagttcacgagggcgactctgaaccgcgttataagtgtcacgtgtgcgacaagtgtttcacccgcggtaataatctcactgtacatctgcggaagaaacaccagttcaagtggcccagcgggcaccctcgcttcagattaggccacttttgtatccctttgccaggctttgctgctctgtacgcaccaactagccctggcacacggaatatgaagatggccatttgtgggtgctcctggttcgcgaccagggtctag

SEQ ID NO: 23176 - DNA, 306 bp, Artificial Sequence
  Description of Artificial Sequence: Synthetic coding sequence
atgaatcttgaacgcgtaagcaacgaggagaagctgaacctttgtagaaagtactatttggggggattcgcctttctgccctttttatggttggttaatatcttttggttttttcgggaggcctttctggttccagcatataccgagcagagccagataaaggggtatgtatggcggtccgccgtggggttcttattttgggtgatcgtgctgacctcctggatcaccatcttccaaatttatcggcctagatggggagccttaggagattacctctcttttacaatccccctcggaactccctag

SEQ ID NO: 23177 - DNA, 1749 bp, Artificial Sequence
  Description of Artificial Sequence: Synthetic coding sequence
atggccgcagcggcaggcggaggttcctgccccggaccaggaagcgcacgcggtagattccccggacgaccacgcggagctggagggggagggggaagaggaggcagaggcaacggagccgagagagtgagagtagctttgcgcagggggggaggagctacagggcctggaggagccgaaccaggagaagatacagctcttctgagattgctgggactgcgtcgaggattgaggagattaagacgtttatgggcgggacctcgagtgcagcggggtcgcggaagggggagaggaagagggtggggaccctcgcgcggatgtgtgcccgaagaggaatcgtctgatggcgaatctgatgaggaagagttccagggatttcacagtgatgaagacgttgcacccagctccctcaggagtgctctgcgcagccagagaggtcgggcacccaggggacggggtcgaaagcataagaccacgcccctcccccctcctaggctggccgatgtggccccaactcctccaaagaccccagcacgcaagaggggtgaggaggggacggagaggatggttcaggcccttaccgagttgctaaggcgggctcaagcccctcaggctcctagatctagggcttgcgaacctagcaccccacgcagaagtagaggtcgacctcccggacgtcccgctggtccctgcaggcggaaacaacaggctgtagtcgttgcagaagcagccgtgactatacccaagcccgagccacccccacctgtcgtgcccgtcaagcatcagacagggagttggaagtgcaaagaggggccaggaccaggacccggaaccccaagacgaggaggtcagagctcccgagggggacggggaggtagaggtaggggacgcggaggcggtctccctttcgtgatcaagttcgtgagtcgcgcaaaaaaggtgaagatgggtcaacttagcctcggcctggaatctgggcaaggccagggacagcatgaagaatcctggcaggacgtgccacagcggcgagtgggatcaggtcaaggcggaagtccttgctggaagaagcaggagcagaaactggatgatgaagaggaagagaaaaaagaggaagaagagaaagataaagagggcgaagagaaagaagaacgcgcagtcgccgaggagatgatgcctgccgctgaaaaggaagaagccaaattgcctccacctcccctgacaccacccgcaccctcacctcccccaccactgccgccaccctccacgtccccacctccacctctttgccctcctccgccaccccctgtctctccccctcccttaccttccccaccccctcctcccgctcaggaagagcaagaggaatcacccccaccggtcgtgcctgcgacctgctctcggaagagagggcgtcctcctttgacaccatcccagagagccgagagagaagcagccagagccggacctgaggggaccagtccgcctacgccaacccctagcactgccaccggcggaccccctgaggattcgcctaccgtcgcccctaagagtacaacattcttgaaaaacattcgccaatttattatgccagtgccactgagtcagagccttcttctaccaatgaccttgcagttgagcttgtcccttggtcaatgggcggcacccaccacatcagcttgcctggatagcccactgtggtctcctttgctactcaggccaagatgtccattgaccggattgcagttatag

SEQ ID NO: 23178 - DNA, 8147 bp, Artificial Sequence
  Description of Artificial Sequence: Synthetic coding sequence
atggccgcagctgctggtggtggcagctgccccggtccaggaagtgctcgtggcagattccccggtcggccaaggggtgccggagggggaggcggtaggggcggtcggggaaatggggcagagagggtcagagtcgctctccggcgtgggggaggggctaccggacctggtggcgcagagccgggagaggatactgctctcttgcgtttgctcggtctcaggcggggtctcagacggctgcggaggctgtgggctggccctagggtgcagcggggtcgcggtcggggtcggggacgcggatggggcccaagtagaggatgtgtgcccgaggaggaaagctccgatggtgagtccgacgaggaggaatttcaaggcttccacagtgacgaagacgttgccccatctagcctgaggtccgccctgcggagccagagaggtcgcgctccccgaggcagaggaagaaaacacaaaactacccctctgccccctcccagactggccgacgtggcacccaccccacctaaaactccggcaagaaagagaggagaggaaggcacagaacgcatggtacaagctctgaccgaactcctgcgcagagcacaggcgcctcaggcccctagaagtagagcctgtgagccttctacaccacgcagatctcgaggcaggcctccagggcgtccggctgggccttgccgacgcaaacaacaagctgtcgtggtcgccgaggccgcagtgaccatcccaaagcccgaacctccaccacccgttgtgccagtaaagcatcagacaggttcttggaagtgcaaagagggaccaggccctggcccaggcactccacggaggggcggacagtcaagtagaggaggcaggggaggccgagggaggggtcgtggcggtgggctgccattcgtgatcaaatttgtgtctagggccaagaaggtcaaaatgggccagctgtccctgggcctggaaagtggacagggacaaggtcaacatgaggagagctggcaggacgtgcctcaacgacgagtcggtagcggccagggtggctccccatgctggaagaaacaggagcagaaattggatgatgaggaggaggaaaaaaaagaagaggaggaaaaagacaaagaaggcgaggaaaaggaggagcgtgctgtcgctgaagagatgatgccggcagcagagaaagaggaggccaaactgcctccaccgccactaactccgcctgcgccatcaccccctccccctctgccacccccatctacttcccctccccctccactttgcccacctccgccacctcctgtgtcgccccctcccttaccatccccaccacctccccctgcccaagaggaacaggaggaaagcccccctcccgtggtaccagcgacgtgcagtagaaaaagggggaggcctcctttgaccccctctcagcgcgctgaaagagaagcagctcgggctggcccagagggtacctccccacctacacctacgcctagcaccgccacagggggacccccagaagattctcccaccgtggctccaaagagtaccacttttttgaagaacatcagacagtttattatgcctgtggtcagcgccagaagctccagagttatcaaaactcctcgccgttttatggacgaggaccctcccaagcctcctaaagtcgaagtcagtccagtgttgcgaccccctatcactacatcaccccctgtgccacaggagccagctccggtccctagtccacctcgggcaccgaccccaccaagcactcccgtcccgctcccagagaagaggcgctcaattctgcgagagcccaccttcaggtggacctcattaactcgcgaactgccaccacctccccctgcgccaccccctccaccagccccatccccaccaccggcacccgcaacatcctccagacggccacttctgcttagggcacctcagtttactccttcagaagcacacttgaaaatttatgaatcagtgttgacgcccccacctcttggcgctcccgaagcgccagagcccgaaccgccacccgctgatgattcccctgctgaaccagagcccagggcagtggggaggactaatcatttatccttaccacgatttgccccagtcgtgactactccggtgaaagctgaggtgtcccctcatggcgctcccgcactgagcaacgggcctcagacccaagcccaactgctgcagccactgcaggccctgcaaactcagctgctgcctcaggcccttcctcctccacagccccagttgcagccccctcccagtccccagcagatgcctccactcgaaaaggctcggatcgccggagtgggcagtctcccactgtctggggttgaggagaagatgttttcactgttaaaacgggctaaggtacagctttttaaaatagatcagcagcaacagcagaaagtggccgcaagcatgccactgagtccaggaggccagatggaagaggtggccggagctgtgaagcagattagtgacaggggaccagtgagatctgaggacgagagcgtagaagcgaaacgggagcgcccatctggccctgagtcccctgtccagggaccacgtatcaaacatgtgtgccgccacgccgcagtggccttagggcaggcccgtgctatggtaccagaggacgtgcctagactaagcgcattgccgctgcgcgaccggcaggacctggcaaccgaggacacatccagtgcgtccgaaacggagtctgtgccgtctagatcccgtcgtggcaaggtggaagcagctggcccaggcggagagagtgaaccaacaggctcaggaggcactttagcccacacgccaaggaggagcctcccctcacaccacggcaagaagatgagaatggcacggtgtggtcattgccgcggatgccttagagttcaggattgcggttcgtgtgtgaattgtctcgacaagcccaaattcggtggacccaataccaaaaaacagtgttgtgtctatcgcaaatgcgataagatcgaggcaagaaaaatggaaaggctagcaaaaaagggaaggaccatcgtcaagacgctattaccttgggactccgacgagtcccccgaggcctcacccggaccacctggccctcgccgaggagcgggagccggtggccctcgggaggaggtcgtcgcccatccaggaccagaggaacaggactccctcctacaacggaaatcagctcgtagatgtgtgaagcagcgccctagctatgacatctttgaagattctgacgactctgaacccggaggccctccggctccaaggcgcagaacccccagagagaatgagctgccgctcccggagcctgaagagcagagtcggcctaggaaacctaccctacagcctgtgctgcagttgaaagcgcgaagacgcttagacaaggacgctctagctcctggcccatttgcgtcattccctaacggctggactggaaaacagaagtcgcccgatggtgttcatcgagtgagagttgactttaaggaagactgtgacctcgagaacgtgtggctcatgggtggcctgtccgttctcactagtgttcctggcggaccacccatggtatgtctattatgcgctagcaaagggttgcatgagcttgtcttttgccaggtgtgctgcgatcccttccaccccttctgtctggaagaagctgaacggccactccctcagcatcacgacacctggtgttgccgcaggtgtaaattctgtcatgtgtgtggcagaaagggcagggggagtaagcacctgctcgagtgcgaaagatgtagacatgcctatcatcccgcttgcttgggtccatcctatccaacacgagccacacgaaaacgcagacactggatctgcagcgcttgtgtccgatgcaagtcatgcggagccaccccagggaaaaattgggatgttgagtggagtggagactatagcttgtgcccgaggtgtactcagctgtatgaaaaagggaactactgcccaatctgcacccgctgttatgaggacaacgattacgagagcaagatgatgcagtgtgctcaatgtgatcactgggtacatgcaaagtgtgagggcctgagtgatgaagactacgagatccttagtggcctccccgattctgtactttatacctgtgggccatgcgccggagcagcacagcccagatggcgagaggcactgtcgggagcactccaggggggtctgcgacaggtgcttcagggactactatccagcaaagttgtggggccactgctgctgtgcactcagtgtgggccagatggcaaacagctgcatcccggaccatgtggcctgcaggctgtgagtcagagattcgaagatggtcactataaatcagtgcactctttcatggaggacatggtcggaattcttatgcggcactccgaggagggtgaaacccctgacagacgggctgggggacagatgaaggggctgttgctcaagctcttggaaagcgcctttgggtggtttgatgctcatgaccccaaatactggagacggtctactagactcccgaacggcgtgcttccaaacgccgtactccctcctagcctggaccacgtctacgcccaatggcggcagcaggagcccgagacccccgaatcaggacagcccccaggagaccccagcgcagcctttcaaggcaaggaccctgctgccttctcccacttggaggatcctcggcagtgtgccttgtgcctcaagtacggcgatgcggacagtaaggaagcaggacgtctcctctacatagggcagaatgagtggacacatgttaactgcgccatttggtctgctgaggtcttcgaagagaatgacggcagcttgaagaacgtgcatgcggcagttgccagaggtcggcagatgagatgtgaactgtgtcttaagcctggagctaccgtgggttgttgtcttagctcctgcctatctaattttcatttcatgtgcgccagagcttcctactgcatatttcaggacgacaaaaaggtgttttgccaaaagcatactgatctactggatgggaaagaaatcgtgaacccagacggtttcgacgtgctacggagggtatacgttgactttgaagggatcaacttcaagcggaaattccttactgggcttgagccagacgccatcaacgtgctcattgggtctattcggattgactccctcgggactctgtccgacctttctgactgcgaaggcaggctattcccaatcggataccagtgctcaaggctttactggagtaccgtcgacgcccgtcgacgatgttggtatagatgcaggattctggaataccggccttggggcccacgcgaggaaccagcccatctggaggcagcagaagaaaaccagaccatcgttcactcccccgcaccttcttcagagccaccaggcggagaagatccccctctggacactgatgtcctcgtcccaggcgctccagaacggcactctcctattcagaacctggacccacctttgcgcccagattccggaagtgccccaccaccggctcctcgcagctttagcggcgctagaataaaagttcccaactatagtccttcgagacgcccactcggaggagtaagcttcggaccattgccttctcccggaagtccgagtagcctaacacatcacataccaactgtcggagatcccgactttccagcacctcctcggagaagcaggcgcccttcaccgctagcaccacgcccacccccatctcggtgggcttctccaccactgaaaaccagtccacagttaagagtcccccctcccacaagtgtggttactgctctgacacccacttccggagaactcgcccctcctggccctgccccaagcccccctcctcctgaggacctggggcctgatttcgaggatatggaagtggtgtctgggttgtctgccgctgacttggactttgctgcttcattactcggcaccgagccattccaggaagaaattgtggctgccggtgctatgggatccagtcatggtgggccaggggactccagcgaagaggagtcgagccctaccagtcggtatatccactttcccgtgaccgttgtgagcgcaccaggcctggccccaagcgccacaccaggcgcacctaggatcgagcagctggacggcgttgatgacggtacagactctgaggcagaggccgtccagcaacccagaggacaaggcactcccccatcaggaccaggagtggtacgcgctggggttctgggggcagccggagaccgcgctcgcccacctgaagaccttcccagcgaaattgtcgattttgtcctgaagaacttgggagggcctggcgacggcggagcaggacccagggaggagtctctgcctccagcccctcccctggctaacggctcacagccctcccagggactcaccgccagtcccgctgaccccacccgcactttcgcttggctgccgggtgctccaggggtgcgcgtcctgtccctgggacctgccccagagccgcctaaacctgcaacctctaagattattcttgtcaataaactgggccaggtatttgttaagatggcgggagagggcgagccagtcccccctccggtgaagcagccccctctgcctccaaccattagccctacagcaccaacatcttggacacttcccccagggcctctactcggtgtgttgcctgtggtgggcgtggtgagaccggctcctccccctccacctcctccacttacgcttgtgctgtcaagcggtcccgcttccccccctcgacaggcaattcgcgtgaagagagtgagcacctttagcggcaggagtccacccgctccccctccctacaaagcccctagattagacgaagacggtgaagcatccgaggacaccccacaagtaccaggacttggctccggcggattctcacgcgtgcgaatgaagacccccacagtgaggggcgtgttggacctggatagaccaggagagccagcgggtgaggagtctcccggaccactccaggaacgatcccctctcctcccgctgccagaggatggaccaccccaggtacctgacggaccccctgatctgctgctagagtcccaatggcatcattactcaggcgaggccagtagtagcgaggaggagccccctagcccagatgacaaagaaaaccaggctcccaagagaactgggccacacctcagattcgaaatatccagcgaagatgggtttagcgtggaggcagagagcctggaaggtgcctggcgcaccctcattgagaaggtccaggaagcacgaggccatgccaggttaagacacctctccttctcgggcatgtctggggctcggctgctcggtattcatcacgatgccgtgatctttctggccgaacaactcccgggagcccaaagatgccagcactacaagttcagatatcaccaacagggggaggggcaggaagaacctccgctgaacccacacggcgcagctagggcagaggtctatctgcgaaaatgtacgtttgacatgttcaacttcctggctagtcaacatcgtgtgcttccagaaggcgctacatgcgacgaggaagaggatgaggtacaacttcgctctacccgacgtgccacctccttagagctgcctatggcaatgcgcttcagacatctgaagaaaacctcaaaggaagccgtcggtgtgtaccggagtgctattcacgggagggggctcttctgcaagaggaatatagatgcaggggagatggtgattgagtactcaggtatcgtgatccgatccgtgctgactgataagcgtgagaaattttatgacggtaagggaattggctgctacatgtttcgcatggatgactttgacgttgtcgacgcgacgatgcacggaaatgcagctagattcattaaccactcttgtgaacctaactgcttttctagggtgatacacgtggagggccagaaacatatagtcatctttgctctgcgcagaattctgcgaggagaggaactcacttatgactacaagtttcctatcgaggatgccagcaataaattaccgtgtaactgcggagccaagagatgcaggagatttctgaatta

SEQ ID NO: 23179 - DNA, 2892 bp, Artificial Sequence
  Description of Artificial Sequence: Synthetic coding sequence
atggctgtcgccccaagattatttggcggtttgtgctttaggtttcgggaccagaacccggaagtggcagtggaagggagactcccaatttctcacagttgtgtgggctgccggagagaaagaaccgccatggcgaccgtcgcagcaaatcccgcagctgccgctgctgccgtcgcggcagccgctgccgtcacagaggatcgcgagccacagcacgaggagcttccgggactggactctcagtggaggcaaatcgaaaatggtgagagtggcagagagagaccattacgcgcaggagaaagttggtttctggttgaaaagcattggtacaagcaatgggaagcctacgttcaggggggagatcaggactcaagcactttccctggctgtatcaataatgcgactcttttccaggacgaaatcaactggcgcctgaaagaaggactggtagagggggaggattatgtgctcctgcccgctgccgcatggcactacctggtctcctggtatggtcttgagcacggtcagccacccattgagcggaaggtgatagagctgcccaatattcagaaagtagaggtgtatcctgtcgaactactactggttagacacaacgacctagggaagtcccacacagtgcagttttctcacacagatagtattggtctggtcctgagaactgcacgtgagagattcctggtggagcctcaggaagatacccgcctgtgggcaaagaactcagaagggtcgttggatcgtctctacgacacccatatcacagtgctggatgccgctctggaaacggggcagctcatcattatggagacccgcaaaaaagacgggacatggccctctgctcaacttcatgtgatgaataacaacatgagtgaagaagatgaggattttaaagggcagcctggcatctgtggcctgacaaacctgggtaatacctgttttatgaattccgctttgcaatgcctttccaacgtcccacaacttactgagtacttcctgaataattgctacttagaggaactcaacttcaggaatccgctggggatgaagggcgagatcgctgaggcatatgccgatctggtgaagcaggcatggagcggccaccacaggtctattgtgccacacgtcttcaagaataaggtcgggcattttgccagccagtttttgggatatcaacaacacgactctcaagagctgctgagctttctgctggacggactccacgaggacttgaacagagtcaagaaaaaggaatacgtggaactgtgtgacgcggcagggaggcccgaccaggaggtcgcacaagaggcgtggcagaaccacaaaagacgaaatgactctgtgatcgtcgacacatttcacggcttattcaagagcacattggtgtgccccgattgcggcaacgtgtctgtgacattcgatcctttctgttacctttctgtcccactgccgatatctcacaaacgagtgctcgaagtgttctttatccccatggacccgagacggaagccagagcagcaccgcttggtcgtcccgaaaaaaggtaaaatcagtgatctctgtgtcgccttgtccaaacacacaggaatcagtcccgagcgaatgatggtcgcggatgtgttttcccacagattctacaaactctaccagctggaggaacccctgagcagtattctcgaccgggacgatattttcgtttacgaggtcagtggccgtatcgaagcgattgaagggagccgagaggacattgtcgtaccggtatacttaagggagcgcactcctgccagagattacaataatagttactatggtctaatgctgttcgggcatcccctactcgtctcggtccctcgggaccgattcacatgggaagggctgtacaacgtccttatgtaccgcctcagcagatatgtgaccaagcccaatagcgatgacgaggacgatggagatgaaaaagaggatgacgaagaggacaaagacgatgttcccggaccatctacaggcggttcactcagagatcctgaaccggaacaagccggtcccagctctggggtcacaaatcggtgtccctttctgctggataattgcctcggtaccagccagtggcctccacgaagacggaggaagcagctgttcactcttcagacagtgaattcgaatggaactagcgatcggactaccagtcccgaggaagtgcacgcgcagccttatatcgcaattgattgggagccggagatgaagaaaagatattatgatgaggttgaagcagagggttatgtaaagcacgattgcgtaggctatgtcatgaaaaaggcccctgtacgtcttcaagaatgcattgaactgttcacaaccgtggaaacacttgaaaaggagaatccttggtattgtccttcctgcaaacagcaccaactagcgacaaagaagttagacctgtggatgcttcctgaaattctcatcatacacttgaagagattctcttacacgaagtttagtagggagaagctcgacacgctcgtggagttccctattcgcgatctggacttttccgaattcgttatacaacctcaaaacgaaagcaatcccgagttgtataaatacgatctgattgctgtcagtaaccattacggaggtatgcgggacggacattacaccacattcgcctgcaacaaggattccggccagtggcattacttcgacgataattccgtgagcccggtcaatgagaatcaaatcgagtctaaggccgcatatgtgttattctatcagaggcaggatgtcgccaggcggttactatcacccgctggatcatcgggtgcaccagcgtccccggcatgcagctctccaccctcaagtgaattcatggacgtgaactag

SEQ ID NO: 23180 - DNA, 2166 bp, Artificial Sequence
  Description of Artificial Sequence: Synthetic coding sequence
atgtctggtactaatcttgacgggaatgatgaatttgatgagcagcttcgaatgcaggagctctacggtgacggcaaagacggggacacccagactgacgcaggaggtgagccagactctctcggccagcagcctacagacacaccctacgagtgggatctggataaaaaggcatggtttcctaagatcaccgaagattttatcgcgacatatcaggcgaattatggtttttctaacgatggagccagtagctccacagcgaacgtggaggatgtgcacgccagaaccgcagaagaaccaccacaggagaaagcacccgagcccacagatgcccgtaagaaaggtgaaaagcgcaaggcagaaagcggatggtttcatgtcgaagaggatagaaacaccaacgtgtacgtcagcggcttgcctcctgatataaccgttgatgagttcatccagttgatgtctaagttcggtatcattatgcgagatccacagacagaagagtttaaagtgaaactgtataaagacaaccaaggcaacctgaagggggatggcttgtgctgctacttgaaaagggagtctgtcgaactcgctttgaaattgctcgacgaagatgagattcgcggttacaagctgcatgtggaggtagccaaatttcaactaaagggggagtacgatgcaagtaagaaaaagaagaagtgcaaggattacaaaaaaaaactgtctatgcaacaaaagcagctggactggcgcccagaaagaagagcaggcccttcccgaatgcggcacgagcgcgtggttatcatcaaaaacatgttccaccccatggatttcgaagacgatccccttgtcctaaacgaaatccgagaggacctgagagtcgaatgtagcaagttcggtcaaatccggaaactgctgttatttgatcgccacccggacggggtggccagcgtgtccttcagggacccggaggaggcagactattgtatacaaacactggacggccgttggttcggaggaaggcaaattacagctcaggcttgggatggcaccaccgactatcaggtcgaggaaacatcaagagaaagagaggagcggctgaggggctgggaggccttccttaatgcacctgaggcaaacagaggcctgaggagaagtgacagcgtcagtgcaagcgaacgcgcaggaccttctcgtgctcgccacttctctgagcaccccagcaccagtaaaatgaatgcccaagaaacagcaactggaatggcctttgaggaaccgatcgacgagaaaaaattcgaaaagaccgaagatgggggagaattcgaggagggcgcaagcgagaataacgcaaaagagtctagcccggagaaggaggcagaagaaggctgccccgagaaggaatctgaggaaggctgtccaaagcggggttttgagggcagttgctctcagaaagagagcgaagaagggaaccccgtgcgtggaagtgaagaagacagccctaaaaaagagagcaagaagaagacactgaaaaatgattgtgaagagaatgggcttgctaaggaaagcgaggacgacttgaacaaggaatctgaagaggaagtgggacccaccaaagaatccgaggaagatgatagcgagaaagagtccgacgaggactgttcagaaaagcagtcagaagacggatctgagagagaatttgaggagaatggtctggaaaaagaccttgacgaagagggcagcgaaaaagagttgcatgagaacgttctcgataaggagctagaggaaaacgactcagaaaatagcgaattcgaagacgacgggagtgagaaagtgcttgatgaggagggcagcgaacgtgagttcgatgaagatagcgacgagaaggaggaagaggaggacacgtacgagaaggtgtttgatgatgagtctgacgagaaggaggatgaggatgcggatgggaaggaagtggaagacgccgacgagaaattgtttgaggacgatgacagcaatgaaaagctcttcgatgaggaggaagacagttccgagaaattgtttgacgattctgatgagcgcggaactctaggcggatttggctcagtcgaagaagggccactaagcaccggcagctcattcattctttcaagtgacgacgacgacgatgatatctag

SEQ ID NO: 23181 - DNA, 672 bp, Artificial Sequence
  Description of Artificial Sequence: Synthetic coding sequence
atgtcaggcactaatttagacggcaacgatgagtttgacgaacagctgcgtatgcaggaactgtacggtgacggaaaggatggggacacccagacagacgctgggggagagcccgattctctcgggcagcagcctacagacaccccatacgagtgggaccttgacaagaaggcatggttcccgaaaatcactgaggacttcattgcaacataccaggctaactacggcttttccaacgatggggcttcctcgtcaacagccaacgttgaagacgttcacgcgcgaactgccgaagagcctccacaggagaaggcccctgagcctaccgacgcccgtaaaaagggggagaaaagaaaggccgagagtgggtggttccatgtcgaggaggataggaatacaaacgtgtatgtgagtggtttgccccctgatatcaccgttgatgagttcatacagctgatgtcgaagtttggaatcattatgagagatccacagactgaggaatttaaggtgaaattatacaaagataatcagggtaatctcaaaggtgacggactctgttgctacctcaagagggagtccgtggaactagcccttaaacttctggacgaggatgaaattagagggtataagctgcacgtagaggtcgccaaattccagttaaaaggtgagtag

SEQ ID NO: 23182 - DNA, 735 bp, Artificial Sequence
  Description of Artificial Sequence: Synthetic coding sequence
atgtccggaactaatctggatggcaacgatgaatttgatgaacagctgcggatgcaagagctgtacggtgacgggaaggatggcgacacccagacggatgcgggaggtgaacccgattctctgggtcagcagccaactgatactccctatgagtgggatttggataaaaaagcctggttccctaagatcactgaagatttcattgctacctatcaggcaaactacgggtttagtaacgatggggcttcgagttccaccgccaatgtggaggacgtgcatgcacgcacagcggaagagccccctcaagagaaagctcctgagcccacggatgcacggaagaagggcgaaaaacgtaaggcggagtcaggttggtttcacgtggaagaagaccggaacacgaacgtgtacgtttcgggcttgccaccagacatcacagtggacgaattcatccagctgatgtcgaagtttggcattattatgagagatccccagaccgaagagtttaaggtcaagctgtacaaggacaatcagggcaacttgaaaggcgacggactgtgctgctatctgaaacgcgagagtgtggaacttgctcttaaactgcttgatgaggacgaaatacggggatataaattgcatgtcgaggtggcgaaattccagttgaaaggggaatacgatgcatcaaaaaagaaaaagaaatgcaaggactacaagaaaaagctatccatgcagcagtag

SEQ ID NO: 23183 - DNA, 2268 bp, Artificial Sequence
  Description of Artificial Sequence: Synthetic coding sequence
atgagcggaactaacctggacggcaacgacgaatttgatgaacaactgaggatgcaggaactgtatggtgatgggaaagacggtgatacacagaccgatgcaggaggtgaacccgatagcctggggcagcagccaacagataccccttatgagtgggaccttgataaaaaagcctggttccctaagataactgaggatttcattgctacctaccaggcaaactacggtttctctaacgacggagcatcctcaagcaccgccaatgtggaggatgtccatgcccgtactgctgaggagccgcctcaggagaaggcccctgagcctacagacgcaaggaagaaaggggaaaagcgcaaggccgagtcaggctggtttcatgtagaggaggatagaaacactaatgtgtacgtgagtggtttaccgcctgacataacagtagatgaatttatccagctcatgtccaagttcggcatcataatgcgcgatcctcagaccgaagaatttaaagttaaactctacaaagataaccaagggaaccttaagggggacggtctctgctgttacctgaaacgagaatcagtggagctggccctgaagctgctggatgaggatgaaattagagggtacaagctgcatgttgaggtggccaaatttcagctgaagggagaatacgacgccagtaagaagaagaagaagtgtaaggactacaagaagaaactttcgatgcaacagaaacaactcgattggcgcccagagcgcagggctgggccatccaggatgcgacacgagcgggtggtcatcatcaagaacatgttccacccaatggattttgaggacgatccactggtgttaaacgagatccgcgaggatctcagagtggaatgttctaagtttggacagatacggaagctgctgctctttgaccggcaccccgatggcgtggcaagtgtgtcctttcgcgatccagaggaagcagattattgcatccagacactggacgggaggtggtttggaggcaggcagataaccgcccaagcctgggatggcactacagattatcaagtcgaggaaacaagcagggagcgggaggaacgccttcgtgggtgggaagccttcttaaatgcccctgaggccaacaggggcttaaggcgatcagactccgtatcagcgtccgagcgtgccggaccatccagagctcgccatttctctgaacatccctccacatcaaaaatgaacgctcaggagacggccaccgggatggccttcgaagaacctatcgatgagaagaaattcgaaaaaacagaagacggaggtgaatttgaagagggtgcgtcagagaacaacgctaaggaatctagtcccgaaaaggaagcagaggaaggatgcccagaaaaggagagcgaggaggggtgtcccaaacggggtttcgagggaagttgctctcagaaggagtccgaggagggtaatccagtgagaggatccgaagaggatagccccaagaaagagtctaaaaaaaaaactcttaagaatgactgtgaggagaacgggttagctaaggagtcagaagatgatttaaacaaggagagtgaagaggaagtgggccctaccaaggaaagcgaggaggacgatagcgagaaagagtctgacgaggactgctccgagaaacagtctgaggatggtagtgagcgggaatttgaggagaatggcctggagaaggatctagacgaagaagggagcgagaaagagttacacgagaacgttcttgacaaagaactggaggagaatgattctgagaactctgaatttgaagacgacgggtcagaaaaggtcctggacgaggagggtagcgaacgcgaattcgacgaagacagcgacgaaaaggaggaggaggaagacacatacgagaaggtgtttgatgacgaatcagatgagaaggaagatgaagagtacgcagatgaaaaaggactagaagccgctgataagaaggcagaagagggagacgcagacgagaagctatttgaggaaagcgacgacaaagaggacgaagacgccgacggaaaggaggtagaagacgctgatgagaaactttttgaggacgatgactccaatgaaaagctcttcgatgaagaagaggactcttccgaaaagctcttcgacgatagcgatgagcggggaaccctaggcggatttggctccgtggaggaggggcctctcagtactggctcctctttcatcctctcatctgatgatgacgacgatgatatctag

SEQ ID NO: 23184 - DNA, 3879 bp, Artificial Sequence
  Description of Artificial Sequence: Synthetic coding sequence
atggacgcgagctatgacgggactgaggtgacagttgttatggaggaaattgaagaagcttactgttatacttccccgggacccccaaagaagaagaaaaaatataaaatccacggggaaaaaactaagaagccaaggagcgcctacctcctttattactatgatatttaccttaaagttcaacaggagctccctcacctgccccagagtgaaatcaacaaaaaaattagtgagagttggagactattgagcgttgcggagcggagttactatttagagaaagctaagcttgaaaaagaggggctggaccctaatagtaagctgtctgctctcaccgctgtggtgccagacatccctggattccgcaagatcctccctcggtctgactatatcatcattccgaagagtagcttgcaagaggaccgctcctgcccgcagctggaactgtgtgtggcgcagaatcaaatgtcccccaaaggacctcccctggtttccaatacagcgccagagacggtcccttcccacgccggtatggctgaacagtgtctagccgttgaagctctcgcagaggaggtaggagcactcacacagagcggagcggtgcaggaaattgctacctccgaaatcctcagtcaggacgttttgctcgaggacgcatccttagaggtgggagaaagccatcagccctatcaaacaagcttggtcatcgaggaaaccctggttaatggttcacccgaccttcccacgggctccctggcagtccctcaccctcaagtcggggagtccgtgagcgtcgtgacagtgatgagagattcatcagagtcttcaagctctgctccggctactcagtttattatgctgccccttcccgcttatagtgtggtagagaaccccacttccatcaaactgacgaccacatatacgcggagaggtcacggaacttgtacaagtcccggatgcagtttcacttatgtcaccaggcacaagccccctaagtgtcccacatgcggaaattttctcggcggaaaatggattcccaaagagaagcctgcaaaagtgaaagtagagctcgcaagcggtgttagctcaaaggggagcgtagtgaaaagaaatcaacaacctgttacaacagaacagaattcatctaaagagaatgcctcaaagctgactctcgaaaactcggaagccgtgtcacagctcctcaacgtggctcctcctagagaggttggggaggaaagtgagtgggaggaagttattattagcgacgctcatgttcttgtcaaggaggcccctgggaattgtgggaccgcagtgacaaagacgccagtggttaaaagcggtgtgcagccagaggtgaccctggggaccaccgacaacgatagccccggagccgacgttccaaccccatctgaagggacgtcaacttcgtcccccctgccagcacctaagaagcctaccggcgctgatctgctgacacctgggagcagggctccagagctgaaaggcagggccaggggtaagccatccttgctggctgccgctcggccaatgagagccatcctgccagcacctgtgaatgtgggcagaggcagctctatgggattgcctcgggcacgccaagcattctcattaagcgacaaaaccccttccgtgcggacatgtgggttgaagcccagtactttgaagcagcttgggcagcccatacagcaacctagcggtccaggtgaagttaagttaccctctggcccttctaacaggacttcccaggttaaggttgtggaggttaaacctgacatgttcccgccttataagtactcctgcaccgtgaccctcgatctcggcttggctacttccaggggtagaggcaagtgcaagaatccctcctgttcatatgtctacacaaatcgccataagcctagaatttgcccaagctgcggggtcaacctggctaaggaccggacagaaaagactacaaaggccatcgaagtatcatcacctctcccagacgtgctcaacgcgactgaacctctcagtacagctcagagagaaatccagaggcaatccaccctgcagctcctccggaaggtgctgcaaatcccagaaaacgaatccgaactagctgaagtctttgctctcatccacgaactcaattcttcccgattaattctttcaaatgtctccgaggaaactgtgaccattgagcagacttcctggagtaactattacgaatctccatccactcagtgcctgctgtgtagctcaccattattcaaggggggacagaatagtcttgccggtccacaggaatgctggttactgaccgcctcacgattgcagacagtgactgcacaggtgaagatgtgccttaatccccactgccttgccctgcactcttttattgatatatacacagggctcttcaatgtgggcaacaagctgctggttagcttggaccttttgtttgcaatccgaaaccagatcaagctcggagaggaccccagggtcagtattaacgtggttctgaagtccgtgcaggaacaaaccgagaagactctaacttctgaggagttatcccagctgcaggagctgttgtgtaatggttattgggcatttgagtgcctgacagtccgagattataatgatatgatctgcggcatttgtggcgtcgcccctaaagttgaaatggcccaacgctccgaagagaatgtcctcgccctgaagagtgtggaatttacctggcctgagtttcttggcagtaacgaggtgaatgtggaagatttttgggctacaatggagaccgaggtgattgaacaggtggctttccctgcctctataccaatcacgaaattcgacgccagtgttatcgctcccttcttcccaccactgatgaggggggcagtggtcgtgaatactgaaaaggacaagaatctggatgttcagcccgtaccgggttcaggctccgcccttgtgcgcctgctgcaagagggaacatgtaaactagacgagatcggtagctacagcgaagagaaattacaacacctgctgcggcagtgcggaattccctttggagccgaggactcaaaggaccagctctgtttctctctgcttgccttatacgaatccgtgcagaatggtgcacgggcaatccgaccaccacgccacttcaccggcggaaagatctacaaggtgtgcccccaccaagtggtgtgtggatcaaaatatctggttagaggagaaagcgccagagatcacgtcgacctcctggcctcctcaagacattggcctcctgtctacgtggtagatatggcaacttcagtcgctctctgtgccgacctgtgttacccggaactgacaaatcaaatgtgggggagaaaccagggttgcttttctagtcccacagaaccgcctgtatctgtctcctgccctgagttgctggatcagcattacaccgtagacatgactgaaacagagcacagcatacagcaccccgtaaccaaaacggcaacccgtcgcatagtgcatgctgggcttcagcctaatccaggagacccttcagccggtcatcattctctggccctgtgtcctgagctcgccccttacgccaccatcctcgctagcattgtggatagcaaacctaatggagtgaggcaacggcctatcgcatttgataatgccacgcactactacctatacaaccgtctgatggactttcttacgagtcgcgagattgtgaataggcaaatccacgacattgtgcagtcctgccagcctggggaggtggtgatcagggataccttgtataggcttggcgtggcacagattaagacggagacggaggaggaaggggaagaggaggaagtggctgcagtggctgagtag

SEQ ID NO: 23185 - DNA, 2310 bp, Artificial Sequence
  Description of Artificial Sequence: Synthetic coding sequence
atgtgtggttctgccctggctttttttacagcagccttcgtctgtttacagaacgacaggaggggtccagcaagctttctctgggccgcatgggttttctctttggttctcggcttgggtcagggcgaagataatcgatgcgccagttcaaacgccgctagttgtgccagatgcctggccctgggaccagagtgtggatggtgtgtgcaagaagacttcataagtgggggttccagaagtgagcgctgtgacattgtaagcaatctgatcagcaaggggtgctctgtggactctatcgagtatcctagtgtgcacgttatcataccaacagaaaatgagattaatactcaagtcacgccaggggaggtatctattcagctgcgacctggagcggaggctaattttatgttgaaggtgcatcccctgaagaagtatccggtcgatctgtattacttggtggatgtatcagcatccatgcataacaatatcgaaaagctgaattctgtcggaaacgatctatcccggaagatggccttctttagcagggactttagacttggctttggcagctacgttgataagaccgtttccccctacattagcatccacccagagaggattcacaatcagtgtagtgattacaatctggattgtatgccaccccatggctacatacacgtcctttccctgaccgagaatatcacagagttcgaaaaagcagtgcaccggcagaagatctcaggaaacatcgatactcccgagggaggattcgacgcaatgctgcaggcagccgtctgtgagtctcatatcggttggcgaaaggaagcaaagcgtctgctgttggtgatgactgaccagactagtcacttggccctcgactcgaagctcgccggaatcgttgtcccaaatgatggaaattgccaccttaagaacaatgtgtacgtcaagagcacaaccatggaacacccgtcactcgggcaactgtctgagaagctgatcgacaacaacatcaatgtaattttcgcagtacagggtaagcaattccactggtataaggatctactgcctttattacctggtacaatcgctggcgaaattgagtcaaaggccgcaaacctgaacaatctggtcgtggaagcttatcagaaactaatcagcgaagtcaaagttcaagtcgaaaatcaggttcaaggaatctattttaatattactgcgatctgtccagatggttccaggaaacccggaatggagggttgccgaaatgtgacatctaatgacgaagtgcttttcaatgttaccgttaccatgaagaagtgcgatgttacagggggaaaaaactatgcaatcatcaagccgattggctttaacgagaccgcaaaaatccatattcacagaaattgctcatgccagtgtgaggataatagggggccaaaggggaagtgcgtcgatgagacctttttagattctaaatgttttcagtgcgacgaaaacaaatgtcattttgacgaggaccagttttccagtgagagctgcaaatctcataaagatcaacccgtgtgtagtggcaggggggtgtgcgtctgcgggaagtgcagctgccacaaaatcaagcttggcaaggtttacggaaagtactgtgaaaaagatgatttcagctgtccatatcatcatggcaacctctgcgccggtcacggggagtgcgaggccggacggtgtcagtgtttcagtgggtgggagggagataggtgccaatgccctagcgccgctgcgcagcactgcgtcaactccaaagggcaggtttgctcaggccgaggcacctgtgtgtgcggcaggtgtgagtgcaccgatcctcggtctattgggagattctgtgaacattgccccacctgctacaccgcttgcaaggaaaattggaactgcatgcagtgcctgcacccccacaacctctcccaggcaattctggaccagtgtaaaacatcctgtgccctgatggagcagcagcactatgtcgatcaaacttcagaatgcttctccagcccgagttatctgcgtattttctttatcatttttatcgtcactttcctgatcgggcttcttaaagttctcataatccggcaggtgatcttacagtggaatagcaataaaatcaagtcctcaagcgactatagggtgtcagccagtaagaaagataaattaattctgcaatcagtttgtacgagggccgtgacatatcgcagagaaaagcccgaggagatcaagatggacatctccaagcttaatgctcacgaaacttttcggtgcaacttttag

SEQ ID NO: 23186 - DNA, 375 bp, Artificial Sequence
  Description of Artificial Sequence: Synthetic coding sequence
atggtctgggaagtgaaaactaaccaaatgcccaacgctgtgcagaagctgctcctcgtcatggacaagcgggcaagtggaatgaatgacagtctagagctgctgcaatgtaacgagaatctaccgtcttcccccggatataacagctgcgacgaacacatggagctcgacgacttaccggagctgcaggcagttcagagcgacccaacacagtctggaatgtatcaactctccagtgacgtcagccatcaggagtacccgcgatcctcatggaaccagaacacctctgatatacccgaaactacctaccgggaaaacgaagtcgattggcttaccgaactggcgaatattgcaacatctccacagtcgccatag

SEQ ID NO: 23187 - DNA, 87 bp, Artificial Sequence
  Description of Artificial Sequence: Synthetic coding sequence
atggtatgggaagttaagacaaaccagatgccgaacgctgtacagaaactgctacttgtgatggacaagagagcctctggcatgtag

SEQ ID NO: 23188 - DNA, 1545 bp, Artificial Sequence
  Description of Artificial Sequence: Synthetic coding sequence
atggtttgggaagtgaagacaaaccaaatgcctaatgccgtgcaaaagctgctgctagtaatggataagcgggctagcgggatgaacgactccctggagctgctccaatgtaacgaaaacctgcccagcagccccggttacaacagctgtgatgaacatatggaattggacgacctcccggaactgcaggcagtccaatcagatccaactcagtctgggatgtatcagctgagttccgatgtaagccaccaagaatatcctaggagctcttggaatcaaaacacttcagacattccggaaacgacatacagagaaaatgaggtcgactggcttactgagctggctaacatagccacgtcacctcagagtcccttgatgcagtgttctttctataaccggtccagtccagttcatatcatagccacctcgaaaagcctgcattcctatgctcgccctccacccgtgagcagctcctccaagtccgagccagcatttccgcatcaccattggaaagaagaaactcctgtccgacacgagcgagcaaacagtgagagcgaatccgggatattctgcatgtctagcctcagcgacgatgacgatttggggtggtgtaactcgtggccaagtacggtctggcactgtttcttgaaggggacacgcctgtgctttcacaagggttcgaacaaggagtggcaggacgtcgaggactttgcccgagccgaaggatgcgacaatgaagaagacctgcaaatggggatacacaaggggtacgggtccgacggcctcaagctgctgagtcatgaagagagcgtttctttcggtgagtccgtcctgaagttaacgttcgaccccggtaccgtggaggacggacttctcaccgttgagtgtaaactggaccacccattctacgttaagaataaaggatggtcaagtttttacccaagcctaacagtggtgcaacatggaattccttgttgtgaagtacatatcggggatgtttgcctccctccgggtcacccagatgccatcaatttcgatgattctggtgttttcgatactttcaagtcctacgattttactccgatggatagcagtgccgtgtacgtcttgagcagcatggcccgacaacggagggcgtcactgtcttgcggcggacccggtggtcaggatttcgcacggtcaggcttcagcaaaaattgtggatcccctggcagcagtcaattatccagcaattccctctacgccaaagctgttaagaaccactcttctggcactgtttccgcaacaagccccaacaaatgtaaaagaccgatgaatgcgtttatgttatttgccaagaagtaccgggtggaatacacccagatgtacccgggaaaggataatcgagctattagcgtgatactcggcgaccggtggaagaaaatgaagaatgaggaacggaggatgtataccctggaggcgaaggccctggctgaagagcagaaacgtttgaatcccgactgttggaaacgaaaacgcacaaactctggcagccagcagcactag

SEQ ID NO: 23189 - DNA, 213 bp, Artificial Sequence
  Description of Artificial Sequence: Synthetic coding sequence
atggtttgggaggtgaagaccaatcaaatgcctaacgcagtgcagaagctgctgttggttatggacaaacgggctagcggaatgaatgattcccttgaactcctgcagtgtaatgaaaacctgccatcgagtccgggatacaacagctgcgatgaacatatggaacttgacgatctgcctgagttgcaggcagtccagagcgatcctacttag

SEQ ID NO: 23190 - DNA, 336 bp, Artificial Sequence
  Description of Artificial Sequence: Synthetic coding sequence
atggtgtgggaggtgaagacaaaccagatgccaaacgccgtacagaagctgcttctagtcatggataaacgggcttcaggaatgaacgacagcttagagctccttcaatgcaatgagaaccttccgtcaagccctgggtacaactcctgcgatgaacacatggagttggacgacctgcccgaactccaggctgtgcagagtgacccaacacaaagcgggatgtaccaactgagtagtgatgttagccatcaggaataccctcgcagctcttggaaccagaacacctctgatatacccgagacaacctaccgcgagaacgaggttgattggctgtag

SEQ ID NO: 23191 - DNA, 1545 bp, Artificial Sequence
  Description of Artificial Sequence: Synthetic coding sequence
atggtgtgggaggtgaaaactaatcagatgcctaacgctgtgcaaaagttgctgcttgtgatggacaaaagagcttcaggcatgaatgacagtctagaactgctgcagtgtaatgagaacctgccgtcaagcccaggatataatagctgtgacgaacatatggagttggacgatttacctgaactacaagccgtgcagagcgatcctacgcaatctggaatgtaccagctttcttcagatgtgtcgcaccaggagtatccacgcagttcttggaatcagaacacaagtgacatacctgaaacaacatatcgtgaaaacgaggtagattggctcacagaacttgccaatatagcaacgtccccacaatcacccctgatgcagtgtagcttctataatcgttcgtctccagtccatatcatcgctactagtaaatcgttgcactcttacgccaggcctccacctgtgtcctcctcctctaaaagcgagcccgcattccctcaccaccattggaaggaggaaactcccgtacggcatgagcgtgcaaactccgagtcggagtccggcatattttgcatgagttctctgtctgatgatgatgacctgggctggtgcaacagctggccctcaaccgtctggcactgcttcctgaaaggtacccggttgtgttttcataagggatctaataaggaatggcaggatgtcgaggacttcgcacgagccgagggttgcgacaatgaagaggatttacagatgggaattcataagggttatggatccgatggcctaaaactgctgtcccatgaggagagtgtttcctttggggagtccgtgctgaagttaaccttcgacccaggcactgtggaagacggattattaacagttgagtgtaagctggatcaccccttctacgtgaaaaataagggatggagcagcttctatccctcacttacagtcgttcagcacggaattccatgctgtgaggtgcacataggcgatgtctgtctccctccaggccaccccgacgccataaacttcgatgacagtggcgtgttcgataccttcaagagctacgatttcaccccaatggatagctcagccgtgtatgttctgagttctatggcaaggcagcgcagggccagcctgagctgtgggggtccagggggacaggacttcgcaagatccgggttcagcaagaattgtgggtctcctgggtcaagccagctgtcctcaaactcactttacgccaaggcggtgaaaaatcatagcagcggcacagtaagtgccacaagccccaacaagtgtaaacgacctatgaacgctttcatgttattcgctaaaaagtatcgggtggaatacacccaaatgtatcctgggaaggacaatagggctatctcggtgatcctgggtgaccgctggaaaaagatgaagaacgaagaaagaagaatgtacacgctggaggccaaggcactagctgaggagcagaagaggctgaacccggactgttggaaaaggaagcgcacaaattcgggatctcaacaacattag

SEQ ID NO: 23192 - DNA, 327 bp, Artificial Sequence
  Description of Artificial Sequence: Synthetic coding sequence
atggtttgggaagttaaaaccaatcaaatgccaaacgctgtgcagaagttattactggtgatggataaaagggcttcgggcatgaatgacagcctcgagctgctccaatgcaacgagaacttacctagtagtcctggatacaactcatgcgatgagcatatggaactcgatgaccttcccgaactgcaggccgtccagtcagatcctacccagtcagggatgtaccaactcagcagcgacgtgagtcatcaagagtaccccaggtcctcgtggaatcaaaatacctccgatatccctgaaactacttaccgtgagaacgaggtgtag

SEQ ID NO: 23193 - DNA, 1365 bp, Artificial Sequence
  Description of Artificial Sequence: Synthetic coding sequence
cagatgcccaacgctgtgcagaagctgctgctggtgatggataagcgcgcatccggcatgaacgattctctggagcttctccagtgcaatgagaatctgccctccagtccaggatacaacagctgcgacgaacacatggagctggatgacctgcctgaactacaggccgtccaatcagatcctacgcagtctggcatgtatcagctgtcatccgatgtgagccatcaggaatacccaaggtcaagctggaatcagaacactagcgatatccctgagacaacctatcgcgaaaacgaggttgattggctcacagaattggcgaatatcgcgacgtccccccaaagccctcttatgcagtgcagtttctacaatagatcctcacctgtgcacatcatcgctacaagcaagagcctgcattcctacgctcggccaccccctgtatcgtcctcaagcaaatcggagcctgcctttccacatcaccattggaaagaggaaaccccggtaaggcacgagagagccaactctgaaagtgagtcaggcatattctgcatgagctctcttagcgacgatgatgaccttggttggtgcaattcttggccctctacggtgtggcattgcttccttaaagggactcgactgtgtttccacaagggatccaataaagaatggcaggacgttgaggactttgcacgcgcagaaggctgtgacaacgaagaggatctccagatggggatccacaaaggctatggcagcgacggcttaaaacttctcagtcatgaggaaagtgtttccttcggcgagagcgtgctcaagctcacgttcgaccccggaacagtggaggatggcctcttgaccgtagaatgcaaattggaccaccctttttatgtgaaaaacaaggggtggtccagtttctatccctccctgacagtagttcaacatggaattccatgttgcgaggttcacattggggatgtatgtctgccacctggacatccagacgctatcaactttgatgattcaggtgtcttcgacactttcaaaagctacgactttactcccatggatagtagcgctgtgtacgttctgagtagtatggcacgccagcgaagggccagcctgtcttgtggagggccaggtgggcaggactttgctagatcaggttttagcaagaattgcggatcccccggatcctcccagttgtcttcaaacagcctgtatgcaaaagccgtcaaaaaccattcctccggcacggtatcggccacctccccgaataaatgcaagaggcctatgaatgcatttatgctgttcgcaaaaaagtaccgagtggagtatacccagatgtaccctggcaaggacaacagatag

SEQ ID NO: 23194 - DNA, 1332 bp, Artificial Sequence
  Description of Artificial Sequence: Synthetic coding sequence
atgcagaaggccacctattacgactcttccgcaatttacggaggctacccctaccaggcggcaaatggatttgcctacaacgccaaccagcaaccatatccggcttctgctgctctcggagcggatggtgaatatcaccgtcccgcatgttctttacagagcccttcctctgccggtggccacccaaaagcccatgaactgtctgaagcctgcctacggaccttgtctgctcccccttcgcaacctccctcgcttggtgaacctcccctccatccacctcctccacaagctgcgcctcctgcaccgcaacctccccagccagcccctcagccacctgcccctactccagccgctccaccaccaccctcttctgcttcccctcctcagaacgcaagcaacaaccccacccctgcaaatgccgcaaagtcacctctgcttaattctcctaccgttgctaaacaaatttttccgtggatgaaggagtcacggcaaaacacaaaacagaagacctctagtagctcaagcggggaatcctgtgcaggcgataaatcccctccaggccaggctagctccaagcgggctagaactgcctacacctcagcccagcttgtcgagctggaaaaagagttccacttcaatcggtatctatgcaggcccagacgcgtggaaatggcgaacttactgaatcttaccgagcggcagattaagatatggttccaaaacaggaggatgaaatacaagaaggatcaaaaaggcaaaggaatgctaacttccagtgggggtcagagtcccagcaggtctccagtgccccctggcgctgggggatacctcaactctatgcactctctggttaatagtgtaccctacgaaccgcagtcaccaccgcctttctccaaaccaccccaaggtacctatggcctgccgcctgcctcgtaccccgcaagcctgccctcttgtgcgccaccgccacccccacaaaagaggtacactgccgcaggagcaggcgcagggggaacccctgattatgacccgcacgcccacggcttgcaaggcaacggttcttacggcacaccgcatatccaaggttcccctgtctttgtaggcggtagttatgttgaacctatgtcgaatagcggcccagcgctgtttggactgactcacctccctcacgccgcaagcggcgctatggattacggaggggcaggacccttgggatcggggcatcaccatggccctgggcctggggagccccatcccacttacacggatcttaccggacatcatccatcacaaggacggattcaggaagcccctaaactgacccatctctag

SEQ ID NO: 23195 - DNA, 858 bp, Artificial Sequence
  Description of Artificial Sequence: Synthetic coding sequence
atgaaagagtctcggcagaacacaaaacagaaaaccagttcctccagcagtggagagagctgtgctggagacaagtctccaccaggccaagccagttcaaagagagcgcgaaccgcctatacatctgctcaattggtggaattagagaaagagtttcattttaaccgctatctctgtagaccaaggcgcgtcgagatggcaaaccttctcaacctcaccgaaaggcagattaagatttggtttcaaaatcgccgtatgaaatacaaaaaagaccaaaagggcaagggcatgttgacttcctcagggggtcaaagtccaagtcgatcacctgtgcctcccggagcgggagggtaccttaacagtatgcattcactggtgaacagtgtgccctacgaaccgcagagcccaccccctttttccaaacctccccagggcacatatggcttgcctccagcctcgtatccggcatcattgccttcatgcgcacccccaccaccaccccagaaacgttacacagcggcaggagctggtgccggaggcacacccgattatgaccctcatgcccatgggctgcagggaaatggctcgtacgggacccctcacatccaagggagtcccgtgttcgtaggcggatcttacgtggagcctatgtcaaattcaggacctgccttgtttgggcttacgcacctcccccacgcagccagtggtgccatggattacggtggggctggcccactgggttcagggcatcaccatggtcccggtccaggcgaaccccacccgacatatacggacttaacgggacaccatcctagccagggtcgtatccaagaggctccgaaactgacacacctttag

SEQ ID NO: 23196 - DNA, 1332 bp, Artificial Sequence
  Description of Artificial Sequence: Synthetic coding sequence
atgcaaaaggcgacctattatgactcaagcgctatatacggtggctacccctaccaggctgcgaacgggttcgcctataacgctaatcaacagccatatccagcttctgctgccctcggcgctgacggcgagtaccataggccagcgtgttccctgcagtctccaagcagtgcaggaggccaccctaaggcccacgaactgtccgaagcttgtctacgcacgcttagcgcaccgccatcccaacccccatccctgggagagcccccattgcacccgccaccccctcaagcagccccacccgctccacaacccccacaacccgcaccccagcccccagcacccacacccgcagccccaccaccacctagtagcgcttccccaccgcaaaacgccagtaacaatcccactcctgctaatgctgccaagagtccacttcttaattcccctaccgttgccaagcagatctttccttggatgaaggagagcagacagaataccaagcagaagacatcgagttcaagttccggagagtcctgcgccggagacaagagtcccccaggtcaagccagctctaagagagctagaacagcctatacgagcgcacagcttgttgagctcgagaaggaattccatttcaatagatacttgtgcagacccagacgcgtcgagatggctaacctactgaacctaactgagcggcagataaagatctggttccagaatcgccgaatgaagtataaaaaagaccagaagggaaagggtatgctgacctcttccggcggtcagtctccaagccgcagccctgtgccccctggcgctggaggctacctgaacagtatgcatagcttggttaactctgtgccatacgaaccccagagcccacccccattttccaagccgcctcaagggacgtacgggttgccccctgcttcatacccagcctccctcccatcatgcgcaccgcctcctccccctcaaaagcgttatactgcagccggagcaggggctggcggaacccctgactacgaccctcacgcccacggtctgcagggaaacggtagctacggcaccccacatattcagggaagcccggtgtttgtcggcggttcatacgtcgagccgatgtccaactccggaccagcactgttcgggctgactcacttgccccatgccgcttcaggagcaatggactacgggggtgcaggacctctgggctccgggcatcaccacggacccggtccgggagagccccatccaacttatactgatctaacaggccaccacccatcccagggcaggattcaggaggcgccaaagctgactcatctctag

SEQ ID NO: 23197 - DNA, 39 bp, Artificial Sequence
  Description of Artificial Sequence: Synthetic coding sequence
atgcagaaagcaacatactacgactccagcgccatttag

SEQ ID NO: 23198 - DNA, 165 bp, Artificial Sequence
  Description of Artificial Sequence: Synthetic coding sequence
atgcaaaaggcaacctactacgatagcagcgccatctatggcggatacccttaccaggccgcaaatggcttcgcatacaatgctaaccagcagccctacccagcatccgctgctctcggggcagatggcgaatatcataggccggcatgttctctccagtcttag

SEQ ID NO: 23199 - DNA, 255 bp, Artificial Sequence
  Description of Artificial Sequence: Synthetic coding sequence
atgcagaaagctacatattacgacagttccgctatctacggaggctatccataccaagccgcaaacggctttgcctataatgcgaaccagcagccctaccctgccagcgctgcactcggcgcagatggggaataccatcgcccagcatgttctctccagtctccttcctctgcaggaggacatcctaaagcccacgagctgtcggaagcctgtcttcgcactttgtcagcacctccatcccagcccccatcctag

SEQ ID NO: 23200 - DNA, 1653 bp, Artificial Sequence
  Description of Artificial Sequence: Synthetic coding sequence
atggtgaggggatgggaaccccctccgggacttgattgcgccatcagcgagggacacaagagtgagggtaccatgccgcctaataaggaagcaagcggcctctcaagctcccctgccggtttaatctgcttaccaccaatctccgaggaacttcagttggtctggacccaggctgctcaaacttctgagctcgattcaaacgagcacctgctaaagacttttagttatttcccttatccctccctggccgacatcgctctgctatgcttgaggtatggtcttcagatggagaaggtaaaaacatggtttatggcacagcggctgaggtgtgggattagctggtccagtgaagagatcgaggaaacacgagctagggtcgtgtatagaagggatcagctgcatttcaaaagcttattgtcattcacgcatcacgctggacggccaccagaggaggtacctccacctccggtgccggcaccagagcaagtcggtattggcatcgggcctccaacgcttagcaaacctactcagaccaaggggctcaaggtggagccggaagagcctagccaaatgcctcctttacctcagtcccaccagaaactcaaagaaagcttaatgacccccggtagcggggcttttccataccaatccgacttttggcagcacctccagagctccggattaagcaaagagcaggctggcagggggcctaatcagtcccatggaattggcaccgccagttggaatcactccacaacggtccctcaaccgcaggccagagacaaaccgccacctatagccctgattgcctcctcttgcaaggaagaatccgcatccagcgtcacacctagtagcagctcaaccagcagctctttccaggtcctcgctaatggcgcaacagcagcttcaaagcctctgcaacctctgggttgcgtaccccaaagcgtatctccatccgagcaagcccttcctccccacctcgagcccgcatggccccagggcttacgacataacagtgtccctggtcgagtcggtccaaccgagtatctgtctcccgatatgcagcggcagcgcaaaacaaagcgtaagaccaaagaacagctggctatcctgaagagtttctttttacaatgtcaatgggcacgtcgtgaggattatcaaaaattagaacagatcacggggctacccagacctgaaataatccaatggttcggcgatacccgatatgcactaaagcacggtcagctgaagtggttcagggacaacgcggtccccggagccccatcttttcaggaccctgcaatccctacacccccaccctctacccggtctctgaacgagagggccgagacgccacctcttcccatcccaccgcctcctccagatatccaaccccttgagcgttactgggccgctcatcagcagctgcgtgaaaccgacatcccacaactgtcgcaggcatcacgccttagcacccagcaggtcctagactggttcgattctaggctccctcagcctgctgaggtggtggtatgcttggacgaggaggaggaggaggaagaagaggaactaccagaagacgacgaagaggaagaggaggaggaagaggaagacgatgatgacgacgacgatgatgttatcatccaggactag

SEQ ID NO: 23201 - DNA, 1032 bp, Artificial Sequence
  Description of Artificial Sequence: Synthetic coding sequence
atgtcaagagccggttcatgggacatggacggtctgagagccgatggagggggagcgggtggcgctccagcttcgagcagttcttcttccgtcgctgccgctgcagcaagtggccagtgcagggggtttctgagcgcccctgtatttgcagggacccactctggacgagccgcagcagcagcagctgccgctgcagccgctgctgcagcggcttccgggttcgcatacccagggacctctgaacgaactgggtcctcgtccagctcaagttcctccgccgttgttgccgcacgccctgaggctcccccagcaaaggagtgcccggctccaacaccagccgctgcagccgctgcaccgccatccgcccctgcactcggttacggctaccatttcgggaacggttactattcctgccgcatgtcgcatggggtcggcctgcagcaaaacgcacttaagagttcccctcacgcgtcccttggtggcttcccagtggaaaagtacatggacgtcagcggactggcctcaagttccgtacctgcaaacgaagtacctgcacgcgcaaaagaagtgtccttttatcaaggatacactagcccctatcagcatgttccaggatatatcgatatggtgtcaacctttggctcaggcgagcctcgccacgaagcatacatcagcatggaggggtatcagtcttggactctcgccaatgggtggaacagccaggtgtattgcacaaaggaccagccacagggaagccacttttggaaaagctccttccccggtgacgtcgcccttaaccagcccgacatgtgtgtctataggcgaggcagaaaaaagagggtaccttatacgaaacttcagttgaaggagcttgaaaacgaatacgctatcaacaaattcatcaacaaggacaaacgaagacgaatctctgcagctacaaacctgtcagaacgccaggtcacgatctggttccagaataggcgggtaaaagacaagaaaattgttagtaagctcaaagacactgtgtcctag

SEQ ID NO: 23202 - DNA, 924 bp, Artificial Sequence
  Description of Artificial Sequence: Synthetic coding sequence
atggcaacagcgcagctctctcactgcattacgatccacaaagcaagcaaggagacagtctttccaagccaaatcacaaacgaacatgagtccctgaaaatggtaaaaaagcttttcgctacatccatctcatgtataacttacctcaggggactctttcccgagtcttcttacggcgagaggcatctcgatgacctgtccctgaagatactgcgcgaggacaaaaagtgtcccggttcccttcacatcatccggtggatccagggatgcttcgacgccctcgaaaaacgctatctgcgcatggccgttctgaccctgtatacggatccaatgggaagtgagaaggtgaccgagatgtaccaattcaaatttaaatataccaaggagggcgctactatggatttcgattcacactccagtagtacttctttcgaaagtggaactaacaacgaagatataaaaaaagccagcgtcctgctgattaggaagctgtacattctcatgcaagacttggagcctctgcctaacaacgtcgtgttgacaatgaaactgcattactataatgctgtgaccccacacgactaccaaccattgggctttaaagagggagtcaattcccacttcctattatttgataaagaaccaataaacgttcaagttggctttgttagtactggctttcatagtatgaaagtcaaggtcatgactgaagcaactaaagttatcgatctcgagaacaacctcttccgggagaattctacaactgagattgcccaccaaggactcgattgcgacgaggaagaggagtgcaatgaccacattcagcgcatgaacttcgtctgcagtcagcagtcaagcgaatgttccaggaagaagcggaaagtcagtgagcctgtgaaagtgtttatacccaatcgcaaatag

SEQ ID NO: 23203 - DNA, 924 bp, Artificial Sequence
  Description of Artificial Sequence: Synthetic coding sequence
atggctacagcccagctgtcacattgcatcaccattcacaaagcctccaaagaaactgtttttccaagccaaattacaaatgaacacgaaagtctgaagatggtaaaaaaactctttgcgacatccatcagctgtattacctacttgaggggtttgttccccgagtcaagttacggcgagagacacctcgacgatctgtcattgaagatcctgcgcgaggataaaaaatgccccggatctcttcatataatccgctggattcaaggctgtttcgatgccctggaaaaacgctacttgagaatggcagttttaaccctgtataccgaccccatgggcagcgagaaggtcacagaaatgtaccagttcaagttcaaatacactaaggaaggcgcaactatggactttgactcccactcttcttcaacatcttttgagagcggcactaataatgaggacataaagaaagctagtgtgctactcatccgaaagctatacatcttaatgcaggacctcgagccgttgcctaacaacgtggtgttgactatgaaattacattattataatgctgtgacaccccacgattaccaaccactgggtttcaaggagggcgtcaacagccattttctgctcttcgacaaggagcctatcaatgtacaggttggctttgtaagcaccggattccactccatgaaggtcaaagtgatgactgaggcaactaaggtgattgatttggagaacaatctttttcgagagaattcaactacagaaatcgcccatcaagggctagattgtgacgaggaagaggaatgcaacgatcacatccagcggatgaactttgtctgctcccagcagtcgagcgagtgctctaggaaaaagcgcaaggtaagtgaaccagtgaaagtgttcatacctaatcgcaagtag

SEQ ID NO: 23204 - DNA, 1074 bp, Artificial Sequence
  Description of Artificial Sequence: Synthetic coding sequence
atgcaggccagagccctgctgttggctgcactggcggcactggcccttgccagagagccaccagccgctccttgccctgctcggtgcgacgtgtcgcggtgcccgtccccgaggtgccccggaggatacgtgccagatttgtgcaattgttgtctagtgtgcgccgcaagcgagggcgagccctgtgggggacccctggactccccctgcggcgaatcactcgagtgtgtccgtggcctgtgccgatgtcggtggtcccacgccgtctgcgggaccgacggccacacgtacgccaatgtctgtgccctgcaagcagcctccaggagggccctgcagttgtcagggacaccggtgcggcagctgcagaaaggagcctgcccactcgggctgcatcagctgtcttcacctaggtataaattcaatttcatcgcagatgttgtagagaagatagcgccagctgtcgtgcacattgaactctttttacggcatcctctgttcggacgcaacgtccccctgtcttcaggaagcggcttcataatgagtgaggcgggtttaatcattacgaacgcccatgtcgtgagctctaacagcgccgcaccaggtcgccagcagttgaaggtgcagctccagaacggagactcctacgaagccacaatcaaagatatcgacaagaagtctgacatcgctacaattaaaatccaccccaagaaaaagttaccggtcttgctccttggccactccgcggacctgcggccaggagaatttgtcgtcgctatcggctccccttttgccttgcagaacacggtcaccacgggaattgtgagcacagcacagcgggaaggtcgggagctcggtttgagagatagtgatatggattatatccaaacagatgcgattatcaactacggaaactctgggggtcccctggttaacctggatggcgaagtgatcggcattaacacattaaaggtcacggccggaataagtttcgcaattccaagcgaccgcatcacccggtttctgaccgagtttcaggataaacagattaaggcgccttctcttgccgtgcattag

SEQ ID NO: 23205 - DNA, 1599 bp, Artificial Sequence
  Description of Artificial Sequence: Synthetic coding sequence
atgcattgcactctgactatggagaccgaagccatcgacggatacatcacctgcgataacgaattgagccctgaacgcgaacactccaatatggctattgatctcacaagttccactcctaatgggcagcacgcatcaccctcccatatgaccagcacaaactccgtcaaactcgagatgcagtccgacgaggagtgcgatcgtaaacccctgagtagagaggatgaaatcagggggcacgacgaagggtcctctcttgaggaaccgctcatcgagagcagcgaggtggctgataacagaaaggttcaagaactacagggcgagggtggaatacgcctgccaaacggcaagctaaagtgcgacgtctgcggcatggtctgcataggcccaaacgtactcatggtgcacaaacggagccatacaggcgaaagaccattccactgtaatcagtgcggggcttctttcacgcaaaaaggaaacctgttgagacacatcaagctgcattctggagagaagccgttcaagtgtccattctgtagctacgcttgcagacgcagggatgcccttaccggccacctgcgtactcattctgtcggtaaaccccacaaatgcaactactgtggacgatcctataagcagcgcagttcccttgaggagcacaaggaacgttgtcataattatttgcagaatgtctccatggaagccgcaggtcaagttatgagtcatcatgttccacctatggaggactgcaaggaacaggaaccaattatggataacaatatcagcctggtcccctttgagaggcccgcagtgatcgaaaagctgacaggcaatatgggaaaacgaaaatcatccacaccacagaagtttgttggcgaaaaactcatgcgattttcataccccgatattcatttcgatatgaacttgacgtatgaaaaggaggccgagctgatgcaaagccatatgatggaccaggcaataaacaatgcaatcacctacctaggcgcagaggctttgcacccactgatgcagcaccccccttccacaatcgctgaggttgcaccagtgatttcatccgcttactctcaggtgtatcacccgaaccgaatcgaacgccctatttcacgcgagactgcggacagccacgaaaataacatggatggccctatctcattgattagaccaaagtcccggccacaagaaagggaagcctccccctctaactcctgcctggacagcaccgactcagagagcagccacgacgaccaccagtcttaccaaggccatcccgcactcaaccccaaacggaaacaatcccctgcttacatgaaggaagacgttaaggctcttgacacaacgaaagctcctaaaggctcactaaaggacatatacaaagtgttcaatggagaaggcgaacagatccgcgcattcaaatgcgagcattgtcgggtgctgtttttggaccacgtgatgtataccattcatatggggtgccatggatatagagatccgttggagtgtaatatctgtggctacaggtcacaggacaggtatgagttcagtagccacatcgtgcgaggcgagcatacttttcattag

SEQ ID NO: 23206 - DNA, 1503 bp, Artificial Sequence
  Description of Artificial Sequence: Synthetic coding sequence
atggaaactgaagcaattgacggctacatcacctgtgacaacgagttgtcccctgagcgggaacactctaatatggccatagacttgacatcctccacgcccaatggacagcacgcttctccaagtcatatgacttctacgaactctgttaagctggagatgcagagcgacgaagaatgcgaccgaaaaccactgtcaagagaggacgaaatacgcggacatgacgaaggctcaagcctggaagaacctctgattgagtcctctgaagtcgcagacaatagaaaagtgcaggagctacaaggggaaggtggaattcgactgccaaatggcgagagaccctttcattgcaaccagtgcggagcctcattcacccagaagggtaatctgctgcgccatatcaaattacactcaggggaaaaaccgtttaaatgcccattctgttcatatgcttgccgcaggagagatgctttaaccgggcaccttaggactcactctgtggggaaaccacacaagtgcaactactgtgggagatcgtacaaacaacgcagcagtttggaggaacataaggagagatgccacaattacttacaaaatgtatcaatggaggctgcaggacaggtcatgtcccaccatgtcccccctatggaagactgtaaggagcaggagccaatcatggacaacaacatcagtctcgtcccattcgaaagacccgcagtaattgaaaaactgaccggcaatatgggtaaacggaagtcctcaacacctcaaaagttcgttggtgagaaactgatgcgcttctcctaccccgatatacacttcgacatgaatctcacgtacgagaaggaagctgaactcatgcagagccacatgatggatcaggccataaataatgcaattacctatctgggggcagaggcactacatccccttatgcagcatcctccttctactatagccgaggtggcccctgtgatatcgtccgcgtacagtcaggtttatcacccaaaccgtatcgagcgacccatctcacgcgagacagcagactcccatgagaataacatggacggcccaatcagccttattagaccaaaatcacgtccccaggaaagagaggcctccccgtccaattcctgcctcgactccaccgattccgaatcatcacatgatgatcaccagagctaccagggtcacccggcattaaatcctaaacgcaagcagtctccagcctacatgaaagaggacgtcaaagccctagataccaccaaggccccaaagggaagtctcaaggacatttataaagtatttaacggtgagggagagcagattcgggcattcaagtgtgagcattgtcgagtcttattccttgatcatgtcatgtatacaattcatatgggatgccacggctatcgagaccccctggaatgcaatatatgcggctaccgctcccaggaccggtacgagttttcgagtcatatagtcagaggcgagcacactttccattag

SEQ ID NO: 23207 - DNA, 1146 bp, Artificial Sequence
  Description of Artificial Sequence: Synthetic coding sequence
atggagaccgaagcaattgacggttacattacatgtgataatgagctgtctcctgaaagggagcacagcaatatggctattgatctgacatccagcacacccaatggtcagcacgcatccccttcccatatgactagtatggggaagccacataaatgcaactactgtggccgttcctacaagcaaagaagctccctggaggagcacaaagaacgttgtcataactacctgcagaacgtttccatggaagctgccggacaggtgatgagccaccatgtcccccctatggaagattgcaaggagcaagagcccatcatggataacaatatctcccttgtacctttcgagcgcccagcggtcatagaaaaactgacgggcaatatgggaaaaaggaagagctctaccccacagaagtttgtcggagagaaacttatgcgattcagctatcctgacattcacttcgatatgaatctgacctatgaaaaagaggccgaactgatgcagagccacatgatggaccaagctattaacaacgcaatcacctatctgggggctgaggccctacacccgcttatgcaacacccccctagtaccattgcagaagtggcccctgtaatttcatccgcctatagccaggtctatcacccaaacaggatcgagcggcctatctccagggagacggccgatagtcacgaaaacaatatggacggacctattagcttgataaggccaaaaagccggcctcaggaacgggaagcgagcccgtcaaattcctgtctggattctaccgattccgagtccagccatgatgatcaccaatcatatcagggtcaccctgccctgaacccaaaacgcaaacagagccctgcatacatgaaagaggatgtgaaggcactagacactaccaaggctccaaaagggtcactcaaagacatctataaggtctttaatggagagggtgagcagattagggcttttaagtgcgagcattgtagagttctattcctggaccatgtgatgtatactatccatatgggatgtcacggctaccgggatccactcgagtgcaacatttgcggatatcgatcacaggatcggtacgaattctcaagccacattgttcgtggggagcacacatttcactag

SEQ ID NO: 23208 - DNA, 720 bp, Artificial Sequence
  Description of Artificial Sequence: Synthetic coding sequence
atggaaactgaggctattgacggctatatcacctgtgataacgaacttagtccggagagagagcatagcaatatggccatcgacttgacatcatccactcctaatggtcagcatgcgtctccctcccatatgacatcaaccaactccgtgaaactggaaatgcaatcagatgaggagtgtgaccgcaagccactgtcacgggaggacgagatacgcggacatgatgaaggatcatccctggaagagcccctaattgagtcatcagaggtagctgataatcgcaaggtgcaggagttgcagggagaagggggaattaggctgccaaatgggaagctgaagtgcgacgtttgtggcatggtgtgcatcggacccaacgtgctcatggtgcacaagaggagtcatactggagagagaccttttcactgcaatcagtgcggggcatccttcactcagaaaggaaacctcttgagacatatcaaattgcacagcggagagaagccttttaaatgcccattttgtagctacgcttgcagacgacgcgacgctctgaccggccatctgcgaacacatagtgtcgggaagccccataaatgcaattactgtggcaggagctacaagcagcgctcatccctggaggaacacaaggagcggtgccataattacttgcaaaatgtcagtatggaggctgcaggccaggttatgtcgcaccacgattcatag

SEQ ID NO: 23209 - DNA, 1359 bp, Artificial Sequence
  Description of Artificial Sequence: Synthetic coding sequence
atggagaccgaagctattgacggttatattacttgcgacaacgaactatctcccgagagggagcattcgaacatggctattgatctgacatccagtacccccaacggacagcacgctagtccctcccatatgacgagcacaaacagcgtcaaattagaaatgcagtctgatgaggaatgcgacaggaaacccctgtcacgggaggacgagatacgcggacacgatgagggtagtagtcttgaagaaccactgatagagtcttccgaagtcgcggacaatcggaaggtgcaggagttgcagggggaagggggtattaggctacccaatggcgaaagaccattccattgtaaccaatgcggcgcaagcttcactcagaagggcaacctcttaaggcatatcaagctgcactcaggcgagaagccatttaaatgcccgttctgttcttacgcttgtcgacgcagagatgctctcaccggccacctccgcacacattctgtcgggaagccacataagtgtaattattgcggaaggtcttacaaacagcgtagttccctggaagaacacaaggaaaggtgtcataattatcttcaaaatgtgtcaatggaggcagctggccaagtcatgtcgcaccatggtgagaaacttatgcgcttcagctaccccgacatccattttgacatgaacctcacatacgaaaaggaggcagaattaatgcagtcccacatgatggaccaggcgatcaataatgccataacctacctgggggctgaggctctgcaccccttaatgcagcacccgccatccactattgccgaggttgcccctgtcatatcctcagcctattcccaggtgtatcatcctaatcgaattgaacgacccatatcccgggaaacagcagacagccacgaaaacaacatggacggccctatcagtttgattcggcctaagtctcgtcctcaggaacgcgaggcaagtccctcgaattcttgtctcgactctaccgattccgaaagttcacatgacgaccaccaaagctatcagggccatcccgcactgaatcccaaacggaaacagtcccctgcttatatgaaggaggatgtaaaggccttagacaccacgaaagcacctaaggggtcactcaaagatatttacaaagtgttcaatggcgaaggtgaacagatccgggcattcaagtgtgaacactgtcgtgtcctgtttcttgaccacgtaatgtatacgattcatatgggctgtcatgggtaccgcgatcccctggaatgcaacatttgcggctatcgctcacaggatcggtacgagttctctagccatattgtccgaggtgaacatacttttcactag

SEQ ID NO: 23210 - DNA, 720 bp, Artificial Sequence
  Description of Artificial Sequence: Synthetic coding sequence
atggaaactgaggccatcgacggttatatcacctgcgacaatgagttgagccccgagcgggagcacagcaatatggccattgatctgacaagctcaaccccgaatggtcaacacgcttctcccagccatatgacatccacaaatagtgttaagttggagatgcagagcgatgaggagtgcgacaggaagccacttagcagagaagacgaaattagaggacacgacgagggctccagcctcgaggaaccgctgattgaatcaagtgaagtagccgataacaggaaggtgcaagagctacagggagagggcggtattcggctcccgaacggaaagctaaagtgtgatgtgtgtgggatggtctgcatcggtccaaacgtgctgatggtgcacaaaaggtctcacaccggcgaacggccttttcactgtaaccagtgcggggctagcttcacgcagaaggggaatcttctccggcatattaaactacactctggagaaaagccctttaaatgccccttttgcagttacgcatgtcggcgacgcgacgctctgacgggacacttacggactcattctgttggaaagcctcataaatgtaattactgcggccgaagctacaagcagcgatcgagtttagaagagcataaggaaaggtgccacaattacctgcagaacgtcagcatggaagccgcaggacaagtgatgagtcaccacgactcgtag

SEQ ID NO: 23211 - DNA, 381 bp, Artificial Sequence
  Description of Artificial Sequence: Synthetic coding sequence
atgcactgtacactgactatggagaccgaagctatagacgggtacataacttgcgataatgaactgtcacccgagcgtgagcattccaatatggctatcgaccttacctctagcacgcctaacggtcaacatgcctccccctcccatatgacctctacaaattcggtgaaactcgagatgcagtccgatgaggagtgtgatcgcaaacccctgagccgcgaagacgagatcagaggacatgacgaaggaagtagtctggaggagcccctgatcgagagctcggaggtcgccgataaccgtaaggtgcaggaactccaaggggaaggtggcatcagactccccaacggtgaacgaccgttccattgcaaccagtgcgggtag

SEQ ID NO: 23212 - DNA, 1581 bp, Artificial Sequence
  Description of Artificial Sequence: Synthetic coding sequence
atggaaacagaagcaatcgacggatacattacctgcgacaacgagctgagtcccgagcgcgaacactcaaatatggccatagaccttacctcgagcactcctaatggccagcatgcctcacccagccatatgacaagcaccaactccgttaagctggagatgcagagcgacgaagagtgcgatagaaagcccctctctcgtgaggacgagatccgcggtcacgacgagggatcaagcctggaggagccattaatcgagagttcagaagtagcagataacaggaaggtgcaggagctgcagggagagggaggcattcgactgccaaacggcaaattaaaatgtgacgtctgtgggatggtctgcataggacccaatgtcctgatggtgcataaacggagccataccggcgaaagaccttttcactgcaatcagtgcggggctagttttacccaaaagggcaacttgctcagacatatcaagctgcatagcggcgagaagcctttcaaatgcccattctgctcatatgcgtgtcggaggcgggacgccttgacaggccatctcaggactcactctgtggggaagcctcacaaatgtaattactgcggcaggagctacaagcagaggagtagccttgaagaacataaagagcgatgtcataattatcttcagaacgtatcaatggaagccgctgggcaggtgatgagccaccatgtccccccaatggaggactgcaaagaacaagagccaattatggacaacaatatttctctggtgccattcgaaaggccagcagtgatcgaaaaacttacgggaaatatgggcaagaggaagtcctctaccccacagaaattcgtgggagagaagctcatgcggtttagttaccccgatattcatttcgacatgaacctaacttacgagaaagaagctgagctgatgcaaagccatatgatggatcaggccatcaacaatgccatcacatatctgggtgccgaggccctgcaccccctgatgcagcacccccctagtacgatcgccgaggttgctccggtgatcagctccgcttactctcaagtgtatcatcctaatcgcattgaaagaccaatttctcgggaaacagcagactcacatgagaacaacatggacggtcccatatccttgatccgaccaaagtctcggcctcaggagagggaggcttccccgagcaattcttgccttgatagcaccgatagtgagtccagccacgacgaccaccagagctaccagggtcaccccgctttaaatccgaaacgtaaacagagtcccgcttatatgaaagaagatgtgaaagccctcgatactactaaggcgcctaaaggatcacttaaagacatctataaggttttcaatggggaaggagaacaaatccgcgcttttaagtgcgaacactgtcgtgtcctgtttctggaccatgttatgtacaccatccatatgggttgtcacggataccgcgatcctctggagtgtaacatctgcggataccgctcgcaggataggtacgagttctctagccacatcgtgagaggcgaacatacttttcactag

SEQ ID NO: 23213 - DNA, 447 bp, Artificial Sequence
  Description of Artificial Sequence: Synthetic coding sequence
atggaaactgaggctatcgatggttacatcacttgcgacaacgagctttctccggagagggagcattctaacatggcgattgatctgaccagtagtacacccaatgggcagcacgccagtccatcgcacatgacttcaacaaactccgtcaagttagaaatgcagagtgatgaagagtgcgacaggaaacctctcagtagggaggacgaaattagggggcatgacgaaggatcgagcctggaggaacccctgattgagagctccgaagtcgcagataataggaaggtgcaggagctgcagggggagggtggtatccggctgcctaacggcaagcttaagtgcgacgtgtgcgggatggtctgcattggacccaacgtgcttatggtgcacaaacgaagccatacaggggttgcggttgttaagacaacgttctctgaattctgttag

SEQ ID NO: 23214 - DNA, 1365 bp, Artificial Sequence
  Description of Artificial Sequence: Synthetic coding sequence
atggagacagaagcgatcgatgggtatattacctgtgacaacgaattgagtcctgagcgagaacactccaatatggccattgacctgaccagctccacgccaaacgggcagcatgctagcccctctcatatgaccagcaccaatagcgtcaagctggaaatgcaatctgacgaagagtgtgatcggaagcccctctcccgggaggacgagattcgtggccacgatgagggaagcagtcttgaagagccactgatcgagtcatccgaagtggcggacaatcgaaaggttcaggagctccagggtgagggagggataagactcccaaatggcgaaagacctttccattgcaaccagtgcggggctagttttacgcagaagggaaacttgttacgtcatattaagcttcactcaggcgagaagccgttcaagtgtcctttttgttcctatgcttgccgacggagggacgccctgacaggtcatctgagaacgcattccgtgcctcctatggaagattgcaaagagcaggagcccatcatggataacaatatttccctggtgcccttcgagcgaccagccgtgattgaaaagctgactggaaatatgggaaagcgcaagtctagcactccacagaaatttgtgggcgaaaagctcatgcgattctcctaccccgatatccacttcgatatgaacctaacttacgagaaagaggcggagctgatgcagtctcacatgatggaccaggcaatcaacaacgccattacctatctgggtgcagaggccctgcaccctctgatgcaacatcctccctcgacaatcgcagaagttgcgcctgtgataagcagtgcctacagccaggtgtaccatccgaaccgaattgagagaccaatttcgcgagaaactgccgattcccacgagaataacatggacggcccaatttccctaatccgcccaaaaagtaggccacaggagcgagaggccagtccgagcaattcctgtctcgattctacagattctgaaagctcccatgatgatcaccagtcttatcaggggcaccctgcgcttaaccctaaacgaaaacagtcacctgcttatatgaaggaggatgtgaaggccctcgataccactaaggcacccaagggctccctgaaggatatttataaagtgttcaatggagaaggagagcagatccgggcattcaagtgcgagcattgtcgagtgttgttccttgatcatgtgatgtacaccattcacatggggtgtcatgggtacagagatcccctggaatgcaatatatgcggatatagatcccaggatcgttacgagttttcctcacacatagtcaggggggagcataccttccactag

SEQ ID NO: 23215 - DNA, 252 bp, Artificial Sequence
  Description of Artificial Sequence: Synthetic coding sequence
atggagacagaagctatcgacggctacatcacctgtgataacgaactcagcccggagagagaacatagcaacatggctatagacctcacttccagcactccaaacgggcaacatgctagtcccagtcacatgactagtactaattcagtgaaacttgagatgcagtctgacgaagaatgcgaccggaaacctctgtcccgtgaagacgagatcagggggcacgacgaaggttcgagcctggaggagccctag

SEQ ID NO: 23216 - DNA, 1581 bp, Artificial Sequence
  Description of Artificial Sequence: Synthetic coding sequence
atggagactgaagcaatcgacggatacatcacctgtgacaatgaactgtctccggaaagagaacatagcaatatggctattgacctgacctcgtctacgcctaatggccaacacgcgtccccttctcacatgacatccaccaatagcgtcaaattggaaatgcagagcgatgaagaatgcgaccgcaagcccctgagtagagaagacgagatccgcggtcatgacgagggttcatcgctggaagaacctctcatcgaaagcagcgaggtcgcagacaacagaaaagtccaggaattgcagggggaaggcggaatccggttgcctaatggcaagcttaaatgtgacgtatgcggcatggtctgtatcgggccaaacgtgttgatggtgcacaaaagaagtcataccggtgaaaggccattccactgtaaccagtgtggggcttccttcacacagaagggcaaccttttgagacacatcaagcttcactcaggcgagaagccgtttaaatgtcccttctgctcctacgcctgtcggcgtagagatgccctaactggccacctcagaacacacagtgtgggcaaaccccataagtgcaactattgcgggaggtcttacaagcagcgctcttcactcgaagaacataaagaaagatgtcacaattacctgcaaaatgtgtctatggaagccgcaggtcaggtgatgtcccaccacgtccccccaatggaggactgtaaagaacaggaaccgatcatggataataatatcagcttggtccctttcgagcgccctgcagtgattgagaagttaactggcaacatggggaagagaaaatcgtccaccccgcagaaatttgtgggcgagaagctgatgaggttttcttatcctgacattcattttgacatgaaccttacgtacgagaaggaagccgaacttatgcagtcgcatatgatggatcaagctatcaataacgccataacctatctgggcgcagaagccctgcacccgctgatgcagcatccacccagcactatcgccgaagtggctccagtgattagttccgcctacagtcaagtctatcaccctaacagaattgaaaggcccatcagccgagaaacggccgatagccacgagaacaacatggatggaccaatttccctgatccgccctaaaagccggcctcaggagagagaagcatccccgagcaattcatgcctcgactcaacagactctgaatcaagccacgacgatcaccaatcctatcaaggccaccccgctttaaacccgaagagaaagcaatctccagcctacatgaaagaggacgtgaaagccttggacacaacaaaagccccaaaaggctcgttaaaagatatttataaggttttcaacggcgagggggagcagattagagctttcaaatgcgagcactgtagggtactttttctcgatcacgtgatgtacaccatacacatgggatgccatggatatagagatccactggagtgtaacatctgtggctatcgcagtcaggaccggtatgagttctcctcccacattgtgcgcggagagcatacctttcattag

SEQ ID NO: 23217 - DNA, 693 bp, Artificial Sequence
  Description of Artificial Sequence: Synthetic coding sequence
atggagacggaggctatcgacggttatatcacttgtgataacgagctttcacctgaaagagaacactcaaacatggccatcgacctcacatctagcacaccgaatggccagcatgctagtccaagccacatgacctctaccattgccgaggtcgccccagttatatcttccgcttactcccaagtgtaccacccaaataggattgagcgacccatttccagggaaactgctgattcacatgaaaacaacatggacggtccgatatctctaatacgaccaaagtctcgaccccaggagcgagaggccagtccatccaattcatgtctcgacagcactgacagcgagtcctcccacgacgaccatcagtcataccagggccatcccgctctgaatccaaaaagaaagcagagtccagcctacatgaaagaagacgtcaaggcgctagatacaaccaaagcacctaagggctctctcaaggatatctacaaagtgtttaatggggagggggagcagatcagagcgttcaagtgtgagcactgtagagtcctctttcttgatcacgttatgtacacaatccatatggggtgccacggctaccgtgacccactggagtgcaatatctgtggctatcggtcccaggaccgctacgagttctcatcccacatagtcagaggcgaacacacatttcattag

SEQ ID NO: 23218 - DNA, 1260 bp, Artificial Sequence
  Description of Artificial Sequence: Synthetic coding sequence
atgggcgaaaagaaaccagagccccttgactttgtgaaagattttcaggagtatctgacgcagcagacacaccacgtgaatatgatttctggcagcgtgtcaggagacaaagaggccgaagccctccagggtgcaggtactgacggcgatcagaacggcctggaccacccatctgtggaagttagtctggacgagaactcaggcatgctagtggatgggttcgagcgtactttcgacggaaagctgaaatgccgctattgcaactatgcctctaagggcaccgctcgcctcatagagcatatccggatacataccggcgaaaagccccatcgatgccatttgtgccctttcgcttcagcctacgaacggcatcttgaggcccatatgcggagccacaccggggagaaaccatacaagtgcgaactgtgttcctttcgctgttctgacagaagtaatctctcccaccacagaagaagaaaacacaagatggtgccaattaagggcacacgttctagcctttcatcaaaaaaaatgtggggagtgctccaaaaaaagacctcaaacttaggctattcacgccgagccctcattaacctgtcgcccccttcaatggttgtccaaaagccagactacctgaacgactttacacacgagatccctaatatccaaactgactcctatgaaagcatggccaagacaacacccactgggggactgcctcgagatcctcaggagctgatggtggataacccgcttaaccagctgagtacattagccggacagctatctagtctgccccctgagaatcagaaccctgcttctcccgatgttgtcccctgccctgacgagaagccattcatgatacagcagccaagcactcaggcggtggtgagcgctgtctccgcctcgatcccccagagtagcagccctacatcccctgagcctaggccgtcgcactcccagcgcaactacagccccgtggccggtccttcctcagagccatcagctcatacatcaacaccatcaatcggtaattcccagccttcaacccccgcacccgctctgcctgtgcaagatccacagttactgcatcattgccagcattgcgatatgtacttcgcagacaatattttatacacaatccacatgggctgccacgggtatgagaatccgttccagtgcaatatctgcggatgtaagtgcaagaacaaatatgattttgcctgccattttgccagaggccaacacaatcagcactag

SEQ ID NO: 23219 - DNA, 1542 bp, Artificial Sequence
  Description of Artificial Sequence: Synthetic coding sequence
atgcgagaaggggcatgcaagcttttggctgcatgttcacaaagagaacaagccctggaagctacgaagtctctgttggtgtgtaattctcgaatcctcagttacatgggcgagcttcagagaagaaaagaagcacaggtgcttggaaagacgagcagacgcccaagtgactccgggcctccagcagagaggagtccctgccgcggacgcgtgtgcattagcgatctccgtatacccttgatgtggaaggatacagaatatttcaaaaacaagggggaccttcacaggtgggctgtgttcctgctcctccaactcggggagcacatccaggatacagaaatgatcctggtcgacagaacattgaccgacatttcttttcaaagtaacgttttgttcgctgaagcgggacccgatttcgagctccggctggaactgtacggcgcttgcgttgaagaggagggtgcgttgacgggaggcccaaagcggctggctaccaaactgagctcgtcgctagggagaagctccggaagacgagtgagagcctcactcgattcagcaggtggcagtggaagctccccaatccttctacccactcccgtcgttgggggtccacgctaccaccttttagctcacactactttgacattggccgctgttcaagacggtttccgaacccacgatctaactctggctagtcacgaagagaatcccgcatggctgccgctgtacggaagcgtgtgctgtcggctggccgctcagcccctctgcatgacccagcctacagcctctggaaccctgagggtgcaacaggccggtgaaatgcagaattgggcccaggtgcatggcgttttaaagggtacgaatctgttctgctatcgtcagcctgaggacgccgatactggagaggagccgctgcttacaatcgcggtgaacaaagagacaagggtccgtgccggtgagctggatcaggcactggggaggccgttcacactgagtatatctaaccaatacggcgatgatgaagtgacacacactctgcagacagagtctagggaggccctgcagagctggatggaggccctgtggcagctgtttttcgacatgtcccagtggaagcaatgctgcgacgagataatgaaaatcgaaactcctgcgcctagaaagcctccacaggcactggccaagcagggaagcctgtaccatgaaatggcaatcgagcccctcgatgatatcgcagccgtaaccgacatacttacccagagagagggagctcgcctcgagacaccccctccttggttagccatgtttacagatcagcctgcactgcctaacccctgcagccccgcatccgtagctcctgcccctgactggacacatcccctgccttggggacggccacgcacatttagcctggatgctgttccacctgatcattcaccccgagcacgcagtgttgcccctttaccccctcagagatctcctcggacacggggactatgttcaaaagggcaacccaggacatggctgcagagccccgtctag

SEQ ID NO: 23220 - DNA, 1092 bp, Artificial Sequence
  Description of Artificial Sequence: Synthetic coding sequence
atgagcaagttatggcgtcgcggatccaccagcggggctatggaggcgcctgagcctggggaggccttagagctttccctggccggagcccatggccacggagtgcacaagaagaagcacaaaaaacacaagaaaaagcacaaaaaaaaacatcaccaggaggaggatgccggtccaacccagcccagtcccgcaaaaccccaactgaagctcaagataaagctcggaggtcaggtgctcggaacaaagtctgtgcccacttttacggtcattcctgagggtcctcggagtccatctcctctcatggtcgtggacaatgaagaagagccaatggagggcgtgccactggagcagtaccgggcatggctggacgaggactcaaacctatcaccctctccactgcgcgacctgtccggcggactcgggggtcaggaagaagaggaagaacagcggtggttagacgctcttgagaagggagaattagacgacaacggcgacttgaagaaagagataaatgaacgactactgaccgccagacagcgcgctctccttcaaaaagccaggtcacaaccctctccgatgcttccactgccagtcgccgaaggatgccccccacctgctctgacagaagaaatgctgctaaaacgggaagaacgggcaaggaagagacgtctccaggctgctcggagggcagaggaacataagaaccagacaattgagcgcctcaccaaaaccgcagctaccagtggcagagggggaaggggtggcgctaggggcgaaagacggggaggaagagctgccgctccggcaccgatggtgcgatactgctccggggctcaggggagcactttgagcttcccgccaggggtgccggcacctactgctgtgtcccaacgtccatccccctctggcccacctcccagatgttccgttcctggctgtccacaccctagaaggtacgcctgttcacgcacagggcaagccctctgcagcttgcagtgttataggatcaatctccagatgcggcttgggggacccgaaggtcctggtagcccgttactggctacattcgagagctgtgcacaagagtag

SEQ ID NO: 23221 - DNA, 594 bp, Artificial Sequence
  Description of Artificial Sequence: Synthetic coding sequence
atggcagcccaaattcctatcgtcgccactactagtacacccggaattgtcagaaactctaagaaacgtccagcctctccttcccacaatggatctagtggcggaggctacggtgcttccaaaaaaaagaaggcatccgcttcctctttcgcacagggaatatccatggaggctatgtccgagaataagatggtgccctcagagttttccactggtccagtagagaaagctgccaagcctctgccgttcaaggaccccaacttcgtccatagcggccatggcggtgctgtcgccggaaaaaaaaaccggacctggaagaatctgaagcagatcctcgcttcagaacgggcattgccatggcagctgaatgatcccaactacttcagcatcgatgcccctcccagcttcaagcctgctaagaagtactctgacgtgagcgggcttctggagcctccaaactgctttccccaaaggctccatcaattgacatttcctctggcaatggatgaaggatcaaatttcagtaggtgcagcccaacgctggtcaatttcggcttcgtctttatcatggctatcctggtcggtgttaaatag

SEQ ID NO: 23222 - DNA, 579 bp, Artificial Sequence
  Description of Artificial Sequence: Synthetic coding sequence
atggctgcccagatcccaattgtggcaacgacttctacccctggtatcgtccggaactcaaaaaagaggcctgcctcacccagccacaatggatcatcagggggaggttacggggcatccaagaagaagaaagcttccgcctctagcttcgcccaggggatcagtatggaggctatgtcggagaacaagatggtgccaagtgaattttcaacgggtcccgtggaaaaagccgcaaaaccactcccatttaaggacccgaactttgtccacagtggccacgggggtgcagtggccggaaaaaagaacagaacatggaagaatctaaaacaaattcttgccagcgaacgcgctctgccgtggcaacttaatgaccctaattacttctccatcgatgctcccccatccttcaaacccgctaagaaatacagcgacgtaagcggcctcctggctaattataccgatccacagagcaagctcagattcagcaccattgaggagttctcctatatccgcaggcttccatccgacgtcgttacagggtacctggctcttaggaaagctacatccattgtgccatag

SEQ ID NO: 23223 - DNA, 687 bp, Artificial Sequence
  Description of Artificial Sequence: Synthetic coding sequence
atggccgcacagattcctatcgtcgccactacttctacgccgggtattgtaagaaactcaaaaaaacggcctgcaagcccaagccacaatggctcttccggaggtgggtatggcgcatccaagaagaagaaggccagtgcgtcttctttcgcacagacatgcctgtcccctagcacaatgattgttagaccccctcagcctcgcggaactacttgcctgctgccctcagctatgattgttcgtccaccccagccacgcggaaacggcataagcatggaggcgatgagcgagaataaaatggtcccttctgagttcagcaccgggccagtagagaaagcagctaaaccccttccctttaaggacccaaatttcgtccattcaggccatgggggagccgtggcagggaaaaagaaccgcacatggaaaaatctaaagcaaattctcgctagtgaacgtgcccttccgtggcagctgaacgaccctaactacttcagcattgacgccccacctagcttcaagcccgctaaaaagtattccgatgtgtctggccttctggcaaattacaccgatccacaaagcaagctccgctttagcacaattgaggagttctcctacatccggagattgccctctgatgttgtgactggctacctcgcacttaggaaggctacttcaattgtcccctag

SEQ ID NO: 23224 - DNA, 13692 bp, Artificial Sequence
  Description of Artificial Sequence: Synthetic coding sequence
atggatcctccacgtcccgcacttctcgctctgctcgctctgcctgccttactcctcctcctcctggctggcgcacgcgcagaggaggagatgttagagaacgtatctttggtttgccctaaggacgcaacacgctttaagcatttgaggaaatatacatataactatgaggccgaatcgagctctggtgtgccgggaacagccgactcaagatctgctactcggatcaactgcaaggtggagctggaagtgccccagttgtgttcatttattttgaaaacatcgcagtgcacgctaaaggaggtttatggtttcaacccagagggcaaggcactcctgaagaagacgaaaaacagcgaggagttcgcggctgccatgtctcggtacgaactgaaacttgcaatacctgagggaaaacaggtgttcctttacccggagaaggatgagccaacatatatcctgaatatcaaaagagggatcatttccgctttactagtcccgccagaaactgaagaagccaaacaagtcctgtttttggacactgtgtacggaaactgctcaacacacttcactgtgaagaccaggaagggaaacgtagccactgaaatatccaccgaaagggacttgggccagtgcgacaggttcaaacctattagaacaggaatatcacccctggccctcatcaagggcatgaccagaccactgagcacgctgatctcgtctagccagtcctgccagtacactcttgatgctaaaaggaagcacgtcgctgaagctatctgcaaagaacagcacctgttcctgccttttagctacaaaaacaagtacggtatggtggcacaggtgacccaaaccctcaaactggaggatacccctaagatcaattcaaggttcttcggtgagggcacgaagaagatgggtctcgcttttgagagtacgaagagcacctccccgccaaaacaagccgaggcagtactgaaaactctccaggagctgaagaagctgaccatctctgagcaaaacattcagagggccaatttattcaacaaactggtgactgagctccgcggtttatcagacgaggcggtgacatctctgctgcctcaactcatcgaagtgagtagccctatcaccctccaggcattagtgcagtgcggccaaccccaatgcagcacccatatcctccaatggcttaagagagtgcacgcaaatcccttactgattgatgtggtaacctatttagttgccttgatccccgaacccagtgctcagcagctccgagagatctttaatatggccagagatcagaggtctcgggcaacactgtatgctctgtcacatgcggtgaacaactaccacaagacgaacccaaccggcacgcaagagcttctcgacattgccaactatttaatggagcagattcaggatgattgtacgggcgatgaggactacacatatctaattctgagagtaattgggaatatgggccagacgatggaacaacttactcctgaactcaaatcatccattcttaagtgcgtacagtccaccaagccatcactaatgatccagaaggccgctattcaagcattgcgcaaaatggagcctaaggacaaggaccaggaggtcttgttgcaaaccttcttagatgacgcttcgcccggtgacaaaagactggccgcatacctgatgctcatgcgcagcccctcacaggcagacataaacaaaatcgttcaaattttgccatgggagcagaacgaacaggtgaagaactttgttgcaagccatatcgctaacattctgaacagcgaggagctggatatccaagacttaaaaaagctggtgaaggaagccctgaaggaatcgcaactgcctacagtgatggactttcgcaaattttctagaaactaccagctgtacaaatccgtgtcccttccctctttagaccctgcttccgccaagattgaggggaacctgatcttcgatcccaacaattacctgccaaaggaatccatgctgaagaccacgctcaccgcctttgggttcgccagcgctgatctgatcgagatcgggctggagggcaagggtttcgagccaaccctggaagctctctttgggaagcaggggttttttccagattctgtgaacaaggctctgtactgggtcaatgggcaagtgcctgacggagtgtccaaagttttggtagaccacttcggctatactaaggatgacaaacatgagcaggatatggtcaatggcatcatgctttcagtggaaaagctcatcaaggatttgaagtccaaagaggtacccgaagcacgggcttatctcagaatcctcggcgaagagctcggctttgcttccctccacgacctgcagctgttggggaagttattacttatgggggctcgcacgctgcagggaatcccacagatgatcggggaggtcattaggaagggctctaagaacgatttctttctgcactacatcttcatggagaacgcttttgagcttccaactggcgcagggttgcagctgcagatatcttcatccggagtgatagccccaggggcaaaggcgggtgtaaagttggaagtagctaatatgcaagctgaactggtggccaagcccagtgtgagtgtcgagttcgtaacaaacatgggcatcattattccagattttgccagaagcggtgtccagatgaacactaacttctttcacgagtctggccttgaggctcacgtggctcttaaggcaggaaagttaaagttcattattccatcaccaaaacgcccagtaaaactgctgtcagggggaaatacactgcacctggtctccactaccaagactgaggtgatccccccactgatcgagaaccggcagtcatggtcggtgtgtaagcaggtgtttcctggtcttaactattgcacatcaggggcttactcaaatgcctcttccaccgatagtgccagttattatccactgaccggagatactaggctggagctggagttgcgacccacaggtgagatcgaacaatattccgtgtccgctacatacgaactgcagagagaggacagggccctggtggatacacttaagtttgtgacacaggccgagggagcaaagcagacagaggctacaatgacatttaaatacaataggcagagtatgactctcagctctgaagtacagattccagatttcgatgtcgacctcggaacaatcctccgggtcaatgatgagtccaccgagggcaaaacctcctaccggctgacgttggatatccagaacaaaaaaattacagaggtggcactgatgggacacctcagctgtgacacaaaagaggagagaaagatcaaaggagttatatcaatccctcggctacaggcagaagcccgttctgagattctggctcactggtcgccggcaaaactgcttctgcagatggacagctctgctacagcttacggcagcaccgtgagtaagcgggtcgcttggcattacgacgaggagaaaatcgaatttgaatggaacacgggtaccaatgtcgatacgaagaagatgacctcaaatttccctgtggatctgtcagactaccccaagtcactgcacatgtatgccaatcggttactcgatcacagagtgcctcagactgatatgacttttagacacgttgggagcaagctcattgtggcaatgtcgagctggcttcagaaagcttcaggcagcctgccttatacacagacactgcaggaccacctcaattctctcaaagagtttaacctgcagaacatgggcctcccagattttcatatccccgagaatctcttcctgaaaagcgacggtcgggtaaaatatacattaaacaaaaactccctgaaaatcgagataccactgcctttcggcggaaaaagctctcgcgacctcaagatgctggagacagtgcgcacaccagccctgcactttaagagcgtaggttttcacctcccatctcgcgagttccaggtgccgacattcaccattccgaagctgtaccagttacaggtgcccctcctgggagtgctggatctctcaaccaacgtgtatagcaatttgtacaactggagcgcttcttatagcggagggaacacatccacagaccacttctctctccgcgctcgataccacatgaaagccgattcggtggtggatctgctgtcttacaacgtgcagggatcaggcgagaccacctatgaccacaagaatacgtttaccctaagttatgatggatcactccgccacaagtttctggattctaacatcaaatttagccatgtagagaagttgggcaataatcccgtgtcaaagggactacttatttttgacgcctccagttcctggggtccccagatgagcgcaagtgttcacctggattcaaagaagaaacagcacctcttcgtgaaagaggtcaaaattgacggccagtttcgtgtgagtagtttctacgcgaaaggaacctacgggttaagctgtcagcgggatccgaacacgggaagattaaatggagagagcaatctgcgattcaactcctcatacctgcagggcacaaaccagattaccgggagatatgaggacggcaccctctccctgacatctacctcggacctgcagagtggcataattaaaaacactgcctcactgaaatacgaaaactatgaacttacgttgaaaagcgacacaaatgggaaatataaaaactttgctaccagcaacaaaatggacatgacgttttctaagcagaacgccctactgcgctccgaataccaggccgattatgagtccctacgattcttctccctgctttcgggaagtctgaatagtcacggacttgagctcaatgctgacatcctgggtacggacaagatcaattccggtgcccacaaagctaccctgcgcatcgggcaagacggtatttccacaagcgccactacaaatctgaaatgcagcttgcttgtactggaaaatgagttgaacgcggaactgggcttatccggggcttcgatgaaactaactactaacggcagattcagggaacacaatgccaagttctctctcgatggaaaggccgcactgactgaactgtcgctgggatccgcttaccaggctatgatcctcggggtagactctaagaatatcttcaattttaaggtgtctcaggaaggattgaagctgtcaaacgacatgatgggctcctacgcagaaatgaagttcgatcacacaaattccctgaatatcgcaggcctgtctttggacttctcatctaaactggataacatctacagttccgataagttctataaacaaaccgtgaatttacagctccagccttatagtctggtgaccacattaaactcagatctcaagtacaacgcgctagatctcacaaataacgggaagctgcgcttggagcccctgaaactgcacgtggccggaaacctgaaaggtgcgtaccagaataacgagataaagcatatctatgccatcagctccgcagctctctccgcctcatataaggccgacacggtggccaaggtgcaaggcgttgagttttctcacaggctcaacaccgacattgcaggactggccagtgctatcgatatgtcgacaaattacaattcagatagtttacacttttctaatgtgtttcgcagcgttatggctcctttcactatgacaatcgacgcacacacaaacgggaatggaaaactggctctctggggagaacacacaggccagctgtacagtaagttcctcctgaaggccgagccactggcttttaccttcagccacgattacaagggatccacctcccatcacctcgttagtagaaagtccataagcgcggctcttgagcataaggtctccgcactgctgactcctgctgaacagacagggacatggaaactcaagacccagttcaataataatgagtatagtcaggacctggatgcctacaataccaaggataagatcggagtggagctcaccggccgtaccctggccgaccttaccctgttagacagccctatcaaagtcccactacttctgagcgaacctatcaacatcattgatgccctggaaatgagagatgcagttgaaaaaccacaggagtttaccatagtcgctttcgtgaaatatgataaaaaccaggatgttcacagtatcaatctcccattttttgaaacgctgcaggaatacttcgaacgaaaccgtcaaacgattattgttgtcctggagaacgtccaaaggaatctcaagcacatcaacatcgaccagtttgtccggaaatacagagccgctttaggaaaactgcctcagcaggccaatgactacctgaactcctttaactgggagcggcaggttagtcacgccaaggagaaactgacggctctgacaaaaaagtaccggattacagaaaacgacatccagatcgctcttgacgacgcaaaaatcaattttaatgagaaactctctcagctgcagacttacatgatccaattcgatcagtatatcaaagattcttacgatctccatgatctcaagatcgcgatcgccaatattatcgacgaaattatagaaaagctgaagtcactagatgagcattatcacattcgagtgaacctggtcaaaaccatccacgatcttcatctgtttatagaaaacatagatttcaataaatctggatctagcaccgcgagttggatccagaacgtcgacactaagtatcagatccggatccaaattcaggagaagttgcagcagctcaagaggcacatccagaatatcgatatacagcacctggccggaaaattgaaacagcacattgaggccattgacgtgagagtgctcctagaccagctcggtaccactatctctttcgagcgtattaatgatatcctggagcatgttaagcatttcgtgatcaacctgataggcgacttcgaggttgctgaaaagattaatgcttttcgcgctaaggttcacgagctcatcgaaaggtatgaggtcgatcaacagatccaggtgctgatggataagttggtggagcttgcccaccagtataaactgaaggagaccatacagaagctatctaatgtgcttcagcaggtgaaaatcaaagactactttgaaaagctggtaggtttcatagatgatgctgttaaaaagctgaacgagttaagcttcaaaacatttatcgaggacgttaacaaattcttagatatgctcatcaaaaaactgaaatccttcgattatcaccagttcgtcgacgaaactaacgacaagattagggaggtcacacagagattgaatggcgagatccaggccctcgaattgccccagaaagccgaggcactgaaactgttcctcgaagagactaaagcaactgtggctgtgtacctcgaatcgcttcaggacaccaagatcacactgattatcaattggttgcaagaagccttgagttctgccagtctggcccatatgaaagccaaatttagagaaacacttgaagatacccgtgacagaatgtatcagatggatatccagcaagaactccagagatatctgagccttgtgggccaggtttactctacactcgtcacttacatctcagattggtggaccctagcggctaaaaatcttacggacttcgctgaacagtatagcattcaagattgggccaaacgtatgaaagcactcgttgaacaagggttcacagtgcccgagatcaagacgatcctgggcacgatgccagccttcgaggtttctcttcaagctctacagaaggcaacctttcagacacctgactttatcgtcccactaacagatctgcgtattccatcagtgcaaatcaactttaaagaccttaagaatatcaagattccctccagattctccaccccagaatttacaattcttaatacgttccacatcccctctttcacaattgactttgtggaaatgaaagtcaagatcatccggaccattgatcagatgctgaactctgaactccagtggccggtcccagatatatacctccgtgacctaaaagtggaggacattccactagcacgcataacacttccggatttcaggctccccgagatcgctatcccagaatttatcatccctacgcttaacctgaatgacttccaggtgccggatctgcacattccggagtttcagcttcctcatattagccataccatcgaggtacctactttcggcaagctatacagcatcctgaagattcaaagccctctgtttaccctggacgccaatgccgatatcggaaacggcactacttccgcaaatgaggccggtatagcagctagcattactgcgaaaggagagtccaaattagaagtcctaaacttcgacttccaggccaatgctcagctatctaatccgaagataaaccccctcgcgcttaaagaaagcgtcaagtttagttctaaatacctgcgcacagagcacggaagtgagatgctgttttttgggaacgccattgaggggaagtcgaacacggtggctagcctccacactgagaagaataccctggaactttccaacggcgtgatagtcaaaataaataaccagctgactcttgacagtaacacaaaatatttccataaactcaacatccccaagctggacttctcatctcaagcagatctgcgtaacgaaatcaaaactctgctgaaggcaggccacatcgcttggacatcctcaggcaaaggtagctggaagtgggcatgcccccgttttagtgacgaaggcacccacgaaagtcagatatcctttaccattgagggaccattaacctcttttggcctgagcaacaagattaactcaaagcatcttagggtgaaccagaatttggtgtacgaaagtgggagccttaatttttctaagctagagatacagtcacaggtcgattctcaacatgtcggccattccgtgctgacagccaaaggaatggcactttttggagagggaaaagctgagttcaccggcagacatgatgctcatctaaacggaaaggtgatcggcactttgaaaaacagcctcttcttctctgcacagcccttcgagatcacagcaagtaccaataacgaggggaatctgaaggtgcggttcccacttcgactgacaggtaaaatcgattttttgaataactacgccctgtttcttagccccagcgcccagcaagcctcttggcaggtgtctgcccgattcaatcagtacaagtacaaccaaaatttctccgccggaaacaacgagaacatcatggaggctcatgtaggtatcaatggcgaggcaaacttggatttcctcaatattccactaaccatccccgagatgcgactgccatacacaattatcacaaccccacctctgaaagattttagcttgtgggagaagacaggtttgaaggagtttctaaaaaccacgaaacaaagcttcgatctctcggtgaaagcacaatataaaaagaacaaacaccgacattccattacaaaccccctggctgtcctttgtgaattcatttctcagtccatcaaaagtttcgaccgacacttcgaaaagaatcgcaacaacgctctcgattttgttactaaatcgtataacgagacgaaaattaaattcgataagtacaaggcagagaagtctcacgatgagcttcctcggactttccagatcccaggctataccgtgcctgttgttaatgtcgaagtgtctccttttactatagaaatgtccgctttcggctatgtcttccccaaggcagtttccatgccttcgtttagcatattaggatccgatgtgcgcgtgcccagctatacactgatcctgcccagcttggagttgcccgtgctgcatgttccacgcaacctgaagctcagcctgccggacttcaaggaattgtgtactatttcgcatatcttcattcctgcaatgggcaatataacctacgacttcagtttcaaaagcagtgttatcactctgaacaccaatgccgagctgttcaaccagtcagatattgttgctcacctgttaagttcctcgtcatccgtgattgacgccctacagtataaactcgaaggtacgactcgattgactcgaaagcgcggattgaagcttgccacggccctgtctctgtcaaacaagttcgtggagggctcacacaattcaacagtgagtctgacaaccaagaacatggaggtgtcagtggctaccacaacaaaggcccagattccaatcttgagaatgaacttcaagcaggaacttaacggaaatacaaagagtaaacccacggtaagctctagtatggaattcaagtatgactttaatagcagcatgctttactcaacagccaaaggagccgtggaccataaattgtctttagaaagccttacctcttacttcagtatcgagtcctctacaaagggagacgttaaggggtcagttctgtcgcgggagtacagcggcacaatcgccagcgaggctaacacctatcttaacagtaaatcaactcgcagctctgtgaaactgcagggcacctctaaaatcgacgatatctggaacctggaggttaaagagaatttcgctggcgaagccacactccagaggatatactcattgtgggaacactctacaaaaaaccatctgcagcttgaagggttgttctttacaaacggcgagcatacatccaaggccactcttgaactatcaccctggcaaatgtccgctttggtacaggtgcatgctagccagccatcttcgtttcacgactttccagatttaggccaagaggttgccctcaacgccaataccaagaatcagaagatccggtggaagaatgaagtgaggatacactccggatcttttcaatcacaggttgagctgtccaatgaccaagaaaaggcacacctggacattgctggcagtctggaggggcatctaaggttcttgaaaaacataattctaccagtctatgacaaatccctgtgggacttcctaaagttggatgtcactacttctataggcaggcggcaacatctgagggtcagcaccgcgttcgtgtacaccaagaacccaaacggctacagcttcagtatccctgtcaaggtacttgccgacaaatttatcatccccggactgaagctgaatgacctgaattcagtcctcgtcatgccgacctttcacgtgcccttcacagatctgcaggtgcccagttgcaaactggattttagggagattcagatttataaaaagctgaggacgtcctcttttgcccttaatttgcctacgctgcctgaagtcaaatttcctgaggtggacgtactcaccaagtactcccagccagaagattctctgatcccatttttcgagattaccgtcccggagtctcaattgaccgtgtctcagtttactcttccaaaatccgtgagtgatgggatagccgcactggatctcaatgcagtcgccaacaagattgccgacttcgagctaccgactatcatcgtccccgaacagacaatcgaaatcccatcgatcaagtttagcgtacctgcgggtatcgtgattccctcctttcaagctctaacagctcggtttgaggtagattctcccgtgtataacgctacctggagtgcctccttaaagaataaagctgactacgtggagaccgtcttggactccacctgctcatcgaccgtccagttcctcgagtatgaactgaacgtattgggtacccacaaaatcgaagatggcactctcgcatctaaaactaaagggaccttcgctcatcgcgatttttcagcagaatatgaagaagatggcaaatacgaagggctgcaggagtgggaaggcaaggcgcacctgaatattaaaagccccgcattcactgatctgcatctacgctaccagaaggacaaaaagggcatcagcacctcagctgctagtccagccgtcggcactgtcgggatggatatggacgaagatgacgacttctccaaatggaatttttattactccccacagagctccccggataagaagctcaccatattcaaaaccgagcttagagtgcgggagtcggatgaagaaacccagatcaaagtgaattgggaagaagaagccgcttcgggcctcctgacatccctgaaggataacgtcccaaaggccacaggggtactgtacgattatgtgaataagtaccattgggagcatacgggcctgacgctcagggaagtttccagtaaactcagaaggaatctgcagaacaacgcggagtgggtttatcagggtgcaattaggcaaatcgacgatatcgacgttagatttcagaaggcagcctccggcactactggaacataccaggagtggaaagataaagcccaaaatctgtaccaggaattactgacacaggagggccaggcatcttttcagggtttaaaagataatgtgttcgatgggcttgtgcgtgtgacccaggaatttcacatgaaggtgaagcacttaattgactcattaattgactttctgaacttcccgaggtttcaatttccgggtaagccaggaatttacaccagagaagaactgtgcactatgttcatcagagaggtgggaacggtgctctctcaggtctatagtaaggtgcacaacggttctgaaatactcttcagttactttcaggaccttgtgataaccctgccgttcgagttacgcaagcataagttaattgatgtgatctctatgtacagggagctcctgaaggacttatcaaaggaggcacaggaggttttcaaggccatccagagcctcaagacaaccgaggtgttgcggaacttgcaggacctgctccaatttatattccaacttatcgaagataacatcaagcagttaaaggaaatgaaattcacgtaccttattaattatatccaagatgagatcaacactatctttagcgactacataccttacgtcttcaaactacttaaggagaatctttgtttgaacttgcacaagtttaacgaatttatacagaatgaactccaagaggccagccaagagctccaacaaatccaccagtacattatggccctgcgggaagaatattttgatccttcaattgttggatggaccgtgaagtactacgaactagaagaaaagatcgtgagcttaattaaaaatctgctggtcgccctgaaggactttcactctgagtatattgtgtcggcgtctaacttcacttcacagctgtccagtcaggtggaacaattcctccatcggaatatccaggaatacctgagcattctgacagatcctgatggaaaaggaaaggaaaaaatcgccgagttaagcgcaaccgcccaggaaatcattaaatctcaggccattgccacaaaaaaaatcatttctgattaccatcagcaattccgctataaactgcaggatttctccgaccagctctctgactattatgagaagttcatcgcggaatccaaaagattaatcgatctgagcatccagaactaccatactttcctgatctacatcacagaattgcttaaaaaactgcagagcacaaccgtaatgaacccttacatgaaactggctccaggggagctcaccattatactttag

SEQ ID NO: 23225 - DNA, 3084 bp, Artificial Sequence
  Description of Artificial Sequence: Synthetic coding sequence
atgtatgagggcaaacacattcacttctccgaggtcgataataagccattgtgcagttattcacctaagctgtgcaagcagcggcgtttgaatgggtacgccttttgcatcagacacgtgctggaggacaagacggccccttttaagcaatgcgaatatgttgcaaaatacaattcgcagaggtgcactaaccccatcccaaagagcgaagaccgcagatattgcaactcccacctccaggtgcttggctttataccaaagaaggagaggaaaaaaaagaatgatcccatcgacgaggtcaaagtgcggcaccagatggatacaatggctttctccttgactgtgcctaccctggccctgaagatgccaaacggtctcgacggtatgtccctgagccctccaggcgcacgcgtccccctacactacttggaaaccgagctggaggaccccttcgcatttaacgaggaagacgatgatctgaaaaaaggagcgacagttcgtaagaaacttcagtctaaactggcccagaatcgccaacggcagcgagaaaccgagatactaaaggtcaggcaggaacacttttcccctcctccagcgcctagtcaacagcagcctcctcagcaacattcgcatttaagccctttatccacctccctaaagccacccgcaccccctcaaggcagtgtttgtaagtcaccacagccacagaacacttccctccccatgcagggcgtggctccaacaacgcatacgattgcacaagccagacaactgtcacataagcggccactgcctttattaccctccagcagagctcccacagttgatcccccaaggacagatagaatcctgatgaaggcaactgcctttagtccgcacttctcctgcatcagccgccttcaaaggttggtaaagttgtgcactcaaaagcaccaattagacactgaccttttcccacacctcggattggattggagtgaggagtctggagaagagcccgaggacagcgagcaggccagcccttaccaagtagcctggtcaattagggaaacccttcgctatcagcgccacgcgagcgatgacgacgacgccgaatccaggtcgtcacgggtgacacaactgtgtacgtactttcaacagaagtacaagcacctgtgcaggctcgagcgggctgagtcaaggcagaagaaatgtcgtcatacatttcggaaggccctgctccaggcagcatctaaggagccagagtgtaccggtcagctcatacaggaactgcgtagggccgcatgcagccggacatcaataagcagaactaagctgcgtgaggtagagccagccgcttgcagcggaaccgtcaagggggaacagtgcgcaaacaaggcattacctttcacccgccattgtttccagcacatcttgcttaaccactcacaacagttattttcctcctgtactgcaaaattcgccgatggacagcagtgttcagttccagtgtttgatattacccaccagacccccctgtgtgaggagcatgcaaagaagatggacaactttcttaggggagacaactcccgtaaagtgcagcatcaacagcaaagaaagcccaggaaaaagacgaaaccacctgccctgacaaaaaagcacaagaaaaaacgtcgtcgtgggccacgaagaccccagaaacctattccacctgcagtgcctcaagggaatctttcaatgcccgcaagtgtttctctgccggtggaggcatcacatatcagaagtcccagcacacctgagctgagtgccgacgaactcccagacgacatcgctaacgaaattaccgacatccctcatgatctagaattgaaccaggaggactttagtgatgtcctccccagactgcccgatgacctgcaggactttgatttcttcgaagggaagaatggcgacctgctccctaccacagaggaggctgaagaactggaacgggcactgcaggccgtcactagccttgagtgtctaagcaccatcggggtcctggcacagtccgacggcgtccccgtgcaggaactgtcggacagaggcatcggggtcttcagtaccgggactggtgcctcgggaattcagtcattatccagggaggtcaacactgacctaggcgaactcctgaatgggcgaattgtccacgacaattttagtagcctggaactggatgagaatctactcaggtccgctacattgagcaacccgccaacacccctggccggacaaatccaggggcagttctcagcccctgctaacgtcgggctaactagtgcaacattgatttctcagtctgccctaggtgagagggccttccccggacagtttcatggcctgcatgatggctcccacgcatcgcagcgaccccaccctgcacagttactctccaaggccgacgacctcataacgtccagacagcagtacagttccgatcactctcattcgtcaccacatggatcacactacgatagtgagcacgttccaagcccctacagtgaccatataaccagccctcacaccactagttactccggggacaatatggccgctacctttagcgcggagatgccaattatggcacagcatctgttgcccacccagcttgaggtgccactggggggagtcgtgaatccacgtacccattggggcaatcttcctgtgaatttaggcgacccaagccccttctctaatctgctcggggctgatggccatttgctatctaccagcctgtctacacctccaaccacaagcaacagtgagacaacacagcccgcattcgctacagtcacccctagtagctcaagtgtcctgcccggactcccccagacttccttctccggcatgggaccatccgccgagctgatggcctccacctcccccaaacagcagctccctcagttttccgccgcattcgggcaccagctttcatctcatagcggcatcccaaaggacctccagcccagccactcttccattgcaccccctaccggattcaccgtgacaggtgcaaccgccacgtcaacaaataacgcctcttctcctttcccctcccccaactag

SEQ ID NO: 23226 - DNA, 114 bp, Artificial Sequence
  Description of Artificial Sequence: Synthetic coding sequence
atgtacgaaggcaagcacattcacttctccgaggttgataacaagccactctgcagctactcacccaaactgtgtaaacagaggcgtttgaacggctatgcattctgcatctag

SEQ ID NO: 23227 - DNA, 735 bp, Artificial Sequence
  Description of Artificial Sequence: Synthetic coding sequence
atgaacggccctgcggacggcgaggtggactataagaaaaaatatcgcaacttgaagcgaaagcttaaattcctaatttatgaacacgagtgttttcaggaagagctccggaaggcgcagcgtaagctcctcaaggtttcccgggacaaaagttttctcctggatcggctcttacagtacgaaaatgttgatgaagacagctccgactctgatgccaccgccagctctgataacagcgagaccgaaggaacgccgaaactctccgatacacctgctcccaagaggaaaagatcacctccacttggcggtgcaccaagcccatcctccctgtccctgccaccatcgacaggctttccgctgcaggcatccggtgtcccatctccttacctaagtagcttagcatcctcccggtacccacctttcccatcggattacttagcattgcagctgccagaacccagcccccttcgcccaaaacgggagaagcgcccaaggcttcccagaaaactgaagatggccgtgggcccacctgattgccctgtgggaggaccccttacatttcctgggcgaggctcaggtgccggtgtaggaactacgttgactccgctgcctcccccaaaaatgcctcccccaaccatcctgagcacagtgcccagacagatgtttagtgatgcgggttcaggagatgacgccctggatggcgacgatgacctcgtgatcgatattcctgaatag

SEQ ID NO: 23228 - DNA, 486 bp, Artificial Sequence
  Description of Artificial Sequence: Synthetic coding sequence
gccggagccgcacgacagcccctgttgggtgtcgcaggcggacagacacttggggctacccccggacccgtgatgaacggaccagcagacggcgaggttgattacaagaaaaagtataggaacttaaaaagaaaactgaaatttctaatttacgagcacgaatgcttccaagaggaactgcgaaaagcccagcggaagctgctgaaagttagtagagataagtctttcctcctcgacagactgttacagtatgagaacgtggacgaggactcaagtgactcagacgccaccgccagctcggataacagcgaaacagagggcacccccaagctgagtgatactcccgctccgaagagaaagaggtccccacccctggggggtgccccatcgccttcttcactctctctgccgccatcaactggatttccccttcaggcctcgggcgtcccatcaccttacttgtcaagcgagagaggtcaggcgtag

SEQ ID NO: 23229 - DNA, 414 bp, Artificial Sequence
  Description of Artificial Sequence: Synthetic coding sequence
atgaatggtcccgctgatggagaggtggactataaaaaaaagtatcggaatctgaagcgtaagttgaagtttttgatatacgaacatgagtgttttcaggaggaactccggaaggcccagcggaagttgctgaaagtatcaagagacaagagcttcctcctggaccggctactgcaatatgagaacgttgatgaggactctagcgactctgatgccaccgcgtctagtgacaactccgagacggagggaactcctaagctgtctgatactccagcaccaaaacggaagaggagtcctccccttggaggcgctcctagtccatcatccctgtctctgcctccgtctacgggtttccctctacaggccagcggcgtcccatccccctacctgtccagcgagagaggacaagcatag

SEQ ID NO: 23230 - DNA, 735 bp, Artificial Sequence
  Description of Artificial Sequence: Synthetic coding sequence
atgaatggccctgctgacggagaggtggattataagaaaaaatatagaaacttgaagcggaagcttaaattccttatatatgaacacgaatgtttccaggaggagctgcgcaaagcccagcgaaagctcttaaaagtctctagggataaatcgtttcttctggaccggcttctgcagtacgaaaacgtggatgaggatagctccgattccgacgctacggcatcatcagacaacagcgaaaccgaaggaacacctaagctgagcgatacaccagcacctaagcgtaagcgtagtcctccattaggaggcgctcccagcccgtcatccctctcactgccgccttcaactgggtttccactgcaagcttctggcgtgccaagcccttacttatcaagcctcgcgagcagccgataccccccattcccctccgattatttggctcttcagttgcccgagccttctccactccgcccaaaacgggagaaacggcctcgacttccaaggaagctgaagatggctgtgggaccacccgattgtcccgttggtggtcctctaactttccctggcagggggtccggcgctggcgtggggaccactctgaccccgctaccaccgccaaagatgccacctccaaccattttgagtaccgtgccacgccagatgttctccgatgctggttccggtgacgatgctttggatggcgatgacgatctggttatagacattcccgaatag

SEQ ID NO: 23231 - DNA, 2133 bp, Artificial Sequence
  Description of Artificial Sequence: Synthetic coding sequence
atgagcgctcagggagattgcgagtttttagtacagagagccagggagttggtcccgcaagacctgtgggcggcaaaggcttggcttataacggccaggtcattgtaccctgcagacttcaatattcagtacgaaatgtacacaatcgagcggaatgcagagcggacagcaacagctggtaggttgttatacgatatgttcgtgaatttcccagaccagcctgttgtttggcgtgaaatcagcattatcacctctgccttacgcaacgatagtcaggacaaacagactcagtttctgagatctttatttgaaaccttgccgggacgcgtccagtgtgagatgctccttaaagtgacagagcagtgtttcaacaccttggaacgatcggagatgctactcctgctgttaagacggttccctgagacagtggttcaacacggcgtgggattaggcgaggcgctcttggaagctgaaactatagaggaacaggagtctccagttaactgctttcgtaagctcttcgtgtgcgacgtgttgcctctcatcattaataaccatgacgtgagactgcccgcaaacctcctatacaaatatctgaacaaggccgctgaattctacattaattacgtaaccagatccacccaaatcgagaaccagcatcagggcgctcaggatacctccgaccttatgagcccctctaagagatctagccagaagtacatcatagaggggctgactgagaaaagctcacaaatagtcgacccctgggaacggttgttcaaaattttgaacgtcgtgggtatgcggtgcgaatggcaaatggacaagggacgtaggagttatggggacatactccaccgaatgaaggacctttgccgctacatgaacaatttcgattcggaggcccatgccaaatacaagaatcaggtcgtgtattcaacgatgctggtcttttttaagaacgcctttcagtatgtgaattctatccagccgagcctttttcagggacctaatgcccctagtcaagttccgctggtgttactcgaggatgtaagtaacgtgtacggggacgttgaaattgacaggaataaacatatccataagaagagaaagttggccgaggggagagaaaagacaatgtccagcgacgatgaggactgttctgccaagggcagaaacaggcatattgtggtcaacaaagccgagctcgccaactcgaccgaggtgctcgagtcatttaagctggccagagagagctgggaactgctctactctctggaattcttggacaaggaattcaccagaatctgtctggcttggaagaccgatacttggctttggctaagaatttttctcactgatatgatcatttaccaaggccagtataagaaggctatagctagtcttcaccaccttgcggctctccaggggtccatttcacagccccagatcacaggccagggtacgctggagcaccaacgagctctgatccagctggccacatgtcactttgccttgggcgaatatcgcatgacctgcgaaaaagtgctggacctcatgtgctatatggtcctccccattcaggatgggggtaagtcccaggaggaaccctccaaggtcaagcctaagttcagaaagggcagcgatttaaaacttctgccatgcacgtctaaggcaatcatgccctactgtctccacctgatgctcgcatgttttaagctgagagcattcacggacaatcgcgatgatatggccctgggccatgtgattgtcctgctgcagcaggagtggccgcgaggtgagaacctgttcctgaaggcagtgaataagatctgccaacaaggcaatttccagtatgaaaatttctttaattacgttactaatatcgacatgctagaggagtttgcttacctacgaacacaggagggaggaaagatccatctcgagctcctccccaaccagggaatgctgatcaagcaccacacagttacaaggggcatcaccaaaggagtcaaggaggacttcaggctggcgatggaacggcaggtgagcagatgcggtgaaaatctcatggtggtcctgcacaggttctgcattaatgagaagattctgctgcttcagacattgacttag

SEQ ID NO: 23232 - DNA, 1389 bp, Artificial Sequence
  Description of Artificial Sequence: Synthetic coding sequence
atggccgcaaccgttaacctcgaattggatccgatctttttgaaagccttgggttttctccattctaaaagcaaggacagcgctgagaaattaaaggccctgttggacgagtcactggctcgtggtatcgactcatcctaccggcctagtcagaaggatgtggagccccctaaaattagttctacaaagaacatctccataaaacaggaacctaaaatctccagttctttacccagcgggaataacaacggaaaagtcttgaccacagaaaaggttaaaaaagaggcggagaagcggcctgccgacaaaatgaagtccgatatcacagagggagttgatatccccaagaagcccaggctagagaaacccgaaacacaatcttccccaatcactgtgcagtcttctaaggatttgcccatggctgatctgagcagttttgaggagaccagcgccgacgattttgctatggagatgggccttgcctgcgtggtgtgtagacaaatgatggtcgccagtggcaatcagcttgtagagtgccaggagtgccataacctctatcatcgggactgccataaaccccaggtgaccgacaaagaggctaacgatcccaggctcgtgtggtactgcgccaggtgcacaaggcagatgaaacgaatggcccagaagactcaaaagcctcctcagaagcctgctcccgctgtggtgagtgtaacccccgcagtaaaagatccattggtgaagaaacctgagacaaaactaaagcaggaaacaacgtttctggcctttaaacggacagaggtgaagacatcaactgtaattagcgggaactccagtagcgcatcagtcagcagtagcgttacatccggccttactggatgggctgccttcgcggcaaagacttcatccgccggacccagcaccgcaaaactgagcagcactacacaaaacaataccggaaaacccgcaacttcatctgccaaccagaagcctgtggggctgaccggcctggccacctcctcaaaaggcggaattgggtccaagatcggatccaacaacagcacgactccaaccgtgcctttaaagccacccccaccactgaccctaggcaagacaggactctcacgatcggtctcttgcgataatgtatctaaagtgggcctgcctagtcccagtagcttggtcccagggtccagctcgcagctgtctggaaatggtaattcaggaacttctggaccctctggatcaaccacctccaaaaccacttctgagtcttcgagttccccttcggcctcattgaagggaccaacctctcaggagtctcagctgaacgccatgaaacggttgcagatggtgaagaaaaaggccgcacagaaaaaactaaagaagtag

SEQ ID NO: 23233 - DNA, 1389 bp, Artificial Sequence
  Description of Artificial Sequence: Synthetic coding sequence
atggccgctacagtgaatctcgaactggatccaatttttctcaaagccttggggttcttgcatagcaagagcaaggacagcgcggagaaattgaaggccttgctggacgaatctctggcaaggggcatcgattcaagctaccgaccgtcgcagaaggacgtggaaccgcctaaaattagttccactaaaaatatttcaatcaagcaggagcccaaaataagttcctcactccccagcggtaataataacggcaaggtattaacaacggagaaagtgaagaaggaggccgaaaagcgcccagcagacaagatgaaaagtgacataaccgaaggagtggacatcccaaagaagccgcgtctggagaagcctgaaacacagtccagtcccataacagtgcaatcctccaaagaccttcctatggcggacttgagctcctttgaggagacctccgctgacgacttcgcgatggaaatgggcctcgcatgcgtggtctgtagacagatgatggtcgcatctgggaaccagttggtggaatgccaggagtgtcataacctgtaccatcgcgactgtcataaaccacaggtgacagacaaggaggctaatgatccacggctcgtgtggtattgcgccagatgcactcggcagatgaaacgcatggcacagaagacgcaaaaaccaccgcagaagcccgcacccgctgtggtgtcagtcacccctgccgttaaggatcctctggtcaaaaagccagaaacaaagctgaaacaggagacaaccttcttggccttcaaaaggaccgaagtcaagactagcaccgtcatctcaggaaactcttcatctgcttcggtatccagctctgtaacgtcgggtctgaccggatgggctgcgtttgcagctaaaacaagcagtgctgggccaagcacagctaagcttagctccacaacccagaataacaccggtaagccagccacctcctcggccaaccaaaagccagtgggtctcactggactcgctacctcttcaaaaggcggaattggcagcaagatcggctctaacaacagcaccactcctacagtgcccctgaagccgcctcccccactaacattgggcaaaacagggctctcccgttccgtgagttgcgataatgtgtccaaggtgggattgccttccccctcctcactcgtgcccggaagctctagccagctttccggcaatggaaacagcggcacatccgggccatctggatccacgacctccaaaaccacaagtgaaagcagctcttcaccatccgcttctctgaaggggcctactagccaggagagtcagctgaacgcaatgaaacgattgcaaatggtgaagaaaaaggccgctcagaagaaactgaagaagtag

SEQ ID NO: 23234 - DNA, 267 bp, Artificial Sequence
  Description of Artificial Sequence: Synthetic coding sequence
atggccgcaacagtcaatttggagcttgatcctatctttctcaaagcattgggattcctgcacagtaagagcaaagacagtgccgaaaagctgaaggcactgctggacgagagcttggctcggggaatcgactcgtcatatcgcccaagtcagaaggatgttgaaccaccaaagatctcttcaactaaaaatatttccatcaagcaggaacctaagatttctagtagtcttccctcaggcaataacaatggtaaggtactgacatag

SEQ ID NO: 23235 - DNA, 399 bp, Artificial Sequence
  Description of Artificial Sequence: Synthetic coding sequence
atggctgccacagtaaacctggaactagatcctatctttctgaaggccctaggattcctccacagtaaatcaaaagattccgccgagaagctcaaagctctccttgatgagtctcttgctagaggaattgattcctcctaccggccaagccagaaagatgtcgagccccctaagatctcctctaccaagaatatatctatcaagcaagaaccaaaaatttcgtccagcctgccttccgggaataataacgggaaagttctcactaccgaaaaagttaagaaagaggcagagaaacgaccagctgacaagatgaagtcggacattacggagggggtcgacatcccaaaaaaacccaggcttgaaaagcccgagacccagagctctcctataacggtttag

SEQ ID NO: 23236 - DNA, 267 bp, Artificial Sequence
  Description of Artificial Sequence: Synthetic coding sequence
atggcagctactgtcaacctcgaactggatccgatcttcctgaaagccctggggtttctgcatagtaaatctaaggactcagccgagaagcttaaggccctgctggatgaatcccttgctcgcggaatagactcgtcgtataggccgtcccaaaaagacgtcgaaccgccaaaaatctcaagtacaaaaaacatctcgataaagcaggagcccaagatttccagttccttaccctccggtaataacaacggcaaggttttgacgtag

SEQ ID NO: 23237 - DNA, 1389 bp, Artificial Sequence
  Description of Artificial Sequence: Synthetic coding sequence
atggctgcgacagtgaatctagagctggatcctattttcctgaaagcactgggctttcttcacagcaagtctaaggatagcgccgaaaagttaaaagccctgctggacgagagccttgccagaggcatagactctagttacagaccgtcccagaaggatgtggagccccctaagattagctccaccaagaatatcagcattaagcaggaacccaaaatatcaagctcgttaccctctggcaataataacgggaaagttctcaccacagagaaagtcaagaaagaagcagagaagcgacctgctgacaaaatgaaatctgacatcacagagggcgtagatatccctaaaaagcctcggctggaaaaaccggagacacagtccagccccattactgtacaatcatcaaaagaccttccgatggcagatctgtcatcctttgaggagacatctgccgacgatttcgctatggagatgggcctcgcctgcgtggtctgccgacagatgatggtcgcatccggcaatcaactagtggagtgccaggagtgccataacctataccatagagactgccacaaaccccaagtgacagataaagaggctaatgatccaagactggtgtggtattgtgctcggtgcactaggcagatgaagaggatggctcaaaaaacccagaaaccaccccagaaacccgctcctgccgtggtgtcagtcacccccgcagttaaagatccattggtgaagaagccagaaaccaaactgaaacaggaaacaacatttttagccttcaaacggacagaggtgaagacctccacagtgatttccggaaactcatccagtgcctctgtgtccagctcagtgaccagcggactgacaggctgggccgcattcgccgctaagacctctagtgccggtccctctaccgccaagctttcatcaacaacgcagaacaacaccggcaaaccagccactagcagtgctaaccagaagcccgtagggctgaccgggctcgcaacctcgtctaaagggggaatcgggtcaaagatcggatcgaacaactctaccaccccaaccgtgcccctcaagccccctccacccctgacactgggaaaaactgggctgtcgaggtccgtgtcttgtgacaatgtttctaaggtggggctgcccagcccctccagtctcgtgccaggttcctctagccaactgtctggcaacggaaactctgggacttcaggcccttcaggatcaactacctcgaagacaacgtcagagtcatcaagctcacccagtgcatcactcaaagggcctacctctcaggaaagccaattgaatgctatgaaacggcttcagatggtcaaaaagaaggcagctcagaagaagcttaagaagtag

SEQ ID NO: 23238 - DNA, 480 bp, Artificial Sequence
  Description of Artificial Sequence: Synthetic coding sequence
atggctgcaactgttaatcttgaactggatccaatatttttgaaagccctgggattcctccacagtaaaagcaaggatagtgccgagaaactgaaagccctcctggatgaaagcttagcaaggggaatcgactcttcctaccgtccaagccaaaaggacgtcgagccacccaaaatctcttccaccaaaaacatctccataaagcaggaaccaaagatctcctcctccttgccttccgggaataacaacggaaaggtgcttacaacagaaaaggtcaagaaagaagccgaaaaacgaccagcagataagatgaaaagtgacattacagaaggcgtagacattccaaaaaagcctagactggagaaacccgagactcagtcatctcccataacagtgcaatcttcaaaagatctgcccatggcagatctgtcaagtttcgaggagacctccgccgatgatttcgcaatggaaatgggatag

SEQ ID NO: 23239 - DNA, 57 bp, Artificial Sequence
  Description of Artificial Sequence: Synthetic coding sequence
atggcagccaccgtcaacctcgaactggatcccatcttcttaaaagcactgggctag

SEQ ID NO: 23240 - DNA, 3129 bp, Artificial Sequence
  Description of Artificial Sequence: Synthetic coding sequence
atggagctccagaaggggaaaggggcagcagctgccgctgcagccagtggagctgccggtggcggtgggggaggcgctggggcaggggctccagggggtggcagactgctgctgagcaccagcttggatgctaaggacgaacttgaggagcgactggaacgatgtatgtccatcgtaacatctatgaccgcaggggtgagtgaacgagaagctaacgacgcgctgaatgcctatgtgtgcaagggcctgcctcaacatgaagagatatgtctcggtctattcaccctgattctcacggaacccgcacaggctcagaaatgctatagagatcttgccctggtctcacgcgacggcatgaacattgttctgaacaaaatcaatcagatactgatggagaagtacctcaagctccaggatacctgcaggactcagctcgtttggctcgtccgcgaactcgttaaatcaggggtgctgggtgcagacggtgtctgcatgacgtttatgaagcagatcgctgggggagatgtcacagccaagaacatttggctggcagagagcgtgctagacattttgactgagcagcgggagtgggtgcttaagtcttccatattaatcgcaatggccgtgtatacctatctgcggttgattgtggaccaccacggcactgcccagttgcaggcgcttagacaaaaggaggtggacttctgcattagcctgctgcgtgagaggttcatggagtgtttgatgatcggccgtgacctggtgagactgctccagaacgtggctcgaatcccagagtttgagctgctgtggaaagacattattcacaacccgcaagctctctcccctcagtttaccggaatactgcagctcctgcagtctaggacaagccggaagtttctagcttgtcgcctaacccctgacatggaaacgaaattgctctttatgacttcaagggtgaggtttggtcagcagaaacgctatcaagattggtttcagcggcagtacctttcgacacctgactcacagagcctgaggtgtgacctgatcagatacatctgcggtgtggttcatccctccaatgaggtcctgtcctccgacattcttccacgatgggctatcataggttggctccttaccacgtgtactagtaacgtagccgctagtaacgcaaagctggcccttttctatgattggctgttttttagcccagataaggattcaatcatgaacatcgagccagccatcctcgtgatgcatcattccatgaaaccgcatccagcaattactgcgacgctcctggattttatgtgtcgaatcatccctaatttctacccaccattagagggacatgtgcgccaaggggtgtttagcagcctgaaccatattgtggagaagcgagttctagcgcaccttgccccactttttgataaccccaaattggacaaagaacttcgggcaatgttgcgggagaaatttcctgaattttgctcatcaccgtctccacccgtggaagtgaagatagaggagccggtgtccatggagatggacaatcatatgagtgataaggatgaaagttgttacgacaacgccgaagcggcattctctgacgatgaggaagatctcaactcaaaaggcaagaagcgagaattcaggtttcaccccattaaggaaactgtggtcgaggagcccgttgacattactccctatctggaccagctagatgagtctctgcgcgacaaggtcctgcagctccaaaaaggcagcgatacagaggcacagtgtgaggtcatgcaggagatcgtggaccaggttctagaagaagattttgattcagagcagctgtccgtgctggcatcctgcctgcaagagctcttcaaggcccatttcagaggagaagtattgccagaagagatcaccgaagagagcttggaggagtccgtaggcaagcccttgtacctcatatttagaaacctatgtcagatgcaggaagataatagtagcttctcgctcctccttgaccttctgagcgaactgtaccaaaagcagcccaaaattggataccaccttctgtactacctgagagccagtaaggccgctgccggaaaaatgaatctatacgagagcttcgcccaagctacacaactgggcgaccttcacacttgcctcatgatggacatgaaagcctgtcaagaagatgatgttcgcctgctctgtcacttgactccaagcatctacaccgaattccccgacgagacattacgtagcggtgagcttcttaatatgattgtggccgttattgattcagctcagttgcaggagcttgtgtgtcatgtgatgatggggaatctagtgatgttcagaaaagattccgtgctgaacatcctgattcagagcttagactgggaaacatttgagcagtattgcgcctggcagctgttcttggcccataatattccactcgagaccattattcccattttgcagcatctcaagtataaggaacatcccgaagctttgagctgtcttctcctgcagctgcggagggagaaaccgagcgaggagatggtgaaaatggtgctgtcccggccttgtcaccccgacgatcagtttacaacgagcatcctgaggcactggtgtatgaaacatgacgaactgctcgcggagcacattaaaagcctactgatcaagaacaatagtctacccaggaagcgccagagcctgcgctcatcatcatccaaactcgctcagttgaccctagagcagattctagagcatttagacaatttaagactgaacttgactaacacaaagcagaatttttttagtcagacccccatcctgcaagccttacaacatgttcaagcctcctgtgacgaggctcacaaaatgaaattctcggaccttttcagtttagccgaggaatatgaagattcttccacgaagcctcccaagtcccgacgcaaagctgcattgagcagtcccaggtccaggaaaaatgccacacagcctcctaacgcagaagaagaatccggctcatcttcagccagcgaggaggaggataccaaacccaagccaaccaagaggaagagaaagggaagcagtgccgtgggctccgacagcgactag

SEQ ID NO: 23241 - DNA, 3129 bp, Artificial Sequence
  Description of Artificial Sequence: Synthetic coding sequence
atggagttgcaaaaaggaaaaggcgctgccgctgccgcagcagcttccggagctgccggtggcggaggtggaggagccggagccggagcaccgggtggcggacgactgctgctgtccactagcctagatgctaaagacgagctggaggagaggcttgagagatgtatgagcattgtcaccagtatgaccgcaggcgtcagcgagagagaggccaacgatgcactgaacgcctatgtttgtaagggactgccacaacacgaagagatctgtctgggcctcttcacgttgattctcacggagccagcacaggcgcaaaaatgctatcgtgacctcgccttggtatctagggacgggatgaacattgtcctcaacaaaattaaccagatcttaatggagaagtacttgaaacttcaagacacttgcaggacccaactggtttggttggtgcgtgagctcgtaaaatctggggtcctgggagcagacggagtgtgtatgacctttatgaagcaaatcgccggaggcgatgttactgcgaagaacatttggctcgctgaaagcgtcctcgatatcctaaccgaacaacgtgaatgggtgctgaaatcctctattttgatagccatggctgtctacacatatctgcggttgattgtagatcaccacggcactgcgcagctgcaggcacttcgccagaaagaagtggacttttgcatctcgctactgcgtgagcgcttcatggaatgcctgatgatcggtcgcgacttggtcaggctgctgcaaaacgtggctcgaatccctgaattcgagctgctctggaaggacatcatccataatcctcaggcattatccccccagttcaccggtattctgcaactgctacagagccggacctcgcggaaattccttgcctgcagactaacacctgacatggagactaagctcctgtttatgacttcccgcgtccgatttggccaacagaagcgctaccaggactggtttcagaggcaatacctgagcacccctgactcccagtctctgcgctgcgaccttattcggtatatctgcggagtagtacaccccagtaacgaagtgctgagcagcgatattcttccaagatgggcgattatcggctggctgctaacaacctgtacttctaacgtggctgcgagtaacgccaagcttgcccttttctacgattggctcttcttctcaccggataaggacagcatcatgaacattgaacccgctatattagtcatgcaccactcgatgaaaccacatcccgctatcacagctactctgctggattttatgtgccggatcatcccaaatttttaccccccactggagggccacgtcagacagggcgtattcagtagtcttaaccacatcgtcgaaaaacgagtactggcacacttggcaccactgtttgataaccccaagctagacaaggaactgcgggctatgctcagggagaaatttcccgagttttgttcttcaccaagcccgcctgtcgaagtaaagatcgaagagccagtatctatggagatggataatcacatgagtgacaaagatgagagttgctacgacaacgctgaagctgccttctccgatgacgaagaagatctgaattctaaaggcaaaaaacgcgaattccggtttcatcccataaaagagactgtagtcgaagaaccggtcgacatcaccccctacctcgaccagttggacgaatctctccgggacaaggtgctccagcttcagaagggttctgacacagaggctcagtgtgaagtgatgcaggaaatcgttgaccaggttttggaggaggatttcgactctgagcagttatccgttcttgcatcttgtctgcaggaactctttaaagcccatttccgcggtgaagtgttgccggaagagattacagaggaatctctggaggagtcggtagggaaacccctgtatttaatttttcgcaatctgtgtcaaatgcaggaggataacagctcgtttagcttgcttttggacctgttatcagaactctaccagaagcagcccaaaatcggctatcatcttctctattatttgagagccagtaaggccgctgctgggaagatgaacttgtacgagagtttcgcacaggcaacacagctgggggatctccacacatgtttaatgatggacatgaaagcttgtcaggaggatgacgttcgcctcctctgtcacttgactccctctatctatactgaattcccagacgaaacgctgcgctctggcgaacttctcaacatgatcgttgcggtgattgacagcgcacaactgcaggaactggtgtgccatgtcatgatggggaacttggtcatgtttagaaaggactctgtacttaatattctcattcagtctctcgattgggagaccttcgagcagtactgcgcatggcagctgttcttagctcacaacatcccactcgaaactatcattcctatactgcaacatttaaaatacaaggaacatccagaagccttatcctgcctcctgctccagctcagaagggagaagcccagtgaggaaatggttaaaatggttttgtcacgtccatgtcatcccgacgatcaatttactacctcaatccttcggcattggtgcatgaaacatgacgagcttctggcagagcacatcaaaagtctgcttattaagaataactcacttccccgtaagaggcagagccttagatcctcctccagcaagctggctcagctgacactggagcagatcctagagcacctggacaacctgaggctgaaccttaccaacaccaagcagaacttcttctcccaaactcctattttgcaagctctccaacacgtgcaggctagctgtgacgaggctcacaagatgaagttttctgatttattttcgctcgctgaggaatacgaggactcaagcacgaagccccctaaatcccgcagaaaggcggctctgtcaagcccaagatctagaaagaatgccacacagccccctaacgcagaggaagagtcaggctctagtagcgctagcgaagaggaagacactaagcctaagccaaccaaacgaaaacgcaaggggagctccgcagttggatcagactccgactag

SEQ ID NO: 23242 - DNA, 2709 bp, Artificial Sequence
  Description of Artificial Sequence: Synthetic coding sequence
atggctgtctatacctaccttagactcatcgtggaccaccacggcactgcacaattacaggccctgcggcagaaggaagtcgatttctgtatctcccttttgcgggaacgattcatggaatgccttatgatcggtcgcgacttggtacggctcctgcagaatgtagctcgcattcccgagttcgaactcctctggaaggacatcattcacaatccgcaagctctcagcccacagttcacgggcatccttcaattgttgcaaagcaggacatccagaaagttcttagcttgccgattgacacccgacatggaaactaagctgctcttcatgactagcagagtgcgatttggccagcagaaacgttaccaggactggtttcagagacagtatctctctacacccgattcgcagagcctgaggtgtgacctgatcagatacatttgcggggtcgtgcatccctccaacgaggtccttagctcagacatccttcccagatgggcaataattggatggcttctcacaacctgtacctccaacgtggccgcttccaatgccaagttggctcttttttatgactggttattcttcagcccagataaggattcaatcatgaatatcgaacccgctattcttgttatgcaccactcaatgaagccgcatccagcaatcaccgccaccctcctggacttcatgtgtagaattatccccaacttctacccccctctggaaggccatgtcaggcaaggtgtattctcttccctgaaccacatcgttgagaaacgggtcttggcacacctcgctccccttttcgacaacccaaaactggataaagagctgcgggcaatgcttcgagagaaattcccagaattctgtagttccccatctccgccagtcgaggtaaaaatcgaagagccagttagtatggagatggataatcatatgtctgacaaagacgaatcctgctacgacaacgctgaagctgccttcagcgatgacgaagaagacctcaactctaagggcaagaagagggagttccggtttcaccctatcaaggaaaccgtagttgaggagcccgtagatattacgccctatttagatcaactggatgagagtctaagagataaggtcctgcagctccagaaaggctcagacacagaggcccagtgcgaggttatgcaagagatagtggatcaggttctggaagaagacttcgatagtgaacaactgtcagtgcttgcatcctgcttacaggagctgttcaaggcccattttcgaggtgaagttctcccagaggagattaccgaggagagtcttgaagagagcgtcggcaagcccctgtaccttatttttcggaacctgtgccagatgcaggaagacaacagcagtttttctctgctccttgacctgctcagtgaactgtaccagaagcagcctaaaataggataccaccttctctactaccttcgcgcttccaaagcagcagccggaaagatgaatttgtacgaatcttttgctcaggcgacgcagttgggagatctgcacacatgcttgatgatggacatgaaggcttgtcaggaggacgatgtccggctgctctgccacctgacgccttcgatatacacagagtttccagatgagacactgagaagtggagagctcctgaatatgatcgttgccgtaatagatagtgcccagcttcaggaactggtttgccatgtgatgatgggtaatctggttatgttccgtaaagattccgtgctaaatatcctcatacaatctctggactgggagacgtttgaacagtactgtgcttggcagctgttccttgcccacaacatcccactagaaactattatacccatcttgcagcacttgaaatataaggagcatccagaggccctgagttgtttactgctccagctccgtcgggagaagccctctgaagagatggtgaagatggtcctgtcaagaccgtgccaccccgacgaccaattcacaaccagcatcctgcgccactggtgcatgaaacacgatgagttgctggccgagcacatcaaatccctgctcataaaaaacaattctctgcccagaaaaaggcagtctctgaggtcatcttccagtaagctcgctcagctgaccctggagcagattctcgaacatctggataacctcaggttgaatctgaccaacacaaagcaaaattgtatgccaagtaccctgggcgtccagtgtcggcgatgctgtccaggacctgattacgcgtggtcccaggctgggggacgcggacgtacccccggagccaccacccatacacgagataaaacaacatgtgcctgctgcctgatatctagccagaccagcgactgcttcagcttcccggctttgccattcctccccctggtcttctcgcagacacctatcctacaagcactgcagcacgttcaggcgtcttgtgacgaggcccacaagatgaagttctctgacctgtttagtctggcagaggagtatgaggacagttcaacgaagcctcctaagagtaggagaaaagccgctttgtccagcccgcgatcaaggaaaaatgcaacacagcccccaaacgccgaggaagaatctggctcatccagcgctagcgaggaggaggatacaaagcctaaaccgacaaagcggaagagaaaagggagctcggccgtcggaagtgactccgattag

SEQ ID NO: 23243 - DNA, 2709 bp, Artificial Sequence
  Description of Artificial Sequence: Synthetic coding sequence
atggcggtgtacacttatctacggctcattgttgatcaccacggcaccgcacaactgcaggccttgcggcagaaagaggtggacttctgcatctctctactgcgcgagcgcttcatggaatgcctcatgatcggtagagacttggtgagactgctgcagaacgtggcccgaattcctgagttcgagcttctttggaaggacatcattcataatccgcaggccctgtccccccagttcaccggcattctacagttactgcagtccagaacatctcggaaatttctggcctgtagactgaccccagatatggagaccaaacttctctttatgaccagtagggtgcgtttcggccaacaaaaacggtaccaagactggtttcagcggcaatacttaagtactcccgattctcagagcctccggtgtgatttaatcaggtacatatgcggtgtggtgcatcctagtaatgaggtgctcagctccgatatacttcccaggtgggctatcattggctggctgctcacaacatgtacaagtaacgttgctgcatctaacgctaagctcgcgctcttctatgactggcttttcttttccccggacaaggacagcatcatgaacattgagccagcaatcttggtgatgcatcactcaatgaagccacatcctgccatcacagctaccctgctcgatttcatgtgcaggattatccctaatttttatcccccactagaaggtcacgtccggcagggagtttttagcagtctgaaccatatcgtagagaagcgggttctggcgcacctggctcctctgttcgataacccgaagctggacaaagagttgcgcgcaatgctgagggagaagtttccggagttctgcagcagcccttcacctcccgtggaggtgaagatcgaagagcctgtgtcaatggaaatggacaaccacatgtctgataaggatgagagttgttacgacaatgccgaagcagccttttcagatgacgaggaagaccttaatagcaagggaaagaagcgagaatttaggttccatccaattaaagagaccgtggtggaagagcctgtcgatattacaccatacctggatcagctggacgagtccctgcgggacaaggtgttacagctacaaaagggtagcgataccgaagctcagtgtgaggtaatgcaggaaatcgttgatcaggttcttgaggaggattttgattccgaacaactatccgtccttgcgtcttgtctacaggagttgtttaaagcccacttccgtggcgaggtgctgcccgaggaaatcaccgaagagtcactggaagagagcgttggtaagccgctgtacctgatcttccgaaacctgtgtcagatgcaggaggataattcctccttctcactgctcctggatttgctcagcgaattgtaccagaaacagcctaaaatcggctatcatctgttgtactacctcagagccagcaaggcggcagcgggaaagatgaatctatacgaatcttttgcccaagctactcagcttggtgatttgcacacttgcctgatgatggatatgaaggcttgtcaggaggacgatgtgcgcctgctctgccatttgaccccatctatctacaccgagttccctgatgaaaccctgcggagtggggagctgctgaacatgattgtagctgttatcgacagcgcgcaactgcaagagctggtttgccacgtcatgatggggaacctggtcatgtttagaaaagactcagtcctgaacatcttgatacagagcctcgattgggagacgttcgagcagtattgcgcctggcagctgttcttggcccataacatcccactggagaccataattcccatccttcagcatctcaagtataaagaacatcccgaggctctgagctgcttgctgctgcagctacggagggaaaaaccttctgaagaaatggtgaaaatggtcctgtctcgcccatgccaccctgacgaccagttcactaccagcattctgaggcactggtgtatgaagcatgacgagttgctcgccgagcacataaagtctctcctcattaagaacaattcactccctaggaaaagacagtccctccggtccagttcctctaagctggcccagttgacccttgaacagattctcgaacatctggataatcttagactgaacctgactaataccaaacagaattgcatgcctagtactttaggtgtacaatgccgcagatgctgccccggacctgactatgcgtggagccaggccggaggacggggaaggacacccggtgccacaacccacacccgggacaagacgacatgtgcttgctgtctgatctcctcccagacatcagactgtttctcttttcctgctctgccttttctgcctctggtattctctcagacacccattctgcaggcattgcaacatgttcaggctagctgtgacgaggcccataaaatgaaattctccgacctgtttagccttgctgaggaatatgaggacagctcgactaaaccacctaagtctaggcgtaaagccgcacttagtagcccccgtagtagaaagaatgctacacagccccctaacgcggaagaggagagtggaagctcgtctgcctctgaggaagaggataccaagccaaaacccacaaaacgtaaaaggaagggctcctctgccgtgggcagcgactcggattag

SEQ ID NO: 23244 - DNA, 1530 bp, Artificial Sequence
  Description of Artificial Sequence: Synthetic coding sequence
cccaattcaatctgtcggcacctccatctcaccgatactagccatggtgtccgcaacaaatgtctgcagttgcttgggaacctcggatccctcgagaagtccgtgaccaaagacgcagaggggctagctgcacgcgatgtgcagaaaatcatcggagattattttagtgaccaggacccgagggtccggaccgccgcaattaaagcaatgctgcagttgcatgaaagggggttgaagctgcatcaaacaatctacaaccaagcctgcaagcttctgtctgacgactatgaacaggtgcggagtgcagctgtccagttgatctgggtcgtcagccagctgtaccccgagtccattgtgcctattcctagctcaaacgaagaaatccgcctcgtggatgatgctttcggcaaaatatgtcacatggtgtctgatggttcctgggttgtccgcgtgcaagccgctaagctgttggggtccatggaacaagtgtcaagccactttctggaacagacacttgataaaaagctcatgtctgacctgagacggaagcgcacggcccacgaacgcgcaaaggaactttactcttccggcgaattctctagcggaaggaagtggggggatgatgctccgaaggaagaagtcgataccggtgcagtcaacctcattgaatctggtgcttgcggagctttcgtccacggattggaagacgaaatgtacgaggtgcgtatcgccgcagtcgaggcattgtgcatgctcgcccagtcctcaccctccttcgctgagaagtgcttggactttctagtcgatatgttcaacgacgaaatcgaggaagttaggctccagagcattcataccatgcggaagatcagcaataacatcaccctacgggaagaccagcttgacaccgttctggcggtccttgaggacagtagtagagacattcgggaggcactgcacgagctgctgtgctgcacaaacgtaagcacaaaagagggcatccatctggcccttgtagagttgctgaagaatctgaccaaataccctacagacagggatagtatttggaagtgcctgaagttccttggtagtcgtcatcctaccctggttctgcctctcgtcccggagctgctgtctactcaccctttcttcgataccgctgagccggacatggacgaccctgcttacattgcagtgctagtgctaatcttcaacgctgctaaaacttgtccgaccatgccggctctcttttcagaccacaccttccggcactacgcatatctgagagactccctgtctcatctagtgcccgcattgaggctcccgggacggaagctagtgtcctcagcggtttcgccatctatcatcccgcaggaggacccatcccagcagtttttgcaacagtcacttgagcgagtgtactccctccagcaccttgatccccagggagcgcaggagttgctggagttcacaatccgggttgaggtgtctccctggtggcctgggtggtcacagaccccagaactaaaatag

SEQ ID NO: 23245 - DNA, 2892 bp, Artificial Sequence
  Description of Artificial Sequence: Synthetic coding sequence
atggccgctcatctcaaaaaacgcgtctacgaagagttcactaaggtggtccagccgcaggaagaaatcgctaccaagaagctacggttgaccaagccctccaaatcagcagcattgcatattgacttgtgtaaggcaacatcaccagccgacgcgctgcagtatctgttgcagttcgcgcgtaaacccgtcgaagccgagtcggttgaaggtgtcgtgaggattctgctggaacactattacaaagaaaacgacccatctgtacggctcaaaatcgcctcactgcttggattactgagcaagacagccggtttttcacctgactgtataatggatgatgccattaacatactccagaacgaaaagagtcatcaagtgttggcacaactgctggatacattacttgcaattggcacaaaactgccagagaatcaggccattcaaatgaggctggtggacgtagcttgcaaacatctgactgacacatcgcacggcgttcggaacaagtgcctgcagctccttggcaatctgggcagtctggaaaagtcggtgaccaaggacgccgaaggtttggccgctcgcgatgtccagaagataataggcgattacttttctgatcaggaccccagagtgcgaactgccgcaatcaaggcgatgttgcaactccacgagcgtgggctaaaactgcaccaaactatctataatcaagcctgtaaactgctgtcggatgattatgagcaagtgaggtcagcggcagttcagctgatttgggtagttagccagctctatccggaatctatcgtgccaatacctagcagtaacgaggaaatcaggctagtggatgatgccttcggcaagatctgccacatggtcagtgatgggagctgggtcgtgcgcgtacaggcagctaagctgctgggctccatggagcaggtctccagtcactttcttgagcaaactttggacaagaagttgatgagcgatttgcgaaggaagaggacagcccatgaacgcgcaaaagagctgtattcctcaggggagttctctagcggaaggaagtggggcgacgacgccccaaaggaagaggtggataccggtgctgtaaacctcatcgagagcggcgcttgcggcgctttcgtacacgggctcgaagatgagatgtacgaggtgcgcatcgcggctgtggaggccctctgtatgcttgcccaatcttcgccatctttcgccgagaaatgcctagactttctggtcgacatgttcaatgatgagattgaagaagtcagactgcagtcgatacacaccatgcggaagatctccaataacatcacgcttagggaagatcaactggataccgtcctggccgtgctggaagacagttctagagacataagggaggcgctgcatgagctgctctgttgtaccaacgtctctacaaaagagggaatccatctggcactagtggaacttcttaaaaatctgacaaagtaccctacagatagggactcaatttggaaatgcctgaagttcctgggatcacgacacccgaccctggtgctccccttggtgcccgagctgcttagtacacatccattttttgacacagcggaaccagatatggacgatcctgcttacattgctgtgctcgtacttattttcaacgcagccaagacttgccccactatgcccgcacttttctctgaccacaccttccgtcattacgcctaccttagagacagtctgagtcatctggtaccggctttgcggctgcccggacggaagttagtgagttccgctgtgtctccctcaatcatcccccaggaggaccctagtcagcagttcctacagcagtcactggagagggtctacagcctccagcatctggacccacagggggcacaggaactcctcgagttcaccatcagagacttgcaacgattgggtgaacttcaatccgagctagctggggtggccgacttttccgccacgtatttacgctgccagctgctgcttattaaagcccttcaggagaagctgtggaatgtagctgccccactgtacctcaagcagagtgatctagcatcagcagccgctaaacagattatggaagagacttacaaaatggaatttatgtactctggcgtggaaaacaaacaggtggtgatcattcatcatatgcgactgcaggccaaagctctgcagttgatcgtcaccgctcggacaactcggggtctcgatccgctgttcgggatgtgtgagaaattccttcaggaggtggacttttttcagcggtattttatcgccgatctaccacacttacaggattctttcgttgataagctcctcgatctcatgccaagactgatgaccagtaagccagcggaagtcgtcaagattctacagaccatgctacgccagtcagcctttcttcacttgccattgcctgagcagatccacaaggctagcgctacaattattgagccagcaggggagagcgataacccactgagattcacttcaggcctggtcgtagcccttgacgtggatgcaaccctagagcacgtgcaggatccacagaatactgtgaaggtgcaggtcttgtaccccgatggccaggcccagatgatccatccaaagccggcagatttcagaaacccgggtccaggcaggcatcgcttgatcactcaagtgtacctgagccacactgcctggactgaggcttgccaggtggaagtacggttgctgttagcttacaactccagcgccaggatacctaaatgcccttggatggaaggaggagagatgtctccccaagtggaaacaagtatcgaaggcactattcccttcagtaaacccgtgaaggtgtacatcatgccaaaaccagccagacggtag

SEQ ID NO: 23246 - DNA, 1017 bp, Artificial Sequence
  Description of Artificial Sequence: Synthetic coding sequence
atgcctgcactcaagcagacggcatctcaggtcacgcagacccttcgtgatctgcagcggctgggggagctgcagtctgagctcgcaggtgtggcggatttctcagcgacgtacctacggtgccaattgctgctgataaaagccttgcaggagaagctgtggaacgtggccgcacccttatacttgaagcagagcgacctggcatccgccgctgccaaacagattatggaggagacctacaagatggagttcatgtactctggcgtggaaaataaacaggtcgtaataatccaccacatgagactgcaagctaaagcacttcaactgattgtgaccgctagaactacccgtggcctagacccattattcgggatgtgcgagaaattcttgcaggaagtcgacttcttccagcgctatttcatcgcggatctgccgcatctgcaagactccttcgtcgataaactactggatctcatgcccagactgatgacaagtaaacctgcagaggtggtaaagatactgcagaccatgttacggcaatccgcttttttgcacctgcccctgccggagcagatccacaaggccagcgctacaattattgaacctgcgggagagtcagataatcccctgagatttacctctggcttggtggtggccttggatgtcgacgctactctggagcatgtgcaagatccccagaacaccgttaaagtacaggtgctttacccggacggccaggctcagatgattcaccctaaacccgctgacttcaggaacccagggcctgggcgacaccgattgattacacaagtatatctgtcgcacaccgcttggaccgaagcttgtcaggtcgaggttaggttgctcctcgcatacaatagcagcgctcgcatacccaagtgtccatggatggagggaggcgagatgagtcctcaggtcgaaacttctatcgagggcactatcccgtttagcaagccagtcaaagtttacataatgccaaaaccagcgcgtcggtag

SEQ ID NO: 23247 - DNA, 2829 bp, Artificial Sequence
  Description of Artificial Sequence: Synthetic coding sequence
atggctagcaactccacaaaatcctttctggccgacgccggatacggggaacaggagcttgatgccaactccgcactgatggagctggataaagggctgcgttcaggcaagctcggcgagcagtgtgaggccgtagtcagatttccaagattattccagaagtacccctttccaatactcatcaacagtgccttcctgaagctagcagacgtgttccgagttggtaacaattttctgagactctgtgtcttgaaggtgacacagcagagcgagaaacatctcgaaaaaatactgaatgtcgatgaatttgtgaaacgtatcttctctgtgattcacagcaacgaccctgtagcgcgagctatcaccctacgaatgctgggttccctcgcatctatcatccctgagcggaaaaatgcacaccattcaatccgacagtccctcgacagccatgacaatgtcgaagtggaagctgctgtgttcgccgcagcaaatttcagcgcccagagcaaggacttcgccgttggtatctgcaataagataagcgagatgatccagggcctggcaacacccgttgatctgaagctaaaattaatccctatcctgcagcatatgcatcatgacgcaatcctggcgagctccgcccgtcagcttctacagcagcttgtgacctcttatccgtccaccaaaatggtgatcgtcagcctccatactttcaccctgctcgccgcttcctcccttgtagatacccccaaacagattcagctgctgcttcagtatttgaaaaatgatcctcgcaaagccgttaagcgccttgcgattcaggatctcaaactgctggccaataaaacacctcatacgtggtcgagggaaaacatccaggcgctatgtgaatgtgcactccagacaccgtatgatagcttgaaactgggtatgctgtccgtcctgtccaccttgtccggaacaatcgccatcaaacattatttcagcatcgtcccaggtaacgtgtcttctagcccacgctctagtgatctcgtaaagctggcccaagagtgctgctatcacaacaatcggggaatagctgcccacggcgttagagtgttaacaaacattaccgttagctgccaggaaaaggatctcctggcactggaacaggacgcggtgttcgggttggagagtctgcttgtgctctgtagtcaggacgactcacccggtgctcaggctacattgaagatcgctctgaattgcatggtcaaactggccaagggcaggccccacttaagccagtcagtggttgagactctcctaactcagctgcacagtgcacaggacgccgcacggatcctcatgtgccactgcctggcagccatagcgatgcagctgccagtactgggtgacggaatgctcggagatttaatggaactgtataaagtgatcggtcgcagcgccactgacaagcagcaggagttgctcgtctccctggccaccgtcatatttgtggcaagtcagaaggcacttagcgtcgaatccaaagccgtgataaagcagcagctggagagtgtcagcaacggctggactgtctaccgaatcgcgagacaagctagtcggatgggaaatcatgacatggccaaggagctctaccaatctctcttgacacaggttgcctccgagcatttttacttttggctgaacagtctcaaggagttctcacacgcggaacagtgccttaccgggcttcaggaagaaaattatagctctgctctctcgtgtatcgccgagtcactgaaattctaccataaaggcattgctagcctgaccgctgctagcacaccgctcaaccctttgagcttccaatgcgagtttgttaaactaagaattgatctgctccaggccttcagtcaactcatctgtacatgtaacagcttgaaaacaagccccccacctgcgatcgcaacaaccattgcaatgaccctcggaaatgatcttcaacgttgcgggaggatatccaaccagatgaagcagagcatggaggaatttagaagtctggcttcgcggtacggcgatttgtaccaagcatctttcgacgctgactcagctaccttgaggaatgtcgagctgcagcagcagagctgcctgctgatctctcacgcgattgaggccctcattctggaccccgagagcgcctcattccaggaatacggatccaccggcactgcacacgccgactctgaatacgagcgccgaatgatgtctgtgtataatcatgtgttggaagaggttgaatctttgaaccgaaagtatacgccagtgtcgtatatgaggtacttttttcagaagctccagagcacctccatcaaactcgccttgagtccaagcccacggaacccagcagagcctattgccgtgcagaataaccagcagctagcattgaaggtggagggcgttgttcagcacggcagcaagccaggcctgttccggaaaatccagtctgtctgcctgaacgtgtcaagtaccctacagtctaagagcgggcaagattataaaatccctatagacaatatgaccaacgagatggaacagcgtgtagaaccacataatgattacttttcaacgcaatttctcctgaattttgccatcctggggacacacaatattactgtggaatcttctgtgaaagacgccaatggcattgtgtggaaaacggggcctaggaccaccatctttgtgaagtccttggaggatccttactcccagcaaattagactgcagcaacagcaggctcaacaacccctgcagcagcagcaacagcgcaatgcttataccagattctag

SEQ ID NO: 23248 - DNA, 2847 bp, Artificial Sequence
  Description of Artificial Sequence: Synthetic coding sequence
atggctagtaattcaaccaaatctttcctggcagacgcaggatatggtgaacaggagctggacgccaacagcgcattgatggaactcgacaaaggtctgcggtccggaaagctcggagaacagtgcgaagccgtcgtgcgatttcccaggctcttccaaaaataccctttccccatactcatcaacagcgcattcctgaaacttgctgatgtatttagggtggggaataattttctaagattgtgtgtactgaaagtgacacagcagtcagaaaagcacttggaaaaaatacttaacgttgatgaatttgtaaagcgtatattttccgtcatacactcaaatgaccccgtcgcacgcgctatcacgctgcgcatgttaggttcattggcttctatcatccccgagcgcaaaaatgcacaccatagcatcagacagtcgctggactctcatgataatgttgaagtggaagccgcagtgtttgctgccgcaaactttagcgcccagtctaaagacttcgcagttggaatttgtaacaaaatcagtgagatgattcaaggcctagcaacccctgtggaccttaaattgaaactaatccccatccttcagcatatgcaccatgatgctatcctagcaagctccgctcggcagctcctgcagcaactagtcacttcatacccatccaccaaaatggtaattgtttccctccatacatttaccctgttggcagcctcaagcctggtggacacgccgaaacagatccagctgttgctgcagtatctaaagaatgacccaagaaaggctgtaaagcgcctagcaattcaggatttgaaactgctggcaaataagaccccgcatacctggtcgcgtgagaatatccaagccctgtgcgagtgtgcgctgcagactccctatgacagtctgaagcttggcatgctaagcgtactctctaccctttctggtacaatagccatcaaacattacttctcaattgtccccggaaacgtatcctcatctcccagaagttcggatctcgttaaactagcccaagaatgttgctatcataacaatcggggaatcgccgcacatggagtcagggtgctgaccaatatcacggtgtcctgtcaggagaaagacctgctcgcgctcgagcaggacgctgtttttgggttggagtccctcttggtgctctgcagtcaggacgactccccaggcgctcaggcaacactgaaaattgcactcaattgcatggtaaagctcgctaaggggagaccccacttgtcccaaagtgtggtggaaacgctgctgacccaattgcattctgcccaggatgccgcaagaatactaatgtgtcattgcctggcggcaatagctatgcaactcccggtgctgggggacggcatgttgggtgaccttatggaactttacaaggtgatcggtagaagtgcaaccgataaacaacaggagctcctggtaagcctggccacggtaatatttgtggctagtcagaaagccctgagtgttgagagtaaggctgtcatcaagcagcaactagagtctgtgtccaatggatggactgtgtaccgaattgctaggcaggcctcgaggatggggaaccacgatatggctaaagagctataccaatccctgctgacgcaagttgcctctgagcacttttatttctggttaaacagcctcaaagagttttcccatgccgagcagtgcttaaccggcctgcaggaggaaaactatagtagcgcactttcttgcattgccgaatccctcaagttctatcacaaggggattgcaagcttgaccgcggcttctacccccctcaatcccctctcattccagtgcgagttcgttaaactcaggattgatctgttacaggctttcagtcaactaatctgcacctgcaactctttaaagacatcaccccctcccgctattgctactactatcgctatgaccttgggaaatgatctccaaaggtgcggcaggatcagtaaccagatgaaacagagtatggaagagtttcgttccttggctagtaggtacggagacctctaccaggcatcttttgatgcggactccgctaccttaaggaatgtggaactacaacaacagagctgtttgttgatatctcacgccatcgaggcgctgatcttggacccagaatccgcttccttccaggagtacggatcaaccggtaccgcacacgctgattcagaatacgaaaggaggatgatgagtgtctataatcacgtgcttgaggagcatacagcctgcctttgtaatgctattatcgctctcctgaaggtccctctctcctttcagcggtattttttccagaaactacagagcacttcaataaagctcgctctgagtcccagcccccgtaaccccgcagaacccattgccgtgcagaacaaccagcagctggcactgaaagtcgaaggagttgtgcaacacggttctaaacccggattgtttcgcaagatccagtccgtctgccttaacgtgtctagcactctccagagcaagtccggacaggattataagatccctatagacaatatgacaaacgaaatggaacaaagggtggaaccgcacaacgattacttttctacccagttcctgctcaacttcgcaatcctggggactcacaacataactgtagagtcgagtgtaaaggacgcgaatggcatcgtgtggaagaccgggccacgaacgacaatcttcgttaaaagtctggaggatccgtactcccaacagattcggctccaacagcagcaggcgcagcagccgcttcaacagcagcagcagcggaacgcttatacccgattctag

SEQ ID NO: 23249 - DNA, 2889 bp, Artificial Sequence
  Description of Artificial Sequence: Synthetic coding sequence
atggctagtaattctacaaagagcttcctggcagacgcaggctatggcgaacaggaactggacgcaaattcagcactaatggagctggataagggcctacggtccggtaaacttggggaacagtgtgaggcggtggtgcgctttccaagattgttccagaaataccccttcccaatcctgatcaatagtgcattcctgaaactcgcagacgtgttcagagtggggaacaatttcctgcggctctgcgtgctcaaggtgactcagcagagtgaaaagcacctggagaagattctgaacgttgacgaattcgttaaacgcatattctccgtgatacactccaatgaccctgttgcacgagcaatcacccttcgcatgctgggcagtctcgctagcattatacccgagcgcaaaaatgcccaccactcgatcagacagagcctcgacagccatgacaatgtggaggttgaagcggctgtcttcgcagccgctaatttcagcgctcagtccaaagacttcgcagtagggatctgcaataaaatcagtgaaatgatacagggactcgctacacccgtggaccttaagctgaaactgatccccatcctccagcatatgcatcatgatgcaatccttgcttctagcgccaggcagctcctccagcagctggtaacaagctacccatccaccaagatggtaatcgtgtccctgcataccttcaccttgctagcagcctcctcattggtggacactcctaaacagatccagctgctactacaatatctcaagaatgaccccagaaaggctgtgaagcgactggctatccaggacctcaaactcctggccaacaaaacgccccatacttggagcagagaaaatatccaagctttgtgcgagtgtgcgctgcagacgccctacgactctttaaaacttgggatgctgtcagtcctcagcaccctgagtggcaccatagcaatcaaacactattttagcatagtgcctggcaacgtgagttcgtctccccgaagttccgatcttgtgaagttagcacaggaatgttgctatcataacaatcgcggaatcgccgcacacggcgtgcgagtgctgactaatatcacagtgagttgtcaggagaaggacttgctcgcactagagcaggatgctgtttttgggctggagtctctgctggtcctctgttcacaggacgactctccaggcgcacaagctacgttgaagatagctcttaattgtatggtgaaactggccaagggtcgccctcatttgtcccagagtgtcgtcgaaactttgctgactcagctccactctgctcaggacgccgctcgaattttgatgtgtcattgtctggctgctattgccatgcagctgcccgtgctgggcgatggcatgctcggggacctcatggagctatataaagtgatcgggagatctgcaacggataagcagcaagagctgctggtgtccctggcaaccgtgatcttcgtggccagccagaaggctttgtctgtcgaaagcaaagctgtgatcaaacagcaattggagtcggtttcaaatggatggaccgtttaccggatcgctagacaagccagtcggatgggcaatcacgacatggctaaggagctttaccagtcactattaactcaggtagcaagcgagcacttctatttctggctaaactccttgaaggaattttcccatgccgaacaatgcctgactgggctccaggaggagaactactcctccgcactttcctgcatcgccgagagcctcaagttctatcacaagggaatagcctcactcacggcggcttcgaccccgctgaaccccctctcctttcaatgcgaattcgttaagttgcgaatcgacctgctgcaagctttcagccagttgatctgcacgtgtaattctctgaagacctcaccaccccctgccattgcaactaccattgccatgacccttggaaacgacctacaaaggtgtggcaggatatctaaccagatgaaacagagcatggaggagtttcggtcattggctagcaggtatggtgatctgtatcaggcatcctttgacgccgacagtgcaaccctgcgtaatgtcgaactgcagcagcagtcgtgcctgttaatttcacatgccatcgaagcgctaatcctggacccagaaagcgccagttttcaggaatacggctccacaggaacagcccatgccgattctgagtatgagcggaggatgatgtctgtttataaccacgtgctagaggaagttgaaagtctcaaccgaaagtatacacccgtttcatacatgcacactgcctgcctgtgcaatgcaattattgctctgctgaaggtgccactatctttccagaggtattttttccagaaactgcagtcaacatctattaagctcgccctgtcaccttctcccagaaaccccgctgagcctatcgccgtgcagaacaatcagcagctggccctgaaggtggagggggttgtgcagcacggatccaaaccgggtttattcaggaaaatccagtcagtgtgcttaaacgtgtcatctacgctgcagtcaaaatctgggcaggactacaagatccctatagataacatgactaacgagatggaacagagggtcgagccccacaacgattacttctccactcaattcctgctgaatttcgcgatcctggggacccataatataaccgtcgagtcctcagtgaaagatgctaacgggatcgtgtggaagaccgggcctcgaacaaccatctttgttaaatcgctggaggacccatacagccaacaaatccgactccagcagcagcaagctcagcaaccacttcagcagcagcaacagcgaaatgcatacacgagattctag

SEQ ID NO: 23250 - DNA, 2742 bp, Artificial Sequence
  Description of Artificial Sequence: Synthetic coding sequence
atggcaagcaatagtacaaagtccttcctggccgacgctggctacggggaacaagaattggacgccaactctgctctgatggaactagacaaagggctgcggtctggaaagctcggcgagcagtgtgaggccgtggtgcgttttccaaggctgttccagaagtaccccttccccatcttgattaactcggctttcttgaagctggcagatgtcttccgagtgggtatgttgggcagtttagcatctataatccccgaacggaagaatgcacaccactcaatcaggcaatctttggacagccatgataatgtcgaggtcgaagccgctgtcttcgccgctgcaaacttcagcgcgcagagcaaggacttcgccgtgggtatttgcaataaaatttccgagatgatacaaggtcttgcgaccccagtggacctgaagctgaagctgatcccgattttgcagcacatgcaccacgacgctattctcgcctcatctgctcgtcagctactccaacagctggtcacctcttacccctccactaagatggtgatcgtatcactccacacctttacactgctggccgcttcatccctggtggacacccccaagcagatccagctgctgctccaatacttaaagaatgatcctcggaaggcagtgaagcgcctcgctatccaggaccttaaacttctggctaataaaacacctcacacatggtcaagggaaaacattcaagccctgtgtgagtgtgccctgcagactccttacgactctttgaaacttggaatgctcagcgttctctctaccctgagtgggaccatcgccattaaacactacttctccatagtacccggaaatgtgtccagttcaccgaggtctagcgatcttgtgaagctggcccaagagtgctgttaccataataatagaggtatagcagctcacggggtcagggtgctgaccaacattaccgtaagctgccaggagaaggacctgctcgccctcgagcaggacgcagtcttcggccttgaatctctgttggttttgtgctcccaggatgactctccaggtgcccaggcaaccctgaagatagcactcaattgtatggttaagctcgccaagggccgacctcatctgtcacagtccgtcgttgagacgctcctgactcagctgcattccgctcaggacgcggcaaggatcctgatgtgccattgcctcgccgcaatagctatgcagctgcccgtcttgggagacggcatgcttggcgatctgatggaactgtataaagtgatcggacgcagtgctaccgataagcagcaagaattgctggtctctttagccaccgtaatcttcgtggccagtcagaaggcgctctctgtcgaaagtaaagcggtcattaagcaacagctcgagtcagtctcaaatggttggactgtctaccgcatcgcccgtcaagcgtccagaatgggaaatcatgacatggcaaaggagctgtaccaaagcctgttaacccaagtcgcctcagagcacttctatttctggttaaattcgctcaaggagtttagccatgcggaacagtgtctaactgggctgcaagaggagaattactcctcagctctttcttgcatcgctgaaagtctcaaattctaccacaagggaattgcaagtctaacagcagccagtacacctctcaacccacttagttttcagtgtgagtttgtaaaactgcgtatagatcttcttcaggcattttcgcagcttatttgcacctgtaattcccttaaaacctcccctcccccagccatagccaccacgatcgctatgacattaggtaacgatttacagagatgtggtcggatctctaaccagatgaagcagtctatggaggaattcaggagcttggccagccggtacggagatctatatcaggcctcattcgacgccgactccgccaccctgcggaacgtggagctgcaacagcagagctgcctattaatctcacacgcaattgaggcgctgatcctagaccctgagtccgcttcctttcaggagtacgggagcactggcactgcccacgccgactctgagtatgagcgacggatgatgagcgtctataaccatgtactggaggaagtcgaaagcctaaatagaaagtacacaccagttagttatatgcacacagcctgtctgtgcaacgctatcattgctctgttgaaagtgcctcttagtttccagcgctatttcttccaaaagcttcagtccacaagcatcaagcttgcactgtccccttcccccagaaatcccgcagagcccatcgccgtgcaaaacaaccagcagcttgctctcaaggtggagggcgtcgtgcagcacggctccaagccgggactgttcagaaaaattcaatccgtgtgcctcaacgtctccagcactctgcagtccaaaagcggacaggattataaaattcccattgataacatgactaacgaaatggaacagcgggtggaaccccacaatgattacttttctacgcagtttctgttaaatttcgcaattcttggcacccataacataactgtggaaagctcagttaaagacgcaaacggaatcgtgtggaagactggcccaagaaccacaatcttcgttaaaagtctggaagatccctactctcagcaaatcagactacagcaacagcaggcccagcaacctctccagcaacagcagcagcgaaacgcctatacacggttttag

SEQ ID NO: 23251 - DNA, 2937 bp, Artificial Sequence
  Description of Artificial Sequence: Synthetic coding sequence
atgtccgctgaggcagcggatcgtgaggccgctactagctcccggccatgcactccccctcagacctgctggttcgaatttctgctcgaggagtctttactagaaaagcatctgagaaaaccctgccccgaccccgctccagtgcagctcatcgttcagtttctggagcaggcctcaaagccttctgttaacgaacaaaatcaggtgcaacctcccccagataataaacggaaccgtattttgaagctcctggcactaaaggtcgcagcacaccttaaatgggatcttgatatcctagagaaatccctgagcgtgcctgttttaaacatgctgctgaacgaattactttgtatttctaaggtgccgcctggtaccaaacacgtggatatggacctggccactctccctcccactacagcaatggctgtactgctgtacaaccgctgggccattagaacaatagtgcagtcctcctttccagtgaaacaggccaagccgggacccccacagctgtcagtgatgaaccagatgcagcaggagaaggagctgacagagaacatcctcaaagtgctgaaggaacaagccgcagactccatcttggtgttggaagccgctctcaaactcaacaaagacctctatgttcacacaatgcgcacactggatcttctggccatggagccaggtatggtaaatggagaaactgagtcctccaccgccggactgaaagtcaagaccgaggagatgcagtgtcaggtgtgttatgatcttggcgcagcttatttccaacagggttccacaaattccgctgtctatgagaatgccagagagaagtttttccggacaaaggagctgattgcggaaatagggtcactcagcctgcattgcacaatcgatgaaaaacgtttagctggctattgtcaggcttgtgacgtactcgtgcctagctccgatagcaccagtcagcaacttactccatatagtcaggtacatatctgcctgcggtccggcaactaccaggaggtgatccagatctttattgaggataatctaactcttagcctgcccgtacagtttagacaatcagtattgcgtgaactgttcaagaaagcacagcagggtaatgaggcgctggacgagatatgttttaaggtctgcgcttgcaatacagtccgcgacattctggaggggaggactatctccgtgcagttcaatcaactgttcttgaggcccaataaagaaaagatagattttctcttggaggtgtgttcccggtccgttaatttggaaaaagcctctgagtctttgaagggaaatatggcggcatttctcaagaacgtgtgtctgggtctcgaagacctccaatatgttttcatgatcagcagtcacgaattgttcataaccttgctgaaggacgaagaacggaagctgcttgtagatcaaatgcgaaaacgaagcccccgagtgaacttgtgcatcaaaccagtcacatcgttttatgatatccccgctagcgcatcagtgaatattgggcaactggagcatcaactgatattgtcagtcgacccctggcggatacgacagatactcattgaattacacggaatgacgagcgagcggcagttttggactgtgtcgaataagtgggaggtgccaagcgtctacagcggtgttatcttaggcattaaggacaacctgacacgcgacctggtatacattttaatggccaaggggctccattgctcgaccgtgaaggatttctcgcatgcaaaacaactgtttgcagcttgcctcgagttagtgactgagttttcaccgaaactgaggcaagtgatgttaaacgagatgctgctgctcgacatacatactcacgaggccggaactggtcaggccggtgaacgccctccctctgacctgatcagccgtgtaaggggataccttgaaatgagacttcccgatatccctcttcggcaagtgattgccgaagagtgcgtggccttcatgctcaattggcgtgaaaacgagtacttaaccctgcaggtacccgcattcctccttcagagtaacccctacgttaagctaggccaactgctggccgcaacttgtaaagagctcccgggaccaaaggagagccgaagaactgccaaagatttgtgggaagtggtggtgcagatctgtagtgtgtcctctcagcacaagcgcggaaacgacggcagagttagcctcatcaaacagcgtgagtcaaccctcggcattatgtacagatccgagctcctctcctttataaaaaaactgcgggagccattggtactcaccatcattcttagcctgtttgtgaagctgcataacgttagggaggatatcgtgaacgatatcaccgctgagcatatctccatctggccttcatcgattcctaacctgcaatcagtggactttgaggccgtcgcgatcaccgttaaagagcttgtgcggtacacattaagcatcaaccccaacaaccactcctggttgataatccaggctgatatatatttcgctaccaatcagtatagcgccgctctgcactattaccttcaagcaggagctgtttgtagcgactttttcaacaaagccgtaccaccagacgtgtatacagaccaagtggccattctttgccagttcctgcgggaaatcgactacaagacagcctttaagagtctgcaggagcagaatagccatgatgctatggacagttattatgactatatttgggacgtgaccatactggagtacctgacatacctgcatcataaacggggtgagactgataaacggcagatcgctattaaggctattggccagacagaactaaacgcctcaaacccggaagaggtgctccagcttgctgcccaacggagaaagaaaaaattcctgcaggctatggctaagctgtacttttag

SEQ ID NO: 23252 - DNA, 2988 bp, Artificial Sequence
  Description of Artificial Sequence: Synthetic coding sequence
atgtccgccgaggccgctgacagagaggcagcaacctcctccagaccatgcaccccaccccagacctgctggttcgagttcctgcttgaggaaagtctgttggagaagcacctacggaagccgtgcccagaccccgctccggtacagcttatcgttcaatttctggaacaggcctctaagccttcggtgaacgagcaaaaccaggtccaacctcctcccgacaacaagaggaatcggatcctcaaactcctggcccttaaggtcgcggcacacctgaagtgggatctggatatccttgaaaagtccctaagtgtgcccgtactgaacatgctactcaatgaactgctgtgcatttctaaagtgcctcccggtaccaagcacgtcgacatggatctcgccaccctgccccctacaactgccatggccgtgctattgtacaatcgctgggcaattagaactatcgttcagtcaagcttccctgttaaacaggctaagcctggcccaccacagttgtctgtgatgaaccaaatgcagcaggaaaaggagctgacggagaatatcctcaaagtcctaaaggaacaggccgctgattccattctcgttttggaagccgctttaaagcttaacaaggatctctacgttcatacaatgcggacattggaccttctggctatggaacccggaatggtgaatggtgaaaccgagagctctacagctggactgaaagtgaagaccgaggaaatgcaatgccaggtatgctatgacctgggtgcagcttatttccagcaggggagtacaaacagtgctgtctacgagaatgctcgagaaaagttttttagaacaaaagaactcatagcagagatagggagcttgtcgctgcattgcaccatcgatgaaaagagactcgcgggatactgccaggcgtgtgacgtcctggttcccagcagtgatagcacatcacagcaattgacaccttattcccaggtccatatatgtttgagaagcgggaactatcaagaggtcattcagatcttcattgaggacaaccttacgctgtccttacccgtccagtttaggcagtccgtgttgcgggagctgtttaagaaggctcagcaaggaaacgaagcacttgatgagatttgctttaaggtctgcgcctgtaatacagtccgagacatcctcgaaggtcgtacgatttctgttcagtttaaccagttgtttcttagacccaataaagaaaaaattgacttcctgctggaggtgtgttccaggagcgtgaatctcgaaaaggcctcagagtctttaaaagggaatatggctgcttttctgaagaatgtttgtctgggcctagaagatctgcaatacgtttttatgatctcatcacacgagctgttcatcaccctgcttaaagatgaggaacgcaaactactagtggatcaaatgcgcaagcgcagcccacgcgtgaacctatgtatcaagcccgtaacatcattctacgacatccccgcttcagcatctgtgaatataggtcaactggagcaccagctcattctgagtgtagatccgtggcgtatccgtcagatattgatcgagctccatgggatgacatcagagcgccagttttggacagtgagtaataagtgggaggttccttccgtttattccggcgtgattctggggattaaggacaacttgacaagagatctcgtttatatcttgatggccaaaggcttacactgtagcactgttaaagattttagccacgccaagcagttatttgccgcttgtctggaactggtaaccgagttcagcccgaagttaaggcaggtgatgctcaacgaaatgctcctgctggacattcacacccacgaagccggtactggacaggcaggcgaacgtccgccttctgatcttatatcacgggtcaggggttacctagagatgcggctgccagacataccgttgcggcaggtgatcgctgaggagtgcgtggcgttcatgttgaattggagagaaaatgagtatctcacgctccaggtccctgcgtttttacttcaatccaatccatacgtgaaactgggtcagctgctggctgctacctgtaaggaactccctggtcctaaagagagcagaagaactgcaaaagacctttgggaggtggtggtacagatttgctctgtaagctctcaacataaacggggaaacgatgggagagttagcctgattaagcagcgagagtctactctggggatcatgtaccgatccgagctgctcagttttataaagaaactacgagagcccttagtcttaacaatcatcctctccctgtttgttaaattgcacaacgttagagaggatatagtcaacgatattactgccgagcatatttccatctggccttctagtatccccaatctccagagtgttgatttcgaagcagtggccatcactgtgaaagagctggtgcgatataccctgtctatcaaccccaataaccactcatggctgatcatccaagctgatatttattttgccaccaaccaatacagcgctgccctgcattattacttgcaggctggggctgtatgctctgatttcttcaataaggccgtgccccctgacgtgtacacagatcaggtcattaagcgaatgataaaatgttgttctctccttaactgccacactcaggtagccatcctgtgtcagtttctgagggaaatcgattacaaaaccgcctttaaatctcttcaggagcagaattctcacgatgccatggatagctattatgattacatttgggatgttacgatcctggagtaccttacttatcttcatcacaaaagaggtgagacggataagcgacaaatagcgattaaagctattgggcagacagaactgaacgcctctaatccagaggaggtgctgcagctggctgctcagcgcaggaagaaaaagtttctacaggccatggcaaaactttacttctag

SEQ ID NO: 23253 - DNA, 1659 bp, Artificial Sequence
  Description of Artificial Sequence: Synthetic coding sequence
atgatggcactgccctacattaccgagcatactgggttcactgggactgtctacgcgaccgaacctactgtccagattggtcgcctgctcatggaagagttagtcaattttattgagcgagtgcccaaagcgcaatctgctagcttatggaaaaacaaagatattcagaggctcctccccagcccactcaaggacgcagtggaggtctccacatggcgcaggtgctacaccatgcaagaagtgaacagcgctttgtcaaagattcagttggtcgggtactcacagaagatcgagctatttggagcagtccaggtgactccactcagcagcggctacgctctggggtcttccaactggatcatacagagtcactacgaaaaggtgtcatatgtgtcaggcagttcgctcctgaccactcacccccaacctatggaccaggcctctctgaaaaacagtgatgtgctagtcttaacaggtctgacacagattccaacagcaaacccggatggaatggtgggcgaattctgcagtaacctggccctcaccgtccggaacggtggaaacgtgctggtcccatgttacccttccggggtgatttatgatttacttgagtgtctctaccagtacatcgattcagcgggtctaagctccgtccccttatacttcatctccccagtggccaactcgagcctggagttcagccagattttcgccgagtggctgtgtcataataaacagagcaaagtctatttacccgagccaccattcccgcatgcagaactcattcagacaaataagcttaagcactacccctctattcacggggatttcagcaatgactttagacagccgtgtgtggttttcacaggccacccttccctacggtttggagacgtcgttcacttcatggaactatgggggaagtctagtctgaacactgtgatctttacagagcctgacttctcctatctcgaagcattggctccgtatcagcccttggctatgaaatgcatatattgccctatagataccagactgaactttatccaggtctctaaattgctgaaggaggtgcaaccgctgcatgtcgtctgccccgagcagtatacccagccaccacctgcacagtcgcatcgtatggacctgatgattgattgtcagcccccagccatgagctatcgacgagcagaagtgcttgccttacctttcaagaggcgatacgaaaaaattgagattatgcctgaactggcagactccctggtgccaatggagatcaagcccggtatttctctggctacggtatccgctgtgttacatacgaaagacaacaagcatctactgcagcctccaccacgccctgcacaaccaaccagcggtaagaagaggaaacgtgtaagcgacgacgtcccagactgcaaagttctgaaaccgctgctgtctggaagcatccctgtggagcagttcgtacaaaccctcgaaaagcacggattttctgacatcaaagtggaagatacagctaaaggccacattgtgctcctgcaggaggcagaaacactcatccaaattgaggaggactccactcatataatatgcgacaatgacgaaatgcttagggtccgtttgcgcgacctcgttttgaaatttttacagaaattctag

SEQ ID NO: 23254 - DNA, 1977 bp, Artificial Sequence
  Description of Artificial Sequence: Synthetic coding sequence
atgaagctgtactgcctctctggccacccaactctcccctgtaatgtgttgaagtttaagagcaccactattatgctcgattgtggactcgatatgaccagtaccctcaacttcctgcccctaccactggtgcagtctcctcgcctgtccaatcttcccggttggtcgctgaaagatggaaatgccttcctggataaggagctcaaggaatgctccggccatgtcttcgtggacagcgtgcctgagttctgcctccccgagaccgagctcattgacttgtcaacagtggacgtgatcctgatttctaactaccattgtatgatggccctgccttacattaccgagcacactgggtttaccggtaccgtgtatgcaaccgaacccactgtgcagatcggcaggctgctcatggaggaactggtgaattttattgaacgagtaccaaaagcccagtcagcttccctgtggaagaataaggacattcagaggctcctccctagtcctctcaaggatgcggtcgaagtttcgacgtggagaagatgctacacaatgcaagaagtcaacagtgcactctctaagatccaattggtcgggtactcacagaaaatcgaactcttcggtgctgtgcaggtcacccctctttcatccgggtacgccttgggctcttcaaattggatcatacagtcccattacgaaaaggttagctacgtcagcggcagttctctattaacaacacacccacagccaatggaccaggccagtctgaaaaacagtgacgttctcgtgcttaccggccttacacagattcctactgcgaaccctgacggcatggtgggtgaattttgttctaaccttgcattgacggttcggaacgggggaaatgttctcgtgccatgttaccccagtggggtgatttacgacctccttgaatgcctctaccaatacatcgattccgcaggcctgagcagtgtgcccttatatttcatctctccggtggcaaactcatctctggagttcagccagatcttcgccgagtggctttgccacaacaaacaatctaaggtctacctccccgagccacctttccctcacgccgaactgatacaaactaacaagctgaaacattatcctagcatccatggcgatttcagtaacgactttcgccagccatgtgtcgtgtttactgggcacccttccctcaggttcggagatgtggtgcattttatggagctttggggaaagtccagtctgaacaccgtgatcttcaccgagcccgatttctcatatctggaggcactggctccctatcagcctctcgccatgaaatgtatttattgccccattgatactcgcctcaactttatccaggtgtctaagctgctaaaggaggtgcagcccctgcacgtggtgtgccccgagcaatacacccaaccgccaccagcccagagccacaggatggatttgatgatcgactgtcaaccccctgcgatgtcctatcgccgagctgaggttctcgccctgccatttaaaagacgttacgagaaaattgagatcatgcccgagctggccgactccctcgtccccatggagattaagcccggaataagcttggctacggtgagtgctgttctccatacaaaggacaacaagcacttgctacagccccctccacggcctgcacagcccacatccggtaaaaagcgcaagagggtgagtgatgatgtgcccgactgtaaggtgttaaagcctctgctttctgggtccatacctgtggagcagtttgtgcagaccctggagaaacatggatttagcgacattaaagtcgaggacacggctaaggggcacatcgttctgttgcaagaggctgagacacttattcagattgaggaggacagcactcatatcatttgcgacaacgacgagatgctccgcgtccgccttcgggaccttgttctgaagtttctgcaaaagttttag

SEQ ID NO: 23255 - DNA, 1509 bp, Artificial Sequence
  Description of Artificial Sequence: Synthetic coding sequence
aagatctactgcctttctggccacccaacgctcccctgcaatgtcctgaagtttaagtctacctggagacgctgctatacaatgcaggaggtgaatagtgcactgtccaagatccagctcgtaggctactcgcagaaaatagagctcttcggtgctgtccaggtgacccccctgagctccggttatgccttaggtagcagcaattggattatccagtcccactacgagaaggtaagttacgtctctgggtcttcgctgcttactactcacccacaacccatggaccaggcctccctgaaaaactccgacgtgctggtcctgacaggtctgacacaaatccccacagctaatcctgacgggatggttggggaattctgctctaacctcgccctgaccgtgcgcaacggaggcaacgtattagtgccttgttatccaagcggcgtcatctacgatctcttggaatgtctctaccaatacatcgattcagccggtctgtcaagtgtgccactttacttcatcagccctgtagctaatagctctttggagttttctcaaatcttcgctgaatggctctgccacaacaagcagagcaaagtgtacctcccagagcccccttttccccatgcagagttgattcagacaaacaagctcaagcactacccgtcaatacacggggatttttcaaatgattttaggcaaccctgtgttgtctttactggtcacccctccttacgcttcggggacgtagtccatttcatggaactgtggggcaaatccagcctcaacacagtgatatttacagagccagatttcagctatctggaggcattggctccgtatcagcccttggcaatgaaatgtatttattgccctatagatacccgacttaacttcatacaggtaagtaaactgctcaaggaggtgcaacctcttcacgtcgtgtgccctgagcaatacacccagcctcctccagctcagtctcatcgcatggatctaatgatcgactgccaacctcccgcaatgagctacaggagagcagaggtcttggctttaccatttaagcggaggtatgaaaagatagagatcatgcctgaactcgcggatagtctggtgcccatggaaataaaacccggaatctcactggctactgtgagtgcagtgttgcacacaaaggacaataaacacctgttacagccccctcctcgccctgcccagccaacatctggcaaaaagcgcaagagagtttccgacgacgtgcccgactgtaaggtgcttaagcccttactgagtggctctataccagtggagcagttcgtgcaaaccctggaaaagcatgggtttagtgatatcaaagtggaggacacagccaaaggacatattgtgctgctccaagaggcagaaaccctgatccagatcgaggaggactcgacccatatcatctgcgataacgatgagatgctgagagtccgcttgcgggatttagtgctgaaattcctgcaaaagttctag

SEQ ID NO: 23256 - DNA, 1914 bp, Artificial Sequence
  Description of Artificial Sequence: Synthetic coding sequence
atgaagttgtattgtctctccggacatccaaccttgccatgcaacgtgcttaagtttaaaagtaccaccatcatgcttgactgcggcctcgatatgacaagcactctaaattttctccctctgccactggtacagagccctcgattgtcaaacctccctggatggagtcttaaagacggtaatgcctttctggacaaaacagaactgatcgatttgtcaacggttgacgtcatcctgattagtaactatcactgcatgatggcactcccatatattactgagcatacgggttttacagggaccgtgtacgccaccgagcctacggtccagattgggaggctacttatggaggagcttgtgaatttcattgagagggtgcctaaagctcagtccgcctcactttggaagaataaggatatccagagactgctacctagcccactgaaggacgcggtggaggtatccacctggcgacgctgttacacaatgcaagaagtgaattccgccctttctaaaatccagctggtgggatattcccagaagatcgagttgttcggagctgttcaagtcacccccctgagcagcggctatgccctcggatccagtaactggattattcaaagccattacgaaaaagtcagttatgtcagcgggtccagcctcctgacgactcatccccagccaatggaccaggcctctctcaaaaacagtgatgtgctggtgttgacaggcttgactcagatccctactgcaaaccccgacgggatggttggagaattctgcagtaacctcgcacttacagtacgcaatggcggaaatgtgctggttccttgctatccttctggcgtgatctacgatttactagagtgcctctaccagtatatagattcagcaggcctgtcctctgttccactttatttcattagcccggttgccaacagcagcctggagttttcccagatttttgccgagtggttgtgccataacaagcagagtaaagtgtacctgccagaacctccattcccacacgccgagcttatccagacaaacaagttgaagcactacccctcgattcacggtgactttagtaacgatttccgacaaccgtgtgttgtcttcacgggacatccctcgcttcggtttggggacgtggttcattttatggaactctgggggaaatcctcacttaacacagtgatcttcacggaaccagacttttcctacctcgaagccttggccccttaccaacctctggctatgaagtgtatctactgccctatagacacacggcttaactttattcaagtgagcaaattacttaaggaagttcagcccctccatgtggtttgccctgaacagtacactcagcctcctcccgcacaatcccaccgcatggacctgatgatagactgccagccgccagctatgagctaccggagggccgaggtcttggccctcccatttaagagacgttacgaaaaaattgagattatgcccgagttggccgacagcttggttcctatggaaatcaagcccggaatttccctggctaccgtgagtgctgtgctgcatactaaggataacaaacatctgttgcagccaccccctagaccggctcagcctactagcggcaagaagagaaagagagtaagtgatgacgtgccagactgtaaagtcctgaaaccactgctgtcaggcagcatccctgttgaacagttcgtccaaactttggagaaacatggtttctctgacattaaggtagaagatacggctaaaggccatattgtgctgctccaggaagcagagactttaatccaaattgaggaagattcaacacatattatttgtgataatgacgagatgctccgtgtgaggcttagagacctggtcctgaagtttcttcagaagttctag

SEQ ID NO: 23257 - DNA, 1905 bp, Artificial Sequence
  Description of Artificial Sequence: Synthetic coding sequence
atgttggactgcgggctcgacatgacttctaccctaaactttctgcctctccccctcgtgcagtcgcctagactgtccaatctcccaggttggtccctcaaggatggtaacgcattcttagacaaagaactgaaagagtgcagcgggcatgtgtttgtggattctgtgccagagttttgtctccccgagaccgagcttatcgacctgtcgactgtagatgtcattctgatctctaactatcactgcatgatggcactgccttacattaccgaacatacagggtttaccggaacagtttacgctacagagcccaccgtgcagattggccgacttctgatggaggaactcgtgaactttatcgagcgggtgcccaaggcacaatctgcatctctttggaaaaataaggatattcaacggctgctgccaagcccgttaaaagatgccgtggaagtgagcacctggagacggtgctacacaatgcaggaggttaacagtgcgctcagtaagatccagctcgtgggatatagtcagaagattgagctctttggtgctgtgcaggtgactccactgagctcggggtatgccttaggctcatctaactggataatccaatcgcactatgagaaagtgagctacgtttctggctctagcttgttgacaacacacccacagccaatggaccaagccagcctcaagaactcagatgtgttggtcctgacaggactgactcagatccccaccgctaatccggacggcatggtgggcgaattctgttctaatctggcccttacagtgcgcaacggcggtaacgtcctggtcccttgctatccctcaggcgtcatttatgatctcttagagtgcctctaccagtacatcgactctgccggactctccagcgtgcccctgtacttcatctctcccgtcgcaaactcctcactcgagttcagccagatttttgctgagtggctatgtcacaacaagcagtcaaaagtgtatttgcccgagccgcctttcccccatgcggaattaatccagaccaacaagctaaagcattaccctagcatccatggggatttcagcaatgatttcagacagccttgtgtcgttttcacgggccaccctagcctacgtttcggagacgtagtccatttcatggagctttgggggaagtccagcttgaacactgttatttttacggaacctgacttttcttacctcgaggccttggcaccttatcaaccactggctatgaagtgtatatattgtcctatagacacccgcctaaacttcatccaggtgtcaaaattgcttaaggaagtacagccacttcatgtagtttgtcccgaacagtatacccaaccaccacccgctcagagccatagaatggacttgatgatcgactgtcagccacccgctatgagctaccgcagggctgaggtgcttgccctgccgttcaaacgtagatacgaaaaaatcgagattatgcctgagttggccgactctcttgtgcctatggagatcaagcccggtatcagcctagccaccgtaagcgcagttcttcacactaaagataataaacacttgctgcagccccctcctaggcctgcacaacccacttcaggaaagaagcgtaaacgcgtgtctgatgacgttccagattgtaaggttttgaaaccactgctatctgggtctattcccgtcgagcagtttgttcagaccttggagaagcatggattctccgatattaaagtggaagacacagcaaaaggtcatattgttttgcttcaggaggccgaaacattgatccaaatagaggaagattctacccacattatctgcgataacgatgaaatgctcagagtgcggctacgcgatctggtcttgaagtttctccaaaaattctag

SEQ ID NO: 23258 - DNA, 1755 bp, Artificial Sequence
  Description of Artificial Sequence: Synthetic coding sequence
atggctagcgtgcaagccagccgaagacagtggtgttatctttgtgacctgcccaagatgccctgggccatggtgtgggacttttctgaagctgtgtgcagaggctgcgtaaacttcgaaggcgctgatcgaatagagctcctaatcgacgcagctaggcaactaaaacgtagtcacgtgctgcccgagggcagaagcccgggtccaccagcactgaagcatcctgcaaccaaggaccttgcagccgcagccgctcaaggccctcagctgccgcctcctcaagcccagccacagccttctggtactgggggtggtgtgtcaggccaagacagatacgatagggccacgagctccggacgtctgccgctgccttctcccgcactggaatataccctggggtcccggctggcgaacggcctagggagggaagaagctgtcgctgaaggagccagacgtgctctgcttggctctatgccagggctgatgcctcccggtttgctggccgctgctgtgagcgggctcggctcgcgcggactcacactggcaccgggtctgtcgcctgccaggccactctttgggtctgacttcgagaaagagaagcaacagaggaacgcggattgtcttgctgagttgaacgaggctatgagggggcgtgccgaggagtggcatggcaggccgaaagccgtcagagaacagctgttggccctgtccgcctgcgctccttttaacgtcaggttcaagaaagaccacggactggtcggaagagtattcgctttcgatgcgactgcacgtccacctggctatgaatttgaactgaagctgtttacagagtatccctgcggctctggaaacgtctacgcaggtgttctggccgtggctagacagatgtttcatgacgccttacgggagccaggtaaagcactcgccagtagtggatttaagtaccttgaatatgaacgcagacatggttccggagagtggcgccagctgggcgaactgctcaccgatggggtcagatctttcagagagcccgcaccagccgaagcattgccccagcagtacccagagccagcccctgccgcattatgcggtcctccgcctcgagcgccttctaggaatctagcccctactccacgcagaaggaaggcttcacctgagccagagggcgaggcagctgggaaaatgactactgaagagcagcagcagagacactgggtagcccctggaggcccttacagcgcggaaaccccgggtgtgccctcacctattgcggctctgaagaatgtcgccgaagcgctcggccattctcccaaagatccgggaggagggggaggccctgttagagccggaggggcaagccccgctgcgtcttcaacagcccaacctcccactcagcacaggctggttgccaggaatggggaggccgaagtgtcccccactgcaggtgccgaggccgtgagtggaggaggatctggaacaggtgccactccaggtgccccactttgttgcactctctgccgggagcgcctcgaggacactcactttgtacagtgcccatccgttccgggacacaagttctgctttccatgcagcagagagttcatcaaggcccagggccctgcaggcgaggtgtactgcccctcaggggacaaatgccctctcgtcggttcgtctgtgccctgggcctttatgcagggtgaaatagcgacaatactggcaggggacatcaaggttaagaaagagagagatccttag

SEQ ID NO: 23259 - DNA, 1764 bp, Artificial Sequence
  Description of Artificial Sequence: Synthetic coding sequence
atggcagccgctgtcgctgttgcggcagccagcaggaggcagtcctgttatctatgcgatctgcccaggatgccgtgggcaatgatttgggactttactgagccagtgtgccggggatgcgtaaattacgagggagcggaccgcgttgaatttgtgatcgaaacggccagacagcttaagagggcacacggctgtttccccgagggcagatcgcctcccggtgctgccgcttccgcggctgctaaacccccacccttgtcagccaaagacatcttgttgcagcagcagcagcagcttggccacggaggacccgaggccgctcctcgtgcccctcaggccctcgagcggtaccccctggcggcagcagcagagagacccccacgcctgggcagcgacttcggaagcagcagacctgcagctagcctggcccaaccgcctaccccacaacctccgcctgtaaacggtatccttgtcccaaacgggttcagcaagctcgaagaaccgcctgagttaaatcgccagagtcctaatcctcgcagaggacacgccgtgccacctacactcgttccacttatgaacgggtccgccacccccttgcccacagccctggggctgggtggtcgtgcagcagcctccctggccgctgtaagcggaacggcagcagcatctctcggctctgcccagcctacagacctcggtgcgcataagaggccggcaagcgtgtcgtcaagtgctgcagtcgaacacgagcagcgggaggctgcggcaaaagaaaaacagcccccaccccctgctcaccggggtcctgcggactcactaagcaccgcagctggagcagcagaactgagcgctgagggagcagggaaatccagaggaagtggcgagcaggattgggtaaataggccaaaaacagttcgcgacacacttctggctttacaccagcacggccactccggtcctttcgagtccaaattcaagaaagagcccgctttgactgcgggtcgcttgctgggcttcgaggctaatggcgcaaacggctccaaggctgtcgcccgaaccgctcgcaagcggaagcccagccctgagccggaaggggaggtggggccacctaagatcaacggggaggcccagccttggttgagtacctccaccgagggtctgaagatccctatgactcccacgtcctcttttgtaagtcccccaccccctaccgcttctcctcacagtaaccgaaccacccccccagaagctgctcaaaacggccagagccctatggccgctcttatcctggtagccgacaacgccggagggagccatgcctccaaagacgctaatcaagttcactccacaactaggaggaattccaacagtccccctagcccgtcttcaatgaaccagaggcggctggggccaagggaggtgggtgggcagggcgcagggaacacaggaggtctggagccagtacatcccgcttcactgcccgactcgtcgctcgcgacttccgcgcctctttgctgtacactctgccatgaacgtctggaggatactcatttcgtccagtgtccctctgtaccatctcacaaattctgcttcccatgtagtcggcaaagcattaaacagcagggtgcctcaggagaggtctactgtcctagcggcgagaagtgccctctggttggctccaacgtcccatgggccttcatgcagggtgaaatcgcaacaatccttgccggtgacgtgaaggtgaagaaggagcgagattcctag

SEQ ID NO: 23260 - DNA, 1716 bp, Artificial Sequence
  Description of Artificial Sequence: Synthetic coding sequence
atggccgcagccgtcgctgtcgccgcagcttcacgcaggcagtcttgctatctctgtgatctcccaagaatgccctgggctatgatttgggattttactgagcccgtgtgccgcggttgcgtaaattatgagggggctgacagggttgagttcgtgatcgagacagctagacagctgaaacgggctcatgggtgcttccccgaggggagatccccaccgggagccgcagccagtgctgcagccaaaccaccccctctgagtgcaaaagacatactccttcaacagcaacagcaactggggcatggcggtcccgaagccgcacccagagcccctcaggccctagaaagatatcctctggcagctgctgcggagcggcctccacggctagggagtgacttcggatctagtcggcctgccgcttctctcgcacagccacccacaccacaaccacctccagtgaacggaatcttagtacctaatggattctccaagctggaagaaccacccgagctgaatcggcaaagcccgaatcctaggagaggacatgcggttccccctactctggtgcccttgatgaatggcagcgcaacacccttacccaccgccttaggactcggtggtcgtgctgccgctagtttagccgctgtgagtggcacagctgccgcttctctagggtccgcacagcctacagatctgggcgctcacaaaaggcccgcaagcgtgagctcaagtgcagcagtagaacatgaacagagggaagcggcagctaaggagaagcaacccccacctcctgctcatcgcggtcctgccgacagcttgagcacagcggcaggagcggctgagctgtccgccgagggggcaggaaaatcccgaggctcaggggaacaggattgggtgaaccggccaaaaactgtgcgggacacgctgctagccctgcaccagcacggccactcgggtccattcgagtccaagttcaaaaaagagcctgctctcaccgcagtagcgaggacagccaggaaacggaagccgtctccagagcccgagggtgaggtcgggcctccaaaaatcaatggcgaagcccagccctggctaagtacttctaccgagggcttaaaaattcccatgactcccactagcagctttgtctcgccccctccacctactgcaagtccacatagtaaccgcacaacccccccagaggcagcacagaatggacagagcccgatggcagcactgattcttgtggccgacaacgcaggagggtctcatgcctcaaaggatgccaaccaggtgcattctactacccgtagaaacagtaactcgccccctagcccgtcctctatgaatcagcgacgactggggccaagggaggttgggggacagggagccggtaacacaggagggttggagcccgttcaccccgcatctctgcctgacagctccctggcgacttcagcacccctatgctgtacactgtgtcatgagaggcttgaagatactcatttcgttcagtgccctagcgtgcccagccacaagttctgttttccctgctcaaggcagtccattaaacagcagggggcttccggggaggtgtactgtccatcaggggagaagtgcccactcgtgggctcaaacgtgccctgggccttcatgcagggggagattgcaacgatccttgccggtgatgttaaagtgaaaaaagaaagggactcttag

SEQ ID NO: 23261 - DNA, 2391 bp, Artificial Sequence
  Description of Artificial Sequence: Synthetic coding sequence
atgtccgcagcacaagttagtagttctcggcgacagagctgttatttatgcgacttaccccgaatgccgtgggcgatgatctgggatttctccgagccagtgtgcagggggtgtgtcaattatgagggggctgatcggatagaattcgtgattgagacagcacgacaacttaaaagggctcatgggtgtttccaggacggacgtagccctggcccaccccctccagtgggcgtcaagaccgttgctctgtcagccaaagaggcagctgccgctgctgcggcagcagccgctgccgctgcagccgctcagcagcagcagcagcagcagcagcagcagcagcagcagcagcagcagcaacaacagcagcagcagcaacaacagctgaatcacgtggacggatcctccaagcccgctgtgctggctgccccatccggcttggaacgatatggactatctgccgctgccgctgccgcagctgccgcagcggctgcggtggaacagcgtagtagattcgagtacccccctccccctgtgtctctgggaagttcctcgcacaccgcgagactacccaacggtcttggagggccaaacggtttccccaagcccacaccagaggaaggcccaccggagttgaataggcagagccccaacagctcctccgcagctgcttccgtcgcctcccggagaggaactcacggcggacttgtcaccggacttcccaatccagggggaggtggagggcctcagttgacggttccaccaaaccttctgcctcagaccctgctgaatggtccagccagtgcagcggtcctaccaccgccacccccacatgccctggggagtagaggcccacctacacccgctccaccaggtgctccgggtggcccagcatgcctgggcggaacacccggtgtgagcgctactagtagcagtgcctcatcatctacaagctcttcggtggctgaggtcggcgtcggcgcaggaggcaaaaggccgggtagcgtgtccagcactgaccaggaaagggagctcaaggaaaagcagaggaatgctgaagccttagccgaactgagcgagtctctgcggaaccgggctgaggaatgggcatctaaaccaaaaatggtacgggatacacttctgaccttagcaggatgcacgccctatgaagtccggtttaagaaggatcactcgctgctggggagagtgtttgcattcgatgctgtcagcaagcccggtatggactacgagctgaaacttttcattgagtaccccactggttcaggcaacgtgtatagtagcgccagtggggtcgctaaacagatgtaccaggattgcatgaaggacttcggcaggggattgtcttctggttttaagtacctcgaatacgagaagaagcatggttctggcgactggaggcttctgggcgatcttctccctgaagcagtgcggttttttaaggagggagtgcccggtgcagatatgctaccacagccatacctggacgctagttgccctatgcttccaacggccttggtctccctctctagggctccctcagctccacctggcactggcgcactgcctccagctgccccatctggcaggggcgctgctgcctcccttcgtaaaagaaaagcttcgccagaacctcccgatagtgcagaaggtgcgctgaagctcggggaggagcagcagaggcagcaatggatggccaaccagtccgaggccctgaagttgacaatgtccgctggtgggttcgccgcacccggacatgccgctggaggccctccacccccacccccacccctcggcccacattccaatcgaacaactccacccgaatccgccccacagaacgggccatctcctatggccgctttaatgagcgtggcggacactttaggcacagcccattctccaaaggacggatcaagcgtccattctaccaccgcctcagcacgacgaaattcctcaagtccagtgtcacctgcttctgtgcccggacagcgcaggctggcttccagaaacggcgatctgaacttgcaggttgcacctcccccaccgtccgctcacccaggaatggatcaggttcacccccagaatatccccgactctcccatggcgaactccggacctttgtgctgtacaatttgccatgagcgtttagaggatacccacttcgtgcagtgtccctcggtcccaagccacaaattttgctttccttgcagtcgcgagagcatcaaggcccaaggggctaccggcgaagtgtactgtcccagcggggagaagtgcccgctcgtgggatccaacgttccttgggcattcatgcagggagagattgccacaatcctcgccggtgacgtgaaagtgaagaaggagcgggatccatag

SEQ ID NO: 23262 - DNA, 1341 bp, Artificial Sequence
  Description of Artificial Sequence: Synthetic coding sequence
atgagcttccctcacttcggacatccctatcgaggcgcaagtcagtttctggctagcgcttcatcctccacaacatgctgcgagtctacacagagatctgtgtccgacgtagcttccgggtcaacccctgccccagcgttatgctgtgctccatacgatagccggctgctgggctcagcaagaccggagttgggggcagccctggggatctacggagccccttacgccgcagccgctgccgcacagagctaccctgggtacttaccttattctcctgaacctccgtctctgtacggggcactaaacccacagtacgaattcaaagaggctgctggctcctttacctcttcgctggcgcaacctggtgcttactatccttacgaaagaactcttggtcaatatcaatacgagaggtacggagctgtggagctcagtggggctggccgacgcaaaaatgccactagggagaccaccagcactctaaaggcatggcttaatgagcaccgcaaaaacccttatcccacgaaaggcgagaagattatgctggccatcatcacgaagatgacactgactcaggtgagtacatggttcgccaatgcacgaaggagattgaagaaagagaacaaaatgacttgggccccaaagaataaaggaggcgaagagcggaaggctgaaggaggcgaggaagattcactcgggtgcctcacagcagacactaaggaggtaacagccagccaggaagccagggggctgagattgtctgacttggaggatcttgaagaagaagaagaagaagaggaagaggccgaggacgaggaggtagtagccaccgccggtgatcggctcactgaattcaggaagggggctcagagtctgcccggtccatgtgctgcagctagagaagggaggctcgagcggagagagtgtggacttgcagcccctcgtttctcctttaatgacccttcaggatctgaggaggctgactttttgagcgccgaaaccggttccccgcgtctgacaatgcattatccctgcctggagaaaccgagaatctggagcctggcccacacagccacggcctctgccgtggaaggggcaccccctgcaagacctcgcccacgtagtccagaatgccggatgattcctgggcagcccccagcgagtgcacgcagactgtccgtgccgagggactctgcctgtgacgagtcttcttgtatccccaaagcttttggtaaccccaagttcgcactccagggattgcccctcaactgcgccccttgcccaaggcggtccgaaccagtggtgcagtgtcagtacccaagtggggctgaggccggttag

SEQ ID NO: 23263 - DNA, 1080 bp, Artificial Sequence
  Description of Artificial Sequence: Synthetic coding sequence
atggtcgacattatcttccattaccctttcctgggggctatgggcgatcatagtaaaaagaagccgggtaccgcgatgtgtgtgggttgcggttcacagatccacgaccagttcattctgagagtgtcacctgaccttgagtggcatgcagcatgccttaagtgcgctgagtgcagtcagtacctggatgagacctgtacgtgcttcgtccgggatggcaagacctattgcaaaagggattacgtcagacttttcggcattaagtgcgcgaagtgccaggtcgggttttcttcttccgacctggtgatgcgggcaagggacagcgtttaccacatagagtgcttcaggtgctctgtgtgcagccggcagttattacccggagatgaattttcattgagagaacacgaactgctgtgcagggctgaccatggcctgctgttagagcgcgcagctgcgggttcccctcgaagcccaggaccattaccaggtgcacgcggactgcacctgcctgacgcagggtctgggcgacaacctgcattacgtccacatgtgcacaagcagactgagaagacgacaagagtgagaaccgttctgaatgagaaacaactgcatactctcagaacatgctatgccgctaatccacgccctgacgcccttatgaaagaacagttggtggagatgaccggcctatccccacgcgtaatccgcgtttggtttcagaacaagaggtgcaaggataaaaaaaagagtatactgatgaaacagctgcagcagcagcaacacagcgacaaaacatcattacagggcctcaccggaactcctctggtggctgggagcccaatcagacatgagaacgccgtacagggctcagctgtagaggtccagacgtaccagccaccatggaaagccctgagtgaattcgccctgcagtccgatctcgaccaacctgcctttcagcagctggtctcatttagcgaaagtggcagtcttggaaattcatctgggtctgacgtgacttctttgtcgtctcagctacccgacacccccaattctatggtgccaagtcctgtagagacctag

SEQ ID NO: 23264 - DNA, 2460 bp, Artificial Sequence
  Description of Artificial Sequence: Synthetic coding sequence
atggattcagagtactactcgggggatcaaagtgatgacggaggcgcaacaccagttcaggatgagcgggactccgggtccgacggcgaggatgacgtgaatgagcagcactcagggagtgacacgggcagcgtggaacgccactccgaaaacgaaaccagcgaccgtgaggacggtttgccaaaggggcaccacgtgacagactcagaaaatgatgaaccattgaatctcaacgcaagtgattctgaatccgaggaactgcatcgccaaaaggattctgactcggagtcagaagaacgggctgagcctcccgctagtgattccgaaaacgaggacgtcaatcagcatgggagcgattccgagtccgaggagacaagaaaacttcctgggtctgactcagagaacgaagaactcctcaatggacacgccagcgatagcgaaaatgaagatgtgggaaaacaccctgcttccgatagcgaaattgaggaactccaaaagtcccccgctagcgactctgagactgaggatgctctcaagccacagattagcgacagcgaaagcgaagagccaccaagacaccaggccagcgattccgaaaatgaagagcccccaaagcctcgcatgtctgatagcgagagtgaagagctgccaaaaccgcaggtatccgatagcgaaagcgaagagccccctcgccatcaagcttcagacagcgagaacgaggagctgcctaagccccgaatcagcgacagtgaatccgaagacccaccgaggcaccaggctagcgattccgagaatgaagaactccctaaacctaggatatccgactctgagagcgaagacccacctcgtaatcaagcttcagactcagagaatgaagaactacctaagccccgtgtgtcagactccgagtctgagggtccccagaaggggcctgcctctgacagtgaaacggaggatgcctccaggcacaaacaaaagccagagtccgatgacgactccgacagagaaaataaaggtgaagacacagaaatgcagaatgactccttccactcagactcccatatggaccgcaagaaatttcatagctccgatagtgaggaagaagagcacaaaaaacagaaaatggattcagatgaggacgaaaaagagggagaggaagagaaagtggctaagagaaaagccgcagtgctgagtgacagcgaagacgaggagaaggcatccgccaagaagtccagagtcgtctcggatgcagacgactctgacagcgacgcagtgagcgacaagtctggaaagcgcgaaaagaccatagctagcgactcagaagaggaggccggaaaagagttaagcgacaagaagaacgaggagaaggacttgtttggatccgacagtgagtctgggaacgaagaggagaatctgattgcagatatctttggtgaatctggagatgaggaggaggaagaatttacgggctttaaccaggaggatctggaggaggagaaaggagagacacaagtaaaagaagctgaagatagcgactccgatgataacattaaaaggggtaaacacatggattttctctccgatttcgagatgatgctgcaacgaaaaaagagcatgtctggcaagcgcagaagaaatagggatggtggcacatttattagcgacgccgacgacgtcgtgtcagctatgatcgtcaagatgaatgaagctgccgaggaggaccgtcagctcaacaatcagaaaaagcccgctctcaagaagcttaccctgctgccggctgtagtgatgcatctcaagaaacaggatctgaaagagacattcattgattcaggagtgatgtccgcaattaaagaatggctgagtcctttgcccgatcgcagtcttcctgcgctgaaaattcgggaggaattactcaagatcctacaggaactgccatccgtttctcaggagacgctgaagcactctggcatcggcagggcagtgatgtatctctacaagcacccgaaggagtctaggagcaataaagacatggctggcaaattaatcaacgaatggtcacgaccaattttcggactgacgtccaattataagggaatgacccgagaagaacgagaacagagagacctggagcagatgccacagcgcaggcgaatgaactctacaggcggtcagactccacggagggatttggagaaagtgctgacaggggaagagaaggccctgcggccaggcgatcccggtttttgcgccagggccagagttcctatgccaagcaataaagattatgtagttaggcccaaatggaatgtcgaaatggagtcttcacgctttcaggcgacctccaaaaagggcatctcgcgcttagacaaacagatgcgtaagttcacagatatccgaaagaagtctagatccgcacacgcagtgaagatttccatcgaaggaaacaaaatgcctctctag

SEQ ID NO: 23265 - DNA, 2319 bp, Artificial Sequence
  Description of Artificial Sequence: Synthetic coding sequence
atggactccgagtactattccggggatcagagcgacgatggaggagctacaccagtgcaggatgaacgcgattccgggtccgacggtgaggatgatgtcaacgagcagcactctgggtcagatactggttcagtcgagagacactcggagaatgagaccagcgatcgagaagatggactgccaaaggggcatcacgtgacggactctgagaacgatagtgagtcagaggagactcgcaagcttccagggtccgacagcgagaacgaggaactcctgaatggacacgccagcgacagtgagaatgaggatgtgggtaaacatcccgcatcagactctgagattgaggagttgcagaagagtccagcttcggacagtgaaaccgaggacgccctgaagccccaaatcagtgattccgagtcggaagaaccccctcgccaccaagcatctgatagcgagaatgaggaaccaccaaagccaaggatgtcggacagcgaatcggaggaacttccaaagccccaggtgtctgattcggagtcagaggagccgccacgacatcaagcctcagattccgagaatgaagagctgcctaaacccagaatttctgactctgagtcagaggaccccccaagacaccaggcctctgattcagagaacgaagaactgcccaagccacgaatttccgattctgagagcgaagatccgcctagaaatcaggcaagtgactctgaaaacgaagagctacctaagccgagagtgagcgacagcgagagcgagggcccacagaaggggcctgcatccgacagcgagacggaagacgcatccaggcacaagcagaagccagaatcagacgacgactctgaccgcgaaaataaaggggaggatactgagatgcagaacgacagttttcattccgattcgcacatggatcggaaaaaattccactccagtgacagtgaggaggaagagcataagaagcagaaaatggactccgatgaagacgagaaagaaggcgaggaggaaaaggtggccaagcgcaaggctgccgttctcagcgacagcgaggacgaagagaaagcttctgccaagaagtcacgggtggtgtctgacgcggatgactcagattcggatgccgtttccgataaatctggcaaacgcgagaagaccatcgcatccgattccgaagaggaagctgggaaagagttatccgataagaagaacgaggagaaggacctgttcggcagcgactcagaaagcggcaatgaggaggagaatctaatcgcagacattttcggtgagagcggagacgaggaggaagaagaattcactggcttcaatcaagaggatctagaagaggaaaagggcgagacccaggtgaaggaagcagaggatagcgatagtgatgacaacattaagcgcggtaagcacatggacttcttgagtgatttcgagatgatgctgcagcgcaagaagtcaatgtccgggaaaaggcgtcggaatcgtgatggaggcacctttatcagtgatgccgacgatgtggttagtgccatgattgttaaaatgaatgaagccgcagaggaagatcgacagctgaataatcagaagaagccggctcttaaaaaacttactcttctgccagctgttgtgatgcacctcaaaaagcaggacctgaaggagacatttattgattccggcgtgatgtccgctatcaaagagtggctgtctcctctccccgacagatcactgccagccctgaaaatcagggaggagctgctgaagatcctgcaggaactgccctccgtttcgcaggaaaccctgaaacactcaggaatcggcagagccgtgatgtatctgtacaagcatcccaaggaaagtcgatctaataaagacatggccggtaaattgatcaatgaatggtcccggccaatctttggcctcacctcaaattacaagggcatgacgcgcgaagaaagggaacagcgggatttggaacagatgccgcaacggcgacgtatgaactctacagggggacaaaccccacggcgagatctggagaaggttctgacaggcgaggagaaggccctgaggccaggggacccagggttttgcgccagggctagggtccccatgccatccaataaggactacgtggtccgacccaaatggaacgtcgaaatggagagctcgcgcttccaggccacaagcaaaaaagggatttctcggctagataaacagatgagaaagtttactgatatcagaaagaagagtcgtagcgcgcatgccgtgaaaatctcaatcgaaggcaataaaatgccactgtag

SEQ ID NO: 23266 - DNA, 1512 bp, Artificial Sequence
  Description of Artificial Sequence: Synthetic coding sequence
atgcccgcaagaccacctgcttgccgtgtgcgcccatttcccccagggctgccagatgacggcggagccacccctgtccaggatgaacgcgacagcggatctgacggcgaggatgacgtcaatgagcagcattcaggaagcgatactgggtccgtggagagacattctgaaaacgagacatccgaccgggaagacggcctgcctaaagggcaccatgtgacagattccgagaacgacgagcccctgaatcttaacgcatctgactccgaatcggaggagcttcatagacagaaggatagcgacagtgagagcgaggagcgggctgagcctccagcaagcgactctgagaatgaggacgtgaaccaacacggctcagattccgagagcgaggaaaccaggaagctcccgggaagcgactcagagaatgaggagttattgaatgggcacgcatctgatagcgagaatgaagacgtaggaaagcacccagccagcgattccgaaattgaggagctccaaaagtcaccagcaagcgactcggagacagaagacgcccttaaaccacaaatctcagattcagagagtgaggaacctcctcggcatcaggctagcgacagtgagaatgaggagccccctaaaccgagaatgagtgattccgagtctgaggaattgccaaaaccgcaggtaagcgatagtgagagcgaggagccccctcgacaccaggcatccgattctgaaaatgaagaactcccgaagcctcgcatcagcgattccgaatctgaggatcccccaaggcatcaggcctcagactcagaaaacgaggaactacccaagcctagaatctctgattcagaatctgaggacccccctagaaatcaggcatccgacagtgagaacgaggaacttcctaagcctcgggtgtccgacagcgaatcagaaggaccacaaaaggggccagcctctgattccgagacggaagatgcatccagacacaaacagaagcccgagagcgatgatgatagcgacagagaaaacaaaggggaggatactgagatgcagaacgactcctttcattccgactcccacatggatcgcaagaagttccattccagtgatagtgaggaggaagaacacaagaagcagaagatggactccgacgaagacgaaaaggagggcgaggaggagaaggtggccaaaaggaaagcggctgtgctgtcagacagtgaggatgaggaaaaagcgagcgctaagaagtctagagtagttagcgatgccgacgattccgactctgacgccgtgagtgataagagtgggaaacgcgagaagacaatcgcatctgatagcgaagaggaggctggcaaagagcttagcgataagaagaacgaggagaaggacctgttcggatctgattctgaatccggcaatgaagaggagaacctgatagccgatatattcggcgagagcggcgatgaggaagaagaggaatttacatatggcctatctgtaagattttag

SEQ ID NO: 23267 - DNA, 2430 bp, Artificial Sequence
  Description of Artificial Sequence: Synthetic coding sequence
atggctggagcggctgctgcggtggccgcaggggctgctgctggggctgccgctgcagctgtgtccgtggccgctccaggccgagctagcgctcctcccccaccgcctccagtgtattgcgtgtgccggcaaccatatgacgtaaataggttcatgatcgagtgcgacatttgcaaggattggttccatgggagttgtgtgggagtggaggagcaccacgccgtggacatcgacctctatcattgtcccaattgcgcggtactacatggctcgtcactcatgaagaaaaggcgtaactggcacagacatgactacactgaaatcgatgatggaagcaaaccagttcaggcgggtacacgtacatttattaaagaactgcgcagccgtgtgttcccctcagcggacgagataattattaagatgcacggaagccagctcacgcagaggtacctggagaagcatggcttcgacgtgcctattatggtacctaagctggatgatttaggtttacgtctcccgagtccaacttttagcgttatggatgtcgagaggtatgtaggtggcgacaaagttatagacgtcatcgacgtggccagacaggctgattcaaagatgaccctacacaactatgtcaaatacttcatgaatcccaataggcctaaggttttgaacgtcatatccctcgaattcagcgacacaaaaatgagtgagctggtggaagtacccgacattgccaagaagctgagttgggtcgagaattactggcctgacgactccgtctttcctaagcccttcgtgcaaaagtactgcctgatgggtgttcaggactcttacactgacttccatattgattttggtggcacctctgtgtggtatcacgtgctatggggcgaaaaaatcttttatttgatcaagcccacagacgagaatctggcgagatacgaatcctggagcagcagtgtgactcagtctgaggtctttttcggggacaaggtcgacaagtgctataaatgtgtagtcaagcaggggcatacgctgtttgttccaacagggtggatccacgctgtcctcactagccaggactgtatggccttcgggggaaatttccttcataacctcaacattggaatgcagcttcggtgttatgagatggaaaaacgactgaagacgcctgatctattcaaatttcccttcttcgaggccatctgctggtttgtggccaaaaacctcttggaaactctcaaagagctgagagaagacgggttccagccgcagacatatctggtgcagggtgtcaaggccctccacaccgccttaaagctgtggatgaagaaagagttggtgagcgaacacgcttttgagatacctgataatgtgaggcccggacacctgatcaaagagctgagcaaagtgattcgggctatagaagaggagaacggtaaaccagtaaagagccagggcatcccaattgtgtgtccagtctcacggtcatccaatgaggccacatccccttaccatagccgtcggaagatgcggaaactcagagatcataatgttcgaaccccctccaatctggacatactggagctgcacacaagagaagtgcttaagcgcctggagatgtgcccctgggaggaggatattctttctagtaaactgaacggaaagtttaacaagcatctgcagccaagtagcacggtccctgaatggagggctaaggataatgacctgcggttactcctaaccaacgggaggatcatcaaggatgagcggcagccatttgctgaccagtctctgtacacagcagacagcgagaacgaggaggataagagacggacgaagaaggccaagatgaagattgaagagtcttccggggtggaaggggttgagcatgaggaaagccagaagccactgaatggtttctttactagggtgaaatccgaactgaggagcagaagctccggttattccgacatcagcgagtctgaagatagcgggccagagtgcacagctttgaaatcaatatttactaccgaagagtcagagtcaagtggtgacgaaaagaaacaggagatcacaagtaactttaaagaggagagtaatgtaatgaggaacttcctccagaaatcccagaagccatcccgatcagagatccctatcaagcgtgagtgccccacctcaacctcaactgaagaggaggccatacagggaatgctttccatggccggtctgcattactccacctgcctacagcgccaaatccagtccaccgattgctccggggaacgcaattcattacaggaccccagctcctgccatggctccaatcatgaggtaagacagctgtatcggtacgacaaaccggtggaatgcgaaacgaggtcccacctgtgttgcccagattggagccccactccggagctcaagtag

SEQ ID NO: 23268 - DNA, 2826 bp, Artificial Sequence
  Description of Artificial Sequence: Synthetic coding sequence
atggcgggagctgccgctgctgtggcagctggcgctgcggctggggcagccgctgcagccgtatccgtggccgctccaggacgcgcaagcgctcctccccctccccctccggtgtactgcgtttgcaggcaaccttacgacgtgaatcgatttatgatcgagtgtgacatttgcaaggactggttccacggtagctgtgtcggagtggaggagcaccacgctgtcgatatagacctttaccactgtccaaactgtgccgtactccatgggtcatccctgatgaagaagaggcgcaattggcaccgtcacgattatacggaaattgacgatggtagtaaaccagttcaggctggaacacgaacttttattaaagaactgcgctcgagagtgttcccatctgccgatgagatcatcattaaaatgcatggatcccaactcacccagcgctacctcgaaaaacatggtttcgacgtacctatcatggtgcctaagctggatgatctgggattgcggctcccttccccaacttttagtgtgatggatgtagagcggtatgtgggcggagataaggttatcgatgtgattgatgtcgccaggcaggccgactccaagatgacccttcataactatgtcaaatacttcatgaaccccaacagaccgaaggtgctaaacgttatctccttagaattttccgataccaaaatgtccgaacttgttgaggtccctgatattgcaaagaagctatcatgggtagaaaactattggcctgatgacagcgtcttccccaaaccatttgttcaaaagtactgtttaatgggagtgcaggatagttatactgactttcacatagattttggtggaacttcagtgtggtaccatgtgctgtggggtgagaagattttctacctgataaagcccactgacgagaacctcgccaggtacgagtcctggtccagttctgtgacgcagagcgaggtattttttggcgacaaggttgacaagtgttacaaatgcgtagtgaagcaggggcacacgctgttcgtccctacagggtggattcacgctgtgctgacgtcccaggattgtatggcctttgggggtaactttctgcataatcttaacatcggcatgcagctgagatgttatgaaatggaaaagcgcctgaaaaccccagatttgttcaagttccccttttttgaggcaatctgttggttcgtcgccaagaatcttctggagaccttgaaagaattgcgcgaggacggtttccagccacagacctaccttgtccagggcgtcaaagcgctgcataccgcactgaagctctggatgaaaaaggaacttgtcagcgagcacgcttttgagatccccgataacgtaagacccggacacttgatcaaggagctgtccaaggtgatcagggcaatcgaagaggagaatggaaaaccagtgaagtcccaggggatcccaattgtctgtcctgtgtccagatcgagcaacgaggcaacttctccttatcacagtcgccgtaagatgcgaaagctaagggaccacaacgtgcggacgccctctaatctggatatcctcgaattgcatactagggaggtgctgaagaggcttgaaatgtgcccttgggaggaggacatcctaagctcaaagctgaatggaaagttcaataaacatctccaaccctccagtacagtgcctgagtggagggccaaggacaacgacctgaggctcttgctgacgaacgggagaattattaaggatgagcgccagccatttgcagatcaaagcctgtataccgcggatagtgagaacgaggaagataagcggagaacgaagaaagccaagatgaagattgaagaaagctctggcgttgagggtgtggaacacgaagaaagtcagaaaccgctgaatgggttttttacccgggtgaaaagcgaactacgctctagaagctccgggtattcagacatatccgagagtgaggacagcggtccagagtgtaccgccctcaagagcatattcactactgaggagagtgaatcgtccggggacgagaagaagcaggagatcacatctaatttcaaggaagaaagcaatgtgatgcgcaatttccttcagaagagtcagaagccttcacgttcagagatacctatcaagagggagtgccctaccagtacttctacagaggaggaggccatacagggaatgctctcaatggccggtcttcactactcgacgtgtctgcagaggcagatccagagtacagattgtagcggtgaaaggaacagcttgcaagatccatcctcctgccacggaagcaaccacgaagtgcggcaactctacagatatgataaaccagtggaatgtggataccatgtcaaaaccgaagatcctgacttacggacctccagctggattaaacagtttgatacgagtcggttccaccctcaggacttgagtcggtctcagaaatgtatcaggaaggaagggtcttcagagatatcgcagagggtgcagtcgcggaactatgtggattcctccggaagctcactgcagaatggaaagtatatgcagaactccaacctaacttccggagcctgccagatctccaatggctccctgtcccctgagcgccctgttggagaaacatcgttcagcgtgcctctacacccgactaagcgacccgcttccaacccccctcccatctcgaaccaggccacgaaagggaaacggcctaaaaagggaatggctaccgccaagcagcggcttggtaagattctcaaactcaatcgaaatggccacgcaagattcttcgtgtag

SEQ ID NO: 23269 - DNA, 4443 bp, Artificial Sequence
  Description of Artificial Sequence: Synthetic coding sequence
atgatcgttatgaacgaccaagtactggaaccgcaaaacgtggatccatcaatggtgcaaatgaccttcctggacgatgtcgtgcactcccttctaaaaggggaaaatatcggaataacatcgcgacgtcggtcacgggcaaaccagaacgtcaacgcggtgcactcccattacacgcgagcacaggctaactcaccgaggcccgctatgaatagtcaggctgccgtccctaagcaaaatactcaccagcagcaacaacagagaagtataagaccaaataagcgcaagggttccgacagttcaattcccgacgaggagaagatgaaagaagagaagtatgattacataagccgcggtgagaaccctaagggtaaaaacaagcatttaatgaataagcggagaaagccagaggaggacgaaaagaagttgaacatgaagcggttaagaactgacaatgtttctgacttttccgaatcctccgacagcgaaaatagcaataaacggataatcgataactcgagcgaacagaagccagagaacgaattgaaaaacaagaacacgagtaaaattaatggggaagagggcaaaccgcacaacaatgagaaggccggagaggagaccctgaagaattctcagccaccttgggatcagatacaggaggataaaaaacatgaggaagccgagaaacgtaaaagcgtcgacacccagctccaggaggacatgatcattcattcgagcgaacaaagcactgtgagtgaccataactcgaatgatctcctgccacaggaatgtaacatggataagacacacaccatggagctgctgcccaaggaaaaattcgtcagccgtcccccaactcccaagtgcgtgatcgatattacgaatgacactaaccttgagaaggtagcccaggagaatagctcaacttttgggctccagacactgcagaagatggaccctaatgtatccgattcgaagcactccattgcgaacgccaaatttcttgagaccgcgaagaaagactccgatcagagttgggtgtcagacgtggttaaggtggatctcacacagtctagcgtgacgaacgcctcgagcggtaatgatcacctcaacatggagaaggagaaatatgtgtcctatatttctccactctcagcagtgtcagtaatggaggacaagttacacaagcgctcacccccaccagaaaccatcaagtccaagctgaatacatcagttgatacccacaagatcaagtctagcccctccccagaagtcgtcaaacctaaaatcacccactcgccagactctgtgaaatccaaagcgacctatgtaaactcgcaggcaacaggtgaacgccgtttggcaaataaaatcgaacacgaactgtctaggtgctcctttcaccccataccgacgcgatcttcaaccctagagaccactaaaagtcccctgataatagataagaacgaacatttcaccgtgtacagggacccagcacttatcggtagtgagactggtgcaaaccatatctccccattcctcagccagcacccttttcccctgcattcctcaagccacagaacatgtctcaatcctgggacacaccatcctgccctgactcctgcaccacaccttctggcagggagcagctcacagactcccttaccaacaattaatactcaccccttaacgagtggcccacaccatgcagttcaccaccctcacctgcttccgaccgtcttacccggagtgcccactgctagtctcctaggaggccaccctcggttggaatctgcccacgcatcatcacttagtcatcttgctctggcacaccagcagcagcaacagcttcttcagcatcagagtcctcaccttctaggacaggcgcacccctccgcatcctacaatcaactaggcctgtaccctatcatttggcagtacccaaacggaactcacgcgtactccggactagggttacctagctctaaatgggtgcatcccgagaatgctgttaacgccgaggcttctctgagaaggaacagtccaagtccatggctacaccagcctactccggtaacgagtgccgacggaattggactcctgagccatatccccgtccgccctagctcagctgaacctcaccgacctctcaagataaccgcccacagttctcccccattaaccaagactctggtcgaccatcataaagaggaattggagcgtaaggcttttatggaaccccttcggtccgtagcttcaaccagtgccaaaaacgatctcgacttgaaccgatcgcagactggcaaggactgccacctgcacagacacttcgttgacccagtactgaaccagctccagagacctccacaagagaccggagagaggcttaataaatataaggaggaacatcgacgcatcttacaagaaagcattgatgttgctccattcactacgaagataaaaggcctcgagggtgaacgtgagaactatagccgagtggcttccagctcaagctctccaaagagtcatatcattaagcaagatatggatgtggaacgctccgtgagcgacctgtacaagatgaagcactcagtaccccagtcccttccccaatcaaactactttacgaccttaagtaatagtgttgtaaatgagccacctcggtcctatccatcaaaggaagtctccaacatttacggcgacaagcaatcgaacgctttggctgccgctgctgcgaacccccagaccctgacatcgtttataactagcctgtctaagccccctcccctgattaagcaccagcctgaaagtgaaggactggtaggcaagatcccagaacacttgccacaccagattgcctcccattcagttacaaccttccgaaatgactgccgaagtcctacacacctcaccgtttcatccaccaacacccttcgcagtatgcctgctttgcaccgagctcccgtttttcatccacccattcatcactcccttgagaggaaagaaggaagttactcttcgctttccccacccactctgacccccgtcatgcctgtgaatgctggcggaaaagtgcaggaatcacagaaaccgcctacgctgattccggagccaaaggacagccaagctaattttaagagcagctctgaacagtccctgacagaaatgtggcggcctaacaacaacctgagcaaagaaaagaccgagtggcacgtggagaagagctctgggaagctccaagctgcaatggcaagcgtgatcgtgagaccaagcagctccaccaagacagattcgatgcccgcaatgcagcttgcatcgaaggatcgggtatctgagcgctcctctgctggtgcccacaagactgattgtcttaagctggcggaggccggagaaacaggacggatcattttgccaaatgtaaactctgactcagttcatacaaagtctgagaagaacttccaggccgtttctcagggtagtgtgccgtcctccgtaatgagcgccgtgaataccatgtgtaacacgaagacagatgttattacctccgctgccgatactacttcggtatcgtcttggggcggtagcgaggttataagcagcctaagtaataccatccttgcatctacttcgtcagagtgcgtgtccagtaagtcagtaagtcagcccgtggcgcagaagcaggagtgcaaggtttctaccactgctcctgtaactctggcctcttctaaaaccgggagtgtcgttcagccaagcagcggcttctccggcactactgattttatacaccttaaaaagcataaagcggctttagcagctgcccaatacaaatcttctaacgcctcagaaaccgagcctaatgccattaagaatcagaccctctcagcatccctgccattagacagcactgtgatttgctctaccattaataaagcgaacagtgttggtaacggacaggcgtcgcagacaagccagccgaattaccacacaaagctcaagaaagcgtggttgacaaggcacagtgaagaggataaaaacaccaacaagatggagaattcaggtaatagcgtctccgaaatcattaagccctgttccgtgaaccttatcgcatcaacttccagtgacatccagaactccgtggacagcaaaatcattgtggacaaatatgtgaaggatgacaaagtaaacaggcgtaaggcaaaaaggacatatgagagtggttcagaatctggcgatagcgatgagtcagagagcaaatccgaacagcgtacaaagcgtcagcctaaaccaacgtacaagaagaagcagaacgatctgcagaaaaggaagggtgagatcgaggaggatctgaagcctaacggcgtgttgagccgatccgccaaggagcgcagtaaattaaagctccagtcaaattccaatagctgccatttagtgaaaaccgaatag

SEQ ID NO: 23270 - DNA, 7622 bp, Artificial Sequence
  Description of Artificial Sequence: Synthetic coding sequence
atggcggtcgagacaagggcagaattggtcgggaaacgctttctgtgtgtcgctgtgggtgacgaagcccgatcagagcgctgggagagcggcagagggtggaggtcatggcgagcgggagtgatacgtgccgtgagtcacagggactccaggaacccagacttagcagtgtatgtggagtttgatgacttagaatgggataagcgcgagtgggtcaaggtctatgaggatttttcgactttcctcgtcgagtaccacctgatctgggcaaagagaaatgacccctcccaaacacaaggatccaagagtaagcagatccagtggccagccctcacattcaaaccattagttgaaagaaacatcccaagttccgtcaccgccgtggaattcctggttgataagcaattggattttctgaccgaggactctgcttttcaaccgtaccaggacgatattgactcgcttaatcccgttctgcgagacaaccctcagctgcatgaagaagtgaaagtgtgggttaaggaacagaaagtgcaagagatatttatgcagggcccttattccctgaatggctaccgagtgcgggtctacagacaggattctgccacccagtggttcacaggtatcattacacatcacgatctcttcacgcggaccatgattgtgatgaatgaccaggtactggagccccagaatgttgaccctagcatggtccagatgacatttctagacgatgtcgttcattcgttgttgaagggagagaatattgggattacttccagaaggcgcagcagagctaatcagaacgttaatgccgtgcactctcattatacaagagcacaggcaaactcccctcgccctgcgatgaactcccaggcagcagtgcccaaacagaacactcatcagcaacagcagcagcggtctataagaccaaacaagcgaaaagggagcgattcctccattcctgacgaagagaagatgaaggaggagaaatacgactacatctcaagaggggagaatccaaagggcaagaataagcatctgatgaacaaacggagaaagcctgaggaggacgagaagaagctcaacatgaagcgcctccggaccgataatgtgagtgacttttcagagtcttcagattctgaaaatagcaacaaaaggataatcgacaattcctcagagcagaagcccgagaacgagctgaaaaacaagaacactagcaaaattaatggggaggaggggaagccacacaataacgagaaggctggagaggaaactttaaagaacagccaaccaccctgggaccagatacaggaagacaaaaagcatgaggaggccgagaaacgtaagagcgtggacacccaactccaagaggatatgatcatacactcctcagagcagtcaaccgtgtctgaccacaacagtaatgacttgttaccccaggagtgcaatatggacaaaacacatactatggagctgcttccaaaggagaagttcgtttcgagaccccctactccaaagtgcgtgattgacatcactaatgacaccaacctggagaaggtggcacaggaaaacagttctacattcggactacaaacgttacaaaaaatggatcctaatgtgagcgactccaagcactccatcgccaatgcgaagtttttggagactgcgaagaaagactccgaccagtcttgggtgtctgacgtcgttaaggtagatctaacccagtcatccgtgacaaacgcctccagcgggaacgaccatcttaatatggagaaggaaaaatatgttagctatatttcccccctgagtgcagtttccgtcatggaagataaactccacaagaggtcaccaccaccagaaacaattaaatccaagctgaacactagcgtcgatacacacaagataaaatcgtcaccgtcccccgaagtggtaaagcccaagatcacccacagccctgatagtgtgaaaagtaaggctacatatgtaaattcacaggccaccggtgaacgtcggctggcaaataaaattgaacatgagctaagcaggtgtagctttcacccaattcccactaggtccagcactctggaaaccaccaaatctccactgatcatcgacaagaacgaacactttacagtatatcgcgatccagccctgataggctctgagaccggagctaatcacatcagcccgttcctgagtcaacaccctttccctctgcacagcagtagccatcgcacctgccttaatccaggtacccaccacccggctttgacccctgctccgcaccttctagcgggatcaagttcccaaactcccctcccaaccataaatacccaccccctaacctcaggccctcaccacgctgtgcatcatccacacctactgcctaccgttctgcctggcgtgccaacagcatctcttttaggaggacacccacgcttggaatcagcccatgcaagttcgttatcacacctggccctagctcaccagcagcagcagcagctgctacagcaccaatccccgcacctgctaggtcaggctcaccctagcgcgagctataatcaactcggactatacccaatcatctggcaatatccaaatggcacgcacgcatacagtgggcttggccttcctagcagtaaatgggtgcaccccgaaaacgcggtcaatgctgaagcttctctgagacgcaattcaccgtccccttggttgcaccagcctaccccagtcacctccgccgatggcattggattactctcccatatccccgtgcgcccttcgagtgcagagccgcaccgcccactgaagattaccgcccacagctcccccccactgactaaaaccctagtcgatcatcacaaggaggagctggaacggaaagcctttatggaaccgctacggtctgtagcttcaacaagcgcaaagaacgatctcgatcttaaccggtcccaaacgggcaaagactgtcatctccatcgacatttcgtcgacccggtgcttaaccaactgcagaggccccctcaggagacaggtgaaaggctgaacaaatataaggaggagcatcggagaattctgcaggagtctattgacgtggctccctttacaacaaaaattaaaggtctcgaaggggaacgcgagaactacagtcgagttgctagctcctcttcctcacccaagagtcatataatcaagcaggacatggatgtggaaaggtccgtctctgatctctacaaaatgaagcacagcgtgccacagagtctgccccagagtaactattttaccactctgagcaattccgtggtaaatgaacccccacggtcctatccgagcaaggaagtgagtaatatttacggggataaacaatcgaatgctctcgccgcagccgctgccaatccgcaaaccctgactagcttcatcacaagtctgagcaagcctccgcctttgataaaacaccagcctgaaagcgagggtctcgtggggaagatcccagaacacctgccacaccagatcgccagccacagcgtgactaccttccgcaatgattgtagatctcctactcatctgaccgtgagctcaacaaacaccctacgcagtatgccagctcttcaccgagcaccagtatttcatccacctattcaccatagcctggagaggaaggagggaagttatagcagtctttctccaccaacactcacccctgtcatgcctgtcaacgcaggcggaaaagtgcaggaaagccagaaaccacccaccctgatacctgagcctaaggattctcaggctaactttaagagcagttccgaacagtctctgacagagatgtggcgcccaaacaacaacctctctaaggaaaagaccgaatggcacgtggagaaatctagtgggaaactgcaggcggctatggcttctgtgatcgtgcggccttccagttcaacaaaaacagattccatgccagccatgcagctggcgagcaaggaccgtgtcagcgaaagaagctcagccggtgcacataagaccgactgtctgaagctcgcggaggcaggtgagacagggagaatcatcctgcctaacgtgaattcagactctgtgcacactaagagcgaaaaaaacttccaggcggtgtcccaggggtccgtccctagttctgtgatgtctgccgtcaacacgatgtgcaataccaaaacagatgttatcacttctgcagccgacacaacaagtgtttcctcttggggcggatctgaagtgatatcctcactgagtaacacaatcctcgcctcgacctcctcggagtgcgtgagttctaagagcgtgtcccagcccgttgcccagaaacaagagtgcaaggtctcaaccacagctccagtgaccttggcatcatctaaaacaggcagtgtagtgcaaccctcgtctggcttttctggaacgaccgacttcattcatctgaaaaagcacaaggccgctctggctgccgctcagtacaaatcatcaaatgcatcagagaccgagccgaacgccattaaaaaccagactttgtcagcttctctgcctctggacagcactgtgatttgtagtacaataaataaggcaaatagtgttggtaacggacaggcttcccaaacatcacagcctaattaccatacaaaattaaagaaggcttggctcactcggcatagcgaagaagacaagaatactaacaagatggaaaatagcgggaattcggtctcggaaataataaaaccttgttcagtcaatctaatcgcgtcaacttcctccgatatccagaacagcgtagacagcaagattattgtggataaatatgtgaaagatgacaaggtcaacaggagaaaagccaaacgcacctatgagtctggaagtgagtccggggacagtgatgagagcgaaagtaagtctgagcagcgcacaaagaggcagcccaaaccaacctataagaagaaacagaatgacttgcagaagcggaaaggtgagatagaggaagatctgaaaccaaacggggtcttgtcacggtctgcaaaagaaaggagtaagctcaaattgcagtccaattccaacaccggaatccccaggtctgttcttaaagactggcggaaagtcaagaagctaaagcaaaccggtgaaagtttcctccaagatgattcctgctgtgaaatagggccaaacctccagaaatgcagagagtgcaggcttattcgaagcaagaagggtgaggagcccgctcactcccccgtcttctgtagattttattacttcagaaggctctcttttagtaagaatggtgtcgtgagaatcgatggcttttcgagtccagaccagtatgacgacgaggctatgtctctgtggacccatgagaattttgaagatgacgaactcgatatagaaacatcaaaatatatactggacatcattggtgataagttctgtcagctggtcactagcgagaagacagcactgtcctgggtcaagaaagatgcaaagatagcctggaagcgggcagtgaggggggtgcgcgaaatgtgcgatgcctgtgaggccacgctgtttaatattcactgggtgtgccagaaatgtggattcgtggtttgcctggattgctacaaggcgaaggagcgcaaaagctcacgtgataaagaactgtacgcttggatgaaatgtgtgaaaggtcaaccccacgaccacaagcacctgatgccaacccagatcatccctgggagtgtcctcactgatctgctggacgctatgcacacactgcgcgagaagtatggcatcaagtcccattgccactgcacaaataagcaaaatcttcaggtgggcaacttcccgactatgaatggagtgagccaggtgcttcaaaacgtattgaaccattcaaacaagatctcgctgtgcatgcccgagtctcagcagcagaacactccccctaagagcgagaagaacggaggaagttcccctgagtccgacgttggcactgataacaaacttacgcctcctgaaagtcagtctcccctccactggctcgccgacctagccgaacagaaagcacgagaagagaagaaggaaaacaaagagctgaccctcgagaaccagatcaaggaggagcgtgaacaagataatagcgagagtccaaacggacgcacatcccctctcgtaagccagaataatgaacagggaagtacactgcgggacctgctaaccacgactgccggaaaacttagggtgggctccacagacgccggaattgccttcgcacccgtctatagcatgggggctccctcttccaaatcaggaaggactatgccaaacattcttgacgacatcatagcttcagtggtggaaaataagatacccccttctaaaacctctaagattaatgtgaaacccgagctcaaggaagagcctgaggaaagcatcataagcgctgtcgacgaaaacaataagctatactcagacatccctcatagttggatctgtgagaagcacatcctgtggttgaaagattataagaatagcagtaactggaagctattcaaagagtgctggaagcaaggtcagcctgccgttgtctccggcgtccacaagaaaatgaacatcagtctatggaaagccgagtccataagtttagacttcggagatcaccaggcagatctccttaactgcaaagactccattatttcaaacgcgaacgtgaaagaattttgggacggtttcgaggaagtgtcaaagagacagaagaacaagagtggcgagacagtggtgctaaagctaaaggactggccaagcggggaagactttaagacaatgatgcctgctcgctatgaggacctgttaaaatctctgcccctccccgaatattgcaatccagaggggaagttcaacctcgccagtcatctgccgggtttcttcgtgagaccagatttaggccctcggctgtgcagcgcatatggagtggtggccgcaaaggatcacgacatcggcaccactaacctgcacatagaggtaagcgacgttgttaacatattagtgtacgtggggatcgccaagggaaacggaatactaagcaaagctggtatcttaaagaagtttgaagaggaagacctcgacgacattctgagaaaaaggctgaaggacagtagcgagattcctggcgctctgtggcatatctacgccggaaaagacgtggacaaaattagagaattcctgcagaagatttcaaaggagcagggcctggaagtcctacccgaacacgatcccatacgagaccaatcatggtatgttaacaaaaaacttcgtcagcggctgctggaggagtacggcgttaggacgtgtaccctcatccagttcctaggcgatgctattgtgctgccagccggagctttgcaccaggttcagaatttccactcgtgtatacaggttaccgaggatttcgttagcccggagcacctcgtggaaagcttccatctaacccaagagctgcgtctgctgaaggaggagatcaactatgacgataagcttcaggtaaagaacatcctctaccacgcagtcaaggagatggtcagagctctcaaaattcacgaggacgaagtcgaggatatggaggagaatta

SEQ ID NO: 23271 - DNA, 6911 bp, Artificial Sequence
  Description of Artificial Sequence: Synthetic coding sequence
atgatcgtcatgaacgaccaagttctggaacctcagaatgtggaccctagcatggttcagatgacctttttggacgatgtggtgcattctctgctgaaaggcgaaaatattggaataacaagtagaagacgtagtcgggctaatcagaatgtcaatgcagtgcacagtcattatactcgcgcacaggccaactctcctagacccgcaatgaactcccaggcagctgtccccaaacaaaacactcatcagcaacagcagcaacggagtatcagacctaacaagaggaagggctccgattcctctattccggatgaggaaaagatgaaggaagaaaaatacgactatatttcccgaggcgaaaaccccaagggcaaaaacaagcacctgatgaacaagcgcaggaagccagaggaggatgagaaaaagctgaacatgaagagactcaggaccgataacgtcagcgactttagcgaaagttctgattccgagaatagcaacaaaagaataatcgacaatagttctgagcaaaagccagaaaacgagctgaagaacaaaaatacaagcaagattaatggtgaggagggcaagccccacaataacgagaaggcaggggaagaaacactcaagaacagccagcccccatgggatcagattcaagaggataaaaaacatgaagaggccgaaaaacgaaaaagtgtggacacgcagttgcaggaagacatgattatccacagcagtgaacaaagcactgtttctgatcataattcaaacgacttactcccacaagagtgtaacatggacaaaacccatacaatggaactcctccccaaggagaaattcgtgagtcggcctccaacccccaagtgcgtgatcgatattaccaatgatacaaacttggagaaggtcgcacaggagaactcctccacatttggactccaaactttacagaagatggatcctaacgtttcagactctaaacactcaatagccaatgccaaattcctggaaactgccaagaaagattccgatcagtcatgggtgagtgatgtggtgaaagtagacctgacccagagtagtgtgacaaatgccagctcagggaatgaccaccttaacatggagaaggagaagtatgtgtcctacatctccccgctctctgcagtcagtgtcatggaggacaaattgcacaagcggtcacctccccctgaaacgatcaagagtaaactgaatacctccgtggatactcataagatcaagtcttccccttcgcccgaggttgtgaaacccaagatcacgcactcaccagattccgttaaatcaaaggccacctatgtgaatagccaagctactggggagagacgcctggcaaataagatagagcacgaactctctagatgttcattccatccgatacctacgcgctcaagcacgctggaaaccaccaagtcacccctgatcattgataagaacgagcacttcacggtgtaccgagatcctgcactgatcggaagcgaaactggagctaatcatatctcccctttcctctcccagcacccctttcccctgcattcctcttctcaccgcacttgtctgaatccaggtacccaccaccccgctttaacacctgccccacatctgttggctggtagtagtagccagactccgttacccactataaatactcacccattgacctctggacctcatcacgccgtccatcacccccatttgctaccgacggtgctgcctggcgtgcctacagcctctctgcttggaggacatcctaggcttgaatctgcgcatgcctcctcactttctcacctcgcattagcacatcagcagcagcagcagctgctccagcaccaaagtccccatttgctcggacaggcacatcccagcgcctcttataaccagttaggcttgtatcccattatctggcagtatcccaacgggacacacgcctattctggattggggctgccgagttcaaaatgggtccaccctgagaacgcagtaaatgcggaggcatctttgcgcaggaacagtccgagcccttggctccatcagccaactcccgtgacctccgctgacggcattggtctgctctctcatattccagtgcgcccaagctctgcagagcctcaccgcccacttaagataacggcccacagctctccgccacttaccaagaccctggtggatcaccataaagaggagttggaaagaaaggcattcatggagcctttgagatctgtcgcctctacatccgccaaaaatgacctggacctcaataggtcgcagacaggcaaggattgccacctccaccgccactttgtggaccctgtactaaaccagctgcagcggcctccacaagaaaccggtgaaagactgaataaatataaggaggaacaccggaggattctccaggaatccatcgatgtggcccctttcaccactaagatcaagggattggaaggagagcgggaaaattacagtcgcgtggctagtagcagtagctctcctaaatctcacatcattaaacaagatatggacgttgagcgatccgtatctgatctctacaagatgaaacactcagttccacagtccctcccgcagtctaattactttaccaccttgtcaaactccgtggtgaatgaacccccacgcagttacccttcaaaagaagtgtcaaatatctacggcgacaaacagagtaatgccctagccgctgccgctgccaatccacagacactgacgtcctttatcaccagcctgagcaaacctccgcctctcatcaagcatcaacctgagtccgaaggcctggtggggaagataccagagcatctgccccatcagatcgcatcacacagcgttaccacctttcggaacgactgtaggagtccaacccatctcaccgtctcctcaacaaatacactgagatccatgcccgcactacatcgggcaccggtttttcatccaccaatccaccatagcctcgagcgcaaagaaggaagctactcctctttgtccccgccaactctgactcccgtgatgccagtgaacgctgggggaaaagtacaggagtcacagaaaccgcctacgttgattccagagccaaaggactcgcaggccaactttaagtccagcagcgaacagtccttaacagagatgtggaggccaaataataatttgtctaaagagaagacagaatggcacgtcgagaaatcatccggcaaacttcaagctgccatggctagcgtgatcgtacgaccttcctcttcaaccaaaacagattccatgcccgctatgcaactcgcctctaaggatcgggtgagcgaaagatctagtgcgggagcacacaagaccgattgcttaaaactcgccgaggcaggagagaccggcaggatcatcttgccaaacgtgaacagcgactccgttcacaccaaaagtgagaagaatttccaggctgtgtcccaaggaagcgtgccctctagcgtgatgtctgcagtcaacacaatgtgcaacaccaagacagatgtgatcacatccgctgcggatacaaccagcgtcagctcgtggggaggcagcgaagttatctcgagcttgtccaacaccatactagcctcaacatctagcgagtgtgtctcttcaaagagcgtgagccagcccgtcgctcagaaacaggaatgcaaagttagcactaccgccccagtgacgctggcctcttctaaaaccgggagcgtagttcagccttcaagcgggtttagcggaactacagactttatccacctaaagaagcataaggccgctctagccgctgcgcagtataagtcgagtaatgcaagcgaaactgagcccaacgcaatcaaaaaccagactttaagcgcctcccttcctcttgatagcacagttatttgcagcactataaataaggcgaattccgtcgggaacggccaggcctcacaaacctcacagccaaactatcacacgaagctgaagaaagcctggcttacccggcactcagaagaagacaaaaatactaacaaaatggaaaattccggcaattctgtgtctgagatcatcaaaccttgttcggtcaatctgatagcatccacatcctccgatatacagaacagtgtggactccaagattattgttgataagtacgtcaaggatgacaaggtgaacagacgaaaagcgaagcgcacttacgagagcgggtcggaaagtggagacagtgacgagtcagagtctaaatccgaacagagaaccaagcgtcagcctaaacccacttataaaaagaagcagaacgacctgcagaaacgcaagggcgaaattgaagaggatctgaaacctaacggcgtgctttcccggagcgcaaaggaacgcagtaaactgaagctgcaatctaactccaacacagggatccctcgttcagttctgaaggattggaggaaggtaaagaagctgaagcagaccggtgagagctttttgcaggacgattcatgttgcgaaattgggcctaatttgcaaaagtgccgcgaatgccgcctcatccgctcgaagaagggtgaagaacctgctcactcacctgtgttctgtcggttctactacttccggagattgtcttttagtaaaaatggagttgtgagaatcgatggcttttcaagccctgaccagtatgatgacgaagcgatgtctctgtggactcatgaaaattttgaggacgatgaacttgacattgagacaagcaagtatatactagatattatcggcgataagttttgccagcttgtgacaagcgagaagactgcgctgtcatgggttaaaaaagatgccaagatcgcctggaagagggccgtaaggggggtgagagaaatgtgtgacgcctgcgaagcaaccttgtttaatatccattgggtgtgccagaagtgcgggtttgtagtgtgtttggactgctacaaggccaaggagcggaagtccagcagagacaaagagttatatgcctggatgaagtgcgtcaaaggccagccccatgatcataagcatctgatgcctacacagattatacctggtagtgtgctgacagatctgctcgacgctatgcatacactgagagagaaatatggaatcaaatcacactgccattgcacgaataagcaaaacctccaagttgggaatttccctacgatgaacggtgtctctcaatcgcagcagcagaatacccctcctaaatccgaaaaaaacggcggtagttcccctgaatctgatgtgggaaccgacaacaaactgacacccccagaatctcaatctccactgcattggttggccgatctggccgagcagaaagccagggaagaaaagaaagagaacaaggaactcaccctggagaaccagatcaaggaggaacgggaacaggacaatagcgagagtccaaacggcagaactagtcccctggtgagtcagaataacgagcaaggctccaccctgagggatctcctgacaaccactgcgggaaagctcagagttggatccacagatgctgggatcgctttcgctcctgtttattctatgggggcaccgtcaagcaagtctggcaggaccatgccgaatattctggatgatataatcgcatcagtcgtagaaaacaagatcccaccttctaagacaagcaaaatcaatgtcaagccagaattaaaagaggagcctgaggagtcaatcatttccgcagttgacgaaaataacaagctatattcggatatacctcactcgtggatctgtgaaaagcacattctgtggctgaaagactataagaactcaagcaattggaaactttttaaggagtgttggaagcaaggccagcctgccgttgtgagcggcgtccacaagaaaatgaacatcagcctgtggaaggccgagtctatatctctggacttcggggaccatcaggccgacctgctcaattgtaaagacagtatcataagcaatgcaaacgtcaaggagttctgggacggctttgaagaagtgtcgaaacgccagaagaacaagtcaggtgaaacagtggtgctgaaactcaaagactggcccagcggcgaagactttaagacgatgatgcctgcgagatacgaggacttactcaagtctctccccttaccagaatactgtaatccagaaggcaagttcaaccttgcttcccacctgcccggattttttgtcaggcccgatctaggccctcgactttgctccgcctacggagtggtcgccgctaaagatcacgacattggtaccaccaatttacatattgaagtgtcagacgtagtcaacatcttagtttatgtcggcatcgcgaaggggaatgggatattgagcaaggccggtattcttaaaaaattcgaagaggaggatctcgatgacatcttgcggaagcggttgaaggatagctctgagatccccggagcactctggcatatttacgctggcaaagacgtggacaagattcgcgagtttctgcagaaaatttcaaaagagcaaggattagaggtcctgccggaacacgatccaatcagggaccagtcttggtacgtaaacaagaaacttcggcaacgtcttctggaagaatatggcgtacgaacttgcacgttgatccaattcctgggggacgcaattgtcctgcctgcaggcgctcttcaccaggtccaaaatttccattcgtgtatacaggtcaccgaagattttgttagtcccgagcatctggttgaatctttccatctgacccaggagcttaggttgctgaaagaagaaatcaattacgatgacaaactgcaggtgaaaaacattttatatcacgcagtcaaagagatggtccgggcactgaagatccatgaagacgaggtagaggatatggaggaaaacta
